United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 58

SEQ ID NO: 2066820 - RNA, 17 nt, Staphylococcus aureus subsp. aureus Mu50
cuguaacgaguccauuu

SEQ ID NO: 2066821 - RNA, 18 nt, Staphylococcus aureus subsp. aureus Mu50
cuguacguuuuaaauaaa

SEQ ID NO: 2066822 - RNA, 13 nt, Staphylococcus aureus subsp. aureus Mu50
cuguacuauauuc

SEQ ID NO: 2066823 - RNA, 20 nt, Staphylococcus aureus subsp. aureus Mu50
cuguaugcgguuauaucauu

SEQ ID NO: 2066824 - RNA, 15 nt, Staphylococcus aureus subsp. aureus Mu50
cugucauuuucugcu

SEQ ID NO: 2066825 - RNA, 14 nt, Staphylococcus aureus subsp. aureus Mu50
cuguccauuuaucu

SEQ ID NO: 2066826 - RNA, 22 nt, Staphylococcus aureus subsp. aureus Mu50
cuguauacgacgucgcaacagg

SEQ ID NO: 2066827 - RNA, 22 nt, Staphylococcus aureus subsp. aureus Mu50
cuguauauggcgauaacaagaa

SEQ ID NO: 2066828 - RNA, 21 nt, Staphylococcus aureus subsp. aureus Mu50
cuggugguaacguaaacaugg

SEQ ID NO: 2066829 - RNA, 19 nt, Staphylococcus aureus subsp. aureus Mu50
cuggguuuuaccauaaauu

SEQ ID NO: 2066830 - RNA, 14 nt, Staphylococcus aureus subsp. aureus Mu50
cugggaaugguugu

SEQ ID NO: 2066831 - RNA, 12 nt, Staphylococcus aureus subsp. aureus Mu50
cuggcuuuuuaa

SEQ ID NO: 2066832 - RNA, 19 nt, Staphylococcus aureus subsp. aureus Mu50
cuggcaacguucuacucua

SEQ ID NO: 2066833 - RNA, 18 nt, Staphylococcus aureus subsp. aureus Mu50
cugcuucuacccuugcaa

SEQ ID NO: 2066834 - RNA, 16 nt, Staphylococcus aureus subsp. aureus Mu50
cugcuuaucauuacuu

SEQ ID NO: 2066835 - RNA, 15 nt, Staphylococcus aureus subsp. aureus Mu50
cuggcaaauugccuu

SEQ ID NO: 2066836 - RNA, 21 nt, Staphylococcus aureus subsp. aureus Mu50
cuggcaaauugccuuucauuu

SEQ ID NO: 2066837 - RNA, 20 nt, Staphylococcus aureus subsp. aureus Mu50
cuggaucgcccauacuaaau

SEQ ID NO: 2066838 - RNA, 22 nt, Staphylococcus aureus subsp. aureus Mu50
cugcugcuuucauagaaccauu

SEQ ID NO: 2066839 - RNA, 14 nt, Staphylococcus aureus subsp. aureus Mu50
cugcuguacguuua

SEQ ID NO: 2066840 - RNA, 16 nt, Staphylococcus aureus subsp. aureus Mu50
cugaugaacauaccug

SEQ ID NO: 2066841 - RNA, 20 nt, Staphylococcus aureus subsp. aureus Mu50
cugaugcuucgaauuuaaca

SEQ ID NO: 2066842 - RNA, 16 nt, Staphylococcus aureus subsp. aureus Mu50
cugauucuucacuaaa

SEQ ID NO: 2066843 - RNA, 19 nt, Staphylococcus aureus subsp. aureus Mu50
cugauucuucacuaaaaau

SEQ ID NO: 2066844 - RNA, 22 nt, Staphylococcus aureus subsp. aureus Mu50
cugauguaccacucauaaucaa

SEQ ID NO: 2066845 - RNA, 17 nt, Staphylococcus aureus subsp. aureus Mu50
cugcagcaauuacaccu

SEQ ID NO: 2066846 - RNA, 18 nt, Staphylococcus aureus subsp. aureus Mu50
cugcaccgauaucauaua

SEQ ID NO: 2066847 - RNA, 17 nt, Staphylococcus aureus subsp. aureus Mu50
cugcacaucauaauaaa

SEQ ID NO: 2066848 - RNA, 13 nt, Staphylococcus aureus subsp. aureus Mu50
cugcaccaagaaa

SEQ ID NO: 2066849 - RNA, 14 nt, Staphylococcus aureus subsp. aureus Mu50
cugccaauauauuc

SEQ ID NO: 2066850 - RNA, 17 nt, Staphylococcus aureus subsp. aureus Mu50
cugcaugggcuucugcu

SEQ ID NO: 2066851 - RNA, 19 nt, Staphylococcus aureus subsp. aureus Mu50
cugcauagcgcucuggauu

SEQ ID NO: 2066852 - RNA, 21 nt, Staphylococcus aureus subsp. aureus Mu50
cugcaucaauaugaccuuuau

SEQ ID NO: 2066853 - RNA, 20 nt, Staphylococcus aureus subsp. aureus Mu50
cugccauuaaacgaaugauu

SEQ ID NO: 2066854 - RNA, 21 nt, Staphylococcus aureus subsp. aureus Mu50
cuucacuucucucuuauuaaa

SEQ ID NO: 2066855 - RNA, 15 nt, Staphylococcus aureus subsp. aureus Mu50
cuucaucuuuaaaga

SEQ ID NO: 2066856 - RNA, 15 nt, Staphylococcus aureus subsp. aureus Mu50
cuucaucuguaucaa

SEQ ID NO: 2066857 - RNA, 19 nt, Staphylococcus aureus subsp. aureus Mu50
cuuccaauacuguugucuu

SEQ ID NO: 2066858 - RNA, 18 nt, Staphylococcus aureus subsp. aureus Mu50
cuuccaacauauaaaaaa

SEQ ID NO: 2066859 - RNA, 19 nt, Staphylococcus aureus subsp. aureus Mu50
cuuccaauaaccccuguca

SEQ ID NO: 2066860 - RNA, 14 nt, Staphylococcus aureus subsp. aureus Mu50
cuuccaauuuaaaa

SEQ ID NO: 2066861 - RNA, 21 nt, Staphylococcus aureus subsp. aureus Mu50
cuuccaaucaacuucauauaa

SEQ ID NO: 2066862 - RNA, 14 nt, Staphylococcus aureus subsp. aureus Mu50
cuucccaucuuuua

SEQ ID NO: 2066863 - RNA, 22 nt, Staphylococcus aureus subsp. aureus Mu50
cuucguuuuuaguguuaauuga

SEQ ID NO: 2066864 - RNA, 19 nt, Staphylococcus aureus subsp. aureus Mu50
cuucgucaaugacuaagau

SEQ ID NO: 2066865 - RNA, 17 nt, Staphylococcus aureus subsp. aureus Mu50
cuucuauagcaccauua

SEQ ID NO: 2066866 - RNA, 18 nt, Staphylococcus aureus subsp. aureus Mu50
cuucuauagcaccauuau

SEQ ID NO: 2066867 - RNA, 14 nt, Staphylococcus aureus subsp. aureus Mu50
cuucuaguaauucu

SEQ ID NO: 2066868 - RNA, 13 nt, Staphylococcus aureus subsp. aureus Mu50
cuucuaucucuuu

SEQ ID NO: 2066869 - RNA, 14 nt, Staphylococcus aureus subsp. aureus Mu50
cuucuauuauauug

SEQ ID NO: 2066870 - RNA, 16 nt, Staphylococcus aureus subsp. aureus Mu50
cuucuauuaauaauuu

SEQ ID NO: 2066871 - RNA, 19 nt, Staphylococcus aureus subsp. aureus Mu50
cuucuaucuucacacuuuu

SEQ ID NO: 2066872 - RNA, 18 nt, Staphylococcus aureus subsp. aureus Mu50
cuucgcuaauaucaucuu

SEQ ID NO: 2066873 - RNA, 22 nt, Staphylococcus aureus subsp. aureus Mu50
cuucaacauagacacuuaacuu

SEQ ID NO: 2066874 - RNA, 17 nt, Staphylococcus aureus subsp. aureus Mu50
cuucaaccauuuguucu

SEQ ID NO: 2066875 - RNA, 14 nt, Staphylococcus aureus subsp. aureus Mu50
cuucaaguuguuuu

SEQ ID NO: 2066876 - RNA, 19 nt, Staphylococcus aureus subsp. aureus Mu50
cuucaagugccauuuuuaa

SEQ ID NO: 2066877 - RNA, 14 nt, Staphylococcus aureus subsp. aureus Mu50
cuucaccaucuuua

SEQ ID NO: 2066878 - RNA, 17 nt, Staphylococcus aureus subsp. aureus Mu50
cuucaaucuaccaauac

SEQ ID NO: 2066879 - RNA, 12 nt, Staphylococcus aureus subsp. aureus Mu50
cuucaauuauuu

SEQ ID NO: 2066880 - RNA, 18 nt, Staphylococcus aureus subsp. aureus Mu50
cuucaauucuuacaccug

SEQ ID NO: 2066881 - RNA, 19 nt, Staphylococcus aureus subsp. aureus Mu50
cuucaauaucuucagcuaa

SEQ ID NO: 2066882 - RNA, 13 nt, Staphylococcus aureus subsp. aureus Mu50
cuuauuuuauacg

SEQ ID NO: 2066883 - RNA, 15 nt, Staphylococcus aureus subsp. aureus Mu50
cuuauuuguuuauua

SEQ ID NO: 2066884 - RNA, 13 nt, Staphylococcus aureus subsp. aureus Mu50
cuuauuuuacuau

SEQ ID NO: 2066885 - RNA, 14 nt, Staphylococcus aureus subsp. aureus Mu50
cuuauuuguuuaau

SEQ ID NO: 2066886 - RNA, 22 nt, Staphylococcus aureus subsp. aureus Mu50
cuuauuuguuuaauuaucuuua

SEQ ID NO: 2066887 - RNA, 15 nt, Staphylococcus aureus subsp. aureus Mu50
cuucaaaauuuugac

SEQ ID NO: 2066888 - RNA, 13 nt, Staphylococcus aureus subsp. aureus Mu50
cuucaaaaaauaa

SEQ ID NO: 2066889 - RNA, 18 nt, Staphylococcus aureus subsp. aureus Mu50
cuucaaaguuuucauuuu

SEQ ID NO: 2066890 - RNA, 17 nt, Staphylococcus aureus subsp. aureus Mu50
cuucaaauguaacauua

SEQ ID NO: 2066891 - RNA, 14 nt, Staphylococcus aureus subsp. aureus Mu50
cuucaaaguuuuca

SEQ ID NO: 2066892 - RNA, 17 nt, Staphylococcus aureus subsp. aureus Mu50
cuuauucgcaccacugg

SEQ ID NO: 2066893 - RNA, 15 nt, Staphylococcus aureus subsp. aureus Mu50
cuuaugaugucaugu

SEQ ID NO: 2066894 - RNA, 15 nt, Staphylococcus aureus subsp. aureus Mu50
cuuaugcauagcucu

SEQ ID NO: 2066895 - RNA, 14 nt, Staphylococcus aureus subsp. aureus Mu50
cuuaugagcaaagc

SEQ ID NO: 2066896 - RNA, 17 nt, Staphylococcus aureus subsp. aureus Mu50
cuuaguuugacaucuau

SEQ ID NO: 2066897 - RNA, 16 nt, Staphylococcus aureus subsp. aureus Mu50
cuuaguuugacaucua

SEQ ID NO: 2066898 - RNA, 21 nt, Staphylococcus aureus subsp. aureus Mu50
cuuauaaagacaccuucaaua

SEQ ID NO: 2066899 - RNA, 17 nt, Staphylococcus aureus subsp. aureus Mu50
cuuauaacaaaaauugc

SEQ ID NO: 2066900 - RNA, 14 nt, Staphylococcus aureus subsp. aureus Mu50
cuuauaacauucuu

SEQ ID NO: 2066901 - RNA, 15 nt, Staphylococcus aureus subsp. aureus Mu50
cuuauaacauucuuc

SEQ ID NO: 2066902 - RNA, 17 nt, Staphylococcus aureus subsp. aureus Mu50
cuuauaagauauagaag

SEQ ID NO: 2066903 - RNA, 17 nt, Staphylococcus aureus subsp. aureus Mu50
cuuauaacauucuucaa

SEQ ID NO: 2066904 - RNA, 12 nt, Staphylococcus aureus subsp. aureus Mu50
cuuaacaacaug

SEQ ID NO: 2066905 - RNA, 16 nt, Staphylococcus aureus subsp. aureus Mu50
cuuaaauuaagaauaa

SEQ ID NO: 2066906 - RNA, 14 nt, Staphylococcus aureus subsp. aureus Mu50
cuuaacauaaaaug

SEQ ID NO: 2066907 - RNA, 16 nt, Staphylococcus aureus subsp. aureus Mu50
cuuaacauaaaaugag

SEQ ID NO: 2066908 - RNA, 18 nt, Staphylococcus aureus subsp. aureus Mu50
cuuaaccauuuaaaaauu

SEQ ID NO: 2066909 - RNA, 11 nt, Staphylococcus aureus subsp. aureus Mu50
cuuaaauauuc

SEQ ID NO: 2066910 - RNA, 23 nt, Staphylococcus aureus subsp. aureus Mu50
cuuaaauggagauucucgguuuu

SEQ ID NO: 2066911 - RNA, 15 nt, Staphylococcus aureus subsp. aureus Mu50
cuuaaauggaugaua

SEQ ID NO: 2066912 - RNA, 21 nt, Staphylococcus aureus subsp. aureus Mu50
cuuaagcuuuaaucauagcau

SEQ ID NO: 2066913 - RNA, 21 nt, Staphylococcus aureus subsp. aureus Mu50
cuuaaguaagauuuaaacauc

SEQ ID NO: 2066914 - RNA, 16 nt, Staphylococcus aureus subsp. aureus Mu50
cuuaaucucuuuuuga

SEQ ID NO: 2066915 - RNA, 20 nt, Staphylococcus aureus subsp. aureus Mu50
cuuaauacgauaauaacuag

SEQ ID NO: 2066916 - RNA, 16 nt, Staphylococcus aureus subsp. aureus Mu50
cuuaauaagcugaaau

SEQ ID NO: 2066917 - RNA, 16 nt, Staphylococcus aureus subsp. aureus Mu50
cuuaacguugcagaga

SEQ ID NO: 2066918 - RNA, 23 nt, Staphylococcus aureus subsp. aureus Mu50
cuuaagcucauuucaauauuaaa

SEQ ID NO: 2066919 - RNA, 14 nt, Staphylococcus aureus subsp. aureus Mu50
cuuaacuuccuuuu

SEQ ID NO: 2066920 - RNA, 18 nt, Staphylococcus aureus subsp. aureus Mu50
cuuacauugauaaaauaa

SEQ ID NO: 2066921 - RNA, 15 nt, Staphylococcus aureus subsp. aureus Mu50
cuuaaugcuucaaau

SEQ ID NO: 2066922 - RNA, 21 nt, Staphylococcus aureus subsp. aureus Mu50
cuuaaugacuucuuuauauuu

SEQ ID NO: 2066923 - RNA, 18 nt, Staphylococcus aureus subsp. aureus Mu50
cuuacccaaaaaauugua

SEQ ID NO: 2066924 - RNA, 18 nt, Staphylococcus aureus subsp. aureus Mu50
cuuaggugucaucgcuuu

SEQ ID NO: 2066925 - RNA, 13 nt, Staphylococcus aureus subsp. aureus Mu50
cuuaguacaaaau

SEQ ID NO: 2066926 - RNA, 23 nt, Staphylococcus aureus subsp. aureus Mu50
cuuaguacacguguauuguauuu

SEQ ID NO: 2066927 - RNA, 21 nt, Staphylococcus aureus subsp. aureus Mu50
cuuagguuauuauaaaauaaa

SEQ ID NO: 2066928 - RNA, 19 nt, Staphylococcus aureus subsp. aureus Mu50
cuuaguaguuguacuucuu

SEQ ID NO: 2066929 - RNA, 22 nt, Staphylococcus aureus subsp. aureus Mu50
cuuaguagauuuauuaaauaua

SEQ ID NO: 2066930 - RNA, 18 nt, Staphylococcus aureus subsp. aureus Mu50
cuuagucaauguauauuu

SEQ ID NO: 2066931 - RNA, 16 nt, Staphylococcus aureus subsp. aureus Mu50
cuuagaauuuacaagu

SEQ ID NO: 2066932 - RNA, 23 nt, Staphylococcus aureus subsp. aureus Mu50
cuuucguuucuuuuauaucgcuu

SEQ ID NO: 2066933 - RNA, 13 nt, Staphylococcus aureus subsp. aureus Mu50
cuuucauuuuagc

SEQ ID NO: 2066934 - RNA, 13 nt, Staphylococcus aureus subsp. aureus Mu50
cuuuccaccauau

SEQ ID NO: 2066935 - RNA, 21 nt, Staphylococcus aureus subsp. aureus Mu50
cuuugaaagaaggaauaauuu

SEQ ID NO: 2066936 - RNA, 21 nt, Staphylococcus aureus subsp. aureus Mu50
cuuugaauauaguccuuccca

SEQ ID NO: 2066937 - RNA, 17 nt, Staphylococcus aureus subsp. aureus Mu50
cuuuggcaccaguacuu

SEQ ID NO: 2066938 - RNA, 20 nt, Staphylococcus aureus subsp. aureus Mu50
cuuuggauuucuuuuuaaaa

SEQ ID NO: 2066939 - RNA, 16 nt, Staphylococcus aureus subsp. aureus Mu50
cuuuggacuuuaaagu

SEQ ID NO: 2066940 - RNA, 18 nt, Staphylococcus aureus subsp. aureus Mu50
cuuuggacuuuaaaguua

SEQ ID NO: 2066941 - RNA, 22 nt, Staphylococcus aureus subsp. aureus Mu50
cuuuggaaauuuauuauaaaau

SEQ ID NO: 2066942 - RNA, 23 nt, Staphylococcus aureus subsp. aureus Mu50
cuuuggaaauuuauuauaaaaua

SEQ ID NO: 2066943 - RNA, 21 nt, Staphylococcus aureus subsp. aureus Mu50
cuuugcuuaaaccuuaauaau

SEQ ID NO: 2066944 - RNA, 20 nt, Staphylococcus aureus subsp. aureus Mu50
cuuugccguauuucaaaugu

SEQ ID NO: 2066945 - RNA, 20 nt, Staphylococcus aureus subsp. aureus Mu50
cuuugauauguuuccucuuu

SEQ ID NO: 2066946 - RNA, 20 nt, Staphylococcus aureus subsp. aureus Mu50
cuuugcauacauaucuuuug

SEQ ID NO: 2066947 - RNA, 21 nt, Staphylococcus aureus subsp. aureus Mu50
cuuugauguucacuaaaugug

SEQ ID NO: 2066948 - RNA, 21 nt, Staphylococcus aureus subsp. aureus Mu50
cuuuaacuguacgauucaauu

SEQ ID NO: 2066949 - RNA, 21 nt, Staphylococcus aureus subsp. aureus Mu50
cuuuaauuaauguucaaaaaa

SEQ ID NO: 2066950 - RNA, 14 nt, Staphylococcus aureus subsp. aureus Mu50
cuuuaauugcucuu

SEQ ID NO: 2066951 - RNA, 16 nt, Staphylococcus aureus subsp. aureus Mu50
cuuuaauuguuaaauc

SEQ ID NO: 2066952 - RNA, 21 nt, Staphylococcus aureus subsp. aureus Mu50
cuuuaauuguuaaaucaccaa

SEQ ID NO: 2066953 - RNA, 17 nt, Staphylococcus aureus subsp. aureus Mu50
cuuuaauguaauuauuu

SEQ ID NO: 2066954 - RNA, 23 nt, Staphylococcus aureus subsp. aureus Mu50
cuuuaagugacacaccaccaccu

SEQ ID NO: 2066955 - RNA, 20 nt, Staphylococcus aureus subsp. aureus Mu50
cuuuaaguaauucauuugcu

SEQ ID NO: 2066956 - RNA, 16 nt, Staphylococcus aureus subsp. aureus Mu50
cuuuaaguaauucauu

SEQ ID NO: 2066957 - RNA, 18 nt, Staphylococcus aureus subsp. aureus Mu50
cuuuaaguaauucauuug

SEQ ID NO: 2066958 - RNA, 17 nt, Staphylococcus aureus subsp. aureus Mu50
cuuuaacuucuuuuguu

SEQ ID NO: 2066959 - RNA, 19 nt, Staphylococcus aureus subsp. aureus Mu50
cuuuaacuucuuuuguuuu

SEQ ID NO: 2066960 - RNA, 13 nt, Staphylococcus aureus subsp. aureus Mu50
cuuuaauuuuuug

SEQ ID NO: 2066961 - RNA, 15 nt, Staphylococcus aureus subsp. aureus Mu50
cuuuacuaaagauag

SEQ ID NO: 2066962 - RNA, 22 nt, Staphylococcus aureus subsp. aureus Mu50
cuuuagaugagauuucguuaga

SEQ ID NO: 2066963 - RNA, 22 nt, Staphylococcus aureus subsp. aureus Mu50
cuuuagcaaaaauauuuaaacu

SEQ ID NO: 2066964 - RNA, 14 nt, Staphylococcus aureus subsp. aureus Mu50
cuuuacuuucauua

SEQ ID NO: 2066965 - RNA, 14 nt, Staphylococcus aureus subsp. aureus Mu50
cuuuagaaagugau

SEQ ID NO: 2066966 - RNA, 21 nt, Staphylococcus aureus subsp. aureus Mu50
cuuuagaaagugauucccaaa

SEQ ID NO: 2066967 - RNA, 13 nt, Staphylococcus aureus subsp. aureus Mu50
cuuuaucuauaug

SEQ ID NO: 2066968 - RNA, 23 nt, Staphylococcus aureus subsp. aureus Mu50
cuuuaugggagugggacagaaau

SEQ ID NO: 2066969 - RNA, 14 nt, Staphylococcus aureus subsp. aureus Mu50
cuuuaugauaauaa

SEQ ID NO: 2066970 - RNA, 14 nt, Staphylococcus aureus subsp. aureus Mu50
cuuuauucuuccca

SEQ ID NO: 2066971 - RNA, 22 nt, Staphylococcus aureus subsp. aureus Mu50
cuuuauucuucccaaaaauugu

SEQ ID NO: 2066972 - RNA, 20 nt, Staphylococcus aureus subsp. aureus Mu50
cuuuauggguauccuucuca

SEQ ID NO: 2066973 - RNA, 21 nt, Staphylococcus aureus subsp. aureus Mu50
cuuuaguaguguauucauuuu

SEQ ID NO: 2066974 - RNA, 15 nt, Staphylococcus aureus subsp. aureus Mu50
cuuuaguguguuuaa

SEQ ID NO: 2066975 - RNA, 19 nt, Staphylococcus aureus subsp. aureus Mu50
cuuuaguguguuuaaaagg

SEQ ID NO: 2066976 - RNA, 12 nt, Staphylococcus aureus subsp. aureus Mu50
cuuuaguuacua

SEQ ID NO: 2066977 - RNA, 19 nt, Staphylococcus aureus subsp. aureus Mu50
cuuuagucgguguuuucuu

SEQ ID NO: 2066978 - RNA, 17 nt, Staphylococcus aureus subsp. aureus Mu50
cuuuaggguucauugcu

SEQ ID NO: 2066979 - RNA, 20 nt, Staphylococcus aureus subsp. aureus Mu50
cuuuaucgaauucuucuuua

SEQ ID NO: 2066980 - RNA, 19 nt, Staphylococcus aureus subsp. aureus Mu50
cuuucaagaccuucuucuc

SEQ ID NO: 2066981 - RNA, 23 nt, Staphylococcus aureus subsp. aureus Mu50
cuuucaaauauaucuaauacuuu

SEQ ID NO: 2066982 - RNA, 16 nt, Staphylococcus aureus subsp. aureus Mu50
cuuuauuuuaaacaug

SEQ ID NO: 2066983 - RNA, 12 nt, Staphylococcus aureus subsp. aureus Mu50
cuuuauuuucuu

SEQ ID NO: 2066984 - RNA, 15 nt, Staphylococcus aureus subsp. aureus Mu50
cuuuauuugauucuu

SEQ ID NO: 2066985 - RNA, 20 nt, Staphylococcus aureus subsp. aureus Mu50
cuuuauuugauucuucacca

SEQ ID NO: 2066986 - RNA, 22 nt, Staphylococcus aureus subsp. aureus Mu50
cuuucagcaccagaacaauuca

SEQ ID NO: 2066987 - RNA, 15 nt, Staphylococcus aureus subsp. aureus Mu50
cuuucaauuaauuua

SEQ ID NO: 2066988 - RNA, 20 nt, Staphylococcus aureus subsp. aureus Mu50
cuugcuggauuacaccuuug

SEQ ID NO: 2066989 - RNA, 14 nt, Staphylococcus aureus subsp. aureus Mu50
cuuggcauuuuuuc

SEQ ID NO: 2066990 - RNA, 12 nt, Staphylococcus aureus subsp. aureus Mu50
cuugcuuacaau

SEQ ID NO: 2066991 - RNA, 17 nt, Staphylococcus aureus subsp. aureus Mu50
cuuggauucaaaugaca

SEQ ID NO: 2066992 - RNA, 18 nt, Staphylococcus aureus subsp. aureus Mu50
cuuguauuuccuuaauau

SEQ ID NO: 2066993 - RNA, 13 nt, Staphylococcus aureus subsp. aureus Mu50
cuugguuaaaguu

SEQ ID NO: 2066994 - RNA, 23 nt, Staphylococcus aureus subsp. aureus Mu50
cuugguauaagaggauuucuagc

SEQ ID NO: 2066995 - RNA, 23 nt, Staphylococcus aureus subsp. aureus Mu50
cuuggcggggccccaacaaaaag

SEQ ID NO: 2066996 - RNA, 16 nt, Staphylococcus aureus subsp. aureus Mu50
cuuggcguauuuuuug

SEQ ID NO: 2066997 - RNA, 18 nt, Staphylococcus aureus subsp. aureus Mu50
cuugggacagaaaacaaa

SEQ ID NO: 2066998 - RNA, 19 nt, Staphylococcus aureus subsp. aureus Mu50
cuugggcugacauuuuugg

SEQ ID NO: 2066999 - RNA, 21 nt, Staphylococcus aureus subsp. aureus Mu50
cuugcauacgaauuaaaauaa

SEQ ID NO: 2067000 - RNA, 16 nt, Staphylococcus aureus subsp. aureus Mu50
cuugaugaaacugauu

SEQ ID NO: 2067001 - RNA, 20 nt, Staphylococcus aureus subsp. aureus Mu50
cuucucaucgaauucauuug

SEQ ID NO: 2067002 - RNA, 15 nt, Staphylococcus aureus subsp. aureus Mu50
cuucucauugaaauc

SEQ ID NO: 2067003 - RNA, 18 nt, Staphylococcus aureus subsp. aureus Mu50
cuucuauuuuauaauaaa

SEQ ID NO: 2067004 - RNA, 19 nt, Staphylococcus aureus subsp. aureus Mu50
cuucuuuuguuuuaccauc

SEQ ID NO: 2067005 - RNA, 19 nt, Staphylococcus aureus subsp. aureus Mu50
cuucuuuugcaaaacgcau

SEQ ID NO: 2067006 - RNA, 20 nt, Staphylococcus aureus subsp. aureus Mu50
cuucuuuuucccaaucgauu

SEQ ID NO: 2067007 - RNA, 17 nt, Staphylococcus aureus subsp. aureus Mu50
cuucuuuuuuaucuaca

SEQ ID NO: 2067008 - RNA, 20 nt, Staphylococcus aureus subsp. aureus Mu50
cuugaauaaauuuuauucuu

SEQ ID NO: 2067009 - RNA, 22 nt, Staphylococcus aureus subsp. aureus Mu50
cuugaaguuguuucuccaguuu

SEQ ID NO: 2067010 - RNA, 23 nt, Staphylococcus aureus subsp. aureus Mu50
cuugaccacuuuuguuaaaaaau

SEQ ID NO: 2067011 - RNA, 15 nt, Staphylococcus aureus subsp. aureus Mu50
cgcgauaaauaauaa

SEQ ID NO: 2067012 - RNA, 12 nt, Staphylococcus aureus subsp. aureus Mu50
cgccauaaucau

SEQ ID NO: 2067013 - RNA, 14 nt, Staphylococcus aureus subsp. aureus Mu50
cgccacuaugugaa

SEQ ID NO: 2067014 - RNA, 14 nt, Staphylococcus aureus subsp. aureus Mu50
cgauaguuuauuaa

SEQ ID NO: 2067015 - RNA, 19 nt, Staphylococcus aureus subsp. aureus Mu50
cgauauaacauuaaaauga

SEQ ID NO: 2067016 - RNA, 23 nt, Staphylococcus aureus subsp. aureus Mu50
cgauauagugcuuguuuauuaca

SEQ ID NO: 2067017 - RNA, 12 nt, Staphylococcus aureus subsp. aureus Mu50
cgauacuuuuug

SEQ ID NO: 2067018 - RNA, 17 nt, Staphylococcus aureus subsp. aureus Mu50
cgauaacaauuuauuaa

SEQ ID NO: 2067019 - RNA, 13 nt, Staphylococcus aureus subsp. aureus Mu50
cgauaaauaauaa

SEQ ID NO: 2067020 - RNA, 15 nt, Staphylococcus aureus subsp. aureus Mu50
ccuucauuagccaaa

SEQ ID NO: 2067021 - RNA, 17 nt, Staphylococcus aureus subsp. aureus Mu50
ccuucauuagccaaauc

SEQ ID NO: 2067022 - RNA, 15 nt, Staphylococcus aureus subsp. aureus Mu50
cgaucaugccuucau

SEQ ID NO: 2067023 - RNA, 18 nt, Staphylococcus aureus subsp. aureus Mu50
cgaucauuagcaauuuca

SEQ ID NO: 2067024 - RNA, 22 nt, Staphylococcus aureus subsp. aureus Mu50
cgaucuucaugaacagcaucuu

SEQ ID NO: 2067025 - RNA, 16 nt, Staphylococcus aureus subsp. aureus Mu50
cgaucuaacaauugca

SEQ ID NO: 2067026 - RNA, 14 nt, Staphylococcus aureus subsp. aureus Mu50
cgaugacuuuuuaa

SEQ ID NO: 2067027 - RNA, 15 nt, Staphylococcus aureus subsp. aureus Mu50
cgaugcuaaaaauau

SEQ ID NO: 2067028 - RNA, 14 nt, Staphylococcus aureus subsp. aureus Mu50
cgaugucagacgaa

SEQ ID NO: 2067029 - RNA, 19 nt, Staphylococcus aureus subsp. aureus Mu50
cgauuaagaaugcaccaac

SEQ ID NO: 2067030 - RNA, 17 nt, Staphylococcus aureus subsp. aureus Mu50
cgauuaauaaaauucua

SEQ ID NO: 2067031 - RNA, 19 nt, Staphylococcus aureus subsp. aureus Mu50
cgcaaguagucuacaguaa

SEQ ID NO: 2067032 - RNA, 18 nt, Staphylococcus aureus subsp. aureus Mu50
cgcaauacgaauaucugu

SEQ ID NO: 2067033 - RNA, 13 nt, Staphylococcus aureus subsp. aureus Mu50
cggaaauacaaug

SEQ ID NO: 2067034 - RNA, 13 nt, Staphylococcus aureus subsp. aureus Mu50
cggaugagaaaug

SEQ ID NO: 2067035 - RNA, 14 nt, Staphylococcus aureus subsp. aureus Mu50
cggcacauucauac

SEQ ID NO: 2067036 - RNA, 19 nt, Staphylococcus aureus subsp. aureus Mu50
cgcuguggcucgaaaauaa

SEQ ID NO: 2067037 - RNA, 11 nt, Staphylococcus aureus subsp. aureus Mu50
cgcuuaauucu

SEQ ID NO: 2067038 - RNA, 13 nt, Staphylococcus aureus subsp. aureus Mu50
cgcuguuuuaaau

SEQ ID NO: 2067039 - RNA, 18 nt, Staphylococcus aureus subsp. aureus Mu50
cgcugguaauauuuuugu

SEQ ID NO: 2067040 - RNA, 11 nt, Staphylococcus aureus subsp. aureus Mu50
cgcuuuauuac

SEQ ID NO: 2067041 - RNA, 17 nt, Staphylococcus aureus subsp. aureus Mu50
cgcuuuauuacuuuaau

SEQ ID NO: 2067042 - RNA, 17 nt, Staphylococcus aureus subsp. aureus Mu50
cgcuuuauucuucccaa

SEQ ID NO: 2067043 - RNA, 13 nt, Staphylococcus aureus subsp. aureus Mu50
cgcuuuugaaguu

SEQ ID NO: 2067044 - RNA, 22 nt, Staphylococcus aureus subsp. aureus Mu50
cgcuuuugaaguugguccaaau

SEQ ID NO: 2067045 - RNA, 12 nt, Staphylococcus aureus subsp. aureus Mu50
cgcuuuuuaaaa

SEQ ID NO: 2067046 - RNA, 10 nt, Staphylococcus aureus subsp. aureus Mu50
cgggaaggaa

SEQ ID NO: 2067047 - RNA, 13 nt, Staphylococcus aureus subsp. aureus Mu50
cggcuuuggauuu

SEQ ID NO: 2067048 - RNA, 14 nt, Staphylococcus aureus subsp. aureus Mu50
cgucacucacuuca

SEQ ID NO: 2067049 - RNA, 17 nt, Staphylococcus aureus subsp. aureus Mu50
cgucacauauaaauauu

SEQ ID NO: 2067050 - RNA, 23 nt, Staphylococcus aureus subsp. aureus Mu50
cgucacaugccaucuuuguaacc

SEQ ID NO: 2067051 - RNA, 14 nt, Staphylococcus aureus subsp. aureus Mu50
cgucacuuuauuaa

SEQ ID NO: 2067052 - RNA, 17 nt, Staphylococcus aureus subsp. aureus Mu50
cguauuucaaauguaau

SEQ ID NO: 2067053 - RNA, 15 nt, Staphylococcus aureus subsp. aureus Mu50
cguauuuaccuucuu

SEQ ID NO: 2067054 - RNA, 14 nt, Staphylococcus aureus subsp. aureus Mu50
cguauuuuaauauu

SEQ ID NO: 2067055 - RNA, 18 nt, Staphylococcus aureus subsp. aureus Mu50
cguauuagccaauaaaau

SEQ ID NO: 2067056 - RNA, 18 nt, Staphylococcus aureus subsp. aureus Mu50
cguauacuuucgaucuuc

SEQ ID NO: 2067057 - RNA, 20 nt, Staphylococcus aureus subsp. aureus Mu50
cguauauauauauuaaaaca

SEQ ID NO: 2067058 - RNA, 14 nt, Staphylococcus aureus subsp. aureus Mu50
cguaguuguccauu

SEQ ID NO: 2067059 - RNA, 15 nt, Staphylococcus aureus subsp. aureus Mu50
cguaacuauaugaaa

SEQ ID NO: 2067060 - RNA, 14 nt, Staphylococcus aureus subsp. aureus Mu50
cguaacuauaugaa

SEQ ID NO: 2067061 - RNA, 16 nt, Staphylococcus aureus subsp. aureus Mu50
cggucucaacuugccu

SEQ ID NO: 2067062 - RNA, 13 nt, Staphylococcus aureus subsp. aureus Mu50
cguaaacaacauc

SEQ ID NO: 2067063 - RNA, 12 nt, Staphylococcus aureus subsp. aureus Mu50
cguaaaaucaug

SEQ ID NO: 2067064 - RNA, 20 nt, Staphylococcus aureus subsp. aureus Mu50
cguaaaaucagucauucaca

SEQ ID NO: 2067065 - RNA, 15 nt, Staphylococcus aureus subsp. aureus Mu50
cgguuugaaaaugac

SEQ ID NO: 2067066 - RNA, 13 nt, Staphylococcus aureus subsp. aureus Mu50
cccguuugauuuc

SEQ ID NO: 2067067 - RNA, 16 nt, Staphylococcus aureus subsp. aureus Mu50
cccuaugaaauaacua

SEQ ID NO: 2067068 - RNA, 22 nt, Staphylococcus aureus subsp. aureus Mu50
cccuacaaaguuuauacuuaau

SEQ ID NO: 2067069 - RNA, 21 nt, Staphylococcus aureus subsp. aureus Mu50
ccauuguuauccaaaacauuu

SEQ ID NO: 2067070 - RNA, 22 nt, Staphylococcus aureus subsp. aureus Mu50
ccauugcacaguuucaucuuca

SEQ ID NO: 2067071 - RNA, 22 nt, Staphylococcus aureus subsp. aureus Mu50
ccauuucgauaccuaaaauacc

SEQ ID NO: 2067072 - RNA, 17 nt, Staphylococcus aureus subsp. aureus Mu50
ccauuuuuuuccaagca

SEQ ID NO: 2067073 - RNA, 18 nt, Staphylococcus aureus subsp. aureus Mu50
ccauuuuuuuccaagcau

SEQ ID NO: 2067074 - RNA, 12 nt, Staphylococcus aureus subsp. aureus Mu50
cccaacacagaa

SEQ ID NO: 2067075 - RNA, 16 nt, Staphylococcus aureus subsp. aureus Mu50
cccccgccacuaugug

SEQ ID NO: 2067076 - RNA, 18 nt, Staphylococcus aureus subsp. aureus Mu50
cccauggauucugauucg

SEQ ID NO: 2067077 - RNA, 16 nt, Staphylococcus aureus subsp. aureus Mu50
cccauguauaaggaua

SEQ ID NO: 2067078 - RNA, 13 nt, Staphylococcus aureus subsp. aureus Mu50
cccauuuuaaagu

SEQ ID NO: 2067079 - RNA, 15 nt, Staphylococcus aureus subsp. aureus Mu50
ccccaacuugcauug

SEQ ID NO: 2067080 - RNA, 20 nt, Staphylococcus aureus subsp. aureus Mu50
ccccaacuugcauugucugu

SEQ ID NO: 2067081 - RNA, 16 nt, Staphylococcus aureus subsp. aureus Mu50
ccccaacacagagaaa

SEQ ID NO: 2067082 - RNA, 18 nt, Staphylococcus aureus subsp. aureus Mu50
ccagucguaaugaugaca

SEQ ID NO: 2067083 - RNA, 15 nt, Staphylococcus aureus subsp. aureus Mu50
ccagucaauuuuuuc

SEQ ID NO: 2067084 - RNA, 13 nt, Staphylococcus aureus subsp. aureus Mu50
ccaguaucucuuu

SEQ ID NO: 2067085 - RNA, 13 nt, Staphylococcus aureus subsp. aureus Mu50
ccaguauaauuuu

SEQ ID NO: 2067086 - RNA, 23 nt, Staphylococcus aureus subsp. aureus Mu50
ccaguauacgaguuauaucuuuu

SEQ ID NO: 2067087 - RNA, 13 nt, Staphylococcus aureus subsp. aureus Mu50
ccagucauguccc

SEQ ID NO: 2067088 - RNA, 18 nt, Staphylococcus aureus subsp. aureus Mu50
ccaguugauuuaagauuu

SEQ ID NO: 2067089 - RNA, 17 nt, Staphylococcus aureus subsp. aureus Mu50
ccauaaauauuuaaaau

SEQ ID NO: 2067090 - RNA, 14 nt, Staphylococcus aureus subsp. aureus Mu50
ccauaaauauuaaa

SEQ ID NO: 2067091 - RNA, 19 nt, Staphylococcus aureus subsp. aureus Mu50
ccauaacuuuauauauaaa

SEQ ID NO: 2067092 - RNA, 19 nt, Staphylococcus aureus subsp. aureus Mu50
ccauaaacauggucaauca

SEQ ID NO: 2067093 - RNA, 13 nt, Staphylococcus aureus subsp. aureus Mu50
ccaguuucaagug

SEQ ID NO: 2067094 - RNA, 21 nt, Staphylococcus aureus subsp. aureus Mu50
ccauaaauaaaaugcuacaau

SEQ ID NO: 2067095 - RNA, 16 nt, Staphylococcus aureus subsp. aureus Mu50
ccaucgcaacugauaa

SEQ ID NO: 2067096 - RNA, 20 nt, Staphylococcus aureus subsp. aureus Mu50
ccaucaauauuuauauuaaa

SEQ ID NO: 2067097 - RNA, 20 nt, Staphylococcus aureus subsp. aureus Mu50
ccaucaauaccauaauuaaa

SEQ ID NO: 2067098 - RNA, 21 nt, Staphylococcus aureus subsp. aureus Mu50
ccauacaaaucguaaacauaa

SEQ ID NO: 2067099 - RNA, 13 nt, Staphylococcus aureus subsp. aureus Mu50
ccauaauuuaaau

SEQ ID NO: 2067100 - RNA, 23 nt, Staphylococcus aureus subsp. aureus Mu50
ccauaugugguggcuauauaauu

SEQ ID NO: 2067101 - RNA, 11 nt, Staphylococcus aureus subsp. aureus Mu50
ccagaauaaau

SEQ ID NO: 2067102 - RNA, 14 nt, Staphylococcus aureus subsp. aureus Mu50
ccagauaucauaau

SEQ ID NO: 2067103 - RNA, 16 nt, Staphylococcus aureus subsp. aureus Mu50
ccagcgacauguccug

SEQ ID NO: 2067104 - RNA, 15 nt, Staphylococcus aureus subsp. aureus Mu50
ccagccucuguguug

SEQ ID NO: 2067105 - RNA, 22 nt, Staphylococcus aureus subsp. aureus Mu50
ccagccccaauuagccccagua

SEQ ID NO: 2067106 - RNA, 11 nt, Staphylococcus aureus subsp. aureus Mu50
ccaccugauaa

SEQ ID NO: 2067107 - RNA, 14 nt, Staphylococcus aureus subsp. aureus Mu50
ccacuuaaucguuc

SEQ ID NO: 2067108 - RNA, 14 nt, Staphylococcus aureus subsp. aureus Mu50
ccacuucuucaccu

SEQ ID NO: 2067109 - RNA, 16 nt, Staphylococcus aureus subsp. aureus Mu50
ccacuugaauacuuuu

SEQ ID NO: 2067110 - RNA, 20 nt, Staphylococcus aureus subsp. aureus Mu50
ccacuugaauacuuuuuaac

SEQ ID NO: 2067111 - RNA, 19 nt, Staphylococcus aureus subsp. aureus Mu50
ccacucaauucucuaacuu

SEQ ID NO: 2067112 - RNA, 19 nt, Staphylococcus aureus subsp. aureus Mu50
ccacucauaaucaagucug

SEQ ID NO: 2067113 - RNA, 16 nt, Staphylococcus aureus subsp. aureus Mu50
ccacuccuuaaacaaa

SEQ ID NO: 2067114 - RNA, 21 nt, Staphylococcus aureus subsp. aureus Mu50
ccuggaauauuaacaccagau

SEQ ID NO: 2067115 - RNA, 23 nt, Staphylococcus aureus subsp. aureus Mu50
ccuggaaucgaaaauaucaauuu

SEQ ID NO: 2067116 - RNA, 15 nt, Staphylococcus aureus subsp. aureus Mu50
ccugcuuuuuuuaua

SEQ ID NO: 2067117 - RNA, 20 nt, Staphylococcus aureus subsp. aureus Mu50
ccuucaauguucaauucacg

SEQ ID NO: 2067118 - RNA, 16 nt, Staphylococcus aureus subsp. aureus Mu50
ccuucaauccaagcaa

SEQ ID NO: 2067119 - RNA, 18 nt, Staphylococcus aureus subsp. aureus Mu50
ccuuacccaaaaaauugu

SEQ ID NO: 2067120 - RNA, 16 nt, Staphylococcus aureus subsp. aureus Mu50
ccuuaauaauaaguau

SEQ ID NO: 2067121 - RNA, 14 nt, Staphylococcus aureus subsp. aureus Mu50
ccuuaaaauauuua

SEQ ID NO: 2067122 - RNA, 19 nt, Staphylococcus aureus subsp. aureus Mu50
ccuguucuuuauuuaaagg

SEQ ID NO: 2067123 - RNA, 19 nt, Staphylococcus aureus subsp. aureus Mu50
ccuguaaaaccauagauaa

SEQ ID NO: 2067124 - RNA, 12 nt, Staphylococcus aureus subsp. aureus Mu50
ccugugauaaaa

SEQ ID NO: 2067125 - RNA, 18 nt, Staphylococcus aureus subsp. aureus Mu50
ccucauaauuaucauaua

SEQ ID NO: 2067126 - RNA, 21 nt, Staphylococcus aureus subsp. aureus Mu50
ccucuaacguuaacaauauuc

SEQ ID NO: 2067127 - RNA, 14 nt, Staphylococcus aureus subsp. aureus Mu50
ccucuaaauaaaau

SEQ ID NO: 2067128 - RNA, 22 nt, Staphylococcus aureus subsp. aureus Mu50
ccugauuccacuacaaucauac

SEQ ID NO: 2067129 - RNA, 15 nt, Staphylococcus aureus subsp. aureus Mu50
ccugauaaugcaugu

SEQ ID NO: 2067130 - RNA, 16 nt, Staphylococcus aureus subsp. aureus Mu50
ccguauuuuaauauug

SEQ ID NO: 2067131 - RNA, 13 nt, Staphylococcus aureus subsp. aureus Mu50
ccguauuucaaau

SEQ ID NO: 2067132 - RNA, 22 nt, Staphylococcus aureus subsp. aureus Mu50
ccucacuagauaguuuauacuu

SEQ ID NO: 2067133 - RNA, 11 nt, Staphylococcus aureus subsp. aureus Mu50
ccuauuuuuua

SEQ ID NO: 2067134 - RNA, 13 nt, Staphylococcus aureus subsp. aureus Mu50
ccuauucccaaaa

SEQ ID NO: 2067135 - RNA, 16 nt, Staphylococcus aureus subsp. aureus Mu50
ccuauuguuuuuuaua

SEQ ID NO: 2067136 - RNA, 11 nt, Staphylococcus aureus subsp. aureus Mu50
ccuauucccaa

SEQ ID NO: 2067137 - RNA, 12 nt, Staphylococcus aureus subsp. aureus Mu50
ccuauuaggauc

SEQ ID NO: 2067138 - RNA, 20 nt, Staphylococcus aureus subsp. aureus Mu50
ccuaugccaaauaacguuaa

SEQ ID NO: 2067139 - RNA, 19 nt, Staphylococcus aureus subsp. aureus Mu50
ccuacugcugucuuuuuga

SEQ ID NO: 2067140 - RNA, 23 nt, Staphylococcus aureus subsp. aureus Mu50
ccuacuuugauauguuuccucuu

SEQ ID NO: 2067141 - RNA, 13 nt, Staphylococcus aureus subsp. aureus Mu50
ccuagcaaaaaua

SEQ ID NO: 2067142 - RNA, 17 nt, Staphylococcus aureus subsp. aureus Mu50
ccuagauaccaaacugc

SEQ ID NO: 2067143 - RNA, 19 nt, Staphylococcus aureus subsp. aureus Mu50
ccuaggaaauaaaaaauaa

SEQ ID NO: 2067144 - RNA, 20 nt, Staphylococcus aureus subsp. aureus Mu50
ccuagguuuauauaucacau

SEQ ID NO: 2067145 - RNA, 11 nt, Staphylococcus aureus subsp. aureus Mu50
ccuauaauagc

SEQ ID NO: 2067146 - RNA, 17 nt, Staphylococcus aureus subsp. aureus Mu50
ccuauacauaacccuaa

SEQ ID NO: 2067147 - RNA, 16 nt, Staphylococcus aureus subsp. aureus Mu50
ccuaaggacuuuaugc

SEQ ID NO: 2067148 - RNA, 17 nt, Staphylococcus aureus subsp. aureus Mu50
ccuaaguuaugacuaac

SEQ ID NO: 2067149 - RNA, 14 nt, Staphylococcus aureus subsp. aureus Mu50
ccuaauaaauaucu

SEQ ID NO: 2067150 - RNA, 13 nt, Staphylococcus aureus subsp. aureus Mu50
ccuaauaauaaaa

SEQ ID NO: 2067151 - RNA, 20 nt, Staphylococcus aureus subsp. aureus Mu50
ccuacaacuauucccacuca

SEQ ID NO: 2067152 - RNA, 18 nt, Staphylococcus aureus subsp. aureus Mu50
ccuacaaauauuucuaaa

SEQ ID NO: 2067153 - RNA, 22 nt, Staphylococcus aureus subsp. aureus Mu50
ccuaagcucguuaauuuuauuu

SEQ ID NO: 2067154 - RNA, 19 nt, Staphylococcus aureus subsp. aureus Mu50
ccuaaaccucuaaauaaaa

SEQ ID NO: 2067155 - RNA, 18 nt, Staphylococcus aureus subsp. aureus Mu50
ccuaaagcuaaugcaagc

SEQ ID NO: 2067156 - RNA, 12 nt, Staphylococcus aureus subsp. aureus Mu50
ccuaaaaacaaa

SEQ ID NO: 2067157 - RNA, 14 nt, Staphylococcus aureus subsp. aureus Mu50
ccguuuuuuauaaa

SEQ ID NO: 2067158 - RNA, 18 nt, Staphylococcus aureus subsp. aureus Mu50
ccguuuuuuauaaaucau

SEQ ID NO: 2067159 - RNA, 19 nt, Staphylococcus aureus subsp. aureus Mu50
cauccacuuuuugccuggc

SEQ ID NO: 2067160 - RNA, 14 nt, Staphylococcus aureus subsp. aureus Mu50
cauccucauaauua

SEQ ID NO: 2067161 - RNA, 16 nt, Staphylococcus aureus subsp. aureus Mu50
caucgauaucuaaguc

SEQ ID NO: 2067162 - RNA, 18 nt, Staphylococcus aureus subsp. aureus Mu50
caucuugagauuuucaac

SEQ ID NO: 2067163 - RNA, 19 nt, Staphylococcus aureus subsp. aureus Mu50
caucuugcgccuuguucaa

SEQ ID NO: 2067164 - RNA, 15 nt, Staphylococcus aureus subsp. aureus Mu50
caucuuguuguucug

SEQ ID NO: 2067165 - RNA, 14 nt, Staphylococcus aureus subsp. aureus Mu50
caucuuuaaagaaa

SEQ ID NO: 2067166 - RNA, 21 nt, Staphylococcus aureus subsp. aureus Mu50
caucuuuguaaccuaaaaaca

SEQ ID NO: 2067167 - RNA, 17 nt, Staphylococcus aureus subsp. aureus Mu50
caucuuuauuuacaaug

SEQ ID NO: 2067168 - RNA, 19 nt, Staphylococcus aureus subsp. aureus Mu50
caucuuucacaauuguaua

SEQ ID NO: 2067169 - RNA, 12 nt, Staphylococcus aureus subsp. aureus Mu50
caucuuucaaau

SEQ ID NO: 2067170 - RNA, 17 nt, Staphylococcus aureus subsp. aureus Mu50
caucuuucaaaugcuua

SEQ ID NO: 2067171 - RNA, 22 nt, Staphylococcus aureus subsp. aureus Mu50
caucuuagacgcuguuuuaaau

SEQ ID NO: 2067172 - RNA, 15 nt, Staphylococcus aureus subsp. aureus Mu50
caucuuaucaagaau

SEQ ID NO: 2067173 - RNA, 23 nt, Staphylococcus aureus subsp. aureus Mu50
caucugaugaggcaauauuaaaa

SEQ ID NO: 2067174 - RNA, 15 nt, Staphylococcus aureus subsp. aureus Mu50
caucugcaagugcuu

SEQ ID NO: 2067175 - RNA, 21 nt, Staphylococcus aureus subsp. aureus Mu50
caucugaugaggcaauauuaa

SEQ ID NO: 2067176 - RNA, 13 nt, Staphylococcus aureus subsp. aureus Mu50
caucugacugauu

SEQ ID NO: 2067177 - RNA, 17 nt, Staphylococcus aureus subsp. aureus Mu50
caucuacuauuuaaucu

SEQ ID NO: 2067178 - RNA, 13 nt, Staphylococcus aureus subsp. aureus Mu50
caucuauguggcu

SEQ ID NO: 2067179 - RNA, 18 nt, Staphylococcus aureus subsp. aureus Mu50
caucuauuuaauaaugua

SEQ ID NO: 2067180 - RNA, 20 nt, Staphylococcus aureus subsp. aureus Mu50
caucuauauuuaauuuugau

SEQ ID NO: 2067181 - RNA, 12 nt, Staphylococcus aureus subsp. aureus Mu50
caucaguaccaa

SEQ ID NO: 2067182 - RNA, 22 nt, Staphylococcus aureus subsp. aureus Mu50
caucaguaccaaagaaaucacc

SEQ ID NO: 2067183 - RNA, 23 nt, Staphylococcus aureus subsp. aureus Mu50
caucauuuucaauacuugaaaga

SEQ ID NO: 2067184 - RNA, 21 nt, Staphylococcus aureus subsp. aureus Mu50
caucauuuacgauacaucauu

SEQ ID NO: 2067185 - RNA, 14 nt, Staphylococcus aureus subsp. aureus Mu50
caucauuuguguuu

SEQ ID NO: 2067186 - RNA, 16 nt, Staphylococcus aureus subsp. aureus Mu50
caucauuuaaauauuu

SEQ ID NO: 2067187 - RNA, 13 nt, Staphylococcus aureus subsp. aureus Mu50
caucauucucaaa

SEQ ID NO: 2067188 - RNA, 20 nt, Staphylococcus aureus subsp. aureus Mu50
caucaugacuauuucgcuuu

SEQ ID NO: 2067189 - RNA, 20 nt, Staphylococcus aureus subsp. aureus Mu50
caucauaaucaagaauauaa

SEQ ID NO: 2067190 - RNA, 12 nt, Staphylococcus aureus subsp. aureus Mu50
caucauauacau

SEQ ID NO: 2067191 - RNA, 14 nt, Staphylococcus aureus subsp. aureus Mu50
caucauaaucugcu

SEQ ID NO: 2067192 - RNA, 22 nt, Staphylococcus aureus subsp. aureus Mu50
caucaucacuguagauucaaau

SEQ ID NO: 2067193 - RNA, 12 nt, Staphylococcus aureus subsp. aureus Mu50
caucaucaccau

SEQ ID NO: 2067194 - RNA, 13 nt, Staphylococcus aureus subsp. aureus Mu50
caucaucaccaua

SEQ ID NO: 2067195 - RNA, 17 nt, Staphylococcus aureus subsp. aureus Mu50
caucaucaccauacuaa

SEQ ID NO: 2067196 - RNA, 14 nt, Staphylococcus aureus subsp. aureus Mu50
caucaucaaguuca

SEQ ID NO: 2067197 - RNA, 19 nt, Staphylococcus aureus subsp. aureus Mu50
caucaucuauaauaccuaa

SEQ ID NO: 2067198 - RNA, 12 nt, Staphylococcus aureus subsp. aureus Mu50
caucaucuauuu

SEQ ID NO: 2067199 - RNA, 18 nt, Staphylococcus aureus subsp. aureus Mu50
caucaacgccauauuuau

SEQ ID NO: 2067200 - RNA, 20 nt, Staphylococcus aureus subsp. aureus Mu50
caucaaguauaaauguuauu

SEQ ID NO: 2067201 - RNA, 17 nt, Staphylococcus aureus subsp. aureus Mu50
caucaauaccauaauua

SEQ ID NO: 2067202 - RNA, 17 nt, Staphylococcus aureus subsp. aureus Mu50
caucaaacaacaucacu

SEQ ID NO: 2067203 - RNA, 20 nt, Staphylococcus aureus subsp. aureus Mu50
caucaaacaacaucacuuua

SEQ ID NO: 2067204 - RNA, 15 nt, Staphylococcus aureus subsp. aureus Mu50
cauauuuugauuuac

SEQ ID NO: 2067205 - RNA, 21 nt, Staphylococcus aureus subsp. aureus Mu50
cauauuuuuuaguaauaacau

SEQ ID NO: 2067206 - RNA, 13 nt, Staphylococcus aureus subsp. aureus Mu50
cauauuuuuuaaa

SEQ ID NO: 2067207 - RNA, 17 nt, Staphylococcus aureus subsp. aureus Mu50
cauauuuuuuaaauuua

SEQ ID NO: 2067208 - RNA, 15 nt, Staphylococcus aureus subsp. aureus Mu50
cauauucaaaauaac

SEQ ID NO: 2067209 - RNA, 13 nt, Staphylococcus aureus subsp. aureus Mu50
cauauauuuuguu

SEQ ID NO: 2067210 - RNA, 21 nt, Staphylococcus aureus subsp. aureus Mu50
cauauacacacuaaggaaaau

SEQ ID NO: 2067211 - RNA, 16 nt, Staphylococcus aureus subsp. aureus Mu50
cauauaugucucucuu

SEQ ID NO: 2067212 - RNA, 20 nt, Staphylococcus aureus subsp. aureus Mu50
cauauaugccgauugcucua

SEQ ID NO: 2067213 - RNA, 23 nt, Staphylococcus aureus subsp. aureus Mu50
cauauaaugguugaauaacacua

SEQ ID NO: 2067214 - RNA, 20 nt, Staphylococcus aureus subsp. aureus Mu50
cauauaauuugggucguuag

SEQ ID NO: 2067215 - RNA, 14 nt, Staphylococcus aureus subsp. aureus Mu50
cauauaaauauuuu

SEQ ID NO: 2067216 - RNA, 12 nt, Staphylococcus aureus subsp. aureus Mu50
cauauaaaucaa

SEQ ID NO: 2067217 - RNA, 15 nt, Staphylococcus aureus subsp. aureus Mu50
cauauguaauacaaa

SEQ ID NO: 2067218 - RNA, 16 nt, Staphylococcus aureus subsp. aureus Mu50
cauauguaauacaaaa

SEQ ID NO: 2067219 - RNA, 18 nt, Staphylococcus aureus subsp. aureus Mu50
cauaugucuguuccucaa

SEQ ID NO: 2067220 - RNA, 22 nt, Staphylococcus aureus subsp. aureus Mu50
cauauuacuucucaucgaauuc

SEQ ID NO: 2067221 - RNA, 20 nt, Staphylococcus aureus subsp. aureus Mu50
cauauuacuuuggaaauuua

SEQ ID NO: 2067222 - RNA, 22 nt, Staphylococcus aureus subsp. aureus Mu50
cauauguuguuucuaaugcuca

SEQ ID NO: 2067223 - RNA, 14 nt, Staphylococcus aureus subsp. aureus Mu50
cauauguuggauuc

SEQ ID NO: 2067224 - RNA, 14 nt, Staphylococcus aureus subsp. aureus Mu50
cauaugugguggcu

SEQ ID NO: 2067225 - RNA, 19 nt, Staphylococcus aureus subsp. aureus Mu50
cauauguguaugauagaau

SEQ ID NO: 2067226 - RNA, 16 nt, Staphylococcus aureus subsp. aureus Mu50
cauugaucuuuuauaa

SEQ ID NO: 2067227 - RNA, 17 nt, Staphylococcus aureus subsp. aureus Mu50
cauugcacuaugcauaa

SEQ ID NO: 2067228 - RNA, 16 nt, Staphylococcus aureus subsp. aureus Mu50
cauuguguauuguuuu

SEQ ID NO: 2067229 - RNA, 12 nt, Staphylococcus aureus subsp. aureus Mu50
cauuuaaaaaau

SEQ ID NO: 2067230 - RNA, 17 nt, Staphylococcus aureus subsp. aureus Mu50
cauuguuucagcugcaa

SEQ ID NO: 2067231 - RNA, 20 nt, Staphylococcus aureus subsp. aureus Mu50
cauuuaaaauauuuuuucug

SEQ ID NO: 2067232 - RNA, 15 nt, Staphylococcus aureus subsp. aureus Mu50
cauuuaaaaaucaaa

SEQ ID NO: 2067233 - RNA, 18 nt, Staphylococcus aureus subsp. aureus Mu50
cauuuaaaauauuuuuuc

SEQ ID NO: 2067234 - RNA, 21 nt, Staphylococcus aureus subsp. aureus Mu50
cauuguuauuaucguaaaaaa

SEQ ID NO: 2067235 - RNA, 17 nt, Staphylococcus aureus subsp. aureus Mu50
cauuguucauacgcuca

SEQ ID NO: 2067236 - RNA, 17 nt, Staphylococcus aureus subsp. aureus Mu50
cauucuaguagcuagaa

SEQ ID NO: 2067237 - RNA, 17 nt, Staphylococcus aureus subsp. aureus Mu50
cauuaggauguucagcu

SEQ ID NO: 2067238 - RNA, 21 nt, Staphylococcus aureus subsp. aureus Mu50
cauuaucaagaacuuuaaaaa

SEQ ID NO: 2067239 - RNA, 13 nt, Staphylococcus aureus subsp. aureus Mu50
cauuaucauuaag

SEQ ID NO: 2067240 - RNA, 17 nt, Staphylococcus aureus subsp. aureus Mu50
cauugaauaaaugaagg

SEQ ID NO: 2067241 - RNA, 13 nt, Staphylococcus aureus subsp. aureus Mu50
cauucuuauuuga

SEQ ID NO: 2067242 - RNA, 15 nt, Staphylococcus aureus subsp. aureus Mu50
cauucuucaaaaaau

SEQ ID NO: 2067243 - RNA, 16 nt, Staphylococcus aureus subsp. aureus Mu50
cauucuucaaaaaaua

SEQ ID NO: 2067244 - RNA, 21 nt, Staphylococcus aureus subsp. aureus Mu50
cauugagauaucuuauaacaa

SEQ ID NO: 2067245 - RNA, 15 nt, Staphylococcus aureus subsp. aureus Mu50
cauugauaaaauaau

SEQ ID NO: 2067246 - RNA, 13 nt, Staphylococcus aureus subsp. aureus Mu50
cauugauaaaaua

SEQ ID NO: 2067247 - RNA, 18 nt, Staphylococcus aureus subsp. aureus Mu50
cauugauaaauuuuuagu

SEQ ID NO: 2067248 - RNA, 21 nt, Staphylococcus aureus subsp. aureus Mu50
cauugauaaauuuuuaguuaa

SEQ ID NO: 2067249 - RNA, 19 nt, Staphylococcus aureus subsp. aureus Mu50
cauuugcaacaauauaaua

SEQ ID NO: 2067250 - RNA, 13 nt, Staphylococcus aureus subsp. aureus Mu50
cauuugaccaagu

SEQ ID NO: 2067251 - RNA, 20 nt, Staphylococcus aureus subsp. aureus Mu50
cauuuaauuggaguucaucu

SEQ ID NO: 2067252 - RNA, 15 nt, Staphylococcus aureus subsp. aureus Mu50
cauuuaauccuucuc

SEQ ID NO: 2067253 - RNA, 13 nt, Staphylococcus aureus subsp. aureus Mu50
cauuuaaauauaa

SEQ ID NO: 2067254 - RNA, 14 nt, Staphylococcus aureus subsp. aureus Mu50
cauuuaauacuuuu

SEQ ID NO: 2067255 - RNA, 22 nt, Staphylococcus aureus subsp. aureus Mu50
cauuuaaggauuuccucgguuu

SEQ ID NO: 2067256 - RNA, 18 nt, Staphylococcus aureus subsp. aureus Mu50
cauuuguguuccugcuac

SEQ ID NO: 2067257 - RNA, 17 nt, Staphylococcus aureus subsp. aureus Mu50
cauuugucuuaauuuuu

SEQ ID NO: 2067258 - RNA, 15 nt, Staphylococcus aureus subsp. aureus Mu50
cauuugucauaauag

SEQ ID NO: 2067259 - RNA, 23 nt, Staphylococcus aureus subsp. aureus Mu50
cauuugucauaauagauaaugca

SEQ ID NO: 2067260 - RNA, 15 nt, Staphylococcus aureus subsp. aureus Mu50
cauuuguauuaauuu

SEQ ID NO: 2067261 - RNA, 14 nt, Staphylococcus aureus subsp. aureus Mu50
cauuuguauagauu

SEQ ID NO: 2067262 - RNA, 22 nt, Staphylococcus aureus subsp. aureus Mu50
cauuuguaaauauuuuuuaaaa

SEQ ID NO: 2067263 - RNA, 13 nt, Staphylococcus aureus subsp. aureus Mu50
cauuuguguuuuu

SEQ ID NO: 2067264 - RNA, 21 nt, Staphylococcus aureus subsp. aureus Mu50
cauuugguggagaaccaaaaa

SEQ ID NO: 2067265 - RNA, 23 nt, Staphylococcus aureus subsp. aureus Mu50
cauuugguggagaaccuuuaaaa

SEQ ID NO: 2067266 - RNA, 21 nt, Staphylococcus aureus subsp. aureus Mu50
cauuuuagauugacuaaguuu

SEQ ID NO: 2067267 - RNA, 20 nt, Staphylococcus aureus subsp. aureus Mu50
cauuuuagcaaaagcuuuua

SEQ ID NO: 2067268 - RNA, 21 nt, Staphylococcus aureus subsp. aureus Mu50
cauuuuaaauucaacuaugaa

SEQ ID NO: 2067269 - RNA, 19 nt, Staphylococcus aureus subsp. aureus Mu50
cauuuuaaauaaaaugcau

SEQ ID NO: 2067270 - RNA, 12 nt, Staphylococcus aureus subsp. aureus Mu50
cauuuuaaauaa

SEQ ID NO: 2067271 - RNA, 17 nt, Staphylococcus aureus subsp. aureus Mu50
cauuuucaaaacuagca

SEQ ID NO: 2067272 - RNA, 15 nt, Staphylococcus aureus subsp. aureus Mu50
cauuuuauccaaacc

SEQ ID NO: 2067273 - RNA, 16 nt, Staphylococcus aureus subsp. aureus Mu50
cauuuuaguuauacua

SEQ ID NO: 2067274 - RNA, 15 nt, Staphylococcus aureus subsp. aureus Mu50
cauuuuaucugaaaa

SEQ ID NO: 2067275 - RNA, 22 nt, Staphylococcus aureus subsp. aureus Mu50
cauuuucauuguauguugaaag

SEQ ID NO: 2067276 - RNA, 17 nt, Staphylococcus aureus subsp. aureus Mu50
cauuuucauuuaauccu

SEQ ID NO: 2067277 - RNA, 19 nt, Staphylococcus aureus subsp. aureus Mu50
cauuuucaacauaauauuu

SEQ ID NO: 2067278 - RNA, 12 nt, Staphylococcus aureus subsp. aureus Mu50
cauuuucugcuu

SEQ ID NO: 2067279 - RNA, 19 nt, Staphylococcus aureus subsp. aureus Mu50
cauuuuuaaauuacuauau

SEQ ID NO: 2067280 - RNA, 16 nt, Staphylococcus aureus subsp. aureus Mu50
cauuuuuaauuuugac

SEQ ID NO: 2067281 - RNA, 15 nt, Staphylococcus aureus subsp. aureus Mu50
cauuuugauuaagug

SEQ ID NO: 2067282 - RNA, 20 nt, Staphylococcus aureus subsp. aureus Mu50
cauuuugacgccagaauaaa

SEQ ID NO: 2067283 - RNA, 23 nt, Staphylococcus aureus subsp. aureus Mu50
cauuuuuauguuaaaucgauacu

SEQ ID NO: 2067284 - RNA, 16 nt, Staphylococcus aureus subsp. aureus Mu50
cauuuuuauaaauuuu

SEQ ID NO: 2067285 - RNA, 20 nt, Staphylococcus aureus subsp. aureus Mu50
cauuuuuauuuaacacuuca

SEQ ID NO: 2067286 - RNA, 14 nt, Staphylococcus aureus subsp. aureus Mu50
cauuuuuaguuaga

SEQ ID NO: 2067287 - RNA, 15 nt, Staphylococcus aureus subsp. aureus Mu50
cauuuuuagaaauag

SEQ ID NO: 2067288 - RNA, 19 nt, Staphylococcus aureus subsp. aureus Mu50
cauuaaguaaucugcaaau

SEQ ID NO: 2067289 - RNA, 18 nt, Staphylococcus aureus subsp. aureus Mu50
cauuaaguacuuuuacaa

SEQ ID NO: 2067290 - RNA, 15 nt, Staphylococcus aureus subsp. aureus Mu50
cauuaauaaauaaua

SEQ ID NO: 2067291 - RNA, 20 nt, Staphylococcus aureus subsp. aureus Mu50
cauuaauacaagucuuuacu

SEQ ID NO: 2067292 - RNA, 16 nt, Staphylococcus aureus subsp. aureus Mu50
cauuaauccuuuauau

SEQ ID NO: 2067293 - RNA, 14 nt, Staphylococcus aureus subsp. aureus Mu50
cauuaauauaaaua

SEQ ID NO: 2067294 - RNA, 17 nt, Staphylococcus aureus subsp. aureus Mu50
cauuaaucuauauaaaa

SEQ ID NO: 2067295 - RNA, 20 nt, Staphylococcus aureus subsp. aureus Mu50
cauuaaucuauauaaaaacu

SEQ ID NO: 2067296 - RNA, 13 nt, Staphylococcus aureus subsp. aureus Mu50
cauuaaauuauua

SEQ ID NO: 2067297 - RNA, 15 nt, Staphylococcus aureus subsp. aureus Mu50
cauuaaggcuuuagu

SEQ ID NO: 2067298 - RNA, 16 nt, Staphylococcus aureus subsp. aureus Mu50
cauuacagauaauuau

SEQ ID NO: 2067299 - RNA, 14 nt, Staphylococcus aureus subsp. aureus Mu50
cauuacagauaauu

SEQ ID NO: 2067300 - RNA, 19 nt, Staphylococcus aureus subsp. aureus Mu50
cauuacauauaucaacaug

SEQ ID NO: 2067301 - RNA, 19 nt, Staphylococcus aureus subsp. aureus Mu50
cauuacauguuacugauga

SEQ ID NO: 2067302 - RNA, 22 nt, Staphylococcus aureus subsp. aureus Mu50
cauuacauuuggcguaaugaua

SEQ ID NO: 2067303 - RNA, 22 nt, Staphylococcus aureus subsp. aureus Mu50
cauuacaaaucaugacauaaaa

SEQ ID NO: 2067304 - RNA, 20 nt, Staphylococcus aureus subsp. aureus Mu50
cauuaauuggauuuuuacaa

SEQ ID NO: 2067305 - RNA, 15 nt, Staphylococcus aureus subsp. aureus Mu50
cauuagcaaauauua

SEQ ID NO: 2067306 - RNA, 16 nt, Staphylococcus aureus subsp. aureus Mu50
cauuagcaugauaaag

SEQ ID NO: 2067307 - RNA, 17 nt, Staphylococcus aureus subsp. aureus Mu50
cauuagcaugauaaagu

SEQ ID NO: 2067308 - RNA, 17 nt, Staphylococcus aureus subsp. aureus Mu50
cauuacccuuuaaacuc

SEQ ID NO: 2067309 - RNA, 22 nt, Staphylococcus aureus subsp. aureus Mu50
caugucuagauuuuaaaucaau

SEQ ID NO: 2067310 - RNA, 19 nt, Staphylococcus aureus subsp. aureus Mu50
cauguuccgcuacaaaaca

SEQ ID NO: 2067311 - RNA, 16 nt, Staphylococcus aureus subsp. aureus Mu50
cauguucuuauaaaaa

SEQ ID NO: 2067312 - RNA, 17 nt, Staphylococcus aureus subsp. aureus Mu50
caugugcuuuguuuauc

SEQ ID NO: 2067313 - RNA, 23 nt, Staphylococcus aureus subsp. aureus Mu50
caugugcuuuguuuaucaauuuc

SEQ ID NO: 2067314 - RNA, 21 nt, Staphylococcus aureus subsp. aureus Mu50
cauuaaaaaaucgaacuagac

SEQ ID NO: 2067315 - RNA, 13 nt, Staphylococcus aureus subsp. aureus Mu50
cauuaaaauaauu

SEQ ID NO: 2067316 - RNA, 14 nt, Staphylococcus aureus subsp. aureus Mu50
cauuaaaauaauua

SEQ ID NO: 2067317 - RNA, 22 nt, Staphylococcus aureus subsp. aureus Mu50
cauuaaaaacgauucauuauau

SEQ ID NO: 2067318 - RNA, 21 nt, Staphylococcus aureus subsp. aureus Mu50
cauuaaaauaauuaaauaaaa

SEQ ID NO: 2067319 - RNA, 12 nt, Staphylococcus aureus subsp. aureus Mu50
cauuaaaaaauc

SEQ ID NO: 2067320 - RNA, 14 nt, Staphylococcus aureus subsp. aureus Mu50
cauuaaaaauaaaa

SEQ ID NO: 2067321 - RNA, 23 nt, Staphylococcus aureus subsp. aureus Mu50
cauuaaaaaaucgaacuagacaa

SEQ ID NO: 2067322 - RNA, 12 nt, Staphylococcus aureus subsp. aureus Mu50
cauuaaaccacu

SEQ ID NO: 2067323 - RNA, 19 nt, Staphylococcus aureus subsp. aureus Mu50
cauguuuggaugaacaaaa

SEQ ID NO: 2067324 - RNA, 19 nt, Staphylococcus aureus subsp. aureus Mu50
caugcaccuuuacaacaua

SEQ ID NO: 2067325 - RNA, 16 nt, Staphylococcus aureus subsp. aureus Mu50
caugcacuuuauuaaa

SEQ ID NO: 2067326 - RNA, 18 nt, Staphylococcus aureus subsp. aureus Mu50
caugaaaaggaaaaacuu

SEQ ID NO: 2067327 - RNA, 18 nt, Staphylococcus aureus subsp. aureus Mu50
caucuuuugguuuaucug

SEQ ID NO: 2067328 - RNA, 19 nt, Staphylococcus aureus subsp. aureus Mu50
caucuuuuugauaauguuc

SEQ ID NO: 2067329 - RNA, 18 nt, Staphylococcus aureus subsp. aureus Mu50
caugcccgauaaaaccac

SEQ ID NO: 2067330 - RNA, 14 nt, Staphylococcus aureus subsp. aureus Mu50
caugccuucaugaa

SEQ ID NO: 2067331 - RNA, 18 nt, Staphylococcus aureus subsp. aureus Mu50
caugcgauugaugcguuu

SEQ ID NO: 2067332 - RNA, 15 nt, Staphylococcus aureus subsp. aureus Mu50
caugcgauucaaucu

SEQ ID NO: 2067333 - RNA, 15 nt, Staphylococcus aureus subsp. aureus Mu50
caugggcuucugcua

SEQ ID NO: 2067334 - RNA, 15 nt, Staphylococcus aureus subsp. aureus Mu50
caugguaucuuuaau

SEQ ID NO: 2067335 - RNA, 17 nt, Staphylococcus aureus subsp. aureus Mu50
cauggaaaagugcgauu

SEQ ID NO: 2067336 - RNA, 12 nt, Staphylococcus aureus subsp. aureus Mu50
cauggaaaagug

SEQ ID NO: 2067337 - RNA, 15 nt, Staphylococcus aureus subsp. aureus Mu50
caugcuuuuaauauu

SEQ ID NO: 2067338 - RNA, 17 nt, Staphylococcus aureus subsp. aureus Mu50
cauacugauuaaacugu

SEQ ID NO: 2067339 - RNA, 18 nt, Staphylococcus aureus subsp. aureus Mu50
cauacuucuauuuuauaa

SEQ ID NO: 2067340 - RNA, 12 nt, Staphylococcus aureus subsp. aureus Mu50
cauacuucaaac

SEQ ID NO: 2067341 - RNA, 16 nt, Staphylococcus aureus subsp. aureus Mu50
cauacucacaaaaaac

SEQ ID NO: 2067342 - RNA, 15 nt, Staphylococcus aureus subsp. aureus Mu50
cauacucacaaaaaa

SEQ ID NO: 2067343 - RNA, 17 nt, Staphylococcus aureus subsp. aureus Mu50
cauaccguacaaaggua

SEQ ID NO: 2067344 - RNA, 17 nt, Staphylococcus aureus subsp. aureus Mu50
cauaccggcaaauaaca

SEQ ID NO: 2067345 - RNA, 17 nt, Staphylococcus aureus subsp. aureus Mu50
cauaccuacaaauaugu

SEQ ID NO: 2067346 - RNA, 20 nt, Staphylococcus aureus subsp. aureus Mu50
cauaccuaauaacgcauaua

SEQ ID NO: 2067347 - RNA, 13 nt, Staphylococcus aureus subsp. aureus Mu50
cauaccuacaaau

SEQ ID NO: 2067348 - RNA, 19 nt, Staphylococcus aureus subsp. aureus Mu50
cauaccuugauuauaugcu

SEQ ID NO: 2067349 - RNA, 17 nt, Staphylococcus aureus subsp. aureus Mu50
cauaccuuuauuauuua

SEQ ID NO: 2067350 - RNA, 17 nt, Staphylococcus aureus subsp. aureus Mu50
cauacccauauuaaauu

SEQ ID NO: 2067351 - RNA, 19 nt, Staphylococcus aureus subsp. aureus Mu50
cauacccauauuaaauuuu

SEQ ID NO: 2067352 - RNA, 21 nt, Staphylococcus aureus subsp. aureus Mu50
cauaccaguggaaauuaugua

SEQ ID NO: 2067353 - RNA, 16 nt, Staphylococcus aureus subsp. aureus Mu50
cauacaggaaauugaa

SEQ ID NO: 2067354 - RNA, 13 nt, Staphylococcus aureus subsp. aureus Mu50
cauacauaugcua

SEQ ID NO: 2067355 - RNA, 15 nt, Staphylococcus aureus subsp. aureus Mu50
cauacauaugcuaua

SEQ ID NO: 2067356 - RNA, 18 nt, Staphylococcus aureus subsp. aureus Mu50
cauaacucaaauaucuaa

SEQ ID NO: 2067357 - RNA, 14 nt, Staphylococcus aureus subsp. aureus Mu50
cauaacugaauaaa

SEQ ID NO: 2067358 - RNA, 22 nt, Staphylococcus aureus subsp. aureus Mu50
cauaaugacaucauguucaugu

SEQ ID NO: 2067359 - RNA, 12 nt, Staphylococcus aureus subsp. aureus Mu50
cauaaucuuuau

SEQ ID NO: 2067360 - RNA, 21 nt, Staphylococcus aureus subsp. aureus Mu50
cauaaugaauaauuaaaaaac

SEQ ID NO: 2067361 - RNA, 20 nt, Staphylococcus aureus subsp. aureus Mu50
cauaaucgggaugauaacca

SEQ ID NO: 2067362 - RNA, 20 nt, Staphylococcus aureus subsp. aureus Mu50
cauaaucucuuuacaccauu

SEQ ID NO: 2067363 - RNA, 19 nt, Staphylococcus aureus subsp. aureus Mu50
caguugacuguaaaacaau

SEQ ID NO: 2067364 - RNA, 14 nt, Staphylococcus aureus subsp. aureus Mu50
caguucuuagauuu

SEQ ID NO: 2067365 - RNA, 15 nt, Staphylococcus aureus subsp. aureus Mu50
caguuaaaucacugc

SEQ ID NO: 2067366 - RNA, 17 nt, Staphylococcus aureus subsp. aureus Mu50
caguguugaauuucaaa

SEQ ID NO: 2067367 - RNA, 14 nt, Staphylococcus aureus subsp. aureus Mu50
caguuguuuuuuug

SEQ ID NO: 2067368 - RNA, 13 nt, Staphylococcus aureus subsp. aureus Mu50
cauaaauauaaaa

SEQ ID NO: 2067369 - RNA, 23 nt, Staphylococcus aureus subsp. aureus Mu50
cauaaaugcuucugguucuucaa

SEQ ID NO: 2067370 - RNA, 15 nt, Staphylococcus aureus subsp. aureus Mu50
cauaaauuagaugaa

SEQ ID NO: 2067371 - RNA, 21 nt, Staphylococcus aureus subsp. aureus Mu50
cauaaauuaggucauuuuuau

SEQ ID NO: 2067372 - RNA, 17 nt, Staphylococcus aureus subsp. aureus Mu50
cauaaaugcuaaaagua

SEQ ID NO: 2067373 - RNA, 18 nt, Staphylococcus aureus subsp. aureus Mu50
cauaacaaaaacaucuac

SEQ ID NO: 2067374 - RNA, 15 nt, Staphylococcus aureus subsp. aureus Mu50
cauaacaaucauuuc

SEQ ID NO: 2067375 - RNA, 15 nt, Staphylococcus aureus subsp. aureus Mu50
caguagucacuguuu

SEQ ID NO: 2067376 - RNA, 21 nt, Staphylococcus aureus subsp. aureus Mu50
caguaguuaauugaaugaaaa

SEQ ID NO: 2067377 - RNA, 15 nt, Staphylococcus aureus subsp. aureus Mu50
caguauauaucaaau

SEQ ID NO: 2067378 - RNA, 21 nt, Staphylococcus aureus subsp. aureus Mu50
caguaguugacugaacgaaaa

SEQ ID NO: 2067379 - RNA, 15 nt, Staphylococcus aureus subsp. aureus Mu50
caguauaauuuucug

SEQ ID NO: 2067380 - RNA, 23 nt, Staphylococcus aureus subsp. aureus Mu50
caguauuugccuuuugaauaauu

SEQ ID NO: 2067381 - RNA, 20 nt, Staphylococcus aureus subsp. aureus Mu50
cagucaauuuuuucaucuuu

SEQ ID NO: 2067382 - RNA, 18 nt, Staphylococcus aureus subsp. aureus Mu50
cagucaauuuuuucaucu

SEQ ID NO: 2067383 - RNA, 14 nt, Staphylococcus aureus subsp. aureus Mu50
cagucaacugcugc

SEQ ID NO: 2067384 - RNA, 15 nt, Staphylococcus aureus subsp. aureus Mu50
cagucaacugcugcu

SEQ ID NO: 2067385 - RNA, 23 nt, Staphylococcus aureus subsp. aureus Mu50
cagucaacugcugcuaaaauaaa

SEQ ID NO: 2067386 - RNA, 12 nt, Staphylococcus aureus subsp. aureus Mu50
cagugaccucag

SEQ ID NO: 2067387 - RNA, 11 nt, Staphylococcus aureus subsp. aureus Mu50
cagugcaauga

SEQ ID NO: 2067388 - RNA, 22 nt, Staphylococcus aureus subsp. aureus Mu50
cagugaaucuaaacuauaauaa

SEQ ID NO: 2067389 - RNA, 16 nt, Staphylococcus aureus subsp. aureus Mu50
cagucaguaaaaauac

SEQ ID NO: 2067390 - RNA, 15 nt, Staphylococcus aureus subsp. aureus Mu50
cagucucuaaaacuu

SEQ ID NO: 2067391 - RNA, 20 nt, Staphylococcus aureus subsp. aureus Mu50
cagucucuaaaacuuuuuca

SEQ ID NO: 2067392 - RNA, 17 nt, Staphylococcus aureus subsp. aureus Mu50
cagucucuuugaagggg

SEQ ID NO: 2067393 - RNA, 10 nt, Staphylococcus aureus subsp. aureus Mu50
caggaaggaa

SEQ ID NO: 2067394 - RNA, 20 nt, Staphylococcus aureus subsp. aureus Mu50
caggaccacucaauucucua

SEQ ID NO: 2067395 - RNA, 21 nt, Staphylococcus aureus subsp. aureus Mu50
caggaauaaauuuugcgaaaa

SEQ ID NO: 2067396 - RNA, 14 nt, Staphylococcus aureus subsp. aureus Mu50
caggaauuguuaaa

SEQ ID NO: 2067397 - RNA, 15 nt, Staphylococcus aureus subsp. aureus Mu50
cagcuucaaaaucaa

SEQ ID NO: 2067398 - RNA, 12 nt, Staphylococcus aureus subsp. aureus Mu50
cagcuucauuaa

SEQ ID NO: 2067399 - RNA, 14 nt, Staphylococcus aureus subsp. aureus Mu50
cagcuucuuuaaca

SEQ ID NO: 2067400 - RNA, 17 nt, Staphylococcus aureus subsp. aureus Mu50
cagcuucuuuaacaauu

SEQ ID NO: 2067401 - RNA, 17 nt, Staphylococcus aureus subsp. aureus Mu50
cagcuguauuuaauaaa

SEQ ID NO: 2067402 - RNA, 14 nt, Staphylococcus aureus subsp. aureus Mu50
cagcuuagcauagc

SEQ ID NO: 2067403 - RNA, 19 nt, Staphylococcus aureus subsp. aureus Mu50
cacuuuaaacaagcaucau

SEQ ID NO: 2067404 - RNA, 16 nt, Staphylococcus aureus subsp. aureus Mu50
cacuuuauaauuuuug

SEQ ID NO: 2067405 - RNA, 17 nt, Staphylococcus aureus subsp. aureus Mu50
cacuuggauucaaauga

SEQ ID NO: 2067406 - RNA, 14 nt, Staphylococcus aureus subsp. aureus Mu50
cacuuuucaugaug

SEQ ID NO: 2067407 - RNA, 14 nt, Staphylococcus aureus subsp. aureus Mu50
cacuuuuguuaaaa

SEQ ID NO: 2067408 - RNA, 16 nt, Staphylococcus aureus subsp. aureus Mu50
cacuuuuguuaaaaaa

SEQ ID NO: 2067409 - RNA, 17 nt, Staphylococcus aureus subsp. aureus Mu50
cacuuuuguuaaaaaau

SEQ ID NO: 2067410 - RNA, 13 nt, Staphylococcus aureus subsp. aureus Mu50
cacuuuuuaaacg

SEQ ID NO: 2067411 - RNA, 15 nt, Staphylococcus aureus subsp. aureus Mu50
cacuuucuacucuga

SEQ ID NO: 2067412 - RNA, 23 nt, Staphylococcus aureus subsp. aureus Mu50
cacuucgccaagccaucuuucuu

SEQ ID NO: 2067413 - RNA, 19 nt, Staphylococcus aureus subsp. aureus Mu50
cacuucgccaagccaucuu

SEQ ID NO: 2067414 - RNA, 23 nt, Staphylococcus aureus subsp. aureus Mu50
cacuucucucuuauuaaaaaaga

SEQ ID NO: 2067415 - RNA, 20 nt, Staphylococcus aureus subsp. aureus Mu50
cacuucaacauauaaaucau

SEQ ID NO: 2067416 - RNA, 14 nt, Staphylococcus aureus subsp. aureus Mu50
cacuuaucaucaca

SEQ ID NO: 2067417 - RNA, 12 nt, Staphylococcus aureus subsp. aureus Mu50
cacuuauuauuu

SEQ ID NO: 2067418 - RNA, 19 nt, Staphylococcus aureus subsp. aureus Mu50
cacuucaaacaaaggggua

SEQ ID NO: 2067419 - RNA, 13 nt, Staphylococcus aureus subsp. aureus Mu50
cacuucaaguuau

SEQ ID NO: 2067420 - RNA, 14 nt, Staphylococcus aureus subsp. aureus Mu50
cacuuauaaacaaa

SEQ ID NO: 2067421 - RNA, 18 nt, Staphylococcus aureus subsp. aureus Mu50
cacuuauaaacaaaagau

SEQ ID NO: 2067422 - RNA, 19 nt, Staphylococcus aureus subsp. aureus Mu50
cacuuacugugaaaauacc

SEQ ID NO: 2067423 - RNA, 21 nt, Staphylococcus aureus subsp. aureus Mu50
cacuuacugugaaaauaccaa

SEQ ID NO: 2067424 - RNA, 20 nt, Staphylococcus aureus subsp. aureus Mu50
cacuucaguuaaaccuucua

SEQ ID NO: 2067425 - RNA, 11 nt, Staphylococcus aureus subsp. aureus Mu50
cacuucauaaa

SEQ ID NO: 2067426 - RNA, 16 nt, Staphylococcus aureus subsp. aureus Mu50
cacuucaguuaaaccu

SEQ ID NO: 2067427 - RNA, 17 nt, Staphylococcus aureus subsp. aureus Mu50
cacuucaguuaaaccuu

SEQ ID NO: 2067428 - RNA, 16 nt, Staphylococcus aureus subsp. aureus Mu50
cacuuaagcuuuaauc

SEQ ID NO: 2067429 - RNA, 14 nt, Staphylococcus aureus subsp. aureus Mu50
cacuuaacucaaag

SEQ ID NO: 2067430 - RNA, 23 nt, Staphylococcus aureus subsp. aureus Mu50
cacuuaaucguucccauucuuug

SEQ ID NO: 2067431 - RNA, 16 nt, Staphylococcus aureus subsp. aureus Mu50
cacuuacugugaaaau

SEQ ID NO: 2067432 - RNA, 22 nt, Staphylococcus aureus subsp. aureus Mu50
cacuuaaucguucccauucuuu

SEQ ID NO: 2067433 - RNA, 16 nt, Staphylococcus aureus subsp. aureus Mu50
cacuuaauauaaggaa

SEQ ID NO: 2067434 - RNA, 16 nt, Staphylococcus aureus subsp. aureus Mu50
caauguuaucuugcuu

SEQ ID NO: 2067435 - RNA, 14 nt, Staphylococcus aureus subsp. aureus Mu50
caauguucaauuca

SEQ ID NO: 2067436 - RNA, 21 nt, Staphylococcus aureus subsp. aureus Mu50
caauguuaggugcuugguuaa

SEQ ID NO: 2067437 - RNA, 17 nt, Staphylococcus aureus subsp. aureus Mu50
caaugugagauauaaag

SEQ ID NO: 2067438 - RNA, 20 nt, Staphylococcus aureus subsp. aureus Mu50
cacugcacaucauaauaaau

SEQ ID NO: 2067439 - RNA, 17 nt, Staphylococcus aureus subsp. aureus Mu50
caauguuuaauuuucua

SEQ ID NO: 2067440 - RNA, 13 nt, Staphylococcus aureus subsp. aureus Mu50
caauguugcuugu

SEQ ID NO: 2067441 - RNA, 16 nt, Staphylococcus aureus subsp. aureus Mu50
cacugccaaucauucg

SEQ ID NO: 2067442 - RNA, 17 nt, Staphylococcus aureus subsp. aureus Mu50
cagaaaugacaucaucu

SEQ ID NO: 2067443 - RNA, 22 nt, Staphylococcus aureus subsp. aureus Mu50
cagaaaugacaucaucuauaau

SEQ ID NO: 2067444 - RNA, 15 nt, Staphylococcus aureus subsp. aureus Mu50
cagaaacccuuggua

SEQ ID NO: 2067445 - RNA, 21 nt, Staphylococcus aureus subsp. aureus Mu50
cagaaacccuugguauaagag

SEQ ID NO: 2067446 - RNA, 20 nt, Staphylococcus aureus subsp. aureus Mu50
cagaaaagggcaaaaaagga

SEQ ID NO: 2067447 - RNA, 21 nt, Staphylococcus aureus subsp. aureus Mu50
cagaagaaaacuauuuuaaaa

SEQ ID NO: 2067448 - RNA, 19 nt, Staphylococcus aureus subsp. aureus Mu50
cagaacuaugaauagauga

SEQ ID NO: 2067449 - RNA, 14 nt, Staphylococcus aureus subsp. aureus Mu50
cagaacuaugaaua

SEQ ID NO: 2067450 - RNA, 15 nt, Staphylococcus aureus subsp. aureus Mu50
cagagaaauucgaaa

SEQ ID NO: 2067451 - RNA, 16 nt, Staphylococcus aureus subsp. aureus Mu50
cagagaaauucgaaaa

SEQ ID NO: 2067452 - RNA, 15 nt, Staphylococcus aureus subsp. aureus Mu50
cagagaauuucgaaa

SEQ ID NO: 2067453 - RNA, 19 nt, Staphylococcus aureus subsp. aureus Mu50
cagagaauuucgaaaagaa

SEQ ID NO: 2067454 - RNA, 17 nt, Staphylococcus aureus subsp. aureus Mu50
cagagccauaaugagag

SEQ ID NO: 2067455 - RNA, 16 nt, Staphylococcus aureus subsp. aureus Mu50
cagacguaucaucaaa

SEQ ID NO: 2067456 - RNA, 14 nt, Staphylococcus aureus subsp. aureus Mu50
cagacgaaucaaag

SEQ ID NO: 2067457 - RNA, 14 nt, Staphylococcus aureus subsp. aureus Mu50
cagauaauuauuuc

SEQ ID NO: 2067458 - RNA, 13 nt, Staphylococcus aureus subsp. aureus Mu50
cagauaauuauuu

SEQ ID NO: 2067459 - RNA, 14 nt, Staphylococcus aureus subsp. aureus Mu50
cagauaauugaaaa

SEQ ID NO: 2067460 - RNA, 23 nt, Staphylococcus aureus subsp. aureus Mu50
cagauagaaugucgauauuucua

SEQ ID NO: 2067461 - RNA, 22 nt, Staphylococcus aureus subsp. aureus Mu50
cagauagaaugucgauauuucu

SEQ ID NO: 2067462 - RNA, 17 nt, Staphylococcus aureus subsp. aureus Mu50
cagauaggaaacuuaaa

SEQ ID NO: 2067463 - RNA, 20 nt, Staphylococcus aureus subsp. aureus Mu50
cagcaaaugcuuaagaaauu

SEQ ID NO: 2067464 - RNA, 11 nt, Staphylococcus aureus subsp. aureus Mu50
cagcaaauaaa

SEQ ID NO: 2067465 - RNA, 17 nt, Staphylococcus aureus subsp. aureus Mu50
cagcacagcgauuaaau

SEQ ID NO: 2067466 - RNA, 14 nt, Staphylococcus aureus subsp. aureus Mu50
cagcacauuuuuag

SEQ ID NO: 2067467 - RNA, 13 nt, Staphylococcus aureus subsp. aureus Mu50
cagauuuuaagug

SEQ ID NO: 2067468 - RNA, 21 nt, Staphylococcus aureus subsp. aureus Mu50
cagauuuuaagugguuaucac

SEQ ID NO: 2067469 - RNA, 23 nt, Staphylococcus aureus subsp. aureus Mu50
cagcaaaaagcccuauuguuuuu

SEQ ID NO: 2067470 - RNA, 15 nt, Staphylococcus aureus subsp. aureus Mu50
cagauuuuaaaaauu

SEQ ID NO: 2067471 - RNA, 21 nt, Staphylococcus aureus subsp. aureus Mu50
cagauuuuaaaaauucauaau

SEQ ID NO: 2067472 - RNA, 17 nt, Staphylococcus aureus subsp. aureus Mu50
cagauguugguucauca

SEQ ID NO: 2067473 - RNA, 22 nt, Staphylococcus aureus subsp. aureus Mu50
cagauucaaacguuuucacuuc

SEQ ID NO: 2067474 - RNA, 17 nt, Staphylococcus aureus subsp. aureus Mu50
cagauucauaucuuuca

SEQ ID NO: 2067475 - RNA, 22 nt, Staphylococcus aureus subsp. aureus Mu50
cagauucauaucuuucaauuaa

SEQ ID NO: 2067476 - RNA, 14 nt, Staphylococcus aureus subsp. aureus Mu50
cagauugauauaaa

SEQ ID NO: 2067477 - RNA, 15 nt, Staphylococcus aureus subsp. aureus Mu50
cagauucuucaccaa

SEQ ID NO: 2067478 - RNA, 21 nt, Staphylococcus aureus subsp. aureus Mu50
cagaugaugcuucgcaucacu

SEQ ID NO: 2067479 - RNA, 13 nt, Staphylococcus aureus subsp. aureus Mu50
cagaugaauaaug

SEQ ID NO: 2067480 - RNA, 16 nt, Staphylococcus aureus subsp. aureus Mu50
cagaugaaccaaaaaa

SEQ ID NO: 2067481 - RNA, 19 nt, Staphylococcus aureus subsp. aureus Mu50
cagcauuaaucguauuuuu

SEQ ID NO: 2067482 - RNA, 17 nt, Staphylococcus aureus subsp. aureus Mu50
cagcauugggacauaaa

SEQ ID NO: 2067483 - RNA, 22 nt, Staphylococcus aureus subsp. aureus Mu50
cagcaguugacuguaaaacaau

SEQ ID NO: 2067484 - RNA, 16 nt, Staphylococcus aureus subsp. aureus Mu50
cagcaguugcacaaau

SEQ ID NO: 2067485 - RNA, 14 nt, Staphylococcus aureus subsp. aureus Mu50
cagcaguaggauaa

SEQ ID NO: 2067486 - RNA, 17 nt, Staphylococcus aureus subsp. aureus Mu50
cagcaguaagauuauuu

SEQ ID NO: 2067487 - RNA, 22 nt, Staphylococcus aureus subsp. aureus Mu50
cagcaccgacaauuauaauaaa

SEQ ID NO: 2067488 - RNA, 20 nt, Staphylococcus aureus subsp. aureus Mu50
cagccgaggcaauauugaac

SEQ ID NO: 2067489 - RNA, 12 nt, Staphylococcus aureus subsp. aureus Mu50
cagcgaaauuug

SEQ ID NO: 2067490 - RNA, 15 nt, Staphylococcus aureus subsp. aureus Mu50
cagccucuauaagua

SEQ ID NO: 2067491 - RNA, 16 nt, Staphylococcus aureus subsp. aureus Mu50
cagcgauuaaaugaug

SEQ ID NO: 2067492 - RNA, 20 nt, Staphylococcus aureus subsp. aureus Mu50
cagcgauaacguacaaugua

SEQ ID NO: 2067493 - RNA, 19 nt, Staphylococcus aureus subsp. aureus Mu50
cagcggaauacagaugaug

SEQ ID NO: 2067494 - RNA, 17 nt, Staphylococcus aureus subsp. aureus Mu50
cagcggaauacagauga

SEQ ID NO: 2067495 - RNA, 13 nt, Staphylococcus aureus subsp. aureus Mu50
caaccaauuauua

SEQ ID NO: 2067496 - RNA, 18 nt, Staphylococcus aureus subsp. aureus Mu50
caaccagucagaaagaau

SEQ ID NO: 2067497 - RNA, 18 nt, Staphylococcus aureus subsp. aureus Mu50
caacaucuuuuguuguuu

SEQ ID NO: 2067498 - RNA, 16 nt, Staphylococcus aureus subsp. aureus Mu50
caacagggguaaaacu

SEQ ID NO: 2067499 - RNA, 16 nt, Staphylococcus aureus subsp. aureus Mu50
caacagggguuuuuau

SEQ ID NO: 2067500 - RNA, 18 nt, Staphylococcus aureus subsp. aureus Mu50
caacagggguuuuuauau

SEQ ID NO: 2067501 - RNA, 22 nt, Staphylococcus aureus subsp. aureus Mu50
caacaugauacguacguugaug

SEQ ID NO: 2067502 - RNA, 20 nt, Staphylococcus aureus subsp. aureus Mu50
caacauugagauuaucuuua

SEQ ID NO: 2067503 - RNA, 13 nt, Staphylococcus aureus subsp. aureus Mu50
caacauuuuuuau

SEQ ID NO: 2067504 - RNA, 23 nt, Staphylococcus aureus subsp. aureus Mu50
caacauuuugauacguaaacacu

SEQ ID NO: 2067505 - RNA, 21 nt, Staphylococcus aureus subsp. aureus Mu50
caacauguuuggaugaacaaa

SEQ ID NO: 2067506 - RNA, 15 nt, Staphylococcus aureus subsp. aureus Mu50
caacauuacaugcac

SEQ ID NO: 2067507 - RNA, 14 nt, Staphylococcus aureus subsp. aureus Mu50
caacauuaaauuau

SEQ ID NO: 2067508 - RNA, 16 nt, Staphylococcus aureus subsp. aureus Mu50
caacauuaaauuauua

SEQ ID NO: 2067509 - RNA, 15 nt, Staphylococcus aureus subsp. aureus Mu50
caacauuaauaaaua

SEQ ID NO: 2067510 - RNA, 14 nt, Staphylococcus aureus subsp. aureus Mu50
caaccucugaugug

SEQ ID NO: 2067511 - RNA, 20 nt, Staphylococcus aureus subsp. aureus Mu50
caacuguaguggaagacaau

SEQ ID NO: 2067512 - RNA, 18 nt, Staphylococcus aureus subsp. aureus Mu50
caacugucgguucaucua

SEQ ID NO: 2067513 - RNA, 18 nt, Staphylococcus aureus subsp. aureus Mu50
caacuuaauacgauaaua

SEQ ID NO: 2067514 - RNA, 13 nt, Staphylococcus aureus subsp. aureus Mu50
caacuuaauaacc

SEQ ID NO: 2067515 - RNA, 22 nt, Staphylococcus aureus subsp. aureus Mu50
caacuuaauaaccauguaaaau

SEQ ID NO: 2067516 - RNA, 16 nt, Staphylococcus aureus subsp. aureus Mu50
caacugcgacaugucc

SEQ ID NO: 2067517 - RNA, 16 nt, Staphylococcus aureus subsp. aureus Mu50
caacugcuuuuuauua

SEQ ID NO: 2067518 - RNA, 13 nt, Staphylococcus aureus subsp. aureus Mu50
caacugaaauuuu

SEQ ID NO: 2067519 - RNA, 16 nt, Staphylococcus aureus subsp. aureus Mu50
caacuaagaugacuga

SEQ ID NO: 2067520 - RNA, 17 nt, Staphylococcus aureus subsp. aureus Mu50
caacuaauaacaaauag

SEQ ID NO: 2067521 - RNA, 18 nt, Staphylococcus aureus subsp. aureus Mu50
caacuaauguuaaaauaa

SEQ ID NO: 2067522 - RNA, 17 nt, Staphylococcus aureus subsp. aureus Mu50
caacuaauuuaaagcau

SEQ ID NO: 2067523 - RNA, 20 nt, Staphylococcus aureus subsp. aureus Mu50
caacuaauuuaaagcaucau

SEQ ID NO: 2067524 - RNA, 19 nt, Staphylococcus aureus subsp. aureus Mu50
caacuacuuaaauuaagaa

SEQ ID NO: 2067525 - RNA, 22 nt, Staphylococcus aureus subsp. aureus Mu50
caacuaauuuaaagcaucauau

SEQ ID NO: 2067526 - RNA, 20 nt, Staphylococcus aureus subsp. aureus Mu50
caacaauugcuaauccauac

SEQ ID NO: 2067527 - RNA, 12 nt, Staphylococcus aureus subsp. aureus Mu50
caacacagagaa

SEQ ID NO: 2067528 - RNA, 23 nt, Staphylococcus aureus subsp. aureus Mu50
caaauuggauaauuucuucuucu

SEQ ID NO: 2067529 - RNA, 21 nt, Staphylococcus aureus subsp. aureus Mu50
caaauugcaauggcaaccuuu

SEQ ID NO: 2067530 - RNA, 17 nt, Staphylococcus aureus subsp. aureus Mu50
caaauugccuuucauuu

SEQ ID NO: 2067531 - RNA, 19 nt, Staphylococcus aureus subsp. aureus Mu50
caaauuuaggcaugucaaa

SEQ ID NO: 2067532 - RNA, 21 nt, Staphylococcus aureus subsp. aureus Mu50
caaauuucucuuucaagaccu

SEQ ID NO: 2067533 - RNA, 22 nt, Staphylococcus aureus subsp. aureus Mu50
caacacagaggcugguggaaag

SEQ ID NO: 2067534 - RNA, 13 nt, Staphylococcus aureus subsp. aureus Mu50
caacacagagaau

SEQ ID NO: 2067535 - RNA, 16 nt, Staphylococcus aureus subsp. aureus Mu50
caacacagagaauuuc

SEQ ID NO: 2067536 - RNA, 15 nt, Staphylococcus aureus subsp. aureus Mu50
caaaugcaauaggau

SEQ ID NO: 2067537 - RNA, 23 nt, Staphylococcus aureus subsp. aureus Mu50
caaaugccgcuucuaauuuuuca

SEQ ID NO: 2067538 - RNA, 15 nt, Staphylococcus aureus subsp. aureus Mu50
caaauuacaaauuau

SEQ ID NO: 2067539 - RNA, 20 nt, Staphylococcus aureus subsp. aureus Mu50
caaauuacacccuuuaaauu

SEQ ID NO: 2067540 - RNA, 14 nt, Staphylococcus aureus subsp. aureus Mu50
caaauuauaaauuu

SEQ ID NO: 2067541 - RNA, 22 nt, Staphylococcus aureus subsp. aureus Mu50
caaauuacugucuuuccauaau

SEQ ID NO: 2067542 - RNA, 15 nt, Staphylococcus aureus subsp. aureus Mu50
caaauugcaaaguaa

SEQ ID NO: 2067543 - RNA, 17 nt, Staphylococcus aureus subsp. aureus Mu50
caaauugacgcauuaau

SEQ ID NO: 2067544 - RNA, 17 nt, Staphylococcus aureus subsp. aureus Mu50
caaauauaauguauaaa

SEQ ID NO: 2067545 - RNA, 21 nt, Staphylococcus aureus subsp. aureus Mu50
caaauauaauguauaaaacag

SEQ ID NO: 2067546 - RNA, 20 nt, Staphylococcus aureus subsp. aureus Mu50
caaauauaucuagccugaaa

SEQ ID NO: 2067547 - RNA, 17 nt, Staphylococcus aureus subsp. aureus Mu50
caaauauacuuuuacca

SEQ ID NO: 2067548 - RNA, 23 nt, Staphylococcus aureus subsp. aureus Mu50
caaaucggcuauacauugauaaa

SEQ ID NO: 2067549 - RNA, 19 nt, Staphylococcus aureus subsp. aureus Mu50
caaaucggaauaaaauaaa

SEQ ID NO: 2067550 - RNA, 21 nt, Staphylococcus aureus subsp. aureus Mu50
caaaucguuucaugcacuuua

SEQ ID NO: 2067551 - RNA, 14 nt, Staphylococcus aureus subsp. aureus Mu50
caaaugacauuuua

SEQ ID NO: 2067552 - RNA, 22 nt, Staphylococcus aureus subsp. aureus Mu50
caaagacauacagucaauacaa

SEQ ID NO: 2067553 - RNA, 19 nt, Staphylococcus aureus subsp. aureus Mu50
caaagacauacagucaaua

SEQ ID NO: 2067554 - RNA, 20 nt, Staphylococcus aureus subsp. aureus Mu50
caaagacacggccugcaagu

SEQ ID NO: 2067555 - RNA, 15 nt, Staphylococcus aureus subsp. aureus Mu50
caaagaauuucgaaa

SEQ ID NO: 2067556 - RNA, 16 nt, Staphylococcus aureus subsp. aureus Mu50
caaagaauuucgaaaa

SEQ ID NO: 2067557 - RNA, 20 nt, Staphylococcus aureus subsp. aureus Mu50
caaagaauuucgaaaagaaa

SEQ ID NO: 2067558 - RNA, 23 nt, Staphylococcus aureus subsp. aureus Mu50
caaagaauuucgaaaagaaauuc

SEQ ID NO: 2067559 - RNA, 22 nt, Staphylococcus aureus subsp. aureus Mu50
caaagcccuaagcucguuaauu

SEQ ID NO: 2067560 - RNA, 20 nt, Staphylococcus aureus subsp. aureus Mu50
caaaaggauaagaacgagaa

SEQ ID NO: 2067561 - RNA, 16 nt, Staphylococcus aureus subsp. aureus Mu50
caaaagcguucaauuu

SEQ ID NO: 2067562 - RNA, 15 nt, Staphylococcus aureus subsp. aureus Mu50
caaaagcgcaggcga

SEQ ID NO: 2067563 - RNA, 22 nt, Staphylococcus aureus subsp. aureus Mu50
caaagaaauguaugauauaaac

SEQ ID NO: 2067564 - RNA, 20 nt, Staphylococcus aureus subsp. aureus Mu50
caaagaaagcuaauaucaau

SEQ ID NO: 2067565 - RNA, 14 nt, Staphylococcus aureus subsp. aureus Mu50
caaauaguucaaau

SEQ ID NO: 2067566 - RNA, 14 nt, Staphylococcus aureus subsp. aureus Mu50
caaauacaguugua

SEQ ID NO: 2067567 - RNA, 16 nt, Staphylococcus aureus subsp. aureus Mu50
caaauacauuucaaaa

SEQ ID NO: 2067568 - RNA, 17 nt, Staphylococcus aureus subsp. aureus Mu50
caaauacaucaauuucu

SEQ ID NO: 2067569 - RNA, 18 nt, Staphylococcus aureus subsp. aureus Mu50
caaauacauaaucauugu

SEQ ID NO: 2067570 - RNA, 21 nt, Staphylococcus aureus subsp. aureus Mu50
caaauacauaaucauugugua

SEQ ID NO: 2067571 - RNA, 13 nt, Staphylococcus aureus subsp. aureus Mu50
caaauaaugaaua

SEQ ID NO: 2067572 - RNA, 19 nt, Staphylococcus aureus subsp. aureus Mu50
caaauaaaacgcuucauau

SEQ ID NO: 2067573 - RNA, 12 nt, Staphylococcus aureus subsp. aureus Mu50
caaauaaaauca

SEQ ID NO: 2067574 - RNA, 17 nt, Staphylococcus aureus subsp. aureus Mu50
caaauaaacacaucuau

SEQ ID NO: 2067575 - RNA, 16 nt, Staphylococcus aureus subsp. aureus Mu50
caaagugcaauuauuu

SEQ ID NO: 2067576 - RNA, 17 nt, Staphylococcus aureus subsp. aureus Mu50
caaagucauuaaaugua

SEQ ID NO: 2067577 - RNA, 23 nt, Staphylococcus aureus subsp. aureus Mu50
caaagguuuacuauuaaaggaaa

SEQ ID NO: 2067578 - RNA, 19 nt, Staphylococcus aureus subsp. aureus Mu50
caaaguaccaucucuauuu

SEQ ID NO: 2067579 - RNA, 20 nt, Staphylococcus aureus subsp. aureus Mu50
caaaguaccaucucuauuuu

SEQ ID NO: 2067580 - RNA, 22 nt, Staphylococcus aureus subsp. aureus Mu50
caaaguaacaugugcaaguaua

SEQ ID NO: 2067581 - RNA, 17 nt, Staphylococcus aureus subsp. aureus Mu50
caaaguacaguuagugg

SEQ ID NO: 2067582 - RNA, 18 nt, Staphylococcus aureus subsp. aureus Mu50
caaaguagauauugaaug

SEQ ID NO: 2067583 - RNA, 17 nt, Staphylococcus aureus subsp. aureus Mu50
caaaguagacauugaau

SEQ ID NO: 2067584 - RNA, 19 nt, Staphylococcus aureus subsp. aureus Mu50
caagguaguuggcugauag

SEQ ID NO: 2067585 - RNA, 15 nt, Staphylococcus aureus subsp. aureus Mu50
caagccaagauaaau

SEQ ID NO: 2067586 - RNA, 14 nt, Staphylococcus aureus subsp. aureus Mu50
caagcaucaugaaa

SEQ ID NO: 2067587 - RNA, 14 nt, Staphylococcus aureus subsp. aureus Mu50
caacuucauuaguu

SEQ ID NO: 2067588 - RNA, 15 nt, Staphylococcus aureus subsp. aureus Mu50
caacuuauucuucac

SEQ ID NO: 2067589 - RNA, 13 nt, Staphylococcus aureus subsp. aureus Mu50
caacuuagcuuag

SEQ ID NO: 2067590 - RNA, 15 nt, Staphylococcus aureus subsp. aureus Mu50
caacuuauaauauua

SEQ ID NO: 2067591 - RNA, 14 nt, Staphylococcus aureus subsp. aureus Mu50
caauagccauuucc

SEQ ID NO: 2067592 - RNA, 14 nt, Staphylococcus aureus subsp. aureus Mu50
caauacuacuuaau

SEQ ID NO: 2067593 - RNA, 15 nt, Staphylococcus aureus subsp. aureus Mu50
caauacguuuccaau

SEQ ID NO: 2067594 - RNA, 15 nt, Staphylococcus aureus subsp. aureus Mu50
caauacaaagaauua

SEQ ID NO: 2067595 - RNA, 20 nt, Staphylococcus aureus subsp. aureus Mu50
caauacaaagaauuauguau

SEQ ID NO: 2067596 - RNA, 14 nt, Staphylococcus aureus subsp. aureus Mu50
caauaauuuuaucu

SEQ ID NO: 2067597 - RNA, 19 nt, Staphylococcus aureus subsp. aureus Mu50
caauacagaacuuuaauaa

SEQ ID NO: 2067598 - RNA, 24 nt, Staphylococcus aureus subsp. aureus Mu50
caauaauugaugaaagacugacua

SEQ ID NO: 2067599 - RNA, 19 nt, Staphylococcus aureus subsp. aureus Mu50
caauagugugcaaguuggc

SEQ ID NO: 2067600 - RNA, 16 nt, Staphylococcus aureus subsp. aureus Mu50
caauaguauaaauauc

SEQ ID NO: 2067601 - RNA, 15 nt, Staphylococcus aureus subsp. aureus Mu50
caauaggaugaaacu

SEQ ID NO: 2067602 - RNA, 18 nt, Staphylococcus aureus subsp. aureus Mu50
caauagguacaacuaaau

SEQ ID NO: 2067603 - RNA, 21 nt, Staphylococcus aureus subsp. aureus Mu50
caauaucuucuaauuccauca

SEQ ID NO: 2067604 - RNA, 19 nt, Staphylococcus aureus subsp. aureus Mu50
caauaucaucauuuaaaua

SEQ ID NO: 2067605 - RNA, 14 nt, Staphylococcus aureus subsp. aureus Mu50
caauaucauauuug

SEQ ID NO: 2067606 - RNA, 22 nt, Staphylococcus aureus subsp. aureus Mu50
caauaauaaaccuaaagauaua

SEQ ID NO: 2067607 - RNA, 23 nt, Staphylococcus aureus subsp. aureus Mu50
caauaacaggugcuuacuuuuaa

SEQ ID NO: 2067608 - RNA, 23 nt, Staphylococcus aureus subsp. aureus Mu50
caauaacaccuguuacuugagaa

SEQ ID NO: 2067609 - RNA, 17 nt, Staphylococcus aureus subsp. aureus Mu50
caauaacaccaauugaa

SEQ ID NO: 2067610 - RNA, 12 nt, Staphylococcus aureus subsp. aureus Mu50
caauaaaucuuu

SEQ ID NO: 2067611 - RNA, 15 nt, Staphylococcus aureus subsp. aureus Mu50
caauaaauuaugaaa

SEQ ID NO: 2067612 - RNA, 23 nt, Staphylococcus aureus subsp. aureus Mu50
caauaaauuucaagguauacaca

SEQ ID NO: 2067613 - RNA, 16 nt, Staphylococcus aureus subsp. aureus Mu50
caauaaauaaacaacu

SEQ ID NO: 2067614 - RNA, 19 nt, Staphylococcus aureus subsp. aureus Mu50
caauaaaucaguaguuuua

SEQ ID NO: 2067615 - RNA, 13 nt, Staphylococcus aureus subsp. aureus Mu50
caaguccaaauaa

SEQ ID NO: 2067616 - RNA, 20 nt, Staphylococcus aureus subsp. aureus Mu50
caaguagucuacaguaaauu

SEQ ID NO: 2067617 - RNA, 19 nt, Staphylococcus aureus subsp. aureus Mu50
caaguuuauaaucuuuuuu

SEQ ID NO: 2067618 - RNA, 13 nt, Staphylococcus aureus subsp. aureus Mu50
caauaaaaugcaa

SEQ ID NO: 2067619 - RNA, 21 nt, Staphylococcus aureus subsp. aureus Mu50
caauaaaauuggaacacgaaa

SEQ ID NO: 2067620 - RNA, 20 nt, Staphylococcus aureus subsp. aureus Mu50
caauaaaaugcaauuuuuca

SEQ ID NO: 2067621 - RNA, 21 nt, Staphylococcus aureus subsp. aureus Mu50
caauguaacuuggcuuaaucu

SEQ ID NO: 2067622 - RNA, 22 nt, Staphylococcus aureus subsp. aureus Mu50
caauguaacuuggcuuaaucuc

SEQ ID NO: 2067623 - RNA, 15 nt, Staphylococcus aureus subsp. aureus Mu50
caauggaucuguuac

SEQ ID NO: 2067624 - RNA, 16 nt, Staphylococcus aureus subsp. aureus Mu50
caaugcgcaaugaaaa

SEQ ID NO: 2067625 - RNA, 17 nt, Staphylococcus aureus subsp. aureus Mu50
caaugacagcagacuuc

SEQ ID NO: 2067626 - RNA, 16 nt, Staphylococcus aureus subsp. aureus Mu50
caaugaauaaauugau

SEQ ID NO: 2067627 - RNA, 19 nt, Staphylococcus aureus subsp. aureus Mu50
caaugacugagaaaaauau

SEQ ID NO: 2067628 - RNA, 16 nt, Staphylococcus aureus subsp. aureus Mu50
caaugcauccaaauau

SEQ ID NO: 2067629 - RNA, 15 nt, Staphylococcus aureus subsp. aureus Mu50
caaugauuuuuaaaa

SEQ ID NO: 2067630 - RNA, 18 nt, Staphylococcus aureus subsp. aureus Mu50
caaugauuuuuaaaaaua

SEQ ID NO: 2067631 - RNA, 14 nt, Staphylococcus aureus subsp. aureus Mu50
caaugauuuuauaa

SEQ ID NO: 2067632 - RNA, 15 nt, Staphylococcus aureus subsp. aureus Mu50
caaugcaaguuggcg

SEQ ID NO: 2067633 - RNA, 20 nt, Staphylococcus aureus subsp. aureus Mu50
caaugagcaagucuucuaaa

SEQ ID NO: 2067634 - RNA, 17 nt, Staphylococcus aureus subsp. aureus Mu50
caaugaggauuguguaa

SEQ ID NO: 2067635 - RNA, 22 nt, Staphylococcus aureus subsp. aureus Mu50
caaugagcaucuugucuaguuc

SEQ ID NO: 2067636 - RNA, 13 nt, Staphylococcus aureus subsp. aureus Mu50
caaugagcaucuu

SEQ ID NO: 2067637 - RNA, 18 nt, Staphylococcus aureus subsp. aureus Mu50
caaugauugaauauuguu

SEQ ID NO: 2067638 - RNA, 18 nt, Staphylococcus aureus subsp. aureus Mu50
caaucauuguaaaugauc

SEQ ID NO: 2067639 - RNA, 23 nt, Staphylococcus aureus subsp. aureus Mu50
caaucauaccggcaaauaacaau

SEQ ID NO: 2067640 - RNA, 15 nt, Staphylococcus aureus subsp. aureus Mu50
caaucauucacuuca

SEQ ID NO: 2067641 - RNA, 12 nt, Staphylococcus aureus subsp. aureus Mu50
caauauuucuug

SEQ ID NO: 2067642 - RNA, 22 nt, Staphylococcus aureus subsp. aureus Mu50
caauauuugauaaguagaaaau

SEQ ID NO: 2067643 - RNA, 17 nt, Staphylococcus aureus subsp. aureus Mu50
caauauuuaucaauaaa

SEQ ID NO: 2067644 - RNA, 20 nt, Staphylococcus aureus subsp. aureus Mu50
caauauuuauauuaaauacu

SEQ ID NO: 2067645 - RNA, 14 nt, Staphylococcus aureus subsp. aureus Mu50
caauauugaacaau

SEQ ID NO: 2067646 - RNA, 21 nt, Staphylococcus aureus subsp. aureus Mu50
caaucaucgcaaauacauaau

SEQ ID NO: 2067647 - RNA, 19 nt, Staphylococcus aureus subsp. aureus Mu50
caaucgcuuuagcaauuga

SEQ ID NO: 2067648 - RNA, 19 nt, Staphylococcus aureus subsp. aureus Mu50
caaucgcauuuuguuucaa

SEQ ID NO: 2067649 - RNA, 21 nt, Staphylococcus aureus subsp. aureus Mu50
caaucguugaaaaauauccug

SEQ ID NO: 2067650 - RNA, 23 nt, Staphylococcus aureus subsp. aureus Mu50
caaucguugaagauguauuuggc

SEQ ID NO: 2067651 - RNA, 13 nt, Staphylococcus aureus subsp. aureus Mu50
caaucguuaauuu

SEQ ID NO: 2067652 - RNA, 13 nt, Staphylococcus aureus subsp. aureus Mu50
caaucuauauaaa

SEQ ID NO: 2067653 - RNA, 23 nt, Staphylococcus aureus subsp. aureus Mu50
auuuuuuaaaugcguaguauaaa

SEQ ID NO: 2067654 - RNA, 18 nt, Staphylococcus aureus subsp. aureus Mu50
auuuuuuagacaaauguu

SEQ ID NO: 2067655 - RNA, 17 nt, Staphylococcus aureus subsp. aureus Mu50
auuuuuuaaugucuaaa

SEQ ID NO: 2067656 - RNA, 14 nt, Staphylococcus aureus subsp. aureus Mu50
auuuuugauuuaau

SEQ ID NO: 2067657 - RNA, 17 nt, Staphylococcus aureus subsp. aureus Mu50
auuuuugauaacuguaa

SEQ ID NO: 2067658 - RNA, 15 nt, Staphylococcus aureus subsp. aureus Mu50
auuuuugaguaauuu

SEQ ID NO: 2067659 - RNA, 19 nt, Staphylococcus aureus subsp. aureus Mu50
auuuuugaguaauuuaauc

SEQ ID NO: 2067660 - RNA, 21 nt, Staphylococcus aureus subsp. aureus Mu50
auuuuucuucaguuaaaucuu

SEQ ID NO: 2067661 - RNA, 19 nt, Staphylococcus aureus subsp. aureus Mu50
auuuuugacuguuaaacaa

SEQ ID NO: 2067662 - RNA, 15 nt, Staphylococcus aureus subsp. aureus Mu50
auuuuuaaauuacua

SEQ ID NO: 2067663 - RNA, 21 nt, Staphylococcus aureus subsp. aureus Mu50
auuuuuaaaaaccuagggaua

SEQ ID NO: 2067664 - RNA, 15 nt, Staphylococcus aureus subsp. aureus Mu50
auuuuguuuugcuuc

SEQ ID NO: 2067665 - RNA, 19 nt, Staphylococcus aureus subsp. aureus Mu50
auuuuucuaaaugauuuau

SEQ ID NO: 2067666 - RNA, 12 nt, Staphylococcus aureus subsp. aureus Mu50
auuuuuuuaugc

SEQ ID NO: 2067667 - RNA, 18 nt, Staphylococcus aureus subsp. aureus Mu50
auuuuuuucacuaauuuc

SEQ ID NO: 2067668 - RNA, 11 nt, Staphylococcus aureus subsp. aureus Mu50
auuuuuuuagg

SEQ ID NO: 2067669 - RNA, 21 nt, Staphylococcus aureus subsp. aureus Mu50
auuuuuuuaaaucuauauaaa

SEQ ID NO: 2067670 - RNA, 14 nt, Staphylococcus aureus subsp. aureus Mu50
auuuuuugauaugg

SEQ ID NO: 2067671 - RNA, 12 nt, Staphylococcus aureus subsp. aureus Mu50
auuuuuuuaaau

SEQ ID NO: 2067672 - RNA, 12 nt, Staphylococcus aureus subsp. aureus Mu50
auuuuuuuaaag

SEQ ID NO: 2067673 - RNA, 17 nt, Staphylococcus aureus subsp. aureus Mu50
auuuuuuggucaccaaa

SEQ ID NO: 2067674 - RNA, 20 nt, Staphylococcus aureus subsp. aureus Mu50
auuuuuuauuccgaacaugu

SEQ ID NO: 2067675 - RNA, 17 nt, Staphylococcus aureus subsp. aureus Mu50
auuuuuucguuuuaaua

SEQ ID NO: 2067676 - RNA, 21 nt, Staphylococcus aureus subsp. aureus Mu50
auuuuuucuauggcacaaaug

SEQ ID NO: 2067677 - RNA, 14 nt, Staphylococcus aureus subsp. aureus Mu50
auuuuuuuguucuu

SEQ ID NO: 2067678 - RNA, 22 nt, Staphylococcus aureus subsp. aureus Mu50
auuuuuuucguaacauuuaaaa

SEQ ID NO: 2067679 - RNA, 23 nt, Staphylococcus aureus subsp. aureus Mu50
auuuuuuucguaacauuuaaaaa

SEQ ID NO: 2067680 - RNA, 14 nt, Staphylococcus aureus subsp. aureus Mu50
auuuuuuuccuuuc

SEQ ID NO: 2067681 - RNA, 15 nt, Staphylococcus aureus subsp. aureus Mu50
auuuuuuucuuucuu

SEQ ID NO: 2067682 - RNA, 20 nt, Staphylococcus aureus subsp. aureus Mu50
caaaaaaagacacaucacua

SEQ ID NO: 2067683 - RNA, 21 nt, Staphylococcus aureus subsp. aureus Mu50
caaaaauaauuaugaaaagua

SEQ ID NO: 2067684 - RNA, 14 nt, Staphylococcus aureus subsp. aureus Mu50
caaaaauaaaaaug

SEQ ID NO: 2067685 - RNA, 17 nt, Staphylococcus aureus subsp. aureus Mu50
caaaaaucauccauaaa

SEQ ID NO: 2067686 - RNA, 21 nt, Staphylococcus aureus subsp. aureus Mu50
caaaaauagauugaaaaaaua

SEQ ID NO: 2067687 - RNA, 21 nt, Staphylococcus aureus subsp. aureus Mu50
caaaaaugaagaauacaaaua

SEQ ID NO: 2067688 - RNA, 11 nt, Staphylococcus aureus subsp. aureus Mu50
caaaaagaauu

SEQ ID NO: 2067689 - RNA, 13 nt, Staphylococcus aureus subsp. aureus Mu50
caaaaagaauuuc

SEQ ID NO: 2067690 - RNA, 15 nt, Staphylococcus aureus subsp. aureus Mu50
caaaaaauaaaaacu

SEQ ID NO: 2067691 - RNA, 12 nt, Staphylococcus aureus subsp. aureus Mu50
caaaaaaugaau

SEQ ID NO: 2067692 - RNA, 22 nt, Staphylococcus aureus subsp. aureus Mu50
caaaacuagcaguaauauguug

SEQ ID NO: 2067693 - RNA, 20 nt, Staphylococcus aureus subsp. aureus Mu50
caaaagaaaguuaauuaugu

SEQ ID NO: 2067694 - RNA, 16 nt, Staphylococcus aureus subsp. aureus Mu50
caaaacuugcgcaugc

SEQ ID NO: 2067695 - RNA, 21 nt, Staphylococcus aureus subsp. aureus Mu50
caaaacaauuuaaaaagcagu

SEQ ID NO: 2067696 - RNA, 15 nt, Staphylococcus aureus subsp. aureus Mu50
caaaacaaaaaauau

SEQ ID NO: 2067697 - RNA, 19 nt, Staphylococcus aureus subsp. aureus Mu50
caaaacaaaaaauaucuuu

SEQ ID NO: 2067698 - RNA, 13 nt, Staphylococcus aureus subsp. aureus Mu50
caaaacaaaaaau

SEQ ID NO: 2067699 - RNA, 22 nt, Staphylococcus aureus subsp. aureus Mu50
caaaacaaaaaauaucuuuuug

SEQ ID NO: 2067700 - RNA, 21 nt, Staphylococcus aureus subsp. aureus Mu50
caaaaccaauuaauuguaaag

SEQ ID NO: 2067701 - RNA, 14 nt, Staphylococcus aureus subsp. aureus Mu50
caaaaccaaaugaa

SEQ ID NO: 2067702 - RNA, 15 nt, Staphylococcus aureus subsp. aureus Mu50
caaaaccaaaugaac

SEQ ID NO: 2067703 - RNA, 13 nt, Staphylococcus aureus subsp. aureus Mu50
caaaacauuuugu

SEQ ID NO: 2067704 - RNA, 18 nt, Staphylococcus aureus subsp. aureus Mu50
caaaacauuuugugacuu

SEQ ID NO: 2067705 - RNA, 23 nt, Staphylococcus aureus subsp. aureus Mu50
auuugccccgccauucauaaaug

SEQ ID NO: 2067706 - RNA, 20 nt, Staphylococcus aureus subsp. aureus Mu50
auuugauuuaaaaaguuaau

SEQ ID NO: 2067707 - RNA, 21 nt, Staphylococcus aureus subsp. aureus Mu50
auuugccccgccauucauaaa

SEQ ID NO: 2067708 - RNA, 21 nt, Staphylococcus aureus subsp. aureus Mu50
auuugaucaaccuguucuuua

SEQ ID NO: 2067709 - RNA, 16 nt, Staphylococcus aureus subsp. aureus Mu50
auuugauaaauaaaau

SEQ ID NO: 2067710 - RNA, 13 nt, Staphylococcus aureus subsp. aureus Mu50
auuugauacaacu

SEQ ID NO: 2067711 - RNA, 21 nt, Staphylococcus aureus subsp. aureus Mu50
auuuggaugguaaguauaauu

SEQ ID NO: 2067712 - RNA, 20 nt, Staphylococcus aureus subsp. aureus Mu50
auuugggucguuagaugaau

SEQ ID NO: 2067713 - RNA, 16 nt, Staphylococcus aureus subsp. aureus Mu50
auuuggguaauguuuu

SEQ ID NO: 2067714 - RNA, 21 nt, Staphylococcus aureus subsp. aureus Mu50
auuuguucaaugauuuuauaa

SEQ ID NO: 2067715 - RNA, 19 nt, Staphylococcus aureus subsp. aureus Mu50
auuuguuaugguauuuaua

SEQ ID NO: 2067716 - RNA, 23 nt, Staphylococcus aureus subsp. aureus Mu50
auuuguguuuuuaauguuugcuu

SEQ ID NO: 2067717 - RNA, 14 nt, Staphylococcus aureus subsp. aureus Mu50
auuuguuaaauuca

SEQ ID NO: 2067718 - RNA, 18 nt, Staphylococcus aureus subsp. aureus Mu50
auuuguuaauuuaauaau

SEQ ID NO: 2067719 - RNA, 19 nt, Staphylococcus aureus subsp. aureus Mu50
auuuguuaauuuaauaauu

SEQ ID NO: 2067720 - RNA, 22 nt, Staphylococcus aureus subsp. aureus Mu50
auuuuaaacaugaacaaucaga

SEQ ID NO: 2067721 - RNA, 20 nt, Staphylococcus aureus subsp. aureus Mu50
auuuuaaaccguuauauauu

SEQ ID NO: 2067722 - RNA, 13 nt, Staphylococcus aureus subsp. aureus Mu50
auuuguugauagu

SEQ ID NO: 2067723 - RNA, 15 nt, Staphylococcus aureus subsp. aureus Mu50
auuuguguauaaaug

SEQ ID NO: 2067724 - RNA, 19 nt, Staphylococcus aureus subsp. aureus Mu50
auuugugguaaucauguaa

SEQ ID NO: 2067725 - RNA, 17 nt, Staphylococcus aureus subsp. aureus Mu50
auuuguggaaauaaaac

SEQ ID NO: 2067726 - RNA, 17 nt, Staphylococcus aureus subsp. aureus Mu50
auuuguauagauuguau

SEQ ID NO: 2067727 - RNA, 20 nt, Staphylococcus aureus subsp. aureus Mu50
auuuggucauagaaauuuua

SEQ ID NO: 2067728 - RNA, 13 nt, Staphylococcus aureus subsp. aureus Mu50
auuuggucaaguu

SEQ ID NO: 2067729 - RNA, 19 nt, Staphylococcus aureus subsp. aureus Mu50
auuuggucauagaaauuuu

SEQ ID NO: 2067730 - RNA, 23 nt, Staphylococcus aureus subsp. aureus Mu50
auuugaacgagcaccuuuugcuu

SEQ ID NO: 2067731 - RNA, 16 nt, Staphylococcus aureus subsp. aureus Mu50
auuugaaagacauuua

SEQ ID NO: 2067732 - RNA, 16 nt, Staphylococcus aureus subsp. aureus Mu50
auuugaacaucauuua

SEQ ID NO: 2067733 - RNA, 14 nt, Staphylococcus aureus subsp. aureus Mu50
auuugaaaauauua

SEQ ID NO: 2067734 - RNA, 22 nt, Staphylococcus aureus subsp. aureus Mu50
auuugaaaauauuacuaacaac

SEQ ID NO: 2067735 - RNA, 18 nt, Staphylococcus aureus subsp. aureus Mu50
auuucuucauuaucaaua

SEQ ID NO: 2067736 - RNA, 19 nt, Staphylococcus aureus subsp. aureus Mu50
auuucuugauggauauuca

SEQ ID NO: 2067737 - RNA, 21 nt, Staphylococcus aureus subsp. aureus Mu50
auuucuauuuauugagauaga

SEQ ID NO: 2067738 - RNA, 18 nt, Staphylococcus aureus subsp. aureus Mu50
auuucuaaaccauuuuca

SEQ ID NO: 2067739 - RNA, 20 nt, Staphylococcus aureus subsp. aureus Mu50
auuucuaaauuauuuauuca

SEQ ID NO: 2067740 - RNA, 13 nt, Staphylococcus aureus subsp. aureus Mu50
auuucuaaauuau

SEQ ID NO: 2067741 - RNA, 23 nt, Staphylococcus aureus subsp. aureus Mu50
auuucucauacuauaagcaauuu

SEQ ID NO: 2067742 - RNA, 18 nt, Staphylococcus aureus subsp. aureus Mu50
auuucaugugcaagcuuu

SEQ ID NO: 2067743 - RNA, 21 nt, Staphylococcus aureus subsp. aureus Mu50
auuucaugugcaagcuuuuua

SEQ ID NO: 2067744 - RNA, 17 nt, Staphylococcus aureus subsp. aureus Mu50
auuuucuggccacuaau

SEQ ID NO: 2067745 - RNA, 20 nt, Staphylococcus aureus subsp. aureus Mu50
auuuucuucaccaguuucug

SEQ ID NO: 2067746 - RNA, 20 nt, Staphylococcus aureus subsp. aureus Mu50
auuuucuuagaaaaucaagu

SEQ ID NO: 2067747 - RNA, 21 nt, Staphylococcus aureus subsp. aureus Mu50
auuuucuuagaaaaucaaguu

SEQ ID NO: 2067748 - RNA, 14 nt, Staphylococcus aureus subsp. aureus Mu50
auuuucuguccaaa

SEQ ID NO: 2067749 - RNA, 22 nt, Staphylococcus aureus subsp. aureus Mu50
auuuugagucguagauacuacc

SEQ ID NO: 2067750 - RNA, 14 nt, Staphylococcus aureus subsp. aureus Mu50
auuuugaguauuug

SEQ ID NO: 2067751 - RNA, 19 nt, Staphylococcus aureus subsp. aureus Mu50
auuuugagucguagauacu

SEQ ID NO: 2067752 - RNA, 14 nt, Staphylococcus aureus subsp. aureus Mu50
auuuugugaauuua

SEQ ID NO: 2067753 - RNA, 19 nt, Staphylococcus aureus subsp. aureus Mu50
auuuugucuuuuauauuuu

SEQ ID NO: 2067754 - RNA, 14 nt, Staphylococcus aureus subsp. aureus Mu50
auuuuguauuuuuc

SEQ ID NO: 2067755 - RNA, 23 nt, Staphylococcus aureus subsp. aureus Mu50
auuuuguuaauaagcgcaucccu

SEQ ID NO: 2067756 - RNA, 23 nt, Staphylococcus aureus subsp. aureus Mu50
auuuuguucaguuaaaucuguau

SEQ ID NO: 2067757 - RNA, 12 nt, Staphylococcus aureus subsp. aureus Mu50
auuuuguuuuaa

SEQ ID NO: 2067758 - RNA, 14 nt, Staphylococcus aureus subsp. aureus Mu50
auuuuguuuuaaaa

SEQ ID NO: 2067759 - RNA, 15 nt, Staphylococcus aureus subsp. aureus Mu50
auuuuguuuuaaaaa

SEQ ID NO: 2067760 - RNA, 15 nt, Staphylococcus aureus subsp. aureus Mu50
auuuuaacuuauaua

SEQ ID NO: 2067761 - RNA, 15 nt, Staphylococcus aureus subsp. aureus Mu50
auuuuaaauuuauaa

SEQ ID NO: 2067762 - RNA, 14 nt, Staphylococcus aureus subsp. aureus Mu50
auuuuaacuuaauu

SEQ ID NO: 2067763 - RNA, 17 nt, Staphylococcus aureus subsp. aureus Mu50
auuuuaacuuaauuaaa

SEQ ID NO: 2067764 - RNA, 13 nt, Staphylococcus aureus subsp. aureus Mu50
auuuuaacuuaua

SEQ ID NO: 2067765 - RNA, 17 nt, Staphylococcus aureus subsp. aureus Mu50
auuuuaaauaaaaugca

SEQ ID NO: 2067766 - RNA, 15 nt, Staphylococcus aureus subsp. aureus Mu50
auuuuaauauuaugu

SEQ ID NO: 2067767 - RNA, 21 nt, Staphylococcus aureus subsp. aureus Mu50
auuuuaauauugaaaugagcu

SEQ ID NO: 2067768 - RNA, 15 nt, Staphylococcus aureus subsp. aureus Mu50
auuuucauaaacucu

SEQ ID NO: 2067769 - RNA, 15 nt, Staphylococcus aureus subsp. aureus Mu50
auuuucauauaaaua

SEQ ID NO: 2067770 - RNA, 16 nt, Staphylococcus aureus subsp. aureus Mu50
auuuucaauuagaaaa

SEQ ID NO: 2067771 - RNA, 22 nt, Staphylococcus aureus subsp. aureus Mu50
auuuucaauuagaaaauuucuc

SEQ ID NO: 2067772 - RNA, 18 nt, Staphylococcus aureus subsp. aureus Mu50
auuuuauucacuuuuuuu

SEQ ID NO: 2067773 - RNA, 13 nt, Staphylococcus aureus subsp. aureus Mu50
auuuuauucuuca

SEQ ID NO: 2067774 - RNA, 18 nt, Staphylococcus aureus subsp. aureus Mu50
auuuucaauaaauuuuau

SEQ ID NO: 2067775 - RNA, 22 nt, Staphylococcus aureus subsp. aureus Mu50
auuuucaauacuugaaagauuu

SEQ ID NO: 2067776 - RNA, 14 nt, Staphylococcus aureus subsp. aureus Mu50
auuuuauuagaaua

SEQ ID NO: 2067777 - RNA, 15 nt, Staphylococcus aureus subsp. aureus Mu50
auuuuaucuuauuau

SEQ ID NO: 2067778 - RNA, 12 nt, Staphylococcus aureus subsp. aureus Mu50
auuuuaugauuu

SEQ ID NO: 2067779 - RNA, 21 nt, Staphylococcus aureus subsp. aureus Mu50
auuuaacgucuaccucuagga

SEQ ID NO: 2067780 - RNA, 14 nt, Staphylococcus aureus subsp. aureus Mu50
auuuaacaaaauua

SEQ ID NO: 2067781 - RNA, 21 nt, Staphylococcus aureus subsp. aureus Mu50
auuuaaaucuaagugguugaa

SEQ ID NO: 2067782 - RNA, 13 nt, Staphylococcus aureus subsp. aureus Mu50
auuuaaauuuuca

SEQ ID NO: 2067783 - RNA, 15 nt, Staphylococcus aureus subsp. aureus Mu50
auuuaaauaacaagu

SEQ ID NO: 2067784 - RNA, 17 nt, Staphylococcus aureus subsp. aureus Mu50
auuuaaagaacuauuuu

SEQ ID NO: 2067785 - RNA, 19 nt, Staphylococcus aureus subsp. aureus Mu50
auuguuugaaaauuaacua

SEQ ID NO: 2067786 - RNA, 15 nt, Staphylococcus aureus subsp. aureus Mu50
auuguuuguuuuuau

SEQ ID NO: 2067787 - RNA, 19 nt, Staphylococcus aureus subsp. aureus Mu50
auuguuauccaaaacauuu

SEQ ID NO: 2067788 - RNA, 16 nt, Staphylococcus aureus subsp. aureus Mu50
auuguucaugguuuaa

SEQ ID NO: 2067789 - RNA, 19 nt, Staphylococcus aureus subsp. aureus Mu50
auuguucaugguuuaauuc

SEQ ID NO: 2067790 - RNA, 19 nt, Staphylococcus aureus subsp. aureus Mu50
auuguuagauaaucucauu

SEQ ID NO: 2067791 - RNA, 21 nt, Staphylococcus aureus subsp. aureus Mu50
auuguuagauaaucucauucu

SEQ ID NO: 2067792 - RNA, 22 nt, Staphylococcus aureus subsp. aureus Mu50
auuguuauagcguuuaagaaau

SEQ ID NO: 2067793 - RNA, 18 nt, Staphylococcus aureus subsp. aureus Mu50
auuguuauccaaaacauu

SEQ ID NO: 2067794 - RNA, 13 nt, Staphylococcus aureus subsp. aureus Mu50
auuguguccuauu

SEQ ID NO: 2067795 - RNA, 13 nt, Staphylococcus aureus subsp. aureus Mu50
auuguuaaacauu

SEQ ID NO: 2067796 - RNA, 15 nt, Staphylococcus aureus subsp. aureus Mu50
auuguuacuuuaacu

SEQ ID NO: 2067797 - RNA, 16 nt, Staphylococcus aureus subsp. aureus Mu50
auuguuacuuuaacuu

SEQ ID NO: 2067798 - RNA, 22 nt, Staphylococcus aureus subsp. aureus Mu50
auuguuaaacuagaaaacauaa

SEQ ID NO: 2067799 - RNA, 12 nt, Staphylococcus aureus subsp. aureus Mu50
auuguucuucag

SEQ ID NO: 2067800 - RNA, 18 nt, Staphylococcus aureus subsp. aureus Mu50
auuguugcaaugauuaau

SEQ ID NO: 2067801 - RNA, 13 nt, Staphylococcus aureus subsp. aureus Mu50
auuguugcaaaau

SEQ ID NO: 2067802 - RNA, 19 nt, Staphylococcus aureus subsp. aureus Mu50
auuguugcaaaauacgauu

SEQ ID NO: 2067803 - RNA, 12 nt, Staphylococcus aureus subsp. aureus Mu50
auuguuuaaaca

SEQ ID NO: 2067804 - RNA, 17 nt, Staphylococcus aureus subsp. aureus Mu50
auuguuuagucuucuuu

SEQ ID NO: 2067805 - RNA, 23 nt, Staphylococcus aureus subsp. aureus Mu50
auuguaauaauaaucuuuaacau

SEQ ID NO: 2067806 - RNA, 20 nt, Staphylococcus aureus subsp. aureus Mu50
auuguauuguuuucaucaug

SEQ ID NO: 2067807 - RNA, 18 nt, Staphylococcus aureus subsp. aureus Mu50
auuguauguugaaaguga

SEQ ID NO: 2067808 - RNA, 22 nt, Staphylococcus aureus subsp. aureus Mu50
auuguauuucuuaacauccuuu

SEQ ID NO: 2067809 - RNA, 13 nt, Staphylococcus aureus subsp. aureus Mu50
auuguauuuuaau

SEQ ID NO: 2067810 - RNA, 22 nt, Staphylococcus aureus subsp. aureus Mu50
auuggguggucguaauuugguc

SEQ ID NO: 2067811 - RNA, 20 nt, Staphylococcus aureus subsp. aureus Mu50
auugguaaauuuaucauuuu

SEQ ID NO: 2067812 - RNA, 16 nt, Staphylococcus aureus subsp. aureus Mu50
auugguugauuaguuu

SEQ ID NO: 2067813 - RNA, 15 nt, Staphylococcus aureus subsp. aureus Mu50
auugguuucaucaua

SEQ ID NO: 2067814 - RNA, 17 nt, Staphylococcus aureus subsp. aureus Mu50
auugguuuggauaaaau

SEQ ID NO: 2067815 - RNA, 21 nt, Staphylococcus aureus subsp. aureus Mu50
auugguuuuuacuauaauaau

SEQ ID NO: 2067816 - RNA, 16 nt, Staphylococcus aureus subsp. aureus Mu50
auugguuuuuagugaa

SEQ ID NO: 2067817 - RNA, 14 nt, Staphylococcus aureus subsp. aureus Mu50
auuguaaaaugcuc

SEQ ID NO: 2067818 - RNA, 18 nt, Staphylococcus aureus subsp. aureus Mu50
auuguaaaaauacauaau

SEQ ID NO: 2067819 - RNA, 13 nt, Staphylococcus aureus subsp. aureus Mu50
auuguaaaacaaa

SEQ ID NO: 2067820 - RNA, 14 nt, Staphylococcus aureus subsp. aureus Mu50
auuguaaauauagu

SEQ ID NO: 2067821 - RNA, 16 nt, Staphylococcus aureus subsp. aureus Mu50
auuguaaaacaaauua

SEQ ID NO: 2067822 - RNA, 18 nt, Staphylococcus aureus subsp. aureus Mu50
auuguaaauauaguaaua

SEQ ID NO: 2067823 - RNA, 13 nt, Staphylococcus aureus subsp. aureus Mu50
auuguaaucuauu

SEQ ID NO: 2067824 - RNA, 22 nt, Staphylococcus aureus subsp. aureus Mu50
auuguaagucgaaaguacccag

SEQ ID NO: 2067825 - RNA, 21 nt, Staphylococcus aureus subsp. aureus Mu50
auugucgacuuuuagauuauc

SEQ ID NO: 2067826 - RNA, 21 nt, Staphylococcus aureus subsp. aureus Mu50
auugucguuguacaucauuaa

SEQ ID NO: 2067827 - RNA, 16 nt, Staphylococcus aureus subsp. aureus Mu50
auugucaugccuucau

SEQ ID NO: 2067828 - RNA, 12 nt, Staphylococcus aureus subsp. aureus Mu50
auugucaucaug

SEQ ID NO: 2067829 - RNA, 14 nt, Staphylococcus aureus subsp. aureus Mu50
auugucuuauaaga

SEQ ID NO: 2067830 - RNA, 15 nt, Staphylococcus aureus subsp. aureus Mu50
auugugaaaucuauu

SEQ ID NO: 2067831 - RNA, 19 nt, Staphylococcus aureus subsp. aureus Mu50
auugucuuuauaaaaaaau

SEQ ID NO: 2067832 - RNA, 18 nt, Staphylococcus aureus subsp. aureus Mu50
auuguguccauaaauauu

SEQ ID NO: 2067833 - RNA, 12 nt, Staphylococcus aureus subsp. aureus Mu50
auuuaauaaugu

SEQ ID NO: 2067834 - RNA, 15 nt, Staphylococcus aureus subsp. aureus Mu50
auuuaauaaguuaau

SEQ ID NO: 2067835 - RNA, 17 nt, Staphylococcus aureus subsp. aureus Mu50
auuuaacucaacuuaaa

SEQ ID NO: 2067836 - RNA, 16 nt, Staphylococcus aureus subsp. aureus Mu50
auuuaauacuuuucuc

SEQ ID NO: 2067837 - RNA, 21 nt, Staphylococcus aureus subsp. aureus Mu50
auuuaauacuauaguaagaaa

SEQ ID NO: 2067838 - RNA, 15 nt, Staphylococcus aureus subsp. aureus Mu50
auuuaauauuguuaa

SEQ ID NO: 2067839 - RNA, 19 nt, Staphylococcus aureus subsp. aureus Mu50
auuuaauauuuagauacug

SEQ ID NO: 2067840 - RNA, 23 nt, Staphylococcus aureus subsp. aureus Mu50
auuuaauaucacgaucuuuaaag

SEQ ID NO: 2067841 - RNA, 14 nt, Staphylococcus aureus subsp. aureus Mu50
auuuaauccuucuc

SEQ ID NO: 2067842 - RNA, 14 nt, Staphylococcus aureus subsp. aureus Mu50
auuuaaucguagga

SEQ ID NO: 2067843 - RNA, 23 nt, Staphylococcus aureus subsp. aureus Mu50
auuuaaucuauuaacugaccuaa

SEQ ID NO: 2067844 - RNA, 20 nt, Staphylococcus aureus subsp. aureus Mu50
auuuagacuuggauaaaaau

SEQ ID NO: 2067845 - RNA, 15 nt, Staphylococcus aureus subsp. aureus Mu50
auuuagauaaaaauu

SEQ ID NO: 2067846 - RNA, 17 nt, Staphylococcus aureus subsp. aureus Mu50
auuuagaugauucuuau

SEQ ID NO: 2067847 - RNA, 20 nt, Staphylococcus aureus subsp. aureus Mu50
auuuagaugcauaaaaaaag

SEQ ID NO: 2067848 - RNA, 22 nt, Staphylococcus aureus subsp. aureus Mu50
auuuagaugcauaaaaaaagaa

SEQ ID NO: 2067849 - RNA, 20 nt, Staphylococcus aureus subsp. aureus Mu50
auuuagaauucuaaaagaau

SEQ ID NO: 2067850 - RNA, 19 nt, Staphylococcus aureus subsp. aureus Mu50
auuuagaauucuaaaagaa

SEQ ID NO: 2067851 - RNA, 22 nt, Staphylococcus aureus subsp. aureus Mu50
auuuagacaucauuguuuuagg

SEQ ID NO: 2067852 - RNA, 14 nt, Staphylococcus aureus subsp. aureus Mu50
auuuaguacauaug

SEQ ID NO: 2067853 - RNA, 16 nt, Staphylococcus aureus subsp. aureus Mu50
auuuaguauaaauaaa

SEQ ID NO: 2067854 - RNA, 18 nt, Staphylococcus aureus subsp. aureus Mu50
auuuagaugauucuuauc

SEQ ID NO: 2067855 - RNA, 17 nt, Staphylococcus aureus subsp. aureus Mu50
auuuaguacauagaccu

SEQ ID NO: 2067856 - RNA, 15 nt, Staphylococcus aureus subsp. aureus Mu50
auuuagucauuacaa

SEQ ID NO: 2067857 - RNA, 16 nt, Staphylococcus aureus subsp. aureus Mu50
auuuaguaucuauaca

SEQ ID NO: 2067858 - RNA, 18 nt, Staphylococcus aureus subsp. aureus Mu50
auuuagucauuacaaauc

SEQ ID NO: 2067859 - RNA, 22 nt, Staphylococcus aureus subsp. aureus Mu50
auuuagugaaacaauuuguaac

SEQ ID NO: 2067860 - RNA, 15 nt, Staphylococcus aureus subsp. aureus Mu50
auuuaguuaaauaca

SEQ ID NO: 2067861 - RNA, 15 nt, Staphylococcus aureus subsp. aureus Mu50
auuuauaaacaauaa

SEQ ID NO: 2067862 - RNA, 17 nt, Staphylococcus aureus subsp. aureus Mu50
auuuaguuuuuuuaaag

SEQ ID NO: 2067863 - RNA, 22 nt, Staphylococcus aureus subsp. aureus Mu50
auuuauaaaaacuuauuugcca

SEQ ID NO: 2067864 - RNA, 13 nt, Staphylococcus aureus subsp. aureus Mu50
auuuaguuaaaua

SEQ ID NO: 2067865 - RNA, 19 nt, Staphylococcus aureus subsp. aureus Mu50
auuuaguuaauuauuuaga

SEQ ID NO: 2067866 - RNA, 19 nt, Staphylococcus aureus subsp. aureus Mu50
auuuauaaacaauuacaaa

SEQ ID NO: 2067867 - RNA, 18 nt, Staphylococcus aureus subsp. aureus Mu50
auuuauaacauuuaagaa

SEQ ID NO: 2067868 - RNA, 14 nt, Staphylococcus aureus subsp. aureus Mu50
auuuauacuauaaa

SEQ ID NO: 2067869 - RNA, 17 nt, Staphylococcus aureus subsp. aureus Mu50
auuuaucgccaauuaau

SEQ ID NO: 2067870 - RNA, 19 nt, Staphylococcus aureus subsp. aureus Mu50
auuuauacuauaaauacaa

SEQ ID NO: 2067871 - RNA, 23 nt, Staphylococcus aureus subsp. aureus Mu50
auuuauuucuuuuugucauuaau

SEQ ID NO: 2067872 - RNA, 21 nt, Staphylococcus aureus subsp. aureus Mu50
auuuauuuauaaaauaaaaug

SEQ ID NO: 2067873 - RNA, 18 nt, Staphylococcus aureus subsp. aureus Mu50
auuuauuuucaauaaaua

SEQ ID NO: 2067874 - RNA, 17 nt, Staphylococcus aureus subsp. aureus Mu50
auuuauuuucuuuggug

SEQ ID NO: 2067875 - RNA, 14 nt, Staphylococcus aureus subsp. aureus Mu50
auuuauuuugauua

SEQ ID NO: 2067876 - RNA, 12 nt, Staphylococcus aureus subsp. aureus Mu50
auuuauuuuuga

SEQ ID NO: 2067877 - RNA, 13 nt, Staphylococcus aureus subsp. aureus Mu50
auuuauuuuuaau

SEQ ID NO: 2067878 - RNA, 15 nt, Staphylococcus aureus subsp. aureus Mu50
auuucaaaaauagcg

SEQ ID NO: 2067879 - RNA, 22 nt, Staphylococcus aureus subsp. aureus Mu50
auuuauuaguugugguuguuaa

SEQ ID NO: 2067880 - RNA, 12 nt, Staphylococcus aureus subsp. aureus Mu50
auuuauuaaaua

SEQ ID NO: 2067881 - RNA, 23 nt, Staphylococcus aureus subsp. aureus Mu50
auuuauuaguugugguuguuaau

SEQ ID NO: 2067882 - RNA, 14 nt, Staphylococcus aureus subsp. aureus Mu50
auuuauuaguuuuu

SEQ ID NO: 2067883 - RNA, 16 nt, Staphylococcus aureus subsp. aureus Mu50
auuuauuguuuuuaaa

SEQ ID NO: 2067884 - RNA, 17 nt, Staphylococcus aureus subsp. aureus Mu50
auuuauuguuuuuaaaa

SEQ ID NO: 2067885 - RNA, 20 nt, Staphylococcus aureus subsp. aureus Mu50
auuuauucuaaauauauuuu

SEQ ID NO: 2067886 - RNA, 13 nt, Staphylococcus aureus subsp. aureus Mu50
auuuauucaaaau

SEQ ID NO: 2067887 - RNA, 20 nt, Staphylococcus aureus subsp. aureus Mu50
auuucaaguguauuaucuuu

SEQ ID NO: 2067888 - RNA, 17 nt, Staphylococcus aureus subsp. aureus Mu50
auuucaacaaacauaaa

SEQ ID NO: 2067889 - RNA, 14 nt, Staphylococcus aureus subsp. aureus Mu50
auuucaacaaacau

SEQ ID NO: 2067890 - RNA, 15 nt, Staphylococcus aureus subsp. aureus Mu50
auuucaacaaacaua

SEQ ID NO: 2067891 - RNA, 16 nt, Staphylococcus aureus subsp. aureus Mu50
auuucaacaaacauaa

SEQ ID NO: 2067892 - RNA, 23 nt, Staphylococcus aureus subsp. aureus Mu50
auuucagcaccgacaauuauaau

SEQ ID NO: 2067893 - RNA, 21 nt, Staphylococcus aureus subsp. aureus Mu50
auuucagcaccgacaauuaua

SEQ ID NO: 2067894 - RNA, 22 nt, Staphylococcus aureus subsp. aureus Mu50
auuucagaacuaugaauagaug

SEQ ID NO: 2067895 - RNA, 13 nt, Staphylococcus aureus subsp. aureus Mu50
auuucaucaugug

SEQ ID NO: 2067896 - RNA, 20 nt, Staphylococcus aureus subsp. aureus Mu50
auuucaucaugugcuuuguu

SEQ ID NO: 2067897 - RNA, 15 nt, Staphylococcus aureus subsp. aureus Mu50
auuucagcgauaacg

SEQ ID NO: 2067898 - RNA, 19 nt, Staphylococcus aureus subsp. aureus Mu50
auuucagcuuauuaagcuu

SEQ ID NO: 2067899 - RNA, 22 nt, Staphylococcus aureus subsp. aureus Mu50
auugcuauauuaguauaauuua

SEQ ID NO: 2067900 - RNA, 13 nt, Staphylococcus aureus subsp. aureus Mu50
auugcuaaaaaaa

SEQ ID NO: 2067901 - RNA, 16 nt, Staphylococcus aureus subsp. aureus Mu50
auugcgaaaaauaauu

SEQ ID NO: 2067902 - RNA, 15 nt, Staphylococcus aureus subsp. aureus Mu50
auugcuuauuuuugu

SEQ ID NO: 2067903 - RNA, 21 nt, Staphylococcus aureus subsp. aureus Mu50
auugcuugaaauuauuauuua

SEQ ID NO: 2067904 - RNA, 18 nt, Staphylococcus aureus subsp. aureus Mu50
auugcuuuacuaauuccg

SEQ ID NO: 2067905 - RNA, 17 nt, Staphylococcus aureus subsp. aureus Mu50
auugcuuguucuuucuu

SEQ ID NO: 2067906 - RNA, 20 nt, Staphylococcus aureus subsp. aureus Mu50
auuggauuaucgaauuagau

SEQ ID NO: 2067907 - RNA, 23 nt, Staphylococcus aureus subsp. aureus Mu50
auuggauuacuuccauugcuucu

SEQ ID NO: 2067908 - RNA, 21 nt, Staphylococcus aureus subsp. aureus Mu50
auugcaacgcaucacaaaauu

SEQ ID NO: 2067909 - RNA, 23 nt, Staphylococcus aureus subsp. aureus Mu50
auugcaagacuuggugcccaagu

SEQ ID NO: 2067910 - RNA, 19 nt, Staphylococcus aureus subsp. aureus Mu50
auugcaaugaauaacaaga

SEQ ID NO: 2067911 - RNA, 14 nt, Staphylococcus aureus subsp. aureus Mu50
auugcaaaugcaau

SEQ ID NO: 2067912 - RNA, 15 nt, Staphylococcus aureus subsp. aureus Mu50
auugcaaaaauaaua

SEQ ID NO: 2067913 - RNA, 21 nt, Staphylococcus aureus subsp. aureus Mu50
auugcaaaaauaauaugaauu

SEQ ID NO: 2067914 - RNA, 15 nt, Staphylococcus aureus subsp. aureus Mu50
auugaguuuuuuaaa

SEQ ID NO: 2067915 - RNA, 23 nt, Staphylococcus aureus subsp. aureus Mu50
auugaggauaauuauuaggggag

SEQ ID NO: 2067916 - RNA, 23 nt, Staphylococcus aureus subsp. aureus Mu50
auugaggaucaaaaguuguugca

SEQ ID NO: 2067917 - RNA, 22 nt, Staphylococcus aureus subsp. aureus Mu50
auugcacuuuuuucauuucuuu

SEQ ID NO: 2067918 - RNA, 22 nt, Staphylococcus aureus subsp. aureus Mu50
auugcacgucuuguaucaacau

SEQ ID NO: 2067919 - RNA, 22 nt, Staphylococcus aureus subsp. aureus Mu50
auugcacuaugcauaauaccaa

SEQ ID NO: 2067920 - RNA, 18 nt, Staphylococcus aureus subsp. aureus Mu50
auucuucaaaaaauaaua

SEQ ID NO: 2067921 - RNA, 22 nt, Staphylococcus aureus subsp. aureus Mu50
auucuucaccaacuuuuuuaac

SEQ ID NO: 2067922 - RNA, 16 nt, Staphylococcus aureus subsp. aureus Mu50
auucuucacuaaaaau

SEQ ID NO: 2067923 - RNA, 17 nt, Staphylococcus aureus subsp. aureus Mu50
auucuucaguuuguugg

SEQ ID NO: 2067924 - RNA, 17 nt, Staphylococcus aureus subsp. aureus Mu50
auucuuauauguuuuau

SEQ ID NO: 2067925 - RNA, 14 nt, Staphylococcus aureus subsp. aureus Mu50
auucuuagauauua

SEQ ID NO: 2067926 - RNA, 19 nt, Staphylococcus aureus subsp. aureus Mu50
auucuuaucauucauuacu

SEQ ID NO: 2067927 - RNA, 22 nt, Staphylococcus aureus subsp. aureus Mu50
auucuuaucauuucaaauaaga

SEQ ID NO: 2067928 - RNA, 21 nt, Staphylococcus aureus subsp. aureus Mu50
auugaaaaauuaaaaaacaaa

SEQ ID NO: 2067929 - RNA, 16 nt, Staphylococcus aureus subsp. aureus Mu50
auugaaauaauauaaa

SEQ ID NO: 2067930 - RNA, 23 nt, Staphylococcus aureus subsp. aureus Mu50
auugacuuacauuuuaauaaaau

SEQ ID NO: 2067931 - RNA, 17 nt, Staphylococcus aureus subsp. aureus Mu50
auugagaaauagcaaca

SEQ ID NO: 2067932 - RNA, 13 nt, Staphylococcus aureus subsp. aureus Mu50
auugacuuuaauu

SEQ ID NO: 2067933 - RNA, 13 nt, Staphylococcus aureus subsp. aureus Mu50
auugaaucaaaua

SEQ ID NO: 2067934 - RNA, 23 nt, Staphylococcus aureus subsp. aureus Mu50
auugaaugaaaaaguugaucuac

SEQ ID NO: 2067935 - RNA, 21 nt, Staphylococcus aureus subsp. aureus Mu50
auugaaucuuuguuauauuuu

SEQ ID NO: 2067936 - RNA, 22 nt, Staphylococcus aureus subsp. aureus Mu50
auugacucgaccuuuauaugaa

SEQ ID NO: 2067937 - RNA, 21 nt, Staphylococcus aureus subsp. aureus Mu50
auucuuaaaaagcagcaguaa

SEQ ID NO: 2067938 - RNA, 14 nt, Staphylococcus aureus subsp. aureus Mu50
auucuggaugguua

SEQ ID NO: 2067939 - RNA, 17 nt, Staphylococcus aureus subsp. aureus Mu50
auucuguguaaauauaa

SEQ ID NO: 2067940 - RNA, 16 nt, Staphylococcus aureus subsp. aureus Mu50
auucuguguaaauaua

SEQ ID NO: 2067941 - RNA, 16 nt, Staphylococcus aureus subsp. aureus Mu50
auucucgauaacuuac

SEQ ID NO: 2067942 - RNA, 16 nt, Staphylococcus aureus subsp. aureus Mu50
auucuccuaauaauuu

SEQ ID NO: 2067943 - RNA, 17 nt, Staphylococcus aureus subsp. aureus Mu50
auucucgauuuuuuuau

SEQ ID NO: 2067944 - RNA, 14 nt, Staphylococcus aureus subsp. aureus Mu50
auucucgguuuuuu

SEQ ID NO: 2067945 - RNA, 22 nt, Staphylococcus aureus subsp. aureus Mu50
auucucuaacuuuaccaauauc

SEQ ID NO: 2067946 - RNA, 13 nt, Staphylococcus aureus subsp. aureus Mu50
auucuauuuuuga

SEQ ID NO: 2067947 - RNA, 15 nt, Staphylococcus aureus subsp. aureus Mu50
auucuauaauuuuaa

SEQ ID NO: 2067948 - RNA, 16 nt, Staphylococcus aureus subsp. aureus Mu50
augccguaguuuucuc

SEQ ID NO: 2067949 - RNA, 20 nt, Staphylococcus aureus subsp. aureus Mu50
augccgcuucuaauuuuuca

SEQ ID NO: 2067950 - RNA, 17 nt, Staphylococcus aureus subsp. aureus Mu50
augccgccuaauaauaa

SEQ ID NO: 2067951 - RNA, 20 nt, Staphylococcus aureus subsp. aureus Mu50
augccuuaugucauauacua

SEQ ID NO: 2067952 - RNA, 20 nt, Staphylococcus aureus subsp. aureus Mu50
augcccuagguuuauauauc

SEQ ID NO: 2067953 - RNA, 14 nt, Staphylococcus aureus subsp. aureus Mu50
augccgagauuauu

SEQ ID NO: 2067954 - RNA, 15 nt, Staphylococcus aureus subsp. aureus Mu50
augcccuuaaagcac

SEQ ID NO: 2067955 - RNA, 20 nt, Staphylococcus aureus subsp. aureus Mu50
augcacaucauugauagaua

SEQ ID NO: 2067956 - RNA, 22 nt, Staphylococcus aureus subsp. aureus Mu50
augauaaagagccacuaaugau

SEQ ID NO: 2067957 - RNA, 20 nt, Staphylococcus aureus subsp. aureus Mu50
augaguuguucagauuugua

SEQ ID NO: 2067958 - RNA, 15 nt, Staphylococcus aureus subsp. aureus Mu50
augaguuuaaaaaua

SEQ ID NO: 2067959 - RNA, 17 nt, Staphylococcus aureus subsp. aureus Mu50
augaguuucucaucuac

SEQ ID NO: 2067960 - RNA, 23 nt, Staphylococcus aureus subsp. aureus Mu50
augaugaauuguuguacauguau

SEQ ID NO: 2067961 - RNA, 17 nt, Staphylococcus aureus subsp. aureus Mu50
augaugaacuuaaugcu

SEQ ID NO: 2067962 - RNA, 21 nt, Staphylococcus aureus subsp. aureus Mu50
augaugaauuguuguacaugu

SEQ ID NO: 2067963 - RNA, 15 nt, Staphylococcus aureus subsp. aureus Mu50
augaugagauaaaau

SEQ ID NO: 2067964 - RNA, 16 nt, Staphylococcus aureus subsp. aureus Mu50
augaugagauaaaauc

SEQ ID NO: 2067965 - RNA, 15 nt, Staphylococcus aureus subsp. aureus Mu50
augaugauaaauuga

SEQ ID NO: 2067966 - RNA, 20 nt, Staphylococcus aureus subsp. aureus Mu50
augaugauaaaaauaaaacc

SEQ ID NO: 2067967 - RNA, 17 nt, Staphylococcus aureus subsp. aureus Mu50
augcaacuaaaacuauc

SEQ ID NO: 2067968 - RNA, 22 nt, Staphylococcus aureus subsp. aureus Mu50
augcaaaucucgucacauauaa

SEQ ID NO: 2067969 - RNA, 20 nt, Staphylococcus aureus subsp. aureus Mu50
augauuggcuugaaguuguu

SEQ ID NO: 2067970 - RNA, 14 nt, Staphylococcus aureus subsp. aureus Mu50
augaugucauguau

SEQ ID NO: 2067971 - RNA, 15 nt, Staphylococcus aureus subsp. aureus Mu50
augauguuaaaaaau

SEQ ID NO: 2067972 - RNA, 21 nt, Staphylococcus aureus subsp. aureus Mu50
augaugugcaaacgauauguu

SEQ ID NO: 2067973 - RNA, 15 nt, Staphylococcus aureus subsp. aureus Mu50
augauuuauaaaaaa

SEQ ID NO: 2067974 - RNA, 14 nt, Staphylococcus aureus subsp. aureus Mu50
augauuuauaaaaa

SEQ ID NO: 2067975 - RNA, 15 nt, Staphylococcus aureus subsp. aureus Mu50
augauuguaauaucu

SEQ ID NO: 2067976 - RNA, 22 nt, Staphylococcus aureus subsp. aureus Mu50
augauuguaauaucuaaagauu

SEQ ID NO: 2067977 - RNA, 18 nt, Staphylococcus aureus subsp. aureus Mu50
augauuuaaguuuauaau

SEQ ID NO: 2067978 - RNA, 12 nt, Staphylococcus aureus subsp. aureus Mu50
augauuugauuu

SEQ ID NO: 2067979 - RNA, 15 nt, Staphylococcus aureus subsp. aureus Mu50
augaaugccuaauuu

SEQ ID NO: 2067980 - RNA, 21 nt, Staphylococcus aureus subsp. aureus Mu50
augaaucgcauuuaaauauaa

SEQ ID NO: 2067981 - RNA, 18 nt, Staphylococcus aureus subsp. aureus Mu50
augaauuauuuaaaaugc

SEQ ID NO: 2067982 - RNA, 19 nt, Staphylococcus aureus subsp. aureus Mu50
augaauuauuuaaaaugcu

SEQ ID NO: 2067983 - RNA, 19 nt, Staphylococcus aureus subsp. aureus Mu50
augaauucauuuuaucuau

SEQ ID NO: 2067984 - RNA, 23 nt, Staphylococcus aureus subsp. aureus Mu50
augaauugaguauuaaauuugaa

SEQ ID NO: 2067985 - RNA, 19 nt, Staphylococcus aureus subsp. aureus Mu50
augaauuuagcaucaaaaa

SEQ ID NO: 2067986 - RNA, 20 nt, Staphylococcus aureus subsp. aureus Mu50
augaauuuacuccuuacaau

SEQ ID NO: 2067987 - RNA, 22 nt, Staphylococcus aureus subsp. aureus Mu50
augaauuuagaugcauaaaaaa

SEQ ID NO: 2067988 - RNA, 16 nt, Staphylococcus aureus subsp. aureus Mu50
augaauuuuaauauau

SEQ ID NO: 2067989 - RNA, 19 nt, Staphylococcus aureus subsp. aureus Mu50
augaccaauagcaauugaa

SEQ ID NO: 2067990 - RNA, 21 nt, Staphylococcus aureus subsp. aureus Mu50
augacauuuaauacuuuucuc

SEQ ID NO: 2067991 - RNA, 14 nt, Staphylococcus aureus subsp. aureus Mu50
augaaucagaugau

SEQ ID NO: 2067992 - RNA, 16 nt, Staphylococcus aureus subsp. aureus Mu50
augaaucaacaauuua

SEQ ID NO: 2067993 - RNA, 12 nt, Staphylococcus aureus subsp. aureus Mu50
augaaucauuuu

SEQ ID NO: 2067994 - RNA, 20 nt, Staphylococcus aureus subsp. aureus Mu50
augaaucgauauaaugaagu

SEQ ID NO: 2067995 - RNA, 13 nt, Staphylococcus aureus subsp. aureus Mu50
augaauagaugau

SEQ ID NO: 2067996 - RNA, 12 nt, Staphylococcus aureus subsp. aureus Mu50
augaauauauug

SEQ ID NO: 2067997 - RNA, 21 nt, Staphylococcus aureus subsp. aureus Mu50
augaauaaugcaauugaccaa

SEQ ID NO: 2067998 - RNA, 19 nt, Staphylococcus aureus subsp. aureus Mu50
augaaguaguuucauugcu

SEQ ID NO: 2067999 - RNA, 16 nt, Staphylococcus aureus subsp. aureus Mu50
augaaguugguuuaga

SEQ ID NO: 2068000 - RNA, 20 nt, Staphylococcus aureus subsp. aureus Mu50
augagauuauuuuuuuaaau

SEQ ID NO: 2068001 - RNA, 14 nt, Staphylococcus aureus subsp. aureus Mu50
augacugcaaauac

SEQ ID NO: 2068002 - RNA, 16 nt, Staphylococcus aureus subsp. aureus Mu50
augaccuggaauauug

SEQ ID NO: 2068003 - RNA, 16 nt, Staphylococcus aureus subsp. aureus Mu50
augacgaacgauagau

SEQ ID NO: 2068004 - RNA, 13 nt, Staphylococcus aureus subsp. aureus Mu50
augacuguagaaa

SEQ ID NO: 2068005 - RNA, 20 nt, Staphylococcus aureus subsp. aureus Mu50
augacuuauuuuucaucauu

SEQ ID NO: 2068006 - RNA, 15 nt, Staphylococcus aureus subsp. aureus Mu50
augagaagcugucuu

SEQ ID NO: 2068007 - RNA, 12 nt, Staphylococcus aureus subsp. aureus Mu50
augagaaauguu

SEQ ID NO: 2068008 - RNA, 16 nt, Staphylococcus aureus subsp. aureus Mu50
augaaaguaccuaaaa

SEQ ID NO: 2068009 - RNA, 17 nt, Staphylococcus aureus subsp. aureus Mu50
augaaaguaccuaaaau

SEQ ID NO: 2068010 - RNA, 14 nt, Staphylococcus aureus subsp. aureus Mu50
augaagaauacaaa

SEQ ID NO: 2068011 - RNA, 16 nt, Staphylococcus aureus subsp. aureus Mu50
augaacuuaaugcuuc

SEQ ID NO: 2068012 - RNA, 22 nt, Staphylococcus aureus subsp. aureus Mu50
augaacuucuacaguuggaggu

SEQ ID NO: 2068013 - RNA, 15 nt, Staphylococcus aureus subsp. aureus Mu50
augaacuuaaugcuu

SEQ ID NO: 2068014 - RNA, 19 nt, Staphylococcus aureus subsp. aureus Mu50
augaaggcuuuuuguuuug

SEQ ID NO: 2068015 - RNA, 14 nt, Staphylococcus aureus subsp. aureus Mu50
aucuuuuaauucuu

SEQ ID NO: 2068016 - RNA, 20 nt, Staphylococcus aureus subsp. aureus Mu50
aucuuuuccaaaacaaaaau

SEQ ID NO: 2068017 - RNA, 21 nt, Staphylococcus aureus subsp. aureus Mu50
aucuuuuauccaauguauaaa

SEQ ID NO: 2068018 - RNA, 19 nt, Staphylococcus aureus subsp. aureus Mu50
augaaaauaccucuacauu

SEQ ID NO: 2068019 - RNA, 22 nt, Staphylococcus aureus subsp. aureus Mu50
augaaaauaccucuacauuaua

SEQ ID NO: 2068020 - RNA, 23 nt, Staphylococcus aureus subsp. aureus Mu50
aucuuuuguaagacuucccaauc

SEQ ID NO: 2068021 - RNA, 21 nt, Staphylococcus aureus subsp. aureus Mu50
aucuucuggauagguaucacu

SEQ ID NO: 2068022 - RNA, 16 nt, Staphylococcus aureus subsp. aureus Mu50
aucuggcaaauugccu

SEQ ID NO: 2068023 - RNA, 22 nt, Staphylococcus aureus subsp. aureus Mu50
aucuuucacaauuguauaaugu

SEQ ID NO: 2068024 - RNA, 13 nt, Staphylococcus aureus subsp. aureus Mu50
aucuuucacaauu

SEQ ID NO: 2068025 - RNA, 15 nt, Staphylococcus aureus subsp. aureus Mu50
aucuuucaaaugcuu

SEQ ID NO: 2068026 - RNA, 20 nt, Staphylococcus aureus subsp. aureus Mu50
aucuuucaacgcauauucua

SEQ ID NO: 2068027 - RNA, 18 nt, Staphylococcus aureus subsp. aureus Mu50
aucuuuccacggcauuua

SEQ ID NO: 2068028 - RNA, 22 nt, Staphylococcus aureus subsp. aureus Mu50
aucuuuacgauaaacuaaaaag

SEQ ID NO: 2068029 - RNA, 21 nt, Staphylococcus aureus subsp. aureus Mu50
aucuuuaauuuucuugccauc

SEQ ID NO: 2068030 - RNA, 22 nt, Staphylococcus aureus subsp. aureus Mu50
aucuuuaacuucugauucuuca

SEQ ID NO: 2068031 - RNA, 15 nt, Staphylococcus aureus subsp. aureus Mu50
aucuuuaauuucauu

SEQ ID NO: 2068032 - RNA, 17 nt, Staphylococcus aureus subsp. aureus Mu50
aucuuuaaagaaaauuu

SEQ ID NO: 2068033 - RNA, 16 nt, Staphylococcus aureus subsp. aureus Mu50
aucuuuaaagucaaca

SEQ ID NO: 2068034 - RNA, 19 nt, Staphylococcus aureus subsp. aureus Mu50
aucuuguuuucauuuaaaa

SEQ ID NO: 2068035 - RNA, 19 nt, Staphylococcus aureus subsp. aureus Mu50
aucuugauuauauuuuucu

SEQ ID NO: 2068036 - RNA, 13 nt, Staphylococcus aureus subsp. aureus Mu50
aucgcccauacca

SEQ ID NO: 2068037 - RNA, 15 nt, Staphylococcus aureus subsp. aureus Mu50
aucgcauuuaaauau

SEQ ID NO: 2068038 - RNA, 23 nt, Staphylococcus aureus subsp. aureus Mu50
aucgcauuuuguuucaacauuuc

SEQ ID NO: 2068039 - RNA, 16 nt, Staphylococcus aureus subsp. aureus Mu50
aucgcauuuaaauaua

SEQ ID NO: 2068040 - RNA, 15 nt, Staphylococcus aureus subsp. aureus Mu50
aucgccuaaaaauaa

SEQ ID NO: 2068041 - RNA, 14 nt, Staphylococcus aureus subsp. aureus Mu50
aucgccuaaaaaua

SEQ ID NO: 2068042 - RNA, 14 nt, Staphylococcus aureus subsp. aureus Mu50
aucgcgauuauuac

SEQ ID NO: 2068043 - RNA, 21 nt, Staphylococcus aureus subsp. aureus Mu50
aucgauaaauguauuaaacau

SEQ ID NO: 2068044 - RNA, 13 nt, Staphylococcus aureus subsp. aureus Mu50
aucgauaaaaugu

SEQ ID NO: 2068045 - RNA, 22 nt, Staphylococcus aureus subsp. aureus Mu50
aucgauuuuauaucuuucugaa

SEQ ID NO: 2068046 - RNA, 22 nt, Staphylococcus aureus subsp. aureus Mu50
aucgauuuuaucgaaauauuua

SEQ ID NO: 2068047 - RNA, 16 nt, Staphylococcus aureus subsp. aureus Mu50
aucgauacuaauaucu

SEQ ID NO: 2068048 - RNA, 13 nt, Staphylococcus aureus subsp. aureus Mu50
aucgauacuuuuu

SEQ ID NO: 2068049 - RNA, 17 nt, Staphylococcus aureus subsp. aureus Mu50
aucgcaccgucaaacuu

SEQ ID NO: 2068050 - RNA, 22 nt, Staphylococcus aureus subsp. aureus Mu50
aucgauuuuggcacauaaauca

SEQ ID NO: 2068051 - RNA, 16 nt, Staphylococcus aureus subsp. aureus Mu50
aucagcuauaaaagua

SEQ ID NO: 2068052 - RNA, 15 nt, Staphylococcus aureus subsp. aureus Mu50
aucagcuaaauauuu

SEQ ID NO: 2068053 - RNA, 18 nt, Staphylococcus aureus subsp. aureus Mu50
aucagcuaaguuaaauau

SEQ ID NO: 2068054 - RNA, 21 nt, Staphylococcus aureus subsp. aureus Mu50
aucgagaggguacacuucaac

SEQ ID NO: 2068055 - RNA, 17 nt, Staphylococcus aureus subsp. aureus Mu50
aucgaacauaaauaaac

SEQ ID NO: 2068056 - RNA, 18 nt, Staphylococcus aureus subsp. aureus Mu50
aucgaacaaaugaaaaag

SEQ ID NO: 2068057 - RNA, 15 nt, Staphylococcus aureus subsp. aureus Mu50
aucgaaaauuucagg

SEQ ID NO: 2068058 - RNA, 14 nt, Staphylococcus aureus subsp. aureus Mu50
aucguuaaggaaag

SEQ ID NO: 2068059 - RNA, 23 nt, Staphylococcus aureus subsp. aureus Mu50
aucguggggugccuuuuacauuu

SEQ ID NO: 2068060 - RNA, 19 nt, Staphylococcus aureus subsp. aureus Mu50
aucuacagagaaucaauua

SEQ ID NO: 2068061 - RNA, 19 nt, Staphylococcus aureus subsp. aureus Mu50
aucuacaucaaauuuuucg

SEQ ID NO: 2068062 - RNA, 20 nt, Staphylococcus aureus subsp. aureus Mu50
aucuacauaauuugaauuag

SEQ ID NO: 2068063 - RNA, 23 nt, Staphylococcus aureus subsp. aureus Mu50
aucuacaauaaccauuucaucau

SEQ ID NO: 2068064 - RNA, 21 nt, Staphylococcus aureus subsp. aureus Mu50
aucuaaaugcacgagcaacau

SEQ ID NO: 2068065 - RNA, 21 nt, Staphylococcus aureus subsp. aureus Mu50
aucuaaaugaucuuuguagcc

SEQ ID NO: 2068066 - RNA, 19 nt, Staphylococcus aureus subsp. aureus Mu50
aucguuauaaguacaaaua

SEQ ID NO: 2068067 - RNA, 17 nt, Staphylococcus aureus subsp. aureus Mu50
aucugcaugguuugcug

SEQ ID NO: 2068068 - RNA, 19 nt, Staphylococcus aureus subsp. aureus Mu50
aucugcaaaugccucuuuc

SEQ ID NO: 2068069 - RNA, 16 nt, Staphylococcus aureus subsp. aureus Mu50
aucugcaaaaugcauu

SEQ ID NO: 2068070 - RNA, 14 nt, Staphylococcus aureus subsp. aureus Mu50
aucugauguugauu

SEQ ID NO: 2068071 - RNA, 18 nt, Staphylococcus aureus subsp. aureus Mu50
aucugaagguaauuuaac

SEQ ID NO: 2068072 - RNA, 14 nt, Staphylococcus aureus subsp. aureus Mu50
aucugacauuuaaa

SEQ ID NO: 2068073 - RNA, 20 nt, Staphylococcus aureus subsp. aureus Mu50
aucucuucugucuaaaaaca

SEQ ID NO: 2068074 - RNA, 21 nt, Staphylococcus aureus subsp. aureus Mu50
aucucuuuuugauuauauuua

SEQ ID NO: 2068075 - RNA, 16 nt, Staphylococcus aureus subsp. aureus Mu50
aucucuuuucuauuca

SEQ ID NO: 2068076 - RNA, 16 nt, Staphylococcus aureus subsp. aureus Mu50
aucucuucaauuuauu

SEQ ID NO: 2068077 - RNA, 20 nt, Staphylococcus aureus subsp. aureus Mu50
aucucuucaauuuauuuuua

SEQ ID NO: 2068078 - RNA, 13 nt, Staphylococcus aureus subsp. aureus Mu50
aucucuuauaagu

SEQ ID NO: 2068079 - RNA, 17 nt, Staphylococcus aureus subsp. aureus Mu50
aucucugcuuuaauaua

SEQ ID NO: 2068080 - RNA, 16 nt, Staphylococcus aureus subsp. aureus Mu50
aucucggcauuuuuau

SEQ ID NO: 2068081 - RNA, 23 nt, Staphylococcus aureus subsp. aureus Mu50
aucucgucacauauaaauauuuu

SEQ ID NO: 2068082 - RNA, 18 nt, Staphylococcus aureus subsp. aureus Mu50
aucucuaccauuucaacc

SEQ ID NO: 2068083 - RNA, 14 nt, Staphylococcus aureus subsp. aureus Mu50
aucucuauuuuuua

SEQ ID NO: 2068084 - RNA, 14 nt, Staphylococcus aureus subsp. aureus Mu50
aucuacuaagugcc

SEQ ID NO: 2068085 - RNA, 15 nt, Staphylococcus aureus subsp. aureus Mu50
aucuacucaaauaua

SEQ ID NO: 2068086 - RNA, 21 nt, Staphylococcus aureus subsp. aureus Mu50
aucuacucaaauauaaauaaa

SEQ ID NO: 2068087 - RNA, 23 nt, Staphylococcus aureus subsp. aureus Mu50
aucuacuuccuuacagacaaaca

SEQ ID NO: 2068088 - RNA, 14 nt, Staphylococcus aureus subsp. aureus Mu50
aucuauaaaaagaa

SEQ ID NO: 2068089 - RNA, 13 nt, Staphylococcus aureus subsp. aureus Mu50
aucuauaaauggc

SEQ ID NO: 2068090 - RNA, 14 nt, Staphylococcus aureus subsp. aureus Mu50
aucuaguacaccuc

SEQ ID NO: 2068091 - RNA, 15 nt, Staphylococcus aureus subsp. aureus Mu50
aucuaguuguuuuau

SEQ ID NO: 2068092 - RNA, 21 nt, Staphylococcus aureus subsp. aureus Mu50
aucuagccugaaauagaaaug

SEQ ID NO: 2068093 - RNA, 19 nt, Staphylococcus aureus subsp. aureus Mu50
aucuagccugaaauagaaa

SEQ ID NO: 2068094 - RNA, 16 nt, Staphylococcus aureus subsp. aureus Mu50
aucuagcugcuucugc

SEQ ID NO: 2068095 - RNA, 18 nt, Staphylococcus aureus subsp. aureus Mu50
aucuaucgguaauuuuug

SEQ ID NO: 2068096 - RNA, 14 nt, Staphylococcus aureus subsp. aureus Mu50
aucuauauuuaauu

SEQ ID NO: 2068097 - RNA, 12 nt, Staphylococcus aureus subsp. aureus Mu50
aucuauaugcau

SEQ ID NO: 2068098 - RNA, 16 nt, Staphylococcus aureus subsp. aureus Mu50
aucuauauaaauguuu

SEQ ID NO: 2068099 - RNA, 18 nt, Staphylococcus aureus subsp. aureus Mu50
aucuauuauuauguuaua

SEQ ID NO: 2068100 - RNA, 15 nt, Staphylococcus aureus subsp. aureus Mu50
aucuaugaaauuuuu

SEQ ID NO: 2068101 - RNA, 12 nt, Staphylococcus aureus subsp. aureus Mu50
aucucaaaauuu

SEQ ID NO: 2068102 - RNA, 12 nt, Staphylococcus aureus subsp. aureus Mu50
aucuauuuuucg

SEQ ID NO: 2068103 - RNA, 18 nt, Staphylococcus aureus subsp. aureus Mu50
aucuauugugauauauga

SEQ ID NO: 2068104 - RNA, 15 nt, Staphylococcus aureus subsp. aureus Mu50
aucuauucaacugau

SEQ ID NO: 2068105 - RNA, 20 nt, Staphylococcus aureus subsp. aureus Mu50
aucuauuuaucauacuucaa

SEQ ID NO: 2068106 - RNA, 15 nt, Staphylococcus aureus subsp. aureus Mu50
aucuauuuuuaacua

SEQ ID NO: 2068107 - RNA, 16 nt, Staphylococcus aureus subsp. aureus Mu50
aucuccauuagaacua

SEQ ID NO: 2068108 - RNA, 13 nt, Staphylococcus aureus subsp. aureus Mu50
aucucauucuuua

SEQ ID NO: 2068109 - RNA, 22 nt, Staphylococcus aureus subsp. aureus Mu50
aucucauuuuuucgagaugaua

SEQ ID NO: 2068110 - RNA, 20 nt, Staphylococcus aureus subsp. aureus Mu50
aucucauucuuuaauauaaa

SEQ ID NO: 2068111 - RNA, 14 nt, Staphylococcus aureus subsp. aureus Mu50
aucucaauccaauu

SEQ ID NO: 2068112 - RNA, 20 nt, Staphylococcus aureus subsp. aureus Mu50
aucucaauccaauuaaauau

SEQ ID NO: 2068113 - RNA, 21 nt, Staphylococcus aureus subsp. aureus Mu50
aucucaauccaauuaaauauu

SEQ ID NO: 2068114 - RNA, 19 nt, Staphylococcus aureus subsp. aureus Mu50
augugcuuuguuuaucaau

SEQ ID NO: 2068115 - RNA, 15 nt, Staphylococcus aureus subsp. aureus Mu50
augugcuuuaucaac

SEQ ID NO: 2068116 - RNA, 20 nt, Staphylococcus aureus subsp. aureus Mu50
augugcaacgguuugaaaaa

SEQ ID NO: 2068117 - RNA, 22 nt, Staphylococcus aureus subsp. aureus Mu50
auguucaaaaaaugaauauaau

SEQ ID NO: 2068118 - RNA, 17 nt, Staphylococcus aureus subsp. aureus Mu50
auguuaaaucgauacug

SEQ ID NO: 2068119 - RNA, 17 nt, Staphylococcus aureus subsp. aureus Mu50
auguuaaagauuauuau

SEQ ID NO: 2068120 - RNA, 14 nt, Staphylococcus aureus subsp. aureus Mu50
auguguuguuuuaa

SEQ ID NO: 2068121 - RNA, 21 nt, Staphylococcus aureus subsp. aureus Mu50
auguguuguuuuaauuguuca

SEQ ID NO: 2068122 - RNA, 17 nt, Staphylococcus aureus subsp. aureus Mu50
augugaugcuugaaugu

SEQ ID NO: 2068123 - RNA, 20 nt, Staphylococcus aureus subsp. aureus Mu50
augugaugcuugaauguuug

SEQ ID NO: 2068124 - RNA, 15 nt, Staphylococcus aureus subsp. aureus Mu50
augugauguguuguu

SEQ ID NO: 2068125 - RNA, 19 nt, Staphylococcus aureus subsp. aureus Mu50
augugaacaucuaguuauu

SEQ ID NO: 2068126 - RNA, 15 nt, Staphylococcus aureus subsp. aureus Mu50
augucuuaucaauua

SEQ ID NO: 2068127 - RNA, 18 nt, Staphylococcus aureus subsp. aureus Mu50
augucuuucaaauacaca

SEQ ID NO: 2068128 - RNA, 14 nt, Staphylococcus aureus subsp. aureus Mu50
augucuuugaaaaa

SEQ ID NO: 2068129 - RNA, 15 nt, Staphylococcus aureus subsp. aureus Mu50
augucuuugaaaaac

SEQ ID NO: 2068130 - RNA, 15 nt, Staphylococcus aureus subsp. aureus Mu50
auguccugaauguuc

SEQ ID NO: 2068131 - RNA, 13 nt, Staphylococcus aureus subsp. aureus Mu50
augguuucuuauu

SEQ ID NO: 2068132 - RNA, 16 nt, Staphylococcus aureus subsp. aureus Mu50
augguuagagaaaaau

SEQ ID NO: 2068133 - RNA, 19 nt, Staphylococcus aureus subsp. aureus Mu50
augguuuaauucaggaaau

SEQ ID NO: 2068134 - RNA, 14 nt, Staphylococcus aureus subsp. aureus Mu50
augguuugaguaaa

SEQ ID NO: 2068135 - RNA, 21 nt, Staphylococcus aureus subsp. aureus Mu50
augguuuucuuuuuaucauga

SEQ ID NO: 2068136 - RNA, 13 nt, Staphylococcus aureus subsp. aureus Mu50
auguaaaauuauu

SEQ ID NO: 2068137 - RNA, 21 nt, Staphylococcus aureus subsp. aureus Mu50
auguaagaacgaaacuuuaau

SEQ ID NO: 2068138 - RNA, 20 nt, Staphylococcus aureus subsp. aureus Mu50
auguaaaaaauaucuuguca

SEQ ID NO: 2068139 - RNA, 22 nt, Staphylococcus aureus subsp. aureus Mu50
auguagugaaagucguuguuga

SEQ ID NO: 2068140 - RNA, 17 nt, Staphylococcus aureus subsp. aureus Mu50
auguaagcuaucguaaa

SEQ ID NO: 2068141 - RNA, 18 nt, Staphylococcus aureus subsp. aureus Mu50
auguaauagagaagggag

SEQ ID NO: 2068142 - RNA, 15 nt, Staphylococcus aureus subsp. aureus Mu50
auguaauagagaagg

SEQ ID NO: 2068143 - RNA, 15 nt, Staphylococcus aureus subsp. aureus Mu50
auguaaucagguuua

SEQ ID NO: 2068144 - RNA, 18 nt, Staphylococcus aureus subsp. aureus Mu50
augucccagauucauauc

SEQ ID NO: 2068145 - RNA, 23 nt, Staphylococcus aureus subsp. aureus Mu50
auguauuaauugaauugauuaua

SEQ ID NO: 2068146 - RNA, 19 nt, Staphylococcus aureus subsp. aureus Mu50
auguccauacguuccuaaa

SEQ ID NO: 2068147 - RNA, 17 nt, Staphylococcus aureus subsp. aureus Mu50
auguaugugaguaauga

SEQ ID NO: 2068148 - RNA, 22 nt, Staphylococcus aureus subsp. aureus Mu50
auguauguuuuaucaauauuag

SEQ ID NO: 2068149 - RNA, 14 nt, Staphylococcus aureus subsp. aureus Mu50
auguaucuauacaa

SEQ ID NO: 2068150 - RNA, 21 nt, Staphylococcus aureus subsp. aureus Mu50
auguauaugaauuuuauaaau

SEQ ID NO: 2068151 - RNA, 22 nt, Staphylococcus aureus subsp. aureus Mu50
auguauaugaauuuuauaaauu

SEQ ID NO: 2068152 - RNA, 12 nt, Staphylococcus aureus subsp. aureus Mu50
auguauaaaaag

SEQ ID NO: 2068153 - RNA, 14 nt, Staphylococcus aureus subsp. aureus Mu50
auguauaaaaagug

SEQ ID NO: 2068154 - RNA, 19 nt, Staphylococcus aureus subsp. aureus Mu50
auguauaaaacagaauuuc

SEQ ID NO: 2068155 - RNA, 20 nt, Staphylococcus aureus subsp. aureus Mu50
auguauaaaaccuucaauca

SEQ ID NO: 2068156 - RNA, 18 nt, Staphylococcus aureus subsp. aureus Mu50
augcgcaaaagcgcaggc

SEQ ID NO: 2068157 - RNA, 19 nt, Staphylococcus aureus subsp. aureus Mu50
augcgcaaaagcgcaggcg

SEQ ID NO: 2068158 - RNA, 15 nt, Staphylococcus aureus subsp. aureus Mu50
augcgcaaugaaaac

SEQ ID NO: 2068159 - RNA, 22 nt, Staphylococcus aureus subsp. aureus Mu50
augccuuuuauuuaucuuuuaa

SEQ ID NO: 2068160 - RNA, 16 nt, Staphylococcus aureus subsp. aureus Mu50
augcgauucucauuua

SEQ ID NO: 2068161 - RNA, 16 nt, Staphylococcus aureus subsp. aureus Mu50
augcgcaaaagcgcag

SEQ ID NO: 2068162 - RNA, 13 nt, Staphylococcus aureus subsp. aureus Mu50
augcgcaaaagcg

SEQ ID NO: 2068163 - RNA, 14 nt, Staphylococcus aureus subsp. aureus Mu50
auggcauuauugcc

SEQ ID NO: 2068164 - RNA, 20 nt, Staphylococcus aureus subsp. aureus Mu50
auggcaucuggcaaauugcc

SEQ ID NO: 2068165 - RNA, 23 nt, Staphylococcus aureus subsp. aureus Mu50
auggcaguaguugacugaacgaa

SEQ ID NO: 2068166 - RNA, 20 nt, Staphylococcus aureus subsp. aureus Mu50
auggcuauguuuuacgccaa

SEQ ID NO: 2068167 - RNA, 16 nt, Staphylococcus aureus subsp. aureus Mu50
augggagaaauuuuuc

SEQ ID NO: 2068168 - RNA, 17 nt, Staphylococcus aureus subsp. aureus Mu50
augggagaaauuuuuca

SEQ ID NO: 2068169 - RNA, 12 nt, Staphylococcus aureus subsp. aureus Mu50
augggccccaac

SEQ ID NO: 2068170 - RNA, 20 nt, Staphylococcus aureus subsp. aureus Mu50
augggccccaacaaagagaa

SEQ ID NO: 2068171 - RNA, 21 nt, Staphylococcus aureus subsp. aureus Mu50
augggauuucacuugaccacu

SEQ ID NO: 2068172 - RNA, 14 nt, Staphylococcus aureus subsp. aureus Mu50
augguguuaaguuu

SEQ ID NO: 2068173 - RNA, 22 nt, Staphylococcus aureus subsp. aureus Mu50
auggugaacuguuaaacucaua

SEQ ID NO: 2068174 - RNA, 15 nt, Staphylococcus aureus subsp. aureus Mu50
auggugaacuaaauu

SEQ ID NO: 2068175 - RNA, 19 nt, Staphylococcus aureus subsp. aureus Mu50
auuaaccuugauuuaauuu

SEQ ID NO: 2068176 - RNA, 20 nt, Staphylococcus aureus subsp. aureus Mu50
auuaacuuaaaauuuaaaua

SEQ ID NO: 2068177 - RNA, 16 nt, Staphylococcus aureus subsp. aureus Mu50
auuaacgucaacagca

SEQ ID NO: 2068178 - RNA, 16 nt, Staphylococcus aureus subsp. aureus Mu50
auuaagcaauguaacu

SEQ ID NO: 2068179 - RNA, 21 nt, Staphylococcus aureus subsp. aureus Mu50
auuaagaauaaucgaacauaa

SEQ ID NO: 2068180 - RNA, 17 nt, Staphylococcus aureus subsp. aureus Mu50
auuaagacugauuaauu

SEQ ID NO: 2068181 - RNA, 16 nt, Staphylococcus aureus subsp. aureus Mu50
auuaacuugauaucau

SEQ ID NO: 2068182 - RNA, 19 nt, Staphylococcus aureus subsp. aureus Mu50
auuaagaagaaauacuuga

SEQ ID NO: 2068183 - RNA, 15 nt, Staphylococcus aureus subsp. aureus Mu50
auuaagaaaaucauu

SEQ ID NO: 2068184 - RNA, 22 nt, Staphylococcus aureus subsp. aureus Mu50
auuaacauuuugaaucauacga

SEQ ID NO: 2068185 - RNA, 22 nt, Staphylococcus aureus subsp. aureus Mu50
auuaacacauucuuauuugaaa

SEQ ID NO: 2068186 - RNA, 21 nt, Staphylococcus aureus subsp. aureus Mu50
auuaacaccagauaucauaau

SEQ ID NO: 2068187 - RNA, 17 nt, Staphylococcus aureus subsp. aureus Mu50
auuaacaauauuaaauu

SEQ ID NO: 2068188 - RNA, 22 nt, Staphylococcus aureus subsp. aureus Mu50
auuaaauuauauguuuuuauua

SEQ ID NO: 2068189 - RNA, 19 nt, Staphylococcus aureus subsp. aureus Mu50
auuaaauuauauguuuuua

SEQ ID NO: 2068190 - RNA, 13 nt, Staphylococcus aureus subsp. aureus Mu50
auuaaaucugcuu

SEQ ID NO: 2068191 - RNA, 22 nt, Staphylococcus aureus subsp. aureus Mu50
auuaaauucuuuucaagaaauu

SEQ ID NO: 2068192 - RNA, 19 nt, Staphylococcus aureus subsp. aureus Mu50
auuaaauuuuguauaaccu

SEQ ID NO: 2068193 - RNA, 18 nt, Staphylococcus aureus subsp. aureus Mu50
auuaaauuugaaaguaaa

SEQ ID NO: 2068194 - RNA, 18 nt, Staphylococcus aureus subsp. aureus Mu50
auuaauggcaacuaagau

SEQ ID NO: 2068195 - RNA, 20 nt, Staphylococcus aureus subsp. aureus Mu50
auuaaugcucuauauaucca

SEQ ID NO: 2068196 - RNA, 16 nt, Staphylococcus aureus subsp. aureus Mu50
auuaaugaaauaccua

SEQ ID NO: 2068197 - RNA, 15 nt, Staphylococcus aureus subsp. aureus Mu50
auuaaucccuucaaa

SEQ ID NO: 2068198 - RNA, 22 nt, Staphylococcus aureus subsp. aureus Mu50
auuaaucguuaauguauaaaaa

SEQ ID NO: 2068199 - RNA, 17 nt, Staphylococcus aureus subsp. aureus Mu50
auuaaucguauuuuuaa

SEQ ID NO: 2068200 - RNA, 15 nt, Staphylococcus aureus subsp. aureus Mu50
auuaauauuagugac

SEQ ID NO: 2068201 - RNA, 17 nt, Staphylococcus aureus subsp. aureus Mu50
auuaauauaaauaucaa

SEQ ID NO: 2068202 - RNA, 20 nt, Staphylococcus aureus subsp. aureus Mu50
auuaauauaaauaucaauug

SEQ ID NO: 2068203 - RNA, 20 nt, Staphylococcus aureus subsp. aureus Mu50
auuaauaggauuauuaucaa

SEQ ID NO: 2068204 - RNA, 12 nt, Staphylococcus aureus subsp. aureus Mu50
auuaauaguaaa

SEQ ID NO: 2068205 - RNA, 18 nt, Staphylococcus aureus subsp. aureus Mu50
auuaaucauaaugaauaa

SEQ ID NO: 2068206 - RNA, 18 nt, Staphylococcus aureus subsp. aureus Mu50
auuaauaacauccccaaa

SEQ ID NO: 2068207 - RNA, 15 nt, Staphylococcus aureus subsp. aureus Mu50
auuaauacaucaaua

SEQ ID NO: 2068208 - RNA, 14 nt, Staphylococcus aureus subsp. aureus Mu50
auuaauaauuaaac

SEQ ID NO: 2068209 - RNA, 20 nt, Staphylococcus aureus subsp. aureus Mu50
auuaauaagugcuguuacuu

SEQ ID NO: 2068210 - RNA, 14 nt, Staphylococcus aureus subsp. aureus Mu50
auuaauagaaagug

SEQ ID NO: 2068211 - RNA, 16 nt, Staphylococcus aureus subsp. aureus Mu50
auuaauagagaaagaa

SEQ ID NO: 2068212 - RNA, 12 nt, Staphylococcus aureus subsp. aureus Mu50
auuaauagagac

SEQ ID NO: 2068213 - RNA, 19 nt, Staphylococcus aureus subsp. aureus Mu50
auuaagcuugaaacaaggu

SEQ ID NO: 2068214 - RNA, 15 nt, Staphylococcus aureus subsp. aureus Mu50
auuaagcuaugcuuu

SEQ ID NO: 2068215 - RNA, 15 nt, Staphylococcus aureus subsp. aureus Mu50
auuaagucuagcauu

SEQ ID NO: 2068216 - RNA, 23 nt, Staphylococcus aureus subsp. aureus Mu50
auuaaaacgaaguuauuuauuca

SEQ ID NO: 2068217 - RNA, 21 nt, Staphylococcus aureus subsp. aureus Mu50
auuaaaaugauaucugacauu

SEQ ID NO: 2068218 - RNA, 18 nt, Staphylococcus aureus subsp. aureus Mu50
auuaaaauuaaauaauga

SEQ ID NO: 2068219 - RNA, 21 nt, Staphylococcus aureus subsp. aureus Mu50
auuaaaauuacgguuugcuuu

SEQ ID NO: 2068220 - RNA, 15 nt, Staphylococcus aureus subsp. aureus Mu50
auuaaaauaauuaaa

SEQ ID NO: 2068221 - RNA, 14 nt, Staphylococcus aureus subsp. aureus Mu50
auuaaaaaacaaaa

SEQ ID NO: 2068222 - RNA, 15 nt, Staphylococcus aureus subsp. aureus Mu50
auuaaaaaacaaaac

SEQ ID NO: 2068223 - RNA, 16 nt, Staphylococcus aureus subsp. aureus Mu50
auguuuuuauuauaca

SEQ ID NO: 2068224 - RNA, 13 nt, Staphylococcus aureus subsp. aureus Mu50
auuaaaaaucaaa

SEQ ID NO: 2068225 - RNA, 15 nt, Staphylococcus aureus subsp. aureus Mu50
auuaaaaaucaaaga

SEQ ID NO: 2068226 - RNA, 19 nt, Staphylococcus aureus subsp. aureus Mu50
auuaaaaaacaauaaaauu

SEQ ID NO: 2068227 - RNA, 22 nt, Staphylococcus aureus subsp. aureus Mu50
auuaaaaaacaauaaaauuacu

SEQ ID NO: 2068228 - RNA, 16 nt, Staphylococcus aureus subsp. aureus Mu50
auuaaaucgauuaaga

SEQ ID NO: 2068229 - RNA, 23 nt, Staphylococcus aureus subsp. aureus Mu50
auuaaauccgcuuguucaacuaa

SEQ ID NO: 2068230 - RNA, 11 nt, Staphylococcus aureus subsp. aureus Mu50
auuaaauagau

SEQ ID NO: 2068231 - RNA, 20 nt, Staphylococcus aureus subsp. aureus Mu50
auuaaagcuagaaacaaugc

SEQ ID NO: 2068232 - RNA, 20 nt, Staphylococcus aureus subsp. aureus Mu50
auuaaagcuaucuucagauu

SEQ ID NO: 2068233 - RNA, 16 nt, Staphylococcus aureus subsp. aureus Mu50
auuaaaguuaaagacu

SEQ ID NO: 2068234 - RNA, 21 nt, Staphylococcus aureus subsp. aureus Mu50
auuaaaguguuucaacauauu

SEQ ID NO: 2068235 - RNA, 12 nt, Staphylococcus aureus subsp. aureus Mu50
auuaaacuuaua

SEQ ID NO: 2068236 - RNA, 15 nt, Staphylococcus aureus subsp. aureus Mu50
auuaaacuuauaacu

SEQ ID NO: 2068237 - RNA, 18 nt, Staphylococcus aureus subsp. aureus Mu50
auuaaagcaucgaacaau

SEQ ID NO: 2068238 - RNA, 20 nt, Staphylococcus aureus subsp. aureus Mu50
auuaaagcaucgaacaaucg

SEQ ID NO: 2068239 - RNA, 22 nt, Staphylococcus aureus subsp. aureus Mu50
auuaaacacgcgguaaaacgaa

SEQ ID NO: 2068240 - RNA, 17 nt, Staphylococcus aureus subsp. aureus Mu50
auguuuaauuuucuaaa

SEQ ID NO: 2068241 - RNA, 20 nt, Staphylococcus aureus subsp. aureus Mu50
auguuuaauuugauuaaauu

SEQ ID NO: 2068242 - RNA, 14 nt, Staphylococcus aureus subsp. aureus Mu50
auguuuaaacauuu

SEQ ID NO: 2068243 - RNA, 19 nt, Staphylococcus aureus subsp. aureus Mu50
auguuuauauugcaaaaau

SEQ ID NO: 2068244 - RNA, 19 nt, Staphylococcus aureus subsp. aureus Mu50
auguuuucuauaauauuua

SEQ ID NO: 2068245 - RNA, 22 nt, Staphylococcus aureus subsp. aureus Mu50
auguuugucguuacuaccuauu

SEQ ID NO: 2068246 - RNA, 21 nt, Staphylococcus aureus subsp. aureus Mu50
auguuugcauaccuauaaaca

SEQ ID NO: 2068247 - RNA, 20 nt, Staphylococcus aureus subsp. aureus Mu50
auguuugcaacauauuuuca

SEQ ID NO: 2068248 - RNA, 22 nt, Staphylococcus aureus subsp. aureus Mu50
auguuugggauauagaaaaggg

SEQ ID NO: 2068249 - RNA, 22 nt, Staphylococcus aureus subsp. aureus Mu50
auguuugaugauucguauucaa

SEQ ID NO: 2068250 - RNA, 15 nt, Staphylococcus aureus subsp. aureus Mu50
auguuugauucuaaa

SEQ ID NO: 2068251 - RNA, 19 nt, Staphylococcus aureus subsp. aureus Mu50
auguuugauucuaaauaau

SEQ ID NO: 2068252 - RNA, 11 nt, Staphylococcus aureus subsp. aureus Mu50
auguuugauuu

SEQ ID NO: 2068253 - RNA, 22 nt, Staphylococcus aureus subsp. aureus Mu50
auguuugauuuuauucacuuuu

SEQ ID NO: 2068254 - RNA, 20 nt, Staphylococcus aureus subsp. aureus Mu50
auguuggaaaaggucaaaaa

SEQ ID NO: 2068255 - RNA, 20 nt, Staphylococcus aureus subsp. aureus Mu50
auguugguucaucaaacaac

SEQ ID NO: 2068256 - RNA, 18 nt, Staphylococcus aureus subsp. aureus Mu50
auguugucacuuggauuc

SEQ ID NO: 2068257 - RNA, 13 nt, Staphylococcus aureus subsp. aureus Mu50
auguuuaaacauu

SEQ ID NO: 2068258 - RNA, 21 nt, Staphylococcus aureus subsp. aureus Mu50
auguuguuugcggcuuccucu

SEQ ID NO: 2068259 - RNA, 14 nt, Staphylococcus aureus subsp. aureus Mu50
auguuguuauauaa

SEQ ID NO: 2068260 - RNA, 19 nt, Staphylococcus aureus subsp. aureus Mu50
auguuguuauauaaauaug

SEQ ID NO: 2068261 - RNA, 23 nt, Staphylococcus aureus subsp. aureus Mu50
auguuguuauauaaauaugguuu

SEQ ID NO: 2068262 - RNA, 16 nt, Staphylococcus aureus subsp. aureus Mu50
auguuguuauaaagga

SEQ ID NO: 2068263 - RNA, 18 nt, Staphylococcus aureus subsp. aureus Mu50
auguucaucaacaugaua

SEQ ID NO: 2068264 - RNA, 15 nt, Staphylococcus aureus subsp. aureus Mu50
auuagucaucaaccu

SEQ ID NO: 2068265 - RNA, 23 nt, Staphylococcus aureus subsp. aureus Mu50
auuagucauccaaagaaacggaa

SEQ ID NO: 2068266 - RNA, 17 nt, Staphylococcus aureus subsp. aureus Mu50
auuagugucacaaagaa

SEQ ID NO: 2068267 - RNA, 15 nt, Staphylococcus aureus subsp. aureus Mu50
auuaguuuuuaaaau

SEQ ID NO: 2068268 - RNA, 14 nt, Staphylococcus aureus subsp. aureus Mu50
auuaggauguucag

SEQ ID NO: 2068269 - RNA, 23 nt, Staphylococcus aureus subsp. aureus Mu50
auuaggauuaacauaacuagcaa

SEQ ID NO: 2068270 - RNA, 16 nt, Staphylococcus aureus subsp. aureus Mu50
auuaggauucaauaau

SEQ ID NO: 2068271 - RNA, 20 nt, Staphylococcus aureus subsp. aureus Mu50
auuaggucuacgaucaaaau

SEQ ID NO: 2068272 - RNA, 15 nt, Staphylococcus aureus subsp. aureus Mu50
auuaguaaauauagu

SEQ ID NO: 2068273 - RNA, 16 nt, Staphylococcus aureus subsp. aureus Mu50
auuaguagccacaauu

SEQ ID NO: 2068274 - RNA, 20 nt, Staphylococcus aureus subsp. aureus Mu50
auuaguacuaaaccgauuaa

SEQ ID NO: 2068275 - RNA, 22 nt, Staphylococcus aureus subsp. aureus Mu50
auuauaauagcuuucguuucuu

SEQ ID NO: 2068276 - RNA, 16 nt, Staphylococcus aureus subsp. aureus Mu50
auuauaauaaauagac

SEQ ID NO: 2068277 - RNA, 18 nt, Staphylococcus aureus subsp. aureus Mu50
auuauaauaaauagacug

SEQ ID NO: 2068278 - RNA, 16 nt, Staphylococcus aureus subsp. aureus Mu50
auuauaaugauuuuua

SEQ ID NO: 2068279 - RNA, 17 nt, Staphylococcus aureus subsp. aureus Mu50
auuauaauuuuguuuca

SEQ ID NO: 2068280 - RNA, 20 nt, Staphylococcus aureus subsp. aureus Mu50
auuauaaguagugauuuuuu

SEQ ID NO: 2068281 - RNA, 22 nt, Staphylococcus aureus subsp. aureus Mu50
auuauaaauuugguacauaaua

SEQ ID NO: 2068282 - RNA, 21 nt, Staphylococcus aureus subsp. aureus Mu50
auuauacgugcuuuaaaguug

SEQ ID NO: 2068283 - RNA, 13 nt, Staphylococcus aureus subsp. aureus Mu50
auuauacacuuuu

SEQ ID NO: 2068284 - RNA, 15 nt, Staphylococcus aureus subsp. aureus Mu50
auuauacaaauuaua

SEQ ID NO: 2068285 - RNA, 21 nt, Staphylococcus aureus subsp. aureus Mu50
auuauauggagcuacccuauu

SEQ ID NO: 2068286 - RNA, 13 nt, Staphylococcus aureus subsp. aureus Mu50
auuauauauauua

SEQ ID NO: 2068287 - RNA, 13 nt, Staphylococcus aureus subsp. aureus Mu50
auuauauuuuucu

SEQ ID NO: 2068288 - RNA, 21 nt, Staphylococcus aureus subsp. aureus Mu50
auuauauuuuucuucaguuaa

SEQ ID NO: 2068289 - RNA, 14 nt, Staphylococcus aureus subsp. aureus Mu50
auuauauuuucuca

SEQ ID NO: 2068290 - RNA, 19 nt, Staphylococcus aureus subsp. aureus Mu50
auuauagggcuguuuuuuu

SEQ ID NO: 2068291 - RNA, 16 nt, Staphylococcus aureus subsp. aureus Mu50
auuauagguauaagaa

SEQ ID NO: 2068292 - RNA, 18 nt, Staphylococcus aureus subsp. aureus Mu50
auuauagucuuaaacaua

SEQ ID NO: 2068293 - RNA, 17 nt, Staphylococcus aureus subsp. aureus Mu50
auuauauagaaaacuag

SEQ ID NO: 2068294 - RNA, 15 nt, Staphylococcus aureus subsp. aureus Mu50
auuacugauuguuaa

SEQ ID NO: 2068295 - RNA, 22 nt, Staphylococcus aureus subsp. aureus Mu50
auuacuccaauuaccaaugaau

SEQ ID NO: 2068296 - RNA, 22 nt, Staphylococcus aureus subsp. aureus Mu50
auuacuugaaaauagccauauu

SEQ ID NO: 2068297 - RNA, 13 nt, Staphylococcus aureus subsp. aureus Mu50
auuacuugaauau

SEQ ID NO: 2068298 - RNA, 15 nt, Staphylococcus aureus subsp. aureus Mu50
auuacuugaauauua

SEQ ID NO: 2068299 - RNA, 16 nt, Staphylococcus aureus subsp. aureus Mu50
auuacuuccauugcuu

SEQ ID NO: 2068300 - RNA, 22 nt, Staphylococcus aureus subsp. aureus Mu50
auuacuuauuucuuuucauuau

SEQ ID NO: 2068301 - RNA, 15 nt, Staphylococcus aureus subsp. aureus Mu50
auuacuguuugcuuu

SEQ ID NO: 2068302 - RNA, 17 nt, Staphylococcus aureus subsp. aureus Mu50
auuacuuucauuguaaa

SEQ ID NO: 2068303 - RNA, 18 nt, Staphylococcus aureus subsp. aureus Mu50
auuacuuuaauuuaguga

SEQ ID NO: 2068304 - RNA, 13 nt, Staphylococcus aureus subsp. aureus Mu50
auuacuuuagaaa

SEQ ID NO: 2068305 - RNA, 17 nt, Staphylococcus aureus subsp. aureus Mu50
auuacuugcacaccagu

SEQ ID NO: 2068306 - RNA, 15 nt, Staphylococcus aureus subsp. aureus Mu50
auuacuuuggaaauu

SEQ ID NO: 2068307 - RNA, 17 nt, Staphylococcus aureus subsp. aureus Mu50
auuacuuuggaaauuua

SEQ ID NO: 2068308 - RNA, 14 nt, Staphylococcus aureus subsp. aureus Mu50
auuagaauauaugu

SEQ ID NO: 2068309 - RNA, 14 nt, Staphylococcus aureus subsp. aureus Mu50
auuagauacuucuu

SEQ ID NO: 2068310 - RNA, 22 nt, Staphylococcus aureus subsp. aureus Mu50
auuagauaaaauaauuguucuu

SEQ ID NO: 2068311 - RNA, 17 nt, Staphylococcus aureus subsp. aureus Mu50
auuagauauauuugaaa

SEQ ID NO: 2068312 - RNA, 22 nt, Staphylococcus aureus subsp. aureus Mu50
auuagauaucuuaaucuaaaaa

SEQ ID NO: 2068313 - RNA, 19 nt, Staphylococcus aureus subsp. aureus Mu50
auuagauauauuugaaagg

SEQ ID NO: 2068314 - RNA, 13 nt, Staphylococcus aureus subsp. aureus Mu50
auuagauuuuaug

SEQ ID NO: 2068315 - RNA, 22 nt, Staphylococcus aureus subsp. aureus Mu50
auuagcgaaaaccucuguuuug

SEQ ID NO: 2068316 - RNA, 23 nt, Staphylococcus aureus subsp. aureus Mu50
auuagccgaaaaacaucauuucu

SEQ ID NO: 2068317 - RNA, 22 nt, Staphylococcus aureus subsp. aureus Mu50
auuagauuuuaugcuuuacuug

SEQ ID NO: 2068318 - RNA, 16 nt, Staphylococcus aureus subsp. aureus Mu50
auuacauaauuuaucu

SEQ ID NO: 2068319 - RNA, 14 nt, Staphylococcus aureus subsp. aureus Mu50
auuacauuuuaugu

SEQ ID NO: 2068320 - RNA, 13 nt, Staphylococcus aureus subsp. aureus Mu50
auuacuaaccuau

SEQ ID NO: 2068321 - RNA, 18 nt, Staphylococcus aureus subsp. aureus Mu50
auuacuaaaacaaauuca

SEQ ID NO: 2068322 - RNA, 19 nt, Staphylococcus aureus subsp. aureus Mu50
auuacuacauaauuuauca

SEQ ID NO: 2068323 - RNA, 19 nt, Staphylococcus aureus subsp. aureus Mu50
auuacuaaccuauuaaaaa

SEQ ID NO: 2068324 - RNA, 20 nt, Staphylococcus aureus subsp. aureus Mu50
auuacuaaccuauuaaaaaa

SEQ ID NO: 2068325 - RNA, 22 nt, Staphylococcus aureus subsp. aureus Mu50
auuacucaaaauuaaagcuuaa

SEQ ID NO: 2068326 - RNA, 17 nt, Staphylococcus aureus subsp. aureus Mu50
auuacgucauaaaauac

SEQ ID NO: 2068327 - RNA, 18 nt, Staphylococcus aureus subsp. aureus Mu50
auuacgcucaucaccuuu

SEQ ID NO: 2068328 - RNA, 17 nt, Staphylococcus aureus subsp. aureus Mu50
auuacgcucauaugucu

SEQ ID NO: 2068329 - RNA, 14 nt, Staphylococcus aureus subsp. aureus Mu50
auuaauguaaugau

SEQ ID NO: 2068330 - RNA, 20 nt, Staphylococcus aureus subsp. aureus Mu50
auuaauguucaaaaaaugaa

SEQ ID NO: 2068331 - RNA, 22 nt, Staphylococcus aureus subsp. aureus Mu50
auuaauuacuuucauuguaaau

SEQ ID NO: 2068332 - RNA, 12 nt, Staphylococcus aureus subsp. aureus Mu50
auuaauuaacaa

SEQ ID NO: 2068333 - RNA, 13 nt, Staphylococcus aureus subsp. aureus Mu50
auuaauugaaaaa

SEQ ID NO: 2068334 - RNA, 17 nt, Staphylococcus aureus subsp. aureus Mu50
auuaauugaaaaaccaa

SEQ ID NO: 2068335 - RNA, 17 nt, Staphylococcus aureus subsp. aureus Mu50
auuaauuggauuaaaua

SEQ ID NO: 2068336 - RNA, 22 nt, Staphylococcus aureus subsp. aureus Mu50
auuaauuauaaguagugauuuu

SEQ ID NO: 2068337 - RNA, 11 nt, Staphylococcus aureus subsp. aureus Mu50
auuaauuauua

SEQ ID NO: 2068338 - RNA, 19 nt, Staphylococcus aureus subsp. aureus Mu50
auuaauuuucuuuuuuaau

SEQ ID NO: 2068339 - RNA, 13 nt, Staphylococcus aureus subsp. aureus Mu50
auuaauuuucuuu

SEQ ID NO: 2068340 - RNA, 15 nt, Staphylococcus aureus subsp. aureus Mu50
auuaauuuuucaaaa

SEQ ID NO: 2068341 - RNA, 17 nt, Staphylococcus aureus subsp. aureus Mu50
auuaauuuuucaaaugu

SEQ ID NO: 2068342 - RNA, 17 nt, Staphylococcus aureus subsp. aureus Mu50
auuaauuucauguucau

SEQ ID NO: 2068343 - RNA, 15 nt, Staphylococcus aureus subsp. aureus Mu50
auuaauuugaaugcc

SEQ ID NO: 2068344 - RNA, 19 nt, Staphylococcus aureus subsp. aureus Mu50
auuaauuguaaagcaugaa

SEQ ID NO: 2068345 - RNA, 20 nt, Staphylococcus aureus subsp. aureus Mu50
auuaauuuacucaaaccauc

SEQ ID NO: 2068346 - RNA, 15 nt, Staphylococcus aureus subsp. aureus Mu50
auuaauuggauuuuu

SEQ ID NO: 2068347 - RNA, 24 nt, Staphylococcus aureus subsp. aureus Mu50
auuacaggaaauccgcauaaauua

SEQ ID NO: 2068348 - RNA, 21 nt, Staphylococcus aureus subsp. aureus Mu50
auuacagcguaacuaaagaau

SEQ ID NO: 2068349 - RNA, 18 nt, Staphylococcus aureus subsp. aureus Mu50
auuacaucuauauuuguu

SEQ ID NO: 2068350 - RNA, 15 nt, Staphylococcus aureus subsp. aureus Mu50
auuacaaugaaaaaa

SEQ ID NO: 2068351 - RNA, 21 nt, Staphylococcus aureus subsp. aureus Mu50
auuacaauaagcgcaauuaaa

SEQ ID NO: 2068352 - RNA, 22 nt, Staphylococcus aureus subsp. aureus Mu50
auuacacuacgcugaugaauga

SEQ ID NO: 2068353 - RNA, 19 nt, Staphylococcus aureus subsp. aureus Mu50
auuacacgcauuacuuuag

SEQ ID NO: 2068354 - RNA, 18 nt, Staphylococcus aureus subsp. aureus Mu50
auuacacccuuuaaauuu

SEQ ID NO: 2068355 - RNA, 19 nt, Staphylococcus aureus subsp. aureus Mu50
auucacuacuuuuucaacu

SEQ ID NO: 2068356 - RNA, 20 nt, Staphylococcus aureus subsp. aureus Mu50
auucacgcguucaaauguug

SEQ ID NO: 2068357 - RNA, 20 nt, Staphylococcus aureus subsp. aureus Mu50
auucacuuuuuuuaauuuga

SEQ ID NO: 2068358 - RNA, 22 nt, Staphylococcus aureus subsp. aureus Mu50
auucacuuuuuuuaauuugauu

SEQ ID NO: 2068359 - RNA, 17 nt, Staphylococcus aureus subsp. aureus Mu50
auucagauuuucgagug

SEQ ID NO: 2068360 - RNA, 13 nt, Staphylococcus aureus subsp. aureus Mu50
auucaauuuaguu

SEQ ID NO: 2068361 - RNA, 18 nt, Staphylococcus aureus subsp. aureus Mu50
auucaauugauuacacca

SEQ ID NO: 2068362 - RNA, 17 nt, Staphylococcus aureus subsp. aureus Mu50
auucaauguaauuuuca

SEQ ID NO: 2068363 - RNA, 16 nt, Staphylococcus aureus subsp. aureus Mu50
auucaaugauuuuuaa

SEQ ID NO: 2068364 - RNA, 14 nt, Staphylococcus aureus subsp. aureus Mu50
auucaauucuguga

SEQ ID NO: 2068365 - RNA, 15 nt, Staphylococcus aureus subsp. aureus Mu50
auucacauacauuuu

SEQ ID NO: 2068366 - RNA, 18 nt, Staphylococcus aureus subsp. aureus Mu50
auucaccagguuuuuuau

SEQ ID NO: 2068367 - RNA, 18 nt, Staphylococcus aureus subsp. aureus Mu50
auucaacgucaucaaaac

SEQ ID NO: 2068368 - RNA, 12 nt, Staphylococcus aureus subsp. aureus Mu50
auucaaccaauu

SEQ ID NO: 2068369 - RNA, 13 nt, Staphylococcus aureus subsp. aureus Mu50
auucaaaucauaa

SEQ ID NO: 2068370 - RNA, 22 nt, Staphylococcus aureus subsp. aureus Mu50
auucaaauaaaugacauuuaau

SEQ ID NO: 2068371 - RNA, 20 nt, Staphylococcus aureus subsp. aureus Mu50
auucaaaguuuucauuuaac

SEQ ID NO: 2068372 - RNA, 21 nt, Staphylococcus aureus subsp. aureus Mu50
auucaaauaaaucaaacuuuu

SEQ ID NO: 2068373 - RNA, 12 nt, Staphylococcus aureus subsp. aureus Mu50
auucaacuuaaa

SEQ ID NO: 2068374 - RNA, 19 nt, Staphylococcus aureus subsp. aureus Mu50
auucaagcaucauuuuucg

SEQ ID NO: 2068375 - RNA, 16 nt, Staphylococcus aureus subsp. aureus Mu50
auucaagcaucauuuu

SEQ ID NO: 2068376 - RNA, 18 nt, Staphylococcus aureus subsp. aureus Mu50
auucaagcaucauuuuuc

SEQ ID NO: 2068377 - RNA, 21 nt, Staphylococcus aureus subsp. aureus Mu50
auuauuuuguauuuuucaaau

SEQ ID NO: 2068378 - RNA, 16 nt, Staphylococcus aureus subsp. aureus Mu50
auuauuugauaaauaa

SEQ ID NO: 2068379 - RNA, 14 nt, Staphylococcus aureus subsp. aureus Mu50
auuauuuuuuuaaa

SEQ ID NO: 2068380 - RNA, 18 nt, Staphylococcus aureus subsp. aureus Mu50
auucaaaauucaauauua

SEQ ID NO: 2068381 - RNA, 19 nt, Staphylococcus aureus subsp. aureus Mu50
auucaaaauucaauauuaa

SEQ ID NO: 2068382 - RNA, 19 nt, Staphylococcus aureus subsp. aureus Mu50
auuauguauuuuuauuuau

SEQ ID NO: 2068383 - RNA, 17 nt, Staphylococcus aureus subsp. aureus Mu50
auuauggagcggaagau

SEQ ID NO: 2068384 - RNA, 14 nt, Staphylococcus aureus subsp. aureus Mu50
auuauguaaaaaau

SEQ ID NO: 2068385 - RNA, 15 nt, Staphylococcus aureus subsp. aureus Mu50
auuaugcuucaaagu

SEQ ID NO: 2068386 - RNA, 21 nt, Staphylococcus aureus subsp. aureus Mu50
auuaugccuauuugacacauu

SEQ ID NO: 2068387 - RNA, 19 nt, Staphylococcus aureus subsp. aureus Mu50
auuauuaggggagauuaga

SEQ ID NO: 2068388 - RNA, 16 nt, Staphylococcus aureus subsp. aureus Mu50
auuauuauaauaaaua

SEQ ID NO: 2068389 - RNA, 19 nt, Staphylococcus aureus subsp. aureus Mu50
auuauuaugccuuugauuu

SEQ ID NO: 2068390 - RNA, 19 nt, Staphylococcus aureus subsp. aureus Mu50
auuauuaaauuauggagcg

SEQ ID NO: 2068391 - RNA, 19 nt, Staphylococcus aureus subsp. aureus Mu50
auuauuaagugaguuuuau

SEQ ID NO: 2068392 - RNA, 20 nt, Staphylococcus aureus subsp. aureus Mu50
auuauuaaggggguaauacu

SEQ ID NO: 2068393 - RNA, 18 nt, Staphylococcus aureus subsp. aureus Mu50
auuauugguugaaauuaa

SEQ ID NO: 2068394 - RNA, 14 nt, Staphylococcus aureus subsp. aureus Mu50
auuauuuauauuuu

SEQ ID NO: 2068395 - RNA, 16 nt, Staphylococcus aureus subsp. aureus Mu50
auuauuuauucauuau

SEQ ID NO: 2068396 - RNA, 22 nt, Staphylococcus aureus subsp. aureus Mu50
auuauuuagaauucuaaaagaa

SEQ ID NO: 2068397 - RNA, 16 nt, Staphylococcus aureus subsp. aureus Mu50
auuauuuaaauuuuca

SEQ ID NO: 2068398 - RNA, 16 nt, Staphylococcus aureus subsp. aureus Mu50
auuauuuaaaaugcuu

SEQ ID NO: 2068399 - RNA, 14 nt, Staphylococcus aureus subsp. aureus Mu50
auuauucucuuuau

SEQ ID NO: 2068400 - RNA, 21 nt, Staphylococcus aureus subsp. aureus Mu50
auuauucucucauuuguauag

SEQ ID NO: 2068401 - RNA, 14 nt, Staphylococcus aureus subsp. aureus Mu50
auuauuauuuuaau

SEQ ID NO: 2068402 - RNA, 17 nt, Staphylococcus aureus subsp. aureus Mu50
auuauuauuaaauuaug

SEQ ID NO: 2068403 - RNA, 14 nt, Staphylococcus aureus subsp. aureus Mu50
auuauuauugaaau

SEQ ID NO: 2068404 - RNA, 16 nt, Staphylococcus aureus subsp. aureus Mu50
auuauuccauugaugu

SEQ ID NO: 2068405 - RNA, 20 nt, Staphylococcus aureus subsp. aureus Mu50
auuauucauaauauauuaac

SEQ ID NO: 2068406 - RNA, 12 nt, Staphylococcus aureus subsp. aureus Mu50
auuauugaaacu

SEQ ID NO: 2068407 - RNA, 20 nt, Staphylococcus aureus subsp. aureus Mu50
auuauugaaaucgauacuaa

SEQ ID NO: 2068408 - RNA, 22 nt, Staphylococcus aureus subsp. aureus Mu50
auuauucugagauugagaauuc

SEQ ID NO: 2068409 - RNA, 16 nt, Staphylococcus aureus subsp. aureus Mu50
auuauugaaaacaaaa

SEQ ID NO: 2068410 - RNA, 17 nt, Staphylococcus aureus subsp. aureus Mu50
auuauucuucauuuaua

SEQ ID NO: 2068411 - RNA, 22 nt, Staphylococcus aureus subsp. aureus Mu50
auuaugauacgcuuuuuaaaaa

SEQ ID NO: 2068412 - RNA, 17 nt, Staphylococcus aureus subsp. aureus Mu50
auuaugauuauauuuuc

SEQ ID NO: 2068413 - RNA, 19 nt, Staphylococcus aureus subsp. aureus Mu50
auuaugauugcuuauuuau

SEQ ID NO: 2068414 - RNA, 20 nt, Staphylococcus aureus subsp. aureus Mu50
auuaugauacgcuuuuuaaa

SEQ ID NO: 2068415 - RNA, 21 nt, Staphylococcus aureus subsp. aureus Mu50
auuaugaggcugaguauacca

SEQ ID NO: 2068416 - RNA, 17 nt, Staphylococcus aureus subsp. aureus Mu50
auuaucuuuaguauuuc

SEQ ID NO: 2068417 - RNA, 22 nt, Staphylococcus aureus subsp. aureus Mu50
auuaucuguaauuaauccaucu

SEQ ID NO: 2068418 - RNA, 12 nt, Staphylococcus aureus subsp. aureus Mu50
auuaucuuuacg

SEQ ID NO: 2068419 - RNA, 22 nt, Staphylococcus aureus subsp. aureus Mu50
auuaucuuuaguauuucaucau

SEQ ID NO: 2068420 - RNA, 22 nt, Staphylococcus aureus subsp. aureus Mu50
auuaucuuuaauuuacaauuaa

SEQ ID NO: 2068421 - RNA, 18 nt, Staphylococcus aureus subsp. aureus Mu50
auuaucuuuguaaauuuu

SEQ ID NO: 2068422 - RNA, 14 nt, Staphylococcus aureus subsp. aureus Mu50
auuaugaaaaguaa

SEQ ID NO: 2068423 - RNA, 14 nt, Staphylococcus aureus subsp. aureus Mu50
auuaucuguaauua

SEQ ID NO: 2068424 - RNA, 18 nt, Staphylococcus aureus subsp. aureus Mu50
auuaucuuaagucaucaa

SEQ ID NO: 2068425 - RNA, 14 nt, Staphylococcus aureus subsp. aureus Mu50
auuaucuaaagaaa

SEQ ID NO: 2068426 - RNA, 15 nt, Staphylococcus aureus subsp. aureus Mu50
auuaucuaaagaaau

SEQ ID NO: 2068427 - RNA, 22 nt, Staphylococcus aureus subsp. aureus Mu50
auuaucuaaagaaaucucuauc

SEQ ID NO: 2068428 - RNA, 14 nt, Staphylococcus aureus subsp. aureus Mu50
auuaucuauccauu

SEQ ID NO: 2068429 - RNA, 20 nt, Staphylococcus aureus subsp. aureus Mu50
auuaucuauccauuugguuu

SEQ ID NO: 2068430 - RNA, 20 nt, Staphylococcus aureus subsp. aureus Mu50
auuaucauauaaaucaaaua

SEQ ID NO: 2068431 - RNA, 21 nt, Staphylococcus aureus subsp. aureus Mu50
auuaucaccuucaaacuuuca

SEQ ID NO: 2068432 - RNA, 15 nt, Staphylococcus aureus subsp. aureus Mu50
auuaucaauagauga

SEQ ID NO: 2068433 - RNA, 14 nt, Staphylococcus aureus subsp. aureus Mu50
auuauccuacugcu

SEQ ID NO: 2068434 - RNA, 18 nt, Staphylococcus aureus subsp. aureus Mu50
auuauccucaaauauauu

SEQ ID NO: 2068435 - RNA, 21 nt, Staphylococcus aureus subsp. aureus Mu50
auuaucgaagaaacauuauau

SEQ ID NO: 2068436 - RNA, 18 nt, Staphylococcus aureus subsp. aureus Mu50
auauaaauuaucagaauc

SEQ ID NO: 2068437 - RNA, 17 nt, Staphylococcus aureus subsp. aureus Mu50
auauaacauuaaaauga

SEQ ID NO: 2068438 - RNA, 18 nt, Staphylococcus aureus subsp. aureus Mu50
auauaacgacacuuuuua

SEQ ID NO: 2068439 - RNA, 21 nt, Staphylococcus aureus subsp. aureus Mu50
auauaaaaaagaucacugcca

SEQ ID NO: 2068440 - RNA, 18 nt, Staphylococcus aureus subsp. aureus Mu50
auauaaaaacaaaagaaa

SEQ ID NO: 2068441 - RNA, 23 nt, Staphylococcus aureus subsp. aureus Mu50
auauaaaaaccccuguugaacuu

SEQ ID NO: 2068442 - RNA, 15 nt, Staphylococcus aureus subsp. aureus Mu50
auauaaaaagugaaa

SEQ ID NO: 2068443 - RNA, 19 nt, Staphylococcus aureus subsp. aureus Mu50
auauaaaacgauaagaauu

SEQ ID NO: 2068444 - RNA, 13 nt, Staphylococcus aureus subsp. aureus Mu50
auauaaaaucauu

SEQ ID NO: 2068445 - RNA, 16 nt, Staphylococcus aureus subsp. aureus Mu50
auauaaaaucauuaau

SEQ ID NO: 2068446 - RNA, 23 nt, Staphylococcus aureus subsp. aureus Mu50
auauaauucgucuguuucauaua

SEQ ID NO: 2068447 - RNA, 19 nt, Staphylococcus aureus subsp. aureus Mu50
auauaauucuuguuugauu

SEQ ID NO: 2068448 - RNA, 17 nt, Staphylococcus aureus subsp. aureus Mu50
auauaauuaauuuugua

SEQ ID NO: 2068449 - RNA, 22 nt, Staphylococcus aureus subsp. aureus Mu50
auauaauguauaaaacagaauu

SEQ ID NO: 2068450 - RNA, 14 nt, Staphylococcus aureus subsp. aureus Mu50
auauaauuuauuua

SEQ ID NO: 2068451 - RNA, 21 nt, Staphylococcus aureus subsp. aureus Mu50
auauaacuauggucaucaauu

SEQ ID NO: 2068452 - RNA, 21 nt, Staphylococcus aureus subsp. aureus Mu50
auauaaugguugaauaacacu

SEQ ID NO: 2068453 - RNA, 23 nt, Staphylococcus aureus subsp. aureus Mu50
auauaacuucuauuaagaaauac

SEQ ID NO: 2068454 - RNA, 19 nt, Staphylococcus aureus subsp. aureus Mu50
auauaagauucauauuuau

SEQ ID NO: 2068455 - RNA, 23 nt, Staphylococcus aureus subsp. aureus Mu50
auaguugagcguuuaauuagaaa

SEQ ID NO: 2068456 - RNA, 20 nt, Staphylococcus aureus subsp. aureus Mu50
auaguugucuuuacauucuu

SEQ ID NO: 2068457 - RNA, 14 nt, Staphylococcus aureus subsp. aureus Mu50
auaguuuauuaaua

SEQ ID NO: 2068458 - RNA, 15 nt, Staphylococcus aureus subsp. aureus Mu50
auaguuucaaugccu

SEQ ID NO: 2068459 - RNA, 23 nt, Staphylococcus aureus subsp. aureus Mu50
auaguuucaaugccuugucuauu

SEQ ID NO: 2068460 - RNA, 18 nt, Staphylococcus aureus subsp. aureus Mu50
auaguuuuucauauucac

SEQ ID NO: 2068461 - RNA, 15 nt, Staphylococcus aureus subsp. aureus Mu50
auaguuuucuucacu

SEQ ID NO: 2068462 - RNA, 18 nt, Staphylococcus aureus subsp. aureus Mu50
auaguggugguacuuuuu

SEQ ID NO: 2068463 - RNA, 19 nt, Staphylococcus aureus subsp. aureus Mu50
auaguaggguauugaaaua

SEQ ID NO: 2068464 - RNA, 18 nt, Staphylococcus aureus subsp. aureus Mu50
auaggaauacaugaguaa

SEQ ID NO: 2068465 - RNA, 17 nt, Staphylococcus aureus subsp. aureus Mu50
auaggauuauuaucaaa

SEQ ID NO: 2068466 - RNA, 24 nt, Staphylococcus aureus subsp. aureus Mu50
auaggauuugcaccuauaccucgu

SEQ ID NO: 2068467 - RNA, 18 nt, Staphylococcus aureus subsp. aureus Mu50
auaggcuugccaauguga

SEQ ID NO: 2068468 - RNA, 17 nt, Staphylococcus aureus subsp. aureus Mu50
auaggugauuauauaua

SEQ ID NO: 2068469 - RNA, 14 nt, Staphylococcus aureus subsp. aureus Mu50
auagguauaagaau

SEQ ID NO: 2068470 - RNA, 15 nt, Staphylococcus aureus subsp. aureus Mu50
auagguauaaucauu

SEQ ID NO: 2068471 - RNA, 13 nt, Staphylococcus aureus subsp. aureus Mu50
auagguaucuuaa

SEQ ID NO: 2068472 - RNA, 19 nt, Staphylococcus aureus subsp. aureus Mu50
auaguaaaauaaauacaau

SEQ ID NO: 2068473 - RNA, 13 nt, Staphylococcus aureus subsp. aureus Mu50
auaguaagaaaag

SEQ ID NO: 2068474 - RNA, 17 nt, Staphylococcus aureus subsp. aureus Mu50
auaguaaagugaaauaa

SEQ ID NO: 2068475 - RNA, 18 nt, Staphylococcus aureus subsp. aureus Mu50
auaguaagguuugaacuc

SEQ ID NO: 2068476 - RNA, 16 nt, Staphylococcus aureus subsp. aureus Mu50
auaguaauaaaagucg

SEQ ID NO: 2068477 - RNA, 13 nt, Staphylococcus aureus subsp. aureus Mu50
auaguaauaaaau

SEQ ID NO: 2068478 - RNA, 19 nt, Staphylococcus aureus subsp. aureus Mu50
auaguacuaagcuuucauu

SEQ ID NO: 2068479 - RNA, 19 nt, Staphylococcus aureus subsp. aureus Mu50
auaguacuuaauuuaaauu

SEQ ID NO: 2068480 - RNA, 16 nt, Staphylococcus aureus subsp. aureus Mu50
auauacuuaauuuaaa

SEQ ID NO: 2068481 - RNA, 17 nt, Staphylococcus aureus subsp. aureus Mu50
auauacuuguucaacaa

SEQ ID NO: 2068482 - RNA, 17 nt, Staphylococcus aureus subsp. aureus Mu50
auauacuuuuuaaauga

SEQ ID NO: 2068483 - RNA, 23 nt, Staphylococcus aureus subsp. aureus Mu50
auauagaaaaugaguacaacaua

SEQ ID NO: 2068484 - RNA, 18 nt, Staphylococcus aureus subsp. aureus Mu50
auauauuaacaacuuuau

SEQ ID NO: 2068485 - RNA, 19 nt, Staphylococcus aureus subsp. aureus Mu50
auauauuaacaacuuuauu

SEQ ID NO: 2068486 - RNA, 20 nt, Staphylococcus aureus subsp. aureus Mu50
auauauguauaacauuauua

SEQ ID NO: 2068487 - RNA, 22 nt, Staphylococcus aureus subsp. aureus Mu50
auauagaagauauaacauguau

SEQ ID NO: 2068488 - RNA, 18 nt, Staphylococcus aureus subsp. aureus Mu50
auauauucguuacaaaug

SEQ ID NO: 2068489 - RNA, 15 nt, Staphylococcus aureus subsp. aureus Mu50
auauauuaaaguaaa

SEQ ID NO: 2068490 - RNA, 14 nt, Staphylococcus aureus subsp. aureus Mu50
auauauuauaaccc

SEQ ID NO: 2068491 - RNA, 12 nt, Staphylococcus aureus subsp. aureus Mu50
auauauuuuguu

SEQ ID NO: 2068492 - RNA, 12 nt, Staphylococcus aureus subsp. aureus Mu50
auauauuugaaa

SEQ ID NO: 2068493 - RNA, 17 nt, Staphylococcus aureus subsp. aureus Mu50
auauauuugaaagguaa

SEQ ID NO: 2068494 - RNA, 19 nt, Staphylococcus aureus subsp. aureus Mu50
auauauuuauuuuugauag

SEQ ID NO: 2068495 - RNA, 21 nt, Staphylococcus aureus subsp. aureus Mu50
auaucagcuuguuucagguuu

SEQ ID NO: 2068496 - RNA, 15 nt, Staphylococcus aureus subsp. aureus Mu50
auaucagcuuuuuca

SEQ ID NO: 2068497 - RNA, 15 nt, Staphylococcus aureus subsp. aureus Mu50
auaucaguaauaaua

SEQ ID NO: 2068498 - RNA, 21 nt, Staphylococcus aureus subsp. aureus Mu50
auaucacaacacauaaauuaa

SEQ ID NO: 2068499 - RNA, 17 nt, Staphylococcus aureus subsp. aureus Mu50
auaucaaaauauaaaau

SEQ ID NO: 2068500 - RNA, 13 nt, Staphylococcus aureus subsp. aureus Mu50
auaucaaaaaaua

SEQ ID NO: 2068501 - RNA, 14 nt, Staphylococcus aureus subsp. aureus Mu50
auaucaaauacauu

SEQ ID NO: 2068502 - RNA, 17 nt, Staphylococcus aureus subsp. aureus Mu50
auaucaaauacauuuca

SEQ ID NO: 2068503 - RNA, 21 nt, Staphylococcus aureus subsp. aureus Mu50
auaucaaauacauuucaaaaa

SEQ ID NO: 2068504 - RNA, 17 nt, Staphylococcus aureus subsp. aureus Mu50
auaucaacguuaauaua

SEQ ID NO: 2068505 - RNA, 14 nt, Staphylococcus aureus subsp. aureus Mu50
auaucaaguuuuaa

SEQ ID NO: 2068506 - RNA, 16 nt, Staphylococcus aureus subsp. aureus Mu50
auaucuaaugcaacuu

SEQ ID NO: 2068507 - RNA, 23 nt, Staphylococcus aureus subsp. aureus Mu50
auaucuacagagaaucaauuauu

SEQ ID NO: 2068508 - RNA, 11 nt, Staphylococcus aureus subsp. aureus Mu50
auaucuaaguc

SEQ ID NO: 2068509 - RNA, 15 nt, Staphylococcus aureus subsp. aureus Mu50
auaucgauaaaugua

SEQ ID NO: 2068510 - RNA, 21 nt, Staphylococcus aureus subsp. aureus Mu50
auauccacgguuuaccacuua

SEQ ID NO: 2068511 - RNA, 21 nt, Staphylococcus aureus subsp. aureus Mu50
auauccaaaauccugaaauua

SEQ ID NO: 2068512 - RNA, 23 nt, Staphylococcus aureus subsp. aureus Mu50
auaucauucuguguaaauauaaa

SEQ ID NO: 2068513 - RNA, 16 nt, Staphylococcus aureus subsp. aureus Mu50
auaucgacaccauuua

SEQ ID NO: 2068514 - RNA, 14 nt, Staphylococcus aureus subsp. aureus Mu50
auaucgacaaauua

SEQ ID NO: 2068515 - RNA, 22 nt, Staphylococcus aureus subsp. aureus Mu50
auaucuuuuuuuuuauaguggu

SEQ ID NO: 2068516 - RNA, 14 nt, Staphylococcus aureus subsp. aureus Mu50
auaucuuuguugca

SEQ ID NO: 2068517 - RNA, 17 nt, Staphylococcus aureus subsp. aureus Mu50
auaucuuuuccaaaaca

SEQ ID NO: 2068518 - RNA, 12 nt, Staphylococcus aureus subsp. aureus Mu50
auaugaaaagag

SEQ ID NO: 2068519 - RNA, 14 nt, Staphylococcus aureus subsp. aureus Mu50
auaugaaaagagaa

SEQ ID NO: 2068520 - RNA, 20 nt, Staphylococcus aureus subsp. aureus Mu50
auaugacuuuuuauuaguau

SEQ ID NO: 2068521 - RNA, 15 nt, Staphylococcus aureus subsp. aureus Mu50
auaucuuucugaaga

SEQ ID NO: 2068522 - RNA, 21 nt, Staphylococcus aureus subsp. aureus Mu50
auaucuuucaauuaauuuaaa

SEQ ID NO: 2068523 - RNA, 18 nt, Staphylococcus aureus subsp. aureus Mu50
auaucuuuaucauuauuc

SEQ ID NO: 2068524 - RNA, 22 nt, Staphylococcus aureus subsp. aureus Mu50
auaucuugcuuggauaauugca

SEQ ID NO: 2068525 - RNA, 22 nt, Staphylococcus aureus subsp. aureus Mu50
auaucuagcugcuucugcugua

SEQ ID NO: 2068526 - RNA, 21 nt, Staphylococcus aureus subsp. aureus Mu50
auaucuuaugauacuuugaaa

SEQ ID NO: 2068527 - RNA, 18 nt, Staphylococcus aureus subsp. aureus Mu50
auaucuuaaguacauaaa

SEQ ID NO: 2068528 - RNA, 19 nt, Staphylococcus aureus subsp. aureus Mu50
auaucuuaaguacauaaau

SEQ ID NO: 2068529 - RNA, 17 nt, Staphylococcus aureus subsp. aureus Mu50
auaucuuaaagaauuaa

SEQ ID NO: 2068530 - RNA, 22 nt, Staphylococcus aureus subsp. aureus Mu50
auagcucuucuuuuucuugcau

SEQ ID NO: 2068531 - RNA, 16 nt, Staphylococcus aureus subsp. aureus Mu50
auagcucuauggcuuc

SEQ ID NO: 2068532 - RNA, 21 nt, Staphylococcus aureus subsp. aureus Mu50
auagcucuucuuuuucuugca

SEQ ID NO: 2068533 - RNA, 18 nt, Staphylococcus aureus subsp. aureus Mu50
auagcuaaugcauuauua

SEQ ID NO: 2068534 - RNA, 13 nt, Staphylococcus aureus subsp. aureus Mu50
auagcuauauuua

SEQ ID NO: 2068535 - RNA, 18 nt, Staphylococcus aureus subsp. aureus Mu50
auagcuauuacuauaaaa

SEQ ID NO: 2068536 - RNA, 22 nt, Staphylococcus aureus subsp. aureus Mu50
auagcuuucguuucuuuuauau

SEQ ID NO: 2068537 - RNA, 14 nt, Staphylococcus aureus subsp. aureus Mu50
auagcgguuuaaaa

SEQ ID NO: 2068538 - RNA, 13 nt, Staphylococcus aureus subsp. aureus Mu50
auagcuaaauaaa

SEQ ID NO: 2068539 - RNA, 15 nt, Staphylococcus aureus subsp. aureus Mu50
auagcuaaacauuuu

SEQ ID NO: 2068540 - RNA, 20 nt, Staphylococcus aureus subsp. aureus Mu50
auagcgcucuggauuuuucu

SEQ ID NO: 2068541 - RNA, 21 nt, Staphylococcus aureus subsp. aureus Mu50
auagcaccguaacauauguac

SEQ ID NO: 2068542 - RNA, 24 nt, Staphylococcus aureus subsp. aureus Mu50
auagcagggugcuaaauuuacgaa

SEQ ID NO: 2068543 - RNA, 14 nt, Staphylococcus aureus subsp. aureus Mu50
auacuuugaaagaa

SEQ ID NO: 2068544 - RNA, 22 nt, Staphylococcus aureus subsp. aureus Mu50
auacuuuuaccauugugaauaa

SEQ ID NO: 2068545 - RNA, 19 nt, Staphylococcus aureus subsp. aureus Mu50
auacuugccuucaaauucu

SEQ ID NO: 2068546 - RNA, 16 nt, Staphylococcus aureus subsp. aureus Mu50
auacuugaugaaacug

SEQ ID NO: 2068547 - RNA, 18 nt, Staphylococcus aureus subsp. aureus Mu50
auacuugaugaaacugau

SEQ ID NO: 2068548 - RNA, 15 nt, Staphylococcus aureus subsp. aureus Mu50
auacuugaagaauca

SEQ ID NO: 2068549 - RNA, 17 nt, Staphylococcus aureus subsp. aureus Mu50
auacuugaagcaucgau

SEQ ID NO: 2068550 - RNA, 21 nt, Staphylococcus aureus subsp. aureus Mu50
auacuucuuuugcaaaacgca

SEQ ID NO: 2068551 - RNA, 20 nt, Staphylococcus aureus subsp. aureus Mu50
auacuuuuauagaaaauuaa

SEQ ID NO: 2068552 - RNA, 13 nt, Staphylococcus aureus subsp. aureus Mu50
auagagaaagaau

SEQ ID NO: 2068553 - RNA, 13 nt, Staphylococcus aureus subsp. aureus Mu50
auagagaagggag

SEQ ID NO: 2068554 - RNA, 14 nt, Staphylococcus aureus subsp. aureus Mu50
auagagacauuuua

SEQ ID NO: 2068555 - RNA, 15 nt, Staphylococcus aureus subsp. aureus Mu50
auagaugugucuuuu

SEQ ID NO: 2068556 - RNA, 24 nt, Staphylococcus aureus subsp. aureus Mu50
auagaugaugugacgauauuuguu

SEQ ID NO: 2068557 - RNA, 14 nt, Staphylococcus aureus subsp. aureus Mu50
auagaugcauaaaa

SEQ ID NO: 2068558 - RNA, 16 nt, Staphylococcus aureus subsp. aureus Mu50
auagaugcauaaaaac

SEQ ID NO: 2068559 - RNA, 17 nt, Staphylococcus aureus subsp. aureus Mu50
auagauuauauuaucau

SEQ ID NO: 2068560 - RNA, 17 nt, Staphylococcus aureus subsp. aureus Mu50
auagcaaugaauuaaua

SEQ ID NO: 2068561 - RNA, 15 nt, Staphylococcus aureus subsp. aureus Mu50
auaauuagauuuaaa

SEQ ID NO: 2068562 - RNA, 21 nt, Staphylococcus aureus subsp. aureus Mu50
auaauuacuaaccuaaagaua

SEQ ID NO: 2068563 - RNA, 19 nt, Staphylococcus aureus subsp. aureus Mu50
auaauuaauuuuguaauua

SEQ ID NO: 2068564 - RNA, 23 nt, Staphylococcus aureus subsp. aureus Mu50
auaauuaacuuacuuuuguaaaa

SEQ ID NO: 2068565 - RNA, 13 nt, Staphylococcus aureus subsp. aureus Mu50
auaauuaauaaca

SEQ ID NO: 2068566 - RNA, 13 nt, Staphylococcus aureus subsp. aureus Mu50
auaauuaauguuu

SEQ ID NO: 2068567 - RNA, 16 nt, Staphylococcus aureus subsp. aureus Mu50
auaccucuacauuaua

SEQ ID NO: 2068568 - RNA, 20 nt, Staphylococcus aureus subsp. aureus Mu50
auacguacgguagucuccca

SEQ ID NO: 2068569 - RNA, 20 nt, Staphylococcus aureus subsp. aureus Mu50
auacguaaacacuuuaguau

SEQ ID NO: 2068570 - RNA, 12 nt, Staphylococcus aureus subsp. aureus Mu50
auaccuuuaaau

SEQ ID NO: 2068571 - RNA, 17 nt, Staphylococcus aureus subsp. aureus Mu50
auacgagcuuugcucau

SEQ ID NO: 2068572 - RNA, 17 nt, Staphylococcus aureus subsp. aureus Mu50
auaccuugauuauaugc

SEQ ID NO: 2068573 - RNA, 15 nt, Staphylococcus aureus subsp. aureus Mu50
auacgaguguuuuaa

SEQ ID NO: 2068574 - RNA, 19 nt, Staphylococcus aureus subsp. aureus Mu50
auacgauaauaacuagaac

SEQ ID NO: 2068575 - RNA, 14 nt, Staphylococcus aureus subsp. aureus Mu50
auacucuaaaaaag

SEQ ID NO: 2068576 - RNA, 15 nt, Staphylococcus aureus subsp. aureus Mu50
auacgugcuuuaaag

SEQ ID NO: 2068577 - RNA, 16 nt, Staphylococcus aureus subsp. aureus Mu50
auacguguguuuucuu

SEQ ID NO: 2068578 - RNA, 22 nt, Staphylococcus aureus subsp. aureus Mu50
auacguguguuuucuuuucaaa

SEQ ID NO: 2068579 - RNA, 19 nt, Staphylococcus aureus subsp. aureus Mu50
auacguugauguaauucug

SEQ ID NO: 2068580 - RNA, 14 nt, Staphylococcus aureus subsp. aureus Mu50
auacguuauuuuuu

SEQ ID NO: 2068581 - RNA, 17 nt, Staphylococcus aureus subsp. aureus Mu50
auacguuuaauaauggu

SEQ ID NO: 2068582 - RNA, 14 nt, Staphylococcus aureus subsp. aureus Mu50
auacuauacugaug

SEQ ID NO: 2068583 - RNA, 17 nt, Staphylococcus aureus subsp. aureus Mu50
auacuauaugaaaagag

SEQ ID NO: 2068584 - RNA, 16 nt, Staphylococcus aureus subsp. aureus Mu50
auacuauaugucuuau

SEQ ID NO: 2068585 - RNA, 19 nt, Staphylococcus aureus subsp. aureus Mu50
auacuaucugacauuuaaa

SEQ ID NO: 2068586 - RNA, 13 nt, Staphylococcus aureus subsp. aureus Mu50
auacucaauaaaa

SEQ ID NO: 2068587 - RNA, 14 nt, Staphylococcus aureus subsp. aureus Mu50
auacuguauuuaua

SEQ ID NO: 2068588 - RNA, 15 nt, Staphylococcus aureus subsp. aureus Mu50
auacugucaucuuuc

SEQ ID NO: 2068589 - RNA, 19 nt, Staphylococcus aureus subsp. aureus Mu50
auacugcucuuuauauaua

SEQ ID NO: 2068590 - RNA, 15 nt, Staphylococcus aureus subsp. aureus Mu50
auacugaauuuuaac

SEQ ID NO: 2068591 - RNA, 16 nt, Staphylococcus aureus subsp. aureus Mu50
auacugaauuuuaacu

SEQ ID NO: 2068592 - RNA, 14 nt, Staphylococcus aureus subsp. aureus Mu50
auacugaaauuuca

SEQ ID NO: 2068593 - RNA, 22 nt, Staphylococcus aureus subsp. aureus Mu50
auacugaugaaaacuuaaaaau

SEQ ID NO: 2068594 - RNA, 22 nt, Staphylococcus aureus subsp. aureus Mu50
auacugccccaaauguaagaac

SEQ ID NO: 2068595 - RNA, 16 nt, Staphylococcus aureus subsp. aureus Mu50
auacugauauuuagaa

SEQ ID NO: 2068596 - RNA, 19 nt, Staphylococcus aureus subsp. aureus Mu50
auacugccauauguuuuag

SEQ ID NO: 2068597 - RNA, 17 nt, Staphylococcus aureus subsp. aureus Mu50
auauuuaaaugucuuuc

SEQ ID NO: 2068598 - RNA, 12 nt, Staphylococcus aureus subsp. aureus Mu50
auauuuuaaaaa

SEQ ID NO: 2068599 - RNA, 16 nt, Staphylococcus aureus subsp. aureus Mu50
auauuuguauaugcaa

SEQ ID NO: 2068600 - RNA, 20 nt, Staphylococcus aureus subsp. aureus Mu50
auauuuuauuagaauauuca

SEQ ID NO: 2068601 - RNA, 12 nt, Staphylococcus aureus subsp. aureus Mu50
auauuuuaaacg

SEQ ID NO: 2068602 - RNA, 16 nt, Staphylococcus aureus subsp. aureus Mu50
auauugcgaaaaauaa

SEQ ID NO: 2068603 - RNA, 17 nt, Staphylococcus aureus subsp. aureus Mu50
auauugucgacuuuuag

SEQ ID NO: 2068604 - RNA, 13 nt, Staphylococcus aureus subsp. aureus Mu50
auauuguuaauuc

SEQ ID NO: 2068605 - RNA, 13 nt, Staphylococcus aureus subsp. aureus Mu50
auauuuuguuaau

SEQ ID NO: 2068606 - RNA, 15 nt, Staphylococcus aureus subsp. aureus Mu50
auauuuuucaauuaa

SEQ ID NO: 2068607 - RNA, 17 nt, Staphylococcus aureus subsp. aureus Mu50
auauuuuuaucaucuuc

SEQ ID NO: 2068608 - RNA, 18 nt, Staphylococcus aureus subsp. aureus Mu50
auauuuuuacauauuuau

SEQ ID NO: 2068609 - RNA, 14 nt, Staphylococcus aureus subsp. aureus Mu50
auauuuuuucugug

SEQ ID NO: 2068610 - RNA, 12 nt, Staphylococcus aureus subsp. aureus Mu50
auauuuuucuuc

SEQ ID NO: 2068611 - RNA, 20 nt, Staphylococcus aureus subsp. aureus Mu50
auauuuuuguauuuauguuu

SEQ ID NO: 2068612 - RNA, 15 nt, Staphylococcus aureus subsp. aureus Mu50
auauucguaaauccu

SEQ ID NO: 2068613 - RNA, 13 nt, Staphylococcus aureus subsp. aureus Mu50
auauucuaaaaaa

SEQ ID NO: 2068614 - RNA, 14 nt, Staphylococcus aureus subsp. aureus Mu50
auauucuaaaaaau

SEQ ID NO: 2068615 - RNA, 21 nt, Staphylococcus aureus subsp. aureus Mu50
auauucuagauucauauuuau

SEQ ID NO: 2068616 - RNA, 18 nt, Staphylococcus aureus subsp. aureus Mu50
auauucuacaugaaucaa

SEQ ID NO: 2068617 - RNA, 21 nt, Staphylococcus aureus subsp. aureus Mu50
auauucuaaaaaauuaaaaau

SEQ ID NO: 2068618 - RNA, 15 nt, Staphylococcus aureus subsp. aureus Mu50
auauucgcuuaaaaa

SEQ ID NO: 2068619 - RNA, 20 nt, Staphylococcus aureus subsp. aureus Mu50
auauucgauacauaaaacau

SEQ ID NO: 2068620 - RNA, 23 nt, Staphylococcus aureus subsp. aureus Mu50
auauucgcgaacguuauuuucaa

SEQ ID NO: 2068621 - RNA, 22 nt, Staphylococcus aureus subsp. aureus Mu50
auauuccuuacuaaguaaccaa

SEQ ID NO: 2068622 - RNA, 22 nt, Staphylococcus aureus subsp. aureus Mu50
auauucuagauucauauuuaua

SEQ ID NO: 2068623 - RNA, 22 nt, Staphylococcus aureus subsp. aureus Mu50
auauucucugcuucuaaaacau

SEQ ID NO: 2068624 - RNA, 22 nt, Staphylococcus aureus subsp. aureus Mu50
auauucuccaacucuaacagcu

SEQ ID NO: 2068625 - RNA, 12 nt, Staphylococcus aureus subsp. aureus Mu50
auauucuuaucu

SEQ ID NO: 2068626 - RNA, 16 nt, Staphylococcus aureus subsp. aureus Mu50
auauugaugaauaaau

SEQ ID NO: 2068627 - RNA, 20 nt, Staphylococcus aureus subsp. aureus Mu50
auauugauucuagugaaaua

SEQ ID NO: 2068628 - RNA, 20 nt, Staphylococcus aureus subsp. aureus Mu50
auauuauugugaaaucuauu

SEQ ID NO: 2068629 - RNA, 17 nt, Staphylococcus aureus subsp. aureus Mu50
auauuauucauaauaua

SEQ ID NO: 2068630 - RNA, 20 nt, Staphylococcus aureus subsp. aureus Mu50
auaugauuacaacuuauucu

SEQ ID NO: 2068631 - RNA, 18 nt, Staphylococcus aureus subsp. aureus Mu50
auauuaugccauucauua

SEQ ID NO: 2068632 - RNA, 16 nt, Staphylococcus aureus subsp. aureus Mu50
auaugagguucaguag

SEQ ID NO: 2068633 - RNA, 13 nt, Staphylococcus aureus subsp. aureus Mu50
auaugauaaauau

SEQ ID NO: 2068634 - RNA, 12 nt, Staphylococcus aureus subsp. aureus Mu50
auaugauaacca

SEQ ID NO: 2068635 - RNA, 15 nt, Staphylococcus aureus subsp. aureus Mu50
auaugauaaccaaac

SEQ ID NO: 2068636 - RNA, 17 nt, Staphylococcus aureus subsp. aureus Mu50
auauucaauaauuauua

SEQ ID NO: 2068637 - RNA, 12 nt, Staphylococcus aureus subsp. aureus Mu50
auauucaaugaa

SEQ ID NO: 2068638 - RNA, 14 nt, Staphylococcus aureus subsp. aureus Mu50
auauucacaucuuu

SEQ ID NO: 2068639 - RNA, 20 nt, Staphylococcus aureus subsp. aureus Mu50
auauucaccuacaacaccaa

SEQ ID NO: 2068640 - RNA, 13 nt, Staphylococcus aureus subsp. aureus Mu50
auauucaaugaau

SEQ ID NO: 2068641 - RNA, 14 nt, Staphylococcus aureus subsp. aureus Mu50
auauucaacuuauu

SEQ ID NO: 2068642 - RNA, 15 nt, Staphylococcus aureus subsp. aureus Mu50
auauucaaaauaacu

SEQ ID NO: 2068643 - RNA, 14 nt, Staphylococcus aureus subsp. aureus Mu50
auauucaaaauaac

SEQ ID NO: 2068644 - RNA, 14 nt, Staphylococcus aureus subsp. aureus Mu50
auauuauuuuuaag

SEQ ID NO: 2068645 - RNA, 12 nt, Staphylococcus aureus subsp. aureus Mu50
auauuauuuuua

SEQ ID NO: 2068646 - RNA, 24 nt, Staphylococcus aureus subsp. aureus Mu50
auauuauuuugcaauugcaaugaa

SEQ ID NO: 2068647 - RNA, 18 nt, Staphylococcus aureus subsp. aureus Mu50
aucaauuucuauuucacu

SEQ ID NO: 2068648 - RNA, 16 nt, Staphylococcus aureus subsp. aureus Mu50
aucaauuuauuauuaa

SEQ ID NO: 2068649 - RNA, 15 nt, Staphylococcus aureus subsp. aureus Mu50
aucaauuuaauuaag

SEQ ID NO: 2068650 - RNA, 22 nt, Staphylococcus aureus subsp. aureus Mu50
aucacaauacgaaaucaaaaau

SEQ ID NO: 2068651 - RNA, 15 nt, Staphylococcus aureus subsp. aureus Mu50
aucacacucuccccg

SEQ ID NO: 2068652 - RNA, 17 nt, Staphylococcus aureus subsp. aureus Mu50
aucaauagccauuuccg

SEQ ID NO: 2068653 - RNA, 20 nt, Staphylococcus aureus subsp. aureus Mu50
aucaauagaugaaaauuuaa

SEQ ID NO: 2068654 - RNA, 19 nt, Staphylococcus aureus subsp. aureus Mu50
aucaauaugaccuuuaugu

SEQ ID NO: 2068655 - RNA, 17 nt, Staphylococcus aureus subsp. aureus Mu50
aucaauaucaaauuugg

SEQ ID NO: 2068656 - RNA, 15 nt, Staphylococcus aureus subsp. aureus Mu50
aucaauauaauuugg

SEQ ID NO: 2068657 - RNA, 16 nt, Staphylococcus aureus subsp. aureus Mu50
aucaauaguuuauaaa

SEQ ID NO: 2068658 - RNA, 20 nt, Staphylococcus aureus subsp. aureus Mu50
aucaauaguuuauaaauuaa

SEQ ID NO: 2068659 - RNA, 21 nt, Staphylococcus aureus subsp. aureus Mu50
aucaauaguuuauaaauuaau

SEQ ID NO: 2068660 - RNA, 17 nt, Staphylococcus aureus subsp. aureus Mu50
aucaacauuaauaaaua

SEQ ID NO: 2068661 - RNA, 22 nt, Staphylococcus aureus subsp. aureus Mu50
aucaaagaaaaagugauaauua

SEQ ID NO: 2068662 - RNA, 18 nt, Staphylococcus aureus subsp. aureus Mu50
aucaaacuuggcaaugaa

SEQ ID NO: 2068663 - RNA, 20 nt, Staphylococcus aureus subsp. aureus Mu50
aucaaaaccgcuauaaaauu

SEQ ID NO: 2068664 - RNA, 18 nt, Staphylococcus aureus subsp. aureus Mu50
aucaacgccauauuuauu

SEQ ID NO: 2068665 - RNA, 19 nt, Staphylococcus aureus subsp. aureus Mu50
aucaacgagucauaaauau

SEQ ID NO: 2068666 - RNA, 19 nt, Staphylococcus aureus subsp. aureus Mu50
aucaacgauugaauuguag

SEQ ID NO: 2068667 - RNA, 16 nt, Staphylococcus aureus subsp. aureus Mu50
aucaagcuagcaucau

SEQ ID NO: 2068668 - RNA, 17 nt, Staphylococcus aureus subsp. aureus Mu50
aucaaguaguuaucuaa

SEQ ID NO: 2068669 - RNA, 16 nt, Staphylococcus aureus subsp. aureus Mu50
aucaaguauaaauguu

SEQ ID NO: 2068670 - RNA, 14 nt, Staphylococcus aureus subsp. aureus Mu50
aucagaaucaagua

SEQ ID NO: 2068671 - RNA, 21 nt, Staphylococcus aureus subsp. aureus Mu50
aucacuugcuguugcaauaaa

SEQ ID NO: 2068672 - RNA, 22 nt, Staphylococcus aureus subsp. aureus Mu50
aucacuugcuguugcaauaaaa

SEQ ID NO: 2068673 - RNA, 13 nt, Staphylococcus aureus subsp. aureus Mu50
aucagacuaaaau

SEQ ID NO: 2068674 - RNA, 23 nt, Staphylococcus aureus subsp. aureus Mu50
aucagcauuuaagcuaucuaaac

SEQ ID NO: 2068675 - RNA, 22 nt, Staphylococcus aureus subsp. aureus Mu50
aucagcauuaaucguauuuuua

SEQ ID NO: 2068676 - RNA, 16 nt, Staphylococcus aureus subsp. aureus Mu50
aucacagcaauaauaa

SEQ ID NO: 2068677 - RNA, 15 nt, Staphylococcus aureus subsp. aureus Mu50
aucacagcaauaaua

SEQ ID NO: 2068678 - RNA, 16 nt, Staphylococcus aureus subsp. aureus Mu50
aucacaguuauauauu

SEQ ID NO: 2068679 - RNA, 22 nt, Staphylococcus aureus subsp. aureus Mu50
aucacaguguugaauuucaaaa

SEQ ID NO: 2068680 - RNA, 23 nt, Staphylococcus aureus subsp. aureus Mu50
aucaccaacaacuuuguuuucag

SEQ ID NO: 2068681 - RNA, 15 nt, Staphylococcus aureus subsp. aureus Mu50
aucaccagauuuuaa

SEQ ID NO: 2068682 - RNA, 13 nt, Staphylococcus aureus subsp. aureus Mu50
aucacuaaaguaa

SEQ ID NO: 2068683 - RNA, 19 nt, Staphylococcus aureus subsp. aureus Mu50
aucacuauauuucacacag

SEQ ID NO: 2068684 - RNA, 14 nt, Staphylococcus aureus subsp. aureus Mu50
aucacuccucuauu

SEQ ID NO: 2068685 - RNA, 16 nt, Staphylococcus aureus subsp. aureus Mu50
aucacucaacauauua

SEQ ID NO: 2068686 - RNA, 21 nt, Staphylococcus aureus subsp. aureus Mu50
aucacugcauauaaagucaua

SEQ ID NO: 2068687 - RNA, 13 nt, Staphylococcus aureus subsp. aureus Mu50
aucacugcuuuca

SEQ ID NO: 2068688 - RNA, 21 nt, Staphylococcus aureus subsp. aureus Mu50
aucacugaaugcuaauacuaa

SEQ ID NO: 2068689 - RNA, 17 nt, Staphylococcus aureus subsp. aureus Mu50
aucaccuuuuauccccu

SEQ ID NO: 2068690 - RNA, 15 nt, Staphylococcus aureus subsp. aureus Mu50
aucacgaucuuuaaa

SEQ ID NO: 2068691 - RNA, 15 nt, Staphylococcus aureus subsp. aureus Mu50
aucacgccauaaucu

SEQ ID NO: 2068692 - RNA, 14 nt, Staphylococcus aureus subsp. aureus Mu50
aguuugacaucuau

SEQ ID NO: 2068693 - RNA, 19 nt, Staphylococcus aureus subsp. aureus Mu50
aguuugaaggugauaaugu

SEQ ID NO: 2068694 - RNA, 17 nt, Staphylococcus aureus subsp. aureus Mu50
aguuuguccuuuaagaa

SEQ ID NO: 2068695 - RNA, 14 nt, Staphylococcus aureus subsp. aureus Mu50
aguuucggaaaaag

SEQ ID NO: 2068696 - RNA, 19 nt, Staphylococcus aureus subsp. aureus Mu50
aguuucuacuguauaagug

SEQ ID NO: 2068697 - RNA, 22 nt, Staphylococcus aureus subsp. aureus Mu50
aguuucugacuuuuaaaaaaca

SEQ ID NO: 2068698 - RNA, 18 nt, Staphylococcus aureus subsp. aureus Mu50
aguuucugagaagaaaua

SEQ ID NO: 2068699 - RNA, 21 nt, Staphylococcus aureus subsp. aureus Mu50
aguuuaaucguauuagccaau

SEQ ID NO: 2068700 - RNA, 21 nt, Staphylococcus aureus subsp. aureus Mu50
aguuuucggcuagauuuuaaa

SEQ ID NO: 2068701 - RNA, 16 nt, Staphylococcus aureus subsp. aureus Mu50
aguuuuacugagggau

SEQ ID NO: 2068702 - RNA, 15 nt, Staphylococcus aureus subsp. aureus Mu50
aguuuguuucuaaau

SEQ ID NO: 2068703 - RNA, 14 nt, Staphylococcus aureus subsp. aureus Mu50
aguuuuaaugaacu

SEQ ID NO: 2068704 - RNA, 16 nt, Staphylococcus aureus subsp. aureus Mu50
aguuuguuuucuuucg

SEQ ID NO: 2068705 - RNA, 20 nt, Staphylococcus aureus subsp. aureus Mu50
aguuuguuucuaaauucuuu

SEQ ID NO: 2068706 - RNA, 14 nt, Staphylococcus aureus subsp. aureus Mu50
auaaaaaaagagac

SEQ ID NO: 2068707 - RNA, 14 nt, Staphylococcus aureus subsp. aureus Mu50
auaaaaaaaucccu

SEQ ID NO: 2068708 - RNA, 19 nt, Staphylococcus aureus subsp. aureus Mu50
aguuuuuuuaaaguuuaaa

SEQ ID NO: 2068709 - RNA, 15 nt, Staphylococcus aureus subsp. aureus Mu50
aguuuuuuuauaagc

SEQ ID NO: 2068710 - RNA, 14 nt, Staphylococcus aureus subsp. aureus Mu50
aguuuuuaaaucaa

SEQ ID NO: 2068711 - RNA, 19 nt, Staphylococcus aureus subsp. aureus Mu50
aguuuuggucaaguaaaug

SEQ ID NO: 2068712 - RNA, 16 nt, Staphylococcus aureus subsp. aureus Mu50
aguuuuuaaaauuauc

SEQ ID NO: 2068713 - RNA, 15 nt, Staphylococcus aureus subsp. aureus Mu50
aguugacaauacaaa

SEQ ID NO: 2068714 - RNA, 21 nt, Staphylococcus aureus subsp. aureus Mu50
aguugaaaauaaucgaacaga

SEQ ID NO: 2068715 - RNA, 21 nt, Staphylococcus aureus subsp. aureus Mu50
aguugaaaaccucuuuuuguu

SEQ ID NO: 2068716 - RNA, 14 nt, Staphylococcus aureus subsp. aureus Mu50
aguugaaaauaauc

SEQ ID NO: 2068717 - RNA, 21 nt, Staphylococcus aureus subsp. aureus Mu50
aguugauugcaugacagcaaa

SEQ ID NO: 2068718 - RNA, 22 nt, Staphylococcus aureus subsp. aureus Mu50
aguugauuuaagauuuaauaaa

SEQ ID NO: 2068719 - RNA, 24 nt, Staphylococcus aureus subsp. aureus Mu50
aguugcacuugguucauaaugauc

SEQ ID NO: 2068720 - RNA, 22 nt, Staphylococcus aureus subsp. aureus Mu50
aguugcauaaucaauuucaccu

SEQ ID NO: 2068721 - RNA, 16 nt, Staphylococcus aureus subsp. aureus Mu50
aguugcugaauaaaau

SEQ ID NO: 2068722 - RNA, 17 nt, Staphylococcus aureus subsp. aureus Mu50
aguuguuauuuuugcua

SEQ ID NO: 2068723 - RNA, 17 nt, Staphylococcus aureus subsp. aureus Mu50
aguuuaagucuaacuuu

SEQ ID NO: 2068724 - RNA, 15 nt, Staphylococcus aureus subsp. aureus Mu50
aguuuaacaauacua

SEQ ID NO: 2068725 - RNA, 13 nt, Staphylococcus aureus subsp. aureus Mu50
aguuguugcaaau

SEQ ID NO: 2068726 - RNA, 21 nt, Staphylococcus aureus subsp. aureus Mu50
aguuguuucuccaguuuuugg

SEQ ID NO: 2068727 - RNA, 11 nt, Staphylococcus aureus subsp. aureus Mu50
aguuuaaaaau

SEQ ID NO: 2068728 - RNA, 19 nt, Staphylococcus aureus subsp. aureus Mu50
aguuacuauauuuauuagu

SEQ ID NO: 2068729 - RNA, 17 nt, Staphylococcus aureus subsp. aureus Mu50
aguuaccuacuacauuc

SEQ ID NO: 2068730 - RNA, 13 nt, Staphylococcus aureus subsp. aureus Mu50
aguguuuguaaug

SEQ ID NO: 2068731 - RNA, 22 nt, Staphylococcus aureus subsp. aureus Mu50
aguuaaacgaaaaaugccaacu

SEQ ID NO: 2068732 - RNA, 17 nt, Staphylococcus aureus subsp. aureus Mu50
aguuaaaagugguuuua

SEQ ID NO: 2068733 - RNA, 11 nt, Staphylococcus aureus subsp. aureus Mu50
aguuaaaaccu

SEQ ID NO: 2068734 - RNA, 20 nt, Staphylococcus aureus subsp. aureus Mu50
aguuaggcgacuuaacuuaa

SEQ ID NO: 2068735 - RNA, 17 nt, Staphylococcus aureus subsp. aureus Mu50
aguuacuucaguuuggu

SEQ ID NO: 2068736 - RNA, 15 nt, Staphylococcus aureus subsp. aureus Mu50
aguuagacuaaaaaa

SEQ ID NO: 2068737 - RNA, 18 nt, Staphylococcus aureus subsp. aureus Mu50
aguuagaagaugauuauu

SEQ ID NO: 2068738 - RNA, 19 nt, Staphylococcus aureus subsp. aureus Mu50
aguguuucauaaucucuuu

SEQ ID NO: 2068739 - RNA, 19 nt, Staphylococcus aureus subsp. aureus Mu50
aguguugaggcguuucaga

SEQ ID NO: 2068740 - RNA, 22 nt, Staphylococcus aureus subsp. aureus Mu50
aguguucucauuauaaugauuu

SEQ ID NO: 2068741 - RNA, 17 nt, Staphylococcus aureus subsp. aureus Mu50
aguguuauaaauagaga

SEQ ID NO: 2068742 - RNA, 22 nt, Staphylococcus aureus subsp. aureus Mu50
aguguuauaauggcgggccccc

SEQ ID NO: 2068743 - RNA, 23 nt, Staphylococcus aureus subsp. aureus Mu50
agugugcaggauaacguucacuu

SEQ ID NO: 2068744 - RNA, 19 nt, Staphylococcus aureus subsp. aureus Mu50
aguuauaccauauuuaugg

SEQ ID NO: 2068745 - RNA, 16 nt, Staphylococcus aureus subsp. aureus Mu50
aguucaaauugaacuu

SEQ ID NO: 2068746 - RNA, 19 nt, Staphylococcus aureus subsp. aureus Mu50
aguucaacagggguuuuua

SEQ ID NO: 2068747 - RNA, 14 nt, Staphylococcus aureus subsp. aureus Mu50
aguucaaacagaaa

SEQ ID NO: 2068748 - RNA, 15 nt, Staphylococcus aureus subsp. aureus Mu50
aguucaaaauacuca

SEQ ID NO: 2068749 - RNA, 15 nt, Staphylococcus aureus subsp. aureus Mu50
aguucacaacaaagu

SEQ ID NO: 2068750 - RNA, 23 nt, Staphylococcus aureus subsp. aureus Mu50
aguucaaauggacuaacgucauu

SEQ ID NO: 2068751 - RNA, 20 nt, Staphylococcus aureus subsp. aureus Mu50
aguucaaagcgauaaaguau

SEQ ID NO: 2068752 - RNA, 21 nt, Staphylococcus aureus subsp. aureus Mu50
agugguuuucuuuauuuuaaa

SEQ ID NO: 2068753 - RNA, 23 nt, Staphylococcus aureus subsp. aureus Mu50
agugguuguaggcuuuuuauuuu

SEQ ID NO: 2068754 - RNA, 22 nt, Staphylococcus aureus subsp. aureus Mu50
agugguuguucccauuuuuaaa

SEQ ID NO: 2068755 - RNA, 20 nt, Staphylococcus aureus subsp. aureus Mu50
agugguaaaaaguuuaaagu

SEQ ID NO: 2068756 - RNA, 22 nt, Staphylococcus aureus subsp. aureus Mu50
aguguaauguuccccugaaaag

SEQ ID NO: 2068757 - RNA, 19 nt, Staphylococcus aureus subsp. aureus Mu50
aguguagccaaauaaauuu

SEQ ID NO: 2068758 - RNA, 13 nt, Staphylococcus aureus subsp. aureus Mu50
aguguaccuuguu

SEQ ID NO: 2068759 - RNA, 16 nt, Staphylococcus aureus subsp. aureus Mu50
agugucacaaagaaau

SEQ ID NO: 2068760 - RNA, 14 nt, Staphylococcus aureus subsp. aureus Mu50
aguguauucauuuu

SEQ ID NO: 2068761 - RNA, 17 nt, Staphylococcus aureus subsp. aureus Mu50
aguguauucauuuuaaa

SEQ ID NO: 2068762 - RNA, 19 nt, Staphylococcus aureus subsp. aureus Mu50
aguguauucauuuuaaauu

SEQ ID NO: 2068763 - RNA, 20 nt, Staphylococcus aureus subsp. aureus Mu50
agugcauuuuuuauuuuacu

SEQ ID NO: 2068764 - RNA, 19 nt, Staphylococcus aureus subsp. aureus Mu50
agugcgguuauuuauacag

SEQ ID NO: 2068765 - RNA, 22 nt, Staphylococcus aureus subsp. aureus Mu50
agugccuugccaugauuuaagg

SEQ ID NO: 2068766 - RNA, 15 nt, Staphylococcus aureus subsp. aureus Mu50
aguggcaaacauuuc

SEQ ID NO: 2068767 - RNA, 19 nt, Staphylococcus aureus subsp. aureus Mu50
aguggauuacagaugaugc

SEQ ID NO: 2068768 - RNA, 18 nt, Staphylococcus aureus subsp. aureus Mu50
aguggaucacgauaaugu

SEQ ID NO: 2068769 - RNA, 13 nt, Staphylococcus aureus subsp. aureus Mu50
aguggauuacaga

SEQ ID NO: 2068770 - RNA, 22 nt, Staphylococcus aureus subsp. aureus Mu50
agucuaacaguuaauaugaauu

SEQ ID NO: 2068771 - RNA, 21 nt, Staphylococcus aureus subsp. aureus Mu50
agucguucaauuguugauuug

SEQ ID NO: 2068772 - RNA, 19 nt, Staphylococcus aureus subsp. aureus Mu50
agucguuguugaaauuaaa

SEQ ID NO: 2068773 - RNA, 18 nt, Staphylococcus aureus subsp. aureus Mu50
agucguucucuuaaauau

SEQ ID NO: 2068774 - RNA, 12 nt, Staphylococcus aureus subsp. aureus Mu50
agucuaugaaua

SEQ ID NO: 2068775 - RNA, 13 nt, Staphylococcus aureus subsp. aureus Mu50
agucuaugaauaa

SEQ ID NO: 2068776 - RNA, 21 nt, Staphylococcus aureus subsp. aureus Mu50
aguaccuaaaauagaaaaauu

SEQ ID NO: 2068777 - RNA, 14 nt, Staphylococcus aureus subsp. aureus Mu50
agucgaacaaugau

SEQ ID NO: 2068778 - RNA, 18 nt, Staphylococcus aureus subsp. aureus Mu50
aguccuucuuugaaauca

SEQ ID NO: 2068779 - RNA, 21 nt, Staphylococcus aureus subsp. aureus Mu50
aguccuucuuugaaaucaaug

SEQ ID NO: 2068780 - RNA, 13 nt, Staphylococcus aureus subsp. aureus Mu50
agucuuuaacuuu

SEQ ID NO: 2068781 - RNA, 22 nt, Staphylococcus aureus subsp. aureus Mu50
agucuuuuuauuuuaauauuuu

SEQ ID NO: 2068782 - RNA, 20 nt, Staphylococcus aureus subsp. aureus Mu50
agucuugugauaauucuuca

SEQ ID NO: 2068783 - RNA, 23 nt, Staphylococcus aureus subsp. aureus Mu50
agucuucuuacugcaauuauuuu

SEQ ID NO: 2068784 - RNA, 13 nt, Staphylococcus aureus subsp. aureus Mu50
agugacacaccac

SEQ ID NO: 2068785 - RNA, 13 nt, Staphylococcus aureus subsp. aureus Mu50
agugaccucaggu

SEQ ID NO: 2068786 - RNA, 14 nt, Staphylococcus aureus subsp. aureus Mu50
agucuuauuuuuau

SEQ ID NO: 2068787 - RNA, 19 nt, Staphylococcus aureus subsp. aureus Mu50
auaacguuaauauaauuaa

SEQ ID NO: 2068788 - RNA, 20 nt, Staphylococcus aureus subsp. aureus Mu50
auaaccuaauucgccaucuu

SEQ ID NO: 2068789 - RNA, 14 nt, Staphylococcus aureus subsp. aureus Mu50
auaacuagaaugau

SEQ ID NO: 2068790 - RNA, 15 nt, Staphylococcus aureus subsp. aureus Mu50
auaacucaaauaucu

SEQ ID NO: 2068791 - RNA, 20 nt, Staphylococcus aureus subsp. aureus Mu50
auaacuagaacaagaauuau

SEQ ID NO: 2068792 - RNA, 13 nt, Staphylococcus aureus subsp. aureus Mu50
auaacuacacuua

SEQ ID NO: 2068793 - RNA, 12 nt, Staphylococcus aureus subsp. aureus Mu50
auaacuuuaaaa

SEQ ID NO: 2068794 - RNA, 18 nt, Staphylococcus aureus subsp. aureus Mu50
auaacuuuaccaccauuu

SEQ ID NO: 2068795 - RNA, 13 nt, Staphylococcus aureus subsp. aureus Mu50
auaacuuuaaaaa

SEQ ID NO: 2068796 - RNA, 15 nt, Staphylococcus aureus subsp. aureus Mu50
auaagaaaauaccua

SEQ ID NO: 2068797 - RNA, 19 nt, Staphylococcus aureus subsp. aureus Mu50
auaagaaaaaguuauauca

SEQ ID NO: 2068798 - RNA, 14 nt, Staphylococcus aureus subsp. aureus Mu50
auaagaaaauacua

SEQ ID NO: 2068799 - RNA, 15 nt, Staphylococcus aureus subsp. aureus Mu50
auaacugauaauacu

SEQ ID NO: 2068800 - RNA, 16 nt, Staphylococcus aureus subsp. aureus Mu50
auaacucuaaauauaa

SEQ ID NO: 2068801 - RNA, 17 nt, Staphylococcus aureus subsp. aureus Mu50
auaacuccuccaaagcu

SEQ ID NO: 2068802 - RNA, 21 nt, Staphylococcus aureus subsp. aureus Mu50
auaacucgcuucguucuaaaa

SEQ ID NO: 2068803 - RNA, 23 nt, Staphylococcus aureus subsp. aureus Mu50
auaacuguucuuucgucuuguaa

SEQ ID NO: 2068804 - RNA, 13 nt, Staphylococcus aureus subsp. aureus Mu50
auaacuguaaaac

SEQ ID NO: 2068805 - RNA, 15 nt, Staphylococcus aureus subsp. aureus Mu50
auaacuguaaaacau

SEQ ID NO: 2068806 - RNA, 14 nt, Staphylococcus aureus subsp. aureus Mu50
auaaccgaaauauu

SEQ ID NO: 2068807 - RNA, 16 nt, Staphylococcus aureus subsp. aureus Mu50
auaaccgcuacaauua

SEQ ID NO: 2068808 - RNA, 16 nt, Staphylococcus aureus subsp. aureus Mu50
auaaccauuucaucau

SEQ ID NO: 2068809 - RNA, 17 nt, Staphylococcus aureus subsp. aureus Mu50
auaaccauuucaucaua

SEQ ID NO: 2068810 - RNA, 16 nt, Staphylococcus aureus subsp. aureus Mu50
auaacccauuuucaaa

SEQ ID NO: 2068811 - RNA, 15 nt, Staphylococcus aureus subsp. aureus Mu50
auaacauuuaagaaa

SEQ ID NO: 2068812 - RNA, 23 nt, Staphylococcus aureus subsp. aureus Mu50
auaacauucuucaaaaaauaaua

SEQ ID NO: 2068813 - RNA, 20 nt, Staphylococcus aureus subsp. aureus Mu50
auaacauucuucaaaaaaua

SEQ ID NO: 2068814 - RNA, 22 nt, Staphylococcus aureus subsp. aureus Mu50
auaacauucuucaaaaaauaau

SEQ ID NO: 2068815 - RNA, 19 nt, Staphylococcus aureus subsp. aureus Mu50
auaacauucuucaaaaaau

SEQ ID NO: 2068816 - RNA, 13 nt, Staphylococcus aureus subsp. aureus Mu50
auaacaccuacug

SEQ ID NO: 2068817 - RNA, 14 nt, Staphylococcus aureus subsp. aureus Mu50
auaacaccaauuaa

SEQ ID NO: 2068818 - RNA, 15 nt, Staphylococcus aureus subsp. aureus Mu50
auaacaccaauuaaa

SEQ ID NO: 2068819 - RNA, 11 nt, Staphylococcus aureus subsp. aureus Mu50
auaacaaacau

SEQ ID NO: 2068820 - RNA, 18 nt, Staphylococcus aureus subsp. aureus Mu50
auaaauuuuuaguuaaag

SEQ ID NO: 2068821 - RNA, 23 nt, Staphylococcus aureus subsp. aureus Mu50
auaacaaaaauugcuauauuagu

SEQ ID NO: 2068822 - RNA, 21 nt, Staphylococcus aureus subsp. aureus Mu50
auaaauuuucuguuuaauuaa

SEQ ID NO: 2068823 - RNA, 21 nt, Staphylococcus aureus subsp. aureus Mu50
auaaauuuguaccaaauaaau

SEQ ID NO: 2068824 - RNA, 17 nt, Staphylococcus aureus subsp. aureus Mu50
auaaauuagaugaaaug

SEQ ID NO: 2068825 - RNA, 19 nt, Staphylococcus aureus subsp. aureus Mu50
auaaauuaaaugcaauaca

SEQ ID NO: 2068826 - RNA, 16 nt, Staphylococcus aureus subsp. aureus Mu50
auaaauguuuauaucu

SEQ ID NO: 2068827 - RNA, 21 nt, Staphylococcus aureus subsp. aureus Mu50
auaaaugucacugcaaacaca

SEQ ID NO: 2068828 - RNA, 12 nt, Staphylococcus aureus subsp. aureus Mu50
auaaauguuaaa

SEQ ID NO: 2068829 - RNA, 16 nt, Staphylococcus aureus subsp. aureus Mu50
auaaaugucauaguau

SEQ ID NO: 2068830 - RNA, 15 nt, Staphylococcus aureus subsp. aureus Mu50
auaaacaauaaaaaa

SEQ ID NO: 2068831 - RNA, 13 nt, Staphylococcus aureus subsp. aureus Mu50
auaaacaauaacu

SEQ ID NO: 2068832 - RNA, 14 nt, Staphylococcus aureus subsp. aureus Mu50
auaaacaauaacug

SEQ ID NO: 2068833 - RNA, 13 nt, Staphylococcus aureus subsp. aureus Mu50
auaaaaaacaaua

SEQ ID NO: 2068834 - RNA, 19 nt, Staphylococcus aureus subsp. aureus Mu50
auaaaaagaauaugauauu

SEQ ID NO: 2068835 - RNA, 12 nt, Staphylococcus aureus subsp. aureus Mu50
auaaaaauaaaa

SEQ ID NO: 2068836 - RNA, 18 nt, Staphylococcus aureus subsp. aureus Mu50
auaaaaagugaaaguauu

SEQ ID NO: 2068837 - RNA, 16 nt, Staphylococcus aureus subsp. aureus Mu50
auaaaaauacauaauu

SEQ ID NO: 2068838 - RNA, 12 nt, Staphylococcus aureus subsp. aureus Mu50
auaaacuaaaaa

SEQ ID NO: 2068839 - RNA, 12 nt, Staphylococcus aureus subsp. aureus Mu50
auaaacuacaca

SEQ ID NO: 2068840 - RNA, 19 nt, Staphylococcus aureus subsp. aureus Mu50
auaaaccuacaauauagaa

SEQ ID NO: 2068841 - RNA, 15 nt, Staphylococcus aureus subsp. aureus Mu50
auaaaucgauaaaau

SEQ ID NO: 2068842 - RNA, 20 nt, Staphylococcus aureus subsp. aureus Mu50
auaaauccuaagucuuuuaa

SEQ ID NO: 2068843 - RNA, 14 nt, Staphylococcus aureus subsp. aureus Mu50
auaaauauuuuuaa

SEQ ID NO: 2068844 - RNA, 13 nt, Staphylococcus aureus subsp. aureus Mu50
auaaauauuggaa

SEQ ID NO: 2068845 - RNA, 14 nt, Staphylococcus aureus subsp. aureus Mu50
auaaauauuguguu

SEQ ID NO: 2068846 - RNA, 14 nt, Staphylococcus aureus subsp. aureus Mu50
auaaaucuaauacu

SEQ ID NO: 2068847 - RNA, 19 nt, Staphylococcus aureus subsp. aureus Mu50
auaaaucuaauacuuucaa

SEQ ID NO: 2068848 - RNA, 21 nt, Staphylococcus aureus subsp. aureus Mu50
auaaauaauuucggauuaucu

SEQ ID NO: 2068849 - RNA, 22 nt, Staphylococcus aureus subsp. aureus Mu50
auaaauaagcaaucauaauacu

SEQ ID NO: 2068850 - RNA, 18 nt, Staphylococcus aureus subsp. aureus Mu50
auaaauauggauuuugaa

SEQ ID NO: 2068851 - RNA, 12 nt, Staphylococcus aureus subsp. aureus Mu50
auaaauauuaaa

SEQ ID NO: 2068852 - RNA, 16 nt, Staphylococcus aureus subsp. aureus Mu50
auaaauauuaaauuca

SEQ ID NO: 2068853 - RNA, 15 nt, Staphylococcus aureus subsp. aureus Mu50
auaaauauuaagcgu

SEQ ID NO: 2068854 - RNA, 19 nt, Staphylococcus aureus subsp. aureus Mu50
auaaauacaauagaaauga

SEQ ID NO: 2068855 - RNA, 20 nt, Staphylococcus aureus subsp. aureus Mu50
auaaauaucauaaaugcaua

SEQ ID NO: 2068856 - RNA, 17 nt, Staphylococcus aureus subsp. aureus Mu50
auaaauaugauguuaaa

SEQ ID NO: 2068857 - RNA, 15 nt, Staphylococcus aureus subsp. aureus Mu50
auaaaggaauagcua

SEQ ID NO: 2068858 - RNA, 21 nt, Staphylococcus aureus subsp. aureus Mu50
auaaagcugauuuuucauuga

SEQ ID NO: 2068859 - RNA, 15 nt, Staphylococcus aureus subsp. aureus Mu50
auaaagcguucucua

SEQ ID NO: 2068860 - RNA, 12 nt, Staphylococcus aureus subsp. aureus Mu50
auaaauaaacaa

SEQ ID NO: 2068861 - RNA, 13 nt, Staphylococcus aureus subsp. aureus Mu50
auaaauaaaaugc

SEQ ID NO: 2068862 - RNA, 17 nt, Staphylococcus aureus subsp. aureus Mu50
auaauauugaugaauaa

SEQ ID NO: 2068863 - RNA, 19 nt, Staphylococcus aureus subsp. aureus Mu50
auaauauugaugaauaaau

SEQ ID NO: 2068864 - RNA, 23 nt, Staphylococcus aureus subsp. aureus Mu50
auaaucaacaaagugcaauuauu

SEQ ID NO: 2068865 - RNA, 22 nt, Staphylococcus aureus subsp. aureus Mu50
auaaucaaaccaccaaaaauca

SEQ ID NO: 2068866 - RNA, 14 nt, Staphylococcus aureus subsp. aureus Mu50
auaaucaagaauau

SEQ ID NO: 2068867 - RNA, 22 nt, Staphylococcus aureus subsp. aureus Mu50
auaauaucaccuuuuuuaagau

SEQ ID NO: 2068868 - RNA, 16 nt, Staphylococcus aureus subsp. aureus Mu50
auaauauauuaacaac

SEQ ID NO: 2068869 - RNA, 14 nt, Staphylococcus aureus subsp. aureus Mu50
auaauauaaauaaa

SEQ ID NO: 2068870 - RNA, 16 nt, Staphylococcus aureus subsp. aureus Mu50
auaauauaaauaaaag

SEQ ID NO: 2068871 - RNA, 18 nt, Staphylococcus aureus subsp. aureus Mu50
auaauagcuugagcaucu

SEQ ID NO: 2068872 - RNA, 15 nt, Staphylococcus aureus subsp. aureus Mu50
auaauagcaaaauua

SEQ ID NO: 2068873 - RNA, 16 nt, Staphylococcus aureus subsp. aureus Mu50
auaauagcaaaauuau

SEQ ID NO: 2068874 - RNA, 15 nt, Staphylococcus aureus subsp. aureus Mu50
auaauagauaauagu

SEQ ID NO: 2068875 - RNA, 19 nt, Staphylococcus aureus subsp. aureus Mu50
auaauaccuucaauugaca

SEQ ID NO: 2068876 - RNA, 14 nt, Staphylococcus aureus subsp. aureus Mu50
auaauaccaauugc

SEQ ID NO: 2068877 - RNA, 18 nt, Staphylococcus aureus subsp. aureus Mu50
auaauacgucguaaugaa

SEQ ID NO: 2068878 - RNA, 19 nt, Staphylococcus aureus subsp. aureus Mu50
auaauacuacauauaaugc

SEQ ID NO: 2068879 - RNA, 14 nt, Staphylococcus aureus subsp. aureus Mu50
auaauagacuuaua

SEQ ID NO: 2068880 - RNA, 16 nt, Staphylococcus aureus subsp. aureus Mu50
auaauacuguauuuua

SEQ ID NO: 2068881 - RNA, 21 nt, Staphylococcus aureus subsp. aureus Mu50
auaauaagagaacuuuucaaa

SEQ ID NO: 2068882 - RNA, 22 nt, Staphylococcus aureus subsp. aureus Mu50
auaauaaguugaauauaaaaaa

SEQ ID NO: 2068883 - RNA, 18 nt, Staphylococcus aureus subsp. aureus Mu50
auaauaacuggcaaauca

SEQ ID NO: 2068884 - RNA, 18 nt, Staphylococcus aureus subsp. aureus Mu50
auaauaaguugaauauaa

SEQ ID NO: 2068885 - RNA, 14 nt, Staphylococcus aureus subsp. aureus Mu50
auaauguuuccauu

SEQ ID NO: 2068886 - RNA, 18 nt, Staphylococcus aureus subsp. aureus Mu50
auaauuaaacuaauagca

SEQ ID NO: 2068887 - RNA, 24 nt, Staphylococcus aureus subsp. aureus Mu50
auaauuaaacuaauagcauuugua

SEQ ID NO: 2068888 - RNA, 12 nt, Staphylococcus aureus subsp. aureus Mu50
auaauuaaauaa

SEQ ID NO: 2068889 - RNA, 16 nt, Staphylococcus aureus subsp. aureus Mu50
auaauuaaauaaaaau

SEQ ID NO: 2068890 - RNA, 18 nt, Staphylococcus aureus subsp. aureus Mu50
auaauuaaauaaaaauau

SEQ ID NO: 2068891 - RNA, 14 nt, Staphylococcus aureus subsp. aureus Mu50
auaaugcuacuauu

SEQ ID NO: 2068892 - RNA, 18 nt, Staphylococcus aureus subsp. aureus Mu50
auaaugaauaauuaaaaa

SEQ ID NO: 2068893 - RNA, 15 nt, Staphylococcus aureus subsp. aureus Mu50
auaaugaauaguaau

SEQ ID NO: 2068894 - RNA, 21 nt, Staphylococcus aureus subsp. aureus Mu50
auaaugaauucauucaauacg

SEQ ID NO: 2068895 - RNA, 15 nt, Staphylococcus aureus subsp. aureus Mu50
auaaugacaaauuau

SEQ ID NO: 2068896 - RNA, 16 nt, Staphylococcus aureus subsp. aureus Mu50
auaaucuuuauuaaua

SEQ ID NO: 2068897 - RNA, 19 nt, Staphylococcus aureus subsp. aureus Mu50
auaaucgguaauuacuugu

SEQ ID NO: 2068898 - RNA, 23 nt, Staphylococcus aureus subsp. aureus Mu50
auaauaaauagacugccaauaaa

SEQ ID NO: 2068899 - RNA, 14 nt, Staphylococcus aureus subsp. aureus Mu50
auaauaaaccuaaa

SEQ ID NO: 2068900 - RNA, 14 nt, Staphylococcus aureus subsp. aureus Mu50
auaauaaaaaggag

SEQ ID NO: 2068901 - RNA, 17 nt, Staphylococcus aureus subsp. aureus Mu50
auaaguugcauauaaaa

SEQ ID NO: 2068902 - RNA, 22 nt, Staphylococcus aureus subsp. aureus Mu50
auaagugauuucuucauuauca

SEQ ID NO: 2068903 - RNA, 17 nt, Staphylococcus aureus subsp. aureus Mu50
auaaguggauuuucucc

SEQ ID NO: 2068904 - RNA, 13 nt, Staphylococcus aureus subsp. aureus Mu50
auaagugauguga

SEQ ID NO: 2068905 - RNA, 13 nt, Staphylococcus aureus subsp. aureus Mu50
auaagugauaaau

SEQ ID NO: 2068906 - RNA, 24 nt, Staphylococcus aureus subsp. aureus Mu50
auaagucugaugucgaaaauagcu

SEQ ID NO: 2068907 - RNA, 13 nt, Staphylococcus aureus subsp. aureus Mu50
auaaguuaaaaau

SEQ ID NO: 2068908 - RNA, 17 nt, Staphylococcus aureus subsp. aureus Mu50
auaaguuaaaaauguaa

SEQ ID NO: 2068909 - RNA, 16 nt, Staphylococcus aureus subsp. aureus Mu50
auaaguugaauauaaa

SEQ ID NO: 2068910 - RNA, 14 nt, Staphylococcus aureus subsp. aureus Mu50
auaaguacaaauaa

SEQ ID NO: 2068911 - RNA, 16 nt, Staphylococcus aureus subsp. aureus Mu50
auaaguaauaauauaa

SEQ ID NO: 2068912 - RNA, 13 nt, Staphylococcus aureus subsp. aureus Mu50
auaaguaguucag

SEQ ID NO: 2068913 - RNA, 19 nt, Staphylococcus aureus subsp. aureus Mu50
auaaguaguucagcaaguu

SEQ ID NO: 2068914 - RNA, 18 nt, Staphylococcus aureus subsp. aureus Mu50
auaaguacaaauaauaca

SEQ ID NO: 2068915 - RNA, 14 nt, Staphylococcus aureus subsp. aureus Mu50
auaaggacucuguu

SEQ ID NO: 2068916 - RNA, 18 nt, Staphylococcus aureus subsp. aureus Mu50
auaagcaaucauaauacu

SEQ ID NO: 2068917 - RNA, 19 nt, Staphylococcus aureus subsp. aureus Mu50
auaagauuuugaauuuuau

SEQ ID NO: 2068918 - RNA, 13 nt, Staphylococcus aureus subsp. aureus Mu50
auaagauuuugaa

SEQ ID NO: 2068919 - RNA, 22 nt, Staphylococcus aureus subsp. aureus Mu50
auaagagaacuuuucaaacaau

SEQ ID NO: 2068920 - RNA, 15 nt, Staphylococcus aureus subsp. aureus Mu50
auaagaugaaauauu

SEQ ID NO: 2068921 - RNA, 21 nt, Staphylococcus aureus subsp. aureus Mu50
auaagacuucccuauauguag

SEQ ID NO: 2068922 - RNA, 18 nt, Staphylococcus aureus subsp. aureus Mu50
auaagagaacuuuucaaa

SEQ ID NO: 2068923 - RNA, 15 nt, Staphylococcus aureus subsp. aureus Mu50
auaagacaauaguau

SEQ ID NO: 2068924 - RNA, 17 nt, Staphylococcus aureus subsp. aureus Mu50
auaagaauuuaaaagag

SEQ ID NO: 2068925 - RNA, 18 nt, Staphylococcus aureus subsp. aureus Mu50
auaagaauuuaaaagaga

SEQ ID NO: 2068926 - RNA, 10 nt, Staphylococcus aureus subsp. aureus Mu50
auaagaauuu

SEQ ID NO: 2068927 - RNA, 20 nt, Staphylococcus aureus subsp. aureus Mu50
auaagaauuaacaacaaaua

SEQ ID NO: 2068928 - RNA, 17 nt, Staphylococcus aureus subsp. aureus Mu50
auaagaaucaucuaaau

SEQ ID NO: 2068929 - RNA, 17 nt, Staphylococcus aureus subsp. aureus Mu50
auaagccuuuucaaaca

SEQ ID NO: 2068930 - RNA, 16 nt, Staphylococcus aureus subsp. aureus Mu50
auaagcgcaauuaaaa

SEQ ID NO: 2068931 - RNA, 21 nt, Staphylococcus aureus subsp. aureus Mu50
auaagcgcaauuaaaaguacu

SEQ ID NO: 2068932 - RNA, 17 nt, Staphylococcus aureus subsp. aureus Mu50
auaaggaagcguaugau

SEQ ID NO: 2068933 - RNA, 12 nt, Staphylococcus aureus subsp. aureus Mu50
auaagcugaaaa

SEQ ID NO: 2068934 - RNA, 13 nt, Staphylococcus aureus subsp. aureus Mu50
aggcaacaaauau

SEQ ID NO: 2068935 - RNA, 11 nt, Staphylococcus aureus subsp. aureus Mu50
aggcaacuuuu

SEQ ID NO: 2068936 - RNA, 22 nt, Staphylococcus aureus subsp. aureus Mu50
aggcacagcggaauacagauga

SEQ ID NO: 2068937 - RNA, 23 nt, Staphylococcus aureus subsp. aureus Mu50
aggcacaguggauuacagaugau

SEQ ID NO: 2068938 - RNA, 21 nt, Staphylococcus aureus subsp. aureus Mu50
aggcacaguggauuacagaug

SEQ ID NO: 2068939 - RNA, 20 nt, Staphylococcus aureus subsp. aureus Mu50
aggauuauagguauaagaau

SEQ ID NO: 2068940 - RNA, 20 nt, Staphylococcus aureus subsp. aureus Mu50
aggauuuccggaacaauacc

SEQ ID NO: 2068941 - RNA, 19 nt, Staphylococcus aureus subsp. aureus Mu50
aggauuugcaccuauaccu

SEQ ID NO: 2068942 - RNA, 15 nt, Staphylococcus aureus subsp. aureus Mu50
aggauguuauaaaau

SEQ ID NO: 2068943 - RNA, 14 nt, Staphylococcus aureus subsp. aureus Mu50
aggauguucaucaa

SEQ ID NO: 2068944 - RNA, 20 nt, Staphylococcus aureus subsp. aureus Mu50
aggauguucaucaacaugau

SEQ ID NO: 2068945 - RNA, 17 nt, Staphylococcus aureus subsp. aureus Mu50
aggaugaguuuaaaaau

SEQ ID NO: 2068946 - RNA, 18 nt, Staphylococcus aureus subsp. aureus Mu50
aggaugaguuuaaaaaua

SEQ ID NO: 2068947 - RNA, 14 nt, Staphylococcus aureus subsp. aureus Mu50
aggcauaacuguau

SEQ ID NO: 2068948 - RNA, 15 nt, Staphylococcus aureus subsp. aureus Mu50
aggcaucucacaauc

SEQ ID NO: 2068949 - RNA, 16 nt, Staphylococcus aureus subsp. aureus Mu50
aggcccauaaauuacu

SEQ ID NO: 2068950 - RNA, 19 nt, Staphylococcus aureus subsp. aureus Mu50
aggccauuuuuauuuaaca

SEQ ID NO: 2068951 - RNA, 14 nt, Staphylococcus aureus subsp. aureus Mu50
aggaagcaugagaa

SEQ ID NO: 2068952 - RNA, 15 nt, Staphylococcus aureus subsp. aureus Mu50
aggaauccaaagcug

SEQ ID NO: 2068953 - RNA, 16 nt, Staphylococcus aureus subsp. aureus Mu50
aggaauaugaauugcu

SEQ ID NO: 2068954 - RNA, 21 nt, Staphylococcus aureus subsp. aureus Mu50
aggaauauuucccuaugaaau

SEQ ID NO: 2068955 - RNA, 17 nt, Staphylococcus aureus subsp. aureus Mu50
aggaauaucuuucaaau

SEQ ID NO: 2068956 - RNA, 13 nt, Staphylococcus aureus subsp. aureus Mu50
aggaauaugaauu

SEQ ID NO: 2068957 - RNA, 14 nt, Staphylococcus aureus subsp. aureus Mu50
aggaauauaaaacu

SEQ ID NO: 2068958 - RNA, 15 nt, Staphylococcus aureus subsp. aureus Mu50
aggaauauaaaacug

SEQ ID NO: 2068959 - RNA, 13 nt, Staphylococcus aureus subsp. aureus Mu50
aggaaacuuaaau

SEQ ID NO: 2068960 - RNA, 15 nt, Staphylococcus aureus subsp. aureus Mu50
aggaaauaaaaaaua

SEQ ID NO: 2068961 - RNA, 23 nt, Staphylococcus aureus subsp. aureus Mu50
agcuuuuuucaauucuagucagg

SEQ ID NO: 2068962 - RNA, 20 nt, Staphylococcus aureus subsp. aureus Mu50
aggaaauggcuccauuuaau

SEQ ID NO: 2068963 - RNA, 22 nt, Staphylococcus aureus subsp. aureus Mu50
aggagcgagccauuauuauuuu

SEQ ID NO: 2068964 - RNA, 22 nt, Staphylococcus aureus subsp. aureus Mu50
aggauaugcuguguaucaucau

SEQ ID NO: 2068965 - RNA, 18 nt, Staphylococcus aureus subsp. aureus Mu50
aggaucaacugaaauuuu

SEQ ID NO: 2068966 - RNA, 19 nt, Staphylococcus aureus subsp. aureus Mu50
aggauacauaaaucuaaua

SEQ ID NO: 2068967 - RNA, 14 nt, Staphylococcus aureus subsp. aureus Mu50
aggauaauuauuag

SEQ ID NO: 2068968 - RNA, 21 nt, Staphylococcus aureus subsp. aureus Mu50
aggagauuguuauuauaaacu

SEQ ID NO: 2068969 - RNA, 12 nt, Staphylococcus aureus subsp. aureus Mu50
aggacuuuaugc

SEQ ID NO: 2068970 - RNA, 13 nt, Staphylococcus aureus subsp. aureus Mu50
aggaccaaauaga

SEQ ID NO: 2068971 - RNA, 19 nt, Staphylococcus aureus subsp. aureus Mu50
aggacacauuuacuuaaga

SEQ ID NO: 2068972 - RNA, 15 nt, Staphylococcus aureus subsp. aureus Mu50
agcuugauuuaacaa

SEQ ID NO: 2068973 - RNA, 14 nt, Staphylococcus aureus subsp. aureus Mu50
agcuuguaacaagc

SEQ ID NO: 2068974 - RNA, 20 nt, Staphylococcus aureus subsp. aureus Mu50
agcuuguaauccuuguucua

SEQ ID NO: 2068975 - RNA, 16 nt, Staphylococcus aureus subsp. aureus Mu50
agcuugcuuacaauaa

SEQ ID NO: 2068976 - RNA, 18 nt, Staphylococcus aureus subsp. aureus Mu50
agcuugcuuacaauaauc

SEQ ID NO: 2068977 - RNA, 22 nt, Staphylococcus aureus subsp. aureus Mu50
agcuugcuuacaauaaucacuu

SEQ ID NO: 2068978 - RNA, 15 nt, Staphylococcus aureus subsp. aureus Mu50
agcuuuucauuuuua

SEQ ID NO: 2068979 - RNA, 14 nt, Staphylococcus aureus subsp. aureus Mu50
agcuuuucuaaugc

SEQ ID NO: 2068980 - RNA, 12 nt, Staphylococcus aureus subsp. aureus Mu50
agcuuuuguaaa

SEQ ID NO: 2068981 - RNA, 13 nt, Staphylococcus aureus subsp. aureus Mu50
agcuuuuguaaag

SEQ ID NO: 2068982 - RNA, 18 nt, Staphylococcus aureus subsp. aureus Mu50
agcuuucauuaauuuuuc

SEQ ID NO: 2068983 - RNA, 17 nt, Staphylococcus aureus subsp. aureus Mu50
agcuuuuacgccuucuu

SEQ ID NO: 2068984 - RNA, 19 nt, Staphylococcus aureus subsp. aureus Mu50
agcuuugcugcuuuuccag

SEQ ID NO: 2068985 - RNA, 15 nt, Staphylococcus aureus subsp. aureus Mu50
agcuuguuucagguu

SEQ ID NO: 2068986 - RNA, 22 nt, Staphylococcus aureus subsp. aureus Mu50
agcuuuaaucauagcauuaaga

SEQ ID NO: 2068987 - RNA, 11 nt, Staphylococcus aureus subsp. aureus Mu50
agcuuucaguu

SEQ ID NO: 2068988 - RNA, 16 nt, Staphylococcus aureus subsp. aureus Mu50
agcuucuuuaacaauu

SEQ ID NO: 2068989 - RNA, 15 nt, Staphylococcus aureus subsp. aureus Mu50
agcuugaauaauaua

SEQ ID NO: 2068990 - RNA, 16 nt, Staphylococcus aureus subsp. aureus Mu50
agcuugaauaauauau

SEQ ID NO: 2068991 - RNA, 18 nt, Staphylococcus aureus subsp. aureus Mu50
agcuugaauaauauauuu

SEQ ID NO: 2068992 - RNA, 22 nt, Staphylococcus aureus subsp. aureus Mu50
agcuucugcaugggcuucugcu

SEQ ID NO: 2068993 - RNA, 17 nt, Staphylococcus aureus subsp. aureus Mu50
agcuucucauugaaauc

SEQ ID NO: 2068994 - RNA, 19 nt, Staphylococcus aureus subsp. aureus Mu50
agcuuaauaaauuguauga

SEQ ID NO: 2068995 - RNA, 21 nt, Staphylococcus aureus subsp. aureus Mu50
agcuuaaauagugcuuuuuca

SEQ ID NO: 2068996 - RNA, 18 nt, Staphylococcus aureus subsp. aureus Mu50
agcuuacaauagugugca

SEQ ID NO: 2068997 - RNA, 14 nt, Staphylococcus aureus subsp. aureus Mu50
agcugcgauauaac

SEQ ID NO: 2068998 - RNA, 22 nt, Staphylococcus aureus subsp. aureus Mu50
agcugugcugucauuuucugcu

SEQ ID NO: 2068999 - RNA, 13 nt, Staphylococcus aureus subsp. aureus Mu50
agcugcaauuuua

SEQ ID NO: 2069000 - RNA, 21 nt, Staphylococcus aureus subsp. aureus Mu50
agcucuuuuuugauuuggaaa

SEQ ID NO: 2069001 - RNA, 18 nt, Staphylococcus aureus subsp. aureus Mu50
agcggacugaaagaaaag

SEQ ID NO: 2069002 - RNA, 22 nt, Staphylococcus aureus subsp. aureus Mu50
agcggaaauaugauugaaugaa

SEQ ID NO: 2069003 - RNA, 13 nt, Staphylococcus aureus subsp. aureus Mu50
agcggaauacaga

SEQ ID NO: 2069004 - RNA, 19 nt, Staphylococcus aureus subsp. aureus Mu50
agcggccgugguaugauuu

SEQ ID NO: 2069005 - RNA, 22 nt, Staphylococcus aureus subsp. aureus Mu50
agcguagcgaaaguaucuauga

SEQ ID NO: 2069006 - RNA, 16 nt, Staphylococcus aureus subsp. aureus Mu50
agcuaauaucaauaau

SEQ ID NO: 2069007 - RNA, 17 nt, Staphylococcus aureus subsp. aureus Mu50
agcuaauaacgcugcac

SEQ ID NO: 2069008 - RNA, 18 nt, Staphylococcus aureus subsp. aureus Mu50
agcuaaugcaacuaaaac

SEQ ID NO: 2069009 - RNA, 13 nt, Staphylococcus aureus subsp. aureus Mu50
agcuaaguuaaau

SEQ ID NO: 2069010 - RNA, 19 nt, Staphylococcus aureus subsp. aureus Mu50
agcucaauaaauuaugaaa

SEQ ID NO: 2069011 - RNA, 17 nt, Staphylococcus aureus subsp. aureus Mu50
agcuaaugucaugaaaa

SEQ ID NO: 2069012 - RNA, 22 nt, Staphylococcus aureus subsp. aureus Mu50
agcuaauuucuaauacauacug

SEQ ID NO: 2069013 - RNA, 15 nt, Staphylococcus aureus subsp. aureus Mu50
agcuauuacuauaaa

SEQ ID NO: 2069014 - RNA, 21 nt, Staphylococcus aureus subsp. aureus Mu50
agggacagaaaagggcaaaaa

SEQ ID NO: 2069015 - RNA, 15 nt, Staphylococcus aureus subsp. aureus Mu50
agggcaaaaaaggau

SEQ ID NO: 2069016 - RNA, 13 nt, Staphylococcus aureus subsp. aureus Mu50
agggcaaaaaagg

SEQ ID NO: 2069017 - RNA, 16 nt, Staphylococcus aureus subsp. aureus Mu50
agggagugaggugaga

SEQ ID NO: 2069018 - RNA, 22 nt, Staphylococcus aureus subsp. aureus Mu50
aggcuguucuggaauugggaaa

SEQ ID NO: 2069019 - RNA, 15 nt, Staphylococcus aureus subsp. aureus Mu50
aggggcuuuuaugca

SEQ ID NO: 2069020 - RNA, 16 nt, Staphylococcus aureus subsp. aureus Mu50
aggggccccaacacag

SEQ ID NO: 2069021 - RNA, 17 nt, Staphylococcus aureus subsp. aureus Mu50
aggggccccaacacaga

SEQ ID NO: 2069022 - RNA, 21 nt, Staphylococcus aureus subsp. aureus Mu50
agggcggucaauuuuaccaug

SEQ ID NO: 2069023 - RNA, 18 nt, Staphylococcus aureus subsp. aureus Mu50
agggccccaacacagaag

SEQ ID NO: 2069024 - RNA, 15 nt, Staphylococcus aureus subsp. aureus Mu50
agggccccaacacag

SEQ ID NO: 2069025 - RNA, 18 nt, Staphylococcus aureus subsp. aureus Mu50
aggcgcuuguaaaauuuu

SEQ ID NO: 2069026 - RNA, 15 nt, Staphylococcus aureus subsp. aureus Mu50
aguaacauacuauaa

SEQ ID NO: 2069027 - RNA, 17 nt, Staphylococcus aureus subsp. aureus Mu50
aguaacauacuauaaaa

SEQ ID NO: 2069028 - RNA, 18 nt, Staphylococcus aureus subsp. aureus Mu50
aguaacauacuauaaaaa

SEQ ID NO: 2069029 - RNA, 19 nt, Staphylococcus aureus subsp. aureus Mu50
aguaacauacuauaaaaau

SEQ ID NO: 2069030 - RNA, 15 nt, Staphylococcus aureus subsp. aureus Mu50
aguaacucaagugau

SEQ ID NO: 2069031 - RNA, 20 nt, Staphylococcus aureus subsp. aureus Mu50
aguaagacgauuucaaugag

SEQ ID NO: 2069032 - RNA, 17 nt, Staphylococcus aureus subsp. aureus Mu50
aguaagauauuuccaaa

SEQ ID NO: 2069033 - RNA, 21 nt, Staphylococcus aureus subsp. aureus Mu50
aguaauaaaagucgauaaaua

SEQ ID NO: 2069034 - RNA, 17 nt, Staphylococcus aureus subsp. aureus Mu50
aguaaguaauaaaauaa

SEQ ID NO: 2069035 - RNA, 13 nt, Staphylococcus aureus subsp. aureus Mu50
aguaauaauauaa

SEQ ID NO: 2069036 - RNA, 22 nt, Staphylococcus aureus subsp. aureus Mu50
aguaauaaaagucgauaaauau

SEQ ID NO: 2069037 - RNA, 15 nt, Staphylococcus aureus subsp. aureus Mu50
aguaauaacaucuaa

SEQ ID NO: 2069038 - RNA, 16 nt, Staphylococcus aureus subsp. aureus Mu50
aguaauaauuuauuga

SEQ ID NO: 2069039 - RNA, 16 nt, Staphylococcus aureus subsp. aureus Mu50
aguacccagaaugcga

SEQ ID NO: 2069040 - RNA, 19 nt, Staphylococcus aureus subsp. aureus Mu50
aguaccauguuuuuuaagu

SEQ ID NO: 2069041 - RNA, 18 nt, Staphylococcus aureus subsp. aureus Mu50
aguaccaaagaaaucacc

SEQ ID NO: 2069042 - RNA, 23 nt, Staphylococcus aureus subsp. aureus Mu50
aguacaguuaguggcauuauauu

SEQ ID NO: 2069043 - RNA, 16 nt, Staphylococcus aureus subsp. aureus Mu50
aguacagcgguuugua

SEQ ID NO: 2069044 - RNA, 21 nt, Staphylococcus aureus subsp. aureus Mu50
aguacaauaauaccuucaauu

SEQ ID NO: 2069045 - RNA, 12 nt, Staphylococcus aureus subsp. aureus Mu50
aguacaauaaua

SEQ ID NO: 2069046 - RNA, 15 nt, Staphylococcus aureus subsp. aureus Mu50
aguacaaauaacaaa

SEQ ID NO: 2069047 - RNA, 13 nt, Staphylococcus aureus subsp. aureus Mu50
aguacaaauaaua

SEQ ID NO: 2069048 - RNA, 22 nt, Staphylococcus aureus subsp. aureus Mu50
aguacaacaguugcaccuaaac

SEQ ID NO: 2069049 - RNA, 16 nt, Staphylococcus aureus subsp. aureus Mu50
aguaauuaaauacuug

SEQ ID NO: 2069050 - RNA, 14 nt, Staphylococcus aureus subsp. aureus Mu50
aguaauuaauuccu

SEQ ID NO: 2069051 - RNA, 14 nt, Staphylococcus aureus subsp. aureus Mu50
aguaauuucuccaa

SEQ ID NO: 2069052 - RNA, 23 nt, Staphylococcus aureus subsp. aureus Mu50
aguaaugaccggcauauaaucca

SEQ ID NO: 2069053 - RNA, 14 nt, Staphylococcus aureus subsp. aureus Mu50
aguaaugauuaacu

SEQ ID NO: 2069054 - RNA, 18 nt, Staphylococcus aureus subsp. aureus Mu50
aguaaugaccaauagcaa

SEQ ID NO: 2069055 - RNA, 15 nt, Staphylococcus aureus subsp. aureus Mu50
aguaaucguaucuuc

SEQ ID NO: 2069056 - RNA, 20 nt, Staphylococcus aureus subsp. aureus Mu50
aguaaucuuguuuucauuua

SEQ ID NO: 2069057 - RNA, 16 nt, Staphylococcus aureus subsp. aureus Mu50
aguaaucaagcaaugc

SEQ ID NO: 2069058 - RNA, 22 nt, Staphylococcus aureus subsp. aureus Mu50
aguaauauguugcuuaucaaca

SEQ ID NO: 2069059 - RNA, 19 nt, Staphylococcus aureus subsp. aureus Mu50
aguaaucagcuuuuucaca

SEQ ID NO: 2069060 - RNA, 14 nt, Staphylococcus aureus subsp. aureus Mu50
agguugaagaagga

SEQ ID NO: 2069061 - RNA, 18 nt, Staphylococcus aureus subsp. aureus Mu50
agguucaucuuuaugcaa

SEQ ID NO: 2069062 - RNA, 15 nt, Staphylococcus aureus subsp. aureus Mu50
agguucuucaucuuu

SEQ ID NO: 2069063 - RNA, 19 nt, Staphylococcus aureus subsp. aureus Mu50
agguuauuauaaaauaaau

SEQ ID NO: 2069064 - RNA, 17 nt, Staphylococcus aureus subsp. aureus Mu50
agguuaaauauuuaauu

SEQ ID NO: 2069065 - RNA, 19 nt, Staphylococcus aureus subsp. aureus Mu50
agguguggaguaaagauca

SEQ ID NO: 2069066 - RNA, 21 nt, Staphylococcus aureus subsp. aureus Mu50
aguaaagggagguauauacaa

SEQ ID NO: 2069067 - RNA, 16 nt, Staphylococcus aureus subsp. aureus Mu50
aguaaagugaaauaaa

SEQ ID NO: 2069068 - RNA, 15 nt, Staphylococcus aureus subsp. aureus Mu50
aguaaaauaaaaaau

SEQ ID NO: 2069069 - RNA, 14 nt, Staphylococcus aureus subsp. aureus Mu50
aguaaaacugcaau

SEQ ID NO: 2069070 - RNA, 16 nt, Staphylococcus aureus subsp. aureus Mu50
agguuuguaagacaac

SEQ ID NO: 2069071 - RNA, 23 nt, Staphylococcus aureus subsp. aureus Mu50
agguuguuuuucaucauuaaaau

SEQ ID NO: 2069072 - RNA, 19 nt, Staphylococcus aureus subsp. aureus Mu50
agguuguucuauacauucc

SEQ ID NO: 2069073 - RNA, 13 nt, Staphylococcus aureus subsp. aureus Mu50
agguuuauauauc

SEQ ID NO: 2069074 - RNA, 14 nt, Staphylococcus aureus subsp. aureus Mu50
agguuuauaaaaaa

SEQ ID NO: 2069075 - RNA, 19 nt, Staphylococcus aureus subsp. aureus Mu50
agguaaaucuguuuaaauu

SEQ ID NO: 2069076 - RNA, 23 nt, Staphylococcus aureus subsp. aureus Mu50
agguaaaucuguuuaaauuuaaa

SEQ ID NO: 2069077 - RNA, 16 nt, Staphylococcus aureus subsp. aureus Mu50
agguaaauuuaaaaua

SEQ ID NO: 2069078 - RNA, 18 nt, Staphylococcus aureus subsp. aureus Mu50
agguaaauuuaaaauaau

SEQ ID NO: 2069079 - RNA, 15 nt, Staphylococcus aureus subsp. aureus Mu50
agguaagugcucaaa

SEQ ID NO: 2069080 - RNA, 22 nt, Staphylococcus aureus subsp. aureus Mu50
agguaagaaaaauucaucaaua

SEQ ID NO: 2069081 - RNA, 13 nt, Staphylococcus aureus subsp. aureus Mu50
agguaacugcuuu

SEQ ID NO: 2069082 - RNA, 23 nt, Staphylococcus aureus subsp. aureus Mu50
agguaacugcuuuggaguuucuu

SEQ ID NO: 2069083 - RNA, 23 nt, Staphylococcus aureus subsp. aureus Mu50
aggguuugccagucauuguauaa

SEQ ID NO: 2069084 - RNA, 17 nt, Staphylococcus aureus subsp. aureus Mu50
agguaugaaauaacaau

SEQ ID NO: 2069085 - RNA, 17 nt, Staphylococcus aureus subsp. aureus Mu50
agguauucaaauaaaca

SEQ ID NO: 2069086 - RNA, 22 nt, Staphylococcus aureus subsp. aureus Mu50
agguauagcaaguuuauaaauu

SEQ ID NO: 2069087 - RNA, 17 nt, Staphylococcus aureus subsp. aureus Mu50
agguaauuuaacauuuu

SEQ ID NO: 2069088 - RNA, 17 nt, Staphylococcus aureus subsp. aureus Mu50
agguaaugcaaguuggg

SEQ ID NO: 2069089 - RNA, 12 nt, Staphylococcus aureus subsp. aureus Mu50
agguaaugcaag

SEQ ID NO: 2069090 - RNA, 13 nt, Staphylococcus aureus subsp. aureus Mu50
agguaaugcaagu

SEQ ID NO: 2069091 - RNA, 13 nt, Staphylococcus aureus subsp. aureus Mu50
agguaauacuuuu

SEQ ID NO: 2069092 - RNA, 22 nt, Staphylococcus aureus subsp. aureus Mu50
aggucaucugaugaggcaauau

SEQ ID NO: 2069093 - RNA, 22 nt, Staphylococcus aureus subsp. aureus Mu50
acgguauuuucaaaacugccaa

SEQ ID NO: 2069094 - RNA, 19 nt, Staphylococcus aureus subsp. aureus Mu50
acguaaguguaaaugaaag

SEQ ID NO: 2069095 - RNA, 18 nt, Staphylococcus aureus subsp. aureus Mu50
acgguaggaccucuuauu

SEQ ID NO: 2069096 - RNA, 21 nt, Staphylococcus aureus subsp. aureus Mu50
acgguauuuucaaaacugcca

SEQ ID NO: 2069097 - RNA, 13 nt, Staphylococcus aureus subsp. aureus Mu50
acgguauuuucaa

SEQ ID NO: 2069098 - RNA, 17 nt, Staphylococcus aureus subsp. aureus Mu50
acgcaauacgaauaucu

SEQ ID NO: 2069099 - RNA, 19 nt, Staphylococcus aureus subsp. aureus Mu50
acgcugguaauauuuuugu

SEQ ID NO: 2069100 - RNA, 14 nt, Staphylococcus aureus subsp. aureus Mu50
acggaauaacuuuu

SEQ ID NO: 2069101 - RNA, 15 nt, Staphylococcus aureus subsp. aureus Mu50
acgcuguuuuaaauu

SEQ ID NO: 2069102 - RNA, 17 nt, Staphylococcus aureus subsp. aureus Mu50
acggcacauucauaccg

SEQ ID NO: 2069103 - RNA, 20 nt, Staphylococcus aureus subsp. aureus Mu50
acucaaaaagccaacacauu

SEQ ID NO: 2069104 - RNA, 19 nt, Staphylococcus aureus subsp. aureus Mu50
acuauuuuugaaaagagcg

SEQ ID NO: 2069105 - RNA, 14 nt, Staphylococcus aureus subsp. aureus Mu50
acucaaauaucuaa

SEQ ID NO: 2069106 - RNA, 15 nt, Staphylococcus aureus subsp. aureus Mu50
acuauucuuucuugc

SEQ ID NO: 2069107 - RNA, 19 nt, Staphylococcus aureus subsp. aureus Mu50
acuauugaaaauagaaaga

SEQ ID NO: 2069108 - RNA, 17 nt, Staphylococcus aureus subsp. aureus Mu50
acuauuuuaaaaaugcu

SEQ ID NO: 2069109 - RNA, 18 nt, Staphylococcus aureus subsp. aureus Mu50
acuauuuuaaaaaugcug

SEQ ID NO: 2069110 - RNA, 15 nt, Staphylococcus aureus subsp. aureus Mu50
acuauuaaaggaaau

SEQ ID NO: 2069111 - RNA, 13 nt, Staphylococcus aureus subsp. aureus Mu50
acuauuaaaggaa

SEQ ID NO: 2069112 - RNA, 19 nt, Staphylococcus aureus subsp. aureus Mu50
acuauuaaaggaaaucaau

SEQ ID NO: 2069113 - RNA, 15 nt, Staphylococcus aureus subsp. aureus Mu50
acuauuaucgaagaa

SEQ ID NO: 2069114 - RNA, 15 nt, Staphylococcus aureus subsp. aureus Mu50
acuauaaaaaacagc

SEQ ID NO: 2069115 - RNA, 16 nt, Staphylococcus aureus subsp. aureus Mu50
acuauaaaaaacagca

SEQ ID NO: 2069116 - RNA, 14 nt, Staphylococcus aureus subsp. aureus Mu50
acuaguuuguaaua

SEQ ID NO: 2069117 - RNA, 15 nt, Staphylococcus aureus subsp. aureus Mu50
acuauaaaaauuuau

SEQ ID NO: 2069118 - RNA, 19 nt, Staphylococcus aureus subsp. aureus Mu50
acuauaacaccaauuaaau

SEQ ID NO: 2069119 - RNA, 17 nt, Staphylococcus aureus subsp. aureus Mu50
acuauaaauacaaauau

SEQ ID NO: 2069120 - RNA, 17 nt, Staphylococcus aureus subsp. aureus Mu50
acuauaaaauucaccaa

SEQ ID NO: 2069121 - RNA, 19 nt, Staphylococcus aureus subsp. aureus Mu50
acuauaaaauucaccaacu

SEQ ID NO: 2069122 - RNA, 14 nt, Staphylococcus aureus subsp. aureus Mu50
acuaucaaugacau

SEQ ID NO: 2069123 - RNA, 13 nt, Staphylococcus aureus subsp. aureus Mu50
acuaucaauauaa

SEQ ID NO: 2069124 - RNA, 14 nt, Staphylococcus aureus subsp. aureus Mu50
acuauauuuauuag

SEQ ID NO: 2069125 - RNA, 19 nt, Staphylococcus aureus subsp. aureus Mu50
acuauauuucacacagcuu

SEQ ID NO: 2069126 - RNA, 21 nt, Staphylococcus aureus subsp. aureus Mu50
acuaaacgauaaauuaacuua

SEQ ID NO: 2069127 - RNA, 16 nt, Staphylococcus aureus subsp. aureus Mu50
acuaaacuuuucuuca

SEQ ID NO: 2069128 - RNA, 22 nt, Staphylococcus aureus subsp. aureus Mu50
acuaauggauaugauaaccaaa

SEQ ID NO: 2069129 - RNA, 20 nt, Staphylococcus aureus subsp. aureus Mu50
acuaauggcacuuaauauaa

SEQ ID NO: 2069130 - RNA, 15 nt, Staphylococcus aureus subsp. aureus Mu50
acuaauguuaaaaua

SEQ ID NO: 2069131 - RNA, 19 nt, Staphylococcus aureus subsp. aureus Mu50
acuaaugucgcacuauaaa

SEQ ID NO: 2069132 - RNA, 18 nt, Staphylococcus aureus subsp. aureus Mu50
acuaauuuagacaucauu

SEQ ID NO: 2069133 - RNA, 14 nt, Staphylococcus aureus subsp. aureus Mu50
acuaauuuauuaau

SEQ ID NO: 2069134 - RNA, 17 nt, Staphylococcus aureus subsp. aureus Mu50
acuaauugaucagcauu

SEQ ID NO: 2069135 - RNA, 16 nt, Staphylococcus aureus subsp. aureus Mu50
acuaccuguuggcuuu

SEQ ID NO: 2069136 - RNA, 15 nt, Staphylococcus aureus subsp. aureus Mu50
acuacgcauuauuaa

SEQ ID NO: 2069137 - RNA, 16 nt, Staphylococcus aureus subsp. aureus Mu50
acuaccuuccauuucg

SEQ ID NO: 2069138 - RNA, 19 nt, Staphylococcus aureus subsp. aureus Mu50
acuaccuauuaauaucaua

SEQ ID NO: 2069139 - RNA, 17 nt, Staphylococcus aureus subsp. aureus Mu50
acuacgcauuuuaaaua

SEQ ID NO: 2069140 - RNA, 19 nt, Staphylococcus aureus subsp. aureus Mu50
acuacugucucaucuucua

SEQ ID NO: 2069141 - RNA, 14 nt, Staphylococcus aureus subsp. aureus Mu50
acuacuuaauuaau

SEQ ID NO: 2069142 - RNA, 19 nt, Staphylococcus aureus subsp. aureus Mu50
acuacuuuuucaacuguac

SEQ ID NO: 2069143 - RNA, 20 nt, Staphylococcus aureus subsp. aureus Mu50
acguuauucguuaacaauca

SEQ ID NO: 2069144 - RNA, 20 nt, Staphylococcus aureus subsp. aureus Mu50
acguugguuuaaaaauugau

SEQ ID NO: 2069145 - RNA, 21 nt, Staphylococcus aureus subsp. aureus Mu50
acuaaaccgauuaauauaaua

SEQ ID NO: 2069146 - RNA, 13 nt, Staphylococcus aureus subsp. aureus Mu50
acuaaacgauaaa

SEQ ID NO: 2069147 - RNA, 14 nt, Staphylococcus aureus subsp. aureus Mu50
acuaaacauugcuu

SEQ ID NO: 2069148 - RNA, 19 nt, Staphylococcus aureus subsp. aureus Mu50
acuaaaacgauaauaauaa

SEQ ID NO: 2069149 - RNA, 23 nt, Staphylococcus aureus subsp. aureus Mu50
acguuuuuuuauaaauuauagua

SEQ ID NO: 2069150 - RNA, 16 nt, Staphylococcus aureus subsp. aureus Mu50
acuaaaaauauauuuc

SEQ ID NO: 2069151 - RNA, 16 nt, Staphylococcus aureus subsp. aureus Mu50
acguuuucuagguaau

SEQ ID NO: 2069152 - RNA, 15 nt, Staphylococcus aureus subsp. aureus Mu50
acguuuuugaaucag

SEQ ID NO: 2069153 - RNA, 21 nt, Staphylococcus aureus subsp. aureus Mu50
acguuuuaaagguuaaauauu

SEQ ID NO: 2069154 - RNA, 11 nt, Staphylococcus aureus subsp. aureus Mu50
acguuuucuag

SEQ ID NO: 2069155 - RNA, 17 nt, Staphylococcus aureus subsp. aureus Mu50
acguuuuccaugaguuu

SEQ ID NO: 2069156 - RNA, 19 nt, Staphylococcus aureus subsp. aureus Mu50
acgugcugccuuuuugcuu

SEQ ID NO: 2069157 - RNA, 16 nt, Staphylococcus aureus subsp. aureus Mu50
acgugcuuuaaaguug

SEQ ID NO: 2069158 - RNA, 13 nt, Staphylococcus aureus subsp. aureus Mu50
acgugcuuuaaag

SEQ ID NO: 2069159 - RNA, 16 nt, Staphylococcus aureus subsp. aureus Mu50
acguaaugaaucaauu

SEQ ID NO: 2069160 - RNA, 21 nt, Staphylococcus aureus subsp. aureus Mu50
acuucacuaggaucuuuucca

SEQ ID NO: 2069161 - RNA, 18 nt, Staphylococcus aureus subsp. aureus Mu50
acuucaauaacaaugcag

SEQ ID NO: 2069162 - RNA, 13 nt, Staphylococcus aureus subsp. aureus Mu50
acuuaugauacug

SEQ ID NO: 2069163 - RNA, 15 nt, Staphylococcus aureus subsp. aureus Mu50
acuuaugauacugau

SEQ ID NO: 2069164 - RNA, 17 nt, Staphylococcus aureus subsp. aureus Mu50
acuuaugagcaaagcaa

SEQ ID NO: 2069165 - RNA, 12 nt, Staphylococcus aureus subsp. aureus Mu50
acuucacauuua

SEQ ID NO: 2069166 - RNA, 18 nt, Staphylococcus aureus subsp. aureus Mu50
acuucaccacauaaaaau

SEQ ID NO: 2069167 - RNA, 19 nt, Staphylococcus aureus subsp. aureus Mu50
acuucaccacauaaaaaua

SEQ ID NO: 2069168 - RNA, 13 nt, Staphylococcus aureus subsp. aureus Mu50
acuuauaauauua

SEQ ID NO: 2069169 - RNA, 15 nt, Staphylococcus aureus subsp. aureus Mu50
acuuauaacugauaa

SEQ ID NO: 2069170 - RNA, 23 nt, Staphylococcus aureus subsp. aureus Mu50
acuuauauauucaauaauuauua

SEQ ID NO: 2069171 - RNA, 12 nt, Staphylococcus aureus subsp. aureus Mu50
acuuauauauuc

SEQ ID NO: 2069172 - RNA, 22 nt, Staphylococcus aureus subsp. aureus Mu50
acuguucuuucgucuuguaaac

SEQ ID NO: 2069173 - RNA, 16 nt, Staphylococcus aureus subsp. aureus Mu50
acugucgcucauccuc

SEQ ID NO: 2069174 - RNA, 14 nt, Staphylococcus aureus subsp. aureus Mu50
acugguugauaaau

SEQ ID NO: 2069175 - RNA, 19 nt, Staphylococcus aureus subsp. aureus Mu50
acugguugauaaauaaacu

SEQ ID NO: 2069176 - RNA, 15 nt, Staphylococcus aureus subsp. aureus Mu50
acuuaaaaaugaaau

SEQ ID NO: 2069177 - RNA, 21 nt, Staphylococcus aureus subsp. aureus Mu50
acuuaaauaucgacaaauuaa

SEQ ID NO: 2069178 - RNA, 15 nt, Staphylococcus aureus subsp. aureus Mu50
acuuaaagauuuacc

SEQ ID NO: 2069179 - RNA, 12 nt, Staphylococcus aureus subsp. aureus Mu50
acuuaaaauuua

SEQ ID NO: 2069180 - RNA, 22 nt, Staphylococcus aureus subsp. aureus Mu50
acuuaaaauuucccuuuauacu

SEQ ID NO: 2069181 - RNA, 17 nt, Staphylococcus aureus subsp. aureus Mu50
acuuaaaacuauaaccu

SEQ ID NO: 2069182 - RNA, 13 nt, Staphylococcus aureus subsp. aureus Mu50
acuuaauaucaua

SEQ ID NO: 2069183 - RNA, 21 nt, Staphylococcus aureus subsp. aureus Mu50
acuuaacgagugcuuucaccu

SEQ ID NO: 2069184 - RNA, 13 nt, Staphylococcus aureus subsp. aureus Mu50
acuuaaccauuua

SEQ ID NO: 2069185 - RNA, 16 nt, Staphylococcus aureus subsp. aureus Mu50
acuuaacuuguguuau

SEQ ID NO: 2069186 - RNA, 15 nt, Staphylococcus aureus subsp. aureus Mu50
acuuaguaauaagac

SEQ ID NO: 2069187 - RNA, 22 nt, Staphylococcus aureus subsp. aureus Mu50
acuuaguagauuuauuaaauau

SEQ ID NO: 2069188 - RNA, 20 nt, Staphylococcus aureus subsp. aureus Mu50
acuuagggugacucaaugaa

SEQ ID NO: 2069189 - RNA, 19 nt, Staphylococcus aureus subsp. aureus Mu50
acuuagcaaucucuuuaga

SEQ ID NO: 2069190 - RNA, 15 nt, Staphylococcus aureus subsp. aureus Mu50
acugcuguucuuuuu

SEQ ID NO: 2069191 - RNA, 20 nt, Staphylococcus aureus subsp. aureus Mu50
acugcuguucucuauuuaua

SEQ ID NO: 2069192 - RNA, 20 nt, Staphylococcus aureus subsp. aureus Mu50
acugcucuuuauauauaaaa

SEQ ID NO: 2069193 - RNA, 19 nt, Staphylococcus aureus subsp. aureus Mu50
acugcuaauuuuuucauca

SEQ ID NO: 2069194 - RNA, 14 nt, Staphylococcus aureus subsp. aureus Mu50
acugcuaauuuuuu

SEQ ID NO: 2069195 - RNA, 13 nt, Staphylococcus aureus subsp. aureus Mu50
acugcuaauauua

SEQ ID NO: 2069196 - RNA, 20 nt, Staphylococcus aureus subsp. aureus Mu50
acugcuaauauuagauaucu

SEQ ID NO: 2069197 - RNA, 18 nt, Staphylococcus aureus subsp. aureus Mu50
acugggacauagaucaau

SEQ ID NO: 2069198 - RNA, 13 nt, Staphylococcus aureus subsp. aureus Mu50
acugcaauuauuu

SEQ ID NO: 2069199 - RNA, 14 nt, Staphylococcus aureus subsp. aureus Mu50
acugcaccuccaac

SEQ ID NO: 2069200 - RNA, 14 nt, Staphylococcus aureus subsp. aureus Mu50
acugcacuuuuauu

SEQ ID NO: 2069201 - RNA, 16 nt, Staphylococcus aureus subsp. aureus Mu50
acugcauauaaaguca

SEQ ID NO: 2069202 - RNA, 17 nt, Staphylococcus aureus subsp. aureus Mu50
acugccauauguuuuag

SEQ ID NO: 2069203 - RNA, 23 nt, Staphylococcus aureus subsp. aureus Mu50
acugccuaauacacuugauaaaa

SEQ ID NO: 2069204 - RNA, 16 nt, Staphylococcus aureus subsp. aureus Mu50
acugauaaaaggggaa

SEQ ID NO: 2069205 - RNA, 20 nt, Staphylococcus aureus subsp. aureus Mu50
acugaaauuucauaaaguuu

SEQ ID NO: 2069206 - RNA, 16 nt, Staphylococcus aureus subsp. aureus Mu50
acugaaacuaaauuaa

SEQ ID NO: 2069207 - RNA, 19 nt, Staphylococcus aureus subsp. aureus Mu50
acugagcaacaaaagaugu

SEQ ID NO: 2069208 - RNA, 22 nt, Staphylococcus aureus subsp. aureus Mu50
acugcaaauacgaguguuuuaa

SEQ ID NO: 2069209 - RNA, 21 nt, Staphylococcus aureus subsp. aureus Mu50
acugcaacaccacacagcauu

SEQ ID NO: 2069210 - RNA, 18 nt, Staphylococcus aureus subsp. aureus Mu50
acugcaacaccacacagc

SEQ ID NO: 2069211 - RNA, 23 nt, Staphylococcus aureus subsp. aureus Mu50
acugauuuauugauaaauauuga

SEQ ID NO: 2069212 - RNA, 18 nt, Staphylococcus aureus subsp. aureus Mu50
acugauuuuguuucaaac

SEQ ID NO: 2069213 - RNA, 17 nt, Staphylococcus aureus subsp. aureus Mu50
acucuagagguaaaucu

SEQ ID NO: 2069214 - RNA, 18 nt, Staphylococcus aureus subsp. aureus Mu50
acucuagagguaaaucua

SEQ ID NO: 2069215 - RNA, 19 nt, Staphylococcus aureus subsp. aureus Mu50
acucugagcacuuagcaau

SEQ ID NO: 2069216 - RNA, 22 nt, Staphylococcus aureus subsp. aureus Mu50
acucugauauugaucugauuuc

SEQ ID NO: 2069217 - RNA, 22 nt, Staphylococcus aureus subsp. aureus Mu50
acucuguuugucacuuaacuca

SEQ ID NO: 2069218 - RNA, 13 nt, Staphylococcus aureus subsp. aureus Mu50
acucuuuuucuuu

SEQ ID NO: 2069219 - RNA, 15 nt, Staphylococcus aureus subsp. aureus Mu50
acuccguugaauuca

SEQ ID NO: 2069220 - RNA, 13 nt, Staphylococcus aureus subsp. aureus Mu50
acucaauaaaauu

SEQ ID NO: 2069221 - RNA, 22 nt, Staphylococcus aureus subsp. aureus Mu50
acucaaugauuguaauaucuaa

SEQ ID NO: 2069222 - RNA, 15 nt, Staphylococcus aureus subsp. aureus Mu50
acuccuccaaagcua

SEQ ID NO: 2069223 - RNA, 15 nt, Staphylococcus aureus subsp. aureus Mu50
acuccucuauuuuau

SEQ ID NO: 2069224 - RNA, 15 nt, Staphylococcus aureus subsp. aureus Mu50
acuccuuaaacaaau

SEQ ID NO: 2069225 - RNA, 15 nt, Staphylococcus aureus subsp. aureus Mu50
acuccuuauuuuucg

SEQ ID NO: 2069226 - RNA, 20 nt, Staphylococcus aureus subsp. aureus Mu50
agauucauaucuuucaauua

SEQ ID NO: 2069227 - RNA, 14 nt, Staphylococcus aureus subsp. aureus Mu50
agauuccugcaaaa

SEQ ID NO: 2069228 - RNA, 23 nt, Staphylococcus aureus subsp. aureus Mu50
agauuaguagccacaauuuugac

SEQ ID NO: 2069229 - RNA, 12 nt, Staphylococcus aureus subsp. aureus Mu50
agauuagagaag

SEQ ID NO: 2069230 - RNA, 21 nt, Staphylococcus aureus subsp. aureus Mu50
agauuaugaaaacauuauuaa

SEQ ID NO: 2069231 - RNA, 22 nt, Staphylococcus aureus subsp. aureus Mu50
agauuauugguugaaauuaauu

SEQ ID NO: 2069232 - RNA, 17 nt, Staphylococcus aureus subsp. aureus Mu50
agauuauuuaaaacuug

SEQ ID NO: 2069233 - RNA, 23 nt, Staphylococcus aureus subsp. aureus Mu50
agauuauuuaaaacuuguaaauu

SEQ ID NO: 2069234 - RNA, 21 nt, Staphylococcus aureus subsp. aureus Mu50
agauugauauaaauuaucaga

SEQ ID NO: 2069235 - RNA, 15 nt, Staphylococcus aureus subsp. aureus Mu50
agauuggaagggcau

SEQ ID NO: 2069236 - RNA, 20 nt, Staphylococcus aureus subsp. aureus Mu50
agauucggaaaauaugauaa

SEQ ID NO: 2069237 - RNA, 16 nt, Staphylococcus aureus subsp. aureus Mu50
agauugaaaaaauaac

SEQ ID NO: 2069238 - RNA, 16 nt, Staphylococcus aureus subsp. aureus Mu50
agauguucacauucuu

SEQ ID NO: 2069239 - RNA, 15 nt, Staphylococcus aureus subsp. aureus Mu50
agauguuucaaaaua

SEQ ID NO: 2069240 - RNA, 22 nt, Staphylococcus aureus subsp. aureus Mu50
agauguuugcaacauauuuuca

SEQ ID NO: 2069241 - RNA, 17 nt, Staphylococcus aureus subsp. aureus Mu50
agauguauaaaacuaau

SEQ ID NO: 2069242 - RNA, 20 nt, Staphylococcus aureus subsp. aureus Mu50
agauggucuuuuaauuaaaa

SEQ ID NO: 2069243 - RNA, 18 nt, Staphylococcus aureus subsp. aureus Mu50
agaugugaugcuugaaug

SEQ ID NO: 2069244 - RNA, 18 nt, Staphylococcus aureus subsp. aureus Mu50
agaugucgaaaaguauau

SEQ ID NO: 2069245 - RNA, 15 nt, Staphylococcus aureus subsp. aureus Mu50
agauguauaaaacua

SEQ ID NO: 2069246 - RNA, 21 nt, Staphylococcus aureus subsp. aureus Mu50
agaugucacuguuaaagaugu

SEQ ID NO: 2069247 - RNA, 19 nt, Staphylococcus aureus subsp. aureus Mu50
agaugcuugaccuucaguu

SEQ ID NO: 2069248 - RNA, 16 nt, Staphylococcus aureus subsp. aureus Mu50
agaugcggaguucacu

SEQ ID NO: 2069249 - RNA, 18 nt, Staphylococcus aureus subsp. aureus Mu50
agaugcucauugcauuuc

SEQ ID NO: 2069250 - RNA, 14 nt, Staphylococcus aureus subsp. aureus Mu50
agaucauuuucaac

SEQ ID NO: 2069251 - RNA, 18 nt, Staphylococcus aureus subsp. aureus Mu50
agaucauuuucaacauaa

SEQ ID NO: 2069252 - RNA, 22 nt, Staphylococcus aureus subsp. aureus Mu50
agaugaaugccuaauuuuguga

SEQ ID NO: 2069253 - RNA, 13 nt, Staphylococcus aureus subsp. aureus Mu50
agaugaauaaugu

SEQ ID NO: 2069254 - RNA, 21 nt, Staphylococcus aureus subsp. aureus Mu50
agaucuuuguaugcaucaguu

SEQ ID NO: 2069255 - RNA, 15 nt, Staphylococcus aureus subsp. aureus Mu50
agaugaaauauucuu

SEQ ID NO: 2069256 - RNA, 21 nt, Staphylococcus aureus subsp. aureus Mu50
agaugaaauauucuuuaauau

SEQ ID NO: 2069257 - RNA, 17 nt, Staphylococcus aureus subsp. aureus Mu50
agaugagauuucguuag

SEQ ID NO: 2069258 - RNA, 22 nt, Staphylococcus aureus subsp. aureus Mu50
agaugacugaaccaauccaaua

SEQ ID NO: 2069259 - RNA, 16 nt, Staphylococcus aureus subsp. aureus Mu50
agaugauacauucuau

SEQ ID NO: 2069260 - RNA, 19 nt, Staphylococcus aureus subsp. aureus Mu50
agaugauauuuaacaaaau

SEQ ID NO: 2069261 - RNA, 15 nt, Staphylococcus aureus subsp. aureus Mu50
agaugaugcuucgca

SEQ ID NO: 2069262 - RNA, 15 nt, Staphylococcus aureus subsp. aureus Mu50
agaugaugcuucuca

SEQ ID NO: 2069263 - RNA, 21 nt, Staphylococcus aureus subsp. aureus Mu50
agaugaucagggaaaucaucu

SEQ ID NO: 2069264 - RNA, 17 nt, Staphylococcus aureus subsp. aureus Mu50
agaugcauaaaaaccua

SEQ ID NO: 2069265 - RNA, 19 nt, Staphylococcus aureus subsp. aureus Mu50
agaugauugucuagcagag

SEQ ID NO: 2069266 - RNA, 16 nt, Staphylococcus aureus subsp. aureus Mu50
agaugauucuuaucau

SEQ ID NO: 2069267 - RNA, 16 nt, Staphylococcus aureus subsp. aureus Mu50
agaugauugucuagca

SEQ ID NO: 2069268 - RNA, 21 nt, Staphylococcus aureus subsp. aureus Mu50
agaucaauaucacuaucagcu

SEQ ID NO: 2069269 - RNA, 14 nt, Staphylococcus aureus subsp. aureus Mu50
agaucaauaucacu

SEQ ID NO: 2069270 - RNA, 17 nt, Staphylococcus aureus subsp. aureus Mu50
agauauaaacauuuaua

SEQ ID NO: 2069271 - RNA, 15 nt, Staphylococcus aureus subsp. aureus Mu50
agauauauuugaaag

SEQ ID NO: 2069272 - RNA, 13 nt, Staphylococcus aureus subsp. aureus Mu50
agauauagaauuc

SEQ ID NO: 2069273 - RNA, 22 nt, Staphylococcus aureus subsp. aureus Mu50
agauauuauaaaaacagcagug

SEQ ID NO: 2069274 - RNA, 21 nt, Staphylococcus aureus subsp. aureus Mu50
agauauuauugugaaaucuau

SEQ ID NO: 2069275 - RNA, 22 nt, Staphylococcus aureus subsp. aureus Mu50
agauaucuuaaucuaaaaauag

SEQ ID NO: 2069276 - RNA, 16 nt, Staphylococcus aureus subsp. aureus Mu50
agaguuuuuauuauua

SEQ ID NO: 2069277 - RNA, 16 nt, Staphylococcus aureus subsp. aureus Mu50
agauaccaaacugccu

SEQ ID NO: 2069278 - RNA, 15 nt, Staphylococcus aureus subsp. aureus Mu50
agauaggauuuacac

SEQ ID NO: 2069279 - RNA, 20 nt, Staphylococcus aureus subsp. aureus Mu50
agauaggaaacuuaaauauu

SEQ ID NO: 2069280 - RNA, 13 nt, Staphylococcus aureus subsp. aureus Mu50
agauaggauuuac

SEQ ID NO: 2069281 - RNA, 14 nt, Staphylococcus aureus subsp. aureus Mu50
agauagaaauuacc

SEQ ID NO: 2069282 - RNA, 20 nt, Staphylococcus aureus subsp. aureus Mu50
agauacugguuaguaaaauu

SEQ ID NO: 2069283 - RNA, 14 nt, Staphylococcus aureus subsp. aureus Mu50
agauacguuauuuc

SEQ ID NO: 2069284 - RNA, 23 nt, Staphylococcus aureus subsp. aureus Mu50
agagaugggcuaagguuguucua

SEQ ID NO: 2069285 - RNA, 17 nt, Staphylococcus aureus subsp. aureus Mu50
agacuaaaaugaaugaa

SEQ ID NO: 2069286 - RNA, 17 nt, Staphylococcus aureus subsp. aureus Mu50
agacuaauuaucuucau

SEQ ID NO: 2069287 - RNA, 22 nt, Staphylococcus aureus subsp. aureus Mu50
agaaaaucguuauaaguacaaa

SEQ ID NO: 2069288 - RNA, 21 nt, Staphylococcus aureus subsp. aureus Mu50
agaaaauaugacgaucuucau

SEQ ID NO: 2069289 - RNA, 17 nt, Staphylococcus aureus subsp. aureus Mu50
agaaaaauucaucaaua

SEQ ID NO: 2069290 - RNA, 16 nt, Staphylococcus aureus subsp. aureus Mu50
agaaagcuaauaucaa

SEQ ID NO: 2069291 - RNA, 18 nt, Staphylococcus aureus subsp. aureus Mu50
agaaagcuaauaucaaua

SEQ ID NO: 2069292 - RNA, 23 nt, Staphylococcus aureus subsp. aureus Mu50
agaaacuauagauaggauauuuu

SEQ ID NO: 2069293 - RNA, 14 nt, Staphylococcus aureus subsp. aureus Mu50
acuuuuuucauuuc

SEQ ID NO: 2069294 - RNA, 16 nt, Staphylococcus aureus subsp. aureus Mu50
acuuuuuucauuucuu

SEQ ID NO: 2069295 - RNA, 14 nt, Staphylococcus aureus subsp. aureus Mu50
acuuuuuuguucaa

SEQ ID NO: 2069296 - RNA, 19 nt, Staphylococcus aureus subsp. aureus Mu50
acuuuuuuguucaaucacu

SEQ ID NO: 2069297 - RNA, 18 nt, Staphylococcus aureus subsp. aureus Mu50
acuuuuuuuaauuugauu

SEQ ID NO: 2069298 - RNA, 23 nt, Staphylococcus aureus subsp. aureus Mu50
acuuuuuuuaaaucuucuauuuu

SEQ ID NO: 2069299 - RNA, 14 nt, Staphylococcus aureus subsp. aureus Mu50
agaaaaagugauaa

SEQ ID NO: 2069300 - RNA, 17 nt, Staphylococcus aureus subsp. aureus Mu50
agaaaaaguuauaucau

SEQ ID NO: 2069301 - RNA, 14 nt, Staphylococcus aureus subsp. aureus Mu50
agaaaaauaugauu

SEQ ID NO: 2069302 - RNA, 18 nt, Staphylococcus aureus subsp. aureus Mu50
agaaaaaguuuuucugac

SEQ ID NO: 2069303 - RNA, 12 nt, Staphylococcus aureus subsp. aureus Mu50
agaaaaaguauu

SEQ ID NO: 2069304 - RNA, 13 nt, Staphylococcus aureus subsp. aureus Mu50
acuuuuuguuaau

SEQ ID NO: 2069305 - RNA, 16 nt, Staphylococcus aureus subsp. aureus Mu50
acuuuuugaguaucca

SEQ ID NO: 2069306 - RNA, 18 nt, Staphylococcus aureus subsp. aureus Mu50
acuuuuucagaaugaacu

SEQ ID NO: 2069307 - RNA, 15 nt, Staphylococcus aureus subsp. aureus Mu50
acuuuuucaacugua

SEQ ID NO: 2069308 - RNA, 15 nt, Staphylococcus aureus subsp. aureus Mu50
acuuuuguuaaaaaa

SEQ ID NO: 2069309 - RNA, 23 nt, Staphylococcus aureus subsp. aureus Mu50
acuuuuuaaacguacauuuuuau

SEQ ID NO: 2069310 - RNA, 12 nt, Staphylococcus aureus subsp. aureus Mu50
acuuuuuaaagg

SEQ ID NO: 2069311 - RNA, 14 nt, Staphylococcus aureus subsp. aureus Mu50
acuuuuuaaaggac

SEQ ID NO: 2069312 - RNA, 12 nt, Staphylococcus aureus subsp. aureus Mu50
acuuuucuuauc

SEQ ID NO: 2069313 - RNA, 23 nt, Staphylococcus aureus subsp. aureus Mu50
acuuuucucgauuaauuuucuuu

SEQ ID NO: 2069314 - RNA, 16 nt, Staphylococcus aureus subsp. aureus Mu50
acuuuugauuuugaau

SEQ ID NO: 2069315 - RNA, 11 nt, Staphylococcus aureus subsp. aureus Mu50
acuuuugauuu

SEQ ID NO: 2069316 - RNA, 13 nt, Staphylococcus aureus subsp. aureus Mu50
acuuccuuuuuau

SEQ ID NO: 2069317 - RNA, 23 nt, Staphylococcus aureus subsp. aureus Mu50
agaacuaagaugugcaucccgaa

SEQ ID NO: 2069318 - RNA, 14 nt, Staphylococcus aureus subsp. aureus Mu50
agaacuaauguaaa

SEQ ID NO: 2069319 - RNA, 22 nt, Staphylococcus aureus subsp. aureus Mu50
agaacuacgcauuuuaaauaaa

SEQ ID NO: 2069320 - RNA, 21 nt, Staphylococcus aureus subsp. aureus Mu50
agaacuauuuuaaauuacaac

SEQ ID NO: 2069321 - RNA, 19 nt, Staphylococcus aureus subsp. aureus Mu50
agaacuaucgauacuaaac

SEQ ID NO: 2069322 - RNA, 13 nt, Staphylococcus aureus subsp. aureus Mu50
agaacuaugaaua

SEQ ID NO: 2069323 - RNA, 19 nt, Staphylococcus aureus subsp. aureus Mu50
agaaccguuuuucaucaau

SEQ ID NO: 2069324 - RNA, 23 nt, Staphylococcus aureus subsp. aureus Mu50
agaaccuauauuaagcauuuguc

SEQ ID NO: 2069325 - RNA, 21 nt, Staphylococcus aureus subsp. aureus Mu50
agaaccuugaaugauauuaac

SEQ ID NO: 2069326 - RNA, 18 nt, Staphylococcus aureus subsp. aureus Mu50
agaaccuuuaaaaguaac

SEQ ID NO: 2069327 - RNA, 13 nt, Staphylococcus aureus subsp. aureus Mu50
agaaccuuucuug

SEQ ID NO: 2069328 - RNA, 14 nt, Staphylococcus aureus subsp. aureus Mu50
agaacgagaauuuc

SEQ ID NO: 2069329 - RNA, 17 nt, Staphylococcus aureus subsp. aureus Mu50
agaacgcuuuauuacuu

SEQ ID NO: 2069330 - RNA, 16 nt, Staphylococcus aureus subsp. aureus Mu50
agaaagugaaggagau

SEQ ID NO: 2069331 - RNA, 16 nt, Staphylococcus aureus subsp. aureus Mu50
agaaauugaauucucg

SEQ ID NO: 2069332 - RNA, 14 nt, Staphylococcus aureus subsp. aureus Mu50
agaaauuuuaaaau

SEQ ID NO: 2069333 - RNA, 21 nt, Staphylococcus aureus subsp. aureus Mu50
agaaauuuaauauuguuaauu

SEQ ID NO: 2069334 - RNA, 12 nt, Staphylococcus aureus subsp. aureus Mu50
agaaauuuuuca

SEQ ID NO: 2069335 - RNA, 15 nt, Staphylococcus aureus subsp. aureus Mu50
agaaauuuuucacuu

SEQ ID NO: 2069336 - RNA, 17 nt, Staphylococcus aureus subsp. aureus Mu50
agaacaaucaauacaga

SEQ ID NO: 2069337 - RNA, 16 nt, Staphylococcus aureus subsp. aureus Mu50
agaaccaaaauuauau

SEQ ID NO: 2069338 - RNA, 18 nt, Staphylococcus aureus subsp. aureus Mu50
agaaccacgcaucaugua

SEQ ID NO: 2069339 - RNA, 17 nt, Staphylococcus aureus subsp. aureus Mu50
agaacagcacauuuuua

SEQ ID NO: 2069340 - RNA, 15 nt, Staphylococcus aureus subsp. aureus Mu50
agaacauaaaaaaac

SEQ ID NO: 2069341 - RNA, 14 nt, Staphylococcus aureus subsp. aureus Mu50
agacacuuaacuug

SEQ ID NO: 2069342 - RNA, 17 nt, Staphylococcus aureus subsp. aureus Mu50
agacauaaccuugcuuu

SEQ ID NO: 2069343 - RNA, 17 nt, Staphylococcus aureus subsp. aureus Mu50
agacauaaauauggauu

SEQ ID NO: 2069344 - RNA, 22 nt, Staphylococcus aureus subsp. aureus Mu50
agacauauagcggugucaauau

SEQ ID NO: 2069345 - RNA, 18 nt, Staphylococcus aureus subsp. aureus Mu50
agacauacucacaaaaaa

SEQ ID NO: 2069346 - RNA, 16 nt, Staphylococcus aureus subsp. aureus Mu50
agaauuucgaaaagaa

SEQ ID NO: 2069347 - RNA, 21 nt, Staphylococcus aureus subsp. aureus Mu50
agaauugcaacgcaucacaaa

SEQ ID NO: 2069348 - RNA, 15 nt, Staphylococcus aureus subsp. aureus Mu50
agaauuuaaaagaga

SEQ ID NO: 2069349 - RNA, 17 nt, Staphylococcus aureus subsp. aureus Mu50
agaauuuaaaagagaau

SEQ ID NO: 2069350 - RNA, 17 nt, Staphylococcus aureus subsp. aureus Mu50
agacacggccugcaagu

SEQ ID NO: 2069351 - RNA, 20 nt, Staphylococcus aureus subsp. aureus Mu50
agacaauaaugcacgcgugc

SEQ ID NO: 2069352 - RNA, 15 nt, Staphylococcus aureus subsp. aureus Mu50
agacaauauuuuuac

SEQ ID NO: 2069353 - RNA, 12 nt, Staphylococcus aureus subsp. aureus Mu50
agacaauauuuu

SEQ ID NO: 2069354 - RNA, 14 nt, Staphylococcus aureus subsp. aureus Mu50
agacguuuuccaug

SEQ ID NO: 2069355 - RNA, 17 nt, Staphylococcus aureus subsp. aureus Mu50
agacguuuuugaaucag

SEQ ID NO: 2069356 - RNA, 19 nt, Staphylococcus aureus subsp. aureus Mu50
agaccauuuuauauuuuag

SEQ ID NO: 2069357 - RNA, 22 nt, Staphylococcus aureus subsp. aureus Mu50
agacccaccguuaaaauauaug

SEQ ID NO: 2069358 - RNA, 18 nt, Staphylococcus aureus subsp. aureus Mu50
agaaucaaccguuuuauu

SEQ ID NO: 2069359 - RNA, 14 nt, Staphylococcus aureus subsp. aureus Mu50
agaaucaauuauug

SEQ ID NO: 2069360 - RNA, 20 nt, Staphylococcus aureus subsp. aureus Mu50
agaaucgaaccaaauuuuau

SEQ ID NO: 2069361 - RNA, 16 nt, Staphylococcus aureus subsp. aureus Mu50
agaauauucagauuuu

SEQ ID NO: 2069362 - RNA, 19 nt, Staphylococcus aureus subsp. aureus Mu50
agaauauucagauuuucga

SEQ ID NO: 2069363 - RNA, 11 nt, Staphylococcus aureus subsp. aureus Mu50
agaauauuaac

SEQ ID NO: 2069364 - RNA, 16 nt, Staphylococcus aureus subsp. aureus Mu50
agaauacuaaaagugu

SEQ ID NO: 2069365 - RNA, 17 nt, Staphylococcus aureus subsp. aureus Mu50
agaauguacaauuuuuu

SEQ ID NO: 2069366 - RNA, 17 nt, Staphylococcus aureus subsp. aureus Mu50
agaauuauuuuggacug

SEQ ID NO: 2069367 - RNA, 14 nt, Staphylococcus aureus subsp. aureus Mu50
agaauuauuuagaa

SEQ ID NO: 2069368 - RNA, 19 nt, Staphylococcus aureus subsp. aureus Mu50
agaauucacgcaauaucau

SEQ ID NO: 2069369 - RNA, 17 nt, Staphylococcus aureus subsp. aureus Mu50
agaauucagcugaugcu

SEQ ID NO: 2069370 - RNA, 16 nt, Staphylococcus aureus subsp. aureus Mu50
agaaugaauaauucca

SEQ ID NO: 2069371 - RNA, 23 nt, Staphylococcus aureus subsp. aureus Mu50
agaaucuuggaaguaucugugaa

SEQ ID NO: 2069372 - RNA, 14 nt, Staphylococcus aureus subsp. aureus Mu50
agaaucuccauuua

SEQ ID NO: 2069373 - RNA, 15 nt, Staphylococcus aureus subsp. aureus Mu50
agaagcuuucuggaa

SEQ ID NO: 2069374 - RNA, 13 nt, Staphylococcus aureus subsp. aureus Mu50
agaaguauuauga

SEQ ID NO: 2069375 - RNA, 16 nt, Staphylococcus aureus subsp. aureus Mu50
agaagaaacuuaauca

SEQ ID NO: 2069376 - RNA, 18 nt, Staphylococcus aureus subsp. aureus Mu50
agaagaauucucuauuca

SEQ ID NO: 2069377 - RNA, 20 nt, Staphylococcus aureus subsp. aureus Mu50
acagguaaauuuaaaauaau

SEQ ID NO: 2069378 - RNA, 23 nt, Staphylococcus aureus subsp. aureus Mu50
acaguaguuaauugaaugaaaau

SEQ ID NO: 2069379 - RNA, 20 nt, Staphylococcus aureus subsp. aureus Mu50
acaguaguuaauugaaugaa

SEQ ID NO: 2069380 - RNA, 17 nt, Staphylococcus aureus subsp. aureus Mu50
acaguacaaauaacaaa

SEQ ID NO: 2069381 - RNA, 15 nt, Staphylococcus aureus subsp. aureus Mu50
acagugaaucuaaac

SEQ ID NO: 2069382 - RNA, 18 nt, Staphylococcus aureus subsp. aureus Mu50
acagucauaaauugauuu

SEQ ID NO: 2069383 - RNA, 15 nt, Staphylococcus aureus subsp. aureus Mu50
acagucaacugcugc

SEQ ID NO: 2069384 - RNA, 23 nt, Staphylococcus aureus subsp. aureus Mu50
acagucaacugcugcuaaaauaa

SEQ ID NO: 2069385 - RNA, 17 nt, Staphylococcus aureus subsp. aureus Mu50
acagugacugauucacc

SEQ ID NO: 2069386 - RNA, 17 nt, Staphylococcus aureus subsp. aureus Mu50
acaguggauuacagaug

SEQ ID NO: 2069387 - RNA, 15 nt, Staphylococcus aureus subsp. aureus Mu50
acaguuacuucaguu

SEQ ID NO: 2069388 - RNA, 22 nt, Staphylococcus aureus subsp. aureus Mu50
acaguuacuuucgcuugcaaag

SEQ ID NO: 2069389 - RNA, 23 nt, Staphylococcus aureus subsp. aureus Mu50
acaguuacuuucgcuugcaaaga

SEQ ID NO: 2069390 - RNA, 20 nt, Staphylococcus aureus subsp. aureus Mu50
acaguucuauagguuuauaa

SEQ ID NO: 2069391 - RNA, 22 nt, Staphylococcus aureus subsp. aureus Mu50
acaguucuauagguuuauaaaa

SEQ ID NO: 2069392 - RNA, 12 nt, Staphylococcus aureus subsp. aureus Mu50
acauaaaauuua

SEQ ID NO: 2069393 - RNA, 13 nt, Staphylococcus aureus subsp. aureus Mu50
acauaaaauuuaa

SEQ ID NO: 2069394 - RNA, 14 nt, Staphylococcus aureus subsp. aureus Mu50
acauaaaauuuaaa

SEQ ID NO: 2069395 - RNA, 22 nt, Staphylococcus aureus subsp. aureus Mu50
acauaaucauuguguauuguuu

SEQ ID NO: 2069396 - RNA, 17 nt, Staphylococcus aureus subsp. aureus Mu50
acauaacagcuaaaaau

SEQ ID NO: 2069397 - RNA, 15 nt, Staphylococcus aureus subsp. aureus Mu50
acauaacacaaguua

SEQ ID NO: 2069398 - RNA, 12 nt, Staphylococcus aureus subsp. aureus Mu50
acauaaaucaau

SEQ ID NO: 2069399 - RNA, 18 nt, Staphylococcus aureus subsp. aureus Mu50
acaucuacaucaaauuuu

SEQ ID NO: 2069400 - RNA, 14 nt, Staphylococcus aureus subsp. aureus Mu50
acaucuauuucuug

SEQ ID NO: 2069401 - RNA, 15 nt, Staphylococcus aureus subsp. aureus Mu50
acaucgccaauuuga

SEQ ID NO: 2069402 - RNA, 22 nt, Staphylococcus aureus subsp. aureus Mu50
acaucgccaauuugauuaguaa

SEQ ID NO: 2069403 - RNA, 14 nt, Staphylococcus aureus subsp. aureus Mu50
acaucugaaaaaau

SEQ ID NO: 2069404 - RNA, 13 nt, Staphylococcus aureus subsp. aureus Mu50
acaucugaaaaaa

SEQ ID NO: 2069405 - RNA, 16 nt, Staphylococcus aureus subsp. aureus Mu50
acaugaauuuuaauau

SEQ ID NO: 2069406 - RNA, 19 nt, Staphylococcus aureus subsp. aureus Mu50
acaugaauuuuaauauauu

SEQ ID NO: 2069407 - RNA, 12 nt, Staphylococcus aureus subsp. aureus Mu50
acaugauaauuu

SEQ ID NO: 2069408 - RNA, 15 nt, Staphylococcus aureus subsp. aureus Mu50
acaugauaauuuuua

SEQ ID NO: 2069409 - RNA, 22 nt, Staphylococcus aureus subsp. aureus Mu50
acaugagauuauuuuuuuaaau

SEQ ID NO: 2069410 - RNA, 16 nt, Staphylococcus aureus subsp. aureus Mu50
acaugauaauuuuuag

SEQ ID NO: 2069411 - RNA, 14 nt, Staphylococcus aureus subsp. aureus Mu50
acaucauuguuuua

SEQ ID NO: 2069412 - RNA, 19 nt, Staphylococcus aureus subsp. aureus Mu50
acaucgcauaauaucuuac

SEQ ID NO: 2069413 - RNA, 13 nt, Staphylococcus aureus subsp. aureus Mu50
acaucauuaaaua

SEQ ID NO: 2069414 - RNA, 15 nt, Staphylococcus aureus subsp. aureus Mu50
acaucauuaaauauu

SEQ ID NO: 2069415 - RNA, 14 nt, Staphylococcus aureus subsp. aureus Mu50
acaucaaauuuuuc

SEQ ID NO: 2069416 - RNA, 22 nt, Staphylococcus aureus subsp. aureus Mu50
acaucaaauagacaccaaaaaa

SEQ ID NO: 2069417 - RNA, 15 nt, Staphylococcus aureus subsp. aureus Mu50
acauauuuucacaau

SEQ ID NO: 2069418 - RNA, 17 nt, Staphylococcus aureus subsp. aureus Mu50
acauauuuuaacuauga

SEQ ID NO: 2069419 - RNA, 13 nt, Staphylococcus aureus subsp. aureus Mu50
acauauuggcuug

SEQ ID NO: 2069420 - RNA, 19 nt, Staphylococcus aureus subsp. aureus Mu50
acauauuuauacugaucaa

SEQ ID NO: 2069421 - RNA, 14 nt, Staphylococcus aureus subsp. aureus Mu50
acauauucauaaua

SEQ ID NO: 2069422 - RNA, 15 nt, Staphylococcus aureus subsp. aureus Mu50
acauacauuuugaaa

SEQ ID NO: 2069423 - RNA, 14 nt, Staphylococcus aureus subsp. aureus Mu50
acauacauuuugaa

SEQ ID NO: 2069424 - RNA, 18 nt, Staphylococcus aureus subsp. aureus Mu50
acauaauuuaucaauuuc

SEQ ID NO: 2069425 - RNA, 20 nt, Staphylococcus aureus subsp. aureus Mu50
acauaauuaacuuucuuuug

SEQ ID NO: 2069426 - RNA, 16 nt, Staphylococcus aureus subsp. aureus Mu50
acauaauuuaucaauu

SEQ ID NO: 2069427 - RNA, 16 nt, Staphylococcus aureus subsp. aureus Mu50
acacuuuaguauuaua

SEQ ID NO: 2069428 - RNA, 16 nt, Staphylococcus aureus subsp. aureus Mu50
acacuugauaaaacua

SEQ ID NO: 2069429 - RNA, 22 nt, Staphylococcus aureus subsp. aureus Mu50
acacuucaacauauaaaucauu

SEQ ID NO: 2069430 - RNA, 22 nt, Staphylococcus aureus subsp. aureus Mu50
acacuguuuuauaaaugaauua

SEQ ID NO: 2069431 - RNA, 22 nt, Staphylococcus aureus subsp. aureus Mu50
acagagaaauucgaaaagaaau

SEQ ID NO: 2069432 - RNA, 23 nt, Staphylococcus aureus subsp. aureus Mu50
acagagaaauucgaaaagaaauu

SEQ ID NO: 2069433 - RNA, 22 nt, Staphylococcus aureus subsp. aureus Mu50
acagagaaucaauuauugaaaa

SEQ ID NO: 2069434 - RNA, 18 nt, Staphylococcus aureus subsp. aureus Mu50
acagaauuucaucaaauc

SEQ ID NO: 2069435 - RNA, 19 nt, Staphylococcus aureus subsp. aureus Mu50
acacugugaaguauugcca

SEQ ID NO: 2069436 - RNA, 15 nt, Staphylococcus aureus subsp. aureus Mu50
acacugcacaucaua

SEQ ID NO: 2069437 - RNA, 17 nt, Staphylococcus aureus subsp. aureus Mu50
acacugagaauuucuaa

SEQ ID NO: 2069438 - RNA, 14 nt, Staphylococcus aureus subsp. aureus Mu50
aauuucaguaccau

SEQ ID NO: 2069439 - RNA, 23 nt, Staphylococcus aureus subsp. aureus Mu50
aauuucaguaucauguucuuaua

SEQ ID NO: 2069440 - RNA, 20 nt, Staphylococcus aureus subsp. aureus Mu50
aauuucauaaaguuuauuua

SEQ ID NO: 2069441 - RNA, 19 nt, Staphylococcus aureus subsp. aureus Mu50
aauuucauaguuaucgauu

SEQ ID NO: 2069442 - RNA, 17 nt, Staphylococcus aureus subsp. aureus Mu50
acagcacgagacaauaa

SEQ ID NO: 2069443 - RNA, 23 nt, Staphylococcus aureus subsp. aureus Mu50
acagagaauuucgaaaagaaauu

SEQ ID NO: 2069444 - RNA, 23 nt, Staphylococcus aureus subsp. aureus Mu50
acagauuuaccucuugauaaaau

SEQ ID NO: 2069445 - RNA, 22 nt, Staphylococcus aureus subsp. aureus Mu50
acagcacauuuuuaguuagaaa

SEQ ID NO: 2069446 - RNA, 16 nt, Staphylococcus aureus subsp. aureus Mu50
acagauuuuaaaaauu

SEQ ID NO: 2069447 - RNA, 19 nt, Staphylococcus aureus subsp. aureus Mu50
acagauuuuaaaaauucau

SEQ ID NO: 2069448 - RNA, 14 nt, Staphylococcus aureus subsp. aureus Mu50
acagcuuuuucuac

SEQ ID NO: 2069449 - RNA, 15 nt, Staphylococcus aureus subsp. aureus Mu50
acagcuacaaauaau

SEQ ID NO: 2069450 - RNA, 13 nt, Staphylococcus aureus subsp. aureus Mu50
acagcuucaaaau

SEQ ID NO: 2069451 - RNA, 16 nt, Staphylococcus aureus subsp. aureus Mu50
accaucauucauaugg

SEQ ID NO: 2069452 - RNA, 14 nt, Staphylococcus aureus subsp. aureus Mu50
accaucaugacagc

SEQ ID NO: 2069453 - RNA, 22 nt, Staphylococcus aureus subsp. aureus Mu50
accauucaucgucucacuuaau

SEQ ID NO: 2069454 - RNA, 14 nt, Staphylococcus aureus subsp. aureus Mu50
accauuccaaaaau

SEQ ID NO: 2069455 - RNA, 14 nt, Staphylococcus aureus subsp. aureus Mu50
accauugaaugaau

SEQ ID NO: 2069456 - RNA, 20 nt, Staphylococcus aureus subsp. aureus Mu50
accauucuaccaguugauuu

SEQ ID NO: 2069457 - RNA, 22 nt, Staphylococcus aureus subsp. aureus Mu50
accauucgaaagccaauuaaua

SEQ ID NO: 2069458 - RNA, 21 nt, Staphylococcus aureus subsp. aureus Mu50
acccacauuaaauauuauuuu

SEQ ID NO: 2069459 - RNA, 19 nt, Staphylococcus aureus subsp. aureus Mu50
accauugugaugauaauua

SEQ ID NO: 2069460 - RNA, 21 nt, Staphylococcus aureus subsp. aureus Mu50
accauugugaauaauuucagu

SEQ ID NO: 2069461 - RNA, 14 nt, Staphylococcus aureus subsp. aureus Mu50
accauuuaaaaauu

SEQ ID NO: 2069462 - RNA, 20 nt, Staphylococcus aureus subsp. aureus Mu50
acccaaguccggcugaaggg

SEQ ID NO: 2069463 - RNA, 13 nt, Staphylococcus aureus subsp. aureus Mu50
acccaaucuuguu

SEQ ID NO: 2069464 - RNA, 18 nt, Staphylococcus aureus subsp. aureus Mu50
accauaacuuuauauaua

SEQ ID NO: 2069465 - RNA, 17 nt, Staphylococcus aureus subsp. aureus Mu50
accauagauuauauuau

SEQ ID NO: 2069466 - RNA, 23 nt, Staphylococcus aureus subsp. aureus Mu50
accauagauuauauuaucauuga

SEQ ID NO: 2069467 - RNA, 15 nt, Staphylococcus aureus subsp. aureus Mu50
accauacucuaacuu

SEQ ID NO: 2069468 - RNA, 16 nt, Staphylococcus aureus subsp. aureus Mu50
accauaguaauaaaau

SEQ ID NO: 2069469 - RNA, 22 nt, Staphylococcus aureus subsp. aureus Mu50
accaguauaaccauguauaucu

SEQ ID NO: 2069470 - RNA, 18 nt, Staphylococcus aureus subsp. aureus Mu50
accaguggaaauuaugua

SEQ ID NO: 2069471 - RNA, 21 nt, Staphylococcus aureus subsp. aureus Mu50
accaguucgaaaauuauacaa

SEQ ID NO: 2069472 - RNA, 23 nt, Staphylococcus aureus subsp. aureus Mu50
accaguuugaucauaauucagug

SEQ ID NO: 2069473 - RNA, 15 nt, Staphylococcus aureus subsp. aureus Mu50
accaccccaacuugc

SEQ ID NO: 2069474 - RNA, 14 nt, Staphylococcus aureus subsp. aureus Mu50
accaccacuuucag

SEQ ID NO: 2069475 - RNA, 20 nt, Staphylococcus aureus subsp. aureus Mu50
accacucaauucucuaacuu

SEQ ID NO: 2069476 - RNA, 19 nt, Staphylococcus aureus subsp. aureus Mu50
accacgauaucuagcugcu

SEQ ID NO: 2069477 - RNA, 19 nt, Staphylococcus aureus subsp. aureus Mu50
accacuggccuuuaaugau

SEQ ID NO: 2069478 - RNA, 20 nt, Staphylococcus aureus subsp. aureus Mu50
accagccucuguguuggggc

SEQ ID NO: 2069479 - RNA, 20 nt, Staphylococcus aureus subsp. aureus Mu50
accaaccaaaaccaaaugaa

SEQ ID NO: 2069480 - RNA, 19 nt, Staphylococcus aureus subsp. aureus Mu50
accaaccaaaaccaaauga

SEQ ID NO: 2069481 - RNA, 14 nt, Staphylococcus aureus subsp. aureus Mu50
accaaguucacuaa

SEQ ID NO: 2069482 - RNA, 24 nt, Staphylococcus aureus subsp. aureus Mu50
accaagugcuuuuuuaccagcaug

SEQ ID NO: 2069483 - RNA, 15 nt, Staphylococcus aureus subsp. aureus Mu50
accaaggguuucugg

SEQ ID NO: 2069484 - RNA, 12 nt, Staphylococcus aureus subsp. aureus Mu50
accaacuuuuuu

SEQ ID NO: 2069485 - RNA, 21 nt, Staphylococcus aureus subsp. aureus Mu50
accaacugucgguucaucuaa

SEQ ID NO: 2069486 - RNA, 22 nt, Staphylococcus aureus subsp. aureus Mu50
accaacugucgguucaucuaaa

SEQ ID NO: 2069487 - RNA, 12 nt, Staphylococcus aureus subsp. aureus Mu50
accaauuuuuag

SEQ ID NO: 2069488 - RNA, 16 nt, Staphylococcus aureus subsp. aureus Mu50
accaauugaaauuaac

SEQ ID NO: 2069489 - RNA, 15 nt, Staphylococcus aureus subsp. aureus Mu50
accaauugaaauuaa

SEQ ID NO: 2069490 - RNA, 15 nt, Staphylococcus aureus subsp. aureus Mu50
accaauuagcaugac

SEQ ID NO: 2069491 - RNA, 17 nt, Staphylococcus aureus subsp. aureus Mu50
accaaucaauaguuuau

SEQ ID NO: 2069492 - RNA, 13 nt, Staphylococcus aureus subsp. aureus Mu50
acauguacauuau

SEQ ID NO: 2069493 - RNA, 20 nt, Staphylococcus aureus subsp. aureus Mu50
acauguacguuuuuuuaaau

SEQ ID NO: 2069494 - RNA, 23 nt, Staphylococcus aureus subsp. aureus Mu50
acauggcuuagguuuaauuuuaa

SEQ ID NO: 2069495 - RNA, 20 nt, Staphylococcus aureus subsp. aureus Mu50
acauguuacugaugaacaua

SEQ ID NO: 2069496 - RNA, 14 nt, Staphylococcus aureus subsp. aureus Mu50
acauuuaagaaacg

SEQ ID NO: 2069497 - RNA, 20 nt, Staphylococcus aureus subsp. aureus Mu50
acauguauuggccaaacaac

SEQ ID NO: 2069498 - RNA, 18 nt, Staphylococcus aureus subsp. aureus Mu50
acauuuacuuaagaacua

SEQ ID NO: 2069499 - RNA, 13 nt, Staphylococcus aureus subsp. aureus Mu50
acauuuaaauaua

SEQ ID NO: 2069500 - RNA, 17 nt, Staphylococcus aureus subsp. aureus Mu50
acauuuauucuuucucu

SEQ ID NO: 2069501 - RNA, 14 nt, Staphylococcus aureus subsp. aureus Mu50
acauuuauuuucaa

SEQ ID NO: 2069502 - RNA, 12 nt, Staphylococcus aureus subsp. aureus Mu50
acauuucccauu

SEQ ID NO: 2069503 - RNA, 22 nt, Staphylococcus aureus subsp. aureus Mu50
acauuuuuuauagcaaauugau

SEQ ID NO: 2069504 - RNA, 22 nt, Staphylococcus aureus subsp. aureus Mu50
accaaauaaauaagugauaaau

SEQ ID NO: 2069505 - RNA, 17 nt, Staphylococcus aureus subsp. aureus Mu50
accaaagaaaucaccag

SEQ ID NO: 2069506 - RNA, 17 nt, Staphylococcus aureus subsp. aureus Mu50
acgauauaacauuaaaa

SEQ ID NO: 2069507 - RNA, 18 nt, Staphylococcus aureus subsp. aureus Mu50
acgauaagaauuaacaac

SEQ ID NO: 2069508 - RNA, 23 nt, Staphylococcus aureus subsp. aureus Mu50
acgauaauaacuagaacaagaau

SEQ ID NO: 2069509 - RNA, 16 nt, Staphylococcus aureus subsp. aureus Mu50
acgauaagaauuaaca

SEQ ID NO: 2069510 - RNA, 15 nt, Staphylococcus aureus subsp. aureus Mu50
acgauauucuacaug

SEQ ID NO: 2069511 - RNA, 20 nt, Staphylococcus aureus subsp. aureus Mu50
acgaucaguugagucaauuu

SEQ ID NO: 2069512 - RNA, 17 nt, Staphylococcus aureus subsp. aureus Mu50
acgaucauaaauauuuu

SEQ ID NO: 2069513 - RNA, 16 nt, Staphylococcus aureus subsp. aureus Mu50
acgagcuggugagaaa

SEQ ID NO: 2069514 - RNA, 19 nt, Staphylococcus aureus subsp. aureus Mu50
acgagcuugggacagaaaa

SEQ ID NO: 2069515 - RNA, 20 nt, Staphylococcus aureus subsp. aureus Mu50
acgagucauaaauauaaaau

SEQ ID NO: 2069516 - RNA, 20 nt, Staphylococcus aureus subsp. aureus Mu50
acgauaacaauuuauuaaaa

SEQ ID NO: 2069517 - RNA, 23 nt, Staphylococcus aureus subsp. aureus Mu50
acgauaacagcuacaaauaauga

SEQ ID NO: 2069518 - RNA, 19 nt, Staphylococcus aureus subsp. aureus Mu50
acgauaacaauuuauuaaa

SEQ ID NO: 2069519 - RNA, 20 nt, Staphylococcus aureus subsp. aureus Mu50
acgauaaauagugauugcuu

SEQ ID NO: 2069520 - RNA, 13 nt, Staphylococcus aureus subsp. aureus Mu50
acgaugguugcuu

SEQ ID NO: 2069521 - RNA, 20 nt, Staphylococcus aureus subsp. aureus Mu50
acgaugagcgcauaaauuuu

SEQ ID NO: 2069522 - RNA, 17 nt, Staphylococcus aureus subsp. aureus Mu50
acgaugaaacucuguuu

SEQ ID NO: 2069523 - RNA, 17 nt, Staphylococcus aureus subsp. aureus Mu50
acgcaaaacaauaugaa

SEQ ID NO: 2069524 - RNA, 23 nt, Staphylococcus aureus subsp. aureus Mu50
acgauuuguucaaugauuuuaua

SEQ ID NO: 2069525 - RNA, 22 nt, Staphylococcus aureus subsp. aureus Mu50
acgauuacgcucauaugucugu

SEQ ID NO: 2069526 - RNA, 18 nt, Staphylococcus aureus subsp. aureus Mu50
acgauuuaauuaaaacau

SEQ ID NO: 2069527 - RNA, 18 nt, Staphylococcus aureus subsp. aureus Mu50
acgauugaguugaaaaua

SEQ ID NO: 2069528 - RNA, 23 nt, Staphylococcus aureus subsp. aureus Mu50
acgaaucacaguuauauauuccu

SEQ ID NO: 2069529 - RNA, 14 nt, Staphylococcus aureus subsp. aureus Mu50
acgacacuuuuuag

SEQ ID NO: 2069530 - RNA, 22 nt, Staphylococcus aureus subsp. aureus Mu50
acgacaacuugaacuaaaacga

SEQ ID NO: 2069531 - RNA, 22 nt, Staphylococcus aureus subsp. aureus Mu50
acgacaaucacagcaauaauaa

SEQ ID NO: 2069532 - RNA, 23 nt, Staphylococcus aureus subsp. aureus Mu50
acgaacaucuaauacauuauguu

SEQ ID NO: 2069533 - RNA, 19 nt, Staphylococcus aureus subsp. aureus Mu50
acgagcaacaucuuuuguu

SEQ ID NO: 2069534 - RNA, 15 nt, Staphylococcus aureus subsp. aureus Mu50
acgacgcuaaacaaa

SEQ ID NO: 2069535 - RNA, 18 nt, Staphylococcus aureus subsp. aureus Mu50
acgacguccagcuaauaa

SEQ ID NO: 2069536 - RNA, 14 nt, Staphylococcus aureus subsp. aureus Mu50
acgacauuguuuag

SEQ ID NO: 2069537 - RNA, 13 nt, Staphylococcus aureus subsp. aureus Mu50
acgacauuuuuag

SEQ ID NO: 2069538 - RNA, 22 nt, Staphylococcus aureus subsp. aureus Mu50
acgacauuuuuagacauuaaaa

SEQ ID NO: 2069539 - RNA, 22 nt, Staphylococcus aureus subsp. aureus Mu50
acgaccagucgcauauuuugau

SEQ ID NO: 2069540 - RNA, 20 nt, Staphylococcus aureus subsp. aureus Mu50
acgaaauggugaacuaaauu

SEQ ID NO: 2069541 - RNA, 13 nt, Staphylococcus aureus subsp. aureus Mu50
acgaaaugcaaug

SEQ ID NO: 2069542 - RNA, 23 nt, Staphylococcus aureus subsp. aureus Mu50
acgaacaagucuugcaauaccuc

SEQ ID NO: 2069543 - RNA, 12 nt, Staphylococcus aureus subsp. aureus Mu50
accuuuuuuaag

SEQ ID NO: 2069544 - RNA, 20 nt, Staphylococcus aureus subsp. aureus Mu50
acgaaaaagaugguuuuguu

SEQ ID NO: 2069545 - RNA, 18 nt, Staphylococcus aureus subsp. aureus Mu50
acgaaaagucagcuuaca

SEQ ID NO: 2069546 - RNA, 14 nt, Staphylococcus aureus subsp. aureus Mu50
accuuuaaaacauc

SEQ ID NO: 2069547 - RNA, 19 nt, Staphylococcus aureus subsp. aureus Mu50
accuuuaaaacaucauuca

SEQ ID NO: 2069548 - RNA, 15 nt, Staphylococcus aureus subsp. aureus Mu50
accuuuaaaacauca

SEQ ID NO: 2069549 - RNA, 13 nt, Staphylococcus aureus subsp. aureus Mu50
accuuuaauaucu

SEQ ID NO: 2069550 - RNA, 17 nt, Staphylococcus aureus subsp. aureus Mu50
accuuuaccaguaucau

SEQ ID NO: 2069551 - RNA, 14 nt, Staphylococcus aureus subsp. aureus Mu50
accuuuacuuucau

SEQ ID NO: 2069552 - RNA, 17 nt, Staphylococcus aureus subsp. aureus Mu50
accuuuagacaauauuu

SEQ ID NO: 2069553 - RNA, 23 nt, Staphylococcus aureus subsp. aureus Mu50
accuuuagacaauauuuuuacau

SEQ ID NO: 2069554 - RNA, 14 nt, Staphylococcus aureus subsp. aureus Mu50
accuuuauuauuua

SEQ ID NO: 2069555 - RNA, 12 nt, Staphylococcus aureus subsp. aureus Mu50
accuuucaaaua

SEQ ID NO: 2069556 - RNA, 16 nt, Staphylococcus aureus subsp. aureus Mu50
accuuuauuauuuaau

SEQ ID NO: 2069557 - RNA, 18 nt, Staphylococcus aureus subsp. aureus Mu50
accuuucaaauauaucua

SEQ ID NO: 2069558 - RNA, 14 nt, Staphylococcus aureus subsp. aureus Mu50
accuuucgauaaac

SEQ ID NO: 2069559 - RNA, 14 nt, Staphylococcus aureus subsp. aureus Mu50
accuuuuucuacca

SEQ ID NO: 2069560 - RNA, 21 nt, Staphylococcus aureus subsp. aureus Mu50
accuuuuaauaguacuuaauu

SEQ ID NO: 2069561 - RNA, 19 nt, Staphylococcus aureus subsp. aureus Mu50
accuuuuauccccucaauu

SEQ ID NO: 2069562 - RNA, 21 nt, Staphylococcus aureus subsp. aureus Mu50
accuuuuaaggcagcuaaaaa

SEQ ID NO: 2069563 - RNA, 17 nt, Staphylococcus aureus subsp. aureus Mu50
accuuugucuuuuuuau

SEQ ID NO: 2069564 - RNA, 20 nt, Staphylococcus aureus subsp. aureus Mu50
accuuguucuuuacuccaaa

SEQ ID NO: 2069565 - RNA, 15 nt, Staphylococcus aureus subsp. aureus Mu50
accuuguaaauuuaa

SEQ ID NO: 2069566 - RNA, 16 nt, Staphylococcus aureus subsp. aureus Mu50
accuugaaugauauua

SEQ ID NO: 2069567 - RNA, 18 nt, Staphylococcus aureus subsp. aureus Mu50
accuugaaugauauuaac

SEQ ID NO: 2069568 - RNA, 16 nt, Staphylococcus aureus subsp. aureus Mu50
accuucagaugcuaca

SEQ ID NO: 2069569 - RNA, 17 nt, Staphylococcus aureus subsp. aureus Mu50
accuucgcauacuuuuu

SEQ ID NO: 2069570 - RNA, 14 nt, Staphylococcus aureus subsp. aureus Mu50
accuucuucucuaa

SEQ ID NO: 2069571 - RNA, 15 nt, Staphylococcus aureus subsp. aureus Mu50
accugggacauuaau

SEQ ID NO: 2069572 - RNA, 17 nt, Staphylococcus aureus subsp. aureus Mu50
accugcuuuuuauuauu

SEQ ID NO: 2069573 - RNA, 18 nt, Staphylococcus aureus subsp. aureus Mu50
accugcugaaguuugaac

SEQ ID NO: 2069574 - RNA, 23 nt, Staphylococcus aureus subsp. aureus Mu50
accuguuucuuuacuucuuucaa

SEQ ID NO: 2069575 - RNA, 17 nt, Staphylococcus aureus subsp. aureus Mu50
accuguuacuugagaac

SEQ ID NO: 2069576 - RNA, 12 nt, Staphylococcus aureus subsp. aureus Mu50
accuguuaaugu

SEQ ID NO: 2069577 - RNA, 17 nt, Staphylococcus aureus subsp. aureus Mu50
accugugacaaaugccu

SEQ ID NO: 2069578 - RNA, 14 nt, Staphylococcus aureus subsp. aureus Mu50
accugugauaaaaa

SEQ ID NO: 2069579 - RNA, 18 nt, Staphylococcus aureus subsp. aureus Mu50
accuggucguacuuucaa

SEQ ID NO: 2069580 - RNA, 22 nt, Staphylococcus aureus subsp. aureus Mu50
accuuaaauauaguugccaugu

SEQ ID NO: 2069581 - RNA, 13 nt, Staphylococcus aureus subsp. aureus Mu50
accuuaauaauga

SEQ ID NO: 2069582 - RNA, 20 nt, Staphylococcus aureus subsp. aureus Mu50
accuuacccaaaaaauugua

SEQ ID NO: 2069583 - RNA, 19 nt, Staphylococcus aureus subsp. aureus Mu50
accuuacuacgcauuauua

SEQ ID NO: 2069584 - RNA, 21 nt, Staphylococcus aureus subsp. aureus Mu50
accuuacuacgcauuauuaag

SEQ ID NO: 2069585 - RNA, 19 nt, Staphylococcus aureus subsp. aureus Mu50
accuuaucaguguaaguuu

SEQ ID NO: 2069586 - RNA, 16 nt, Staphylococcus aureus subsp. aureus Mu50
accucuugauaaaaua

SEQ ID NO: 2069587 - RNA, 12 nt, Staphylococcus aureus subsp. aureus Mu50
accucuuuuguu

SEQ ID NO: 2069588 - RNA, 15 nt, Staphylococcus aureus subsp. aureus Mu50
accucauuugacaua

SEQ ID NO: 2069589 - RNA, 17 nt, Staphylococcus aureus subsp. aureus Mu50
accuauuuuuugagcac

SEQ ID NO: 2069590 - RNA, 21 nt, Staphylococcus aureus subsp. aureus Mu50
accuaucccuguaaaaccaua

SEQ ID NO: 2069591 - RNA, 18 nt, Staphylococcus aureus subsp. aureus Mu50
accuaugauauaugcugc

SEQ ID NO: 2069592 - RNA, 17 nt, Staphylococcus aureus subsp. aureus Mu50
accuauuccuauuacua

SEQ ID NO: 2069593 - RNA, 16 nt, Staphylococcus aureus subsp. aureus Mu50
accuaaggcuaaugau

SEQ ID NO: 2069594 - RNA, 20 nt, Staphylococcus aureus subsp. aureus Mu50
accguuuuuuauaaaucauu

SEQ ID NO: 2069595 - RNA, 16 nt, Staphylococcus aureus subsp. aureus Mu50
accuaaaaacagcagu

SEQ ID NO: 2069596 - RNA, 13 nt, Staphylococcus aureus subsp. aureus Mu50
accuaaaaacaaa

SEQ ID NO: 2069597 - RNA, 22 nt, Staphylococcus aureus subsp. aureus Mu50
accuaauuguuaagagguuuug

SEQ ID NO: 2069598 - RNA, 12 nt, Staphylococcus aureus subsp. aureus Mu50
accuacaaauau

SEQ ID NO: 2069599 - RNA, 18 nt, Staphylococcus aureus subsp. aureus Mu50
accuaauucauauauacu

SEQ ID NO: 2069600 - RNA, 22 nt, Staphylococcus aureus subsp. aureus Mu50
accuaaguuaauuuaucguuua

SEQ ID NO: 2069601 - RNA, 23 nt, Staphylococcus aureus subsp. aureus Mu50
accuaauauauuacuaaccuauu

SEQ ID NO: 2069602 - RNA, 18 nt, Staphylococcus aureus subsp. aureus Mu50
accuaauauuuuaaacgu

SEQ ID NO: 2069603 - RNA, 20 nt, Staphylococcus aureus subsp. aureus Mu50
accuacaacgaagaauccua

SEQ ID NO: 2069604 - RNA, 21 nt, Staphylococcus aureus subsp. aureus Mu50
accuacacgaccaagacgaac

SEQ ID NO: 2069605 - RNA, 19 nt, Staphylococcus aureus subsp. aureus Mu50
accuacaacaccaauugaa

SEQ ID NO: 2069606 - RNA, 15 nt, Staphylococcus aureus subsp. aureus Mu50
accuacagauaaagc

SEQ ID NO: 2069607 - RNA, 16 nt, Staphylococcus aureus subsp. aureus Mu50
accuacacggucccaa

SEQ ID NO: 2069608 - RNA, 14 nt, Staphylococcus aureus subsp. aureus Mu50
accuauauuaagca

SEQ ID NO: 2069609 - RNA, 16 nt, Staphylococcus aureus subsp. aureus Mu50
accuauaagucucuuu

SEQ ID NO: 2069610 - RNA, 13 nt, Staphylococcus aureus subsp. aureus Mu50
accuauaccucgu

SEQ ID NO: 2069611 - RNA, 15 nt, Staphylococcus aureus subsp. aureus Mu50
accgucaaacuuaaa

SEQ ID NO: 2069612 - RNA, 15 nt, Staphylococcus aureus subsp. aureus Mu50
accgucacaaaccau

SEQ ID NO: 2069613 - RNA, 17 nt, Staphylococcus aureus subsp. aureus Mu50
accgucacaaaccauuc

SEQ ID NO: 2069614 - RNA, 22 nt, Staphylococcus aureus subsp. aureus Mu50
accguauuauuggauuugaagu

SEQ ID NO: 2069615 - RNA, 20 nt, Staphylococcus aureus subsp. aureus Mu50
accgucuucucuaucaguau

SEQ ID NO: 2069616 - RNA, 13 nt, Staphylococcus aureus subsp. aureus Mu50
accguaauuuuaa

SEQ ID NO: 2069617 - RNA, 14 nt, Staphylococcus aureus subsp. aureus Mu50
accguaaucuuuua

SEQ ID NO: 2069618 - RNA, 16 nt, Staphylococcus aureus subsp. aureus Mu50
accguaacauauguac

SEQ ID NO: 2069619 - RNA, 16 nt, Staphylococcus aureus subsp. aureus Mu50
accggcauauaaucca

SEQ ID NO: 2069620 - RNA, 16 nt, Staphylococcus aureus subsp. aureus Mu50
accgcuuaauucuuca

SEQ ID NO: 2069621 - RNA, 21 nt, Staphylococcus aureus subsp. aureus Mu50
accgcacuuucuauuaauaua

SEQ ID NO: 2069622 - RNA, 20 nt, Staphylococcus aureus subsp. aureus Mu50
accgauuaauauaauaccua

SEQ ID NO: 2069623 - RNA, 14 nt, Staphylococcus aureus subsp. aureus Mu50
aacccacauuaaau

SEQ ID NO: 2069624 - RNA, 16 nt, Staphylococcus aureus subsp. aureus Mu50
aacccauggauucuga

SEQ ID NO: 2069625 - RNA, 22 nt, Staphylococcus aureus subsp. aureus Mu50
aaccauuuuuuuaucuguagaa

SEQ ID NO: 2069626 - RNA, 14 nt, Staphylococcus aureus subsp. aureus Mu50
aaccauuucaucau

SEQ ID NO: 2069627 - RNA, 19 nt, Staphylococcus aureus subsp. aureus Mu50
aaccauugaaugaauccca

SEQ ID NO: 2069628 - RNA, 24 nt, Staphylococcus aureus subsp. aureus Mu50
aaccauuccaauuucaaguguauu

SEQ ID NO: 2069629 - RNA, 12 nt, Staphylococcus aureus subsp. aureus Mu50
aaccaucugugu

SEQ ID NO: 2069630 - RNA, 17 nt, Staphylococcus aureus subsp. aureus Mu50
aaccaugauuagcgcac

SEQ ID NO: 2069631 - RNA, 16 nt, Staphylococcus aureus subsp. aureus Mu50
aaccauaguaauaaaa

SEQ ID NO: 2069632 - RNA, 18 nt, Staphylococcus aureus subsp. aureus Mu50
aaccauaguaauaaaaug

SEQ ID NO: 2069633 - RNA, 15 nt, Staphylococcus aureus subsp. aureus Mu50
aaccaucauaaaugu

SEQ ID NO: 2069634 - RNA, 16 nt, Staphylococcus aureus subsp. aureus Mu50
aaccauaacaauuuug

SEQ ID NO: 2069635 - RNA, 17 nt, Staphylococcus aureus subsp. aureus Mu50
aaccauaaguaaaacug

SEQ ID NO: 2069636 - RNA, 13 nt, Staphylococcus aureus subsp. aureus Mu50
aaccauaacaauu

SEQ ID NO: 2069637 - RNA, 15 nt, Staphylococcus aureus subsp. aureus Mu50
aaccaccugauaaua

SEQ ID NO: 2069638 - RNA, 19 nt, Staphylococcus aureus subsp. aureus Mu50
aaccaccaguauaaccaug

SEQ ID NO: 2069639 - RNA, 16 nt, Staphylococcus aureus subsp. aureus Mu50
aaccaccaaaaaucau

SEQ ID NO: 2069640 - RNA, 16 nt, Staphylococcus aureus subsp. aureus Mu50
aaccagcuaaaccauc

SEQ ID NO: 2069641 - RNA, 18 nt, Staphylococcus aureus subsp. aureus Mu50
aaccguaacuauaugaaa

SEQ ID NO: 2069642 - RNA, 17 nt, Staphylococcus aureus subsp. aureus Mu50
aaccgcuuaauucuuca

SEQ ID NO: 2069643 - RNA, 18 nt, Staphylococcus aureus subsp. aureus Mu50
aaccgauuaauauaauac

SEQ ID NO: 2069644 - RNA, 21 nt, Staphylococcus aureus subsp. aureus Mu50
aaccgccaacuaauguuaaaa

SEQ ID NO: 2069645 - RNA, 14 nt, Staphylococcus aureus subsp. aureus Mu50
aaccgcuguuuuuc

SEQ ID NO: 2069646 - RNA, 22 nt, Staphylococcus aureus subsp. aureus Mu50
aaccgcuacaauuauaaaugau

SEQ ID NO: 2069647 - RNA, 15 nt, Staphylococcus aureus subsp. aureus Mu50
aaccgaagcgcagug

SEQ ID NO: 2069648 - RNA, 21 nt, Staphylococcus aureus subsp. aureus Mu50
aaccgaagcgcagugaccuca

SEQ ID NO: 2069649 - RNA, 12 nt, Staphylococcus aureus subsp. aureus Mu50
aacccuuuaaac

SEQ ID NO: 2069650 - RNA, 16 nt, Staphylococcus aureus subsp. aureus Mu50
aacaucugaaucugaa

SEQ ID NO: 2069651 - RNA, 17 nt, Staphylococcus aureus subsp. aureus Mu50
aacaucugaaaaaauua

SEQ ID NO: 2069652 - RNA, 23 nt, Staphylococcus aureus subsp. aureus Mu50
aacaugaccuaauauauuacuaa

SEQ ID NO: 2069653 - RNA, 21 nt, Staphylococcus aureus subsp. aureus Mu50
aacaucuuuuguuguuuuuga

SEQ ID NO: 2069654 - RNA, 12 nt, Staphylococcus aureus subsp. aureus Mu50
aacaugaacaau

SEQ ID NO: 2069655 - RNA, 17 nt, Staphylococcus aureus subsp. aureus Mu50
aacaugaacaaucagau

SEQ ID NO: 2069656 - RNA, 20 nt, Staphylococcus aureus subsp. aureus Mu50
aacaucgauuuaucauuauu

SEQ ID NO: 2069657 - RNA, 22 nt, Staphylococcus aureus subsp. aureus Mu50
aacauccugcuuauuaauuguu

SEQ ID NO: 2069658 - RNA, 23 nt, Staphylococcus aureus subsp. aureus Mu50
aacauuacuuuaacaguuguaau

SEQ ID NO: 2069659 - RNA, 18 nt, Staphylococcus aureus subsp. aureus Mu50
aacauuacccuuuaaacu

SEQ ID NO: 2069660 - RNA, 18 nt, Staphylococcus aureus subsp. aureus Mu50
aacauuaggauguucagc

SEQ ID NO: 2069661 - RNA, 22 nt, Staphylococcus aureus subsp. aureus Mu50
aacauuacaugcaccuuuacaa

SEQ ID NO: 2069662 - RNA, 23 nt, Staphylococcus aureus subsp. aureus Mu50
aacauuaaucuauauaaaaacug

SEQ ID NO: 2069663 - RNA, 17 nt, Staphylococcus aureus subsp. aureus Mu50
aacauuacccuuuaaac

SEQ ID NO: 2069664 - RNA, 17 nt, Staphylococcus aureus subsp. aureus Mu50
aacauuaauaaauaaua

SEQ ID NO: 2069665 - RNA, 15 nt, Staphylococcus aureus subsp. aureus Mu50
aacauguauuuagua

SEQ ID NO: 2069666 - RNA, 20 nt, Staphylococcus aureus subsp. aureus Mu50
aacauguuccgcuacaaaac

SEQ ID NO: 2069667 - RNA, 17 nt, Staphylococcus aureus subsp. aureus Mu50
aacauguacaauuuuua

SEQ ID NO: 2069668 - RNA, 13 nt, Staphylococcus aureus subsp. aureus Mu50
aacaugugcaagu

SEQ ID NO: 2069669 - RNA, 13 nt, Staphylococcus aureus subsp. aureus Mu50
aacauguguauga

SEQ ID NO: 2069670 - RNA, 12 nt, Staphylococcus aureus subsp. aureus Mu50
aacauuaaaaau

SEQ ID NO: 2069671 - RNA, 16 nt, Staphylococcus aureus subsp. aureus Mu50
aacauuaaauuauuag

SEQ ID NO: 2069672 - RNA, 21 nt, Staphylococcus aureus subsp. aureus Mu50
aacauuaaaauaauuaaauaa

SEQ ID NO: 2069673 - RNA, 13 nt, Staphylococcus aureus subsp. aureus Mu50
aacauuaaaaugu

SEQ ID NO: 2069674 - RNA, 18 nt, Staphylococcus aureus subsp. aureus Mu50
aacauuaaaauaauuaaa

SEQ ID NO: 2069675 - RNA, 20 nt, Staphylococcus aureus subsp. aureus Mu50
aacauuaaaauaauuaaaua

SEQ ID NO: 2069676 - RNA, 13 nt, Staphylococcus aureus subsp. aureus Mu50
aacaugauacgua

SEQ ID NO: 2069677 - RNA, 22 nt, Staphylococcus aureus subsp. aureus Mu50
aacaugauacugaaauuucaua

SEQ ID NO: 2069678 - RNA, 20 nt, Staphylococcus aureus subsp. aureus Mu50
aacaugauucaugauauguu

SEQ ID NO: 2069679 - RNA, 21 nt, Staphylococcus aureus subsp. aureus Mu50
aacaugauucaugauauguuc

SEQ ID NO: 2069680 - RNA, 21 nt, Staphylococcus aureus subsp. aureus Mu50
aaccaauuuuaacuuauauac

SEQ ID NO: 2069681 - RNA, 23 nt, Staphylococcus aureus subsp. aureus Mu50
aaccaaaucggaauaaaauaaau

SEQ ID NO: 2069682 - RNA, 13 nt, Staphylococcus aureus subsp. aureus Mu50
aaccaaauaauug

SEQ ID NO: 2069683 - RNA, 22 nt, Staphylococcus aureus subsp. aureus Mu50
aacauuuguuggaagccuucaa

SEQ ID NO: 2069684 - RNA, 13 nt, Staphylococcus aureus subsp. aureus Mu50
aacauuugucaua

SEQ ID NO: 2069685 - RNA, 14 nt, Staphylococcus aureus subsp. aureus Mu50
aacauuuaaaaaau

SEQ ID NO: 2069686 - RNA, 16 nt, Staphylococcus aureus subsp. aureus Mu50
aacauuuaagaaacgu

SEQ ID NO: 2069687 - RNA, 19 nt, Staphylococcus aureus subsp. aureus Mu50
aacauuuauucuuucucua

SEQ ID NO: 2069688 - RNA, 20 nt, Staphylococcus aureus subsp. aureus Mu50
aacauuuuuuauagcaaauu

SEQ ID NO: 2069689 - RNA, 15 nt, Staphylococcus aureus subsp. aureus Mu50
aaccaaaaccaaaug

SEQ ID NO: 2069690 - RNA, 22 nt, Staphylococcus aureus subsp. aureus Mu50
aacauuuugccccucauucaca

SEQ ID NO: 2069691 - RNA, 11 nt, Staphylococcus aureus subsp. aureus Mu50
aacauuuuuag

SEQ ID NO: 2069692 - RNA, 13 nt, Staphylococcus aureus subsp. aureus Mu50
aacauuuugaguc

SEQ ID NO: 2069693 - RNA, 20 nt, Staphylococcus aureus subsp. aureus Mu50
aacauugagauuaucuuuag

SEQ ID NO: 2069694 - RNA, 18 nt, Staphylococcus aureus subsp. aureus Mu50
aacauuauuuauauuuag

SEQ ID NO: 2069695 - RNA, 19 nt, Staphylococcus aureus subsp. aureus Mu50
aacauuauuuauauuuaga

SEQ ID NO: 2069696 - RNA, 13 nt, Staphylococcus aureus subsp. aureus Mu50
aacauuauuuuug

SEQ ID NO: 2069697 - RNA, 14 nt, Staphylococcus aureus subsp. aureus Mu50
aacauuauuuuugu

SEQ ID NO: 2069698 - RNA, 13 nt, Staphylococcus aureus subsp. aureus Mu50
aacauaauauuuc

SEQ ID NO: 2069699 - RNA, 15 nt, Staphylococcus aureus subsp. aureus Mu50
aacauaauauuuuga

SEQ ID NO: 2069700 - RNA, 12 nt, Staphylococcus aureus subsp. aureus Mu50
aacauaaugaca

SEQ ID NO: 2069701 - RNA, 13 nt, Staphylococcus aureus subsp. aureus Mu50
aacauaauuuuua

SEQ ID NO: 2069702 - RNA, 20 nt, Staphylococcus aureus subsp. aureus Mu50
aacauaccuaauaacgcaua

SEQ ID NO: 2069703 - RNA, 19 nt, Staphylococcus aureus subsp. aureus Mu50
aacauaauuuuuauuuaca

SEQ ID NO: 2069704 - RNA, 15 nt, Staphylococcus aureus subsp. aureus Mu50
aacauauaaaucauu

SEQ ID NO: 2069705 - RNA, 18 nt, Staphylococcus aureus subsp. aureus Mu50
aacauagcuuaauaauua

SEQ ID NO: 2069706 - RNA, 21 nt, Staphylococcus aureus subsp. aureus Mu50
aacauagcuuaauaauuaaua

SEQ ID NO: 2069707 - RNA, 16 nt, Staphylococcus aureus subsp. aureus Mu50
aacauauguacuauua

SEQ ID NO: 2069708 - RNA, 18 nt, Staphylococcus aureus subsp. aureus Mu50
aacauauucauaauaucg

SEQ ID NO: 2069709 - RNA, 13 nt, Staphylococcus aureus subsp. aureus Mu50
aacauauuauaua

SEQ ID NO: 2069710 - RNA, 19 nt, Staphylococcus aureus subsp. aureus Mu50
aacauauuauauauauucc

SEQ ID NO: 2069711 - RNA, 14 nt, Staphylococcus aureus subsp. aureus Mu50
aacaucaucuaugc

SEQ ID NO: 2069712 - RNA, 13 nt, Staphylococcus aureus subsp. aureus Mu50
aacaucaucuuua

SEQ ID NO: 2069713 - RNA, 13 nt, Staphylococcus aureus subsp. aureus Mu50
aacaucauucaca

SEQ ID NO: 2069714 - RNA, 16 nt, Staphylococcus aureus subsp. aureus Mu50
aacauccccaaaaaua

SEQ ID NO: 2069715 - RNA, 15 nt, Staphylococcus aureus subsp. aureus Mu50
aacaguuaauaugaa

SEQ ID NO: 2069716 - RNA, 15 nt, Staphylococcus aureus subsp. aureus Mu50
aacaguuaauuauac

SEQ ID NO: 2069717 - RNA, 13 nt, Staphylococcus aureus subsp. aureus Mu50
aacaguuuuaaag

SEQ ID NO: 2069718 - RNA, 12 nt, Staphylococcus aureus subsp. aureus Mu50
aacauaaaaaug

SEQ ID NO: 2069719 - RNA, 24 nt, Staphylococcus aureus subsp. aureus Mu50
aacauaacaugaccuaauauauua

SEQ ID NO: 2069720 - RNA, 18 nt, Staphylococcus aureus subsp. aureus Mu50
aacagcgugaauauaagu

SEQ ID NO: 2069721 - RNA, 13 nt, Staphylococcus aureus subsp. aureus Mu50
aacagcuacaaau

SEQ ID NO: 2069722 - RNA, 15 nt, Staphylococcus aureus subsp. aureus Mu50
aacagcuacaaauaa

SEQ ID NO: 2069723 - RNA, 15 nt, Staphylococcus aureus subsp. aureus Mu50
aacagcuuuuucuac

SEQ ID NO: 2069724 - RNA, 20 nt, Staphylococcus aureus subsp. aureus Mu50
aacagcggaauacagaugau

SEQ ID NO: 2069725 - RNA, 13 nt, Staphylococcus aureus subsp. aureus Mu50
aacagcauaaaua

SEQ ID NO: 2069726 - RNA, 18 nt, Staphylococcus aureus subsp. aureus Mu50
aacagcaguaagauuauu

SEQ ID NO: 2069727 - RNA, 18 nt, Staphylococcus aureus subsp. aureus Mu50
aacagcaguaagauauuu

SEQ ID NO: 2069728 - RNA, 21 nt, Staphylococcus aureus subsp. aureus Mu50
aacacggucgccaacaguaau

SEQ ID NO: 2069729 - RNA, 16 nt, Staphylococcus aureus subsp. aureus Mu50
aacacgcucuuuucaa

SEQ ID NO: 2069730 - RNA, 21 nt, Staphylococcus aureus subsp. aureus Mu50
aacacgaugagcgcauaaauu

SEQ ID NO: 2069731 - RNA, 22 nt, Staphylococcus aureus subsp. aureus Mu50
aacacugugaaguauugccaaa

SEQ ID NO: 2069732 - RNA, 21 nt, Staphylococcus aureus subsp. aureus Mu50
aacacguucuugguauuuuuu

SEQ ID NO: 2069733 - RNA, 18 nt, Staphylococcus aureus subsp. aureus Mu50
aacagaaccgaaaauaau

SEQ ID NO: 2069734 - RNA, 18 nt, Staphylococcus aureus subsp. aureus Mu50
aacacauucuuauuugaa

SEQ ID NO: 2069735 - RNA, 16 nt, Staphylococcus aureus subsp. aureus Mu50
aacaccacacagcauu

SEQ ID NO: 2069736 - RNA, 12 nt, Staphylococcus aureus subsp. aureus Mu50
aacaccaauuga

SEQ ID NO: 2069737 - RNA, 22 nt, Staphylococcus aureus subsp. aureus Mu50
aacaccagauaucauaauauug

SEQ ID NO: 2069738 - RNA, 21 nt, Staphylococcus aureus subsp. aureus Mu50
aacacaucuauguggcuacuu

SEQ ID NO: 2069739 - RNA, 17 nt, Staphylococcus aureus subsp. aureus Mu50
aacacagacguuuuuga

SEQ ID NO: 2069740 - RNA, 18 nt, Staphylococcus aureus subsp. aureus Mu50
aacacagagaauuucgaa

SEQ ID NO: 2069741 - RNA, 23 nt, Staphylococcus aureus subsp. aureus Mu50
aacacagagaaauucgaaaagaa

SEQ ID NO: 2069742 - RNA, 14 nt, Staphylococcus aureus subsp. aureus Mu50
aacaccuaauauuu

SEQ ID NO: 2069743 - RNA, 22 nt, Staphylococcus aureus subsp. aureus Mu50
aacacgacaaucgaauguauug

SEQ ID NO: 2069744 - RNA, 15 nt, Staphylococcus aureus subsp. aureus Mu50
aacaaucguuuuaau

SEQ ID NO: 2069745 - RNA, 15 nt, Staphylococcus aureus subsp. aureus Mu50
aacaaucuuuuucau

SEQ ID NO: 2069746 - RNA, 13 nt, Staphylococcus aureus subsp. aureus Mu50
aacaauaauugau

SEQ ID NO: 2069747 - RNA, 14 nt, Staphylococcus aureus subsp. aureus Mu50
aacaauaacaccug

SEQ ID NO: 2069748 - RNA, 17 nt, Staphylococcus aureus subsp. aureus Mu50
aacaauacauaaugguu

SEQ ID NO: 2069749 - RNA, 19 nt, Staphylococcus aureus subsp. aureus Mu50
aacaauaccgcgauaaaua

SEQ ID NO: 2069750 - RNA, 19 nt, Staphylococcus aureus subsp. aureus Mu50
aacaauagguacaacuaaa

SEQ ID NO: 2069751 - RNA, 12 nt, Staphylococcus aureus subsp. aureus Mu50
aacaauacuacu

SEQ ID NO: 2069752 - RNA, 16 nt, Staphylococcus aureus subsp. aureus Mu50
aacaaucaaauuacaa

SEQ ID NO: 2069753 - RNA, 13 nt, Staphylococcus aureus subsp. aureus Mu50
aacaaucagauaa

SEQ ID NO: 2069754 - RNA, 22 nt, Staphylococcus aureus subsp. aureus Mu50
aacaauagguacaacuaaauau

SEQ ID NO: 2069755 - RNA, 21 nt, Staphylococcus aureus subsp. aureus Mu50
aacaauagguacaacuaaaua

SEQ ID NO: 2069756 - RNA, 13 nt, Staphylococcus aureus subsp. aureus Mu50
aacaauauaauau

SEQ ID NO: 2069757 - RNA, 19 nt, Staphylococcus aureus subsp. aureus Mu50
aacacaaaaaugaagaaua

SEQ ID NO: 2069758 - RNA, 16 nt, Staphylococcus aureus subsp. aureus Mu50
aacacaaauaaaggca

SEQ ID NO: 2069759 - RNA, 23 nt, Staphylococcus aureus subsp. aureus Mu50
aacaauuuuauauagacaguagu

SEQ ID NO: 2069760 - RNA, 12 nt, Staphylococcus aureus subsp. aureus Mu50
aacaauuuuaaa

SEQ ID NO: 2069761 - RNA, 17 nt, Staphylococcus aureus subsp. aureus Mu50
aacaauucuucaucaug

SEQ ID NO: 2069762 - RNA, 14 nt, Staphylococcus aureus subsp. aureus Mu50
aacaauucauuaau

SEQ ID NO: 2069763 - RNA, 16 nt, Staphylococcus aureus subsp. aureus Mu50
aacaauucuucaucau

SEQ ID NO: 2069764 - RNA, 17 nt, Staphylococcus aureus subsp. aureus Mu50
aacaauugauugcucua

SEQ ID NO: 2069765 - RNA, 22 nt, Staphylococcus aureus subsp. aureus Mu50
aacaacaaauauaauguauaaa

SEQ ID NO: 2069766 - RNA, 20 nt, Staphylococcus aureus subsp. aureus Mu50
aacaaauucauauuaacugu

SEQ ID NO: 2069767 - RNA, 17 nt, Staphylococcus aureus subsp. aureus Mu50
aacaaauucauauuaac

SEQ ID NO: 2069768 - RNA, 16 nt, Staphylococcus aureus subsp. aureus Mu50
aacaaaucgauuaauu

SEQ ID NO: 2069769 - RNA, 18 nt, Staphylococcus aureus subsp. aureus Mu50
aacaaaucuauaaauauc

SEQ ID NO: 2069770 - RNA, 17 nt, Staphylococcus aureus subsp. aureus Mu50
aacaaaucuuuuaaauu

SEQ ID NO: 2069771 - RNA, 11 nt, Staphylococcus aureus subsp. aureus Mu50
aacaaagaagc

SEQ ID NO: 2069772 - RNA, 15 nt, Staphylococcus aureus subsp. aureus Mu50
aacaaacgcugauuu

SEQ ID NO: 2069773 - RNA, 23 nt, Staphylococcus aureus subsp. aureus Mu50
aacaaaguaauccccgaagcaca

SEQ ID NO: 2069774 - RNA, 21 nt, Staphylococcus aureus subsp. aureus Mu50
aacaaagugcaauuauuucaa

SEQ ID NO: 2069775 - RNA, 14 nt, Staphylococcus aureus subsp. aureus Mu50
aacaaauauaauac

SEQ ID NO: 2069776 - RNA, 15 nt, Staphylococcus aureus subsp. aureus Mu50
aacaaauaguucaaa

SEQ ID NO: 2069777 - RNA, 22 nt, Staphylococcus aureus subsp. aureus Mu50
aacaaaauuaagaagaaauacu

SEQ ID NO: 2069778 - RNA, 22 nt, Staphylococcus aureus subsp. aureus Mu50
aacaaacauuaaucuauauaaa

SEQ ID NO: 2069779 - RNA, 14 nt, Staphylococcus aureus subsp. aureus Mu50
aacaaaagaaaguu

SEQ ID NO: 2069780 - RNA, 18 nt, Staphylococcus aureus subsp. aureus Mu50
aacaaaauauacuaaauu

SEQ ID NO: 2069781 - RNA, 17 nt, Staphylococcus aureus subsp. aureus Mu50
aaauuuuuuguaaacau

SEQ ID NO: 2069782 - RNA, 15 nt, Staphylococcus aureus subsp. aureus Mu50
aaauuuuucacuuca

SEQ ID NO: 2069783 - RNA, 14 nt, Staphylococcus aureus subsp. aureus Mu50
aacaaaaagaauuu

SEQ ID NO: 2069784 - RNA, 20 nt, Staphylococcus aureus subsp. aureus Mu50
aacaaguauaaaugcagcug

SEQ ID NO: 2069785 - RNA, 18 nt, Staphylococcus aureus subsp. aureus Mu50
aacaagguucuaaaucuu

SEQ ID NO: 2069786 - RNA, 20 nt, Staphylococcus aureus subsp. aureus Mu50
aacaagcuuuucauuuuuau

SEQ ID NO: 2069787 - RNA, 17 nt, Staphylococcus aureus subsp. aureus Mu50
aacaagcuuuuuucaau

SEQ ID NO: 2069788 - RNA, 14 nt, Staphylococcus aureus subsp. aureus Mu50
aacaagcaucauga

SEQ ID NO: 2069789 - RNA, 15 nt, Staphylococcus aureus subsp. aureus Mu50
aacaagcaucaugaa

SEQ ID NO: 2069790 - RNA, 16 nt, Staphylococcus aureus subsp. aureus Mu50
aacaagccuuaaaaua

SEQ ID NO: 2069791 - RNA, 14 nt, Staphylococcus aureus subsp. aureus Mu50
aacaagauucauac

SEQ ID NO: 2069792 - RNA, 14 nt, Staphylococcus aureus subsp. aureus Mu50
aacaacuaaagguc

SEQ ID NO: 2069793 - RNA, 23 nt, Staphylococcus aureus subsp. aureus Mu50
aacaacuuuaauuuuucauuaau

SEQ ID NO: 2069794 - RNA, 15 nt, Staphylococcus aureus subsp. aureus Mu50
aacaacuuuguuuuc

SEQ ID NO: 2069795 - RNA, 23 nt, Staphylococcus aureus subsp. aureus Mu50
aacaaccucugauacuucaccau

SEQ ID NO: 2069796 - RNA, 20 nt, Staphylococcus aureus subsp. aureus Mu50
aacaaccgucccauaaaaga

SEQ ID NO: 2069797 - RNA, 23 nt, Staphylococcus aureus subsp. aureus Mu50
aacaaccguuuuaaguacagcau

SEQ ID NO: 2069798 - RNA, 22 nt, Staphylococcus aureus subsp. aureus Mu50
aaauuuguaccaaauaaauuaa

SEQ ID NO: 2069799 - RNA, 18 nt, Staphylococcus aureus subsp. aureus Mu50
aaauuuguguucaaauca

SEQ ID NO: 2069800 - RNA, 19 nt, Staphylococcus aureus subsp. aureus Mu50
aaauuuguguucaaaucac

SEQ ID NO: 2069801 - RNA, 14 nt, Staphylococcus aureus subsp. aureus Mu50
aaauuuuacgaaaa

SEQ ID NO: 2069802 - RNA, 17 nt, Staphylococcus aureus subsp. aureus Mu50
aaauuuuuaagaagcuu

SEQ ID NO: 2069803 - RNA, 15 nt, Staphylococcus aureus subsp. aureus Mu50
aaauuuugaagaagu

SEQ ID NO: 2069804 - RNA, 22 nt, Staphylococcus aureus subsp. aureus Mu50
aaauuuucuguuuaauuaaaau

SEQ ID NO: 2069805 - RNA, 12 nt, Staphylococcus aureus subsp. aureus Mu50
aaauuuugaaga

SEQ ID NO: 2069806 - RNA, 22 nt, Staphylococcus aureus subsp. aureus Mu50
aaauuucauaaaguuuauuuau

SEQ ID NO: 2069807 - RNA, 17 nt, Staphylococcus aureus subsp. aureus Mu50
aaauuucaggcguuaau

SEQ ID NO: 2069808 - RNA, 19 nt, Staphylococcus aureus subsp. aureus Mu50
aaauuucaccgcuuucaau

SEQ ID NO: 2069809 - RNA, 13 nt, Staphylococcus aureus subsp. aureus Mu50
aaauuuauuuuua

SEQ ID NO: 2069810 - RNA, 12 nt, Staphylococcus aureus subsp. aureus Mu50
aaauuucaaaaa

SEQ ID NO: 2069811 - RNA, 17 nt, Staphylococcus aureus subsp. aureus Mu50
aaauuuauuauaaaaua

SEQ ID NO: 2069812 - RNA, 18 nt, Staphylococcus aureus subsp. aureus Mu50
aaauuuauuauaaaauag

SEQ ID NO: 2069813 - RNA, 19 nt, Staphylococcus aureus subsp. aureus Mu50
aaauuucgccucaucuaau

SEQ ID NO: 2069814 - RNA, 16 nt, Staphylococcus aureus subsp. aureus Mu50
aaauuucgacaucuag

SEQ ID NO: 2069815 - RNA, 23 nt, Staphylococcus aureus subsp. aureus Mu50
aaauuguggagaucuaacaauau

SEQ ID NO: 2069816 - RNA, 20 nt, Staphylococcus aureus subsp. aureus Mu50
aaauuguggcguaguuugaa

SEQ ID NO: 2069817 - RNA, 14 nt, Staphylococcus aureus subsp. aureus Mu50
aaauuguauagaau

SEQ ID NO: 2069818 - RNA, 23 nt, Staphylococcus aureus subsp. aureus Mu50
aaauugguuuggauaaaaugaua

SEQ ID NO: 2069819 - RNA, 14 nt, Staphylococcus aureus subsp. aureus Mu50
aaauuguaugaaua

SEQ ID NO: 2069820 - RNA, 24 nt, Staphylococcus aureus subsp. aureus Mu50
aaauuguauuucuuaacauccuuu

SEQ ID NO: 2069821 - RNA, 17 nt, Staphylococcus aureus subsp. aureus Mu50
aaauuguucuaauacac

SEQ ID NO: 2069822 - RNA, 20 nt, Staphylococcus aureus subsp. aureus Mu50
aaauuguuuacuauacuuug

SEQ ID NO: 2069823 - RNA, 23 nt, Staphylococcus aureus subsp. aureus Mu50
aaauuguguugaaucaacaguuu

SEQ ID NO: 2069824 - RNA, 14 nt, Staphylococcus aureus subsp. aureus Mu50
aaauuguguuucuu

SEQ ID NO: 2069825 - RNA, 16 nt, Staphylococcus aureus subsp. aureus Mu50
aaauuuaguaucucau

SEQ ID NO: 2069826 - RNA, 21 nt, Staphylococcus aureus subsp. aureus Mu50
aaauuuaguuaaguauuuaaa

SEQ ID NO: 2069827 - RNA, 15 nt, Staphylococcus aureus subsp. aureus Mu50
aaauuuaauauuguu

SEQ ID NO: 2069828 - RNA, 16 nt, Staphylococcus aureus subsp. aureus Mu50
aaauuuaaaacaauga

SEQ ID NO: 2069829 - RNA, 17 nt, Staphylococcus aureus subsp. aureus Mu50
aaauuuaaaacaaugau

SEQ ID NO: 2069830 - RNA, 19 nt, Staphylococcus aureus subsp. aureus Mu50
aaauugcuauauuaguaua

SEQ ID NO: 2069831 - RNA, 20 nt, Staphylococcus aureus subsp. aureus Mu50
aaauugccuuucauuuuagc

SEQ ID NO: 2069832 - RNA, 12 nt, Staphylococcus aureus subsp. aureus Mu50
aaauuguaaaac

SEQ ID NO: 2069833 - RNA, 19 nt, Staphylococcus aureus subsp. aureus Mu50
aaauuggauaauuucuucu

SEQ ID NO: 2069834 - RNA, 14 nt, Staphylococcus aureus subsp. aureus Mu50
uuucaaaacuagca

SEQ ID NO: 2069835 - RNA, 15 nt, Staphylococcus aureus subsp. aureus Mu50
uuucaaaaccaauua

SEQ ID NO: 2069836 - RNA, 11 nt, Staphylococcus aureus subsp. aureus Mu50
uuucaaaaaua

SEQ ID NO: 2069837 - RNA, 19 nt, Staphylococcus aureus subsp. aureus Mu50
aaauugcaaaguaacaaua

SEQ ID NO: 2069838 - RNA, 15 nt, Staphylococcus aureus subsp. aureus Mu50
aaauugauucuuugg

SEQ ID NO: 2069839 - RNA, 12 nt, Staphylococcus aureus subsp. aureus Mu50
aaauugauuaaa

SEQ ID NO: 2069840 - RNA, 21 nt, Staphylococcus aureus subsp. aureus Mu50
aaauugauauugcaaaacuug

SEQ ID NO: 2069841 - RNA, 15 nt, Staphylococcus aureus subsp. aureus Mu50
aagaaauaauuuaaa

SEQ ID NO: 2069842 - RNA, 21 nt, Staphylococcus aureus subsp. aureus Mu50
aagaaauacuaauuucuauag

SEQ ID NO: 2069843 - RNA, 13 nt, Staphylococcus aureus subsp. aureus Mu50
aagaaauuaaagu

SEQ ID NO: 2069844 - RNA, 13 nt, Staphylococcus aureus subsp. aureus Mu50
aagaaauguuaaa

SEQ ID NO: 2069845 - RNA, 15 nt, Staphylococcus aureus subsp. aureus Mu50
aagaaauguuaaauu

SEQ ID NO: 2069846 - RNA, 18 nt, Staphylococcus aureus subsp. aureus Mu50
aagaaauguuaaauuaaa

SEQ ID NO: 2069847 - RNA, 14 nt, Staphylococcus aureus subsp. aureus Mu50
aagaaaucaacaac

SEQ ID NO: 2069848 - RNA, 16 nt, Staphylococcus aureus subsp. aureus Mu50
aagaaaucaacaacuu

SEQ ID NO: 2069849 - RNA, 19 nt, Staphylococcus aureus subsp. aureus Mu50
aagaaaccuuuuuucucuu

SEQ ID NO: 2069850 - RNA, 15 nt, Staphylococcus aureus subsp. aureus Mu50
aacuuuuuuaacuuu

SEQ ID NO: 2069851 - RNA, 13 nt, Staphylococcus aureus subsp. aureus Mu50
aacuuuuuuaaca

SEQ ID NO: 2069852 - RNA, 15 nt, Staphylococcus aureus subsp. aureus Mu50
aacuuuuuuaacagc

SEQ ID NO: 2069853 - RNA, 21 nt, Staphylococcus aureus subsp. aureus Mu50
aagaaaaagugauaauuaaaa

SEQ ID NO: 2069854 - RNA, 20 nt, Staphylococcus aureus subsp. aureus Mu50
aagaaaaagugauaauuaaa

SEQ ID NO: 2069855 - RNA, 14 nt, Staphylococcus aureus subsp. aureus Mu50
aagaaaauuucagu

SEQ ID NO: 2069856 - RNA, 18 nt, Staphylococcus aureus subsp. aureus Mu50
aagaaaauacuaacaauu

SEQ ID NO: 2069857 - RNA, 13 nt, Staphylococcus aureus subsp. aureus Mu50
aagaaaauacuaa

SEQ ID NO: 2069858 - RNA, 15 nt, Staphylococcus aureus subsp. aureus Mu50
aagaacuuuaaaaau

SEQ ID NO: 2069859 - RNA, 18 nt, Staphylococcus aureus subsp. aureus Mu50
aagaagauuaugaaaaca

SEQ ID NO: 2069860 - RNA, 22 nt, Staphylococcus aureus subsp. aureus Mu50
aagaagauuaugaaaacauuau

SEQ ID NO: 2069861 - RNA, 19 nt, Staphylococcus aureus subsp. aureus Mu50
aagaaggaugaguuuaaaa

SEQ ID NO: 2069862 - RNA, 12 nt, Staphylococcus aureus subsp. aureus Mu50
aagaaauuuuuu

SEQ ID NO: 2069863 - RNA, 13 nt, Staphylococcus aureus subsp. aureus Mu50
aagaaauuguguu

SEQ ID NO: 2069864 - RNA, 13 nt, Staphylococcus aureus subsp. aureus Mu50
aagaaauucuaca

SEQ ID NO: 2069865 - RNA, 22 nt, Staphylococcus aureus subsp. aureus Mu50
aagaaauucuacaggcaaugca

SEQ ID NO: 2069866 - RNA, 22 nt, Staphylococcus aureus subsp. aureus Mu50
aagaacaguauguggauacaaa

SEQ ID NO: 2069867 - RNA, 14 nt, Staphylococcus aureus subsp. aureus Mu50
aagaacauaaccua

SEQ ID NO: 2069868 - RNA, 14 nt, Staphylococcus aureus subsp. aureus Mu50
aagaaauuuuuucu

SEQ ID NO: 2069869 - RNA, 23 nt, Staphylococcus aureus subsp. aureus Mu50
aacuuguuguuauuuauuugauu

SEQ ID NO: 2069870 - RNA, 17 nt, Staphylococcus aureus subsp. aureus Mu50
aacuuuaagcugucaua

SEQ ID NO: 2069871 - RNA, 14 nt, Staphylococcus aureus subsp. aureus Mu50
aacuuuaauaccag

SEQ ID NO: 2069872 - RNA, 19 nt, Staphylococcus aureus subsp. aureus Mu50
aacuuuaauuuuucauuaa

SEQ ID NO: 2069873 - RNA, 20 nt, Staphylococcus aureus subsp. aureus Mu50
aacuuuaauuaaagcaucuu

SEQ ID NO: 2069874 - RNA, 22 nt, Staphylococcus aureus subsp. aureus Mu50
aacuuuaauuaaagcaucuuca

SEQ ID NO: 2069875 - RNA, 14 nt, Staphylococcus aureus subsp. aureus Mu50
aacuuguaaucaua

SEQ ID NO: 2069876 - RNA, 20 nt, Staphylococcus aureus subsp. aureus Mu50
aacuugugauauauaaccau

SEQ ID NO: 2069877 - RNA, 14 nt, Staphylococcus aureus subsp. aureus Mu50
aacuuggcaaugaa

SEQ ID NO: 2069878 - RNA, 16 nt, Staphylococcus aureus subsp. aureus Mu50
aacuuggcaaugaaau

SEQ ID NO: 2069879 - RNA, 18 nt, Staphylococcus aureus subsp. aureus Mu50
aacuugaacuaaaacgau

SEQ ID NO: 2069880 - RNA, 13 nt, Staphylococcus aureus subsp. aureus Mu50
aacuucuuuucuu

SEQ ID NO: 2069881 - RNA, 21 nt, Staphylococcus aureus subsp. aureus Mu50
aacuucuuuuguuuuaccauc

SEQ ID NO: 2069882 - RNA, 22 nt, Staphylococcus aureus subsp. aureus Mu50
aacuucuuuuguuuuaccauca

SEQ ID NO: 2069883 - RNA, 17 nt, Staphylococcus aureus subsp. aureus Mu50
aacuugaucauuauaaa

SEQ ID NO: 2069884 - RNA, 19 nt, Staphylococcus aureus subsp. aureus Mu50
aacuugaucauuauaaaau

SEQ ID NO: 2069885 - RNA, 14 nt, Staphylococcus aureus subsp. aureus Mu50
aacuugauuaugua

SEQ ID NO: 2069886 - RNA, 20 nt, Staphylococcus aureus subsp. aureus Mu50
aacuugaucauuauaaaaug

SEQ ID NO: 2069887 - RNA, 17 nt, Staphylococcus aureus subsp. aureus Mu50
aacuuuaguauauucaa

SEQ ID NO: 2069888 - RNA, 20 nt, Staphylococcus aureus subsp. aureus Mu50
aacuuuaccaauaucaugca

SEQ ID NO: 2069889 - RNA, 22 nt, Staphylococcus aureus subsp. aureus Mu50
aacuuuaauuuuucauuaauac

SEQ ID NO: 2069890 - RNA, 23 nt, Staphylococcus aureus subsp. aureus Mu50
aacuuuaccaccauuuuuagaaa

SEQ ID NO: 2069891 - RNA, 20 nt, Staphylococcus aureus subsp. aureus Mu50
aacuuucacucauauuacuu

SEQ ID NO: 2069892 - RNA, 17 nt, Staphylococcus aureus subsp. aureus Mu50
aacuuuuuaacugccau

SEQ ID NO: 2069893 - RNA, 19 nt, Staphylococcus aureus subsp. aureus Mu50
aacuuuuuaacugccauau

SEQ ID NO: 2069894 - RNA, 16 nt, Staphylococcus aureus subsp. aureus Mu50
aacuuuuccuuguugg

SEQ ID NO: 2069895 - RNA, 15 nt, Staphylococcus aureus subsp. aureus Mu50
aacuuauuauuuauc

SEQ ID NO: 2069896 - RNA, 15 nt, Staphylococcus aureus subsp. aureus Mu50
aacuuauuugccaua

SEQ ID NO: 2069897 - RNA, 13 nt, Staphylococcus aureus subsp. aureus Mu50
aacuuauucuuca

SEQ ID NO: 2069898 - RNA, 13 nt, Staphylococcus aureus subsp. aureus Mu50
aacuuauuauuua

SEQ ID NO: 2069899 - RNA, 18 nt, Staphylococcus aureus subsp. aureus Mu50
aacuucacgcaaaacaau

SEQ ID NO: 2069900 - RNA, 20 nt, Staphylococcus aureus subsp. aureus Mu50
aacuuauauacguugauuaa

SEQ ID NO: 2069901 - RNA, 20 nt, Staphylococcus aureus subsp. aureus Mu50
aacuuagguuauuauaaaau

SEQ ID NO: 2069902 - RNA, 22 nt, Staphylococcus aureus subsp. aureus Mu50
aacuuaauuaaaaaaagauuag

SEQ ID NO: 2069903 - RNA, 17 nt, Staphylococcus aureus subsp. aureus Mu50
aacuuaaucaagcuagc

SEQ ID NO: 2069904 - RNA, 13 nt, Staphylococcus aureus subsp. aureus Mu50
aacuuacauuaca

SEQ ID NO: 2069905 - RNA, 18 nt, Staphylococcus aureus subsp. aureus Mu50
aacuuacauuacauauau

SEQ ID NO: 2069906 - RNA, 15 nt, Staphylococcus aureus subsp. aureus Mu50
aacuuaccaugauga

SEQ ID NO: 2069907 - RNA, 14 nt, Staphylococcus aureus subsp. aureus Mu50
aacuucauaauaua

SEQ ID NO: 2069908 - RNA, 13 nt, Staphylococcus aureus subsp. aureus Mu50
aacuuccuaaaau

SEQ ID NO: 2069909 - RNA, 21 nt, Staphylococcus aureus subsp. aureus Mu50
aacuuccuaaaauuuacaaau

SEQ ID NO: 2069910 - RNA, 20 nt, Staphylococcus aureus subsp. aureus Mu50
aacuuccuuuuuauuuuuug

SEQ ID NO: 2069911 - RNA, 22 nt, Staphylococcus aureus subsp. aureus Mu50
aacuucuucuccguauuuaccu

SEQ ID NO: 2069912 - RNA, 13 nt, Staphylococcus aureus subsp. aureus Mu50
aacuucucuuagu

SEQ ID NO: 2069913 - RNA, 22 nt, Staphylococcus aureus subsp. aureus Mu50
aacuucugaaacgccucaacac

SEQ ID NO: 2069914 - RNA, 12 nt, Staphylococcus aureus subsp. aureus Mu50
aacuucuacagu

SEQ ID NO: 2069915 - RNA, 18 nt, Staphylococcus aureus subsp. aureus Mu50
aacuggaacuuacaaguc

SEQ ID NO: 2069916 - RNA, 14 nt, Staphylococcus aureus subsp. aureus Mu50
aacugggauauaga

SEQ ID NO: 2069917 - RNA, 21 nt, Staphylococcus aureus subsp. aureus Mu50
aacugugcaugacgauaauga

SEQ ID NO: 2069918 - RNA, 13 nt, Staphylococcus aureus subsp. aureus Mu50
aacugugauucau

SEQ ID NO: 2069919 - RNA, 11 nt, Staphylococcus aureus subsp. aureus Mu50
aacuuaaauau

SEQ ID NO: 2069920 - RNA, 12 nt, Staphylococcus aureus subsp. aureus Mu50
aacuuaaauauc

SEQ ID NO: 2069921 - RNA, 20 nt, Staphylococcus aureus subsp. aureus Mu50
aacuuaaauaucgacaaauu

SEQ ID NO: 2069922 - RNA, 13 nt, Staphylococcus aureus subsp. aureus Mu50
aacuuaaaaauga

SEQ ID NO: 2069923 - RNA, 23 nt, Staphylococcus aureus subsp. aureus Mu50
aacuuaaaaaugaaaugaaguau

SEQ ID NO: 2069924 - RNA, 17 nt, Staphylococcus aureus subsp. aureus Mu50
aacuguuaaacucauac

SEQ ID NO: 2069925 - RNA, 15 nt, Staphylococcus aureus subsp. aureus Mu50
aacuguuuaucauga

SEQ ID NO: 2069926 - RNA, 22 nt, Staphylococcus aureus subsp. aureus Mu50
aacuguucuuucgucuuguaaa

SEQ ID NO: 2069927 - RNA, 23 nt, Staphylococcus aureus subsp. aureus Mu50
aacuguucuuucgucuuguaaac

SEQ ID NO: 2069928 - RNA, 13 nt, Staphylococcus aureus subsp. aureus Mu50
aacugaauuucgu

SEQ ID NO: 2069929 - RNA, 19 nt, Staphylococcus aureus subsp. aureus Mu50
aacugacccuugucaguuu

SEQ ID NO: 2069930 - RNA, 14 nt, Staphylococcus aureus subsp. aureus Mu50
aacugaaauuuuuc

SEQ ID NO: 2069931 - RNA, 21 nt, Staphylococcus aureus subsp. aureus Mu50
aacugaguucaauuaaauuau

SEQ ID NO: 2069932 - RNA, 17 nt, Staphylococcus aureus subsp. aureus Mu50
aacugaucauuuucauu

SEQ ID NO: 2069933 - RNA, 23 nt, Staphylococcus aureus subsp. aureus Mu50
aacugauaauacuguuuaaauaa

SEQ ID NO: 2069934 - RNA, 17 nt, Staphylococcus aureus subsp. aureus Mu50
aacugauaaaaggggaa

SEQ ID NO: 2069935 - RNA, 23 nt, Staphylococcus aureus subsp. aureus Mu50
aacugaguucaauuaaauuauau

SEQ ID NO: 2069936 - RNA, 21 nt, Staphylococcus aureus subsp. aureus Mu50
aacugaucauuuucauuuaau

SEQ ID NO: 2069937 - RNA, 20 nt, Staphylococcus aureus subsp. aureus Mu50
aacugcauguacaucuuuag

SEQ ID NO: 2069938 - RNA, 15 nt, Staphylococcus aureus subsp. aureus Mu50
aacugcauauaaagu

SEQ ID NO: 2069939 - RNA, 22 nt, Staphylococcus aureus subsp. aureus Mu50
aacugauugggcugauaauaaa

SEQ ID NO: 2069940 - RNA, 13 nt, Staphylococcus aureus subsp. aureus Mu50
aacugauuuuguu

SEQ ID NO: 2069941 - RNA, 17 nt, Staphylococcus aureus subsp. aureus Mu50
aacugauuuuguuucaa

SEQ ID NO: 2069942 - RNA, 18 nt, Staphylococcus aureus subsp. aureus Mu50
aacugcaaacuugauuca

SEQ ID NO: 2069943 - RNA, 20 nt, Staphylococcus aureus subsp. aureus Mu50
aacugcaaagccauguguag

SEQ ID NO: 2069944 - RNA, 14 nt, Staphylococcus aureus subsp. aureus Mu50
aacugcauaaaagc

SEQ ID NO: 2069945 - RNA, 14 nt, Staphylococcus aureus subsp. aureus Mu50
aacugcuaauuuuu

SEQ ID NO: 2069946 - RNA, 19 nt, Staphylococcus aureus subsp. aureus Mu50
aacugcugcuaaaauaaaa

SEQ ID NO: 2069947 - RNA, 20 nt, Staphylococcus aureus subsp. aureus Mu50
aacucgcauugccuguagaa

SEQ ID NO: 2069948 - RNA, 20 nt, Staphylococcus aureus subsp. aureus Mu50
aacucguuauagauaaguag

SEQ ID NO: 2069949 - RNA, 19 nt, Staphylococcus aureus subsp. aureus Mu50
aacucguuauagauaagua

SEQ ID NO: 2069950 - RNA, 21 nt, Staphylococcus aureus subsp. aureus Mu50
aacucuuuuaacccacauuaa

SEQ ID NO: 2069951 - RNA, 14 nt, Staphylococcus aureus subsp. aureus Mu50
aacucugagcacuu

SEQ ID NO: 2069952 - RNA, 22 nt, Staphylococcus aureus subsp. aureus Mu50
aacucugauauugaucugauuu

SEQ ID NO: 2069953 - RNA, 24 nt, Staphylococcus aureus subsp. aureus Mu50
aacucuaaauauaauagaaauaau

SEQ ID NO: 2069954 - RNA, 16 nt, Staphylococcus aureus subsp. aureus Mu50
aacucuaaauauaaua

SEQ ID NO: 2069955 - RNA, 15 nt, Staphylococcus aureus subsp. aureus Mu50
aacucaacuuaaaua

SEQ ID NO: 2069956 - RNA, 17 nt, Staphylococcus aureus subsp. aureus Mu50
aacucaaaaagccaaca

SEQ ID NO: 2069957 - RNA, 17 nt, Staphylococcus aureus subsp. aureus Mu50
aacuauuaucgaagaaa

SEQ ID NO: 2069958 - RNA, 12 nt, Staphylococcus aureus subsp. aureus Mu50
aacuauucccac

SEQ ID NO: 2069959 - RNA, 16 nt, Staphylococcus aureus subsp. aureus Mu50
aacuaugaauagauga

SEQ ID NO: 2069960 - RNA, 22 nt, Staphylococcus aureus subsp. aureus Mu50
aacuauguuacuuauauauuca

SEQ ID NO: 2069961 - RNA, 14 nt, Staphylococcus aureus subsp. aureus Mu50
aacuaucugauuaa

SEQ ID NO: 2069962 - RNA, 16 nt, Staphylococcus aureus subsp. aureus Mu50
aacucauaccaaaaac

SEQ ID NO: 2069963 - RNA, 23 nt, Staphylococcus aureus subsp. aureus Mu50
aacuaaaaagcgugguucccaau

SEQ ID NO: 2069964 - RNA, 11 nt, Staphylococcus aureus subsp. aureus Mu50
aacuaaaaugu

SEQ ID NO: 2069965 - RNA, 18 nt, Staphylococcus aureus subsp. aureus Mu50
aacuaacacgucacaugg

SEQ ID NO: 2069966 - RNA, 17 nt, Staphylococcus aureus subsp. aureus Mu50
aacuaacauaauuuuua

SEQ ID NO: 2069967 - RNA, 14 nt, Staphylococcus aureus subsp. aureus Mu50
aacuaaauuaaaag

SEQ ID NO: 2069968 - RNA, 16 nt, Staphylococcus aureus subsp. aureus Mu50
aacuaacuaauaacuc

SEQ ID NO: 2069969 - RNA, 12 nt, Staphylococcus aureus subsp. aureus Mu50
aacuaagauaua

SEQ ID NO: 2069970 - RNA, 16 nt, Staphylococcus aureus subsp. aureus Mu50
aacuaauaacaaauag

SEQ ID NO: 2069971 - RNA, 17 nt, Staphylococcus aureus subsp. aureus Mu50
aacuaauagcauuugua

SEQ ID NO: 2069972 - RNA, 20 nt, Staphylococcus aureus subsp. aureus Mu50
aacuaauaauuuguaauucc

SEQ ID NO: 2069973 - RNA, 16 nt, Staphylococcus aureus subsp. aureus Mu50
aacuaauguuaaaaua

SEQ ID NO: 2069974 - RNA, 16 nt, Staphylococcus aureus subsp. aureus Mu50
aacuaauuuaaagcau

SEQ ID NO: 2069975 - RNA, 17 nt, Staphylococcus aureus subsp. aureus Mu50
aacuaaguuauuuagua

SEQ ID NO: 2069976 - RNA, 14 nt, Staphylococcus aureus subsp. aureus Mu50
aacuacgcauuuua

SEQ ID NO: 2069977 - RNA, 20 nt, Staphylococcus aureus subsp. aureus Mu50
aacuacgauaccggcaacug

SEQ ID NO: 2069978 - RNA, 17 nt, Staphylococcus aureus subsp. aureus Mu50
aacuauaauaauuggaa

SEQ ID NO: 2069979 - RNA, 19 nt, Staphylococcus aureus subsp. aureus Mu50
aacuauaaccuauuaaauc

SEQ ID NO: 2069980 - RNA, 18 nt, Staphylococcus aureus subsp. aureus Mu50
aacuauaauaaagauuau

SEQ ID NO: 2069981 - RNA, 19 nt, Staphylococcus aureus subsp. aureus Mu50
aacuauaauaaagauuaua

SEQ ID NO: 2069982 - RNA, 15 nt, Staphylococcus aureus subsp. aureus Mu50
aacuagaaugauuaa

SEQ ID NO: 2069983 - RNA, 18 nt, Staphylococcus aureus subsp. aureus Mu50
aacuacuuaaauuaagaa

SEQ ID NO: 2069984 - RNA, 13 nt, Staphylococcus aureus subsp. aureus Mu50
aacuacuucauca

SEQ ID NO: 2069985 - RNA, 22 nt, Staphylococcus aureus subsp. aureus Mu50
aacgucacaugccaucuuugua

SEQ ID NO: 2069986 - RNA, 22 nt, Staphylococcus aureus subsp. aureus Mu50
aacgucauauguuuuauaauaa

SEQ ID NO: 2069987 - RNA, 15 nt, Staphylococcus aureus subsp. aureus Mu50
aacguaucauuuaaa

SEQ ID NO: 2069988 - RNA, 18 nt, Staphylococcus aureus subsp. aureus Mu50
aacguauauaaguuaaaa

SEQ ID NO: 2069989 - RNA, 18 nt, Staphylococcus aureus subsp. aureus Mu50
aacguuauucguuaacaa

SEQ ID NO: 2069990 - RNA, 20 nt, Staphylococcus aureus subsp. aureus Mu50
aacguuauucguuaacaauc

SEQ ID NO: 2069991 - RNA, 16 nt, Staphylococcus aureus subsp. aureus Mu50
aacguuauuuucaaua

SEQ ID NO: 2069992 - RNA, 19 nt, Staphylococcus aureus subsp. aureus Mu50
aacguucaaucguuucuuc

SEQ ID NO: 2069993 - RNA, 17 nt, Staphylococcus aureus subsp. aureus Mu50
aacguugaguauuacuu

SEQ ID NO: 2069994 - RNA, 23 nt, Staphylococcus aureus subsp. aureus Mu50
aacguugccauacccauauuaaa

SEQ ID NO: 2069995 - RNA, 15 nt, Staphylococcus aureus subsp. aureus Mu50
aacguacauuuauga

SEQ ID NO: 2069996 - RNA, 19 nt, Staphylococcus aureus subsp. aureus Mu50
aacguacaauguauuaccu

SEQ ID NO: 2069997 - RNA, 18 nt, Staphylococcus aureus subsp. aureus Mu50
aacgcucaacuauauaua

SEQ ID NO: 2069998 - RNA, 16 nt, Staphylococcus aureus subsp. aureus Mu50
aacgcuaauuuuacuc

SEQ ID NO: 2069999 - RNA, 22 nt, Staphylococcus aureus subsp. aureus Mu50
aacgcuuugcagauugauauaa

SEQ ID NO: 2070000 - RNA, 20 nt, Staphylococcus aureus subsp. aureus Mu50
aacgcauauucuauuguugu

SEQ ID NO: 2070001 - RNA, 18 nt, Staphylococcus aureus subsp. aureus Mu50
aacgccucaacacuuucu

SEQ ID NO: 2070002 - RNA, 23 nt, Staphylococcus aureus subsp. aureus Mu50
aacgauaagauagcuauauuuag

SEQ ID NO: 2070003 - RNA, 14 nt, Staphylococcus aureus subsp. aureus Mu50
aacgaggucuuuuu

SEQ ID NO: 2070004 - RNA, 18 nt, Staphylococcus aureus subsp. aureus Mu50
aacgagucauaaauauaa

SEQ ID NO: 2070005 - RNA, 15 nt, Staphylococcus aureus subsp. aureus Mu50
aacgauaccaaauau

SEQ ID NO: 2070006 - RNA, 18 nt, Staphylococcus aureus subsp. aureus Mu50
aacgauaccaaauauauu

SEQ ID NO: 2070007 - RNA, 23 nt, Staphylococcus aureus subsp. aureus Mu50
aacgauagauucugauacagaac

SEQ ID NO: 2070008 - RNA, 13 nt, Staphylococcus aureus subsp. aureus Mu50
aacgacuaaccac

SEQ ID NO: 2070009 - RNA, 16 nt, Staphylococcus aureus subsp. aureus Mu50
aacgacuaaccacauu

SEQ ID NO: 2070010 - RNA, 17 nt, Staphylococcus aureus subsp. aureus Mu50
aacgagcuggugagaaa

SEQ ID NO: 2070011 - RNA, 19 nt, Staphylococcus aureus subsp. aureus Mu50
aacgaucuguccauuuauc

SEQ ID NO: 2070012 - RNA, 14 nt, Staphylococcus aureus subsp. aureus Mu50
aaccuaaaaacaaa

SEQ ID NO: 2070013 - RNA, 13 nt, Staphylococcus aureus subsp. aureus Mu50
aaccuaaaaacaa

SEQ ID NO: 2070014 - RNA, 15 nt, Staphylococcus aureus subsp. aureus Mu50
aaccguuauauauua

SEQ ID NO: 2070015 - RNA, 18 nt, Staphylococcus aureus subsp. aureus Mu50
aaccgucacaaaccauuc

SEQ ID NO: 2070016 - RNA, 13 nt, Staphylococcus aureus subsp. aureus Mu50
aaccuauuaauua

SEQ ID NO: 2070017 - RNA, 23 nt, Staphylococcus aureus subsp. aureus Mu50
aaccuagggauaauuuuauugac

SEQ ID NO: 2070018 - RNA, 16 nt, Staphylococcus aureus subsp. aureus Mu50
aaccuaaugcuuuaau

SEQ ID NO: 2070019 - RNA, 20 nt, Staphylococcus aureus subsp. aureus Mu50
aaccuaaagauaauauuaaa

SEQ ID NO: 2070020 - RNA, 17 nt, Staphylococcus aureus subsp. aureus Mu50
aaccuaaagauaauauu

SEQ ID NO: 2070021 - RNA, 22 nt, Staphylococcus aureus subsp. aureus Mu50
aaccugagccauaacugaauaa

SEQ ID NO: 2070022 - RNA, 15 nt, Staphylococcus aureus subsp. aureus Mu50
aacgacacuuuuuag

SEQ ID NO: 2070023 - RNA, 17 nt, Staphylococcus aureus subsp. aureus Mu50
aacgaauguuccuuguu

SEQ ID NO: 2070024 - RNA, 22 nt, Staphylococcus aureus subsp. aureus Mu50
aacgaaucgccuacuauaaaua

SEQ ID NO: 2070025 - RNA, 20 nt, Staphylococcus aureus subsp. aureus Mu50
aaccuuuuuguuuucaauaa

SEQ ID NO: 2070026 - RNA, 18 nt, Staphylococcus aureus subsp. aureus Mu50
aaccuuggcuucauguuc

SEQ ID NO: 2070027 - RNA, 14 nt, Staphylococcus aureus subsp. aureus Mu50
aaccuuuaaaacau

SEQ ID NO: 2070028 - RNA, 15 nt, Staphylococcus aureus subsp. aureus Mu50
aaccuuuaaaaguaa

SEQ ID NO: 2070029 - RNA, 15 nt, Staphylococcus aureus subsp. aureus Mu50
aaccuuuucaaauua

SEQ ID NO: 2070030 - RNA, 21 nt, Staphylococcus aureus subsp. aureus Mu50
aaccuuugguuguuaggggcu

SEQ ID NO: 2070031 - RNA, 17 nt, Staphylococcus aureus subsp. aureus Mu50
aaccuuacccaaaaaau

SEQ ID NO: 2070032 - RNA, 19 nt, Staphylococcus aureus subsp. aureus Mu50
aaucauucacuucaaguua

SEQ ID NO: 2070033 - RNA, 15 nt, Staphylococcus aureus subsp. aureus Mu50
aaucauucguuuaau

SEQ ID NO: 2070034 - RNA, 17 nt, Staphylococcus aureus subsp. aureus Mu50
aaucauuaauaauuaaa

SEQ ID NO: 2070035 - RNA, 16 nt, Staphylococcus aureus subsp. aureus Mu50
aaucaucgcaaauaca

SEQ ID NO: 2070036 - RNA, 18 nt, Staphylococcus aureus subsp. aureus Mu50
aaucaucguauuucauau

SEQ ID NO: 2070037 - RNA, 15 nt, Staphylococcus aureus subsp. aureus Mu50
aaucaucuuuuugaa

SEQ ID NO: 2070038 - RNA, 15 nt, Staphylococcus aureus subsp. aureus Mu50
aaucaugcauucuau

SEQ ID NO: 2070039 - RNA, 21 nt, Staphylococcus aureus subsp. aureus Mu50
aaucaugcucguuuuuauuca

SEQ ID NO: 2070040 - RNA, 13 nt, Staphylococcus aureus subsp. aureus Mu50
aaucauaaugaau

SEQ ID NO: 2070041 - RNA, 20 nt, Staphylococcus aureus subsp. aureus Mu50
aaucauaaugaauaauuaaa

SEQ ID NO: 2070042 - RNA, 12 nt, Staphylococcus aureus subsp. aureus Mu50
aaucauagauau

SEQ ID NO: 2070043 - RNA, 22 nt, Staphylococcus aureus subsp. aureus Mu50
aaucauagauauaagaaaucca

SEQ ID NO: 2070044 - RNA, 20 nt, Staphylococcus aureus subsp. aureus Mu50
aaucauagaggcacagugga

SEQ ID NO: 2070045 - RNA, 20 nt, Staphylococcus aureus subsp. aureus Mu50
aaucauagcaacaucggcac

SEQ ID NO: 2070046 - RNA, 17 nt, Staphylococcus aureus subsp. aureus Mu50
aaucaguaauaucaagg

SEQ ID NO: 2070047 - RNA, 19 nt, Staphylococcus aureus subsp. aureus Mu50
aaucaguaguuuuaaaagu

SEQ ID NO: 2070048 - RNA, 17 nt, Staphylococcus aureus subsp. aureus Mu50
aaucagcuuuuucacau

SEQ ID NO: 2070049 - RNA, 24 nt, Staphylococcus aureus subsp. aureus Mu50
aaucagcuuuuucacauugccuaa

SEQ ID NO: 2070050 - RNA, 14 nt, Staphylococcus aureus subsp. aureus Mu50
aauauuaaauucau

SEQ ID NO: 2070051 - RNA, 18 nt, Staphylococcus aureus subsp. aureus Mu50
aauauuaaaauuaaaacu

SEQ ID NO: 2070052 - RNA, 13 nt, Staphylococcus aureus subsp. aureus Mu50
aauauuaaauuau

SEQ ID NO: 2070053 - RNA, 11 nt, Staphylococcus aureus subsp. aureus Mu50
aauauuaaaau

SEQ ID NO: 2070054 - RNA, 12 nt, Staphylococcus aureus subsp. aureus Mu50
aauauuaaaauc

SEQ ID NO: 2070055 - RNA, 19 nt, Staphylococcus aureus subsp. aureus Mu50
aauaugguuucuuauuaaa

SEQ ID NO: 2070056 - RNA, 21 nt, Staphylococcus aureus subsp. aureus Mu50
aauaugguuucuuauuaaaua

SEQ ID NO: 2070057 - RNA, 17 nt, Staphylococcus aureus subsp. aureus Mu50
aauauguaaucagguuu

SEQ ID NO: 2070058 - RNA, 18 nt, Staphylococcus aureus subsp. aureus Mu50
aauccaagauauauaacu

SEQ ID NO: 2070059 - RNA, 17 nt, Staphylococcus aureus subsp. aureus Mu50
aauccaauauacaaugc

SEQ ID NO: 2070060 - RNA, 19 nt, Staphylococcus aureus subsp. aureus Mu50
aaucauuguaaaugaucau

SEQ ID NO: 2070061 - RNA, 15 nt, Staphylococcus aureus subsp. aureus Mu50
aaucauuguggcuuu

SEQ ID NO: 2070062 - RNA, 18 nt, Staphylococcus aureus subsp. aureus Mu50
aaucauugguuucaucau

SEQ ID NO: 2070063 - RNA, 21 nt, Staphylococcus aureus subsp. aureus Mu50
aaucauuguggcuuuuuuuau

SEQ ID NO: 2070064 - RNA, 18 nt, Staphylococcus aureus subsp. aureus Mu50
aauccauucuucuuguuu

SEQ ID NO: 2070065 - RNA, 14 nt, Staphylococcus aureus subsp. aureus Mu50
aaucuacaauauua

SEQ ID NO: 2070066 - RNA, 12 nt, Staphylococcus aureus subsp. aureus Mu50
aaucuacaauau

SEQ ID NO: 2070067 - RNA, 18 nt, Staphylococcus aureus subsp. aureus Mu50
aaucuacgauuuucaaga

SEQ ID NO: 2070068 - RNA, 18 nt, Staphylococcus aureus subsp. aureus Mu50
aaucuagaauauaacaac

SEQ ID NO: 2070069 - RNA, 15 nt, Staphylococcus aureus subsp. aureus Mu50
aaucguaucuucacu

SEQ ID NO: 2070070 - RNA, 20 nt, Staphylococcus aureus subsp. aureus Mu50
aaucguaacauaucagcuuu

SEQ ID NO: 2070071 - RNA, 17 nt, Staphylococcus aureus subsp. aureus Mu50
aaucgcauuuaaauaua

SEQ ID NO: 2070072 - RNA, 15 nt, Staphylococcus aureus subsp. aureus Mu50
aaucgcauuuaaaua

SEQ ID NO: 2070073 - RNA, 17 nt, Staphylococcus aureus subsp. aureus Mu50
aauccuuggaaacgaua

SEQ ID NO: 2070074 - RNA, 13 nt, Staphylococcus aureus subsp. aureus Mu50
aauccugauucca

SEQ ID NO: 2070075 - RNA, 23 nt, Staphylococcus aureus subsp. aureus Mu50
aauccucaguuauaccauauuua

SEQ ID NO: 2070076 - RNA, 21 nt, Staphylococcus aureus subsp. aureus Mu50
aauccuauggcgcaauuuuua

SEQ ID NO: 2070077 - RNA, 23 nt, Staphylococcus aureus subsp. aureus Mu50
aauccguaacgaugguugcuuca

SEQ ID NO: 2070078 - RNA, 21 nt, Staphylococcus aureus subsp. aureus Mu50
aaucccaaguuacaauaucau

SEQ ID NO: 2070079 - RNA, 19 nt, Staphylococcus aureus subsp. aureus Mu50
aaucccauaaugacuauaa

SEQ ID NO: 2070080 - RNA, 20 nt, Staphylococcus aureus subsp. aureus Mu50
aauccgauuuugauauaaaa

SEQ ID NO: 2070081 - RNA, 20 nt, Staphylococcus aureus subsp. aureus Mu50
aaucuguacuucuaauuugc

SEQ ID NO: 2070082 - RNA, 21 nt, Staphylococcus aureus subsp. aureus Mu50
aaucuguuuaaauuuaaaaga

SEQ ID NO: 2070083 - RNA, 19 nt, Staphylococcus aureus subsp. aureus Mu50
aaucuguucauaauguaag

SEQ ID NO: 2070084 - RNA, 14 nt, Staphylococcus aureus subsp. aureus Mu50
aaucuuaauugucu

SEQ ID NO: 2070085 - RNA, 14 nt, Staphylococcus aureus subsp. aureus Mu50
aaucuauugcaaua

SEQ ID NO: 2070086 - RNA, 15 nt, Staphylococcus aureus subsp. aureus Mu50
aaucuauaccauucc

SEQ ID NO: 2070087 - RNA, 21 nt, Staphylococcus aureus subsp. aureus Mu50
aaucuauaccauuccaaaaau

SEQ ID NO: 2070088 - RNA, 21 nt, Staphylococcus aureus subsp. aureus Mu50
aaucuauuaaugcucuauaua

SEQ ID NO: 2070089 - RNA, 18 nt, Staphylococcus aureus subsp. aureus Mu50
aaucuauggaaaauguua

SEQ ID NO: 2070090 - RNA, 22 nt, Staphylococcus aureus subsp. aureus Mu50
aaucuuauuuuguuuuaaaaaa

SEQ ID NO: 2070091 - RNA, 13 nt, Staphylococcus aureus subsp. aureus Mu50
aaucuuaguuaaa

SEQ ID NO: 2070092 - RNA, 18 nt, Staphylococcus aureus subsp. aureus Mu50
aaucuuaguuaaaauuca

SEQ ID NO: 2070093 - RNA, 21 nt, Staphylococcus aureus subsp. aureus Mu50
aaucuuuugagacguuuucca

SEQ ID NO: 2070094 - RNA, 21 nt, Staphylococcus aureus subsp. aureus Mu50
aaucuuuuguaagacuuccca

SEQ ID NO: 2070095 - RNA, 12 nt, Staphylococcus aureus subsp. aureus Mu50
aaucuuuuaacu

SEQ ID NO: 2070096 - RNA, 13 nt, Staphylococcus aureus subsp. aureus Mu50
aaucuuuuaacuu

SEQ ID NO: 2070097 - RNA, 20 nt, Staphylococcus aureus subsp. aureus Mu50
aaucuuuguuauauuuuuag

SEQ ID NO: 2070098 - RNA, 17 nt, Staphylococcus aureus subsp. aureus Mu50
aaugaaccagcuaacca

SEQ ID NO: 2070099 - RNA, 20 nt, Staphylococcus aureus subsp. aureus Mu50
aaugaaccagcuaaccaaau

SEQ ID NO: 2070100 - RNA, 18 nt, Staphylococcus aureus subsp. aureus Mu50
aaugagcuuuucuaaugc

SEQ ID NO: 2070101 - RNA, 18 nt, Staphylococcus aureus subsp. aureus Mu50
aaugaucaucuauauuua

SEQ ID NO: 2070102 - RNA, 15 nt, Staphylococcus aureus subsp. aureus Mu50
aaugauuugugguaa

SEQ ID NO: 2070103 - RNA, 19 nt, Staphylococcus aureus subsp. aureus Mu50
aaugauuugugguaaucau

SEQ ID NO: 2070104 - RNA, 19 nt, Staphylococcus aureus subsp. aureus Mu50
aaugauuuuauaauauuau

SEQ ID NO: 2070105 - RNA, 17 nt, Staphylococcus aureus subsp. aureus Mu50
aaugauggguaguuaau

SEQ ID NO: 2070106 - RNA, 16 nt, Staphylococcus aureus subsp. aureus Mu50
aaugcaacuaaaacua

SEQ ID NO: 2070107 - RNA, 21 nt, Staphylococcus aureus subsp. aureus Mu50
aaugacgugcuuuuaaaugua

SEQ ID NO: 2070108 - RNA, 19 nt, Staphylococcus aureus subsp. aureus Mu50
aaugagcaucuugucuagu

SEQ ID NO: 2070109 - RNA, 16 nt, Staphylococcus aureus subsp. aureus Mu50
aaugaaucaauugcau

SEQ ID NO: 2070110 - RNA, 18 nt, Staphylococcus aureus subsp. aureus Mu50
aaugaauaaugacaaauu

SEQ ID NO: 2070111 - RNA, 14 nt, Staphylococcus aureus subsp. aureus Mu50
aaugaauaauucca

SEQ ID NO: 2070112 - RNA, 12 nt, Staphylococcus aureus subsp. aureus Mu50
aaugaauaauug

SEQ ID NO: 2070113 - RNA, 22 nt, Staphylococcus aureus subsp. aureus Mu50
aaugaauaaucaaaguucguaa

SEQ ID NO: 2070114 - RNA, 21 nt, Staphylococcus aureus subsp. aureus Mu50
aaugaauaaugacaaauuauc

SEQ ID NO: 2070115 - RNA, 20 nt, Staphylococcus aureus subsp. aureus Mu50
aaugaccggcauauaaucca

SEQ ID NO: 2070116 - RNA, 15 nt, Staphylococcus aureus subsp. aureus Mu50
aaugaauuauuuaaa

SEQ ID NO: 2070117 - RNA, 13 nt, Staphylococcus aureus subsp. aureus Mu50
aaugcgcaaugaa

SEQ ID NO: 2070118 - RNA, 16 nt, Staphylococcus aureus subsp. aureus Mu50
aaugcgacaucgccaa

SEQ ID NO: 2070119 - RNA, 17 nt, Staphylococcus aureus subsp. aureus Mu50
aaugcauuacuacuuua

SEQ ID NO: 2070120 - RNA, 19 nt, Staphylococcus aureus subsp. aureus Mu50
aaugcauccaaauauuaaa

SEQ ID NO: 2070121 - RNA, 20 nt, Staphylococcus aureus subsp. aureus Mu50
aaugcagcuguauaaccaua

SEQ ID NO: 2070122 - RNA, 19 nt, Staphylococcus aureus subsp. aureus Mu50
aaugguuucauaaacugaa

SEQ ID NO: 2070123 - RNA, 15 nt, Staphylococcus aureus subsp. aureus Mu50
aaugcuuuaauaaau

SEQ ID NO: 2070124 - RNA, 18 nt, Staphylococcus aureus subsp. aureus Mu50
aaugcuugaauuuuauua

SEQ ID NO: 2070125 - RNA, 16 nt, Staphylococcus aureus subsp. aureus Mu50
aaugcuucaaauguaa

SEQ ID NO: 2070126 - RNA, 13 nt, Staphylococcus aureus subsp. aureus Mu50
aaugcuuauauaa

SEQ ID NO: 2070127 - RNA, 15 nt, Staphylococcus aureus subsp. aureus Mu50
aaugcuguuuuaugg

SEQ ID NO: 2070128 - RNA, 21 nt, Staphylococcus aureus subsp. aureus Mu50
aaugcguggauguguuuuaau

SEQ ID NO: 2070129 - RNA, 16 nt, Staphylococcus aureus subsp. aureus Mu50
aauucaggaaaugcau

SEQ ID NO: 2070130 - RNA, 14 nt, Staphylococcus aureus subsp. aureus Mu50
aauucauaaaugcu

SEQ ID NO: 2070131 - RNA, 23 nt, Staphylococcus aureus subsp. aureus Mu50
aauucaguaaucuuguuuucauu

SEQ ID NO: 2070132 - RNA, 20 nt, Staphylococcus aureus subsp. aureus Mu50
aauucaguaucuaaauauua

SEQ ID NO: 2070133 - RNA, 11 nt, Staphylococcus aureus subsp. aureus Mu50
aauucacuuua

SEQ ID NO: 2070134 - RNA, 15 nt, Staphylococcus aureus subsp. aureus Mu50
aauucacgagcugcu

SEQ ID NO: 2070135 - RNA, 17 nt, Staphylococcus aureus subsp. aureus Mu50
aauucacgcaauaucau

SEQ ID NO: 2070136 - RNA, 21 nt, Staphylococcus aureus subsp. aureus Mu50
aauucauuuuauaaaucaaag

SEQ ID NO: 2070137 - RNA, 17 nt, Staphylococcus aureus subsp. aureus Mu50
aauuccaaagaaagcua

SEQ ID NO: 2070138 - RNA, 15 nt, Staphylococcus aureus subsp. aureus Mu50
aauuccauuaaguua

SEQ ID NO: 2070139 - RNA, 18 nt, Staphylococcus aureus subsp. aureus Mu50
aauucccauguauucuua

SEQ ID NO: 2070140 - RNA, 19 nt, Staphylococcus aureus subsp. aureus Mu50
aauucuauuuuugauuuaa

SEQ ID NO: 2070141 - RNA, 13 nt, Staphylococcus aureus subsp. aureus Mu50
aauucuauuuuug

SEQ ID NO: 2070142 - RNA, 20 nt, Staphylococcus aureus subsp. aureus Mu50
aauucucuuuguuggggccc

SEQ ID NO: 2070143 - RNA, 17 nt, Staphylococcus aureus subsp. aureus Mu50
aauucugaaaucaguuu

SEQ ID NO: 2070144 - RNA, 22 nt, Staphylococcus aureus subsp. aureus Mu50
aauucguuuugcuaaccaucau

SEQ ID NO: 2070145 - RNA, 15 nt, Staphylococcus aureus subsp. aureus Mu50
aauucuaaaagaauu

SEQ ID NO: 2070146 - RNA, 16 nt, Staphylococcus aureus subsp. aureus Mu50
aauucuaaaagaauua

SEQ ID NO: 2070147 - RNA, 20 nt, Staphylococcus aureus subsp. aureus Mu50
aauucguuuugcuaaccauc

SEQ ID NO: 2070148 - RNA, 14 nt, Staphylococcus aureus subsp. aureus Mu50
aauucuaacugcaa

SEQ ID NO: 2070149 - RNA, 17 nt, Staphylococcus aureus subsp. aureus Mu50
aauucuauaauuuuaau

SEQ ID NO: 2070150 - RNA, 19 nt, Staphylococcus aureus subsp. aureus Mu50
aauucgacucaaacaauaa

SEQ ID NO: 2070151 - RNA, 22 nt, Staphylococcus aureus subsp. aureus Mu50
aauucgccuaaaugguuuugaa

SEQ ID NO: 2070152 - RNA, 21 nt, Staphylococcus aureus subsp. aureus Mu50
aauucgccuaaaugguuuuga

SEQ ID NO: 2070153 - RNA, 22 nt, Staphylococcus aureus subsp. aureus Mu50
aauucgcuugauuaauuuuauc

SEQ ID NO: 2070154 - RNA, 13 nt, Staphylococcus aureus subsp. aureus Mu50
aauucguugauuu

SEQ ID NO: 2070155 - RNA, 19 nt, Staphylococcus aureus subsp. aureus Mu50
aauucgucuguuucauaua

SEQ ID NO: 2070156 - RNA, 21 nt, Staphylococcus aureus subsp. aureus Mu50
aauuccucuggaacuuuaaua

SEQ ID NO: 2070157 - RNA, 13 nt, Staphylococcus aureus subsp. aureus Mu50
aauuccuucuaua

SEQ ID NO: 2070158 - RNA, 21 nt, Staphylococcus aureus subsp. aureus Mu50
aauuccuggugcaauaauaaa

SEQ ID NO: 2070159 - RNA, 23 nt, Staphylococcus aureus subsp. aureus Mu50
aauuagguauaguguuugacaag

SEQ ID NO: 2070160 - RNA, 14 nt, Staphylococcus aureus subsp. aureus Mu50
aauuagauuuuguu

SEQ ID NO: 2070161 - RNA, 22 nt, Staphylococcus aureus subsp. aureus Mu50
aauuagccgaaaaacaucauuu

SEQ ID NO: 2070162 - RNA, 21 nt, Staphylococcus aureus subsp. aureus Mu50
aauuagauuuuaugcuuuacu

SEQ ID NO: 2070163 - RNA, 13 nt, Staphylococcus aureus subsp. aureus Mu50
aauuacaacuuuu

SEQ ID NO: 2070164 - RNA, 20 nt, Staphylococcus aureus subsp. aureus Mu50
aauuacaauauaauuuccua

SEQ ID NO: 2070165 - RNA, 18 nt, Staphylococcus aureus subsp. aureus Mu50
aauuacacccuuuaaauu

SEQ ID NO: 2070166 - RNA, 14 nt, Staphylococcus aureus subsp. aureus Mu50
aauuacucuuuuuc

SEQ ID NO: 2070167 - RNA, 20 nt, Staphylococcus aureus subsp. aureus Mu50
aauuacuguaaauaugaacu

SEQ ID NO: 2070168 - RNA, 21 nt, Staphylococcus aureus subsp. aureus Mu50
aauuacuguuaggauaaagau

SEQ ID NO: 2070169 - RNA, 21 nt, Staphylococcus aureus subsp. aureus Mu50
aauguaggcgccauaaucauu

SEQ ID NO: 2070170 - RNA, 14 nt, Staphylococcus aureus subsp. aureus Mu50
aauuaaauucaaau

SEQ ID NO: 2070171 - RNA, 17 nt, Staphylococcus aureus subsp. aureus Mu50
aauuaacaacaaauaua

SEQ ID NO: 2070172 - RNA, 12 nt, Staphylococcus aureus subsp. aureus Mu50
aauuaacaauau

SEQ ID NO: 2070173 - RNA, 11 nt, Staphylococcus aureus subsp. aureus Mu50
aauuaacaaua

SEQ ID NO: 2070174 - RNA, 22 nt, Staphylococcus aureus subsp. aureus Mu50
aauguaagaacgaaacuuuaau

SEQ ID NO: 2070175 - RNA, 21 nt, Staphylococcus aureus subsp. aureus Mu50
aauguaagcaacauaugauuu

SEQ ID NO: 2070176 - RNA, 18 nt, Staphylococcus aureus subsp. aureus Mu50
aauguacauuguaaauau

SEQ ID NO: 2070177 - RNA, 21 nt, Staphylococcus aureus subsp. aureus Mu50
aauguaccgaauccuucauca

SEQ ID NO: 2070178 - RNA, 18 nt, Staphylococcus aureus subsp. aureus Mu50
aauuaauguucaaaaaau

SEQ ID NO: 2070179 - RNA, 13 nt, Staphylococcus aureus subsp. aureus Mu50
aauuaauuaaaau

SEQ ID NO: 2070180 - RNA, 23 nt, Staphylococcus aureus subsp. aureus Mu50
aauuaaccuugauuuaauuuuua

SEQ ID NO: 2070181 - RNA, 18 nt, Staphylococcus aureus subsp. aureus Mu50
aauuaaccuugauuuaau

SEQ ID NO: 2070182 - RNA, 19 nt, Staphylococcus aureus subsp. aureus Mu50
aauuaaccuugauuuaauu

SEQ ID NO: 2070183 - RNA, 22 nt, Staphylococcus aureus subsp. aureus Mu50
aauuaauuacuuucauuguaaa

SEQ ID NO: 2070184 - RNA, 19 nt, Staphylococcus aureus subsp. aureus Mu50
aauuaauuaucauaaagau

SEQ ID NO: 2070185 - RNA, 15 nt, Staphylococcus aureus subsp. aureus Mu50
aauuauuaauuuaau

SEQ ID NO: 2070186 - RNA, 18 nt, Staphylococcus aureus subsp. aureus Mu50
aauuauuaauuuaaucca

SEQ ID NO: 2070187 - RNA, 23 nt, Staphylococcus aureus subsp. aureus Mu50
aauuauuagaacguaauguuaca

SEQ ID NO: 2070188 - RNA, 12 nt, Staphylococcus aureus subsp. aureus Mu50
aauuauuauaau

SEQ ID NO: 2070189 - RNA, 13 nt, Staphylococcus aureus subsp. aureus Mu50
aauuauuauaaua

SEQ ID NO: 2070190 - RNA, 19 nt, Staphylococcus aureus subsp. aureus Mu50
aauuauuauaauaaauaga

SEQ ID NO: 2070191 - RNA, 18 nt, Staphylococcus aureus subsp. aureus Mu50
aauuauuauaguuuagau

SEQ ID NO: 2070192 - RNA, 20 nt, Staphylococcus aureus subsp. aureus Mu50
aauuauguauuuuuauuuau

SEQ ID NO: 2070193 - RNA, 19 nt, Staphylococcus aureus subsp. aureus Mu50
aauuauggagcggaagaua

SEQ ID NO: 2070194 - RNA, 19 nt, Staphylococcus aureus subsp. aureus Mu50
aauuauggcagauccauaa

SEQ ID NO: 2070195 - RNA, 21 nt, Staphylococcus aureus subsp. aureus Mu50
aauuaucuuuacgauaaacua

SEQ ID NO: 2070196 - RNA, 15 nt, Staphylococcus aureus subsp. aureus Mu50
aauuaugacuuauuu

SEQ ID NO: 2070197 - RNA, 23 nt, Staphylococcus aureus subsp. aureus Mu50
aauuaugauuauauuuucucaua

SEQ ID NO: 2070198 - RNA, 19 nt, Staphylococcus aureus subsp. aureus Mu50
aauuaucauuaaauugcuu

SEQ ID NO: 2070199 - RNA, 17 nt, Staphylococcus aureus subsp. aureus Mu50
aauuaucauaaagauaa

SEQ ID NO: 2070200 - RNA, 14 nt, Staphylococcus aureus subsp. aureus Mu50
aauuaucauauaaa

SEQ ID NO: 2070201 - RNA, 20 nt, Staphylococcus aureus subsp. aureus Mu50
aauuaucauaugugauuuaa

SEQ ID NO: 2070202 - RNA, 12 nt, Staphylococcus aureus subsp. aureus Mu50
aauuauauaccc

SEQ ID NO: 2070203 - RNA, 15 nt, Staphylococcus aureus subsp. aureus Mu50
aauuauccuacugcu

SEQ ID NO: 2070204 - RNA, 18 nt, Staphylococcus aureus subsp. aureus Mu50
aauuauauuuauuuguac

SEQ ID NO: 2070205 - RNA, 14 nt, Staphylococcus aureus subsp. aureus Mu50
aauuaucuucauca

SEQ ID NO: 2070206 - RNA, 20 nt, Staphylococcus aureus subsp. aureus Mu50
aauuaucuuaagucaucaau

SEQ ID NO: 2070207 - RNA, 15 nt, Staphylococcus aureus subsp. aureus Mu50
aauuaucuuaaguca

SEQ ID NO: 2070208 - RNA, 13 nt, Staphylococcus aureus subsp. aureus Mu50
aauuauuucucuu

SEQ ID NO: 2070209 - RNA, 16 nt, Staphylococcus aureus subsp. aureus Mu50
aauuauuuaaaaugcu

SEQ ID NO: 2070210 - RNA, 11 nt, Staphylococcus aureus subsp. aureus Mu50
aauuauuucau

SEQ ID NO: 2070211 - RNA, 21 nt, Staphylococcus aureus subsp. aureus Mu50
aauuauuuuucucaacaguuu

SEQ ID NO: 2070212 - RNA, 17 nt, Staphylococcus aureus subsp. aureus Mu50
aauuauuuuaaaaaaug

SEQ ID NO: 2070213 - RNA, 20 nt, Staphylococcus aureus subsp. aureus Mu50
aauuauuauuuaaauuuuca

SEQ ID NO: 2070214 - RNA, 15 nt, Staphylococcus aureus subsp. aureus Mu50
aauuauuuagaaacu

SEQ ID NO: 2070215 - RNA, 19 nt, Staphylococcus aureus subsp. aureus Mu50
aauuauuuauucauuauag

SEQ ID NO: 2070216 - RNA, 18 nt, Staphylococcus aureus subsp. aureus Mu50
aauuauugagaauauuua

SEQ ID NO: 2070217 - RNA, 14 nt, Staphylococcus aureus subsp. aureus Mu50
aauucaauauuaau

SEQ ID NO: 2070218 - RNA, 15 nt, Staphylococcus aureus subsp. aureus Mu50
aauucaaugauuuuu

SEQ ID NO: 2070219 - RNA, 16 nt, Staphylococcus aureus subsp. aureus Mu50
aauucaauaaucuuag

SEQ ID NO: 2070220 - RNA, 20 nt, Staphylococcus aureus subsp. aureus Mu50
aauucaaugauuuuuaaaaa

SEQ ID NO: 2070221 - RNA, 18 nt, Staphylococcus aureus subsp. aureus Mu50
aauucaaaaugccaagaa

SEQ ID NO: 2070222 - RNA, 22 nt, Staphylococcus aureus subsp. aureus Mu50
aauugguuuggauaaaaugaua

SEQ ID NO: 2070223 - RNA, 12 nt, Staphylococcus aureus subsp. aureus Mu50
aauuguaaaucu

SEQ ID NO: 2070224 - RNA, 16 nt, Staphylococcus aureus subsp. aureus Mu50
aauuguaaucuauuuu

SEQ ID NO: 2070225 - RNA, 14 nt, Staphylococcus aureus subsp. aureus Mu50
aauugguuuucaug

SEQ ID NO: 2070226 - RNA, 18 nt, Staphylococcus aureus subsp. aureus Mu50
aauugguuuuuagugaaa

SEQ ID NO: 2070227 - RNA, 23 nt, Staphylococcus aureus subsp. aureus Mu50
aauugguuuuuagugaaaagaac

SEQ ID NO: 2070228 - RNA, 15 nt, Staphylococcus aureus subsp. aureus Mu50
aauuguaaagcauga

SEQ ID NO: 2070229 - RNA, 13 nt, Staphylococcus aureus subsp. aureus Mu50
aauuguauagaau

SEQ ID NO: 2070230 - RNA, 11 nt, Staphylococcus aureus subsp. aureus Mu50
aauuguauaaa

SEQ ID NO: 2070231 - RNA, 22 nt, Staphylococcus aureus subsp. aureus Mu50
aauugugccauuugcaacaaua

SEQ ID NO: 2070232 - RNA, 23 nt, Staphylococcus aureus subsp. aureus Mu50
aauugucguucucguguaaaaug

SEQ ID NO: 2070233 - RNA, 11 nt, Staphylococcus aureus subsp. aureus Mu50
aauuguuaucg

SEQ ID NO: 2070234 - RNA, 13 nt, Staphylococcus aureus subsp. aureus Mu50
aauuguucuaaua

SEQ ID NO: 2070235 - RNA, 19 nt, Staphylococcus aureus subsp. aureus Mu50
aauuguucuaauacaccaa

SEQ ID NO: 2070236 - RNA, 22 nt, Staphylococcus aureus subsp. aureus Mu50
aauuguuaguuuucuuaaaaga

SEQ ID NO: 2070237 - RNA, 16 nt, Staphylococcus aureus subsp. aureus Mu50
aauuguguuucuuuua

SEQ ID NO: 2070238 - RNA, 21 nt, Staphylococcus aureus subsp. aureus Mu50
aauuguguugaaucaacaguu

SEQ ID NO: 2070239 - RNA, 14 nt, Staphylococcus aureus subsp. aureus Mu50
aauuguuuacuaua

SEQ ID NO: 2070240 - RNA, 17 nt, Staphylococcus aureus subsp. aureus Mu50
aauuguucuucagaaac

SEQ ID NO: 2070241 - RNA, 16 nt, Staphylococcus aureus subsp. aureus Mu50
aauuuaaaaagcagua

SEQ ID NO: 2070242 - RNA, 21 nt, Staphylococcus aureus subsp. aureus Mu50
aauuuaaaacaaugauuaaaa

SEQ ID NO: 2070243 - RNA, 15 nt, Staphylococcus aureus subsp. aureus Mu50
aauuuaaaagaaaaa

SEQ ID NO: 2070244 - RNA, 14 nt, Staphylococcus aureus subsp. aureus Mu50
aauuuaaaauaguu

SEQ ID NO: 2070245 - RNA, 19 nt, Staphylococcus aureus subsp. aureus Mu50
aauuuaaaacaaugauuaa

SEQ ID NO: 2070246 - RNA, 14 nt, Staphylococcus aureus subsp. aureus Mu50
aauuuaacaucuuu

SEQ ID NO: 2070247 - RNA, 12 nt, Staphylococcus aureus subsp. aureus Mu50
aauuuaaaugcu

SEQ ID NO: 2070248 - RNA, 19 nt, Staphylococcus aureus subsp. aureus Mu50
aauuuaacggaaauacaau

SEQ ID NO: 2070249 - RNA, 17 nt, Staphylococcus aureus subsp. aureus Mu50
aauuuaacguuuugaug

SEQ ID NO: 2070250 - RNA, 20 nt, Staphylococcus aureus subsp. aureus Mu50
aauuuaacguuauucauuug

SEQ ID NO: 2070251 - RNA, 20 nt, Staphylococcus aureus subsp. aureus Mu50
aauuuaaagucuucaucuuu

SEQ ID NO: 2070252 - RNA, 12 nt, Staphylococcus aureus subsp. aureus Mu50
aauuuaaauauu

SEQ ID NO: 2070253 - RNA, 13 nt, Staphylococcus aureus subsp. aureus Mu50
aauuuaaaugaua

SEQ ID NO: 2070254 - RNA, 15 nt, Staphylococcus aureus subsp. aureus Mu50
aauuuaaacgcacua

SEQ ID NO: 2070255 - RNA, 23 nt, Staphylococcus aureus subsp. aureus Mu50
aauuuaaacgcacuauuuuuaua

SEQ ID NO: 2070256 - RNA, 21 nt, Staphylococcus aureus subsp. aureus Mu50
aauuuaaagaacuauuuuaaa

SEQ ID NO: 2070257 - RNA, 13 nt, Staphylococcus aureus subsp. aureus Mu50
aauuuaaagcauc

SEQ ID NO: 2070258 - RNA, 15 nt, Staphylococcus aureus subsp. aureus Mu50
aauuuaaagcaucau

SEQ ID NO: 2070259 - RNA, 18 nt, Staphylococcus aureus subsp. aureus Mu50
aauuuaaagcaucauaua

SEQ ID NO: 2070260 - RNA, 21 nt, Staphylococcus aureus subsp. aureus Mu50
aauuucacgcugaaauuuuuu

SEQ ID NO: 2070261 - RNA, 17 nt, Staphylococcus aureus subsp. aureus Mu50
aauuucaauuuggaaau

SEQ ID NO: 2070262 - RNA, 19 nt, Staphylococcus aureus subsp. aureus Mu50
aauuucaaaauaguaaagu

SEQ ID NO: 2070263 - RNA, 12 nt, Staphylococcus aureus subsp. aureus Mu50
aauuucaaaaua

SEQ ID NO: 2070264 - RNA, 16 nt, Staphylococcus aureus subsp. aureus Mu50
aauuuauauagucuau

SEQ ID NO: 2070265 - RNA, 22 nt, Staphylococcus aureus subsp. aureus Mu50
aauuuauguguugugauauaua

SEQ ID NO: 2070266 - RNA, 12 nt, Staphylococcus aureus subsp. aureus Mu50
aauuuauuauua

SEQ ID NO: 2070267 - RNA, 13 nt, Staphylococcus aureus subsp. aureus Mu50
aauuuauuauaaa

SEQ ID NO: 2070268 - RNA, 22 nt, Staphylococcus aureus subsp. aureus Mu50
aauuuauuauaaaauagaagua

SEQ ID NO: 2070269 - RNA, 15 nt, Staphylococcus aureus subsp. aureus Mu50
aauuuacgaaaguag

SEQ ID NO: 2070270 - RNA, 18 nt, Staphylococcus aureus subsp. aureus Mu50
aauuuaauugguucuucu

SEQ ID NO: 2070271 - RNA, 17 nt, Staphylococcus aureus subsp. aureus Mu50
aauuuacucaaaccauc

SEQ ID NO: 2070272 - RNA, 13 nt, Staphylococcus aureus subsp. aureus Mu50
aauuuaauaauua

SEQ ID NO: 2070273 - RNA, 19 nt, Staphylococcus aureus subsp. aureus Mu50
aauuuaauacuauaguaag

SEQ ID NO: 2070274 - RNA, 20 nt, Staphylococcus aureus subsp. aureus Mu50
aauuuaauaggcuauguaaa

SEQ ID NO: 2070275 - RNA, 15 nt, Staphylococcus aureus subsp. aureus Mu50
aauuuaauauuauaa

SEQ ID NO: 2070276 - RNA, 12 nt, Staphylococcus aureus subsp. aureus Mu50
aauuuagaugca

SEQ ID NO: 2070277 - RNA, 17 nt, Staphylococcus aureus subsp. aureus Mu50
aauuuaggcaugucaaa

SEQ ID NO: 2070278 - RNA, 15 nt, Staphylococcus aureus subsp. aureus Mu50
aauuuaguauaaaua

SEQ ID NO: 2070279 - RNA, 21 nt, Staphylococcus aureus subsp. aureus Mu50
aauuuaguauaaauaaaaaua

SEQ ID NO: 2070280 - RNA, 18 nt, Staphylococcus aureus subsp. aureus Mu50
aauuuagugaaacaauuu

SEQ ID NO: 2070281 - RNA, 15 nt, Staphylococcus aureus subsp. aureus Mu50
aauuuagucauuaca

SEQ ID NO: 2070282 - RNA, 16 nt, Staphylococcus aureus subsp. aureus Mu50
aauugagaaguauuau

SEQ ID NO: 2070283 - RNA, 19 nt, Staphylococcus aureus subsp. aureus Mu50
aauugacuuuaauugcucu

SEQ ID NO: 2070284 - RNA, 20 nt, Staphylococcus aureus subsp. aureus Mu50
aauugagagaaguuucuaua

SEQ ID NO: 2070285 - RNA, 22 nt, Staphylococcus aureus subsp. aureus Mu50
aauugacuuacauuuuaauaaa

SEQ ID NO: 2070286 - RNA, 11 nt, Staphylococcus aureus subsp. aureus Mu50
aauugaguauu

SEQ ID NO: 2070287 - RNA, 16 nt, Staphylococcus aureus subsp. aureus Mu50
aauugaguuguugcaa

SEQ ID NO: 2070288 - RNA, 22 nt, Staphylococcus aureus subsp. aureus Mu50
aauugaguuguugcaacuugug

SEQ ID NO: 2070289 - RNA, 23 nt, Staphylococcus aureus subsp. aureus Mu50
aauugaguauuaaauuugaaagu

SEQ ID NO: 2070290 - RNA, 19 nt, Staphylococcus aureus subsp. aureus Mu50
aauugaguauuaaauuugu

SEQ ID NO: 2070291 - RNA, 11 nt, Staphylococcus aureus subsp. aureus Mu50
aauugaaaauc

SEQ ID NO: 2070292 - RNA, 15 nt, Staphylococcus aureus subsp. aureus Mu50
aauugaaauuaacug

SEQ ID NO: 2070293 - RNA, 18 nt, Staphylococcus aureus subsp. aureus Mu50
aauugaaauuaacuguau

SEQ ID NO: 2070294 - RNA, 21 nt, Staphylococcus aureus subsp. aureus Mu50
aauugaauuucgcacaauguu

SEQ ID NO: 2070295 - RNA, 22 nt, Staphylococcus aureus subsp. aureus Mu50
aauugaaggccauuuuuauuua

SEQ ID NO: 2070296 - RNA, 23 nt, Staphylococcus aureus subsp. aureus Mu50
aauugaauauuuuucaauuaaau

SEQ ID NO: 2070297 - RNA, 14 nt, Staphylococcus aureus subsp. aureus Mu50
aauugaaugaaaau

SEQ ID NO: 2070298 - RNA, 15 nt, Staphylococcus aureus subsp. aureus Mu50
aauugaaugaaaaua

SEQ ID NO: 2070299 - RNA, 21 nt, Staphylococcus aureus subsp. aureus Mu50
aauucuucaaccauuuguucu

SEQ ID NO: 2070300 - RNA, 22 nt, Staphylococcus aureus subsp. aureus Mu50
aauucuucuuuagauugaucag

SEQ ID NO: 2070301 - RNA, 21 nt, Staphylococcus aureus subsp. aureus Mu50
aauucuuuuucagcuaauugu

SEQ ID NO: 2070302 - RNA, 23 nt, Staphylococcus aureus subsp. aureus Mu50
aauucuuuuucagcuaauugucg

SEQ ID NO: 2070303 - RNA, 15 nt, Staphylococcus aureus subsp. aureus Mu50
aauucuuuuguaauu

SEQ ID NO: 2070304 - RNA, 18 nt, Staphylococcus aureus subsp. aureus Mu50
aauucuuuucaagaaauu

SEQ ID NO: 2070305 - RNA, 23 nt, Staphylococcus aureus subsp. aureus Mu50
aauucuuaaucgagugauucagg

SEQ ID NO: 2070306 - RNA, 16 nt, Staphylococcus aureus subsp. aureus Mu50
aauucuucaaccauuu

SEQ ID NO: 2070307 - RNA, 15 nt, Staphylococcus aureus subsp. aureus Mu50
aauucuuauaaaaua

SEQ ID NO: 2070308 - RNA, 22 nt, Staphylococcus aureus subsp. aureus Mu50
aauucuucaucaauaacuauaa

SEQ ID NO: 2070309 - RNA, 21 nt, Staphylococcus aureus subsp. aureus Mu50
aauucuucaucuucuucaaaa

SEQ ID NO: 2070310 - RNA, 15 nt, Staphylococcus aureus subsp. aureus Mu50
aauucuuaaaaagca

SEQ ID NO: 2070311 - RNA, 20 nt, Staphylococcus aureus subsp. aureus Mu50
aauucugguuuaaugagcuu

SEQ ID NO: 2070312 - RNA, 17 nt, Staphylococcus aureus subsp. aureus Mu50
aauucuggauuaaaccc

SEQ ID NO: 2070313 - RNA, 23 nt, Staphylococcus aureus subsp. aureus Mu50
aauugcauuacuacaaacuugau

SEQ ID NO: 2070314 - RNA, 21 nt, Staphylococcus aureus subsp. aureus Mu50
aauugauugcucuaagcauuc

SEQ ID NO: 2070315 - RNA, 14 nt, Staphylococcus aureus subsp. aureus Mu50
aauugaugauuacu

SEQ ID NO: 2070316 - RNA, 20 nt, Staphylococcus aureus subsp. aureus Mu50
aauugcuauauuaguauaau

SEQ ID NO: 2070317 - RNA, 18 nt, Staphylococcus aureus subsp. aureus Mu50
aauuggauaauuucuucu

SEQ ID NO: 2070318 - RNA, 22 nt, Staphylococcus aureus subsp. aureus Mu50
aauuggcaacggcacauucaua

SEQ ID NO: 2070319 - RNA, 16 nt, Staphylococcus aureus subsp. aureus Mu50
aauuggcagauagaau

SEQ ID NO: 2070320 - RNA, 16 nt, Staphylococcus aureus subsp. aureus Mu50
aauuggauuaaauacg

SEQ ID NO: 2070321 - RNA, 22 nt, Staphylococcus aureus subsp. aureus Mu50
aauuggauuaucgaauuagauu

SEQ ID NO: 2070322 - RNA, 18 nt, Staphylococcus aureus subsp. aureus Mu50
aauugcuuguuuuaaaug

SEQ ID NO: 2070323 - RNA, 13 nt, Staphylococcus aureus subsp. aureus Mu50
aauugcuuguucu

SEQ ID NO: 2070324 - RNA, 16 nt, Staphylococcus aureus subsp. aureus Mu50
aauugcuugaaauuau

SEQ ID NO: 2070325 - RNA, 21 nt, Staphylococcus aureus subsp. aureus Mu50
aauugcuugaaauuauuauuu

SEQ ID NO: 2070326 - RNA, 16 nt, Staphylococcus aureus subsp. aureus Mu50
aagggagcauuucacu

SEQ ID NO: 2070327 - RNA, 20 nt, Staphylococcus aureus subsp. aureus Mu50
aagggaucggucuugaaaac

SEQ ID NO: 2070328 - RNA, 20 nt, Staphylococcus aureus subsp. aureus Mu50
aagggaucguucuuugauua

SEQ ID NO: 2070329 - RNA, 22 nt, Staphylococcus aureus subsp. aureus Mu50
aaggggaugggagaaauuuuuc

SEQ ID NO: 2070330 - RNA, 16 nt, Staphylococcus aureus subsp. aureus Mu50
aaggauguuauaaaau

SEQ ID NO: 2070331 - RNA, 16 nt, Staphylococcus aureus subsp. aureus Mu50
aaggaugaguuuaaaa

SEQ ID NO: 2070332 - RNA, 17 nt, Staphylococcus aureus subsp. aureus Mu50
aaguaauggauugauaa

SEQ ID NO: 2070333 - RNA, 12 nt, Staphylococcus aureus subsp. aureus Mu50
aaguaaauaaua

SEQ ID NO: 2070334 - RNA, 12 nt, Staphylococcus aureus subsp. aureus Mu50
aaguaaaacugc

SEQ ID NO: 2070335 - RNA, 14 nt, Staphylococcus aureus subsp. aureus Mu50
aaguaaaaguuuug

SEQ ID NO: 2070336 - RNA, 15 nt, Staphylococcus aureus subsp. aureus Mu50
aaggucccauuaaaa

SEQ ID NO: 2070337 - RNA, 16 nt, Staphylococcus aureus subsp. aureus Mu50
aaggucaaaaaauuaa

SEQ ID NO: 2070338 - RNA, 17 nt, Staphylococcus aureus subsp. aureus Mu50
aaguacacgaauaccaa

SEQ ID NO: 2070339 - RNA, 19 nt, Staphylococcus aureus subsp. aureus Mu50
aaguacacgaauaccaaga

SEQ ID NO: 2070340 - RNA, 14 nt, Staphylococcus aureus subsp. aureus Mu50
aaguaauuaaauac

SEQ ID NO: 2070341 - RNA, 13 nt, Staphylococcus aureus subsp. aureus Mu50
aaguaauguuaaa

SEQ ID NO: 2070342 - RNA, 17 nt, Staphylococcus aureus subsp. aureus Mu50
aaguacaaauaauacag

SEQ ID NO: 2070343 - RNA, 17 nt, Staphylococcus aureus subsp. aureus Mu50
aaguaauuuaauugguu

SEQ ID NO: 2070344 - RNA, 13 nt, Staphylococcus aureus subsp. aureus Mu50
aaguacaaauaau

SEQ ID NO: 2070345 - RNA, 17 nt, Staphylococcus aureus subsp. aureus Mu50
aaguacuuacaaauaua

SEQ ID NO: 2070346 - RNA, 22 nt, Staphylococcus aureus subsp. aureus Mu50
aaguacuuaccuuucaaauaua

SEQ ID NO: 2070347 - RNA, 14 nt, Staphylococcus aureus subsp. aureus Mu50
aaguacuuuaccac

SEQ ID NO: 2070348 - RNA, 21 nt, Staphylococcus aureus subsp. aureus Mu50
aaguacgacgguauaaaaaaa

SEQ ID NO: 2070349 - RNA, 22 nt, Staphylococcus aureus subsp. aureus Mu50
aaguacgcaauuuaauauuaua

SEQ ID NO: 2070350 - RNA, 13 nt, Staphylococcus aureus subsp. aureus Mu50
aaguauaugaauc

SEQ ID NO: 2070351 - RNA, 14 nt, Staphylococcus aureus subsp. aureus Mu50
aaguauaucuuuga

SEQ ID NO: 2070352 - RNA, 21 nt, Staphylococcus aureus subsp. aureus Mu50
aaguauacuugaagaaucagg

SEQ ID NO: 2070353 - RNA, 17 nt, Staphylococcus aureus subsp. aureus Mu50
aaguaguuguuauauuc

SEQ ID NO: 2070354 - RNA, 13 nt, Staphylococcus aureus subsp. aureus Mu50
aaguaguuucauu

SEQ ID NO: 2070355 - RNA, 16 nt, Staphylococcus aureus subsp. aureus Mu50
aaguauuaugauugcu

SEQ ID NO: 2070356 - RNA, 15 nt, Staphylococcus aureus subsp. aureus Mu50
aaguauuagauauau

SEQ ID NO: 2070357 - RNA, 14 nt, Staphylococcus aureus subsp. aureus Mu50
aaguagauauugaa

SEQ ID NO: 2070358 - RNA, 20 nt, Staphylococcus aureus subsp. aureus Mu50
aagucgcucuagacauuaca

SEQ ID NO: 2070359 - RNA, 13 nt, Staphylococcus aureus subsp. aureus Mu50
aagucauuaaaug

SEQ ID NO: 2070360 - RNA, 16 nt, Staphylococcus aureus subsp. aureus Mu50
aagucauuaaauguac

SEQ ID NO: 2070361 - RNA, 13 nt, Staphylococcus aureus subsp. aureus Mu50
aaguuauaaauua

SEQ ID NO: 2070362 - RNA, 18 nt, Staphylococcus aureus subsp. aureus Mu50
aaguuaggcgacuuaacu

SEQ ID NO: 2070363 - RNA, 18 nt, Staphylococcus aureus subsp. aureus Mu50
aaguuaucaaauugaccg

SEQ ID NO: 2070364 - RNA, 12 nt, Staphylococcus aureus subsp. aureus Mu50
aaguuauaucau

SEQ ID NO: 2070365 - RNA, 15 nt, Staphylococcus aureus subsp. aureus Mu50
aaguuauauaaauuu

SEQ ID NO: 2070366 - RNA, 18 nt, Staphylococcus aureus subsp. aureus Mu50
aaguuauauaaauuugua

SEQ ID NO: 2070367 - RNA, 22 nt, Staphylococcus aureus subsp. aureus Mu50
aaguuaucggcuaaaguuauaa

SEQ ID NO: 2070368 - RNA, 20 nt, Staphylococcus aureus subsp. aureus Mu50
aaguuaugaugggaaaaaau

SEQ ID NO: 2070369 - RNA, 19 nt, Staphylococcus aureus subsp. aureus Mu50
aaguucaaccauaugacuu

SEQ ID NO: 2070370 - RNA, 20 nt, Staphylococcus aureus subsp. aureus Mu50
aagugguuuuacugcuucaa

SEQ ID NO: 2070371 - RNA, 17 nt, Staphylococcus aureus subsp. aureus Mu50
aagugguuguucccauu

SEQ ID NO: 2070372 - RNA, 18 nt, Staphylococcus aureus subsp. aureus Mu50
aaguguaaaugaaaguac

SEQ ID NO: 2070373 - RNA, 19 nt, Staphylococcus aureus subsp. aureus Mu50
aaguguagccaaauaaauu

SEQ ID NO: 2070374 - RNA, 17 nt, Staphylococcus aureus subsp. aureus Mu50
aagugcgguuauuuaua

SEQ ID NO: 2070375 - RNA, 16 nt, Staphylococcus aureus subsp. aureus Mu50
aagugcgguuuaaucu

SEQ ID NO: 2070376 - RNA, 13 nt, Staphylococcus aureus subsp. aureus Mu50
aagugacacugua

SEQ ID NO: 2070377 - RNA, 22 nt, Staphylococcus aureus subsp. aureus Mu50
aagucucuuuugauaaauuccc

SEQ ID NO: 2070378 - RNA, 16 nt, Staphylococcus aureus subsp. aureus Mu50
aagucuguugguuuau

SEQ ID NO: 2070379 - RNA, 20 nt, Staphylococcus aureus subsp. aureus Mu50
aagucugcugguaacucuuc

SEQ ID NO: 2070380 - RNA, 19 nt, Staphylococcus aureus subsp. aureus Mu50
aagugccuugccaugauuu

SEQ ID NO: 2070381 - RNA, 21 nt, Staphylococcus aureus subsp. aureus Mu50
aagugccuugccaugauuuaa

SEQ ID NO: 2070382 - RNA, 17 nt, Staphylococcus aureus subsp. aureus Mu50
aagcugacuuuccacca

SEQ ID NO: 2070383 - RNA, 23 nt, Staphylococcus aureus subsp. aureus Mu50
aagcuuuuuugcuuuuauaauaa

SEQ ID NO: 2070384 - RNA, 14 nt, Staphylococcus aureus subsp. aureus Mu50
aaggaaauggcucc

SEQ ID NO: 2070385 - RNA, 20 nt, Staphylococcus aureus subsp. aureus Mu50
aagcuucuguguuggggccc

SEQ ID NO: 2070386 - RNA, 21 nt, Staphylococcus aureus subsp. aureus Mu50
aagcuuguaauccuuguucua

SEQ ID NO: 2070387 - RNA, 21 nt, Staphylococcus aureus subsp. aureus Mu50
aagcuuuuuugcuuuuauaau

SEQ ID NO: 2070388 - RNA, 12 nt, Staphylococcus aureus subsp. aureus Mu50
aaggacaggaau

SEQ ID NO: 2070389 - RNA, 22 nt, Staphylococcus aureus subsp. aureus Mu50
aaggaacguguucuaaaaguug

SEQ ID NO: 2070390 - RNA, 16 nt, Staphylococcus aureus subsp. aureus Mu50
aagcuaaguuugaagg

SEQ ID NO: 2070391 - RNA, 20 nt, Staphylococcus aureus subsp. aureus Mu50
aagcucauuucaauauuaaa

SEQ ID NO: 2070392 - RNA, 22 nt, Staphylococcus aureus subsp. aureus Mu50
aagcucaugaaucagaugauuu

SEQ ID NO: 2070393 - RNA, 15 nt, Staphylococcus aureus subsp. aureus Mu50
aagcucaugaaucag

SEQ ID NO: 2070394 - RNA, 18 nt, Staphylococcus aureus subsp. aureus Mu50
aagcucaauaaauuauga

SEQ ID NO: 2070395 - RNA, 15 nt, Staphylococcus aureus subsp. aureus Mu50
aagcuaaagaguuau

SEQ ID NO: 2070396 - RNA, 20 nt, Staphylococcus aureus subsp. aureus Mu50
aagcguucucuaauuucaca

SEQ ID NO: 2070397 - RNA, 18 nt, Staphylococcus aureus subsp. aureus Mu50
aagcgcaggcgaaccgaa

SEQ ID NO: 2070398 - RNA, 12 nt, Staphylococcus aureus subsp. aureus Mu50
aagcgcagugac

SEQ ID NO: 2070399 - RNA, 15 nt, Staphylococcus aureus subsp. aureus Mu50
aagcgcagugaccuc

SEQ ID NO: 2070400 - RNA, 23 nt, Staphylococcus aureus subsp. aureus Mu50
aagcccaugcccgauaaaaccac

SEQ ID NO: 2070401 - RNA, 13 nt, Staphylococcus aureus subsp. aureus Mu50
aagccaucaauau

SEQ ID NO: 2070402 - RNA, 15 nt, Staphylococcus aureus subsp. aureus Mu50
aagccaucuuucuuu

SEQ ID NO: 2070403 - RNA, 14 nt, Staphylococcus aureus subsp. aureus Mu50
aagcgcaauuaaaa

SEQ ID NO: 2070404 - RNA, 19 nt, Staphylococcus aureus subsp. aureus Mu50
aagcgauaaaguaugagug

SEQ ID NO: 2070405 - RNA, 20 nt, Staphylococcus aureus subsp. aureus Mu50
aagcgacgauuggaaaguuu

SEQ ID NO: 2070406 - RNA, 16 nt, Staphylococcus aureus subsp. aureus Mu50
aagccuucaauaguuu

SEQ ID NO: 2070407 - RNA, 17 nt, Staphylococcus aureus subsp. aureus Mu50
aagccuucaauaguuuc

SEQ ID NO: 2070408 - RNA, 20 nt, Staphylococcus aureus subsp. aureus Mu50
aagccuucaauaguuucaau

SEQ ID NO: 2070409 - RNA, 21 nt, Staphylococcus aureus subsp. aureus Mu50
aagccuuaaaauauuuaacuu

SEQ ID NO: 2070410 - RNA, 18 nt, Staphylococcus aureus subsp. aureus Mu50
aauauaauuaauuuugua

SEQ ID NO: 2070411 - RNA, 15 nt, Staphylococcus aureus subsp. aureus Mu50
aauauacuaaaguuc

SEQ ID NO: 2070412 - RNA, 17 nt, Staphylococcus aureus subsp. aureus Mu50
aauauacuuaauuuaaa

SEQ ID NO: 2070413 - RNA, 20 nt, Staphylococcus aureus subsp. aureus Mu50
aauauacuuaauuuaaaucu

SEQ ID NO: 2070414 - RNA, 14 nt, Staphylococcus aureus subsp. aureus Mu50
aauaguucaaaaua

SEQ ID NO: 2070415 - RNA, 13 nt, Staphylococcus aureus subsp. aureus Mu50
aauauaauagaaa

SEQ ID NO: 2070416 - RNA, 17 nt, Staphylococcus aureus subsp. aureus Mu50
aauaguuaccaaaauuu

SEQ ID NO: 2070417 - RNA, 23 nt, Staphylococcus aureus subsp. aureus Mu50
aauaguuaccaaaauuugaaaua

SEQ ID NO: 2070418 - RNA, 15 nt, Staphylococcus aureus subsp. aureus Mu50
aauaguuaagauuuu

SEQ ID NO: 2070419 - RNA, 12 nt, Staphylococcus aureus subsp. aureus Mu50
aauagugugcaa

SEQ ID NO: 2070420 - RNA, 20 nt, Staphylococcus aureus subsp. aureus Mu50
aauauaauguauaaaacaga

SEQ ID NO: 2070421 - RNA, 15 nt, Staphylococcus aureus subsp. aureus Mu50
aauauaauagaaaua

SEQ ID NO: 2070422 - RNA, 13 nt, Staphylococcus aureus subsp. aureus Mu50
aauauaauauaca

SEQ ID NO: 2070423 - RNA, 13 nt, Staphylococcus aureus subsp. aureus Mu50
aauauaauuauua

SEQ ID NO: 2070424 - RNA, 15 nt, Staphylococcus aureus subsp. aureus Mu50
aauauacacaaaaag

SEQ ID NO: 2070425 - RNA, 23 nt, Staphylococcus aureus subsp. aureus Mu50
aauauacacaaaaagacuuccaa

SEQ ID NO: 2070426 - RNA, 20 nt, Staphylococcus aureus subsp. aureus Mu50
aauagguuauuugauaauga

SEQ ID NO: 2070427 - RNA, 14 nt, Staphylococcus aureus subsp. aureus Mu50
aauaggucgcugug

SEQ ID NO: 2070428 - RNA, 21 nt, Staphylococcus aureus subsp. aureus Mu50
aauaggcgcuuguaaaauuuu

SEQ ID NO: 2070429 - RNA, 15 nt, Staphylococcus aureus subsp. aureus Mu50
aauaucuaaagauuu

SEQ ID NO: 2070430 - RNA, 18 nt, Staphylococcus aureus subsp. aureus Mu50
aauauccugcaguugauu

SEQ ID NO: 2070431 - RNA, 15 nt, Staphylococcus aureus subsp. aureus Mu50
aauaucugucaaagg

SEQ ID NO: 2070432 - RNA, 15 nt, Staphylococcus aureus subsp. aureus Mu50
aauauccaaaauccu

SEQ ID NO: 2070433 - RNA, 19 nt, Staphylococcus aureus subsp. aureus Mu50
aauaucauauuugaauacu

SEQ ID NO: 2070434 - RNA, 16 nt, Staphylococcus aureus subsp. aureus Mu50
aauaucauauucaaaa

SEQ ID NO: 2070435 - RNA, 16 nt, Staphylococcus aureus subsp. aureus Mu50
aauauaguuaaaguua

SEQ ID NO: 2070436 - RNA, 18 nt, Staphylococcus aureus subsp. aureus Mu50
aauauaucuaauacuuuc

SEQ ID NO: 2070437 - RNA, 22 nt, Staphylococcus aureus subsp. aureus Mu50
aauaucagguacaaauggaaua

SEQ ID NO: 2070438 - RNA, 18 nt, Staphylococcus aureus subsp. aureus Mu50
aauaucauaccguacaaa

SEQ ID NO: 2070439 - RNA, 15 nt, Staphylococcus aureus subsp. aureus Mu50
aauauaguaauaaaa

SEQ ID NO: 2070440 - RNA, 13 nt, Staphylococcus aureus subsp. aureus Mu50
aauacauuuuuau

SEQ ID NO: 2070441 - RNA, 16 nt, Staphylococcus aureus subsp. aureus Mu50
aauaccacuuaaucgu

SEQ ID NO: 2070442 - RNA, 18 nt, Staphylococcus aureus subsp. aureus Mu50
aauacccuacuauauauc

SEQ ID NO: 2070443 - RNA, 22 nt, Staphylococcus aureus subsp. aureus Mu50
aauaauuguucuucagaaacuu

SEQ ID NO: 2070444 - RNA, 20 nt, Staphylococcus aureus subsp. aureus Mu50
aauaauuuuaaaaauaaaaa

SEQ ID NO: 2070445 - RNA, 17 nt, Staphylococcus aureus subsp. aureus Mu50
aauaauuuguaauuccu

SEQ ID NO: 2070446 - RNA, 14 nt, Staphylococcus aureus subsp. aureus Mu50
aauaauuuugauau

SEQ ID NO: 2070447 - RNA, 11 nt, Staphylococcus aureus subsp. aureus Mu50
aauaauugucc

SEQ ID NO: 2070448 - RNA, 17 nt, Staphylococcus aureus subsp. aureus Mu50
aauaauuuacauuaauu

SEQ ID NO: 2070449 - RNA, 16 nt, Staphylococcus aureus subsp. aureus Mu50
aauacgcuugauaaaa

SEQ ID NO: 2070450 - RNA, 21 nt, Staphylococcus aureus subsp. aureus Mu50
aauacgccaaauaucaguaau

SEQ ID NO: 2070451 - RNA, 17 nt, Staphylococcus aureus subsp. aureus Mu50
aauaccuccccaacuua

SEQ ID NO: 2070452 - RNA, 18 nt, Staphylococcus aureus subsp. aureus Mu50
aauaccuaauugcuuaau

SEQ ID NO: 2070453 - RNA, 21 nt, Staphylococcus aureus subsp. aureus Mu50
aauaccuaauugcuuaauauc

SEQ ID NO: 2070454 - RNA, 22 nt, Staphylococcus aureus subsp. aureus Mu50
aauaccuaugauauaugcugca

SEQ ID NO: 2070455 - RNA, 17 nt, Staphylococcus aureus subsp. aureus Mu50
aauaccuaaccauaaca

SEQ ID NO: 2070456 - RNA, 23 nt, Staphylococcus aureus subsp. aureus Mu50
aauaccuaucccuguaaaaccau

SEQ ID NO: 2070457 - RNA, 22 nt, Staphylococcus aureus subsp. aureus Mu50
aauacuuucacuuuuuauauca

SEQ ID NO: 2070458 - RNA, 15 nt, Staphylococcus aureus subsp. aureus Mu50
aauacuuuuuaacug

SEQ ID NO: 2070459 - RNA, 14 nt, Staphylococcus aureus subsp. aureus Mu50
aauacuuuucucga

SEQ ID NO: 2070460 - RNA, 21 nt, Staphylococcus aureus subsp. aureus Mu50
aauagaaaaauuucaaaaaua

SEQ ID NO: 2070461 - RNA, 22 nt, Staphylococcus aureus subsp. aureus Mu50
aauagaaagcgcauuugucauc

SEQ ID NO: 2070462 - RNA, 17 nt, Staphylococcus aureus subsp. aureus Mu50
aauagauaaugcaccug

SEQ ID NO: 2070463 - RNA, 20 nt, Staphylococcus aureus subsp. aureus Mu50
aauacuuucaaacaaaucuu

SEQ ID NO: 2070464 - RNA, 17 nt, Staphylococcus aureus subsp. aureus Mu50
aauacuguauuuuaacg

SEQ ID NO: 2070465 - RNA, 18 nt, Staphylococcus aureus subsp. aureus Mu50
aauagauuuagaaacaau

SEQ ID NO: 2070466 - RNA, 19 nt, Staphylococcus aureus subsp. aureus Mu50
aauagaugagaaaguaaaa

SEQ ID NO: 2070467 - RNA, 20 nt, Staphylococcus aureus subsp. aureus Mu50
aauagcauuccuaauuauau

SEQ ID NO: 2070468 - RNA, 22 nt, Staphylococcus aureus subsp. aureus Mu50
aauagcagggugcuaaauuuac

SEQ ID NO: 2070469 - RNA, 15 nt, Staphylococcus aureus subsp. aureus Mu50
aauagcaguuucuga

SEQ ID NO: 2070470 - RNA, 20 nt, Staphylococcus aureus subsp. aureus Mu50
aauagcauuuguaaacagua

SEQ ID NO: 2070471 - RNA, 14 nt, Staphylococcus aureus subsp. aureus Mu50
aauagccauauuca

SEQ ID NO: 2070472 - RNA, 19 nt, Staphylococcus aureus subsp. aureus Mu50
aauagccauucgaugcuaa

SEQ ID NO: 2070473 - RNA, 14 nt, Staphylococcus aureus subsp. aureus Mu50
aauaaccauguaaa

SEQ ID NO: 2070474 - RNA, 23 nt, Staphylococcus aureus subsp. aureus Mu50
aauaaccauguaaaauuagcaag

SEQ ID NO: 2070475 - RNA, 16 nt, Staphylococcus aureus subsp. aureus Mu50
aauaacccauuuucaa

SEQ ID NO: 2070476 - RNA, 21 nt, Staphylococcus aureus subsp. aureus Mu50
aauaaccaccaucccauuaaa

SEQ ID NO: 2070477 - RNA, 18 nt, Staphylococcus aureus subsp. aureus Mu50
aauaacaguuaauuauac

SEQ ID NO: 2070478 - RNA, 17 nt, Staphylococcus aureus subsp. aureus Mu50
aauaacacgauuugguu

SEQ ID NO: 2070479 - RNA, 17 nt, Staphylococcus aureus subsp. aureus Mu50
aauaacauguuuguggc

SEQ ID NO: 2070480 - RNA, 12 nt, Staphylococcus aureus subsp. aureus Mu50
aauaacaucuaa

SEQ ID NO: 2070481 - RNA, 18 nt, Staphylococcus aureus subsp. aureus Mu50
aauaaccgcacuuucuau

SEQ ID NO: 2070482 - RNA, 19 nt, Staphylococcus aureus subsp. aureus Mu50
aauaaccuagguuaaagau

SEQ ID NO: 2070483 - RNA, 17 nt, Staphylococcus aureus subsp. aureus Mu50
aauaaccgcuuaauucu

SEQ ID NO: 2070484 - RNA, 18 nt, Staphylococcus aureus subsp. aureus Mu50
aauaaccgcuuaauucuu

SEQ ID NO: 2070485 - RNA, 17 nt, Staphylococcus aureus subsp. aureus Mu50
aauaaccuuuaaaacau

SEQ ID NO: 2070486 - RNA, 17 nt, Staphylococcus aureus subsp. aureus Mu50
aauaacuguagcgaagu

SEQ ID NO: 2070487 - RNA, 20 nt, Staphylococcus aureus subsp. aureus Mu50
aauaacuggcaaaucaaaca

SEQ ID NO: 2070488 - RNA, 22 nt, Staphylococcus aureus subsp. aureus Mu50
aauaacuucguuuuaauaaauu

SEQ ID NO: 2070489 - RNA, 21 nt, Staphylococcus aureus subsp. aureus Mu50
aauaacuuuaccaccauuuuu

SEQ ID NO: 2070490 - RNA, 20 nt, Staphylococcus aureus subsp. aureus Mu50
aauaagagaacuuuucaaac

SEQ ID NO: 2070491 - RNA, 11 nt, Staphylococcus aureus subsp. aureus Mu50
aauaagauuau

SEQ ID NO: 2070492 - RNA, 16 nt, Staphylococcus aureus subsp. aureus Mu50
aauaacuggcaaauca

SEQ ID NO: 2070493 - RNA, 15 nt, Staphylococcus aureus subsp. aureus Mu50
aauaacguuaauaua

SEQ ID NO: 2070494 - RNA, 22 nt, Staphylococcus aureus subsp. aureus Mu50
aauaacaccaauugaauauuuu

SEQ ID NO: 2070495 - RNA, 18 nt, Staphylococcus aureus subsp. aureus Mu50
aauaacaccuuucauuug

SEQ ID NO: 2070496 - RNA, 23 nt, Staphylococcus aureus subsp. aureus Mu50
aauaacaccuuucauuuggaaac

SEQ ID NO: 2070497 - RNA, 17 nt, Staphylococcus aureus subsp. aureus Mu50
aauaacaaaauuaaaua

SEQ ID NO: 2070498 - RNA, 17 nt, Staphylococcus aureus subsp. aureus Mu50
aauaaauuuugcgaaaa

SEQ ID NO: 2070499 - RNA, 20 nt, Staphylococcus aureus subsp. aureus Mu50
aauaaauuuugcgaaaauau

SEQ ID NO: 2070500 - RNA, 21 nt, Staphylococcus aureus subsp. aureus Mu50
aauaaauuuugcgaaaauauc

SEQ ID NO: 2070501 - RNA, 15 nt, Staphylococcus aureus subsp. aureus Mu50
aauaaauuuuauaua

SEQ ID NO: 2070502 - RNA, 23 nt, Staphylococcus aureus subsp. aureus Mu50
aauaaauugcacgucuuguauca

SEQ ID NO: 2070503 - RNA, 13 nt, Staphylococcus aureus subsp. aureus Mu50
aauaaauuaaauu

SEQ ID NO: 2070504 - RNA, 14 nt, Staphylococcus aureus subsp. aureus Mu50
aauaaauguuaaag

SEQ ID NO: 2070505 - RNA, 21 nt, Staphylococcus aureus subsp. aureus Mu50
aauaaauuaugaaagugaauu

SEQ ID NO: 2070506 - RNA, 13 nt, Staphylococcus aureus subsp. aureus Mu50
aauaaaucuuucc

SEQ ID NO: 2070507 - RNA, 17 nt, Staphylococcus aureus subsp. aureus Mu50
aauaaaucuaucuacuc

SEQ ID NO: 2070508 - RNA, 18 nt, Staphylococcus aureus subsp. aureus Mu50
aauaaaucuaucuacuca

SEQ ID NO: 2070509 - RNA, 19 nt, Staphylococcus aureus subsp. aureus Mu50
aauaaaugacauuuaauac

SEQ ID NO: 2070510 - RNA, 21 nt, Staphylococcus aureus subsp. aureus Mu50
aauaaaugacuucacauuuau

SEQ ID NO: 2070511 - RNA, 20 nt, Staphylococcus aureus subsp. aureus Mu50
aauaaaugcuauauuuagaa

SEQ ID NO: 2070512 - RNA, 20 nt, Staphylococcus aureus subsp. aureus Mu50
aauaaaucauacgagaaauu

SEQ ID NO: 2070513 - RNA, 21 nt, Staphylococcus aureus subsp. aureus Mu50
aauaaaucauuaguuguauca

SEQ ID NO: 2070514 - RNA, 16 nt, Staphylococcus aureus subsp. aureus Mu50
aaguugcugaauaaaa

SEQ ID NO: 2070515 - RNA, 12 nt, Staphylococcus aureus subsp. aureus Mu50
aauaaauaacuu

SEQ ID NO: 2070516 - RNA, 16 nt, Staphylococcus aureus subsp. aureus Mu50
aauaaauacaauguua

SEQ ID NO: 2070517 - RNA, 18 nt, Staphylococcus aureus subsp. aureus Mu50
aaguuauuuggauauuua

SEQ ID NO: 2070518 - RNA, 16 nt, Staphylococcus aureus subsp. aureus Mu50
aaguugcauauaaaaa

SEQ ID NO: 2070519 - RNA, 16 nt, Staphylococcus aureus subsp. aureus Mu50
aauaauaucaccuuuu

SEQ ID NO: 2070520 - RNA, 12 nt, Staphylococcus aureus subsp. aureus Mu50
aauaauauauuu

SEQ ID NO: 2070521 - RNA, 13 nt, Staphylococcus aureus subsp. aureus Mu50
aauaauaugaauu

SEQ ID NO: 2070522 - RNA, 15 nt, Staphylococcus aureus subsp. aureus Mu50
aauaauccaagauau

SEQ ID NO: 2070523 - RNA, 15 nt, Staphylococcus aureus subsp. aureus Mu50
aauaaucauccauau

SEQ ID NO: 2070524 - RNA, 20 nt, Staphylococcus aureus subsp. aureus Mu50
aauaauaaaccuaaagauau

SEQ ID NO: 2070525 - RNA, 11 nt, Staphylococcus aureus subsp. aureus Mu50
aauaauaaaau

SEQ ID NO: 2070526 - RNA, 12 nt, Staphylococcus aureus subsp. aureus Mu50
aauaauaaaaua

SEQ ID NO: 2070527 - RNA, 15 nt, Staphylococcus aureus subsp. aureus Mu50
aauaauaaguugaau

SEQ ID NO: 2070528 - RNA, 19 nt, Staphylococcus aureus subsp. aureus Mu50
aauaauacgcuugauaaaa

SEQ ID NO: 2070529 - RNA, 14 nt, Staphylococcus aureus subsp. aureus Mu50
aauaauacuacaua

SEQ ID NO: 2070530 - RNA, 16 nt, Staphylococcus aureus subsp. aureus Mu50
aauaauacuacauaua

SEQ ID NO: 2070531 - RNA, 16 nt, Staphylococcus aureus subsp. aureus Mu50
aauaauagcaaaauua

SEQ ID NO: 2070532 - RNA, 18 nt, Staphylococcus aureus subsp. aureus Mu50
aauaauagcaguuucuga

SEQ ID NO: 2070533 - RNA, 19 nt, Staphylococcus aureus subsp. aureus Mu50
aauaauauaaaaacaaaag

SEQ ID NO: 2070534 - RNA, 20 nt, Staphylococcus aureus subsp. aureus Mu50
aauaauauaaauaaaagcca

SEQ ID NO: 2070535 - RNA, 15 nt, Staphylococcus aureus subsp. aureus Mu50
aauaagcgcaauuaa

SEQ ID NO: 2070536 - RNA, 17 nt, Staphylococcus aureus subsp. aureus Mu50
aauaagcgcaauuaaaa

SEQ ID NO: 2070537 - RNA, 19 nt, Staphylococcus aureus subsp. aureus Mu50
aauaagugguuguucccau

SEQ ID NO: 2070538 - RNA, 15 nt, Staphylococcus aureus subsp. aureus Mu50
aauaagugguuguuc

SEQ ID NO: 2070539 - RNA, 20 nt, Staphylococcus aureus subsp. aureus Mu50
aauaaugaugcauaagauuu

SEQ ID NO: 2070540 - RNA, 20 nt, Staphylococcus aureus subsp. aureus Mu50
aauaaugacaaauuaucacu

SEQ ID NO: 2070541 - RNA, 18 nt, Staphylococcus aureus subsp. aureus Mu50
aauaauccgagucauacu

SEQ ID NO: 2070542 - RNA, 15 nt, Staphylococcus aureus subsp. aureus Mu50
aauaaucgaacagaa

SEQ ID NO: 2070543 - RNA, 18 nt, Staphylococcus aureus subsp. aureus Mu50
aauaaucgaacagaaaau

SEQ ID NO: 2070544 - RNA, 18 nt, Staphylococcus aureus subsp. aureus Mu50
aauaaucgaacauaaaua

SEQ ID NO: 2070545 - RNA, 16 nt, Staphylococcus aureus subsp. aureus Mu50
aauaaucggacugaug

SEQ ID NO: 2070546 - RNA, 20 nt, Staphylococcus aureus subsp. aureus Mu50
aauaaucgguaauuacuugu

SEQ ID NO: 2070547 - RNA, 17 nt, Staphylococcus aureus subsp. aureus Mu50
aauaauuagauuuaaaa

SEQ ID NO: 2070548 - RNA, 18 nt, Staphylococcus aureus subsp. aureus Mu50
aauaauucccuaggaaau

SEQ ID NO: 2070549 - RNA, 17 nt, Staphylococcus aureus subsp. aureus Mu50
aauaauuggaaucaucu

SEQ ID NO: 2070550 - RNA, 13 nt, Staphylococcus aureus subsp. aureus Mu50
aauaauugcuaaa

SEQ ID NO: 2070551 - RNA, 16 nt, Staphylococcus aureus subsp. aureus Mu50
aauaauugcuaaaaua

SEQ ID NO: 2070552 - RNA, 15 nt, Staphylococcus aureus subsp. aureus Mu50
aauaaugugaaaaau

SEQ ID NO: 2070553 - RNA, 18 nt, Staphylococcus aureus subsp. aureus Mu50
aauaaugugaaaaaucuu

SEQ ID NO: 2070554 - RNA, 17 nt, Staphylococcus aureus subsp. aureus Mu50
aauaauguuuccauuua

SEQ ID NO: 2070555 - RNA, 11 nt, Staphylococcus aureus subsp. aureus Mu50
aauaauguuuc

SEQ ID NO: 2070556 - RNA, 16 nt, Staphylococcus aureus subsp. aureus Mu50
aauaaugucuuacuuu

SEQ ID NO: 2070557 - RNA, 16 nt, Staphylococcus aureus subsp. aureus Mu50
aauaauuagauuuaaa

SEQ ID NO: 2070558 - RNA, 18 nt, Staphylococcus aureus subsp. aureus Mu50
aauaauuacuaaccuaaa

SEQ ID NO: 2070559 - RNA, 19 nt, Staphylococcus aureus subsp. aureus Mu50
uuggucaccuacagauaaa

SEQ ID NO: 2070560 - RNA, 21 nt, Staphylococcus aureus subsp. aureus Mu50
uugguuaauacguuuaauaau

SEQ ID NO: 2070561 - RNA, 14 nt, Staphylococcus aureus subsp. aureus Mu50
uugguuacuuagua

SEQ ID NO: 2070562 - RNA, 23 nt, Staphylococcus aureus subsp. aureus Mu50
uugguggaugucaugucuagauu

SEQ ID NO: 2070563 - RNA, 18 nt, Staphylococcus aureus subsp. aureus Mu50
uugguauucaucuucaaa

SEQ ID NO: 2070564 - RNA, 13 nt, Staphylococcus aureus subsp. aureus Mu50
uugguauugguaa

SEQ ID NO: 2070565 - RNA, 20 nt, Staphylococcus aureus subsp. aureus Mu50
uugguaagcuaauuucuaau

SEQ ID NO: 2070566 - RNA, 20 nt, Staphylococcus aureus subsp. aureus Mu50
uugggcugauaauaaaaguu

SEQ ID NO: 2070567 - RNA, 20 nt, Staphylococcus aureus subsp. aureus Mu50
uuggggccccgacuauuuuu

SEQ ID NO: 2070568 - RNA, 23 nt, Staphylococcus aureus subsp. aureus Mu50
uuggggaugggccccaacaaaga

SEQ ID NO: 2070569 - RNA, 18 nt, Staphylococcus aureus subsp. aureus Mu50
uuggggugagggccccaa

SEQ ID NO: 2070570 - RNA, 21 nt, Staphylococcus aureus subsp. aureus Mu50
uuggcuggcccccaacacuga

SEQ ID NO: 2070571 - RNA, 18 nt, Staphylococcus aureus subsp. aureus Mu50
uuggcuucgucaucaaca

SEQ ID NO: 2070572 - RNA, 15 nt, Staphylococcus aureus subsp. aureus Mu50
uugggaauugaccac

SEQ ID NO: 2070573 - RNA, 18 nt, Staphylococcus aureus subsp. aureus Mu50
uuggcucuauaucaaauu

SEQ ID NO: 2070574 - RNA, 21 nt, Staphylococcus aureus subsp. aureus Mu50
uuggcggggccccaacacaga

SEQ ID NO: 2070575 - RNA, 21 nt, Staphylococcus aureus subsp. aureus Mu50
uugcugcuguacaauuucgcu

SEQ ID NO: 2070576 - RNA, 19 nt, Staphylococcus aureus subsp. aureus Mu50
uugcuaucaaacuuggcaa

SEQ ID NO: 2070577 - RNA, 21 nt, Staphylococcus aureus subsp. aureus Mu50
uugcuaaccaucauaaauguu

SEQ ID NO: 2070578 - RNA, 16 nt, Staphylococcus aureus subsp. aureus Mu50
uugcgguuggcucuuu

SEQ ID NO: 2070579 - RNA, 15 nt, Staphylococcus aureus subsp. aureus Mu50
uugcuuaauaucaug

SEQ ID NO: 2070580 - RNA, 19 nt, Staphylococcus aureus subsp. aureus Mu50
uugcuuauuuuuguauucu

SEQ ID NO: 2070581 - RNA, 17 nt, Staphylococcus aureus subsp. aureus Mu50
uugcuuaacuuccuuuu

SEQ ID NO: 2070582 - RNA, 13 nt, Staphylococcus aureus subsp. aureus Mu50
uugcuuuaauuug

SEQ ID NO: 2070583 - RNA, 14 nt, Staphylococcus aureus subsp. aureus Mu50
uugcuuuaauuuga

SEQ ID NO: 2070584 - RNA, 21 nt, Staphylococcus aureus subsp. aureus Mu50
uugcuuuaauuugauuaaauu

SEQ ID NO: 2070585 - RNA, 13 nt, Staphylococcus aureus subsp. aureus Mu50
uugcuucuguauc

SEQ ID NO: 2070586 - RNA, 17 nt, Staphylococcus aureus subsp. aureus Mu50
uugcuucuuaucaacaa

SEQ ID NO: 2070587 - RNA, 17 nt, Staphylococcus aureus subsp. aureus Mu50
uugcuucuuuaaaggaa

SEQ ID NO: 2070588 - RNA, 19 nt, Staphylococcus aureus subsp. aureus Mu50
uugcuuguacgauaacuac

SEQ ID NO: 2070589 - RNA, 17 nt, Staphylococcus aureus subsp. aureus Mu50
uuggauagguaacuaaa

SEQ ID NO: 2070590 - RNA, 14 nt, Staphylococcus aureus subsp. aureus Mu50
uuggaucuuucaaa

SEQ ID NO: 2070591 - RNA, 17 nt, Staphylococcus aureus subsp. aureus Mu50
uuggcacauaaaucaau

SEQ ID NO: 2070592 - RNA, 15 nt, Staphylococcus aureus subsp. aureus Mu50
uuggcacauaaauca

SEQ ID NO: 2070593 - RNA, 13 nt, Staphylococcus aureus subsp. aureus Mu50
uuggaauacucuu

SEQ ID NO: 2070594 - RNA, 23 nt, Staphylococcus aureus subsp. aureus Mu50
uuggaaucaucuuuuugaaauuu

SEQ ID NO: 2070595 - RNA, 15 nt, Staphylococcus aureus subsp. aureus Mu50
uuggaggugaugaga

SEQ ID NO: 2070596 - RNA, 17 nt, Staphylococcus aureus subsp. aureus Mu50
uuggagcguaaaguuuu

SEQ ID NO: 2070597 - RNA, 14 nt, Staphylococcus aureus subsp. aureus Mu50
uuggaaagauggga

SEQ ID NO: 2070598 - RNA, 13 nt, Staphylococcus aureus subsp. aureus Mu50
uugcuuuuuacua

SEQ ID NO: 2070599 - RNA, 14 nt, Staphylococcus aureus subsp. aureus Mu50
uugcuuuuuacuau

SEQ ID NO: 2070600 - RNA, 21 nt, Staphylococcus aureus subsp. aureus Mu50
uugcuuuuucaaauaauauaa

SEQ ID NO: 2070601 - RNA, 12 nt, Staphylococcus aureus subsp. aureus Mu50
uuggaagucugc

SEQ ID NO: 2070602 - RNA, 19 nt, Staphylococcus aureus subsp. aureus Mu50
uugccauacccauauuaaa

SEQ ID NO: 2070603 - RNA, 22 nt, Staphylococcus aureus subsp. aureus Mu50
uugccauacccauauuaaauuu

SEQ ID NO: 2070604 - RNA, 20 nt, Staphylococcus aureus subsp. aureus Mu50
uugccaucaauuucuguaau

SEQ ID NO: 2070605 - RNA, 13 nt, Staphylococcus aureus subsp. aureus Mu50
uugcgaaaauauc

SEQ ID NO: 2070606 - RNA, 16 nt, Staphylococcus aureus subsp. aureus Mu50
uugccuuuugaauaau

SEQ ID NO: 2070607 - RNA, 13 nt, Staphylococcus aureus subsp. aureus Mu50
uugcauauaaaaa

SEQ ID NO: 2070608 - RNA, 19 nt, Staphylococcus aureus subsp. aureus Mu50
uugcauacguaaaugguaa

SEQ ID NO: 2070609 - RNA, 14 nt, Staphylococcus aureus subsp. aureus Mu50
uugcauugauuuca

SEQ ID NO: 2070610 - RNA, 19 nt, Staphylococcus aureus subsp. aureus Mu50
uugcaugacagcaaauuuu

SEQ ID NO: 2070611 - RNA, 14 nt, Staphylococcus aureus subsp. aureus Mu50
uugauuuuauucac

SEQ ID NO: 2070612 - RNA, 16 nt, Staphylococcus aureus subsp. aureus Mu50
uugcacuuuuuucauu

SEQ ID NO: 2070613 - RNA, 20 nt, Staphylococcus aureus subsp. aureus Mu50
uugcacuuuuuucauuucuu

SEQ ID NO: 2070614 - RNA, 18 nt, Staphylococcus aureus subsp. aureus Mu50
uugcacucuuuucucguu

SEQ ID NO: 2070615 - RNA, 16 nt, Staphylococcus aureus subsp. aureus Mu50
uugauggauauucaau

SEQ ID NO: 2070616 - RNA, 16 nt, Staphylococcus aureus subsp. aureus Mu50
uugaucuuugacaugu

SEQ ID NO: 2070617 - RNA, 18 nt, Staphylococcus aureus subsp. aureus Mu50
uugaucgauuguuuauua

SEQ ID NO: 2070618 - RNA, 23 nt, Staphylococcus aureus subsp. aureus Mu50
uugauauaaaaagugaaaguauu

SEQ ID NO: 2070619 - RNA, 21 nt, Staphylococcus aureus subsp. aureus Mu50
uugauauaguuauaugugcuu

SEQ ID NO: 2070620 - RNA, 20 nt, Staphylococcus aureus subsp. aureus Mu50
uugauagcaccguaacauau

SEQ ID NO: 2070621 - RNA, 17 nt, Staphylococcus aureus subsp. aureus Mu50
uugauaguaauaguuaa

SEQ ID NO: 2070622 - RNA, 15 nt, Staphylococcus aureus subsp. aureus Mu50
uugauagcuaaugca

SEQ ID NO: 2070623 - RNA, 13 nt, Staphylococcus aureus subsp. aureus Mu50
uugauauaaaaag

SEQ ID NO: 2070624 - RNA, 23 nt, Staphylococcus aureus subsp. aureus Mu50
uugauauagucaaugaauaauga

SEQ ID NO: 2070625 - RNA, 11 nt, Staphylococcus aureus subsp. aureus Mu50
uugauagucac

SEQ ID NO: 2070626 - RNA, 22 nt, Staphylococcus aureus subsp. aureus Mu50
uugauagugguagccaauauca

SEQ ID NO: 2070627 - RNA, 15 nt, Staphylococcus aureus subsp. aureus Mu50
uugauagacuaauua

SEQ ID NO: 2070628 - RNA, 18 nt, Staphylococcus aureus subsp. aureus Mu50
uugauuuagcauacauua

SEQ ID NO: 2070629 - RNA, 19 nt, Staphylococcus aureus subsp. aureus Mu50
uugauuuggguaauguuuu

SEQ ID NO: 2070630 - RNA, 15 nt, Staphylococcus aureus subsp. aureus Mu50
uugauuuacgugcau

SEQ ID NO: 2070631 - RNA, 16 nt, Staphylococcus aureus subsp. aureus Mu50
uugauuuaacaaccuc

SEQ ID NO: 2070632 - RNA, 12 nt, Staphylococcus aureus subsp. aureus Mu50
uugauuauguaa

SEQ ID NO: 2070633 - RNA, 13 nt, Staphylococcus aureus subsp. aureus Mu50
uugauuauucuau

SEQ ID NO: 2070634 - RNA, 17 nt, Staphylococcus aureus subsp. aureus Mu50
uugauuagcauaccuuu

SEQ ID NO: 2070635 - RNA, 17 nt, Staphylococcus aureus subsp. aureus Mu50
uugauuauauuucucau

SEQ ID NO: 2070636 - RNA, 18 nt, Staphylococcus aureus subsp. aureus Mu50
uugauguucuugaaaaca

SEQ ID NO: 2070637 - RNA, 15 nt, Staphylococcus aureus subsp. aureus Mu50
uugauuaaaaguguu

SEQ ID NO: 2070638 - RNA, 20 nt, Staphylococcus aureus subsp. aureus Mu50
uugauuaaaaacgucucuau

SEQ ID NO: 2070639 - RNA, 14 nt, Staphylococcus aureus subsp. aureus Mu50
uugauuaaaagugu

SEQ ID NO: 2070640 - RNA, 16 nt, Staphylococcus aureus subsp. aureus Mu50
uugaugucaauuucac

SEQ ID NO: 2070641 - RNA, 14 nt, Staphylococcus aureus subsp. aureus Mu50
uugauguguugcau

SEQ ID NO: 2070642 - RNA, 22 nt, Staphylococcus aureus subsp. aureus Mu50
uugauaaguucuagauuauuua

SEQ ID NO: 2070643 - RNA, 21 nt, Staphylococcus aureus subsp. aureus Mu50
uugauaaguagaaaauaugac

SEQ ID NO: 2070644 - RNA, 21 nt, Staphylococcus aureus subsp. aureus Mu50
uugaguguguccaucauuugu

SEQ ID NO: 2070645 - RNA, 17 nt, Staphylococcus aureus subsp. aureus Mu50
uugagucuuagacauug

SEQ ID NO: 2070646 - RNA, 13 nt, Staphylococcus aureus subsp. aureus Mu50
uugaguauuaaau

SEQ ID NO: 2070647 - RNA, 22 nt, Staphylococcus aureus subsp. aureus Mu50
uugaguaucaugcuuuuaauau

SEQ ID NO: 2070648 - RNA, 23 nt, Staphylococcus aureus subsp. aureus Mu50
uugaggaccacggucuugauauu

SEQ ID NO: 2070649 - RNA, 16 nt, Staphylococcus aureus subsp. aureus Mu50
uugagguguggaguaa

SEQ ID NO: 2070650 - RNA, 21 nt, Staphylococcus aureus subsp. aureus Mu50
uucuuguuuagggaaucccau

SEQ ID NO: 2070651 - RNA, 14 nt, Staphylococcus aureus subsp. aureus Mu50
uucuucuuuuuuau

SEQ ID NO: 2070652 - RNA, 22 nt, Staphylococcus aureus subsp. aureus Mu50
uuuauaacauacguuauuuuuu

SEQ ID NO: 2070653 - RNA, 12 nt, Staphylococcus aureus subsp. aureus Mu50
uuuagcauugcc

SEQ ID NO: 2070654 - RNA, 18 nt, Staphylococcus aureus subsp. aureus Mu50
uuuauaacauuuaagaaa

SEQ ID NO: 2070655 - RNA, 15 nt, Staphylococcus aureus subsp. aureus Mu50
uuuauaauaaauuuc

SEQ ID NO: 2070656 - RNA, 15 nt, Staphylococcus aureus subsp. aureus Mu50
uuuauaauaaauguc

SEQ ID NO: 2070657 - RNA, 13 nt, Staphylococcus aureus subsp. aureus Mu50
uuuauaauucuaa

SEQ ID NO: 2070658 - RNA, 19 nt, Staphylococcus aureus subsp. aureus Mu50
uuuauauauaaagaaauaa

SEQ ID NO: 2070659 - RNA, 14 nt, Staphylococcus aureus subsp. aureus Mu50
uuuauaauuuuuga

SEQ ID NO: 2070660 - RNA, 13 nt, Staphylococcus aureus subsp. aureus Mu50
uuuauacauaaau

SEQ ID NO: 2070661 - RNA, 13 nt, Staphylococcus aureus subsp. aureus Mu50
uuuagccaaugcu

SEQ ID NO: 2070662 - RNA, 15 nt, Staphylococcus aureus subsp. aureus Mu50
uuuagaugcauaaaa

SEQ ID NO: 2070663 - RNA, 15 nt, Staphylococcus aureus subsp. aureus Mu50
uuuagacaauauuuu

SEQ ID NO: 2070664 - RNA, 17 nt, Staphylococcus aureus subsp. aureus Mu50
uuuagacauuaaaaaau

SEQ ID NO: 2070665 - RNA, 15 nt, Staphylococcus aureus subsp. aureus Mu50
uuuagauaaaaauua

SEQ ID NO: 2070666 - RNA, 13 nt, Staphylococcus aureus subsp. aureus Mu50
uuuaucacuguau

SEQ ID NO: 2070667 - RNA, 15 nt, Staphylococcus aureus subsp. aureus Mu50
uuuaucaauuucuau

SEQ ID NO: 2070668 - RNA, 21 nt, Staphylococcus aureus subsp. aureus Mu50
uuuaucaauuucuauuucacu

SEQ ID NO: 2070669 - RNA, 19 nt, Staphylococcus aureus subsp. aureus Mu50
uuuaucaaauucaucagua

SEQ ID NO: 2070670 - RNA, 17 nt, Staphylococcus aureus subsp. aureus Mu50
uuuaucaacaaauuuaa

SEQ ID NO: 2070671 - RNA, 14 nt, Staphylococcus aureus subsp. aureus Mu50
uuuaucaauuucua

SEQ ID NO: 2070672 - RNA, 15 nt, Staphylococcus aureus subsp. aureus Mu50
uuuaucaacauaaaa

SEQ ID NO: 2070673 - RNA, 12 nt, Staphylococcus aureus subsp. aureus Mu50
uuuaucaauauu

SEQ ID NO: 2070674 - RNA, 16 nt, Staphylococcus aureus subsp. aureus Mu50
uuuauauuuauuuuau

SEQ ID NO: 2070675 - RNA, 18 nt, Staphylococcus aureus subsp. aureus Mu50
uuuauauuuaaacucucu

SEQ ID NO: 2070676 - RNA, 16 nt, Staphylococcus aureus subsp. aureus Mu50
uuuauauuauuucaau

SEQ ID NO: 2070677 - RNA, 13 nt, Staphylococcus aureus subsp. aureus Mu50
uuuauauuuuuau

SEQ ID NO: 2070678 - RNA, 15 nt, Staphylococcus aureus subsp. aureus Mu50
uuuauauuuuuauca

SEQ ID NO: 2070679 - RNA, 20 nt, Staphylococcus aureus subsp. aureus Mu50
uuuauccgucgaauauaauu

SEQ ID NO: 2070680 - RNA, 20 nt, Staphylococcus aureus subsp. aureus Mu50
uuuauccaaaccaauuuuaa

SEQ ID NO: 2070681 - RNA, 13 nt, Staphylococcus aureus subsp. aureus Mu50
uuuaugcuuuaaa

SEQ ID NO: 2070682 - RNA, 12 nt, Staphylococcus aureus subsp. aureus Mu50
uuuaugauuguu

SEQ ID NO: 2070683 - RNA, 22 nt, Staphylococcus aureus subsp. aureus Mu50
uuuaugagcuucuuuaaauaca

SEQ ID NO: 2070684 - RNA, 20 nt, Staphylococcus aureus subsp. aureus Mu50
uuuaugacaaaguucugcaa

SEQ ID NO: 2070685 - RNA, 20 nt, Staphylococcus aureus subsp. aureus Mu50
uuuaugaauugaguauuaaa

SEQ ID NO: 2070686 - RNA, 15 nt, Staphylococcus aureus subsp. aureus Mu50
uuuaucuaguuguuu

SEQ ID NO: 2070687 - RNA, 18 nt, Staphylococcus aureus subsp. aureus Mu50
uuuaucgaucgguauuuu

SEQ ID NO: 2070688 - RNA, 17 nt, Staphylococcus aureus subsp. aureus Mu50
uuuaucugaaaauauca

SEQ ID NO: 2070689 - RNA, 15 nt, Staphylococcus aureus subsp. aureus Mu50
uuuaucugcaaaaug

SEQ ID NO: 2070690 - RNA, 22 nt, Staphylococcus aureus subsp. aureus Mu50
uuuaucuguagaaacacuuuua

SEQ ID NO: 2070691 - RNA, 19 nt, Staphylococcus aureus subsp. aureus Mu50
uuuaucuguaacaaagucu

SEQ ID NO: 2070692 - RNA, 12 nt, Staphylococcus aureus subsp. aureus Mu50
uuuauuaaauaa

SEQ ID NO: 2070693 - RNA, 14 nt, Staphylococcus aureus subsp. aureus Mu50
uuuauguauuuauu

SEQ ID NO: 2070694 - RNA, 17 nt, Staphylococcus aureus subsp. aureus Mu50
uuuauguuuuaauuucu

SEQ ID NO: 2070695 - RNA, 13 nt, Staphylococcus aureus subsp. aureus Mu50
uuuaugguguggu

SEQ ID NO: 2070696 - RNA, 21 nt, Staphylococcus aureus subsp. aureus Mu50
uuuaugguguggugugaugua

SEQ ID NO: 2070697 - RNA, 20 nt, Staphylococcus aureus subsp. aureus Mu50
uuuauuuaacacuucaguua

SEQ ID NO: 2070698 - RNA, 14 nt, Staphylococcus aureus subsp. aureus Mu50
uuuauuuaauuauu

SEQ ID NO: 2070699 - RNA, 16 nt, Staphylococcus aureus subsp. aureus Mu50
uuuauugccgguuaaa

SEQ ID NO: 2070700 - RNA, 15 nt, Staphylococcus aureus subsp. aureus Mu50
uuuauugcaauaaca

SEQ ID NO: 2070701 - RNA, 12 nt, Staphylococcus aureus subsp. aureus Mu50
uuuauuacuuau

SEQ ID NO: 2070702 - RNA, 14 nt, Staphylococcus aureus subsp. aureus Mu50
uuuauuacuuuaau

SEQ ID NO: 2070703 - RNA, 18 nt, Staphylococcus aureus subsp. aureus Mu50
uuuacaccuauaccucau

SEQ ID NO: 2070704 - RNA, 21 nt, Staphylococcus aureus subsp. aureus Mu50
uuuaaugggcgauaaaaguug

SEQ ID NO: 2070705 - RNA, 22 nt, Staphylococcus aureus subsp. aureus Mu50
uuuaaugggcgugccauuaaaa

SEQ ID NO: 2070706 - RNA, 20 nt, Staphylococcus aureus subsp. aureus Mu50
uuuaauguauaaauuaguuu

SEQ ID NO: 2070707 - RNA, 16 nt, Staphylococcus aureus subsp. aureus Mu50
uuuaaugucuaaaaau

SEQ ID NO: 2070708 - RNA, 12 nt, Staphylococcus aureus subsp. aureus Mu50
uuuaauguguaa

SEQ ID NO: 2070709 - RNA, 16 nt, Staphylococcus aureus subsp. aureus Mu50
uuuacagucaacugcu

SEQ ID NO: 2070710 - RNA, 23 nt, Staphylococcus aureus subsp. aureus Mu50
uuuacauggcuuagguuuaauuu

SEQ ID NO: 2070711 - RNA, 20 nt, Staphylococcus aureus subsp. aureus Mu50
uuuaccucuugauaaaauaa

SEQ ID NO: 2070712 - RNA, 15 nt, Staphylococcus aureus subsp. aureus Mu50
uuuacauuucucguu

SEQ ID NO: 2070713 - RNA, 15 nt, Staphylococcus aureus subsp. aureus Mu50
uuuacgugcauugua

SEQ ID NO: 2070714 - RNA, 14 nt, Staphylococcus aureus subsp. aureus Mu50
uuuacuaaaugaau

SEQ ID NO: 2070715 - RNA, 18 nt, Staphylococcus aureus subsp. aureus Mu50
uuuagaaagaauacaguu

SEQ ID NO: 2070716 - RNA, 18 nt, Staphylococcus aureus subsp. aureus Mu50
uuuagaaaaggauuauag

SEQ ID NO: 2070717 - RNA, 17 nt, Staphylococcus aureus subsp. aureus Mu50
uuuagaauaagaaauaa

SEQ ID NO: 2070718 - RNA, 18 nt, Staphylococcus aureus subsp. aureus Mu50
uuuaaucuuauucgcacc

SEQ ID NO: 2070719 - RNA, 19 nt, Staphylococcus aureus subsp. aureus Mu50
uuuaaucguaacauaucag

SEQ ID NO: 2070720 - RNA, 21 nt, Staphylococcus aureus subsp. aureus Mu50
uuuaaucguaacauaucagcu

SEQ ID NO: 2070721 - RNA, 23 nt, Staphylococcus aureus subsp. aureus Mu50
uuuaaucacaucuuuuugauaau

SEQ ID NO: 2070722 - RNA, 13 nt, Staphylococcus aureus subsp. aureus Mu50
uuuaaucaaaaaa

SEQ ID NO: 2070723 - RNA, 19 nt, Staphylococcus aureus subsp. aureus Mu50
uuuaauauuugauaacaaa

SEQ ID NO: 2070724 - RNA, 15 nt, Staphylococcus aureus subsp. aureus Mu50
uuuaauauuuucuua

SEQ ID NO: 2070725 - RNA, 16 nt, Staphylococcus aureus subsp. aureus Mu50
uuuaauccuucuccaa

SEQ ID NO: 2070726 - RNA, 21 nt, Staphylococcus aureus subsp. aureus Mu50
uuuaauauugaaaugagcuua

SEQ ID NO: 2070727 - RNA, 11 nt, Staphylococcus aureus subsp. aureus Mu50
uuuaauauuua

SEQ ID NO: 2070728 - RNA, 21 nt, Staphylococcus aureus subsp. aureus Mu50
uuuaauauuuagauacugaau

SEQ ID NO: 2070729 - RNA, 21 nt, Staphylococcus aureus subsp. aureus Mu50
uuuaauauagauuugaauuaa

SEQ ID NO: 2070730 - RNA, 16 nt, Staphylococcus aureus subsp. aureus Mu50
uuuaauaguacuuaau

SEQ ID NO: 2070731 - RNA, 13 nt, Staphylococcus aureus subsp. aureus Mu50
uuuaauauaaauu

SEQ ID NO: 2070732 - RNA, 21 nt, Staphylococcus aureus subsp. aureus Mu50
uuuaauacuauaguaagaaaa

SEQ ID NO: 2070733 - RNA, 17 nt, Staphylococcus aureus subsp. aureus Mu50
uuuaauaacaaaauuaa

SEQ ID NO: 2070734 - RNA, 13 nt, Staphylococcus aureus subsp. aureus Mu50
uuuaauaacuaaa

SEQ ID NO: 2070735 - RNA, 21 nt, Staphylococcus aureus subsp. aureus Mu50
uuuaauaaccuuuaaaacauc

SEQ ID NO: 2070736 - RNA, 14 nt, Staphylococcus aureus subsp. aureus Mu50
uuuaauaauuaaau

SEQ ID NO: 2070737 - RNA, 18 nt, Staphylococcus aureus subsp. aureus Mu50
uuuaauaauuaaauauaa

SEQ ID NO: 2070738 - RNA, 22 nt, Staphylococcus aureus subsp. aureus Mu50
uuuaaaacaucauucacaaguu

SEQ ID NO: 2070739 - RNA, 12 nt, Staphylococcus aureus subsp. aureus Mu50
uuuaaaaaugcu

SEQ ID NO: 2070740 - RNA, 22 nt, Staphylococcus aureus subsp. aureus Mu50
uuuaaaaaugcugguaaauguu

SEQ ID NO: 2070741 - RNA, 23 nt, Staphylococcus aureus subsp. aureus Mu50
uuuaacuuaauuaaaaaaagauu

SEQ ID NO: 2070742 - RNA, 24 nt, Staphylococcus aureus subsp. aureus Mu50
uuuaacuuaauuaaaaaaagauua

SEQ ID NO: 2070743 - RNA, 14 nt, Staphylococcus aureus subsp. aureus Mu50
uuuaagaucaauau

SEQ ID NO: 2070744 - RNA, 18 nt, Staphylococcus aureus subsp. aureus Mu50
uuuaagauagguuuauuu

SEQ ID NO: 2070745 - RNA, 12 nt, Staphylococcus aureus subsp. aureus Mu50
uuuaaaaauaca

SEQ ID NO: 2070746 - RNA, 14 nt, Staphylococcus aureus subsp. aureus Mu50
uuuaagaauguaca

SEQ ID NO: 2070747 - RNA, 19 nt, Staphylococcus aureus subsp. aureus Mu50
uuuaaguuaucaaauugac

SEQ ID NO: 2070748 - RNA, 17 nt, Staphylococcus aureus subsp. aureus Mu50
uuuaauaaaccagugcg

SEQ ID NO: 2070749 - RNA, 12 nt, Staphylococcus aureus subsp. aureus Mu50
uuuaauaaaaac

SEQ ID NO: 2070750 - RNA, 18 nt, Staphylococcus aureus subsp. aureus Mu50
uuuaauaaaaaccaauau

SEQ ID NO: 2070751 - RNA, 15 nt, Staphylococcus aureus subsp. aureus Mu50
uuuaagcuuaucaac

SEQ ID NO: 2070752 - RNA, 19 nt, Staphylococcus aureus subsp. aureus Mu50
uugucauuugaacaucauu

SEQ ID NO: 2070753 - RNA, 12 nt, Staphylococcus aureus subsp. aureus Mu50
uugucaucuuuu

SEQ ID NO: 2070754 - RNA, 13 nt, Staphylococcus aureus subsp. aureus Mu50
uugucaugccuuc

SEQ ID NO: 2070755 - RNA, 14 nt, Staphylococcus aureus subsp. aureus Mu50
uugucaugccuuca

SEQ ID NO: 2070756 - RNA, 18 nt, Staphylococcus aureus subsp. aureus Mu50
uugucaucauguucuaau

SEQ ID NO: 2070757 - RNA, 17 nt, Staphylococcus aureus subsp. aureus Mu50
uuguccaugccuuaugu

SEQ ID NO: 2070758 - RNA, 23 nt, Staphylococcus aureus subsp. aureus Mu50
uuguccuuuaagaacauaaccua

SEQ ID NO: 2070759 - RNA, 19 nt, Staphylococcus aureus subsp. aureus Mu50
uuguauaccuauuccuauu

SEQ ID NO: 2070760 - RNA, 18 nt, Staphylococcus aureus subsp. aureus Mu50
uuguauagaauguguaug

SEQ ID NO: 2070761 - RNA, 17 nt, Staphylococcus aureus subsp. aureus Mu50
uuguauagaauguguau

SEQ ID NO: 2070762 - RNA, 22 nt, Staphylococcus aureus subsp. aureus Mu50
uuguauagauuguauuuaauaa

SEQ ID NO: 2070763 - RNA, 17 nt, Staphylococcus aureus subsp. aureus Mu50
uuguauuuuauuuauuu

SEQ ID NO: 2070764 - RNA, 13 nt, Staphylococcus aureus subsp. aureus Mu50
uuguauuuuucaa

SEQ ID NO: 2070765 - RNA, 19 nt, Staphylococcus aureus subsp. aureus Mu50
uugucacaaucuguucaua

SEQ ID NO: 2070766 - RNA, 21 nt, Staphylococcus aureus subsp. aureus Mu50
uugucacaaucuguucauaau

SEQ ID NO: 2070767 - RNA, 19 nt, Staphylococcus aureus subsp. aureus Mu50
uugucacuuggauucaaau

SEQ ID NO: 2070768 - RNA, 20 nt, Staphylococcus aureus subsp. aureus Mu50
uugucaguuuuuuuauaagc

SEQ ID NO: 2070769 - RNA, 22 nt, Staphylococcus aureus subsp. aureus Mu50
uuguaccaaauaaauuaaauuu

SEQ ID NO: 2070770 - RNA, 16 nt, Staphylococcus aureus subsp. aureus Mu50
uuguacauauguguau

SEQ ID NO: 2070771 - RNA, 18 nt, Staphylococcus aureus subsp. aureus Mu50
uuguacaucauuaaauau

SEQ ID NO: 2070772 - RNA, 21 nt, Staphylococcus aureus subsp. aureus Mu50
uuguacgcuucaauuauuuca

SEQ ID NO: 2070773 - RNA, 11 nt, Staphylococcus aureus subsp. aureus Mu50
uuguacuucuu

SEQ ID NO: 2070774 - RNA, 23 nt, Staphylococcus aureus subsp. aureus Mu50
uuguagggaguauuguuuuauau

SEQ ID NO: 2070775 - RNA, 20 nt, Staphylococcus aureus subsp. aureus Mu50
uuguagccuucaacuaaugu

SEQ ID NO: 2070776 - RNA, 21 nt, Staphylococcus aureus subsp. aureus Mu50
uuguacaaaaaauuguaaguc

SEQ ID NO: 2070777 - RNA, 15 nt, Staphylococcus aureus subsp. aureus Mu50
uuguaauuuaaaaua

SEQ ID NO: 2070778 - RNA, 21 nt, Staphylococcus aureus subsp. aureus Mu50
uuguaauuagugcaaguaauu

SEQ ID NO: 2070779 - RNA, 19 nt, Staphylococcus aureus subsp. aureus Mu50
uuguaauccuuguucuauu

SEQ ID NO: 2070780 - RNA, 21 nt, Staphylococcus aureus subsp. aureus Mu50
uuguaagcucaugaaucagau

SEQ ID NO: 2070781 - RNA, 15 nt, Staphylococcus aureus subsp. aureus Mu50
uuguaacuauugaaa

SEQ ID NO: 2070782 - RNA, 20 nt, Staphylococcus aureus subsp. aureus Mu50
uuguaacaagcauuuuucaa

SEQ ID NO: 2070783 - RNA, 12 nt, Staphylococcus aureus subsp. aureus Mu50
uuguucuucaga

SEQ ID NO: 2070784 - RNA, 12 nt, Staphylococcus aureus subsp. aureus Mu50
uuguucggcuuu

SEQ ID NO: 2070785 - RNA, 14 nt, Staphylococcus aureus subsp. aureus Mu50
uuguugcaaugauu

SEQ ID NO: 2070786 - RNA, 16 nt, Staphylococcus aureus subsp. aureus Mu50
uuguugauaguaaucu

SEQ ID NO: 2070787 - RNA, 22 nt, Staphylococcus aureus subsp. aureus Mu50
uuguugaauaauuaauguuucu

SEQ ID NO: 2070788 - RNA, 20 nt, Staphylococcus aureus subsp. aureus Mu50
uuguuuucaaaugaaaauac

SEQ ID NO: 2070789 - RNA, 12 nt, Staphylococcus aureus subsp. aureus Mu50
uuguuugcuucu

SEQ ID NO: 2070790 - RNA, 16 nt, Staphylococcus aureus subsp. aureus Mu50
uuguuuugcuucuuua

SEQ ID NO: 2070791 - RNA, 22 nt, Staphylococcus aureus subsp. aureus Mu50
uuuaaaaauaaaaaaccaauaa

SEQ ID NO: 2070792 - RNA, 13 nt, Staphylococcus aureus subsp. aureus Mu50
uuguguugaauca

SEQ ID NO: 2070793 - RNA, 20 nt, Staphylococcus aureus subsp. aureus Mu50
uuguguuuuuaauguuugcu

SEQ ID NO: 2070794 - RNA, 22 nt, Staphylococcus aureus subsp. aureus Mu50
uuguucaacuaaauuuucuaaa

SEQ ID NO: 2070795 - RNA, 20 nt, Staphylococcus aureus subsp. aureus Mu50
uuguucaauucagcaaugag

SEQ ID NO: 2070796 - RNA, 15 nt, Staphylococcus aureus subsp. aureus Mu50
uuguucaugguuuaa

SEQ ID NO: 2070797 - RNA, 12 nt, Staphylococcus aureus subsp. aureus Mu50
uuguucagauuu

SEQ ID NO: 2070798 - RNA, 19 nt, Staphylococcus aureus subsp. aureus Mu50
uugugguaaucauguaaug

SEQ ID NO: 2070799 - RNA, 21 nt, Staphylococcus aureus subsp. aureus Mu50
uuguguguuuuaaaauuauuu

SEQ ID NO: 2070800 - RNA, 19 nt, Staphylococcus aureus subsp. aureus Mu50
uuguguaucuguaacauaa

SEQ ID NO: 2070801 - RNA, 16 nt, Staphylococcus aureus subsp. aureus Mu50
uugucuuaauaugcaa

SEQ ID NO: 2070802 - RNA, 13 nt, Staphylococcus aureus subsp. aureus Mu50
uugucuguauuau

SEQ ID NO: 2070803 - RNA, 16 nt, Staphylococcus aureus subsp. aureus Mu50
uugugaauaaaauugu

SEQ ID NO: 2070804 - RNA, 15 nt, Staphylococcus aureus subsp. aureus Mu50
uugugaauaauuuca

SEQ ID NO: 2070805 - RNA, 18 nt, Staphylococcus aureus subsp. aureus Mu50
uugugaauuuauuuugua

SEQ ID NO: 2070806 - RNA, 13 nt, Staphylococcus aureus subsp. aureus Mu50
uugucuuugaaug

SEQ ID NO: 2070807 - RNA, 17 nt, Staphylococcus aureus subsp. aureus Mu50
uugucuuuuuuaucaug

SEQ ID NO: 2070808 - RNA, 18 nt, Staphylococcus aureus subsp. aureus Mu50
uugugaaauuagagaacg

SEQ ID NO: 2070809 - RNA, 14 nt, Staphylococcus aureus subsp. aureus Mu50
uugugcuuuuccau

SEQ ID NO: 2070810 - RNA, 15 nt, Staphylococcus aureus subsp. aureus Mu50
uugugcuuuuccaua

SEQ ID NO: 2070811 - RNA, 18 nt, Staphylococcus aureus subsp. aureus Mu50
uugugauaauucuucaac

SEQ ID NO: 2070812 - RNA, 14 nt, Staphylococcus aureus subsp. aureus Mu50
uucuagauucauau

SEQ ID NO: 2070813 - RNA, 19 nt, Staphylococcus aureus subsp. aureus Mu50
uucuagauucauauuuaua

SEQ ID NO: 2070814 - RNA, 15 nt, Staphylococcus aureus subsp. aureus Mu50
uucguuuucaucaac

SEQ ID NO: 2070815 - RNA, 12 nt, Staphylococcus aureus subsp. aureus Mu50
uucguuuuacua

SEQ ID NO: 2070816 - RNA, 19 nt, Staphylococcus aureus subsp. aureus Mu50
uucuaaaaaauuaaaaauu

SEQ ID NO: 2070817 - RNA, 18 nt, Staphylococcus aureus subsp. aureus Mu50
uucuaaaaaauuaaaaau

SEQ ID NO: 2070818 - RNA, 12 nt, Staphylococcus aureus subsp. aureus Mu50
uucuaaaaguug

SEQ ID NO: 2070819 - RNA, 14 nt, Staphylococcus aureus subsp. aureus Mu50
uucuaaaauaaaac

SEQ ID NO: 2070820 - RNA, 18 nt, Staphylococcus aureus subsp. aureus Mu50
uucuaaacaacuucugaa

SEQ ID NO: 2070821 - RNA, 15 nt, Staphylococcus aureus subsp. aureus Mu50
uucucauuauaauga

SEQ ID NO: 2070822 - RNA, 13 nt, Staphylococcus aureus subsp. aureus Mu50
uucucauugaaau

SEQ ID NO: 2070823 - RNA, 23 nt, Staphylococcus aureus subsp. aureus Mu50
uucucaacaaaucuauaaauauc

SEQ ID NO: 2070824 - RNA, 19 nt, Staphylococcus aureus subsp. aureus Mu50
uucucaucuauuuaauaau

SEQ ID NO: 2070825 - RNA, 21 nt, Staphylococcus aureus subsp. aureus Mu50
uucuauuuuugauuuaauaau

SEQ ID NO: 2070826 - RNA, 15 nt, Staphylococcus aureus subsp. aureus Mu50
uucuauuuuucaauu

SEQ ID NO: 2070827 - RNA, 17 nt, Staphylococcus aureus subsp. aureus Mu50
uucuauuuucauagaug

SEQ ID NO: 2070828 - RNA, 18 nt, Staphylococcus aureus subsp. aureus Mu50
uucuauuuuauaauaaau

SEQ ID NO: 2070829 - RNA, 16 nt, Staphylococcus aureus subsp. aureus Mu50
uucuaucaaauaauga

SEQ ID NO: 2070830 - RNA, 10 nt, Staphylococcus aureus subsp. aureus Mu50
uucugcuucu

SEQ ID NO: 2070831 - RNA, 20 nt, Staphylococcus aureus subsp. aureus Mu50
uucugcgugcuuaauuacaa

SEQ ID NO: 2070832 - RNA, 20 nt, Staphylococcus aureus subsp. aureus Mu50
uucugaaacuuuaauacuac

SEQ ID NO: 2070833 - RNA, 21 nt, Staphylococcus aureus subsp. aureus Mu50
uucugaaaugauacauuauua

SEQ ID NO: 2070834 - RNA, 18 nt, Staphylococcus aureus subsp. aureus Mu50
uucuccuaauaauuuggu

SEQ ID NO: 2070835 - RNA, 23 nt, Staphylococcus aureus subsp. aureus Mu50
uucucccauacugauuaacaagg

SEQ ID NO: 2070836 - RNA, 12 nt, Staphylococcus aureus subsp. aureus Mu50
uucuucaucuuu

SEQ ID NO: 2070837 - RNA, 17 nt, Staphylococcus aureus subsp. aureus Mu50
uucuucaguuaaaucuu

SEQ ID NO: 2070838 - RNA, 15 nt, Staphylococcus aureus subsp. aureus Mu50
uucuucauaguucaa

SEQ ID NO: 2070839 - RNA, 13 nt, Staphylococcus aureus subsp. aureus Mu50
uucuucaauuguc

SEQ ID NO: 2070840 - RNA, 14 nt, Staphylococcus aureus subsp. aureus Mu50
uucuucacuaaaaa

SEQ ID NO: 2070841 - RNA, 18 nt, Staphylococcus aureus subsp. aureus Mu50
uucuucacugcuguuuuu

SEQ ID NO: 2070842 - RNA, 13 nt, Staphylococcus aureus subsp. aureus Mu50
uucuuauucaaau

SEQ ID NO: 2070843 - RNA, 12 nt, Staphylococcus aureus subsp. aureus Mu50
uucuuauuugaa

SEQ ID NO: 2070844 - RNA, 18 nt, Staphylococcus aureus subsp. aureus Mu50
uucuuauuuauucauaac

SEQ ID NO: 2070845 - RNA, 13 nt, Staphylococcus aureus subsp. aureus Mu50
uucuuauaaaaau

SEQ ID NO: 2070846 - RNA, 11 nt, Staphylococcus aureus subsp. aureus Mu50
uucuuauaaaa

SEQ ID NO: 2070847 - RNA, 12 nt, Staphylococcus aureus subsp. aureus Mu50
uucuuauaaaaa

SEQ ID NO: 2070848 - RNA, 13 nt, Staphylococcus aureus subsp. aureus Mu50
uucuuauaaaaua

SEQ ID NO: 2070849 - RNA, 13 nt, Staphylococcus aureus subsp. aureus Mu50
uucuuauuaaaua

SEQ ID NO: 2070850 - RNA, 15 nt, Staphylococcus aureus subsp. aureus Mu50
uucuuauuaaauaag

SEQ ID NO: 2070851 - RNA, 22 nt, Staphylococcus aureus subsp. aureus Mu50
uucuuaucuguaccguuuuuua

SEQ ID NO: 2070852 - RNA, 13 nt, Staphylococcus aureus subsp. aureus Mu50
uucuuaauuauca

SEQ ID NO: 2070853 - RNA, 18 nt, Staphylococcus aureus subsp. aureus Mu50
uucuuaacauaaaaugag

SEQ ID NO: 2070854 - RNA, 22 nt, Staphylococcus aureus subsp. aureus Mu50
uucuuaaaucaacaucaucuuu

SEQ ID NO: 2070855 - RNA, 19 nt, Staphylococcus aureus subsp. aureus Mu50
uucuguacguuuuaaauaa

SEQ ID NO: 2070856 - RNA, 23 nt, Staphylococcus aureus subsp. aureus Mu50
uucugucgcuucuucuucagaaa

SEQ ID NO: 2070857 - RNA, 17 nt, Staphylococcus aureus subsp. aureus Mu50
uucuuaaaaagcagcag

SEQ ID NO: 2070858 - RNA, 11 nt, Staphylococcus aureus subsp. aureus Mu50
uucuuaaaaag

SEQ ID NO: 2070859 - RNA, 16 nt, Staphylococcus aureus subsp. aureus Mu50
uucggaugagaaaugu

SEQ ID NO: 2070860 - RNA, 12 nt, Staphylococcus aureus subsp. aureus Mu50
uucggauaaaua

SEQ ID NO: 2070861 - RNA, 15 nt, Staphylococcus aureus subsp. aureus Mu50
uucggcuuuccuaau

SEQ ID NO: 2070862 - RNA, 23 nt, Staphylococcus aureus subsp. aureus Mu50
uucguccaacauguaacaaaaua

SEQ ID NO: 2070863 - RNA, 16 nt, Staphylococcus aureus subsp. aureus Mu50
uucgauuauucuuaau

SEQ ID NO: 2070864 - RNA, 13 nt, Staphylococcus aureus subsp. aureus Mu50
uucgauucauaaa

SEQ ID NO: 2070865 - RNA, 18 nt, Staphylococcus aureus subsp. aureus Mu50
uucgacuguauacgacgu

SEQ ID NO: 2070866 - RNA, 21 nt, Staphylococcus aureus subsp. aureus Mu50
uucgagugcuuuuaaucaaau

SEQ ID NO: 2070867 - RNA, 16 nt, Staphylococcus aureus subsp. aureus Mu50
uucgauuuagaagaac

SEQ ID NO: 2070868 - RNA, 15 nt, Staphylococcus aureus subsp. aureus Mu50
uucgauucauaaaau

SEQ ID NO: 2070869 - RNA, 18 nt, Staphylococcus aureus subsp. aureus Mu50
uuccaaucaacuucauau

SEQ ID NO: 2070870 - RNA, 16 nt, Staphylococcus aureus subsp. aureus Mu50
uuccaaguuaaugcac

SEQ ID NO: 2070871 - RNA, 15 nt, Staphylococcus aureus subsp. aureus Mu50
uucccuaugaaauaa

SEQ ID NO: 2070872 - RNA, 17 nt, Staphylococcus aureus subsp. aureus Mu50
uucccuguuaugaagua

SEQ ID NO: 2070873 - RNA, 17 nt, Staphylococcus aureus subsp. aureus Mu50
uucgaacgcuugaaaaa

SEQ ID NO: 2070874 - RNA, 17 nt, Staphylococcus aureus subsp. aureus Mu50
uucgaacuaucaauaua

SEQ ID NO: 2070875 - RNA, 16 nt, Staphylococcus aureus subsp. aureus Mu50
uucgaacgcuugaaaa

SEQ ID NO: 2070876 - RNA, 17 nt, Staphylococcus aureus subsp. aureus Mu50
uucgaagucauaugcau

SEQ ID NO: 2070877 - RNA, 18 nt, Staphylococcus aureus subsp. aureus Mu50
uuccuaaaccucuaaaua

SEQ ID NO: 2070878 - RNA, 22 nt, Staphylococcus aureus subsp. aureus Mu50
uuccucuggaacuuuaauacca

SEQ ID NO: 2070879 - RNA, 15 nt, Staphylococcus aureus subsp. aureus Mu50
uuccuaaagucgucu

SEQ ID NO: 2070880 - RNA, 15 nt, Staphylococcus aureus subsp. aureus Mu50
uucauuuguauuaau

SEQ ID NO: 2070881 - RNA, 19 nt, Staphylococcus aureus subsp. aureus Mu50
uucauuuguauuaauuuga

SEQ ID NO: 2070882 - RNA, 18 nt, Staphylococcus aureus subsp. aureus Mu50
uucauuucccuuaaauca

SEQ ID NO: 2070883 - RNA, 17 nt, Staphylococcus aureus subsp. aureus Mu50
uucauuuaguuaaauac

SEQ ID NO: 2070884 - RNA, 12 nt, Staphylococcus aureus subsp. aureus Mu50
uucauuuaacau

SEQ ID NO: 2070885 - RNA, 12 nt, Staphylococcus aureus subsp. aureus Mu50
uucauuuaaaaa

SEQ ID NO: 2070886 - RNA, 16 nt, Staphylococcus aureus subsp. aureus Mu50
uucauuguuaaacauu

SEQ ID NO: 2070887 - RNA, 17 nt, Staphylococcus aureus subsp. aureus Mu50
uucauuguaauaauaau

SEQ ID NO: 2070888 - RNA, 17 nt, Staphylococcus aureus subsp. aureus Mu50
uucauugcguaagguau

SEQ ID NO: 2070889 - RNA, 23 nt, Staphylococcus aureus subsp. aureus Mu50
uucauucguacuuccaauacugu

SEQ ID NO: 2070890 - RNA, 22 nt, Staphylococcus aureus subsp. aureus Mu50
uucauuauagucuuaaacauaa

SEQ ID NO: 2070891 - RNA, 21 nt, Staphylococcus aureus subsp. aureus Mu50
uucauuauagugugucauaau

SEQ ID NO: 2070892 - RNA, 19 nt, Staphylococcus aureus subsp. aureus Mu50
uuccaagagaauuaauaau

SEQ ID NO: 2070893 - RNA, 16 nt, Staphylococcus aureus subsp. aureus Mu50
uuccaacaacuaagau

SEQ ID NO: 2070894 - RNA, 18 nt, Staphylococcus aureus subsp. aureus Mu50
uuccaaauugcaaaguaa

SEQ ID NO: 2070895 - RNA, 18 nt, Staphylococcus aureus subsp. aureus Mu50
uuccaaauugaaauuauc

SEQ ID NO: 2070896 - RNA, 11 nt, Staphylococcus aureus subsp. aureus Mu50
uuccaaaaauu

SEQ ID NO: 2070897 - RNA, 14 nt, Staphylococcus aureus subsp. aureus Mu50
uucauuuuauaaau

SEQ ID NO: 2070898 - RNA, 17 nt, Staphylococcus aureus subsp. aureus Mu50
uucauuuucaaauaacu

SEQ ID NO: 2070899 - RNA, 14 nt, Staphylococcus aureus subsp. aureus Mu50
uucauuaauacaag

SEQ ID NO: 2070900 - RNA, 16 nt, Staphylococcus aureus subsp. aureus Mu50
uucauuaauuuuucaa

SEQ ID NO: 2070901 - RNA, 15 nt, Staphylococcus aureus subsp. aureus Mu50
uucauguccaucuuu

SEQ ID NO: 2070902 - RNA, 17 nt, Staphylococcus aureus subsp. aureus Mu50
uucauguuugauucuaa

SEQ ID NO: 2070903 - RNA, 21 nt, Staphylococcus aureus subsp. aureus Mu50
uucauguuugauucuaaauaa

SEQ ID NO: 2070904 - RNA, 16 nt, Staphylococcus aureus subsp. aureus Mu50
uucauguaugaaguaa

SEQ ID NO: 2070905 - RNA, 17 nt, Staphylococcus aureus subsp. aureus Mu50
uucaugugucacaauga

SEQ ID NO: 2070906 - RNA, 19 nt, Staphylococcus aureus subsp. aureus Mu50
uucaugugucauaauccau

SEQ ID NO: 2070907 - RNA, 14 nt, Staphylococcus aureus subsp. aureus Mu50
uucauguucauaau

SEQ ID NO: 2070908 - RNA, 12 nt, Staphylococcus aureus subsp. aureus Mu50
uucaucuuucaa

SEQ ID NO: 2070909 - RNA, 16 nt, Staphylococcus aureus subsp. aureus Mu50
uucaucuucuucaaaa

SEQ ID NO: 2070910 - RNA, 12 nt, Staphylococcus aureus subsp. aureus Mu50
uucaucuugcaa

SEQ ID NO: 2070911 - RNA, 19 nt, Staphylococcus aureus subsp. aureus Mu50
uucaucucuuauaaguuca

SEQ ID NO: 2070912 - RNA, 12 nt, Staphylococcus aureus subsp. aureus Mu50
uucaucuucaaa

SEQ ID NO: 2070913 - RNA, 20 nt, Staphylococcus aureus subsp. aureus Mu50
uucaucgucucacuuaauaa

SEQ ID NO: 2070914 - RNA, 18 nt, Staphylococcus aureus subsp. aureus Mu50
uucaucguucauauauuu

SEQ ID NO: 2070915 - RNA, 20 nt, Staphylococcus aureus subsp. aureus Mu50
uucauaaaauuuaaaacaau

SEQ ID NO: 2070916 - RNA, 17 nt, Staphylococcus aureus subsp. aureus Mu50
uucaguucaaacagaaa

SEQ ID NO: 2070917 - RNA, 14 nt, Staphylococcus aureus subsp. aureus Mu50
uucauaaugaucaa

SEQ ID NO: 2070918 - RNA, 16 nt, Staphylococcus aureus subsp. aureus Mu50
uucauaaugaucaagu

SEQ ID NO: 2070919 - RNA, 21 nt, Staphylococcus aureus subsp. aureus Mu50
uucauacacuaucauuaucaa

SEQ ID NO: 2070920 - RNA, 13 nt, Staphylococcus aureus subsp. aureus Mu50
uucauaauuaaca

SEQ ID NO: 2070921 - RNA, 20 nt, Staphylococcus aureus subsp. aureus Mu50
uucauaauuaacacauucaa

SEQ ID NO: 2070922 - RNA, 14 nt, Staphylococcus aureus subsp. aureus Mu50
uucauaauuaauaa

SEQ ID NO: 2070923 - RNA, 22 nt, Staphylococcus aureus subsp. aureus Mu50
uucauaagucuuaacaaauuaa

SEQ ID NO: 2070924 - RNA, 16 nt, Staphylococcus aureus subsp. aureus Mu50
uucauaaacucuuaca

SEQ ID NO: 2070925 - RNA, 18 nt, Staphylococcus aureus subsp. aureus Mu50
uucauaaaugacugaauu

SEQ ID NO: 2070926 - RNA, 22 nt, Staphylococcus aureus subsp. aureus Mu50
uucaguacgguuauuuaauaau

SEQ ID NO: 2070927 - RNA, 19 nt, Staphylococcus aureus subsp. aureus Mu50
uucaguaggacauauaaau

SEQ ID NO: 2070928 - RNA, 15 nt, Staphylococcus aureus subsp. aureus Mu50
uucaguaauuucucc

SEQ ID NO: 2070929 - RNA, 21 nt, Staphylococcus aureus subsp. aureus Mu50
uucagguuuuaugaauugagu

SEQ ID NO: 2070930 - RNA, 22 nt, Staphylococcus aureus subsp. aureus Mu50
uucaguauagacuauaggucuu

SEQ ID NO: 2070931 - RNA, 22 nt, Staphylococcus aureus subsp. aureus Mu50
uucagcuaauucgucuacauau

SEQ ID NO: 2070932 - RNA, 22 nt, Staphylococcus aureus subsp. aureus Mu50
uucagcgauaacguacaaugua

SEQ ID NO: 2070933 - RNA, 18 nt, Staphylococcus aureus subsp. aureus Mu50
uucauaguguuuguaaug

SEQ ID NO: 2070934 - RNA, 14 nt, Staphylococcus aureus subsp. aureus Mu50
uucauaguuuaugu

SEQ ID NO: 2070935 - RNA, 22 nt, Staphylococcus aureus subsp. aureus Mu50
uucauacacugcacaucauaau

SEQ ID NO: 2070936 - RNA, 15 nt, Staphylococcus aureus subsp. aureus Mu50
uucaucaauaacuau

SEQ ID NO: 2070937 - RNA, 22 nt, Staphylococcus aureus subsp. aureus Mu50
uucauauuuagguaauacauca

SEQ ID NO: 2070938 - RNA, 14 nt, Staphylococcus aureus subsp. aureus Mu50
uucauaucuuucaa

SEQ ID NO: 2070939 - RNA, 16 nt, Staphylococcus aureus subsp. aureus Mu50
uucauauggugaacug

SEQ ID NO: 2070940 - RNA, 13 nt, Staphylococcus aureus subsp. aureus Mu50
uucauauuaacug

SEQ ID NO: 2070941 - RNA, 19 nt, Staphylococcus aureus subsp. aureus Mu50
uucaucauaaucugcugcu

SEQ ID NO: 2070942 - RNA, 19 nt, Staphylococcus aureus subsp. aureus Mu50
uucaucaguaccaaagaaa

SEQ ID NO: 2070943 - RNA, 20 nt, Staphylococcus aureus subsp. aureus Mu50
uucaccauuucguguuccaa

SEQ ID NO: 2070944 - RNA, 14 nt, Staphylococcus aureus subsp. aureus Mu50
uucaccaacuuuuu

SEQ ID NO: 2070945 - RNA, 14 nt, Staphylococcus aureus subsp. aureus Mu50
uucacucuguaaua

SEQ ID NO: 2070946 - RNA, 17 nt, Staphylococcus aureus subsp. aureus Mu50
uucagaaacuuuugaaa

SEQ ID NO: 2070947 - RNA, 19 nt, Staphylococcus aureus subsp. aureus Mu50
uucacuguauaaggaugua

SEQ ID NO: 2070948 - RNA, 16 nt, Staphylococcus aureus subsp. aureus Mu50
uucacuguauaaauaa

SEQ ID NO: 2070949 - RNA, 15 nt, Staphylococcus aureus subsp. aureus Mu50
uucacuucaaacaaa

SEQ ID NO: 2070950 - RNA, 12 nt, Staphylococcus aureus subsp. aureus Mu50
uucacuguuuua

SEQ ID NO: 2070951 - RNA, 16 nt, Staphylococcus aureus subsp. aureus Mu50
uucagauuuguauuuu

SEQ ID NO: 2070952 - RNA, 14 nt, Staphylococcus aureus subsp. aureus Mu50
uucagaugaauaau

SEQ ID NO: 2070953 - RNA, 19 nt, Staphylococcus aureus subsp. aureus Mu50
uucagaacuaugaauagau

SEQ ID NO: 2070954 - RNA, 13 nt, Staphylococcus aureus subsp. aureus Mu50
uucacauuuaucc

SEQ ID NO: 2070955 - RNA, 17 nt, Staphylococcus aureus subsp. aureus Mu50
uucacauucuugaauaa

SEQ ID NO: 2070956 - RNA, 13 nt, Staphylococcus aureus subsp. aureus Mu50
uucaauuaucaaa

SEQ ID NO: 2070957 - RNA, 16 nt, Staphylococcus aureus subsp. aureus Mu50
uucaauuaaauguuua

SEQ ID NO: 2070958 - RNA, 18 nt, Staphylococcus aureus subsp. aureus Mu50
uucaauguuuaauuuucu

SEQ ID NO: 2070959 - RNA, 23 nt, Staphylococcus aureus subsp. aureus Mu50
uucaauugacauuaaugauagca

SEQ ID NO: 2070960 - RNA, 15 nt, Staphylococcus aureus subsp. aureus Mu50
uucaauucuuacacc

SEQ ID NO: 2070961 - RNA, 19 nt, Staphylococcus aureus subsp. aureus Mu50
uucaauucgcauuaaauaa

SEQ ID NO: 2070962 - RNA, 21 nt, Staphylococcus aureus subsp. aureus Mu50
uucaauucgcucacaugugaa

SEQ ID NO: 2070963 - RNA, 13 nt, Staphylococcus aureus subsp. aureus Mu50
uucaaucgucaca

SEQ ID NO: 2070964 - RNA, 14 nt, Staphylococcus aureus subsp. aureus Mu50
uucaaguuuaaaau

SEQ ID NO: 2070965 - RNA, 14 nt, Staphylococcus aureus subsp. aureus Mu50
uucaagcguuucuu

SEQ ID NO: 2070966 - RNA, 21 nt, Staphylococcus aureus subsp. aureus Mu50
uucaaguaauggauugauaau

SEQ ID NO: 2070967 - RNA, 21 nt, Staphylococcus aureus subsp. aureus Mu50
uucaaguauauccgcaucuuu

SEQ ID NO: 2070968 - RNA, 19 nt, Staphylococcus aureus subsp. aureus Mu50
uucaauguaucaccuaauu

SEQ ID NO: 2070969 - RNA, 18 nt, Staphylococcus aureus subsp. aureus Mu50
uucaaugucuacuuugaa

SEQ ID NO: 2070970 - RNA, 18 nt, Staphylococcus aureus subsp. aureus Mu50
uucaaugauuuuuaaaaa

SEQ ID NO: 2070971 - RNA, 19 nt, Staphylococcus aureus subsp. aureus Mu50
uucaaugagaagcugucuu

SEQ ID NO: 2070972 - RNA, 14 nt, Staphylococcus aureus subsp. aureus Mu50
uuauucuaauacaa

SEQ ID NO: 2070973 - RNA, 13 nt, Staphylococcus aureus subsp. aureus Mu50
uuauucuaaauau

SEQ ID NO: 2070974 - RNA, 20 nt, Staphylococcus aureus subsp. aureus Mu50
uuauugccgguuaaauuauu

SEQ ID NO: 2070975 - RNA, 12 nt, Staphylococcus aureus subsp. aureus Mu50
uuauuucagcuu

SEQ ID NO: 2070976 - RNA, 15 nt, Staphylococcus aureus subsp. aureus Mu50
uuauuucaauuauca

SEQ ID NO: 2070977 - RNA, 16 nt, Staphylococcus aureus subsp. aureus Mu50
uuauuuauucagcauu

SEQ ID NO: 2070978 - RNA, 12 nt, Staphylococcus aureus subsp. aureus Mu50
uuauuuauauuu

SEQ ID NO: 2070979 - RNA, 17 nt, Staphylococcus aureus subsp. aureus Mu50
uuauuuauaaacaauaa

SEQ ID NO: 2070980 - RNA, 17 nt, Staphylococcus aureus subsp. aureus Mu50
uuauucaauugauuaca

SEQ ID NO: 2070981 - RNA, 12 nt, Staphylococcus aureus subsp. aureus Mu50
uuauuauuuauc

SEQ ID NO: 2070982 - RNA, 20 nt, Staphylococcus aureus subsp. aureus Mu50
uuauuaugaauuauuaauaa

SEQ ID NO: 2070983 - RNA, 12 nt, Staphylococcus aureus subsp. aureus Mu50
uuauuauuaaau

SEQ ID NO: 2070984 - RNA, 14 nt, Staphylococcus aureus subsp. aureus Mu50
uuauuauuaaauua

SEQ ID NO: 2070985 - RNA, 20 nt, Staphylococcus aureus subsp. aureus Mu50
uuauuauuacaaugaaaaaa

SEQ ID NO: 2070986 - RNA, 19 nt, Staphylococcus aureus subsp. aureus Mu50
uuauucaaaauucaauauu

SEQ ID NO: 2070987 - RNA, 20 nt, Staphylococcus aureus subsp. aureus Mu50
uuauuauuuuguauuuuuca

SEQ ID NO: 2070988 - RNA, 14 nt, Staphylococcus aureus subsp. aureus Mu50
uuauucaaaucaua

SEQ ID NO: 2070989 - RNA, 13 nt, Staphylococcus aureus subsp. aureus Mu50
uuauucaauauuu

SEQ ID NO: 2070990 - RNA, 22 nt, Staphylococcus aureus subsp. aureus Mu50
uuaggauguucagcuaacucuu

SEQ ID NO: 2070991 - RNA, 17 nt, Staphylococcus aureus subsp. aureus Mu50
uuaggcgcuacaauguu

SEQ ID NO: 2070992 - RNA, 19 nt, Staphylococcus aureus subsp. aureus Mu50
uuauuaucuuuguaaauuu

SEQ ID NO: 2070993 - RNA, 15 nt, Staphylococcus aureus subsp. aureus Mu50
uuauuaucuuuguaa

SEQ ID NO: 2070994 - RNA, 22 nt, Staphylococcus aureus subsp. aureus Mu50
uuauuaucagcccaaucaguuu

SEQ ID NO: 2070995 - RNA, 17 nt, Staphylococcus aureus subsp. aureus Mu50
uuaggcuuaaauauaau

SEQ ID NO: 2070996 - RNA, 21 nt, Staphylococcus aureus subsp. aureus Mu50
uuaggcuuauuaacuuuuccu

SEQ ID NO: 2070997 - RNA, 19 nt, Staphylococcus aureus subsp. aureus Mu50
uucaacaaacauaaauaag

SEQ ID NO: 2070998 - RNA, 17 nt, Staphylococcus aureus subsp. aureus Mu50
uucaacagggguaaaac

SEQ ID NO: 2070999 - RNA, 21 nt, Staphylococcus aureus subsp. aureus Mu50
uucaaauguugacuacucaau

SEQ ID NO: 2071000 - RNA, 13 nt, Staphylococcus aureus subsp. aureus Mu50
uucaaauguugaa

SEQ ID NO: 2071001 - RNA, 16 nt, Staphylococcus aureus subsp. aureus Mu50
uucaacauauaaauca

SEQ ID NO: 2071002 - RNA, 15 nt, Staphylococcus aureus subsp. aureus Mu50
uucaacuacuucauc

SEQ ID NO: 2071003 - RNA, 15 nt, Staphylococcus aureus subsp. aureus Mu50
uucaacuaauuuaaa

SEQ ID NO: 2071004 - RNA, 19 nt, Staphylococcus aureus subsp. aureus Mu50
uucaacuuguuuccuacac

SEQ ID NO: 2071005 - RNA, 18 nt, Staphylococcus aureus subsp. aureus Mu50
uucaacuuguuuccuaca

SEQ ID NO: 2071006 - RNA, 16 nt, Staphylococcus aureus subsp. aureus Mu50
uucaacuuauuauuua

SEQ ID NO: 2071007 - RNA, 23 nt, Staphylococcus aureus subsp. aureus Mu50
uucaaagacacggccugcaaguc

SEQ ID NO: 2071008 - RNA, 19 nt, Staphylococcus aureus subsp. aureus Mu50
uuauuuugcaauugcaaug

SEQ ID NO: 2071009 - RNA, 13 nt, Staphylococcus aureus subsp. aureus Mu50
uuauuuuaucauc

SEQ ID NO: 2071010 - RNA, 23 nt, Staphylococcus aureus subsp. aureus Mu50
uuauuuucauauaaauagcuucu

SEQ ID NO: 2071011 - RNA, 17 nt, Staphylococcus aureus subsp. aureus Mu50
uuauuuucaauaaauuu

SEQ ID NO: 2071012 - RNA, 23 nt, Staphylococcus aureus subsp. aureus Mu50
uuauuuucaauaaauuuuauaua

SEQ ID NO: 2071013 - RNA, 17 nt, Staphylococcus aureus subsp. aureus Mu50
uuauuuucaauaaauaa

SEQ ID NO: 2071014 - RNA, 21 nt, Staphylococcus aureus subsp. aureus Mu50
uucaaaguagacauugaauaa

SEQ ID NO: 2071015 - RNA, 19 nt, Staphylococcus aureus subsp. aureus Mu50
uucaaagcugucaacuugu

SEQ ID NO: 2071016 - RNA, 19 nt, Staphylococcus aureus subsp. aureus Mu50
uucaaauauaucuaauacu

SEQ ID NO: 2071017 - RNA, 21 nt, Staphylococcus aureus subsp. aureus Mu50
uucaaauaaaucaaacuuuuc

SEQ ID NO: 2071018 - RNA, 21 nt, Staphylococcus aureus subsp. aureus Mu50
uucaaauaaaugacauuuaau

SEQ ID NO: 2071019 - RNA, 16 nt, Staphylococcus aureus subsp. aureus Mu50
uucaaauaauauaaaa

SEQ ID NO: 2071020 - RNA, 16 nt, Staphylococcus aureus subsp. aureus Mu50
uggcacauaaaucaau

SEQ ID NO: 2071021 - RNA, 13 nt, Staphylococcus aureus subsp. aureus Mu50
ugcguuaauaauu

SEQ ID NO: 2071022 - RNA, 14 nt, Staphylococcus aureus subsp. aureus Mu50
uggcaaagaauccu

SEQ ID NO: 2071023 - RNA, 16 nt, Staphylococcus aureus subsp. aureus Mu50
uggauuucuuuuuaaa

SEQ ID NO: 2071024 - RNA, 14 nt, Staphylococcus aureus subsp. aureus Mu50
uggauuucuuuuua

SEQ ID NO: 2071025 - RNA, 13 nt, Staphylococcus aureus subsp. aureus Mu50
uggauuucuuauu

SEQ ID NO: 2071026 - RNA, 19 nt, Staphylococcus aureus subsp. aureus Mu50
uggcauuuacgaaguuuaa

SEQ ID NO: 2071027 - RNA, 21 nt, Staphylococcus aureus subsp. aureus Mu50
uggccuuuaaugauucuacag

SEQ ID NO: 2071028 - RNA, 14 nt, Staphylococcus aureus subsp. aureus Mu50
uggcggggccccaa

SEQ ID NO: 2071029 - RNA, 15 nt, Staphylococcus aureus subsp. aureus Mu50
ugguaccuuuccaau

SEQ ID NO: 2071030 - RNA, 19 nt, Staphylococcus aureus subsp. aureus Mu50
ugguacuacuauccagucc

SEQ ID NO: 2071031 - RNA, 18 nt, Staphylococcus aureus subsp. aureus Mu50
ugguauugauuauucuuu

SEQ ID NO: 2071032 - RNA, 17 nt, Staphylococcus aureus subsp. aureus Mu50
ugguauaucgaaaggua

SEQ ID NO: 2071033 - RNA, 19 nt, Staphylococcus aureus subsp. aureus Mu50
uggguuuuaccauaaauug

SEQ ID NO: 2071034 - RNA, 12 nt, Staphylococcus aureus subsp. aureus Mu50
ugguaaauuuau

SEQ ID NO: 2071035 - RNA, 23 nt, Staphylococcus aureus subsp. aureus Mu50
ugguaaauuuaucauuuuaagua

SEQ ID NO: 2071036 - RNA, 18 nt, Staphylococcus aureus subsp. aureus Mu50
ugguacauaaauaccugg

SEQ ID NO: 2071037 - RNA, 11 nt, Staphylococcus aureus subsp. aureus Mu50
ugguaauauuu

SEQ ID NO: 2071038 - RNA, 14 nt, Staphylococcus aureus subsp. aureus Mu50
ugguauuuuuuaaa

SEQ ID NO: 2071039 - RNA, 15 nt, Staphylococcus aureus subsp. aureus Mu50
ugguauuuuuuaaau

SEQ ID NO: 2071040 - RNA, 19 nt, Staphylococcus aureus subsp. aureus Mu50
uggcuuuuuuuauggugug

SEQ ID NO: 2071041 - RNA, 18 nt, Staphylococcus aureus subsp. aureus Mu50
ugggauauagaaaaggga

SEQ ID NO: 2071042 - RNA, 21 nt, Staphylococcus aureus subsp. aureus Mu50
uggcuuuuuaauuguuuaaua

SEQ ID NO: 2071043 - RNA, 13 nt, Staphylococcus aureus subsp. aureus Mu50
uggcuuuuuuaau

SEQ ID NO: 2071044 - RNA, 18 nt, Staphylococcus aureus subsp. aureus Mu50
uggcuuuuuuauuuuaua

SEQ ID NO: 2071045 - RNA, 14 nt, Staphylococcus aureus subsp. aureus Mu50
uggcuucucuuagu

SEQ ID NO: 2071046 - RNA, 21 nt, Staphylococcus aureus subsp. aureus Mu50
uggcuuagguuuaauuuuaaa

SEQ ID NO: 2071047 - RNA, 15 nt, Staphylococcus aureus subsp. aureus Mu50
uggcguugcaccaag

SEQ ID NO: 2071048 - RNA, 17 nt, Staphylococcus aureus subsp. aureus Mu50
uggggcccacaccccaa

SEQ ID NO: 2071049 - RNA, 22 nt, Staphylococcus aureus subsp. aureus Mu50
uggggaugggccccaacaaaga

SEQ ID NO: 2071050 - RNA, 11 nt, Staphylococcus aureus subsp. aureus Mu50
ugugguaaaag

SEQ ID NO: 2071051 - RNA, 16 nt, Staphylococcus aureus subsp. aureus Mu50
uguguauuuuuauugu

SEQ ID NO: 2071052 - RNA, 22 nt, Staphylococcus aureus subsp. aureus Mu50
ugugucaaauaggcauaaugaa

SEQ ID NO: 2071053 - RNA, 22 nt, Staphylococcus aureus subsp. aureus Mu50
ugugucauaauccauucuucuu

SEQ ID NO: 2071054 - RNA, 16 nt, Staphylococcus aureus subsp. aureus Mu50
uguguaugaucaagcu

SEQ ID NO: 2071055 - RNA, 22 nt, Staphylococcus aureus subsp. aureus Mu50
uguggcuacuaaucuuuuuuua

SEQ ID NO: 2071056 - RNA, 17 nt, Staphylococcus aureus subsp. aureus Mu50
uguggcggugguauggu

SEQ ID NO: 2071057 - RNA, 14 nt, Staphylococcus aureus subsp. aureus Mu50
ugugcuguucuauu

SEQ ID NO: 2071058 - RNA, 20 nt, Staphylococcus aureus subsp. aureus Mu50
uguguccauaaauauuaaau

SEQ ID NO: 2071059 - RNA, 19 nt, Staphylococcus aureus subsp. aureus Mu50
uguguucggaauuugcaca

SEQ ID NO: 2071060 - RNA, 14 nt, Staphylococcus aureus subsp. aureus Mu50
uguguguuuuaaaa

SEQ ID NO: 2071061 - RNA, 14 nt, Staphylococcus aureus subsp. aureus Mu50
uguguuguuuuaau

SEQ ID NO: 2071062 - RNA, 17 nt, Staphylococcus aureus subsp. aureus Mu50
uguguuggugcuauuaa

SEQ ID NO: 2071063 - RNA, 18 nt, Staphylococcus aureus subsp. aureus Mu50
uguguuugcuuuuuacua

SEQ ID NO: 2071064 - RNA, 11 nt, Staphylococcus aureus subsp. aureus Mu50
uguguuuucaa

SEQ ID NO: 2071065 - RNA, 14 nt, Staphylococcus aureus subsp. aureus Mu50
uguguuuucuuuuc

SEQ ID NO: 2071066 - RNA, 16 nt, Staphylococcus aureus subsp. aureus Mu50
uguguuucuuuuauuu

SEQ ID NO: 2071067 - RNA, 21 nt, Staphylococcus aureus subsp. aureus Mu50
uguguuucuuuuauuuucaua

SEQ ID NO: 2071068 - RNA, 18 nt, Staphylococcus aureus subsp. aureus Mu50
uguuaaaauuugaauuga

SEQ ID NO: 2071069 - RNA, 18 nt, Staphylococcus aureus subsp. aureus Mu50
uguuaaagauuauuauua

SEQ ID NO: 2071070 - RNA, 16 nt, Staphylococcus aureus subsp. aureus Mu50
uguuaaauucuaaaac

SEQ ID NO: 2071071 - RNA, 12 nt, Staphylococcus aureus subsp. aureus Mu50
uguuaaaucacc

SEQ ID NO: 2071072 - RNA, 15 nt, Staphylococcus aureus subsp. aureus Mu50
uguuaaauucuaaaa

SEQ ID NO: 2071073 - RNA, 18 nt, Staphylococcus aureus subsp. aureus Mu50
uguuaauuucaacauuac

SEQ ID NO: 2071074 - RNA, 13 nt, Staphylococcus aureus subsp. aureus Mu50
uguuaauuuaaua

SEQ ID NO: 2071075 - RNA, 20 nt, Staphylococcus aureus subsp. aureus Mu50
uguuaaucaaaauuaugacu

SEQ ID NO: 2071076 - RNA, 14 nt, Staphylococcus aureus subsp. aureus Mu50
uguuaaguuuucaa

SEQ ID NO: 2071077 - RNA, 21 nt, Staphylococcus aureus subsp. aureus Mu50
uguuaacugauaaaaggggaa

SEQ ID NO: 2071078 - RNA, 15 nt, Staphylococcus aureus subsp. aureus Mu50
uguuacacaaauuaa

SEQ ID NO: 2071079 - RNA, 22 nt, Staphylococcus aureus subsp. aureus Mu50
uguuacugcacggauaccuacu

SEQ ID NO: 2071080 - RNA, 13 nt, Staphylococcus aureus subsp. aureus Mu50
uguuacuuauaua

SEQ ID NO: 2071081 - RNA, 18 nt, Staphylococcus aureus subsp. aureus Mu50
uguuacuaguuuguaaua

SEQ ID NO: 2071082 - RNA, 15 nt, Staphylococcus aureus subsp. aureus Mu50
uguuacuugagaacc

SEQ ID NO: 2071083 - RNA, 20 nt, Staphylococcus aureus subsp. aureus Mu50
uguuacuuauauauucaaua

SEQ ID NO: 2071084 - RNA, 18 nt, Staphylococcus aureus subsp. aureus Mu50
uguuacuucuaauaguaa

SEQ ID NO: 2071085 - RNA, 23 nt, Staphylococcus aureus subsp. aureus Mu50
ugugacucggggaauuuuuaugc

SEQ ID NO: 2071086 - RNA, 14 nt, Staphylococcus aureus subsp. aureus Mu50
ugugaauguuuugu

SEQ ID NO: 2071087 - RNA, 12 nt, Staphylococcus aureus subsp. aureus Mu50
ugugacauacca

SEQ ID NO: 2071088 - RNA, 20 nt, Staphylococcus aureus subsp. aureus Mu50
ugucuuaucaauuagccaau

SEQ ID NO: 2071089 - RNA, 16 nt, Staphylococcus aureus subsp. aureus Mu50
ugucuuacuuuuaaau

SEQ ID NO: 2071090 - RNA, 19 nt, Staphylococcus aureus subsp. aureus Mu50
ugugaauaugcuuuuaaua

SEQ ID NO: 2071091 - RNA, 13 nt, Staphylococcus aureus subsp. aureus Mu50
ugugcaucauuua

SEQ ID NO: 2071092 - RNA, 17 nt, Staphylococcus aureus subsp. aureus Mu50
uguccaauaaauugugg

SEQ ID NO: 2071093 - RNA, 23 nt, Staphylococcus aureus subsp. aureus Mu50
ugucauuucuucuuuuucccaau

SEQ ID NO: 2071094 - RNA, 19 nt, Staphylococcus aureus subsp. aureus Mu50
ugucuaguucgauuuuuua

SEQ ID NO: 2071095 - RNA, 15 nt, Staphylococcus aureus subsp. aureus Mu50
ugucguauucuucaa

SEQ ID NO: 2071096 - RNA, 23 nt, Staphylococcus aureus subsp. aureus Mu50
ugucuagacuuauuugaaugcaa

SEQ ID NO: 2071097 - RNA, 20 nt, Staphylococcus aureus subsp. aureus Mu50
ugucauguguucaaauaacg

SEQ ID NO: 2071098 - RNA, 20 nt, Staphylococcus aureus subsp. aureus Mu50
ugucaugaauuuucaucauu

SEQ ID NO: 2071099 - RNA, 15 nt, Staphylococcus aureus subsp. aureus Mu50
ugucaugccuucauu

SEQ ID NO: 2071100 - RNA, 22 nt, Staphylococcus aureus subsp. aureus Mu50
ugucaucaccuuguuaaaauaa

SEQ ID NO: 2071101 - RNA, 12 nt, Staphylococcus aureus subsp. aureus Mu50
ugucaucgcuuu

SEQ ID NO: 2071102 - RNA, 21 nt, Staphylococcus aureus subsp. aureus Mu50
ugucaguuuugaagaauaaaa

SEQ ID NO: 2071103 - RNA, 20 nt, Staphylococcus aureus subsp. aureus Mu50
ugucauaauagauaaugcac

SEQ ID NO: 2071104 - RNA, 19 nt, Staphylococcus aureus subsp. aureus Mu50
ugucauaauccauucuucu

SEQ ID NO: 2071105 - RNA, 11 nt, Staphylococcus aureus subsp. aureus Mu50
ugucauaccuu

SEQ ID NO: 2071106 - RNA, 19 nt, Staphylococcus aureus subsp. aureus Mu50
uguaugccgccuaauaaua

SEQ ID NO: 2071107 - RNA, 19 nt, Staphylococcus aureus subsp. aureus Mu50
uguaugaguucguaaucuu

SEQ ID NO: 2071108 - RNA, 20 nt, Staphylococcus aureus subsp. aureus Mu50
uguaugauaaccauuaugau

SEQ ID NO: 2071109 - RNA, 20 nt, Staphylococcus aureus subsp. aureus Mu50
uguaugauagaauacuaaaa

SEQ ID NO: 2071110 - RNA, 19 nt, Staphylococcus aureus subsp. aureus Mu50
uguaucaagaucaacaaug

SEQ ID NO: 2071111 - RNA, 14 nt, Staphylococcus aureus subsp. aureus Mu50
uguauggcauaacc

SEQ ID NO: 2071112 - RNA, 13 nt, Staphylococcus aureus subsp. aureus Mu50
uguauuuuuauuu

SEQ ID NO: 2071113 - RNA, 13 nt, Staphylococcus aureus subsp. aureus Mu50
uguauuuuucuua

SEQ ID NO: 2071114 - RNA, 21 nt, Staphylococcus aureus subsp. aureus Mu50
uguauuuuucuuaauuaucau

SEQ ID NO: 2071115 - RNA, 22 nt, Staphylococcus aureus subsp. aureus Mu50
ugucaaauacguaucaagaaaa

SEQ ID NO: 2071116 - RNA, 16 nt, Staphylococcus aureus subsp. aureus Mu50
ugucaauaaauuguuu

SEQ ID NO: 2071117 - RNA, 20 nt, Staphylococcus aureus subsp. aureus Mu50
ugucacuaauggauaugaua

SEQ ID NO: 2071118 - RNA, 17 nt, Staphylococcus aureus subsp. aureus Mu50
uguauagagagaaauaa

SEQ ID NO: 2071119 - RNA, 20 nt, Staphylococcus aureus subsp. aureus Mu50
uguauagcuggcuuuuuaau

SEQ ID NO: 2071120 - RNA, 17 nt, Staphylococcus aureus subsp. aureus Mu50
uguauagauuguauuua

SEQ ID NO: 2071121 - RNA, 20 nt, Staphylococcus aureus subsp. aureus Mu50
uguauagauuguauuuaaua

SEQ ID NO: 2071122 - RNA, 14 nt, Staphylococcus aureus subsp. aureus Mu50
uguauauucuuuuu

SEQ ID NO: 2071123 - RNA, 17 nt, Staphylococcus aureus subsp. aureus Mu50
uguauauuuaacaucaa

SEQ ID NO: 2071124 - RNA, 20 nt, Staphylococcus aureus subsp. aureus Mu50
uguauaaagggcuauuugau

SEQ ID NO: 2071125 - RNA, 14 nt, Staphylococcus aureus subsp. aureus Mu50
uguauaaauaauaa

SEQ ID NO: 2071126 - RNA, 21 nt, Staphylococcus aureus subsp. aureus Mu50
uguauaaauaauaaaugcuau

SEQ ID NO: 2071127 - RNA, 20 nt, Staphylococcus aureus subsp. aureus Mu50
uguauaaaaagugcauauuu

SEQ ID NO: 2071128 - RNA, 17 nt, Staphylococcus aureus subsp. aureus Mu50
uguagggggcauuauua

SEQ ID NO: 2071129 - RNA, 16 nt, Staphylococcus aureus subsp. aureus Mu50
uguaguacuauaguca

SEQ ID NO: 2071130 - RNA, 22 nt, Staphylococcus aureus subsp. aureus Mu50
uguaguaguuccguugaauuaa

SEQ ID NO: 2071131 - RNA, 21 nt, Staphylococcus aureus subsp. aureus Mu50
uguagugcgcuuauuuuacua

SEQ ID NO: 2071132 - RNA, 18 nt, Staphylococcus aureus subsp. aureus Mu50
uguaguuaagauaccuuu

SEQ ID NO: 2071133 - RNA, 21 nt, Staphylococcus aureus subsp. aureus Mu50
uguaguuaagauaccuuuuuc

SEQ ID NO: 2071134 - RNA, 23 nt, Staphylococcus aureus subsp. aureus Mu50
uguaaaacaaugcccguguaaca

SEQ ID NO: 2071135 - RNA, 22 nt, Staphylococcus aureus subsp. aureus Mu50
uguaaaaccuuacccaaaaaau

SEQ ID NO: 2071136 - RNA, 12 nt, Staphylococcus aureus subsp. aureus Mu50
uguaaaaaauau

SEQ ID NO: 2071137 - RNA, 13 nt, Staphylococcus aureus subsp. aureus Mu50
uguaaaaaauauc

SEQ ID NO: 2071138 - RNA, 14 nt, Staphylococcus aureus subsp. aureus Mu50
uguaaccaccugau

SEQ ID NO: 2071139 - RNA, 15 nt, Staphylococcus aureus subsp. aureus Mu50
uguaacacgcucuuu

SEQ ID NO: 2071140 - RNA, 20 nt, Staphylococcus aureus subsp. aureus Mu50
uguaacacgcucuuuucaaa

SEQ ID NO: 2071141 - RNA, 12 nt, Staphylococcus aureus subsp. aureus Mu50
uguaaaaugcuc

SEQ ID NO: 2071142 - RNA, 19 nt, Staphylococcus aureus subsp. aureus Mu50
uguaaacaugguuuucuuu

SEQ ID NO: 2071143 - RNA, 13 nt, Staphylococcus aureus subsp. aureus Mu50
uggucuuucuuag

SEQ ID NO: 2071144 - RNA, 18 nt, Staphylococcus aureus subsp. aureus Mu50
ugguuucauaaacugaau

SEQ ID NO: 2071145 - RNA, 19 nt, Staphylococcus aureus subsp. aureus Mu50
ugguuuaccuaguuuuacu

SEQ ID NO: 2071146 - RNA, 15 nt, Staphylococcus aureus subsp. aureus Mu50
ugguuuaaugagcuu

SEQ ID NO: 2071147 - RNA, 13 nt, Staphylococcus aureus subsp. aureus Mu50
ugguuuugaugua

SEQ ID NO: 2071148 - RNA, 16 nt, Staphylococcus aureus subsp. aureus Mu50
uguaauauuauaacca

SEQ ID NO: 2071149 - RNA, 15 nt, Staphylococcus aureus subsp. aureus Mu50
uguaauaugaaggcu

SEQ ID NO: 2071150 - RNA, 17 nt, Staphylococcus aureus subsp. aureus Mu50
uguaauaucuaaagauu

SEQ ID NO: 2071151 - RNA, 23 nt, Staphylococcus aureus subsp. aureus Mu50
uguaaucacuaucuguuguuaua

SEQ ID NO: 2071152 - RNA, 19 nt, Staphylococcus aureus subsp. aureus Mu50
uguaauccgcagaccacau

SEQ ID NO: 2071153 - RNA, 22 nt, Staphylococcus aureus subsp. aureus Mu50
uguaaugaguaggcucuuaaug

SEQ ID NO: 2071154 - RNA, 13 nt, Staphylococcus aureus subsp. aureus Mu50
uguaauccuuguu

SEQ ID NO: 2071155 - RNA, 21 nt, Staphylococcus aureus subsp. aureus Mu50
uguaccaucacuaaaguaaau

SEQ ID NO: 2071156 - RNA, 20 nt, Staphylococcus aureus subsp. aureus Mu50
uguaccaucacuaaaguaaa

SEQ ID NO: 2071157 - RNA, 13 nt, Staphylococcus aureus subsp. aureus Mu50
uguaccaccccaa

SEQ ID NO: 2071158 - RNA, 23 nt, Staphylococcus aureus subsp. aureus Mu50
uguacaaccuuugcuuaaaccuu

SEQ ID NO: 2071159 - RNA, 14 nt, Staphylococcus aureus subsp. aureus Mu50
uguacaauuuuuaa

SEQ ID NO: 2071160 - RNA, 18 nt, Staphylococcus aureus subsp. aureus Mu50
uguacaauuuuuaaaaac

SEQ ID NO: 2071161 - RNA, 13 nt, Staphylococcus aureus subsp. aureus Mu50
uguacuucaauuu

SEQ ID NO: 2071162 - RNA, 16 nt, Staphylococcus aureus subsp. aureus Mu50
uguaccguauuuuaau

SEQ ID NO: 2071163 - RNA, 23 nt, Staphylococcus aureus subsp. aureus Mu50
uguacuuuuauguuguuauaaag

SEQ ID NO: 2071164 - RNA, 21 nt, Staphylococcus aureus subsp. aureus Mu50
uguuuaccuaaaucuuuaaau

SEQ ID NO: 2071165 - RNA, 17 nt, Staphylococcus aureus subsp. aureus Mu50
uguuuaauuaaaauaca

SEQ ID NO: 2071166 - RNA, 21 nt, Staphylococcus aureus subsp. aureus Mu50
uguuuaauuugauuaaauuca

SEQ ID NO: 2071167 - RNA, 20 nt, Staphylococcus aureus subsp. aureus Mu50
uguuuaguauggaauaaaug

SEQ ID NO: 2071168 - RNA, 11 nt, Staphylococcus aureus subsp. aureus Mu50
uguuguuuuaa

SEQ ID NO: 2071169 - RNA, 14 nt, Staphylococcus aureus subsp. aureus Mu50
uguuguuauauaaa

SEQ ID NO: 2071170 - RNA, 15 nt, Staphylococcus aureus subsp. aureus Mu50
uguuuaaauaaaauu

SEQ ID NO: 2071171 - RNA, 13 nt, Staphylococcus aureus subsp. aureus Mu50
uguuuaaauuuaa

SEQ ID NO: 2071172 - RNA, 22 nt, Staphylococcus aureus subsp. aureus Mu50
uguuggaagccuucaauaguuu

SEQ ID NO: 2071173 - RNA, 20 nt, Staphylococcus aureus subsp. aureus Mu50
uguugguucaucaaacaaca

SEQ ID NO: 2071174 - RNA, 17 nt, Staphylococcus aureus subsp. aureus Mu50
uguuggggcccacaccc

SEQ ID NO: 2071175 - RNA, 16 nt, Staphylococcus aureus subsp. aureus Mu50
uguuggcuuuuugagu

SEQ ID NO: 2071176 - RNA, 14 nt, Staphylococcus aureus subsp. aureus Mu50
uguugugaauaaaa

SEQ ID NO: 2071177 - RNA, 13 nt, Staphylococcus aureus subsp. aureus Mu50
uguugauaauagc

SEQ ID NO: 2071178 - RNA, 23 nt, Staphylococcus aureus subsp. aureus Mu50
uguugauaaugcuacuauuaaau

SEQ ID NO: 2071179 - RNA, 15 nt, Staphylococcus aureus subsp. aureus Mu50
uguugcaaaauacga

SEQ ID NO: 2071180 - RNA, 18 nt, Staphylococcus aureus subsp. aureus Mu50
uguugaacgguagauuua

SEQ ID NO: 2071181 - RNA, 19 nt, Staphylococcus aureus subsp. aureus Mu50
uguugacauuugaccaagu

SEQ ID NO: 2071182 - RNA, 18 nt, Staphylococcus aureus subsp. aureus Mu50
uguugaccaccugauaau

SEQ ID NO: 2071183 - RNA, 22 nt, Staphylococcus aureus subsp. aureus Mu50
uguugaggcguuucagaaguug

SEQ ID NO: 2071184 - RNA, 16 nt, Staphylococcus aureus subsp. aureus Mu50
uguucugcuuuuucuu

SEQ ID NO: 2071185 - RNA, 21 nt, Staphylococcus aureus subsp. aureus Mu50
uguucuggaauugggaaauau

SEQ ID NO: 2071186 - RNA, 14 nt, Staphylococcus aureus subsp. aureus Mu50
uguucuuauaaaaa

SEQ ID NO: 2071187 - RNA, 15 nt, Staphylococcus aureus subsp. aureus Mu50
uguucuuauaaaaaa

SEQ ID NO: 2071188 - RNA, 19 nt, Staphylococcus aureus subsp. aureus Mu50
uguucuugaaaacaauaaa

SEQ ID NO: 2071189 - RNA, 22 nt, Staphylococcus aureus subsp. aureus Mu50
uguucuugaaaacaauaaauuu

SEQ ID NO: 2071190 - RNA, 18 nt, Staphylococcus aureus subsp. aureus Mu50
uguucuucgucaaauuca

SEQ ID NO: 2071191 - RNA, 14 nt, Staphylococcus aureus subsp. aureus Mu50
uguucuucagaaac

SEQ ID NO: 2071192 - RNA, 22 nt, Staphylococcus aureus subsp. aureus Mu50
uguucuucagaaacuuuugaaa

SEQ ID NO: 2071193 - RNA, 21 nt, Staphylococcus aureus subsp. aureus Mu50
uguucuucugcauagcgcucu

SEQ ID NO: 2071194 - RNA, 18 nt, Staphylococcus aureus subsp. aureus Mu50
uguucuuucuuucuuuuc

SEQ ID NO: 2071195 - RNA, 17 nt, Staphylococcus aureus subsp. aureus Mu50
uguucgggaauuuuuua

SEQ ID NO: 2071196 - RNA, 18 nt, Staphylococcus aureus subsp. aureus Mu50
uguucucgucuuucgucc

SEQ ID NO: 2071197 - RNA, 15 nt, Staphylococcus aureus subsp. aureus Mu50
uguucucauuauaau

SEQ ID NO: 2071198 - RNA, 15 nt, Staphylococcus aureus subsp. aureus Mu50
uguucucuauuuaua

SEQ ID NO: 2071199 - RNA, 19 nt, Staphylococcus aureus subsp. aureus Mu50
uguucuaaugauauuugau

SEQ ID NO: 2071200 - RNA, 22 nt, Staphylococcus aureus subsp. aureus Mu50
uguucuaaccauucguaauaaa

SEQ ID NO: 2071201 - RNA, 17 nt, Staphylococcus aureus subsp. aureus Mu50
uguuccgcuacaaaaca

SEQ ID NO: 2071202 - RNA, 18 nt, Staphylococcus aureus subsp. aureus Mu50
uguuccgcuacaaaacau

SEQ ID NO: 2071203 - RNA, 21 nt, Staphylococcus aureus subsp. aureus Mu50
uguuccgcuacaaaacauauu

SEQ ID NO: 2071204 - RNA, 20 nt, Staphylococcus aureus subsp. aureus Mu50
uguuccuccaccaccugcaa

SEQ ID NO: 2071205 - RNA, 23 nt, Staphylococcus aureus subsp. aureus Mu50
uguuccugcuacaacuucuucuc

SEQ ID NO: 2071206 - RNA, 19 nt, Staphylococcus aureus subsp. aureus Mu50
uguuccaaucuuuuuaauu

SEQ ID NO: 2071207 - RNA, 16 nt, Staphylococcus aureus subsp. aureus Mu50
uguucauuggcaauau

SEQ ID NO: 2071208 - RNA, 22 nt, Staphylococcus aureus subsp. aureus Mu50
uguucaacuaaauuuucuaaau

SEQ ID NO: 2071209 - RNA, 17 nt, Staphylococcus aureus subsp. aureus Mu50
uguucaacuaaauuuuc

SEQ ID NO: 2071210 - RNA, 17 nt, Staphylococcus aureus subsp. aureus Mu50
uguucaauuguuacuuu

SEQ ID NO: 2071211 - RNA, 23 nt, Staphylococcus aureus subsp. aureus Mu50
uguucaaugauuuuauaauauua

SEQ ID NO: 2071212 - RNA, 16 nt, Staphylococcus aureus subsp. aureus Mu50
uguucaaugauuuuau

SEQ ID NO: 2071213 - RNA, 13 nt, Staphylococcus aureus subsp. aureus Mu50
uguucaauauuua

SEQ ID NO: 2071214 - RNA, 18 nt, Staphylococcus aureus subsp. aureus Mu50
uguucaauacuucuuguu

SEQ ID NO: 2071215 - RNA, 14 nt, Staphylococcus aureus subsp. aureus Mu50
uguucacuaaaugu

SEQ ID NO: 2071216 - RNA, 21 nt, Staphylococcus aureus subsp. aureus Mu50
uguucaguuguuuuuuuguca

SEQ ID NO: 2071217 - RNA, 16 nt, Staphylococcus aureus subsp. aureus Mu50
uguucaguuguuuuuu

SEQ ID NO: 2071218 - RNA, 19 nt, Staphylococcus aureus subsp. aureus Mu50
uguuaggagagauguauaa

SEQ ID NO: 2071219 - RNA, 22 nt, Staphylococcus aureus subsp. aureus Mu50
uguuaggagagauguauaaaac

SEQ ID NO: 2071220 - RNA, 13 nt, Staphylococcus aureus subsp. aureus Mu50
uguuaggauaaag

SEQ ID NO: 2071221 - RNA, 13 nt, Staphylococcus aureus subsp. aureus Mu50
uguuaggggcuuu

SEQ ID NO: 2071222 - RNA, 16 nt, Staphylococcus aureus subsp. aureus Mu50
uguuaggggcuuuuau

SEQ ID NO: 2071223 - RNA, 14 nt, Staphylococcus aureus subsp. aureus Mu50
uguuagucuuuuua

SEQ ID NO: 2071224 - RNA, 23 nt, Staphylococcus aureus subsp. aureus Mu50
uguuauauaaauaugguuucuua

SEQ ID NO: 2071225 - RNA, 11 nt, Staphylococcus aureus subsp. aureus Mu50
uguuauaaaau

SEQ ID NO: 2071226 - RNA, 15 nt, Staphylococcus aureus subsp. aureus Mu50
uguuauguaugaaag

SEQ ID NO: 2071227 - RNA, 22 nt, Staphylococcus aureus subsp. aureus Mu50
uguuauuaucguaaaaaaacgu

SEQ ID NO: 2071228 - RNA, 15 nt, Staphylococcus aureus subsp. aureus Mu50
uguuauuaaccauca

SEQ ID NO: 2071229 - RNA, 15 nt, Staphylococcus aureus subsp. aureus Mu50
uguuauugcaauaaa

SEQ ID NO: 2071230 - RNA, 15 nt, Staphylococcus aureus subsp. aureus Mu50
uuaaaaccuuuucaa

SEQ ID NO: 2071231 - RNA, 13 nt, Staphylococcus aureus subsp. aureus Mu50
uuaaaacuauaau

SEQ ID NO: 2071232 - RNA, 20 nt, Staphylococcus aureus subsp. aureus Mu50
uuaaaagacauccacagaau

SEQ ID NO: 2071233 - RNA, 15 nt, Staphylococcus aureus subsp. aureus Mu50
uuaaaagauaaauaa

SEQ ID NO: 2071234 - RNA, 19 nt, Staphylococcus aureus subsp. aureus Mu50
uuaaaacaauaauuuaaua

SEQ ID NO: 2071235 - RNA, 13 nt, Staphylococcus aureus subsp. aureus Mu50
uuaaaaaucaaag

SEQ ID NO: 2071236 - RNA, 15 nt, Staphylococcus aureus subsp. aureus Mu50
uuaaaaaucaaagag

SEQ ID NO: 2071237 - RNA, 17 nt, Staphylococcus aureus subsp. aureus Mu50
uuaaaaaucaaagaggc

SEQ ID NO: 2071238 - RNA, 16 nt, Staphylococcus aureus subsp. aureus Mu50
uuaaaauauuuaacuu

SEQ ID NO: 2071239 - RNA, 21 nt, Staphylococcus aureus subsp. aureus Mu50
uuaaaauaugauuuaaaauau

SEQ ID NO: 2071240 - RNA, 22 nt, Staphylococcus aureus subsp. aureus Mu50
uuaaaauauaaauuucuucaua

SEQ ID NO: 2071241 - RNA, 18 nt, Staphylococcus aureus subsp. aureus Mu50
uuaaaauaguucuuuaaa

SEQ ID NO: 2071242 - RNA, 18 nt, Staphylococcus aureus subsp. aureus Mu50
uuaaaaggcgaaacauua

SEQ ID NO: 2071243 - RNA, 17 nt, Staphylococcus aureus subsp. aureus Mu50
uuaaaaguaacauacua

SEQ ID NO: 2071244 - RNA, 15 nt, Staphylococcus aureus subsp. aureus Mu50
uuaaaauaaaucuuu

SEQ ID NO: 2071245 - RNA, 18 nt, Staphylococcus aureus subsp. aureus Mu50
uuaaaaaaccugaaacaa

SEQ ID NO: 2071246 - RNA, 21 nt, Staphylococcus aureus subsp. aureus Mu50
uuaaaaaacaauaaaauuacu

SEQ ID NO: 2071247 - RNA, 19 nt, Staphylococcus aureus subsp. aureus Mu50
uuaaaaaacauaccugcau

SEQ ID NO: 2071248 - RNA, 14 nt, Staphylococcus aureus subsp. aureus Mu50
uuaaaaaacaaaac

SEQ ID NO: 2071249 - RNA, 12 nt, Staphylococcus aureus subsp. aureus Mu50
uuaaaaauaaaa

SEQ ID NO: 2071250 - RNA, 16 nt, Staphylococcus aureus subsp. aureus Mu50
uuaaaaauauguguua

SEQ ID NO: 2071251 - RNA, 17 nt, Staphylococcus aureus subsp. aureus Mu50
uuaaaaauacagcuaca

SEQ ID NO: 2071252 - RNA, 12 nt, Staphylococcus aureus subsp. aureus Mu50
uuaaaaacagca

SEQ ID NO: 2071253 - RNA, 19 nt, Staphylococcus aureus subsp. aureus Mu50
uuaaaaacaauauugacuu

SEQ ID NO: 2071254 - RNA, 22 nt, Staphylococcus aureus subsp. aureus Mu50
uuaaaauucaguaucuaaauau

SEQ ID NO: 2071255 - RNA, 22 nt, Staphylococcus aureus subsp. aureus Mu50
uuaaaauugguuuggauaaaau

SEQ ID NO: 2071256 - RNA, 15 nt, Staphylococcus aureus subsp. aureus Mu50
uuaaacaagcaucau

SEQ ID NO: 2071257 - RNA, 15 nt, Staphylococcus aureus subsp. aureus Mu50
uuaaaauuuaaauau

SEQ ID NO: 2071258 - RNA, 19 nt, Staphylococcus aureus subsp. aureus Mu50
uuaaacaagccuuaaaaua

SEQ ID NO: 2071259 - RNA, 20 nt, Staphylococcus aureus subsp. aureus Mu50
uuaaaaugauaucugacauu

SEQ ID NO: 2071260 - RNA, 21 nt, Staphylococcus aureus subsp. aureus Mu50
uuaaaaucucauaauaauuca

SEQ ID NO: 2071261 - RNA, 18 nt, Staphylococcus aureus subsp. aureus Mu50
uuaaaaugcuuuuuugaa

SEQ ID NO: 2071262 - RNA, 18 nt, Staphylococcus aureus subsp. aureus Mu50
uuaaaauuaaaccuacaa

SEQ ID NO: 2071263 - RNA, 11 nt, Staphylococcus aureus subsp. aureus Mu50
uuaaaauuauu

SEQ ID NO: 2071264 - RNA, 20 nt, Staphylococcus aureus subsp. aureus Mu50
uuaaacauccaauuauguuu

SEQ ID NO: 2071265 - RNA, 21 nt, Staphylococcus aureus subsp. aureus Mu50
uuaaacauccaauuauguuua

SEQ ID NO: 2071266 - RNA, 16 nt, Staphylococcus aureus subsp. aureus Mu50
uuaaacaguuuaauuc

SEQ ID NO: 2071267 - RNA, 22 nt, Staphylococcus aureus subsp. aureus Mu50
uuaaacauuuuuagaaucaaaa

SEQ ID NO: 2071268 - RNA, 14 nt, Staphylococcus aureus subsp. aureus Mu50
uuaaaccuuaauaa

SEQ ID NO: 2071269 - RNA, 14 nt, Staphylococcus aureus subsp. aureus Mu50
uuaaacuuauuaau

SEQ ID NO: 2071270 - RNA, 20 nt, Staphylococcus aureus subsp. aureus Mu50
uuaaacuuauuaauuaauag

SEQ ID NO: 2071271 - RNA, 19 nt, Staphylococcus aureus subsp. aureus Mu50
uuaaacuuccuuuuuuuaa

SEQ ID NO: 2071272 - RNA, 15 nt, Staphylococcus aureus subsp. aureus Mu50
uuaaacgguucauuu

SEQ ID NO: 2071273 - RNA, 20 nt, Staphylococcus aureus subsp. aureus Mu50
uuaaacgcugauuuuauaaa

SEQ ID NO: 2071274 - RNA, 16 nt, Staphylococcus aureus subsp. aureus Mu50
uuaaacucucuaaaaa

SEQ ID NO: 2071275 - RNA, 21 nt, Staphylococcus aureus subsp. aureus Mu50
uuaaagcaaauuauauagaaa

SEQ ID NO: 2071276 - RNA, 13 nt, Staphylococcus aureus subsp. aureus Mu50
uuaaagcaucaua

SEQ ID NO: 2071277 - RNA, 15 nt, Staphylococcus aureus subsp. aureus Mu50
uuaaagcaucuucaa

SEQ ID NO: 2071278 - RNA, 15 nt, Staphylococcus aureus subsp. aureus Mu50
uuaaagauuaaaaua

SEQ ID NO: 2071279 - RNA, 13 nt, Staphylococcus aureus subsp. aureus Mu50
uuaaagauuauua

SEQ ID NO: 2071280 - RNA, 18 nt, Staphylococcus aureus subsp. aureus Mu50
uuaaagauuuacccauua

SEQ ID NO: 2071281 - RNA, 16 nt, Staphylococcus aureus subsp. aureus Mu50
uuaaagacuagccaua

SEQ ID NO: 2071282 - RNA, 20 nt, Staphylococcus aureus subsp. aureus Mu50
uuaaagacugaaccguauaa

SEQ ID NO: 2071283 - RNA, 19 nt, Staphylococcus aureus subsp. aureus Mu50
uuaaagauggcugcaucaa

SEQ ID NO: 2071284 - RNA, 19 nt, Staphylococcus aureus subsp. aureus Mu50
uuaaagaugucgaaaagua

SEQ ID NO: 2071285 - RNA, 18 nt, Staphylococcus aureus subsp. aureus Mu50
uuaaagauggcugcauca

SEQ ID NO: 2071286 - RNA, 19 nt, Staphylococcus aureus subsp. aureus Mu50
uuaaagaaaaguuuaaguc

SEQ ID NO: 2071287 - RNA, 20 nt, Staphylococcus aureus subsp. aureus Mu50
uuaaagaacuauuuuaaauu

SEQ ID NO: 2071288 - RNA, 21 nt, Staphylococcus aureus subsp. aureus Mu50
uuaaagaacuauuuuaaauua

SEQ ID NO: 2071289 - RNA, 14 nt, Staphylococcus aureus subsp. aureus Mu50
uguuuuauagcauu

SEQ ID NO: 2071290 - RNA, 19 nt, Staphylococcus aureus subsp. aureus Mu50
uguuuuaugauuuucuuua

SEQ ID NO: 2071291 - RNA, 21 nt, Staphylococcus aureus subsp. aureus Mu50
uguuuucaacaguuuuaaaga

SEQ ID NO: 2071292 - RNA, 14 nt, Staphylococcus aureus subsp. aureus Mu50
uguuuucaauaauu

SEQ ID NO: 2071293 - RNA, 12 nt, Staphylococcus aureus subsp. aureus Mu50
uguuuuaauaau

SEQ ID NO: 2071294 - RNA, 12 nt, Staphylococcus aureus subsp. aureus Mu50
uguuuuaaaauu

SEQ ID NO: 2071295 - RNA, 16 nt, Staphylococcus aureus subsp. aureus Mu50
uguuuuaaaauuauuu

SEQ ID NO: 2071296 - RNA, 12 nt, Staphylococcus aureus subsp. aureus Mu50
uguuuuaaaaaa

SEQ ID NO: 2071297 - RNA, 24 nt, Staphylococcus aureus subsp. aureus Mu50
uguuuguaaugucgaucuaacaau

SEQ ID NO: 2071298 - RNA, 18 nt, Staphylococcus aureus subsp. aureus Mu50
uguuuggaugcuuuucua

SEQ ID NO: 2071299 - RNA, 13 nt, Staphylococcus aureus subsp. aureus Mu50
uguuuggcauaau

SEQ ID NO: 2071300 - RNA, 13 nt, Staphylococcus aureus subsp. aureus Mu50
uguuuuuuaagua

SEQ ID NO: 2071301 - RNA, 20 nt, Staphylococcus aureus subsp. aureus Mu50
uguuuuugauaguaauaguu

SEQ ID NO: 2071302 - RNA, 17 nt, Staphylococcus aureus subsp. aureus Mu50
uguuuuucaucauuaaa

SEQ ID NO: 2071303 - RNA, 18 nt, Staphylococcus aureus subsp. aureus Mu50
uguuuuucaucauuaaaa

SEQ ID NO: 2071304 - RNA, 19 nt, Staphylococcus aureus subsp. aureus Mu50
uguuuuucaucauuaaaau

SEQ ID NO: 2071305 - RNA, 19 nt, Staphylococcus aureus subsp. aureus Mu50
uguuuuuaauguuugcuuu

SEQ ID NO: 2071306 - RNA, 19 nt, Staphylococcus aureus subsp. aureus Mu50
uguuuuuaacagcuuuuuc

SEQ ID NO: 2071307 - RNA, 18 nt, Staphylococcus aureus subsp. aureus Mu50
uguuuucuauaauauuua

SEQ ID NO: 2071308 - RNA, 15 nt, Staphylococcus aureus subsp. aureus Mu50
uguuuucuuuucaaa

SEQ ID NO: 2071309 - RNA, 20 nt, Staphylococcus aureus subsp. aureus Mu50
uguuuugagagauuauuuaa

SEQ ID NO: 2071310 - RNA, 20 nt, Staphylococcus aureus subsp. aureus Mu50
uguuuugcgguuuuuuugau

SEQ ID NO: 2071311 - RNA, 20 nt, Staphylococcus aureus subsp. aureus Mu50
uguuuuggaaaaauuguggc

SEQ ID NO: 2071312 - RNA, 12 nt, Staphylococcus aureus subsp. aureus Mu50
uguuuauaucuu

SEQ ID NO: 2071313 - RNA, 15 nt, Staphylococcus aureus subsp. aureus Mu50
uguuuauauugcaaa

SEQ ID NO: 2071314 - RNA, 21 nt, Staphylococcus aureus subsp. aureus Mu50
uguuuaucaugaugauaaauu

SEQ ID NO: 2071315 - RNA, 17 nt, Staphylococcus aureus subsp. aureus Mu50
uguuuaucaauuucucu

SEQ ID NO: 2071316 - RNA, 22 nt, Staphylococcus aureus subsp. aureus Mu50
uguuuaucaugaugauaaauug

SEQ ID NO: 2071317 - RNA, 19 nt, Staphylococcus aureus subsp. aureus Mu50
uguuuaucugaauuuuacu

SEQ ID NO: 2071318 - RNA, 18 nt, Staphylococcus aureus subsp. aureus Mu50
uguuuaucuguaucaaaa

SEQ ID NO: 2071319 - RNA, 20 nt, Staphylococcus aureus subsp. aureus Mu50
uguuuauuacauaauuuauc

SEQ ID NO: 2071320 - RNA, 16 nt, Staphylococcus aureus subsp. aureus Mu50
uguuuauuuagaauaa

SEQ ID NO: 2071321 - RNA, 12 nt, Staphylococcus aureus subsp. aureus Mu50
uguuucaacaua

SEQ ID NO: 2071322 - RNA, 19 nt, Staphylococcus aureus subsp. aureus Mu50
uguuucaacauauuauaua

SEQ ID NO: 2071323 - RNA, 23 nt, Staphylococcus aureus subsp. aureus Mu50
uguuucaacauauuauauauauu

SEQ ID NO: 2071324 - RNA, 14 nt, Staphylococcus aureus subsp. aureus Mu50
uguuuccucuuuaa

SEQ ID NO: 2071325 - RNA, 15 nt, Staphylococcus aureus subsp. aureus Mu50
uguuucauauauauu

SEQ ID NO: 2071326 - RNA, 21 nt, Staphylococcus aureus subsp. aureus Mu50
uguuucauaugcaucaacaga

SEQ ID NO: 2071327 - RNA, 14 nt, Staphylococcus aureus subsp. aureus Mu50
uguuucaacauauu

SEQ ID NO: 2071328 - RNA, 21 nt, Staphylococcus aureus subsp. aureus Mu50
uguuucagcuuguccauagua

SEQ ID NO: 2071329 - RNA, 15 nt, Staphylococcus aureus subsp. aureus Mu50
uguuucaggauaaug

SEQ ID NO: 2071330 - RNA, 17 nt, Staphylococcus aureus subsp. aureus Mu50
uguuucaggauaaugaa

SEQ ID NO: 2071331 - RNA, 16 nt, Staphylococcus aureus subsp. aureus Mu50
uguuuggaugaacaaa

SEQ ID NO: 2071332 - RNA, 14 nt, Staphylococcus aureus subsp. aureus Mu50
uguuugcuuuuugu

SEQ ID NO: 2071333 - RNA, 14 nt, Staphylococcus aureus subsp. aureus Mu50
uguuugagauauau

SEQ ID NO: 2071334 - RNA, 18 nt, Staphylococcus aureus subsp. aureus Mu50
uguuugaauggcaaauau

SEQ ID NO: 2071335 - RNA, 21 nt, Staphylococcus aureus subsp. aureus Mu50
uguuugaugauucguauucaa

SEQ ID NO: 2071336 - RNA, 22 nt, Staphylococcus aureus subsp. aureus Mu50
uguuucuuuacuucuuucaaaa

SEQ ID NO: 2071337 - RNA, 13 nt, Staphylococcus aureus subsp. aureus Mu50
uguuucuuguucu

SEQ ID NO: 2071338 - RNA, 23 nt, Staphylococcus aureus subsp. aureus Mu50
uguuucuuagcuagcauguuuug

SEQ ID NO: 2071339 - RNA, 18 nt, Staphylococcus aureus subsp. aureus Mu50
uguuucuaaauucuuuuu

SEQ ID NO: 2071340 - RNA, 20 nt, Staphylococcus aureus subsp. aureus Mu50
uuacaaauguauaaauaaua

SEQ ID NO: 2071341 - RNA, 22 nt, Staphylococcus aureus subsp. aureus Mu50
uuacaaaguuaaccauacauau

SEQ ID NO: 2071342 - RNA, 17 nt, Staphylococcus aureus subsp. aureus Mu50
uuacaaaucaugacaua

SEQ ID NO: 2071343 - RNA, 13 nt, Staphylococcus aureus subsp. aureus Mu50
uuacaaacuucac

SEQ ID NO: 2071344 - RNA, 16 nt, Staphylococcus aureus subsp. aureus Mu50
uuacaaacuucacauc

SEQ ID NO: 2071345 - RNA, 14 nt, Staphylococcus aureus subsp. aureus Mu50
uuaauuuuucauua

SEQ ID NO: 2071346 - RNA, 12 nt, Staphylococcus aureus subsp. aureus Mu50
uuacaacuuuua

SEQ ID NO: 2071347 - RNA, 16 nt, Staphylococcus aureus subsp. aureus Mu50
uuacacaaauuaaaac

SEQ ID NO: 2071348 - RNA, 14 nt, Staphylococcus aureus subsp. aureus Mu50
uuacaacuuauucu

SEQ ID NO: 2071349 - RNA, 15 nt, Staphylococcus aureus subsp. aureus Mu50
uuacaccuauaccuc

SEQ ID NO: 2071350 - RNA, 21 nt, Staphylococcus aureus subsp. aureus Mu50
uuaaugacuaugcaaaugaaa

SEQ ID NO: 2071351 - RNA, 20 nt, Staphylococcus aureus subsp. aureus Mu50
uuaaugacuucuuuauauuu

SEQ ID NO: 2071352 - RNA, 22 nt, Staphylococcus aureus subsp. aureus Mu50
uuaaugacuucuuuauauuuau

SEQ ID NO: 2071353 - RNA, 14 nt, Staphylococcus aureus subsp. aureus Mu50
uuaaucuuaauauu

SEQ ID NO: 2071354 - RNA, 23 nt, Staphylococcus aureus subsp. aureus Mu50
uuaaucucuuuuugauuauauuu

SEQ ID NO: 2071355 - RNA, 14 nt, Staphylococcus aureus subsp. aureus Mu50
uuaauuuugacaua

SEQ ID NO: 2071356 - RNA, 19 nt, Staphylococcus aureus subsp. aureus Mu50
uuaauuuugauauuuuuca

SEQ ID NO: 2071357 - RNA, 24 nt, Staphylococcus aureus subsp. aureus Mu50
uuaauuuugcaacauuaaauuauu

SEQ ID NO: 2071358 - RNA, 16 nt, Staphylococcus aureus subsp. aureus Mu50
uuaauuucacuuuaac

SEQ ID NO: 2071359 - RNA, 22 nt, Staphylococcus aureus subsp. aureus Mu50
uuaauuucacuuuaacuucuuu

SEQ ID NO: 2071360 - RNA, 16 nt, Staphylococcus aureus subsp. aureus Mu50
uuaauuucaugugcaa

SEQ ID NO: 2071361 - RNA, 14 nt, Staphylococcus aureus subsp. aureus Mu50
uuaauuuuauuuua

SEQ ID NO: 2071362 - RNA, 17 nt, Staphylococcus aureus subsp. aureus Mu50
uuaauuuaauuuuagua

SEQ ID NO: 2071363 - RNA, 20 nt, Staphylococcus aureus subsp. aureus Mu50
uuaauuuaacggaaauacaa

SEQ ID NO: 2071364 - RNA, 23 nt, Staphylococcus aureus subsp. aureus Mu50
uuaauuuaacggaaauacaauga

SEQ ID NO: 2071365 - RNA, 21 nt, Staphylococcus aureus subsp. aureus Mu50
uuaauuuaaguaguuguuaua

SEQ ID NO: 2071366 - RNA, 15 nt, Staphylococcus aureus subsp. aureus Mu50
uuaauuguuuaauaa

SEQ ID NO: 2071367 - RNA, 18 nt, Staphylococcus aureus subsp. aureus Mu50
uuaauuguuuaauaacaa

SEQ ID NO: 2071368 - RNA, 20 nt, Staphylococcus aureus subsp. aureus Mu50
uuacauaauuuaucugcaaa

SEQ ID NO: 2071369 - RNA, 18 nt, Staphylococcus aureus subsp. aureus Mu50
uuacauauacgacauuuu

SEQ ID NO: 2071370 - RNA, 15 nt, Staphylococcus aureus subsp. aureus Mu50
uuacauauugcauuu

SEQ ID NO: 2071371 - RNA, 14 nt, Staphylococcus aureus subsp. aureus Mu50
uuaccaucuuuaau

SEQ ID NO: 2071372 - RNA, 12 nt, Staphylococcus aureus subsp. aureus Mu50
uuaccaucuuua

SEQ ID NO: 2071373 - RNA, 17 nt, Staphylococcus aureus subsp. aureus Mu50
uuaccauugugaauaau

SEQ ID NO: 2071374 - RNA, 12 nt, Staphylococcus aureus subsp. aureus Mu50
uuacccaaaaaa

SEQ ID NO: 2071375 - RNA, 14 nt, Staphylococcus aureus subsp. aureus Mu50
uuaccaguaucauu

SEQ ID NO: 2071376 - RNA, 18 nt, Staphylococcus aureus subsp. aureus Mu50
uuacgaucauaaauauuu

SEQ ID NO: 2071377 - RNA, 21 nt, Staphylococcus aureus subsp. aureus Mu50
uuacgaucauaaauauuuucu

SEQ ID NO: 2071378 - RNA, 21 nt, Staphylococcus aureus subsp. aureus Mu50
uuacgagugcacuuguaauau

SEQ ID NO: 2071379 - RNA, 23 nt, Staphylococcus aureus subsp. aureus Mu50
uuacgagugcacuuguaauauua

SEQ ID NO: 2071380 - RNA, 23 nt, Staphylococcus aureus subsp. aureus Mu50
uuacgacauacuugucguauucu

SEQ ID NO: 2071381 - RNA, 15 nt, Staphylococcus aureus subsp. aureus Mu50
uuaccuuuaauuaca

SEQ ID NO: 2071382 - RNA, 19 nt, Staphylococcus aureus subsp. aureus Mu50
uuaccuaauaggauuuccu

SEQ ID NO: 2071383 - RNA, 14 nt, Staphylococcus aureus subsp. aureus Mu50
uuaccuuuccauuc

SEQ ID NO: 2071384 - RNA, 20 nt, Staphylococcus aureus subsp. aureus Mu50
uuagaugcauaaaaaaagaa

SEQ ID NO: 2071385 - RNA, 16 nt, Staphylococcus aureus subsp. aureus Mu50
uuagaugcauaaaaaa

SEQ ID NO: 2071386 - RNA, 19 nt, Staphylococcus aureus subsp. aureus Mu50
uuagaugcauaaaaaaaga

SEQ ID NO: 2071387 - RNA, 17 nt, Staphylococcus aureus subsp. aureus Mu50
uuagauauuauaaaaac

SEQ ID NO: 2071388 - RNA, 15 nt, Staphylococcus aureus subsp. aureus Mu50
uuagauaucuuaauc

SEQ ID NO: 2071389 - RNA, 21 nt, Staphylococcus aureus subsp. aureus Mu50
uuagauauauuugaaagguaa

SEQ ID NO: 2071390 - RNA, 16 nt, Staphylococcus aureus subsp. aureus Mu50
uuagauuaucuuucaa

SEQ ID NO: 2071391 - RNA, 17 nt, Staphylococcus aureus subsp. aureus Mu50
uuagauucacuguauaa

SEQ ID NO: 2071392 - RNA, 12 nt, Staphylococcus aureus subsp. aureus Mu50
uuagauuuaaaa

SEQ ID NO: 2071393 - RNA, 21 nt, Staphylococcus aureus subsp. aureus Mu50
uuagauugacuaaguuuguuu

SEQ ID NO: 2071394 - RNA, 19 nt, Staphylococcus aureus subsp. aureus Mu50
uuagcgcaccaauuaucaa

SEQ ID NO: 2071395 - RNA, 15 nt, Staphylococcus aureus subsp. aureus Mu50
uuacuucauaaguca

SEQ ID NO: 2071396 - RNA, 18 nt, Staphylococcus aureus subsp. aureus Mu50
uuacuucuaauaguaaug

SEQ ID NO: 2071397 - RNA, 19 nt, Staphylococcus aureus subsp. aureus Mu50
uuagaaaaguaaguaaaau

SEQ ID NO: 2071398 - RNA, 21 nt, Staphylococcus aureus subsp. aureus Mu50
uuagaaacaaucguugaagau

SEQ ID NO: 2071399 - RNA, 19 nt, Staphylococcus aureus subsp. aureus Mu50
uuagaaaguauuuauuucu

SEQ ID NO: 2071400 - RNA, 13 nt, Staphylococcus aureus subsp. aureus Mu50
uuagauaaaaauu

SEQ ID NO: 2071401 - RNA, 17 nt, Staphylococcus aureus subsp. aureus Mu50
uuagauaaaaauuacua

SEQ ID NO: 2071402 - RNA, 14 nt, Staphylococcus aureus subsp. aureus Mu50
uuagaguuuuuauu

SEQ ID NO: 2071403 - RNA, 13 nt, Staphylococcus aureus subsp. aureus Mu50
uuagacauuaaaa

SEQ ID NO: 2071404 - RNA, 14 nt, Staphylococcus aureus subsp. aureus Mu50
uuagauaaauuaau

SEQ ID NO: 2071405 - RNA, 20 nt, Staphylococcus aureus subsp. aureus Mu50
uuagauaaaauaauuguucu

SEQ ID NO: 2071406 - RNA, 16 nt, Staphylococcus aureus subsp. aureus Mu50
uuacuacuuaauuaau

SEQ ID NO: 2071407 - RNA, 16 nt, Staphylococcus aureus subsp. aureus Mu50
uuacuaguuuguaaua

SEQ ID NO: 2071408 - RNA, 13 nt, Staphylococcus aureus subsp. aureus Mu50
uuacuauaaaaaa

SEQ ID NO: 2071409 - RNA, 15 nt, Staphylococcus aureus subsp. aureus Mu50
uuacuauuaaaggaa

SEQ ID NO: 2071410 - RNA, 16 nt, Staphylococcus aureus subsp. aureus Mu50
uuacuuauauauucaa

SEQ ID NO: 2071411 - RNA, 16 nt, Staphylococcus aureus subsp. aureus Mu50
uuacuguuaggauaaa

SEQ ID NO: 2071412 - RNA, 19 nt, Staphylococcus aureus subsp. aureus Mu50
uuacugucuuuccauaaua

SEQ ID NO: 2071413 - RNA, 13 nt, Staphylococcus aureus subsp. aureus Mu50
uuacuucaguuug

SEQ ID NO: 2071414 - RNA, 21 nt, Staphylococcus aureus subsp. aureus Mu50
uuacgccaccaguuucaagug

SEQ ID NO: 2071415 - RNA, 15 nt, Staphylococcus aureus subsp. aureus Mu50
uuacuacuuaauuaa

SEQ ID NO: 2071416 - RNA, 16 nt, Staphylococcus aureus subsp. aureus Mu50
uuacuacgcauuauua

SEQ ID NO: 2071417 - RNA, 22 nt, Staphylococcus aureus subsp. aureus Mu50
uuaacuguacgauucaauuuaa

SEQ ID NO: 2071418 - RNA, 22 nt, Staphylococcus aureus subsp. aureus Mu50
uuaacugguugauaaauaaacu

SEQ ID NO: 2071419 - RNA, 20 nt, Staphylococcus aureus subsp. aureus Mu50
uuaacuguacgauucaauuu

SEQ ID NO: 2071420 - RNA, 16 nt, Staphylococcus aureus subsp. aureus Mu50
uuaacuuaauuaaaaa

SEQ ID NO: 2071421 - RNA, 17 nt, Staphylococcus aureus subsp. aureus Mu50
uuaacuucauaauauau

SEQ ID NO: 2071422 - RNA, 14 nt, Staphylococcus aureus subsp. aureus Mu50
uuaacuuuaacauc

SEQ ID NO: 2071423 - RNA, 12 nt, Staphylococcus aureus subsp. aureus Mu50
uuaacuuuaaua

SEQ ID NO: 2071424 - RNA, 20 nt, Staphylococcus aureus subsp. aureus Mu50
uuaacuuuccgccuucaauc

SEQ ID NO: 2071425 - RNA, 12 nt, Staphylococcus aureus subsp. aureus Mu50
uuaagcauuugu

SEQ ID NO: 2071426 - RNA, 16 nt, Staphylococcus aureus subsp. aureus Mu50
uuaagaaaucaacaac

SEQ ID NO: 2071427 - RNA, 15 nt, Staphylococcus aureus subsp. aureus Mu50
uuaacaucugaaucu

SEQ ID NO: 2071428 - RNA, 20 nt, Staphylococcus aureus subsp. aureus Mu50
uuaacauuuauucuuucucu

SEQ ID NO: 2071429 - RNA, 18 nt, Staphylococcus aureus subsp. aureus Mu50
uuaacauuugucauaaua

SEQ ID NO: 2071430 - RNA, 15 nt, Staphylococcus aureus subsp. aureus Mu50
uuaacaucaauuacu

SEQ ID NO: 2071431 - RNA, 19 nt, Staphylococcus aureus subsp. aureus Mu50
uuaaucagcuauaaaagua

SEQ ID NO: 2071432 - RNA, 14 nt, Staphylococcus aureus subsp. aureus Mu50
uuaauauauuuauu

SEQ ID NO: 2071433 - RNA, 19 nt, Staphylococcus aureus subsp. aureus Mu50
uuaauaucacgaucuuuaa

SEQ ID NO: 2071434 - RNA, 17 nt, Staphylococcus aureus subsp. aureus Mu50
uuaauaucauauucaaa

SEQ ID NO: 2071435 - RNA, 14 nt, Staphylococcus aureus subsp. aureus Mu50
uuaauccaauuuaa

SEQ ID NO: 2071436 - RNA, 22 nt, Staphylococcus aureus subsp. aureus Mu50
uuaauaccuaucccuguaaaac

SEQ ID NO: 2071437 - RNA, 14 nt, Staphylococcus aureus subsp. aureus Mu50
uuaauacauaucgg

SEQ ID NO: 2071438 - RNA, 20 nt, Staphylococcus aureus subsp. aureus Mu50
uuaauacaucaauaucuucu

SEQ ID NO: 2071439 - RNA, 20 nt, Staphylococcus aureus subsp. aureus Mu50
uuaauaauuuuuuuccuuuc

SEQ ID NO: 2071440 - RNA, 19 nt, Staphylococcus aureus subsp. aureus Mu50
uuaauaauuuguuuuauuu

SEQ ID NO: 2071441 - RNA, 13 nt, Staphylococcus aureus subsp. aureus Mu50
uuaauaccuauga

SEQ ID NO: 2071442 - RNA, 13 nt, Staphylococcus aureus subsp. aureus Mu50
uuaauauaaauuu

SEQ ID NO: 2071443 - RNA, 22 nt, Staphylococcus aureus subsp. aureus Mu50
uuaauauaaauuuugaauuaca

SEQ ID NO: 2071444 - RNA, 18 nt, Staphylococcus aureus subsp. aureus Mu50
uuaauauaacuucuauua

SEQ ID NO: 2071445 - RNA, 13 nt, Staphylococcus aureus subsp. aureus Mu50
uuaauauaaguau

SEQ ID NO: 2071446 - RNA, 16 nt, Staphylococcus aureus subsp. aureus Mu50
uuaauauaauuaauuu

SEQ ID NO: 2071447 - RNA, 13 nt, Staphylococcus aureus subsp. aureus Mu50
uuaaguacuuuua

SEQ ID NO: 2071448 - RNA, 14 nt, Staphylococcus aureus subsp. aureus Mu50
uuaaguacagcaua

SEQ ID NO: 2071449 - RNA, 13 nt, Staphylococcus aureus subsp. aureus Mu50
uuaagcccuuccc

SEQ ID NO: 2071450 - RNA, 22 nt, Staphylococcus aureus subsp. aureus Mu50
uuaauaaauuuaacguuauuca

SEQ ID NO: 2071451 - RNA, 15 nt, Staphylococcus aureus subsp. aureus Mu50
uuaauaauuaaacaa

SEQ ID NO: 2071452 - RNA, 12 nt, Staphylococcus aureus subsp. aureus Mu50
uuaauaauuaau

SEQ ID NO: 2071453 - RNA, 13 nt, Staphylococcus aureus subsp. aureus Mu50
uuaauaaauuuaa

SEQ ID NO: 2071454 - RNA, 18 nt, Staphylococcus aureus subsp. aureus Mu50
uuaauaaaauucuauaau

SEQ ID NO: 2071455 - RNA, 21 nt, Staphylococcus aureus subsp. aureus Mu50
uuaaauacaauuucuucauuu

SEQ ID NO: 2071456 - RNA, 15 nt, Staphylococcus aureus subsp. aureus Mu50
uuaaauaaugauaaa

SEQ ID NO: 2071457 - RNA, 20 nt, Staphylococcus aureus subsp. aureus Mu50
uuaaauaaauucucuaauuu

SEQ ID NO: 2071458 - RNA, 22 nt, Staphylococcus aureus subsp. aureus Mu50
uuaaauaaucgaaaauuucagg

SEQ ID NO: 2071459 - RNA, 23 nt, Staphylococcus aureus subsp. aureus Mu50
uuaaauauaaagacgauuuauua

SEQ ID NO: 2071460 - RNA, 21 nt, Staphylococcus aureus subsp. aureus Mu50
uuaaauaggugauuauauaua

SEQ ID NO: 2071461 - RNA, 16 nt, Staphylococcus aureus subsp. aureus Mu50
uuaaauacgccaaaua

SEQ ID NO: 2071462 - RNA, 17 nt, Staphylococcus aureus subsp. aureus Mu50
uuaaauacuugcucuaa

SEQ ID NO: 2071463 - RNA, 14 nt, Staphylococcus aureus subsp. aureus Mu50
uuaaauacuauaua

SEQ ID NO: 2071464 - RNA, 19 nt, Staphylococcus aureus subsp. aureus Mu50
uuaaaucaccaacaacuuu

SEQ ID NO: 2071465 - RNA, 19 nt, Staphylococcus aureus subsp. aureus Mu50
uuaaaucacugcuuucaag

SEQ ID NO: 2071466 - RNA, 18 nt, Staphylococcus aureus subsp. aureus Mu50
uuaaauccgcuuguucaa

SEQ ID NO: 2071467 - RNA, 15 nt, Staphylococcus aureus subsp. aureus Mu50
uuaaaucuaauuauu

SEQ ID NO: 2071468 - RNA, 11 nt, Staphylococcus aureus subsp. aureus Mu50
uuaaauaucau

SEQ ID NO: 2071469 - RNA, 18 nt, Staphylococcus aureus subsp. aureus Mu50
uuaaauaugaauaaugca

SEQ ID NO: 2071470 - RNA, 20 nt, Staphylococcus aureus subsp. aureus Mu50
uuaaauaucaugcaaaacua

SEQ ID NO: 2071471 - RNA, 15 nt, Staphylococcus aureus subsp. aureus Mu50
uuaaauauucuuauc

SEQ ID NO: 2071472 - RNA, 14 nt, Staphylococcus aureus subsp. aureus Mu50
uuaaaggaaaucaa

SEQ ID NO: 2071473 - RNA, 17 nt, Staphylococcus aureus subsp. aureus Mu50
uuaaagcuaucuucaga

SEQ ID NO: 2071474 - RNA, 22 nt, Staphylococcus aureus subsp. aureus Mu50
uuaaagcuaguaaugccauuaa

SEQ ID NO: 2071475 - RNA, 17 nt, Staphylococcus aureus subsp. aureus Mu50
uuaaaguagaaccuaua

SEQ ID NO: 2071476 - RNA, 22 nt, Staphylococcus aureus subsp. aureus Mu50
uuaaaguagaaccuauauuaag

SEQ ID NO: 2071477 - RNA, 22 nt, Staphylococcus aureus subsp. aureus Mu50
uuaaaguaaccacaacaaugca

SEQ ID NO: 2071478 - RNA, 15 nt, Staphylococcus aureus subsp. aureus Mu50
uuaaagguuaaauau

SEQ ID NO: 2071479 - RNA, 16 nt, Staphylococcus aureus subsp. aureus Mu50
uuaaagguuaaauauu

SEQ ID NO: 2071480 - RNA, 20 nt, Staphylococcus aureus subsp. aureus Mu50
uuaaagguuaaauauuuaau

SEQ ID NO: 2071481 - RNA, 22 nt, Staphylococcus aureus subsp. aureus Mu50
uuaaagucuguugguuuaucag

SEQ ID NO: 2071482 - RNA, 11 nt, Staphylococcus aureus subsp. aureus Mu50
uuaaagucuuc

SEQ ID NO: 2071483 - RNA, 19 nt, Staphylococcus aureus subsp. aureus Mu50
uuaaaguuguugaaauuuc

SEQ ID NO: 2071484 - RNA, 14 nt, Staphylococcus aureus subsp. aureus Mu50
uuaaaguguuucaa

SEQ ID NO: 2071485 - RNA, 22 nt, Staphylococcus aureus subsp. aureus Mu50
uuaaaguguuucaacauauuau

SEQ ID NO: 2071486 - RNA, 15 nt, Staphylococcus aureus subsp. aureus Mu50
uuaaauaaaugacuu

SEQ ID NO: 2071487 - RNA, 17 nt, Staphylococcus aureus subsp. aureus Mu50
uuaaaguuuaaauauuc

SEQ ID NO: 2071488 - RNA, 18 nt, Staphylococcus aureus subsp. aureus Mu50
uuaaaguuuaaauauuca

SEQ ID NO: 2071489 - RNA, 16 nt, Staphylococcus aureus subsp. aureus Mu50
uuaaauaaaaauauug

SEQ ID NO: 2071490 - RNA, 13 nt, Staphylococcus aureus subsp. aureus Mu50
uuaaauaaaaaua

SEQ ID NO: 2071491 - RNA, 13 nt, Staphylococcus aureus subsp. aureus Mu50
uuaaaucuucuag

SEQ ID NO: 2071492 - RNA, 17 nt, Staphylococcus aureus subsp. aureus Mu50
uuaaaucuaauuauuca

SEQ ID NO: 2071493 - RNA, 15 nt, Staphylococcus aureus subsp. aureus Mu50
uuaaaucuauauaaa

SEQ ID NO: 2071494 - RNA, 21 nt, Staphylococcus aureus subsp. aureus Mu50
uuaaaugaugcaguaaaacca

SEQ ID NO: 2071495 - RNA, 20 nt, Staphylococcus aureus subsp. aureus Mu50
uuaaaugauggguauuuugu

SEQ ID NO: 2071496 - RNA, 16 nt, Staphylococcus aureus subsp. aureus Mu50
uuaaaugauuuaauaa

SEQ ID NO: 2071497 - RNA, 21 nt, Staphylococcus aureus subsp. aureus Mu50
uuaaaugcccaccauguacau

SEQ ID NO: 2071498 - RNA, 21 nt, Staphylococcus aureus subsp. aureus Mu50
uuaaauguacauuguaaauau

SEQ ID NO: 2071499 - RNA, 19 nt, Staphylococcus aureus subsp. aureus Mu50
uuaaauguauuuuuacuuu

SEQ ID NO: 2071500 - RNA, 22 nt, Staphylococcus aureus subsp. aureus Mu50
uuaaauguacauuguaaauaua

SEQ ID NO: 2071501 - RNA, 18 nt, Staphylococcus aureus subsp. aureus Mu50
uuaaaugucuuucaaaua

SEQ ID NO: 2071502 - RNA, 21 nt, Staphylococcus aureus subsp. aureus Mu50
uuaaauuagggugaacaguua

SEQ ID NO: 2071503 - RNA, 21 nt, Staphylococcus aureus subsp. aureus Mu50
uuaaauuauauguuuuuauua

SEQ ID NO: 2071504 - RNA, 20 nt, Staphylococcus aureus subsp. aureus Mu50
uuaaauuauuguuuuaaugu

SEQ ID NO: 2071505 - RNA, 15 nt, Staphylococcus aureus subsp. aureus Mu50
uuaaauuauuuaauu

SEQ ID NO: 2071506 - RNA, 21 nt, Staphylococcus aureus subsp. aureus Mu50
uuaaauugcuugaaauuauua

SEQ ID NO: 2071507 - RNA, 14 nt, Staphylococcus aureus subsp. aureus Mu50
uuaaauuuaaaaga

SEQ ID NO: 2071508 - RNA, 13 nt, Staphylococcus aureus subsp. aureus Mu50
uuaaauuuaaaag

SEQ ID NO: 2071509 - RNA, 18 nt, Staphylococcus aureus subsp. aureus Mu50
uuaaauucuuauaaaaua

SEQ ID NO: 2071510 - RNA, 19 nt, Staphylococcus aureus subsp. aureus Mu50
uuaaauuauuuaauuuuuc

SEQ ID NO: 2071511 - RNA, 19 nt, Staphylococcus aureus subsp. aureus Mu50
uuaaauucuuauaaaauaa

SEQ ID NO: 2071512 - RNA, 21 nt, Staphylococcus aureus subsp. aureus Mu50
uuaaauucuuauaaaauaaaa

SEQ ID NO: 2071513 - RNA, 21 nt, Staphylococcus aureus subsp. aureus Mu50
uuaacaccagauaucauaaua

SEQ ID NO: 2071514 - RNA, 17 nt, Staphylococcus aureus subsp. aureus Mu50
uuaacacauucaaauaa

SEQ ID NO: 2071515 - RNA, 20 nt, Staphylococcus aureus subsp. aureus Mu50
uuaacaaugcgauuaaacuc

SEQ ID NO: 2071516 - RNA, 14 nt, Staphylococcus aureus subsp. aureus Mu50
uuaacaauauuaaa

SEQ ID NO: 2071517 - RNA, 16 nt, Staphylococcus aureus subsp. aureus Mu50
uuaacaagauaacuag

SEQ ID NO: 2071518 - RNA, 15 nt, Staphylococcus aureus subsp. aureus Mu50
uuaacaacuuuaauu

SEQ ID NO: 2071519 - RNA, 18 nt, Staphylococcus aureus subsp. aureus Mu50
uuaaauuucugaacauaa

SEQ ID NO: 2071520 - RNA, 14 nt, Staphylococcus aureus subsp. aureus Mu50
uuaaauuuuaaguu

SEQ ID NO: 2071521 - RNA, 13 nt, Staphylococcus aureus subsp. aureus Mu50
uuaaauuuucauc

SEQ ID NO: 2071522 - RNA, 19 nt, Staphylococcus aureus subsp. aureus Mu50
uuaaauuuucaucauaauc

SEQ ID NO: 2071523 - RNA, 17 nt, Staphylococcus aureus subsp. aureus Mu50
uuaaauuuguguucaaa

SEQ ID NO: 2071524 - RNA, 14 nt, Staphylococcus aureus subsp. aureus Mu50
uuaacaacaaauau

SEQ ID NO: 2071525 - RNA, 16 nt, Staphylococcus aureus subsp. aureus Mu50
uuaacaacaaauauaa

SEQ ID NO: 2071526 - RNA, 12 nt, Staphylococcus aureus subsp. aureus Mu50
ucuauaaauauc

SEQ ID NO: 2071527 - RNA, 14 nt, Staphylococcus aureus subsp. aureus Mu50
ucuauaaagaauga

SEQ ID NO: 2071528 - RNA, 15 nt, Staphylococcus aureus subsp. aureus Mu50
ucuauaauuugugug

SEQ ID NO: 2071529 - RNA, 22 nt, Staphylococcus aureus subsp. aureus Mu50
ucuauaccauuccaaaaauugu

SEQ ID NO: 2071530 - RNA, 23 nt, Staphylococcus aureus subsp. aureus Mu50
ucuauaccauuccaaaaauugua

SEQ ID NO: 2071531 - RNA, 16 nt, Staphylococcus aureus subsp. aureus Mu50
ucuauauuaauagaaa

SEQ ID NO: 2071532 - RNA, 16 nt, Staphylococcus aureus subsp. aureus Mu50
ucuauaugcauauauu

SEQ ID NO: 2071533 - RNA, 19 nt, Staphylococcus aureus subsp. aureus Mu50
ucuauauaguaaaauaaau

SEQ ID NO: 2071534 - RNA, 14 nt, Staphylococcus aureus subsp. aureus Mu50
ucuauaauaccuaa

SEQ ID NO: 2071535 - RNA, 20 nt, Staphylococcus aureus subsp. aureus Mu50
ucuauagaauuuuucauaua

SEQ ID NO: 2071536 - RNA, 18 nt, Staphylococcus aureus subsp. aureus Mu50
ucuauagguuuauaaaaa

SEQ ID NO: 2071537 - RNA, 19 nt, Staphylococcus aureus subsp. aureus Mu50
ucuauauaaauguuuauau

SEQ ID NO: 2071538 - RNA, 16 nt, Staphylococcus aureus subsp. aureus Mu50
ucuauauaaaaacugu

SEQ ID NO: 2071539 - RNA, 16 nt, Staphylococcus aureus subsp. aureus Mu50
ucuaugaauaauguuu

SEQ ID NO: 2071540 - RNA, 21 nt, Staphylococcus aureus subsp. aureus Mu50
ucuaucguuguguauuguuug

SEQ ID NO: 2071541 - RNA, 17 nt, Staphylococcus aureus subsp. aureus Mu50
ucuaucuauaaacguca

SEQ ID NO: 2071542 - RNA, 12 nt, Staphylococcus aureus subsp. aureus Mu50
ucuaucaaauua

SEQ ID NO: 2071543 - RNA, 17 nt, Staphylococcus aureus subsp. aureus Mu50
ucuaucgguaauuuuug

SEQ ID NO: 2071544 - RNA, 21 nt, Staphylococcus aureus subsp. aureus Mu50
ucuaucgccuaaaaauaaaau

SEQ ID NO: 2071545 - RNA, 16 nt, Staphylococcus aureus subsp. aureus Mu50
ucuaucgccuaaaaau

SEQ ID NO: 2071546 - RNA, 17 nt, Staphylococcus aureus subsp. aureus Mu50
ucuaucgccuaaaaaua

SEQ ID NO: 2071547 - RNA, 12 nt, Staphylococcus aureus subsp. aureus Mu50
ucuagaauauaa

SEQ ID NO: 2071548 - RNA, 13 nt, Staphylococcus aureus subsp. aureus Mu50
aaaugauaucuau

SEQ ID NO: 2071549 - RNA, 16 nt, Staphylococcus aureus subsp. aureus Mu50
aaaugaucaucguaua

SEQ ID NO: 2071550 - RNA, 16 nt, Staphylococcus aureus subsp. aureus Mu50
aaaugauaauuuaaua

SEQ ID NO: 2071551 - RNA, 15 nt, Staphylococcus aureus subsp. aureus Mu50
aaaugauacauuauu

SEQ ID NO: 2071552 - RNA, 23 nt, Staphylococcus aureus subsp. aureus Mu50
aaaugauagcuaaacauuuuaua

SEQ ID NO: 2071553 - RNA, 20 nt, Staphylococcus aureus subsp. aureus Mu50
aaaugauagggcauugagau

SEQ ID NO: 2071554 - RNA, 15 nt, Staphylococcus aureus subsp. aureus Mu50
ucuagauuauuuaaa

SEQ ID NO: 2071555 - RNA, 15 nt, Staphylococcus aureus subsp. aureus Mu50
ucuagauucauauuu

SEQ ID NO: 2071556 - RNA, 13 nt, Staphylococcus aureus subsp. aureus Mu50
ucuagaugaaauu

SEQ ID NO: 2071557 - RNA, 15 nt, Staphylococcus aureus subsp. aureus Mu50
ucuagagauaacuag

SEQ ID NO: 2071558 - RNA, 24 nt, Staphylococcus aureus subsp. aureus Mu50
ucuagacuuauuugaaugcaaauc

SEQ ID NO: 2071559 - RNA, 21 nt, Staphylococcus aureus subsp. aureus Mu50
ucuagcguagcgaaaguaucu

SEQ ID NO: 2071560 - RNA, 22 nt, Staphylococcus aureus subsp. aureus Mu50
ucuaguacaccucuaaguucac

SEQ ID NO: 2071561 - RNA, 20 nt, Staphylococcus aureus subsp. aureus Mu50
ucuaguagcuagaacagaua

SEQ ID NO: 2071562 - RNA, 16 nt, Staphylococcus aureus subsp. aureus Mu50
ucuagcucuccuacaa

SEQ ID NO: 2071563 - RNA, 13 nt, Staphylococcus aureus subsp. aureus Mu50
aaaugcauuacua

SEQ ID NO: 2071564 - RNA, 13 nt, Staphylococcus aureus subsp. aureus Mu50
aaaugcaauacau

SEQ ID NO: 2071565 - RNA, 23 nt, Staphylococcus aureus subsp. aureus Mu50
aaaugauuuauucuaaauauauu

SEQ ID NO: 2071566 - RNA, 14 nt, Staphylococcus aureus subsp. aureus Mu50
aaaugauuuauucu

SEQ ID NO: 2071567 - RNA, 20 nt, Staphylococcus aureus subsp. aureus Mu50
aaaugauuuauucuaaauau

SEQ ID NO: 2071568 - RNA, 13 nt, Staphylococcus aureus subsp. aureus Mu50
aaaugauuaauaa

SEQ ID NO: 2071569 - RNA, 18 nt, Staphylococcus aureus subsp. aureus Mu50
aaaugauuguuuuaagug

SEQ ID NO: 2071570 - RNA, 19 nt, Staphylococcus aureus subsp. aureus Mu50
ucucaucauuuucaauacu

SEQ ID NO: 2071571 - RNA, 13 nt, Staphylococcus aureus subsp. aureus Mu50
ucucauaauaauu

SEQ ID NO: 2071572 - RNA, 21 nt, Staphylococcus aureus subsp. aureus Mu50
ucucagcaauacuaacugaag

SEQ ID NO: 2071573 - RNA, 14 nt, Staphylococcus aureus subsp. aureus Mu50
ucucagcaauacua

SEQ ID NO: 2071574 - RNA, 20 nt, Staphylococcus aureus subsp. aureus Mu50
aaaugcgacguuguucucuc

SEQ ID NO: 2071575 - RNA, 21 nt, Staphylococcus aureus subsp. aureus Mu50
aaaugccaacuauaccuaggg

SEQ ID NO: 2071576 - RNA, 16 nt, Staphylococcus aureus subsp. aureus Mu50
ucucacuuaauaaaua

SEQ ID NO: 2071577 - RNA, 20 nt, Staphylococcus aureus subsp. aureus Mu50
aaaugcgcuuccaauuuaaa

SEQ ID NO: 2071578 - RNA, 13 nt, Staphylococcus aureus subsp. aureus Mu50
ucuauuaauaauu

SEQ ID NO: 2071579 - RNA, 14 nt, Staphylococcus aureus subsp. aureus Mu50
ucuauuaaugcucu

SEQ ID NO: 2071580 - RNA, 17 nt, Staphylococcus aureus subsp. aureus Mu50
ucuauugcaauauaguu

SEQ ID NO: 2071581 - RNA, 13 nt, Staphylococcus aureus subsp. aureus Mu50
ucuauuuaauaau

SEQ ID NO: 2071582 - RNA, 21 nt, Staphylococcus aureus subsp. aureus Mu50
ucuauugugauauaugaaaua

SEQ ID NO: 2071583 - RNA, 17 nt, Staphylococcus aureus subsp. aureus Mu50
ucuauuuuauaauaaau

SEQ ID NO: 2071584 - RNA, 16 nt, Staphylococcus aureus subsp. aureus Mu50
ucuauuugauaagaaa

SEQ ID NO: 2071585 - RNA, 14 nt, Staphylococcus aureus subsp. aureus Mu50
ucuauuuuugauuu

SEQ ID NO: 2071586 - RNA, 20 nt, Staphylococcus aureus subsp. aureus Mu50
ucuauuuuugauuuaauaau

SEQ ID NO: 2071587 - RNA, 19 nt, Staphylococcus aureus subsp. aureus Mu50
ucuauuuuaugauuugauu

SEQ ID NO: 2071588 - RNA, 17 nt, Staphylococcus aureus subsp. aureus Mu50
ucucaaugcauuuaauu

SEQ ID NO: 2071589 - RNA, 18 nt, Staphylococcus aureus subsp. aureus Mu50
ucucaaugugagauauaa

SEQ ID NO: 2071590 - RNA, 17 nt, Staphylococcus aureus subsp. aureus Mu50
ucuaaugcuaauuuaac

SEQ ID NO: 2071591 - RNA, 20 nt, Staphylococcus aureus subsp. aureus Mu50
ucuaauacuuucaaacaaau

SEQ ID NO: 2071592 - RNA, 15 nt, Staphylococcus aureus subsp. aureus Mu50
ucuaauacuuucacu

SEQ ID NO: 2071593 - RNA, 17 nt, Staphylococcus aureus subsp. aureus Mu50
ucuaauacauacugauu

SEQ ID NO: 2071594 - RNA, 23 nt, Staphylococcus aureus subsp. aureus Mu50
ucuaauacuucaccacauaaaaa

SEQ ID NO: 2071595 - RNA, 17 nt, Staphylococcus aureus subsp. aureus Mu50
ucuaaucacuuggcgua

SEQ ID NO: 2071596 - RNA, 14 nt, Staphylococcus aureus subsp. aureus Mu50
ucuaauccaaaaua

SEQ ID NO: 2071597 - RNA, 18 nt, Staphylococcus aureus subsp. aureus Mu50
ucuaauccaaaauaaucg

SEQ ID NO: 2071598 - RNA, 21 nt, Staphylococcus aureus subsp. aureus Mu50
ucuaauucaaugauuuuuaaa

SEQ ID NO: 2071599 - RNA, 18 nt, Staphylococcus aureus subsp. aureus Mu50
ucuaauuauucaugaauc

SEQ ID NO: 2071600 - RNA, 14 nt, Staphylococcus aureus subsp. aureus Mu50
ucuaauucugaaau

SEQ ID NO: 2071601 - RNA, 13 nt, Staphylococcus aureus subsp. aureus Mu50
ucuaauucguaau

SEQ ID NO: 2071602 - RNA, 19 nt, Staphylococcus aureus subsp. aureus Mu50
ucuaauuguuguaauucuu

SEQ ID NO: 2071603 - RNA, 13 nt, Staphylococcus aureus subsp. aureus Mu50
ucuaauuucacaa

SEQ ID NO: 2071604 - RNA, 20 nt, Staphylococcus aureus subsp. aureus Mu50
ucuaauuugcaaaaucaacc

SEQ ID NO: 2071605 - RNA, 19 nt, Staphylococcus aureus subsp. aureus Mu50
ucuacaauauucaauaauu

SEQ ID NO: 2071606 - RNA, 19 nt, Staphylococcus aureus subsp. aureus Mu50
ucuacaauauuaaaauuaa

SEQ ID NO: 2071607 - RNA, 20 nt, Staphylococcus aureus subsp. aureus Mu50
ucuacaacuucauuaguugc

SEQ ID NO: 2071608 - RNA, 23 nt, Staphylococcus aureus subsp. aureus Mu50
ucuacauuauauugagacaacau

SEQ ID NO: 2071609 - RNA, 23 nt, Staphylococcus aureus subsp. aureus Mu50
ucuacauacaacucguuuuucca

SEQ ID NO: 2071610 - RNA, 21 nt, Staphylococcus aureus subsp. aureus Mu50
ucuacauauuggcuugcuuca

SEQ ID NO: 2071611 - RNA, 14 nt, Staphylococcus aureus subsp. aureus Mu50
ucuacagguaaugc

SEQ ID NO: 2071612 - RNA, 18 nt, Staphylococcus aureus subsp. aureus Mu50
ucuacagguaaugcaagu

SEQ ID NO: 2071613 - RNA, 22 nt, Staphylococcus aureus subsp. aureus Mu50
ucuacagguaaugcaaguuggg

SEQ ID NO: 2071614 - RNA, 15 nt, Staphylococcus aureus subsp. aureus Mu50
ucuacauaauuugaa

SEQ ID NO: 2071615 - RNA, 22 nt, Staphylococcus aureus subsp. aureus Mu50
ucuacaggcaaugcaaguuggc

SEQ ID NO: 2071616 - RNA, 18 nt, Staphylococcus aureus subsp. aureus Mu50
ucuacaggcaaugcaagu

SEQ ID NO: 2071617 - RNA, 21 nt, Staphylococcus aureus subsp. aureus Mu50
ucuacagcaucaccuaaagcu

SEQ ID NO: 2071618 - RNA, 22 nt, Staphylococcus aureus subsp. aureus Mu50
ucuacucgaaaccagcuuacug

SEQ ID NO: 2071619 - RNA, 17 nt, Staphylococcus aureus subsp. aureus Mu50
ucuacuuaguaauaaga

SEQ ID NO: 2071620 - RNA, 17 nt, Staphylococcus aureus subsp. aureus Mu50
ucuaccaauaauucccu

SEQ ID NO: 2071621 - RNA, 22 nt, Staphylococcus aureus subsp. aureus Mu50
ucuaccaauaauucccuaggaa

SEQ ID NO: 2071622 - RNA, 18 nt, Staphylococcus aureus subsp. aureus Mu50
aaaugacuucacauuuau

SEQ ID NO: 2071623 - RNA, 23 nt, Staphylococcus aureus subsp. aureus Mu50
aaaugacugaauuaauauccaaa

SEQ ID NO: 2071624 - RNA, 14 nt, Staphylococcus aureus subsp. aureus Mu50
aaaugacaucaucu

SEQ ID NO: 2071625 - RNA, 15 nt, Staphylococcus aureus subsp. aureus Mu50
aaaugaauugcuugu

SEQ ID NO: 2071626 - RNA, 19 nt, Staphylococcus aureus subsp. aureus Mu50
aaaugaaugaagacgaaua

SEQ ID NO: 2071627 - RNA, 20 nt, Staphylococcus aureus subsp. aureus Mu50
aaaugaauguuaagacauau

SEQ ID NO: 2071628 - RNA, 14 nt, Staphylococcus aureus subsp. aureus Mu50
aaaugacugaauua

SEQ ID NO: 2071629 - RNA, 18 nt, Staphylococcus aureus subsp. aureus Mu50
aaaugacugaauuaauau

SEQ ID NO: 2071630 - RNA, 20 nt, Staphylococcus aureus subsp. aureus Mu50
aaaugacgugcuuuuaaaug

SEQ ID NO: 2071631 - RNA, 23 nt, Staphylococcus aureus subsp. aureus Mu50
aaaugacgugcuuuuaaauguau

SEQ ID NO: 2071632 - RNA, 19 nt, Staphylococcus aureus subsp. aureus Mu50
aaaugacgauaccuuuaau

SEQ ID NO: 2071633 - RNA, 15 nt, Staphylococcus aureus subsp. aureus Mu50
aaaugacauuuaaua

SEQ ID NO: 2071634 - RNA, 22 nt, Staphylococcus aureus subsp. aureus Mu50
aaaucuuguuggauuuuaacaa

SEQ ID NO: 2071635 - RNA, 16 nt, Staphylococcus aureus subsp. aureus Mu50
ucuaacuuaccaugau

SEQ ID NO: 2071636 - RNA, 21 nt, Staphylococcus aureus subsp. aureus Mu50
ucuaacuuuaccaauaucaug

SEQ ID NO: 2071637 - RNA, 19 nt, Staphylococcus aureus subsp. aureus Mu50
ucuaacggcguuuguuucu

SEQ ID NO: 2071638 - RNA, 16 nt, Staphylococcus aureus subsp. aureus Mu50
ucuaacguuaacaaua

SEQ ID NO: 2071639 - RNA, 13 nt, Staphylococcus aureus subsp. aureus Mu50
aaaugaaaguacc

SEQ ID NO: 2071640 - RNA, 19 nt, Staphylococcus aureus subsp. aureus Mu50
aaaucuuuuguaagacuuc

SEQ ID NO: 2071641 - RNA, 22 nt, Staphylococcus aureus subsp. aureus Mu50
aaaucuuuuagcuuuuguaaag

SEQ ID NO: 2071642 - RNA, 14 nt, Staphylococcus aureus subsp. aureus Mu50
aaaugaaaaaguaa

SEQ ID NO: 2071643 - RNA, 15 nt, Staphylococcus aureus subsp. aureus Mu50
aaaucuuuuacuaaa

SEQ ID NO: 2071644 - RNA, 21 nt, Staphylococcus aureus subsp. aureus Mu50
aaaucuuuuacuaaaugaauu

SEQ ID NO: 2071645 - RNA, 20 nt, Staphylococcus aureus subsp. aureus Mu50
aaaucuuuuagcuuuuguaa

SEQ ID NO: 2071646 - RNA, 13 nt, Staphylococcus aureus subsp. aureus Mu50
aaaucuuuaaaug

SEQ ID NO: 2071647 - RNA, 14 nt, Staphylococcus aureus subsp. aureus Mu50
aaaucuuuaaaugu

SEQ ID NO: 2071648 - RNA, 16 nt, Staphylococcus aureus subsp. aureus Mu50
aaaucuuuacuuguaa

SEQ ID NO: 2071649 - RNA, 23 nt, Staphylococcus aureus subsp. aureus Mu50
aaaucuuguuggauuuuaacaag

SEQ ID NO: 2071650 - RNA, 19 nt, Staphylococcus aureus subsp. aureus Mu50
aaaucuuuaacauuugucc

SEQ ID NO: 2071651 - RNA, 16 nt, Staphylococcus aureus subsp. aureus Mu50
ucuaaagcuauaaaaa

SEQ ID NO: 2071652 - RNA, 14 nt, Staphylococcus aureus subsp. aureus Mu50
ucuaaagauuucag

SEQ ID NO: 2071653 - RNA, 16 nt, Staphylococcus aureus subsp. aureus Mu50
ucuaaacuauaauaau

SEQ ID NO: 2071654 - RNA, 18 nt, Staphylococcus aureus subsp. aureus Mu50
ucuaaacuauaauaauug

SEQ ID NO: 2071655 - RNA, 18 nt, Staphylococcus aureus subsp. aureus Mu50
ucuaaacuucuauuaaua

SEQ ID NO: 2071656 - RNA, 21 nt, Staphylococcus aureus subsp. aureus Mu50
ucuaaacuucuauuaauaauu

SEQ ID NO: 2071657 - RNA, 20 nt, Staphylococcus aureus subsp. aureus Mu50
ucuaaauauaauagaaauaa

SEQ ID NO: 2071658 - RNA, 17 nt, Staphylococcus aureus subsp. aureus Mu50
ucuaaauaguuuuucau

SEQ ID NO: 2071659 - RNA, 18 nt, Staphylococcus aureus subsp. aureus Mu50
ucuaaauaaaauuaaaac

SEQ ID NO: 2071660 - RNA, 14 nt, Staphylococcus aureus subsp. aureus Mu50
ucuaaccacuucuu

SEQ ID NO: 2071661 - RNA, 12 nt, Staphylococcus aureus subsp. aureus Mu50
ucuaaccaucuc

SEQ ID NO: 2071662 - RNA, 16 nt, Staphylococcus aureus subsp. aureus Mu50
ucuaacagcuuaauuu

SEQ ID NO: 2071663 - RNA, 20 nt, Staphylococcus aureus subsp. aureus Mu50
ucuaaauucuuuuuguucgg

SEQ ID NO: 2071664 - RNA, 14 nt, Staphylococcus aureus subsp. aureus Mu50
ucuaacaguuaaua

SEQ ID NO: 2071665 - RNA, 22 nt, Staphylococcus aureus subsp. aureus Mu50
ucuaaaugcacgagcaacaucu

SEQ ID NO: 2071666 - RNA, 20 nt, Staphylococcus aureus subsp. aureus Mu50
ucuaaauauuaaauuauugu

SEQ ID NO: 2071667 - RNA, 18 nt, Staphylococcus aureus subsp. aureus Mu50
ucuaaauuauuuauucau

SEQ ID NO: 2071668 - RNA, 18 nt, Staphylococcus aureus subsp. aureus Mu50
ucguuuugcuaaccauca

SEQ ID NO: 2071669 - RNA, 21 nt, Staphylococcus aureus subsp. aureus Mu50
ucguuuugcuaaccaucauaa

SEQ ID NO: 2071670 - RNA, 16 nt, Staphylococcus aureus subsp. aureus Mu50
ucguuuuaauaaauug

SEQ ID NO: 2071671 - RNA, 21 nt, Staphylococcus aureus subsp. aureus Mu50
ucguuuuuucauuguaauaau

SEQ ID NO: 2071672 - RNA, 14 nt, Staphylococcus aureus subsp. aureus Mu50
ucguuuuuuuagcu

SEQ ID NO: 2071673 - RNA, 14 nt, Staphylococcus aureus subsp. aureus Mu50
ucuaaaaacauaaa

SEQ ID NO: 2071674 - RNA, 16 nt, Staphylococcus aureus subsp. aureus Mu50
ucuaaaaacauaaaaa

SEQ ID NO: 2071675 - RNA, 16 nt, Staphylococcus aureus subsp. aureus Mu50
ucuaaaacuuuuucaa

SEQ ID NO: 2071676 - RNA, 16 nt, Staphylococcus aureus subsp. aureus Mu50
ucuaaaacggaaauaa

SEQ ID NO: 2071677 - RNA, 17 nt, Staphylococcus aureus subsp. aureus Mu50
ucuaaaaguuguaauuu

SEQ ID NO: 2071678 - RNA, 19 nt, Staphylococcus aureus subsp. aureus Mu50
ucuaaaaagcggacugaaa

SEQ ID NO: 2071679 - RNA, 23 nt, Staphylococcus aureus subsp. aureus Mu50
ucuaaaaguuguaauuuaaaaua

SEQ ID NO: 2071680 - RNA, 15 nt, Staphylococcus aureus subsp. aureus Mu50
ucuggcaaauugccu

SEQ ID NO: 2071681 - RNA, 11 nt, Staphylococcus aureus subsp. aureus Mu50
ucugcuuuauu

SEQ ID NO: 2071682 - RNA, 16 nt, Staphylococcus aureus subsp. aureus Mu50
ucugcuuuauuuuauc

SEQ ID NO: 2071683 - RNA, 23 nt, Staphylococcus aureus subsp. aureus Mu50
ucugcaugguuugcugguugcuu

SEQ ID NO: 2071684 - RNA, 19 nt, Staphylococcus aureus subsp. aureus Mu50
ucugcaugggcuucugcua

SEQ ID NO: 2071685 - RNA, 23 nt, Staphylococcus aureus subsp. aureus Mu50
ucugucugaauuagauuuuguug

SEQ ID NO: 2071686 - RNA, 15 nt, Staphylococcus aureus subsp. aureus Mu50
ucuguguaaauauaa

SEQ ID NO: 2071687 - RNA, 11 nt, Staphylococcus aureus subsp. aureus Mu50
ucuguguuggg

SEQ ID NO: 2071688 - RNA, 13 nt, Staphylococcus aureus subsp. aureus Mu50
ucuguaucaauca

SEQ ID NO: 2071689 - RNA, 21 nt, Staphylococcus aureus subsp. aureus Mu50
ucuguauccucgguauuuaau

SEQ ID NO: 2071690 - RNA, 23 nt, Staphylococcus aureus subsp. aureus Mu50
ucuguaucgauucgauuauuuag

SEQ ID NO: 2071691 - RNA, 14 nt, Staphylococcus aureus subsp. aureus Mu50
ucugucaaauugga

SEQ ID NO: 2071692 - RNA, 16 nt, Staphylococcus aureus subsp. aureus Mu50
ucuguccgauuuuuaa

SEQ ID NO: 2071693 - RNA, 20 nt, Staphylococcus aureus subsp. aureus Mu50
ucuguccgauaucuuuuaau

SEQ ID NO: 2071694 - RNA, 13 nt, Staphylococcus aureus subsp. aureus Mu50
ucuguccaaaaag

SEQ ID NO: 2071695 - RNA, 18 nt, Staphylococcus aureus subsp. aureus Mu50
ucuguccgauuuuuaaug

SEQ ID NO: 2071696 - RNA, 21 nt, Staphylococcus aureus subsp. aureus Mu50
ucugucggacuccuuuuacuu

SEQ ID NO: 2071697 - RNA, 17 nt, Staphylococcus aureus subsp. aureus Mu50
ucugucuaaaaacauaa

SEQ ID NO: 2071698 - RNA, 19 nt, Staphylococcus aureus subsp. aureus Mu50
ucuguagcgauaccuuuaa

SEQ ID NO: 2071699 - RNA, 13 nt, Staphylococcus aureus subsp. aureus Mu50
ucuguaauuaauc

SEQ ID NO: 2071700 - RNA, 18 nt, Staphylococcus aureus subsp. aureus Mu50
ucuguaccguauuuuaau

SEQ ID NO: 2071701 - RNA, 16 nt, Staphylococcus aureus subsp. aureus Mu50
ucuguacguuuuaaau

SEQ ID NO: 2071702 - RNA, 12 nt, Staphylococcus aureus subsp. aureus Mu50
ucuguacuucua

SEQ ID NO: 2071703 - RNA, 19 nt, Staphylococcus aureus subsp. aureus Mu50
ucuguacguuuuaaauaaa

SEQ ID NO: 2071704 - RNA, 17 nt, Staphylococcus aureus subsp. aureus Mu50
ucugguucuuuacuaaa

SEQ ID NO: 2071705 - RNA, 23 nt, Staphylococcus aureus subsp. aureus Mu50
ucuguaaccaaaagaaauucgcu

SEQ ID NO: 2071706 - RNA, 22 nt, Staphylococcus aureus subsp. aureus Mu50
ucuguaaauuaucuaaagaaau

SEQ ID NO: 2071707 - RNA, 15 nt, Staphylococcus aureus subsp. aureus Mu50
ucuuccaaucaacuu

SEQ ID NO: 2071708 - RNA, 22 nt, Staphylococcus aureus subsp. aureus Mu50
ucuuccaaucaacuucauauaa

SEQ ID NO: 2071709 - RNA, 19 nt, Staphylococcus aureus subsp. aureus Mu50
ucuucacuaaaaauauauu

SEQ ID NO: 2071710 - RNA, 9 nt, Staphylococcus aureus subsp. aureus Mu50
ucuucacca

SEQ ID NO: 2071711 - RNA, 17 nt, Staphylococcus aureus subsp. aureus Mu50
ucuucaauucuuacacc

SEQ ID NO: 2071712 - RNA, 18 nt, Staphylococcus aureus subsp. aureus Mu50
ucuucaauuucauuuuug

SEQ ID NO: 2071713 - RNA, 13 nt, Staphylococcus aureus subsp. aureus Mu50
ucuucaauugucu

SEQ ID NO: 2071714 - RNA, 20 nt, Staphylococcus aureus subsp. aureus Mu50
ucuucccaaaaauuguucaa

SEQ ID NO: 2071715 - RNA, 22 nt, Staphylococcus aureus subsp. aureus Mu50
ucuguguuggggcccacacccc

SEQ ID NO: 2071716 - RNA, 16 nt, Staphylococcus aureus subsp. aureus Mu50
ucuguucauaauguaa

SEQ ID NO: 2071717 - RNA, 17 nt, Staphylococcus aureus subsp. aureus Mu50
ucuuaccauuuauccuu

SEQ ID NO: 2071718 - RNA, 18 nt, Staphylococcus aureus subsp. aureus Mu50
ucuuaguaagacugccau

SEQ ID NO: 2071719 - RNA, 22 nt, Staphylococcus aureus subsp. aureus Mu50
ucuuacuacuuaauuaauaauu

SEQ ID NO: 2071720 - RNA, 23 nt, Staphylococcus aureus subsp. aureus Mu50
ucuuacuacuuaauuaauaauuu

SEQ ID NO: 2071721 - RNA, 14 nt, Staphylococcus aureus subsp. aureus Mu50
ucuuaucuuuuuac

SEQ ID NO: 2071722 - RNA, 13 nt, Staphylococcus aureus subsp. aureus Mu50
ucuucaauauuua

SEQ ID NO: 2071723 - RNA, 21 nt, Staphylococcus aureus subsp. aureus Mu50
ucuucaauauuuaaauuuuaa

SEQ ID NO: 2071724 - RNA, 17 nt, Staphylococcus aureus subsp. aureus Mu50
ucuucaaucuaccaaua

SEQ ID NO: 2071725 - RNA, 18 nt, Staphylococcus aureus subsp. aureus Mu50
ucuucaaucuaccaauac

SEQ ID NO: 2071726 - RNA, 13 nt, Staphylococcus aureus subsp. aureus Mu50
ucuuaucaacaac

SEQ ID NO: 2071727 - RNA, 17 nt, Staphylococcus aureus subsp. aureus Mu50
ucuuaguuaaaauucag

SEQ ID NO: 2071728 - RNA, 18 nt, Staphylococcus aureus subsp. aureus Mu50
ucuuaguuaaaauucagu

SEQ ID NO: 2071729 - RNA, 21 nt, Staphylococcus aureus subsp. aureus Mu50
ucuuaucaagaauauaacgaa

SEQ ID NO: 2071730 - RNA, 18 nt, Staphylococcus aureus subsp. aureus Mu50
ucuuaucauuucaaauaa

SEQ ID NO: 2071731 - RNA, 15 nt, Staphylococcus aureus subsp. aureus Mu50
ucuuaucauaaucuu

SEQ ID NO: 2071732 - RNA, 22 nt, Staphylococcus aureus subsp. aureus Mu50
ucugauacagaaccaacaauaa

SEQ ID NO: 2071733 - RNA, 13 nt, Staphylococcus aureus subsp. aureus Mu50
ucugcaauuucau

SEQ ID NO: 2071734 - RNA, 18 nt, Staphylococcus aureus subsp. aureus Mu50
ucucuuuacaccauugca

SEQ ID NO: 2071735 - RNA, 18 nt, Staphylococcus aureus subsp. aureus Mu50
ucugaaacuuuaauacua

SEQ ID NO: 2071736 - RNA, 20 nt, Staphylococcus aureus subsp. aureus Mu50
ucugacauuguugcuaaucu

SEQ ID NO: 2071737 - RNA, 12 nt, Staphylococcus aureus subsp. aureus Mu50
ucucuucuggag

SEQ ID NO: 2071738 - RNA, 16 nt, Staphylococcus aureus subsp. aureus Mu50
ucucuucugucuaaaa

SEQ ID NO: 2071739 - RNA, 21 nt, Staphylococcus aureus subsp. aureus Mu50
aaaugcuucugguucuucaau

SEQ ID NO: 2071740 - RNA, 17 nt, Staphylococcus aureus subsp. aureus Mu50
ucucugaaaaacuucuu

SEQ ID NO: 2071741 - RNA, 22 nt, Staphylococcus aureus subsp. aureus Mu50
aaaugcuuaauuuguuuuaaau

SEQ ID NO: 2071742 - RNA, 19 nt, Staphylococcus aureus subsp. aureus Mu50
ucucugcuuuaauauaauu

SEQ ID NO: 2071743 - RNA, 17 nt, Staphylococcus aureus subsp. aureus Mu50
ucucguugcacaacagu

SEQ ID NO: 2071744 - RNA, 23 nt, Staphylococcus aureus subsp. aureus Mu50
ucucuaaaaagcggacugaaaga

SEQ ID NO: 2071745 - RNA, 17 nt, Staphylococcus aureus subsp. aureus Mu50
ucucuaaaacuuuuuca

SEQ ID NO: 2071746 - RNA, 18 nt, Staphylococcus aureus subsp. aureus Mu50
ucucguguaaaaugcaau

SEQ ID NO: 2071747 - RNA, 21 nt, Staphylococcus aureus subsp. aureus Mu50
ucucuaacgauuucuaguuua

SEQ ID NO: 2071748 - RNA, 23 nt, Staphylococcus aureus subsp. aureus Mu50
ucucuaucaguccgcuuuuucau

SEQ ID NO: 2071749 - RNA, 21 nt, Staphylococcus aureus subsp. aureus Mu50
ucuccuacaacuauucccacu

SEQ ID NO: 2071750 - RNA, 23 nt, Staphylococcus aureus subsp. aureus Mu50
ucucgcauacugucaucuuucaa

SEQ ID NO: 2071751 - RNA, 20 nt, Staphylococcus aureus subsp. aureus Mu50
ucucgauuaauuuucuuuuu

SEQ ID NO: 2071752 - RNA, 14 nt, Staphylococcus aureus subsp. aureus Mu50
ucuccaguuuucaa

SEQ ID NO: 2071753 - RNA, 22 nt, Staphylococcus aureus subsp. aureus Mu50
ucucccuuaaauacaauuucuu

SEQ ID NO: 2071754 - RNA, 16 nt, Staphylococcus aureus subsp. aureus Mu50
ucucaucuucuaaauc

SEQ ID NO: 2071755 - RNA, 21 nt, Staphylococcus aureus subsp. aureus Mu50
ucucauucuuuaauauaaauu

SEQ ID NO: 2071756 - RNA, 21 nt, Staphylococcus aureus subsp. aureus Mu50
ucucauuauaaugauuuuuau

SEQ ID NO: 2071757 - RNA, 19 nt, Staphylococcus aureus subsp. aureus Mu50
ucguuguacaguaauauuc

SEQ ID NO: 2071758 - RNA, 15 nt, Staphylococcus aureus subsp. aureus Mu50
ucguuucgucagauu

SEQ ID NO: 2071759 - RNA, 14 nt, Staphylococcus aureus subsp. aureus Mu50
ucguucucuuaaau

SEQ ID NO: 2071760 - RNA, 15 nt, Staphylococcus aureus subsp. aureus Mu50
ucguucucuuaaaua

SEQ ID NO: 2071761 - RNA, 21 nt, Staphylococcus aureus subsp. aureus Mu50
ucguucucuuaaauaugaaua

SEQ ID NO: 2071762 - RNA, 18 nt, Staphylococcus aureus subsp. aureus Mu50
ucguucaauuguugauuu

SEQ ID NO: 2071763 - RNA, 24 nt, Staphylococcus aureus subsp. aureus Mu50
ucguucaagaacaaucaauacaga

SEQ ID NO: 2071764 - RNA, 14 nt, Staphylococcus aureus subsp. aureus Mu50
ucguuaucuaagau

SEQ ID NO: 2071765 - RNA, 21 nt, Staphylococcus aureus subsp. aureus Mu50
ucguucaagaacaaucaauac

SEQ ID NO: 2071766 - RNA, 15 nt, Staphylococcus aureus subsp. aureus Mu50
ucguucauauauuuu

SEQ ID NO: 2071767 - RNA, 20 nt, Staphylococcus aureus subsp. aureus Mu50
ucguucgaaguagcuuguuu

SEQ ID NO: 2071768 - RNA, 22 nt, Staphylococcus aureus subsp. aureus Mu50
ucguuauaaguacaaauaauac

SEQ ID NO: 2071769 - RNA, 22 nt, Staphylococcus aureus subsp. aureus Mu50
ucguuaacaaucaguaauaaug

SEQ ID NO: 2071770 - RNA, 21 nt, Staphylococcus aureus subsp. aureus Mu50
ucguuaaggaaagcuucauau

SEQ ID NO: 2071771 - RNA, 15 nt, Staphylococcus aureus subsp. aureus Mu50
ucguguuccaauuuu

SEQ ID NO: 2071772 - RNA, 23 nt, Staphylococcus aureus subsp. aureus Mu50
ucgucuucuuuuuguccccagcc

SEQ ID NO: 2071773 - RNA, 21 nt, Staphylococcus aureus subsp. aureus Mu50
ucgucuuguaaacuucuuuuc

SEQ ID NO: 2071774 - RNA, 22 nt, Staphylococcus aureus subsp. aureus Mu50
ucgucuuuaucaacauaaaauu

SEQ ID NO: 2071775 - RNA, 12 nt, Staphylococcus aureus subsp. aureus Mu50
ucgugagccccu

SEQ ID NO: 2071776 - RNA, 16 nt, Staphylococcus aureus subsp. aureus Mu50
ucgugauagaaguuuu

SEQ ID NO: 2071777 - RNA, 18 nt, Staphylococcus aureus subsp. aureus Mu50
ucgucucacuuaauaaau

SEQ ID NO: 2071778 - RNA, 15 nt, Staphylococcus aureus subsp. aureus Mu50
ucguaguuguccauu

SEQ ID NO: 2071779 - RNA, 19 nt, Staphylococcus aureus subsp. aureus Mu50
ucguaggaugcuuccuuuu

SEQ ID NO: 2071780 - RNA, 21 nt, Staphylococcus aureus subsp. aureus Mu50
ucguauauguaaucagaguag

SEQ ID NO: 2071781 - RNA, 19 nt, Staphylococcus aureus subsp. aureus Mu50
ucguauaguacuaaaagua

SEQ ID NO: 2071782 - RNA, 14 nt, Staphylococcus aureus subsp. aureus Mu50
ucguauaagaauca

SEQ ID NO: 2071783 - RNA, 13 nt, Staphylococcus aureus subsp. aureus Mu50
ucguauuucauau

SEQ ID NO: 2071784 - RNA, 16 nt, Staphylococcus aureus subsp. aureus Mu50
ucguauucaaaguuuu

SEQ ID NO: 2071785 - RNA, 16 nt, Staphylococcus aureus subsp. aureus Mu50
ucguauucuuuuaaua

SEQ ID NO: 2071786 - RNA, 15 nt, Staphylococcus aureus subsp. aureus Mu50
ucguauucuuuuaau

SEQ ID NO: 2071787 - RNA, 19 nt, Staphylococcus aureus subsp. aureus Mu50
ucguaauguguuaauacuu

SEQ ID NO: 2071788 - RNA, 22 nt, Staphylococcus aureus subsp. aureus Mu50
ucguaauugucuuuauaaaaaa

SEQ ID NO: 2071789 - RNA, 14 nt, Staphylococcus aureus subsp. aureus Mu50
ucguaaugaugaca

SEQ ID NO: 2071790 - RNA, 16 nt, Staphylococcus aureus subsp. aureus Mu50
ucguaacauuuaaaaa

SEQ ID NO: 2071791 - RNA, 17 nt, Staphylococcus aureus subsp. aureus Mu50
ucguaacauuuaaaaaa

SEQ ID NO: 2071792 - RNA, 16 nt, Staphylococcus aureus subsp. aureus Mu50
ucguacuuccaauacu

SEQ ID NO: 2071793 - RNA, 18 nt, Staphylococcus aureus subsp. aureus Mu50
ucguacuuccaauacugu

SEQ ID NO: 2071794 - RNA, 13 nt, Staphylococcus aureus subsp. aureus Mu50
ucguacuuucaaa

SEQ ID NO: 2071795 - RNA, 14 nt, Staphylococcus aureus subsp. aureus Mu50
ucguacuuucaaau

SEQ ID NO: 2071796 - RNA, 15 nt, Staphylococcus aureus subsp. aureus Mu50
ucgucacguaaaaua

SEQ ID NO: 2071797 - RNA, 19 nt, Staphylococcus aureus subsp. aureus Mu50
ucggcuaaaguuauaaauu

SEQ ID NO: 2071798 - RNA, 13 nt, Staphylococcus aureus subsp. aureus Mu50
ucgguauuuuaaa

SEQ ID NO: 2071799 - RNA, 18 nt, Staphylococcus aureus subsp. aureus Mu50
ucgguauuuaauguuuua

SEQ ID NO: 2071800 - RNA, 22 nt, Staphylococcus aureus subsp. aureus Mu50
ucgguuuuauuuuuaucaucau

SEQ ID NO: 2071801 - RNA, 23 nt, Staphylococcus aureus subsp. aureus Mu50
ucgguuuuauuuuuaucaucaug

SEQ ID NO: 2071802 - RNA, 21 nt, Staphylococcus aureus subsp. aureus Mu50
ucgguuugauuaaaaucugcu

SEQ ID NO: 2071803 - RNA, 16 nt, Staphylococcus aureus subsp. aureus Mu50
ucgguucaucuaaaau

SEQ ID NO: 2071804 - RNA, 18 nt, Staphylococcus aureus subsp. aureus Mu50
ucgguucaucuaaaauga

SEQ ID NO: 2071805 - RNA, 15 nt, Staphylococcus aureus subsp. aureus Mu50
ucgguuugauuaaaa

SEQ ID NO: 2071806 - RNA, 15 nt, Staphylococcus aureus subsp. aureus Mu50
ucgguuuauuuaaua

SEQ ID NO: 2071807 - RNA, 14 nt, Staphylococcus aureus subsp. aureus Mu50
ucgguaugauauuu

SEQ ID NO: 2071808 - RNA, 14 nt, Staphylococcus aureus subsp. aureus Mu50
ucgguauucaauuc

SEQ ID NO: 2071809 - RNA, 17 nt, Staphylococcus aureus subsp. aureus Mu50
ucgguauuuaauguuuu

SEQ ID NO: 2071810 - RNA, 17 nt, Staphylococcus aureus subsp. aureus Mu50
ucggauuauauuuagau

SEQ ID NO: 2071811 - RNA, 16 nt, Staphylococcus aureus subsp. aureus Mu50
ucggauuaucuguaau

SEQ ID NO: 2071812 - RNA, 17 nt, Staphylococcus aureus subsp. aureus Mu50
ucggauaaauaaguuaa

SEQ ID NO: 2071813 - RNA, 18 nt, Staphylococcus aureus subsp. aureus Mu50
ucggaugagaaauguuaa

SEQ ID NO: 2071814 - RNA, 12 nt, Staphylococcus aureus subsp. aureus Mu50
ucggacagagga

SEQ ID NO: 2071815 - RNA, 13 nt, Staphylococcus aureus subsp. aureus Mu50
ucggaauaaaaua

SEQ ID NO: 2071816 - RNA, 15 nt, Staphylococcus aureus subsp. aureus Mu50
ucgcuugauuaauuu

SEQ ID NO: 2071817 - RNA, 19 nt, Staphylococcus aureus subsp. aureus Mu50
ucgcuugauuaauuuuauc

SEQ ID NO: 2071818 - RNA, 19 nt, Staphylococcus aureus subsp. aureus Mu50
ucgcuuucauaccuugauu

SEQ ID NO: 2071819 - RNA, 18 nt, Staphylococcus aureus subsp. aureus Mu50
ucggaaaaagaugaaaaa

SEQ ID NO: 2071820 - RNA, 14 nt, Staphylococcus aureus subsp. aureus Mu50
ucgcucuagacauu

SEQ ID NO: 2071821 - RNA, 21 nt, Staphylococcus aureus subsp. aureus Mu50
uccauacuucuauuuuauaau

SEQ ID NO: 2071822 - RNA, 14 nt, Staphylococcus aureus subsp. aureus Mu50
ucgccaagccaucu

SEQ ID NO: 2071823 - RNA, 20 nt, Staphylococcus aureus subsp. aureus Mu50
ucgccauuguccaacugcuu

SEQ ID NO: 2071824 - RNA, 21 nt, Staphylococcus aureus subsp. aureus Mu50
ucgcccuuuagccaaugcuuc

SEQ ID NO: 2071825 - RNA, 14 nt, Staphylococcus aureus subsp. aureus Mu50
ucgccuacuauaaa

SEQ ID NO: 2071826 - RNA, 19 nt, Staphylococcus aureus subsp. aureus Mu50
ucgcgaacguuauuuucaa

SEQ ID NO: 2071827 - RNA, 12 nt, Staphylococcus aureus subsp. aureus Mu50
ugaacuuuuauu

SEQ ID NO: 2071828 - RNA, 23 nt, Staphylococcus aureus subsp. aureus Mu50
ugaagcgcuuggauuuuuugguu

SEQ ID NO: 2071829 - RNA, 17 nt, Staphylococcus aureus subsp. aureus Mu50
ugaagggguuuuuucuu

SEQ ID NO: 2071830 - RNA, 23 nt, Staphylococcus aureus subsp. aureus Mu50
ugaaggcuuugaagggagcauuu

SEQ ID NO: 2071831 - RNA, 13 nt, Staphylococcus aureus subsp. aureus Mu50
ugaagauguauuu

SEQ ID NO: 2071832 - RNA, 19 nt, Staphylococcus aureus subsp. aureus Mu50
ugaagaugcuuuaauuaaa

SEQ ID NO: 2071833 - RNA, 22 nt, Staphylococcus aureus subsp. aureus Mu50
ugaauauacuuaauuuaaaucu

SEQ ID NO: 2071834 - RNA, 13 nt, Staphylococcus aureus subsp. aureus Mu50
ugaauauagcugu

SEQ ID NO: 2071835 - RNA, 13 nt, Staphylococcus aureus subsp. aureus Mu50
ugaauauuauuca

SEQ ID NO: 2071836 - RNA, 16 nt, Staphylococcus aureus subsp. aureus Mu50
ugaauauuauucauaa

SEQ ID NO: 2071837 - RNA, 17 nt, Staphylococcus aureus subsp. aureus Mu50
ugaauauggaaaaugua

SEQ ID NO: 2071838 - RNA, 13 nt, Staphylococcus aureus subsp. aureus Mu50
ugaauauaaaaaa

SEQ ID NO: 2071839 - RNA, 14 nt, Staphylococcus aureus subsp. aureus Mu50
ugaaguuacuauau

SEQ ID NO: 2071840 - RNA, 22 nt, Staphylococcus aureus subsp. aureus Mu50
ugaaguuuaaucguauuagcca

SEQ ID NO: 2071841 - RNA, 14 nt, Staphylococcus aureus subsp. aureus Mu50
ugaauaauauauuu

SEQ ID NO: 2071842 - RNA, 22 nt, Staphylococcus aureus subsp. aureus Mu50
ugaauaaucauccauauaugcc

SEQ ID NO: 2071843 - RNA, 15 nt, Staphylococcus aureus subsp. aureus Mu50
ugaauaauuccagua

SEQ ID NO: 2071844 - RNA, 11 nt, Staphylococcus aureus subsp. aureus Mu50
ugaauaauucc

SEQ ID NO: 2071845 - RNA, 17 nt, Staphylococcus aureus subsp. aureus Mu50
ugaauaauugcuaaaau

SEQ ID NO: 2071846 - RNA, 14 nt, Staphylococcus aureus subsp. aureus Mu50
ugaauaauuucagu

SEQ ID NO: 2071847 - RNA, 22 nt, Staphylococcus aureus subsp. aureus Mu50
ugaauaauuucaguucuuagau

SEQ ID NO: 2071848 - RNA, 13 nt, Staphylococcus aureus subsp. aureus Mu50
ugaacaauucuuc

SEQ ID NO: 2071849 - RNA, 21 nt, Staphylococcus aureus subsp. aureus Mu50
ugaacaauaccgcgauaaaua

SEQ ID NO: 2071850 - RNA, 19 nt, Staphylococcus aureus subsp. aureus Mu50
ugaacaaucagauaaguua

SEQ ID NO: 2071851 - RNA, 23 nt, Staphylococcus aureus subsp. aureus Mu50
ugaacaaaaaauaaaaacuucua

SEQ ID NO: 2071852 - RNA, 19 nt, Staphylococcus aureus subsp. aureus Mu50
ugaaauuuuuuagugaaaa

SEQ ID NO: 2071853 - RNA, 18 nt, Staphylococcus aureus subsp. aureus Mu50
ugaaccaauccaauauac

SEQ ID NO: 2071854 - RNA, 20 nt, Staphylococcus aureus subsp. aureus Mu50
ugaacauauuauaaaagugu

SEQ ID NO: 2071855 - RNA, 17 nt, Staphylococcus aureus subsp. aureus Mu50
ugaacaucauuuaauug

SEQ ID NO: 2071856 - RNA, 18 nt, Staphylococcus aureus subsp. aureus Mu50
ugaacaucauuuaauuga

SEQ ID NO: 2071857 - RNA, 14 nt, Staphylococcus aureus subsp. aureus Mu50
ugaaauuuuuaaua

SEQ ID NO: 2071858 - RNA, 13 nt, Staphylococcus aureus subsp. aureus Mu50
ugaaauuuuuccg

SEQ ID NO: 2071859 - RNA, 14 nt, Staphylococcus aureus subsp. aureus Mu50
ugaaauuuuuccga

SEQ ID NO: 2071860 - RNA, 23 nt, Staphylococcus aureus subsp. aureus Mu50
ugaaauucgaacuaucaauauaa

SEQ ID NO: 2071861 - RNA, 21 nt, Staphylococcus aureus subsp. aureus Mu50
ugaaauuaacgucaacagcau

SEQ ID NO: 2071862 - RNA, 23 nt, Staphylococcus aureus subsp. aureus Mu50
ugaaauuaacgucaacagcauaa

SEQ ID NO: 2071863 - RNA, 22 nt, Staphylococcus aureus subsp. aureus Mu50
ugaaauuauuauuuaaauuuuc

SEQ ID NO: 2071864 - RNA, 17 nt, Staphylococcus aureus subsp. aureus Mu50
ugaaauuauuauuuaaa

SEQ ID NO: 2071865 - RNA, 17 nt, Staphylococcus aureus subsp. aureus Mu50
ugaaauggaaaguaaua

SEQ ID NO: 2071866 - RNA, 15 nt, Staphylococcus aureus subsp. aureus Mu50
ugaaaugguaucuaa

SEQ ID NO: 2071867 - RNA, 19 nt, Staphylococcus aureus subsp. aureus Mu50
ugaaauuagaaaaauauga

SEQ ID NO: 2071868 - RNA, 16 nt, Staphylococcus aureus subsp. aureus Mu50
ugaaauuaaauucaaa

SEQ ID NO: 2071869 - RNA, 17 nt, Staphylococcus aureus subsp. aureus Mu50
ugaaauguuuaucaauu

SEQ ID NO: 2071870 - RNA, 15 nt, Staphylococcus aureus subsp. aureus Mu50
ugaaaugagcuuaag

SEQ ID NO: 2071871 - RNA, 22 nt, Staphylococcus aureus subsp. aureus Mu50
ugaaaugauacauuauuaaaua

SEQ ID NO: 2071872 - RNA, 15 nt, Staphylococcus aureus subsp. aureus Mu50
ugaaauauuuaucuu

SEQ ID NO: 2071873 - RNA, 14 nt, Staphylococcus aureus subsp. aureus Mu50
ugaaagauacugcu

SEQ ID NO: 2071874 - RNA, 19 nt, Staphylococcus aureus subsp. aureus Mu50
ugaaagaaaagugaaaacu

SEQ ID NO: 2071875 - RNA, 22 nt, Staphylococcus aureus subsp. aureus Mu50
ugaaaccuuugguucaaucauu

SEQ ID NO: 2071876 - RNA, 13 nt, Staphylococcus aureus subsp. aureus Mu50
ugaaacuuuaaua

SEQ ID NO: 2071877 - RNA, 16 nt, Staphylococcus aureus subsp. aureus Mu50
ugaaacuuuaauacua

SEQ ID NO: 2071878 - RNA, 16 nt, Staphylococcus aureus subsp. aureus Mu50
ugaaauaucgagaggg

SEQ ID NO: 2071879 - RNA, 20 nt, Staphylococcus aureus subsp. aureus Mu50
ugaaauauaccaaccaaaac

SEQ ID NO: 2071880 - RNA, 19 nt, Staphylococcus aureus subsp. aureus Mu50
ugaaaguaccuaaaauaga

SEQ ID NO: 2071881 - RNA, 23 nt, Staphylococcus aureus subsp. aureus Mu50
ugaaaguaccgguuuuucguaua

SEQ ID NO: 2071882 - RNA, 17 nt, Staphylococcus aureus subsp. aureus Mu50
ugaaaguaccuaaaaua

SEQ ID NO: 2071883 - RNA, 18 nt, Staphylococcus aureus subsp. aureus Mu50
ugaaaguaccuaaaauag

SEQ ID NO: 2071884 - RNA, 21 nt, Staphylococcus aureus subsp. aureus Mu50
ucuucggcuuuguaaaauugu

SEQ ID NO: 2071885 - RNA, 14 nt, Staphylococcus aureus subsp. aureus Mu50
ugaaacaucuugau

SEQ ID NO: 2071886 - RNA, 14 nt, Staphylococcus aureus subsp. aureus Mu50
ugaaaccauacuaa

SEQ ID NO: 2071887 - RNA, 13 nt, Staphylococcus aureus subsp. aureus Mu50
ugacaguuuccau

SEQ ID NO: 2071888 - RNA, 17 nt, Staphylococcus aureus subsp. aureus Mu50
ugacauauuuuuuaaau

SEQ ID NO: 2071889 - RNA, 19 nt, Staphylococcus aureus subsp. aureus Mu50
ugacauaucgauauucucc

SEQ ID NO: 2071890 - RNA, 12 nt, Staphylococcus aureus subsp. aureus Mu50
ugacaucaucua

SEQ ID NO: 2071891 - RNA, 22 nt, Staphylococcus aureus subsp. aureus Mu50
ugaccauuaucaagaacuuuaa

SEQ ID NO: 2071892 - RNA, 17 nt, Staphylococcus aureus subsp. aureus Mu50
ugacacacccaaauuua

SEQ ID NO: 2071893 - RNA, 18 nt, Staphylococcus aureus subsp. aureus Mu50
ugacaaagcuaaagugaa

SEQ ID NO: 2071894 - RNA, 14 nt, Staphylococcus aureus subsp. aureus Mu50
ugacaaauuaucac

SEQ ID NO: 2071895 - RNA, 20 nt, Staphylococcus aureus subsp. aureus Mu50
ugaaucgauauaaugaaguu

SEQ ID NO: 2071896 - RNA, 24 nt, Staphylococcus aureus subsp. aureus Mu50
ugaaucggugucuuuauguuugau

SEQ ID NO: 2071897 - RNA, 19 nt, Staphylococcus aureus subsp. aureus Mu50
ugaaucuagaauauaacaa

SEQ ID NO: 2071898 - RNA, 16 nt, Staphylococcus aureus subsp. aureus Mu50
ugaaucuagaauauaa

SEQ ID NO: 2071899 - RNA, 21 nt, Staphylococcus aureus subsp. aureus Mu50
ugaaucuaaacuauaauaauu

SEQ ID NO: 2071900 - RNA, 14 nt, Staphylococcus aureus subsp. aureus Mu50
ugaaucuaaacuau

SEQ ID NO: 2071901 - RNA, 18 nt, Staphylococcus aureus subsp. aureus Mu50
ugaaucuaaacuauaaua

SEQ ID NO: 2071902 - RNA, 16 nt, Staphylococcus aureus subsp. aureus Mu50
ugaaucccauaaugac

SEQ ID NO: 2071903 - RNA, 14 nt, Staphylococcus aureus subsp. aureus Mu50
ugaaucgcauuuaa

SEQ ID NO: 2071904 - RNA, 23 nt, Staphylococcus aureus subsp. aureus Mu50
ugaauauuuuucaauuaaauguu

SEQ ID NO: 2071905 - RNA, 21 nt, Staphylococcus aureus subsp. aureus Mu50
ugaaugaaguaauauauaaaa

SEQ ID NO: 2071906 - RNA, 14 nt, Staphylococcus aureus subsp. aureus Mu50
ugaaugaaguaaua

SEQ ID NO: 2071907 - RNA, 16 nt, Staphylococcus aureus subsp. aureus Mu50
ugaaugauugcauuga

SEQ ID NO: 2071908 - RNA, 14 nt, Staphylococcus aureus subsp. aureus Mu50
ugaaugauauuaac

SEQ ID NO: 2071909 - RNA, 14 nt, Staphylococcus aureus subsp. aureus Mu50
ugaaugaaaauaag

SEQ ID NO: 2071910 - RNA, 15 nt, Staphylococcus aureus subsp. aureus Mu50
ugaaucuuuguuaua

SEQ ID NO: 2071911 - RNA, 23 nt, Staphylococcus aureus subsp. aureus Mu50
ugaaucuuguugaacucugauau

SEQ ID NO: 2071912 - RNA, 20 nt, Staphylococcus aureus subsp. aureus Mu50
ugaaucuuauuuuguuuuaa

SEQ ID NO: 2071913 - RNA, 16 nt, Staphylococcus aureus subsp. aureus Mu50
ugaauggcaaauauga

SEQ ID NO: 2071914 - RNA, 14 nt, Staphylococcus aureus subsp. aureus Mu50
ugaauggcaaauau

SEQ ID NO: 2071915 - RNA, 12 nt, Staphylococcus aureus subsp. aureus Mu50
ugaauggcucgu

SEQ ID NO: 2071916 - RNA, 19 nt, Staphylococcus aureus subsp. aureus Mu50
ugaaugggucauuaaauga

SEQ ID NO: 2071917 - RNA, 12 nt, Staphylococcus aureus subsp. aureus Mu50
ugaauuaacaau

SEQ ID NO: 2071918 - RNA, 23 nt, Staphylococcus aureus subsp. aureus Mu50
ugaauguuggaucggcauuguaa

SEQ ID NO: 2071919 - RNA, 12 nt, Staphylococcus aureus subsp. aureus Mu50
ugaauuaaaaaa

SEQ ID NO: 2071920 - RNA, 22 nt, Staphylococcus aureus subsp. aureus Mu50
ugaauguuugguaacacuguga

SEQ ID NO: 2071921 - RNA, 20 nt, Staphylococcus aureus subsp. aureus Mu50
ugaauguuuucuaaaucuaa

SEQ ID NO: 2071922 - RNA, 12 nt, Staphylococcus aureus subsp. aureus Mu50
ugaaugguugau

SEQ ID NO: 2071923 - RNA, 19 nt, Staphylococcus aureus subsp. aureus Mu50
ugaaugguugauuauauuu

SEQ ID NO: 2071924 - RNA, 14 nt, Staphylococcus aureus subsp. aureus Mu50
ugaauucauuuuau

SEQ ID NO: 2071925 - RNA, 16 nt, Staphylococcus aureus subsp. aureus Mu50
ugaauucauucaauac

SEQ ID NO: 2071926 - RNA, 19 nt, Staphylococcus aureus subsp. aureus Mu50
ugaauuauuuaaaaugcuu

SEQ ID NO: 2071927 - RNA, 18 nt, Staphylococcus aureus subsp. aureus Mu50
ugaauugaaaaauuaaaa

SEQ ID NO: 2071928 - RNA, 21 nt, Staphylococcus aureus subsp. aureus Mu50
ugaauugaguauuaaauuuga

SEQ ID NO: 2071929 - RNA, 16 nt, Staphylococcus aureus subsp. aureus Mu50
ugaauugaguauuaaa

SEQ ID NO: 2071930 - RNA, 12 nt, Staphylococcus aureus subsp. aureus Mu50
ugaauuucuuua

SEQ ID NO: 2071931 - RNA, 21 nt, Staphylococcus aureus subsp. aureus Mu50
ugaauuuuaauauauuuggag

SEQ ID NO: 2071932 - RNA, 13 nt, Staphylococcus aureus subsp. aureus Mu50
ugaauuuuuauuu

SEQ ID NO: 2071933 - RNA, 21 nt, Staphylococcus aureus subsp. aureus Mu50
ugaauuuuauaaauuaaaugc

SEQ ID NO: 2071934 - RNA, 21 nt, Staphylococcus aureus subsp. aureus Mu50
ugaauuuuauaaguauauaau

SEQ ID NO: 2071935 - RNA, 18 nt, Staphylococcus aureus subsp. aureus Mu50
ugaauugguugaucaauu

SEQ ID NO: 2071936 - RNA, 17 nt, Staphylococcus aureus subsp. aureus Mu50
ugaauuggauuaucgaa

SEQ ID NO: 2071937 - RNA, 13 nt, Staphylococcus aureus subsp. aureus Mu50
ugaauuguuaguu

SEQ ID NO: 2071938 - RNA, 19 nt, Staphylococcus aureus subsp. aureus Mu50
ugaauuguuaguuuucuua

SEQ ID NO: 2071939 - RNA, 18 nt, Staphylococcus aureus subsp. aureus Mu50
ugaauugucuuaauaugc

SEQ ID NO: 2071940 - RNA, 15 nt, Staphylococcus aureus subsp. aureus Mu50
ugaauuuaauacuau

SEQ ID NO: 2071941 - RNA, 14 nt, Staphylococcus aureus subsp. aureus Mu50
ugaauuuauuuugu

SEQ ID NO: 2071942 - RNA, 14 nt, Staphylococcus aureus subsp. aureus Mu50
ugaauuucaaaaua

SEQ ID NO: 2071943 - RNA, 14 nt, Staphylococcus aureus subsp. aureus Mu50
ugaauuuagaugca

SEQ ID NO: 2071944 - RNA, 21 nt, Staphylococcus aureus subsp. aureus Mu50
ugaauuuagaugcauaaaaaa

SEQ ID NO: 2071945 - RNA, 14 nt, Staphylococcus aureus subsp. aureus Mu50
ugaauuuagcauca

SEQ ID NO: 2071946 - RNA, 12 nt, Staphylococcus aureus subsp. aureus Mu50
ugauguaauucu

SEQ ID NO: 2071947 - RNA, 15 nt, Staphylococcus aureus subsp. aureus Mu50
ugauguaauucuguu

SEQ ID NO: 2071948 - RNA, 13 nt, Staphylococcus aureus subsp. aureus Mu50
ugaugugaaaauu

SEQ ID NO: 2071949 - RNA, 22 nt, Staphylococcus aureus subsp. aureus Mu50
ugauguaugugaguaaugaccg

SEQ ID NO: 2071950 - RNA, 13 nt, Staphylococcus aureus subsp. aureus Mu50
ugaugugcuaccu

SEQ ID NO: 2071951 - RNA, 18 nt, Staphylococcus aureus subsp. aureus Mu50
ugauguguuguuuuaauu

SEQ ID NO: 2071952 - RNA, 16 nt, Staphylococcus aureus subsp. aureus Mu50
ugauguguugcauuac

SEQ ID NO: 2071953 - RNA, 18 nt, Staphylococcus aureus subsp. aureus Mu50
ugauuacaacuuauucuu

SEQ ID NO: 2071954 - RNA, 17 nt, Staphylococcus aureus subsp. aureus Mu50
ugauuaauuauugagaa

SEQ ID NO: 2071955 - RNA, 16 nt, Staphylococcus aureus subsp. aureus Mu50
ugauuaauuuuaucuu

SEQ ID NO: 2071956 - RNA, 23 nt, Staphylococcus aureus subsp. aureus Mu50
ugauuaauuauugagaauauuua

SEQ ID NO: 2071957 - RNA, 22 nt, Staphylococcus aureus subsp. aureus Mu50
ugauuacguugguuuaaaaauu

SEQ ID NO: 2071958 - RNA, 16 nt, Staphylococcus aureus subsp. aureus Mu50
ugauuaccaacaaggu

SEQ ID NO: 2071959 - RNA, 17 nt, Staphylococcus aureus subsp. aureus Mu50
ugauuaccuucucuuca

SEQ ID NO: 2071960 - RNA, 23 nt, Staphylococcus aureus subsp. aureus Mu50
ugauuaaaguguuucaacauauu

SEQ ID NO: 2071961 - RNA, 19 nt, Staphylococcus aureus subsp. aureus Mu50
ugauuaaaaacgucucuau

SEQ ID NO: 2071962 - RNA, 22 nt, Staphylococcus aureus subsp. aureus Mu50
ugauguuuucuauaauauuuaa

SEQ ID NO: 2071963 - RNA, 20 nt, Staphylococcus aureus subsp. aureus Mu50
ugauguucaauauuuucaug

SEQ ID NO: 2071964 - RNA, 22 nt, Staphylococcus aureus subsp. aureus Mu50
ugauucauuucgauuaauuuaa

SEQ ID NO: 2071965 - RNA, 18 nt, Staphylococcus aureus subsp. aureus Mu50
ugauucuaaauaaucgaa

SEQ ID NO: 2071966 - RNA, 14 nt, Staphylococcus aureus subsp. aureus Mu50
ugauucuagugaaa

SEQ ID NO: 2071967 - RNA, 16 nt, Staphylococcus aureus subsp. aureus Mu50
ugauucuacagcacug

SEQ ID NO: 2071968 - RNA, 19 nt, Staphylococcus aureus subsp. aureus Mu50
ugauucuacagcacugaaa

SEQ ID NO: 2071969 - RNA, 23 nt, Staphylococcus aureus subsp. aureus Mu50
ugauuauucuuugauuaaaucuu

SEQ ID NO: 2071970 - RNA, 22 nt, Staphylococcus aureus subsp. aureus Mu50
ugauucaccagguuuuuuauuu

SEQ ID NO: 2071971 - RNA, 15 nt, Staphylococcus aureus subsp. aureus Mu50
ugauuauucuucauu

SEQ ID NO: 2071972 - RNA, 18 nt, Staphylococcus aureus subsp. aureus Mu50
ugauuauucuucauuuau

SEQ ID NO: 2071973 - RNA, 16 nt, Staphylococcus aureus subsp. aureus Mu50
ugauuaucauuguuca

SEQ ID NO: 2071974 - RNA, 13 nt, Staphylococcus aureus subsp. aureus Mu50
ugauuaucauaug

SEQ ID NO: 2071975 - RNA, 22 nt, Staphylococcus aureus subsp. aureus Mu50
ugauuagcauaccuuuauuauu

SEQ ID NO: 2071976 - RNA, 17 nt, Staphylococcus aureus subsp. aureus Mu50
ugauuauaaugauuguc

SEQ ID NO: 2071977 - RNA, 14 nt, Staphylococcus aureus subsp. aureus Mu50
ugauuauauuucuc

SEQ ID NO: 2071978 - RNA, 15 nt, Staphylococcus aureus subsp. aureus Mu50
ugauuauauuucuca

SEQ ID NO: 2071979 - RNA, 16 nt, Staphylococcus aureus subsp. aureus Mu50
ugauuauauuucucau

SEQ ID NO: 2071980 - RNA, 18 nt, Staphylococcus aureus subsp. aureus Mu50
ugauuauauuucucauac

SEQ ID NO: 2071981 - RNA, 15 nt, Staphylococcus aureus subsp. aureus Mu50
ugauuauauuuuucu

SEQ ID NO: 2071982 - RNA, 19 nt, Staphylococcus aureus subsp. aureus Mu50
ugauuauauuuuucuucag

SEQ ID NO: 2071983 - RNA, 21 nt, Staphylococcus aureus subsp. aureus Mu50
ugauuuauucuaaauauauuu

SEQ ID NO: 2071984 - RNA, 16 nt, Staphylococcus aureus subsp. aureus Mu50
ugauuguaauaucuaa

SEQ ID NO: 2071985 - RNA, 22 nt, Staphylococcus aureus subsp. aureus Mu50
ugauugcugcuguacaauuucg

SEQ ID NO: 2071986 - RNA, 24 nt, Staphylococcus aureus subsp. aureus Mu50
ugaucuuuuuuauauucaacuuau

SEQ ID NO: 2071987 - RNA, 19 nt, Staphylococcus aureus subsp. aureus Mu50
ugaugaagcaguuguuggu

SEQ ID NO: 2071988 - RNA, 20 nt, Staphylococcus aureus subsp. aureus Mu50
ugaugaaguaguuucauugc

SEQ ID NO: 2071989 - RNA, 16 nt, Staphylococcus aureus subsp. aureus Mu50
ugaugcgaaaccuuuc

SEQ ID NO: 2071990 - RNA, 19 nt, Staphylococcus aureus subsp. aureus Mu50
ugaugcauaagauuuugaa

SEQ ID NO: 2071991 - RNA, 19 nt, Staphylococcus aureus subsp. aureus Mu50
ugaugcuugaauguuugaa

SEQ ID NO: 2071992 - RNA, 20 nt, Staphylococcus aureus subsp. aureus Mu50
ugauacauuauuaaauagau

SEQ ID NO: 2071993 - RNA, 16 nt, Staphylococcus aureus subsp. aureus Mu50
ugauacauucuauuaa

SEQ ID NO: 2071994 - RNA, 23 nt, Staphylococcus aureus subsp. aureus Mu50
ugauauuaagucuagcauuagaa

SEQ ID NO: 2071995 - RNA, 18 nt, Staphylococcus aureus subsp. aureus Mu50
ugauauuuaacaaaauua

SEQ ID NO: 2071996 - RNA, 23 nt, Staphylococcus aureus subsp. aureus Mu50
ugauauuugcuagucauaauuua

SEQ ID NO: 2071997 - RNA, 19 nt, Staphylococcus aureus subsp. aureus Mu50
ugauauugaucugauuuca

SEQ ID NO: 2071998 - RNA, 19 nt, Staphylococcus aureus subsp. aureus Mu50
ugauauuuuucgaauuuaa

SEQ ID NO: 2071999 - RNA, 23 nt, Staphylococcus aureus subsp. aureus Mu50
ugagucaauuucuuuaaagucuu

SEQ ID NO: 2072000 - RNA, 14 nt, Staphylococcus aureus subsp. aureus Mu50
ugaguuuaaaaaua

SEQ ID NO: 2072001 - RNA, 12 nt, Staphylococcus aureus subsp. aureus Mu50
ugaguuuaaaaa

SEQ ID NO: 2072002 - RNA, 13 nt, Staphylococcus aureus subsp. aureus Mu50
ugaguuuaaaaau

SEQ ID NO: 2072003 - RNA, 14 nt, Staphylococcus aureus subsp. aureus Mu50
ugaguuggcaucag

SEQ ID NO: 2072004 - RNA, 23 nt, Staphylococcus aureus subsp. aureus Mu50
ugaguuggcaucagacuaaaaug

SEQ ID NO: 2072005 - RNA, 13 nt, Staphylococcus aureus subsp. aureus Mu50
ugauaaugcaugu

SEQ ID NO: 2072006 - RNA, 12 nt, Staphylococcus aureus subsp. aureus Mu50
ugauaaauuaaa

SEQ ID NO: 2072007 - RNA, 23 nt, Staphylococcus aureus subsp. aureus Mu50
ugauaacaaccgucccauaaaag

SEQ ID NO: 2072008 - RNA, 14 nt, Staphylococcus aureus subsp. aureus Mu50
ugauacauaaaaug

SEQ ID NO: 2072009 - RNA, 13 nt, Staphylococcus aureus subsp. aureus Mu50
ugauacauuauua

SEQ ID NO: 2072010 - RNA, 14 nt, Staphylococcus aureus subsp. aureus Mu50
ugauacauuauuaa

SEQ ID NO: 2072011 - RNA, 22 nt, Staphylococcus aureus subsp. aureus Mu50
ugauaauuuuucuucuuuuuua

SEQ ID NO: 2072012 - RNA, 14 nt, Staphylococcus aureus subsp. aureus Mu50
ugauaauucuucaa

SEQ ID NO: 2072013 - RNA, 22 nt, Staphylococcus aureus subsp. aureus Mu50
ugauaauuaauuaaaauucucu

SEQ ID NO: 2072014 - RNA, 16 nt, Staphylococcus aureus subsp. aureus Mu50
ugaguaucaugcuuuu

SEQ ID NO: 2072015 - RNA, 19 nt, Staphylococcus aureus subsp. aureus Mu50
ugaguaucaugcuuuuaau

SEQ ID NO: 2072016 - RNA, 15 nt, Staphylococcus aureus subsp. aureus Mu50
ugaguauccaauacu

SEQ ID NO: 2072017 - RNA, 15 nt, Staphylococcus aureus subsp. aureus Mu50
ugaguauauucaaaa

SEQ ID NO: 2072018 - RNA, 20 nt, Staphylococcus aureus subsp. aureus Mu50
ugaguaaauuaauagagaaa

SEQ ID NO: 2072019 - RNA, 20 nt, Staphylococcus aureus subsp. aureus Mu50
ugaggcccauaaauuacuug

SEQ ID NO: 2072020 - RNA, 18 nt, Staphylococcus aureus subsp. aureus Mu50
ugaggcccauaaauuacu

SEQ ID NO: 2072021 - RNA, 19 nt, Staphylococcus aureus subsp. aureus Mu50
ugaggcccauaaauuacuu

SEQ ID NO: 2072022 - RNA, 17 nt, Staphylococcus aureus subsp. aureus Mu50
ugagcuuuguuagcauc

SEQ ID NO: 2072023 - RNA, 19 nt, Staphylococcus aureus subsp. aureus Mu50
ugagcuuuguuugaaacaa

SEQ ID NO: 2072024 - RNA, 18 nt, Staphylococcus aureus subsp. aureus Mu50
ugagcuuuucuaaugcua

SEQ ID NO: 2072025 - RNA, 16 nt, Staphylococcus aureus subsp. aureus Mu50
ugagcuuaauaaauug

SEQ ID NO: 2072026 - RNA, 16 nt, Staphylococcus aureus subsp. aureus Mu50
ugagcuucuuuaaaua

SEQ ID NO: 2072027 - RNA, 17 nt, Staphylococcus aureus subsp. aureus Mu50
ugagcuucuuuaaauac

SEQ ID NO: 2072028 - RNA, 16 nt, Staphylococcus aureus subsp. aureus Mu50
ugacuguagaaaacau

SEQ ID NO: 2072029 - RNA, 14 nt, Staphylococcus aureus subsp. aureus Mu50
ugacuguuaaacaa

SEQ ID NO: 2072030 - RNA, 16 nt, Staphylococcus aureus subsp. aureus Mu50
ugacuuuaauugcucu

SEQ ID NO: 2072031 - RNA, 14 nt, Staphylococcus aureus subsp. aureus Mu50
ugacuuuaaaucuu

SEQ ID NO: 2072032 - RNA, 14 nt, Staphylococcus aureus subsp. aureus Mu50
ugaccuucaguuuc

SEQ ID NO: 2072033 - RNA, 15 nt, Staphylococcus aureus subsp. aureus Mu50
ugagaaucuuggaag

SEQ ID NO: 2072034 - RNA, 19 nt, Staphylococcus aureus subsp. aureus Mu50
ugagaauauuuauuguuuu

SEQ ID NO: 2072035 - RNA, 17 nt, Staphylococcus aureus subsp. aureus Mu50
ugagaauugcaacgcau

SEQ ID NO: 2072036 - RNA, 16 nt, Staphylococcus aureus subsp. aureus Mu50
ugagaauuucuaauua

SEQ ID NO: 2072037 - RNA, 20 nt, Staphylococcus aureus subsp. aureus Mu50
ugagaaaaauauuucuaaua

SEQ ID NO: 2072038 - RNA, 14 nt, Staphylococcus aureus subsp. aureus Mu50
ugacuuuuauaauu

SEQ ID NO: 2072039 - RNA, 21 nt, Staphylococcus aureus subsp. aureus Mu50
ugacuuuuaaaaaacauaccu

SEQ ID NO: 2072040 - RNA, 23 nt, Staphylococcus aureus subsp. aureus Mu50
ugacuuuuaaaaaacauaccugc

SEQ ID NO: 2072041 - RNA, 13 nt, Staphylococcus aureus subsp. aureus Mu50
ugacuuuuuaaua

SEQ ID NO: 2072042 - RNA, 16 nt, Staphylococcus aureus subsp. aureus Mu50
ugacuuugucauacua

SEQ ID NO: 2072043 - RNA, 14 nt, Staphylococcus aureus subsp. aureus Mu50
ugacuuuuaaaaaa

SEQ ID NO: 2072044 - RNA, 15 nt, Staphylococcus aureus subsp. aureus Mu50
ugagcacuuaauaag

SEQ ID NO: 2072045 - RNA, 22 nt, Staphylococcus aureus subsp. aureus Mu50
ugagauuauuuuuuuaaaucua

SEQ ID NO: 2072046 - RNA, 13 nt, Staphylococcus aureus subsp. aureus Mu50
ugagauuaucuuu

SEQ ID NO: 2072047 - RNA, 19 nt, Staphylococcus aureus subsp. aureus Mu50
ugagauuaucuuuagacau

SEQ ID NO: 2072048 - RNA, 15 nt, Staphylococcus aureus subsp. aureus Mu50
ugagcacaaacuaaa

SEQ ID NO: 2072049 - RNA, 13 nt, Staphylococcus aureus subsp. aureus Mu50
ugagcaucuuuua

SEQ ID NO: 2072050 - RNA, 14 nt, Staphylococcus aureus subsp. aureus Mu50
ugagcaucuugucu

SEQ ID NO: 2072051 - RNA, 20 nt, Staphylococcus aureus subsp. aureus Mu50
aaauggugaacuaaauugaa

SEQ ID NO: 2072052 - RNA, 23 nt, Staphylococcus aureus subsp. aureus Mu50
aaauggcaucuggcaaauugccu

SEQ ID NO: 2072053 - RNA, 19 nt, Staphylococcus aureus subsp. aureus Mu50
ugccuggcaacguucuacu

SEQ ID NO: 2072054 - RNA, 18 nt, Staphylococcus aureus subsp. aureus Mu50
ugccggcuuuuucuuuug

SEQ ID NO: 2072055 - RNA, 13 nt, Staphylococcus aureus subsp. aureus Mu50
ugccuaauuuugu

SEQ ID NO: 2072056 - RNA, 23 nt, Staphylococcus aureus subsp. aureus Mu50
ugccguuugaagucuguuuagaa

SEQ ID NO: 2072057 - RNA, 17 nt, Staphylococcus aureus subsp. aureus Mu50
ugccguuauuuucaaua

SEQ ID NO: 2072058 - RNA, 17 nt, Staphylococcus aureus subsp. aureus Mu50
ugcccaccauguacauu

SEQ ID NO: 2072059 - RNA, 16 nt, Staphylococcus aureus subsp. aureus Mu50
ugccauauguuuuaga

SEQ ID NO: 2072060 - RNA, 14 nt, Staphylococcus aureus subsp. aureus Mu50
ugccaucuuuguaa

SEQ ID NO: 2072061 - RNA, 13 nt, Staphylococcus aureus subsp. aureus Mu50
ugccauucauuaa

SEQ ID NO: 2072062 - RNA, 18 nt, Staphylococcus aureus subsp. aureus Mu50
ugccauucauuaagcuuu

SEQ ID NO: 2072063 - RNA, 21 nt, Staphylococcus aureus subsp. aureus Mu50
ugccauuuuuaaauuacuaua

SEQ ID NO: 2072064 - RNA, 19 nt, Staphylococcus aureus subsp. aureus Mu50
ugccauuguuauccaaaac

SEQ ID NO: 2072065 - RNA, 17 nt, Staphylococcus aureus subsp. aureus Mu50
ugccaauaaaaugcaau

SEQ ID NO: 2072066 - RNA, 22 nt, Staphylococcus aureus subsp. aureus Mu50
ugccaaauuucucuuucaagac

SEQ ID NO: 2072067 - RNA, 20 nt, Staphylococcus aureus subsp. aureus Mu50
ugcauuaauuucaugugcaa

SEQ ID NO: 2072068 - RNA, 22 nt, Staphylococcus aureus subsp. aureus Mu50
ugcauuacuacuuuauaaauau

SEQ ID NO: 2072069 - RNA, 14 nt, Staphylococcus aureus subsp. aureus Mu50
ugcauuacgcuguc

SEQ ID NO: 2072070 - RNA, 17 nt, Staphylococcus aureus subsp. aureus Mu50
ugcauauuuaauacauu

SEQ ID NO: 2072071 - RNA, 23 nt, Staphylococcus aureus subsp. aureus Mu50
ugcauagguaaccuuaaauauag

SEQ ID NO: 2072072 - RNA, 16 nt, Staphylococcus aureus subsp. aureus Mu50
ugcauauauugaggau

SEQ ID NO: 2072073 - RNA, 17 nt, Staphylococcus aureus subsp. aureus Mu50
ugcaugcuucucaauuu

SEQ ID NO: 2072074 - RNA, 17 nt, Staphylococcus aureus subsp. aureus Mu50
ugcaugacgauaaugaa

SEQ ID NO: 2072075 - RNA, 15 nt, Staphylococcus aureus subsp. aureus Mu50
ugcaucccgaaaguu

SEQ ID NO: 2072076 - RNA, 14 nt, Staphylococcus aureus subsp. aureus Mu50
ugcagagaauauag

SEQ ID NO: 2072077 - RNA, 14 nt, Staphylococcus aureus subsp. aureus Mu50
ugcagauaauugaa

SEQ ID NO: 2072078 - RNA, 18 nt, Staphylococcus aureus subsp. aureus Mu50
ugcagauaauugaaaauc

SEQ ID NO: 2072079 - RNA, 19 nt, Staphylococcus aureus subsp. aureus Mu50
ugcaggauaacguucacuu

SEQ ID NO: 2072080 - RNA, 19 nt, Staphylococcus aureus subsp. aureus Mu50
ugcacuuuuuuuaaaucuu

SEQ ID NO: 2072081 - RNA, 17 nt, Staphylococcus aureus subsp. aureus Mu50
ugcacuuguaauauuau

SEQ ID NO: 2072082 - RNA, 22 nt, Staphylococcus aureus subsp. aureus Mu50
ugcacuuguaauauuauaacca

SEQ ID NO: 2072083 - RNA, 15 nt, Staphylococcus aureus subsp. aureus Mu50
ugcacuuuaacauaa

SEQ ID NO: 2072084 - RNA, 13 nt, Staphylococcus aureus subsp. aureus Mu50
ugcacuuuauuaa

SEQ ID NO: 2072085 - RNA, 20 nt, Staphylococcus aureus subsp. aureus Mu50
ugauuuggaaagaugggauu

SEQ ID NO: 2072086 - RNA, 23 nt, Staphylococcus aureus subsp. aureus Mu50
ugauuuguuacuucuaauaguaa

SEQ ID NO: 2072087 - RNA, 15 nt, Staphylococcus aureus subsp. aureus Mu50
ugauuuguuacuucu

SEQ ID NO: 2072088 - RNA, 16 nt, Staphylococcus aureus subsp. aureus Mu50
ugauuuguuacuucua

SEQ ID NO: 2072089 - RNA, 17 nt, Staphylococcus aureus subsp. aureus Mu50
uccagcgacauguccug

SEQ ID NO: 2072090 - RNA, 16 nt, Staphylococcus aureus subsp. aureus Mu50
uccauaaauaaaaugc

SEQ ID NO: 2072091 - RNA, 18 nt, Staphylococcus aureus subsp. aureus Mu50
uccauaacuguaguuucu

SEQ ID NO: 2072092 - RNA, 22 nt, Staphylococcus aureus subsp. aureus Mu50
uccauaacuguaguuucuuaau

SEQ ID NO: 2072093 - RNA, 18 nt, Staphylococcus aureus subsp. aureus Mu50
uccauaaucuuuauuaau

SEQ ID NO: 2072094 - RNA, 14 nt, Staphylococcus aureus subsp. aureus Mu50
uccaguuuucaauu

SEQ ID NO: 2072095 - RNA, 23 nt, Staphylococcus aureus subsp. aureus Mu50
uccaguuuucaauuuauuaacug

SEQ ID NO: 2072096 - RNA, 18 nt, Staphylococcus aureus subsp. aureus Mu50
uccaaaucgugauaucuu

SEQ ID NO: 2072097 - RNA, 18 nt, Staphylococcus aureus subsp. aureus Mu50
uccaaauucauuuguauu

SEQ ID NO: 2072098 - RNA, 16 nt, Staphylococcus aureus subsp. aureus Mu50
uccaaaauccugaaau

SEQ ID NO: 2072099 - RNA, 15 nt, Staphylococcus aureus subsp. aureus Mu50
uccaaaguaauauga

SEQ ID NO: 2072100 - RNA, 18 nt, Staphylococcus aureus subsp. aureus Mu50
ucaucuuuuugaaauuuc

SEQ ID NO: 2072101 - RNA, 13 nt, Staphylococcus aureus subsp. aureus Mu50
ucaucuuuaugca

SEQ ID NO: 2072102 - RNA, 20 nt, Staphylococcus aureus subsp. aureus Mu50
ucaucuugcgccuuguucaa

SEQ ID NO: 2072103 - RNA, 18 nt, Staphylococcus aureus subsp. aureus Mu50
ucaucuugagauuuucaa

SEQ ID NO: 2072104 - RNA, 22 nt, Staphylococcus aureus subsp. aureus Mu50
ucaucuugcaaguauuuucuua

SEQ ID NO: 2072105 - RNA, 18 nt, Staphylococcus aureus subsp. aureus Mu50
ucaucuuaucaagaauau

SEQ ID NO: 2072106 - RNA, 19 nt, Staphylococcus aureus subsp. aureus Mu50
ucaucuggugcaauauuau

SEQ ID NO: 2072107 - RNA, 16 nt, Staphylococcus aureus subsp. aureus Mu50
ucaucuguaucaauca

SEQ ID NO: 2072108 - RNA, 17 nt, Staphylococcus aureus subsp. aureus Mu50
ucaucguccacgaaucu

SEQ ID NO: 2072109 - RNA, 21 nt, Staphylococcus aureus subsp. aureus Mu50
ucaucguucauauauuuuguu

SEQ ID NO: 2072110 - RNA, 14 nt, Staphylococcus aureus subsp. aureus Mu50
ucaucuaaaaugag

SEQ ID NO: 2072111 - RNA, 17 nt, Staphylococcus aureus subsp. aureus Mu50
ucaucguucauauauuu

SEQ ID NO: 2072112 - RNA, 16 nt, Staphylococcus aureus subsp. aureus Mu50
ucaucuacuauuuaau

SEQ ID NO: 2072113 - RNA, 21 nt, Staphylococcus aureus subsp. aureus Mu50
ucaucuacuauuuaaucuuaa

SEQ ID NO: 2072114 - RNA, 23 nt, Staphylococcus aureus subsp. aureus Mu50
ucaucuauuauuauguuauaaau

SEQ ID NO: 2072115 - RNA, 17 nt, Staphylococcus aureus subsp. aureus Mu50
ucaucuauaauaccuaa

SEQ ID NO: 2072116 - RNA, 12 nt, Staphylococcus aureus subsp. aureus Mu50
ucaucuauuuaa

SEQ ID NO: 2072117 - RNA, 23 nt, Staphylococcus aureus subsp. aureus Mu50
ucaucuauuuaauaauguaucau

SEQ ID NO: 2072118 - RNA, 22 nt, Staphylococcus aureus subsp. aureus Mu50
ucaucuauuuuuaacuaauaga

SEQ ID NO: 2072119 - RNA, 16 nt, Staphylococcus aureus subsp. aureus Mu50
ucaugaauaaauacaa

SEQ ID NO: 2072120 - RNA, 20 nt, Staphylococcus aureus subsp. aureus Mu50
ucaugaauaaauacaauguu

SEQ ID NO: 2072121 - RNA, 15 nt, Staphylococcus aureus subsp. aureus Mu50
ucaugauuaauuaaa

SEQ ID NO: 2072122 - RNA, 16 nt, Staphylococcus aureus subsp. aureus Mu50
ucaugcauaagaaaua

SEQ ID NO: 2072123 - RNA, 16 nt, Staphylococcus aureus subsp. aureus Mu50
ucaugaugauaaauug

SEQ ID NO: 2072124 - RNA, 22 nt, Staphylococcus aureus subsp. aureus Mu50
ucaugcaaaacuaaucaaauua

SEQ ID NO: 2072125 - RNA, 19 nt, Staphylococcus aureus subsp. aureus Mu50
ucaugcauaaucaucauug

SEQ ID NO: 2072126 - RNA, 13 nt, Staphylococcus aureus subsp. aureus Mu50
ucaugccuucauu

SEQ ID NO: 2072127 - RNA, 18 nt, Staphylococcus aureus subsp. aureus Mu50
ucauucguacuuccaaua

SEQ ID NO: 2072128 - RNA, 13 nt, Staphylococcus aureus subsp. aureus Mu50
ucauuauuuaaau

SEQ ID NO: 2072129 - RNA, 20 nt, Staphylococcus aureus subsp. aureus Mu50
ucauuauuuagaauucuaaa

SEQ ID NO: 2072130 - RNA, 23 nt, Staphylococcus aureus subsp. aureus Mu50
ucauuauuuagaauucuaaaaga

SEQ ID NO: 2072131 - RNA, 18 nt, Staphylococcus aureus subsp. aureus Mu50
ucauucacaaugauugaa

SEQ ID NO: 2072132 - RNA, 17 nt, Staphylococcus aureus subsp. aureus Mu50
ucauguauauggcauca

SEQ ID NO: 2072133 - RNA, 20 nt, Staphylococcus aureus subsp. aureus Mu50
ucauguauauggcaucauca

SEQ ID NO: 2072134 - RNA, 18 nt, Staphylococcus aureus subsp. aureus Mu50
ucauguacaguuacuuuc

SEQ ID NO: 2072135 - RNA, 20 nt, Staphylococcus aureus subsp. aureus Mu50
ucauguaaugcuuaaaaaca

SEQ ID NO: 2072136 - RNA, 14 nt, Staphylococcus aureus subsp. aureus Mu50
ucauuaauaaauug

SEQ ID NO: 2072137 - RNA, 14 nt, Staphylococcus aureus subsp. aureus Mu50
ucauuaauaauuaa

SEQ ID NO: 2072138 - RNA, 12 nt, Staphylococcus aureus subsp. aureus Mu50
ucauuaauacaa

SEQ ID NO: 2072139 - RNA, 16 nt, Staphylococcus aureus subsp. aureus Mu50
ucauuaaccuuacaua

SEQ ID NO: 2072140 - RNA, 13 nt, Staphylococcus aureus subsp. aureus Mu50
ucauuaaaucuga

SEQ ID NO: 2072141 - RNA, 19 nt, Staphylococcus aureus subsp. aureus Mu50
ucauuaaaucugauucauu

SEQ ID NO: 2072142 - RNA, 22 nt, Staphylococcus aureus subsp. aureus Mu50
ucauuuuuucgagaugauauua

SEQ ID NO: 2072143 - RNA, 13 nt, Staphylococcus aureus subsp. aureus Mu50
uccaaaauccuga

SEQ ID NO: 2072144 - RNA, 19 nt, Staphylococcus aureus subsp. aureus Mu50
uccaaaaauuguaaaaccu

SEQ ID NO: 2072145 - RNA, 13 nt, Staphylococcus aureus subsp. aureus Mu50
uccaaaaauugua

SEQ ID NO: 2072146 - RNA, 14 nt, Staphylococcus aureus subsp. aureus Mu50
ucauuuucaaauaa

SEQ ID NO: 2072147 - RNA, 22 nt, Staphylococcus aureus subsp. aureus Mu50
ucauuuuauccaaaccaauuuu

SEQ ID NO: 2072148 - RNA, 20 nt, Staphylococcus aureus subsp. aureus Mu50
ucauuuucaacauaauauuu

SEQ ID NO: 2072149 - RNA, 16 nt, Staphylococcus aureus subsp. aureus Mu50
ucauuuuuauaaauuu

SEQ ID NO: 2072150 - RNA, 16 nt, Staphylococcus aureus subsp. aureus Mu50
ucauuuucaacauaau

SEQ ID NO: 2072151 - RNA, 18 nt, Staphylococcus aureus subsp. aureus Mu50
ucauuuucaaauaacuga

SEQ ID NO: 2072152 - RNA, 15 nt, Staphylococcus aureus subsp. aureus Mu50
ucauucuuuauagaa

SEQ ID NO: 2072153 - RNA, 16 nt, Staphylococcus aureus subsp. aureus Mu50
ucauucuuuaauauaa

SEQ ID NO: 2072154 - RNA, 23 nt, Staphylococcus aureus subsp. aureus Mu50
ucauucuguguaaauauaaauau

SEQ ID NO: 2072155 - RNA, 20 nt, Staphylococcus aureus subsp. aureus Mu50
ucauuggauagguaacuaaa

SEQ ID NO: 2072156 - RNA, 18 nt, Staphylococcus aureus subsp. aureus Mu50
ucauugcuugguuugauu

SEQ ID NO: 2072157 - RNA, 16 nt, Staphylococcus aureus subsp. aureus Mu50
ucauugguuucaucau

SEQ ID NO: 2072158 - RNA, 14 nt, Staphylococcus aureus subsp. aureus Mu50
ucauuguaacucaa

SEQ ID NO: 2072159 - RNA, 18 nt, Staphylococcus aureus subsp. aureus Mu50
ucauuuaguuaaauacaa

SEQ ID NO: 2072160 - RNA, 15 nt, Staphylococcus aureus subsp. aureus Mu50
ucauuuauaacauuu

SEQ ID NO: 2072161 - RNA, 14 nt, Staphylococcus aureus subsp. aureus Mu50
ucagccacugucau

SEQ ID NO: 2072162 - RNA, 11 nt, Staphylococcus aureus subsp. aureus Mu50
ucacuucaacg

SEQ ID NO: 2072163 - RNA, 16 nt, Staphylococcus aureus subsp. aureus Mu50
ucacuucaaacaaagg

SEQ ID NO: 2072164 - RNA, 17 nt, Staphylococcus aureus subsp. aureus Mu50
ucagccacugucaugug

SEQ ID NO: 2072165 - RNA, 16 nt, Staphylococcus aureus subsp. aureus Mu50
ucacuuauuauuuugu

SEQ ID NO: 2072166 - RNA, 19 nt, Staphylococcus aureus subsp. aureus Mu50
ucacuuaauaaauaauuuc

SEQ ID NO: 2072167 - RNA, 16 nt, Staphylococcus aureus subsp. aureus Mu50
ucacuguuuuauuaug

SEQ ID NO: 2072168 - RNA, 12 nt, Staphylococcus aureus subsp. aureus Mu50
ucacuuaauaaa

SEQ ID NO: 2072169 - RNA, 19 nt, Staphylococcus aureus subsp. aureus Mu50
ucacucuguaauaaagaau

SEQ ID NO: 2072170 - RNA, 23 nt, Staphylococcus aureus subsp. aureus Mu50
ucacugaaugcuaauacuaauca

SEQ ID NO: 2072171 - RNA, 20 nt, Staphylococcus aureus subsp. aureus Mu50
ucacugcaaacacaguacaa

SEQ ID NO: 2072172 - RNA, 22 nt, Staphylococcus aureus subsp. aureus Mu50
ucaggaucacguuuuucuuuaa

SEQ ID NO: 2072173 - RNA, 22 nt, Staphylococcus aureus subsp. aureus Mu50
ucagcuuuggcgacauaaauac

SEQ ID NO: 2072174 - RNA, 18 nt, Staphylococcus aureus subsp. aureus Mu50
ucagcuuuggcgacauaa

SEQ ID NO: 2072175 - RNA, 15 nt, Staphylococcus aureus subsp. aureus Mu50
ucagcuuuaauaaua

SEQ ID NO: 2072176 - RNA, 17 nt, Staphylococcus aureus subsp. aureus Mu50
ucagcuaaguuaaauau

SEQ ID NO: 2072177 - RNA, 15 nt, Staphylococcus aureus subsp. aureus Mu50
ucagcuaaguuaaau

SEQ ID NO: 2072178 - RNA, 16 nt, Staphylococcus aureus subsp. aureus Mu50
ucaggguuuaagauuu

SEQ ID NO: 2072179 - RNA, 16 nt, Staphylococcus aureus subsp. aureus Mu50
ucaguaccaaagaaau

SEQ ID NO: 2072180 - RNA, 14 nt, Staphylococcus aureus subsp. aureus Mu50
ucagggaaaucauc

SEQ ID NO: 2072181 - RNA, 16 nt, Staphylococcus aureus subsp. aureus Mu50
ucaguuuuuaaaucaa

SEQ ID NO: 2072182 - RNA, 20 nt, Staphylococcus aureus subsp. aureus Mu50
ucauaaaaaucauaaauaac

SEQ ID NO: 2072183 - RNA, 18 nt, Staphylococcus aureus subsp. aureus Mu50
ucaguuauaccauauuua

SEQ ID NO: 2072184 - RNA, 20 nt, Staphylococcus aureus subsp. aureus Mu50
ucaguccgcuuuuucauaga

SEQ ID NO: 2072185 - RNA, 18 nt, Staphylococcus aureus subsp. aureus Mu50
ucagucaauucaaacuga

SEQ ID NO: 2072186 - RNA, 15 nt, Staphylococcus aureus subsp. aureus Mu50
ucagucauucacaua

SEQ ID NO: 2072187 - RNA, 15 nt, Staphylococcus aureus subsp. aureus Mu50
ucagucaguaaaaau

SEQ ID NO: 2072188 - RNA, 16 nt, Staphylococcus aureus subsp. aureus Mu50
ucagucaguaaaaaua

SEQ ID NO: 2072189 - RNA, 13 nt, Staphylococcus aureus subsp. aureus Mu50
ucauaaaauuuaa

SEQ ID NO: 2072190 - RNA, 18 nt, Staphylococcus aureus subsp. aureus Mu50
ucauaaaguuuauuuaug

SEQ ID NO: 2072191 - RNA, 13 nt, Staphylococcus aureus subsp. aureus Mu50
ucauaaauauuuu

SEQ ID NO: 2072192 - RNA, 22 nt, Staphylococcus aureus subsp. aureus Mu50
ucauaaccgcuucuuuuaaguu

SEQ ID NO: 2072193 - RNA, 21 nt, Staphylococcus aureus subsp. aureus Mu50
ucauaaccgcuucuuuuaagu

SEQ ID NO: 2072194 - RNA, 15 nt, Staphylococcus aureus subsp. aureus Mu50
ucauaaguuaaaguu

SEQ ID NO: 2072195 - RNA, 22 nt, Staphylococcus aureus subsp. aureus Mu50
ucauaagucuuaacaaauuaaa

SEQ ID NO: 2072196 - RNA, 19 nt, Staphylococcus aureus subsp. aureus Mu50
ucaucaguaccaaagaaau

SEQ ID NO: 2072197 - RNA, 13 nt, Staphylococcus aureus subsp. aureus Mu50
ucaucauaaucug

SEQ ID NO: 2072198 - RNA, 19 nt, Staphylococcus aureus subsp. aureus Mu50
ucaucacgugauaaugacu

SEQ ID NO: 2072199 - RNA, 16 nt, Staphylococcus aureus subsp. aureus Mu50
ucaucauuaaaucuga

SEQ ID NO: 2072200 - RNA, 23 nt, Staphylococcus aureus subsp. aureus Mu50
ucaucaugugcuuuguuuaucaa

SEQ ID NO: 2072201 - RNA, 13 nt, Staphylococcus aureus subsp. aureus Mu50
ucaucauuacgaa

SEQ ID NO: 2072202 - RNA, 17 nt, Staphylococcus aureus subsp. aureus Mu50
ucaucauuaguuuuuaa

SEQ ID NO: 2072203 - RNA, 20 nt, Staphylococcus aureus subsp. aureus Mu50
ucaucauuaguuuuuaaaau

SEQ ID NO: 2072204 - RNA, 20 nt, Staphylococcus aureus subsp. aureus Mu50
ucaucaugacuauuuuccau

SEQ ID NO: 2072205 - RNA, 14 nt, Staphylococcus aureus subsp. aureus Mu50
ucaucaugcauaau

SEQ ID NO: 2072206 - RNA, 22 nt, Staphylococcus aureus subsp. aureus Mu50
ucaucaugcauaaucaucauug

SEQ ID NO: 2072207 - RNA, 15 nt, Staphylococcus aureus subsp. aureus Mu50
ucauccgccaauuaa

SEQ ID NO: 2072208 - RNA, 15 nt, Staphylococcus aureus subsp. aureus Mu50
ucauccauaaaaaua

SEQ ID NO: 2072209 - RNA, 14 nt, Staphylococcus aureus subsp. aureus Mu50
ucauauucaaaaua

SEQ ID NO: 2072210 - RNA, 19 nt, Staphylococcus aureus subsp. aureus Mu50
ucauauucaaaauaacuua

SEQ ID NO: 2072211 - RNA, 13 nt, Staphylococcus aureus subsp. aureus Mu50
ucauauucacauc

SEQ ID NO: 2072212 - RNA, 20 nt, Staphylococcus aureus subsp. aureus Mu50
ucauauuugaauacuuuauu

SEQ ID NO: 2072213 - RNA, 16 nt, Staphylococcus aureus subsp. aureus Mu50
ucauaucauaccaaaa

SEQ ID NO: 2072214 - RNA, 22 nt, Staphylococcus aureus subsp. aureus Mu50
ucauaucauaccaaaaaguauu

SEQ ID NO: 2072215 - RNA, 16 nt, Staphylococcus aureus subsp. aureus Mu50
ucauauaugucucucu

SEQ ID NO: 2072216 - RNA, 17 nt, Staphylococcus aureus subsp. aureus Mu50
ucauaugugccauaugu

SEQ ID NO: 2072217 - RNA, 11 nt, Staphylococcus aureus subsp. aureus Mu50
ucauaucuuua

SEQ ID NO: 2072218 - RNA, 20 nt, Staphylococcus aureus subsp. aureus Mu50
ucauaucuuucaauuaauuu

SEQ ID NO: 2072219 - RNA, 14 nt, Staphylococcus aureus subsp. aureus Mu50
ucaucaaacaacau

SEQ ID NO: 2072220 - RNA, 20 nt, Staphylococcus aureus subsp. aureus Mu50
ucaucaacaaucuuuuucau

SEQ ID NO: 2072221 - RNA, 23 nt, Staphylococcus aureus subsp. aureus Mu50
ucaucaacacacacaguuuauaa

SEQ ID NO: 2072222 - RNA, 14 nt, Staphylococcus aureus subsp. aureus Mu50
ucaucaaaaguuug

SEQ ID NO: 2072223 - RNA, 13 nt, Staphylococcus aureus subsp. aureus Mu50
ucaucaauuggca

SEQ ID NO: 2072224 - RNA, 20 nt, Staphylococcus aureus subsp. aureus Mu50
ucaucaccauacuaaaacau

SEQ ID NO: 2072225 - RNA, 20 nt, Staphylococcus aureus subsp. aureus Mu50
ucauauaaaacaaaaacggu

SEQ ID NO: 2072226 - RNA, 13 nt, Staphylococcus aureus subsp. aureus Mu50
ucauauaaaucaa

SEQ ID NO: 2072227 - RNA, 20 nt, Staphylococcus aureus subsp. aureus Mu50
ucauauaaaucaaauauacu

SEQ ID NO: 2072228 - RNA, 16 nt, Staphylococcus aureus subsp. aureus Mu50
ucauagugaaauucga

SEQ ID NO: 2072229 - RNA, 20 nt, Staphylococcus aureus subsp. aureus Mu50
ucauaguucaaauugaacuu

SEQ ID NO: 2072230 - RNA, 18 nt, Staphylococcus aureus subsp. aureus Mu50
ucauaguuauuaaaucuu

SEQ ID NO: 2072231 - RNA, 16 nt, Staphylococcus aureus subsp. aureus Mu50
ucauacuauaagcaau

SEQ ID NO: 2072232 - RNA, 20 nt, Staphylococcus aureus subsp. aureus Mu50
ucauacuaucuacaauaacc

SEQ ID NO: 2072233 - RNA, 14 nt, Staphylococcus aureus subsp. aureus Mu50
ucauacgagaaauu

SEQ ID NO: 2072234 - RNA, 18 nt, Staphylococcus aureus subsp. aureus Mu50
ucauacacugcacaucau

SEQ ID NO: 2072235 - RNA, 18 nt, Staphylococcus aureus subsp. aureus Mu50
ucauaccgaagaaacuaa

SEQ ID NO: 2072236 - RNA, 13 nt, Staphylococcus aureus subsp. aureus Mu50
ucauaccaaaaac

SEQ ID NO: 2072237 - RNA, 17 nt, Staphylococcus aureus subsp. aureus Mu50
ucauaccaaaaacauua

SEQ ID NO: 2072238 - RNA, 21 nt, Staphylococcus aureus subsp. aureus Mu50
ucauaaugaauaauuaaaaaa

SEQ ID NO: 2072239 - RNA, 20 nt, Staphylococcus aureus subsp. aureus Mu50
ucauaauuaacacauucaaa

SEQ ID NO: 2072240 - RNA, 11 nt, Staphylococcus aureus subsp. aureus Mu50
ucauaauuaau

SEQ ID NO: 2072241 - RNA, 15 nt, Staphylococcus aureus subsp. aureus Mu50
ucauaauuuuguuuu

SEQ ID NO: 2072242 - RNA, 16 nt, Staphylococcus aureus subsp. aureus Mu50
ucauaauuaauaacau

SEQ ID NO: 2072243 - RNA, 15 nt, Staphylococcus aureus subsp. aureus Mu50
ucauaauucaguguu

SEQ ID NO: 2072244 - RNA, 16 nt, Staphylococcus aureus subsp. aureus Mu50
ucauaaucaagucugc

SEQ ID NO: 2072245 - RNA, 15 nt, Staphylococcus aureus subsp. aureus Mu50
ucauaaucaagaaua

SEQ ID NO: 2072246 - RNA, 14 nt, Staphylococcus aureus subsp. aureus Mu50
ucauaauauaacau

SEQ ID NO: 2072247 - RNA, 17 nt, Staphylococcus aureus subsp. aureus Mu50
ucauaauauauuaacaa

SEQ ID NO: 2072248 - RNA, 18 nt, Staphylococcus aureus subsp. aureus Mu50
ucauaaucaagucugcau

SEQ ID NO: 2072249 - RNA, 17 nt, Staphylococcus aureus subsp. aureus Mu50
ucauaaugaucaaguag

SEQ ID NO: 2072250 - RNA, 17 nt, Staphylococcus aureus subsp. aureus Mu50
ucacuacaguguaugau

SEQ ID NO: 2072251 - RNA, 17 nt, Staphylococcus aureus subsp. aureus Mu50
ucacguaaugaaucaau

SEQ ID NO: 2072252 - RNA, 22 nt, Staphylococcus aureus subsp. aureus Mu50
ucacgguuuacccacuuauaaa

SEQ ID NO: 2072253 - RNA, 16 nt, Staphylococcus aureus subsp. aureus Mu50
ucacuaaaguaaauaa

SEQ ID NO: 2072254 - RNA, 20 nt, Staphylococcus aureus subsp. aureus Mu50
ucacuaaucucgguacauuu

SEQ ID NO: 2072255 - RNA, 14 nt, Staphylococcus aureus subsp. aureus Mu50
ucacgcugaaauuu

SEQ ID NO: 2072256 - RNA, 15 nt, Staphylococcus aureus subsp. aureus Mu50
ucacgauuuuuaaaa

SEQ ID NO: 2072257 - RNA, 14 nt, Staphylococcus aureus subsp. aureus Mu50
ucaccuucccaguc

SEQ ID NO: 2072258 - RNA, 20 nt, Staphylococcus aureus subsp. aureus Mu50
ucaccuaaaugauuaauaac

SEQ ID NO: 2072259 - RNA, 14 nt, Staphylococcus aureus subsp. aureus Mu50
ucaccuuuuuuaac

SEQ ID NO: 2072260 - RNA, 16 nt, Staphylococcus aureus subsp. aureus Mu50
ucaccuuuuuuaacuu

SEQ ID NO: 2072261 - RNA, 21 nt, Staphylococcus aureus subsp. aureus Mu50
ucaccuuuaggcaaauaaccu

SEQ ID NO: 2072262 - RNA, 13 nt, Staphylococcus aureus subsp. aureus Mu50
ucacgaucuuuaa

SEQ ID NO: 2072263 - RNA, 17 nt, Staphylococcus aureus subsp. aureus Mu50
ucacgauuaauaaaauu

SEQ ID NO: 2072264 - RNA, 20 nt, Staphylococcus aureus subsp. aureus Mu50
ucacgauuaauaaaauucua

SEQ ID NO: 2072265 - RNA, 21 nt, Staphylococcus aureus subsp. aureus Mu50
ucacgauuacgcucauauguc

SEQ ID NO: 2072266 - RNA, 19 nt, Staphylococcus aureus subsp. aureus Mu50
ucacgacuugauagcauuu

SEQ ID NO: 2072267 - RNA, 15 nt, Staphylococcus aureus subsp. aureus Mu50
ucacgauaauguaua

SEQ ID NO: 2072268 - RNA, 20 nt, Staphylococcus aureus subsp. aureus Mu50
ucaccguaaucuuuuaacuu

SEQ ID NO: 2072269 - RNA, 14 nt, Staphylococcus aureus subsp. aureus Mu50
ucaccguaaucuuu

SEQ ID NO: 2072270 - RNA, 19 nt, Staphylococcus aureus subsp. aureus Mu50
ucaccguaaucuuuuaacu

SEQ ID NO: 2072271 - RNA, 16 nt, Staphylococcus aureus subsp. aureus Mu50
ucaccauuuacuucau

SEQ ID NO: 2072272 - RNA, 18 nt, Staphylococcus aureus subsp. aureus Mu50
ucacauuaaguuaaacgu

SEQ ID NO: 2072273 - RNA, 19 nt, Staphylococcus aureus subsp. aureus Mu50
ucacauucuugaauaaauu

SEQ ID NO: 2072274 - RNA, 18 nt, Staphylococcus aureus subsp. aureus Mu50
ucaccaauccgauucacu

SEQ ID NO: 2072275 - RNA, 17 nt, Staphylococcus aureus subsp. aureus Mu50
ucaccaacuuuuuuaac

SEQ ID NO: 2072276 - RNA, 20 nt, Staphylococcus aureus subsp. aureus Mu50
ucaccaacaacuuuguuuuc

SEQ ID NO: 2072277 - RNA, 13 nt, Staphylococcus aureus subsp. aureus Mu50
ucacauuuauaac

SEQ ID NO: 2072278 - RNA, 13 nt, Staphylococcus aureus subsp. aureus Mu50
ucacaaugaccau

SEQ ID NO: 2072279 - RNA, 21 nt, Staphylococcus aureus subsp. aureus Mu50
ucacaaugaccauugucaugc

SEQ ID NO: 2072280 - RNA, 16 nt, Staphylococcus aureus subsp. aureus Mu50
ucacaaucauagauau

SEQ ID NO: 2072281 - RNA, 14 nt, Staphylococcus aureus subsp. aureus Mu50
ucacaauauaacau

SEQ ID NO: 2072282 - RNA, 22 nt, Staphylococcus aureus subsp. aureus Mu50
ucacaauacgaaaucaaaaaua

SEQ ID NO: 2072283 - RNA, 21 nt, Staphylococcus aureus subsp. aureus Mu50
ucacaauacgaaaucaaaaau

SEQ ID NO: 2072284 - RNA, 15 nt, Staphylococcus aureus subsp. aureus Mu50
ucacaacacauaaau

SEQ ID NO: 2072285 - RNA, 16 nt, Staphylococcus aureus subsp. aureus Mu50
ucaauuuuuacuaaau

SEQ ID NO: 2072286 - RNA, 19 nt, Staphylococcus aureus subsp. aureus Mu50
ucaauuaaacuuaagaaua

SEQ ID NO: 2072287 - RNA, 15 nt, Staphylococcus aureus subsp. aureus Mu50
ucaauguuauuaaac

SEQ ID NO: 2072288 - RNA, 20 nt, Staphylococcus aureus subsp. aureus Mu50
ucaauguuuaauuuucuaaa

SEQ ID NO: 2072289 - RNA, 20 nt, Staphylococcus aureus subsp. aureus Mu50
ucaauuaaucggaucauuau

SEQ ID NO: 2072290 - RNA, 22 nt, Staphylococcus aureus subsp. aureus Mu50
ucaauuacucuuuuucuuucau

SEQ ID NO: 2072291 - RNA, 19 nt, Staphylococcus aureus subsp. aureus Mu50
ucaauuaauuuaaaugcuu

SEQ ID NO: 2072292 - RNA, 16 nt, Staphylococcus aureus subsp. aureus Mu50
ucaauuucauuugaaa

SEQ ID NO: 2072293 - RNA, 15 nt, Staphylococcus aureus subsp. aureus Mu50
ucaauuagaaaauuu

SEQ ID NO: 2072294 - RNA, 13 nt, Staphylococcus aureus subsp. aureus Mu50
ucaauuaguucug

SEQ ID NO: 2072295 - RNA, 14 nt, Staphylococcus aureus subsp. aureus Mu50
ucaauuucuauuuc

SEQ ID NO: 2072296 - RNA, 15 nt, Staphylococcus aureus subsp. aureus Mu50
ucaaucguuaauuuc

SEQ ID NO: 2072297 - RNA, 19 nt, Staphylococcus aureus subsp. aureus Mu50
ucaaugcauuuaauuuaau

SEQ ID NO: 2072298 - RNA, 14 nt, Staphylococcus aureus subsp. aureus Mu50
ucaauguuauuaaa

SEQ ID NO: 2072299 - RNA, 20 nt, Staphylococcus aureus subsp. aureus Mu50
ucaaguuggugugcaauuaa

SEQ ID NO: 2072300 - RNA, 12 nt, Staphylococcus aureus subsp. aureus Mu50
ucaauauuaaaa

SEQ ID NO: 2072301 - RNA, 19 nt, Staphylococcus aureus subsp. aureus Mu50
ucaaguucaccguaaucuu

SEQ ID NO: 2072302 - RNA, 21 nt, Staphylococcus aureus subsp. aureus Mu50
ucaauauuaaucauaaugaau

SEQ ID NO: 2072303 - RNA, 19 nt, Staphylococcus aureus subsp. aureus Mu50
ucaauauucuuaucauuca

SEQ ID NO: 2072304 - RNA, 14 nt, Staphylococcus aureus subsp. aureus Mu50
ucaaguauaucuuc

SEQ ID NO: 2072305 - RNA, 18 nt, Staphylococcus aureus subsp. aureus Mu50
ucaagucugcauuaauuu

SEQ ID NO: 2072306 - RNA, 20 nt, Staphylococcus aureus subsp. aureus Mu50
ucaagugccauuuuuaaauu

SEQ ID NO: 2072307 - RNA, 22 nt, Staphylococcus aureus subsp. aureus Mu50
ucaauccaauuaaauauuuaac

SEQ ID NO: 2072308 - RNA, 22 nt, Staphylococcus aureus subsp. aureus Mu50
ucaaucccuuuuagcauaauua

SEQ ID NO: 2072309 - RNA, 22 nt, Staphylococcus aureus subsp. aureus Mu50
ucaauccaucaauaccauaauu

SEQ ID NO: 2072310 - RNA, 21 nt, Staphylococcus aureus subsp. aureus Mu50
ucaauccuaaauuauaaauag

SEQ ID NO: 2072311 - RNA, 17 nt, Staphylococcus aureus subsp. aureus Mu50
ucaagguauacacaaau

SEQ ID NO: 2072312 - RNA, 19 nt, Staphylococcus aureus subsp. aureus Mu50
ucaagcugagcuuuaauuu

SEQ ID NO: 2072313 - RNA, 14 nt, Staphylococcus aureus subsp. aureus Mu50
ucaagcuuaauaag

SEQ ID NO: 2072314 - RNA, 18 nt, Staphylococcus aureus subsp. aureus Mu50
ucaagcaucauuuuucgu

SEQ ID NO: 2072315 - RNA, 23 nt, Staphylococcus aureus subsp. aureus Mu50
ucaagcgcaugcuugaacuuuua

SEQ ID NO: 2072316 - RNA, 21 nt, Staphylococcus aureus subsp. aureus Mu50
ucaaaugacauuuuaaaucua

SEQ ID NO: 2072317 - RNA, 16 nt, Staphylococcus aureus subsp. aureus Mu50
ucaacgggaacaucau

SEQ ID NO: 2072318 - RNA, 22 nt, Staphylococcus aureus subsp. aureus Mu50
ucaaaugacauuuuaaaucuaa

SEQ ID NO: 2072319 - RNA, 19 nt, Staphylococcus aureus subsp. aureus Mu50
ucaacguauauaaguuaaa

SEQ ID NO: 2072320 - RNA, 16 nt, Staphylococcus aureus subsp. aureus Mu50
ucaacgucaucugcuu

SEQ ID NO: 2072321 - RNA, 18 nt, Staphylococcus aureus subsp. aureus Mu50
ucaacugcugcuaaaaua

SEQ ID NO: 2072322 - RNA, 17 nt, Staphylococcus aureus subsp. aureus Mu50
ucaacugcuucacgauu

SEQ ID NO: 2072323 - RNA, 15 nt, Staphylococcus aureus subsp. aureus Mu50
ucaagaaauguuaaa

SEQ ID NO: 2072324 - RNA, 15 nt, Staphylococcus aureus subsp. aureus Mu50
ucaagaaaaaguuuu

SEQ ID NO: 2072325 - RNA, 14 nt, Staphylococcus aureus subsp. aureus Mu50
ucaacuuaaauauc

SEQ ID NO: 2072326 - RNA, 17 nt, Staphylococcus aureus subsp. aureus Mu50
ucaacuuagaauuuaca

SEQ ID NO: 2072327 - RNA, 10 nt, Staphylococcus aureus subsp. aureus Mu50
ucaagaacaa

SEQ ID NO: 2072328 - RNA, 19 nt, Staphylococcus aureus subsp. aureus Mu50
ucaagaaauucgcaagccu

SEQ ID NO: 2072329 - RNA, 18 nt, Staphylococcus aureus subsp. aureus Mu50
ucaagaacuuuaaaaauu

SEQ ID NO: 2072330 - RNA, 14 nt, Staphylococcus aureus subsp. aureus Mu50
ucaagaacuuuaaa

SEQ ID NO: 2072331 - RNA, 19 nt, Staphylococcus aureus subsp. aureus Mu50
ucaagaccaaauauuuuau

SEQ ID NO: 2072332 - RNA, 19 nt, Staphylococcus aureus subsp. aureus Mu50
ucaagaaugugaacaucua

SEQ ID NO: 2072333 - RNA, 19 nt, Staphylococcus aureus subsp. aureus Mu50
uauucaaugauuaguaaug

SEQ ID NO: 2072334 - RNA, 10 nt, Staphylococcus aureus subsp. aureus Mu50
uauucaauug

SEQ ID NO: 2072335 - RNA, 19 nt, Staphylococcus aureus subsp. aureus Mu50
uauucacuuuuuuuaauuu

SEQ ID NO: 2072336 - RNA, 23 nt, Staphylococcus aureus subsp. aureus Mu50
uauucauagaccuaugaauuuag

SEQ ID NO: 2072337 - RNA, 14 nt, Staphylococcus aureus subsp. aureus Mu50
uauucgauaauaua

SEQ ID NO: 2072338 - RNA, 13 nt, Staphylococcus aureus subsp. aureus Mu50
uauucauuuuaaa

SEQ ID NO: 2072339 - RNA, 20 nt, Staphylococcus aureus subsp. aureus Mu50
uauucgauacauaaaacauc

SEQ ID NO: 2072340 - RNA, 12 nt, Staphylococcus aureus subsp. aureus Mu50
uauucggcaaaa

SEQ ID NO: 2072341 - RNA, 21 nt, Staphylococcus aureus subsp. aureus Mu50
uauucuauuuuucaauucgcu

SEQ ID NO: 2072342 - RNA, 18 nt, Staphylococcus aureus subsp. aureus Mu50
uauucugagauugagaau

SEQ ID NO: 2072343 - RNA, 21 nt, Staphylococcus aureus subsp. aureus Mu50
uauucugagauugagaauuca

SEQ ID NO: 2072344 - RNA, 14 nt, Staphylococcus aureus subsp. aureus Mu50
uauuauuaauuccu

SEQ ID NO: 2072345 - RNA, 17 nt, Staphylococcus aureus subsp. aureus Mu50
uauuauauugaauugaa

SEQ ID NO: 2072346 - RNA, 19 nt, Staphylococcus aureus subsp. aureus Mu50
uauuaucaaagaaauguau

SEQ ID NO: 2072347 - RNA, 14 nt, Staphylococcus aureus subsp. aureus Mu50
uauuauuauaauuu

SEQ ID NO: 2072348 - RNA, 14 nt, Staphylococcus aureus subsp. aureus Mu50
uauuauuaugugua

SEQ ID NO: 2072349 - RNA, 12 nt, Staphylococcus aureus subsp. aureus Mu50
uauuauugaaau

SEQ ID NO: 2072350 - RNA, 13 nt, Staphylococcus aureus subsp. aureus Mu50
uauuauucucuca

SEQ ID NO: 2072351 - RNA, 18 nt, Staphylococcus aureus subsp. aureus Mu50
uauuagccaauaaaaugu

SEQ ID NO: 2072352 - RNA, 19 nt, Staphylococcus aureus subsp. aureus Mu50
uauuagccaauaaaauguc

SEQ ID NO: 2072353 - RNA, 14 nt, Staphylococcus aureus subsp. aureus Mu50
uauuagauauauuu

SEQ ID NO: 2072354 - RNA, 17 nt, Staphylococcus aureus subsp. aureus Mu50
uauuauauaauaagaga

SEQ ID NO: 2072355 - RNA, 22 nt, Staphylococcus aureus subsp. aureus Mu50
uauuauacugcucuuuauauau

SEQ ID NO: 2072356 - RNA, 21 nt, Staphylococcus aureus subsp. aureus Mu50
uauuaggcuuaaauauaauga

SEQ ID NO: 2072357 - RNA, 14 nt, Staphylococcus aureus subsp. aureus Mu50
uauuauaauuuugu

SEQ ID NO: 2072358 - RNA, 20 nt, Staphylococcus aureus subsp. aureus Mu50
uauccauucaauguuuaauu

SEQ ID NO: 2072359 - RNA, 21 nt, Staphylococcus aureus subsp. aureus Mu50
uauccgaaaauugcuaaaaaa

SEQ ID NO: 2072360 - RNA, 23 nt, Staphylococcus aureus subsp. aureus Mu50
uauccgaaaauugcuaaaaaaau

SEQ ID NO: 2072361 - RNA, 14 nt, Staphylococcus aureus subsp. aureus Mu50
uauccauuaugaug

SEQ ID NO: 2072362 - RNA, 24 nt, Staphylococcus aureus subsp. aureus Mu50
uauccgcaucuuuugguuuaucug

SEQ ID NO: 2072363 - RNA, 15 nt, Staphylococcus aureus subsp. aureus Mu50
uauuacuauaaaaaa

SEQ ID NO: 2072364 - RNA, 22 nt, Staphylococcus aureus subsp. aureus Mu50
uauuacuacauaauuuaucaau

SEQ ID NO: 2072365 - RNA, 16 nt, Staphylococcus aureus subsp. aureus Mu50
uauuacuuauuucuuu

SEQ ID NO: 2072366 - RNA, 14 nt, Staphylococcus aureus subsp. aureus Mu50
uauuacuugaaaau

SEQ ID NO: 2072367 - RNA, 14 nt, Staphylococcus aureus subsp. aureus Mu50
uauuacuuuaauuu

SEQ ID NO: 2072368 - RNA, 17 nt, Staphylococcus aureus subsp. aureus Mu50
uauucuguaacguuacu

SEQ ID NO: 2072369 - RNA, 14 nt, Staphylococcus aureus subsp. aureus Mu50
aaaucgaacaaaug

SEQ ID NO: 2072370 - RNA, 14 nt, Staphylococcus aureus subsp. aureus Mu50
uauugaauugaaaa

SEQ ID NO: 2072371 - RNA, 22 nt, Staphylococcus aureus subsp. aureus Mu50
uauugaauggaguauaucagcu

SEQ ID NO: 2072372 - RNA, 13 nt, Staphylococcus aureus subsp. aureus Mu50
uauugaauaauca

SEQ ID NO: 2072373 - RNA, 18 nt, Staphylococcus aureus subsp. aureus Mu50
uauugaccaccuguaucu

SEQ ID NO: 2072374 - RNA, 15 nt, Staphylococcus aureus subsp. aureus Mu50
uauugagaauauuaa

SEQ ID NO: 2072375 - RNA, 14 nt, Staphylococcus aureus subsp. aureus Mu50
uauugauauucuaa

SEQ ID NO: 2072376 - RNA, 21 nt, Staphylococcus aureus subsp. aureus Mu50
uauugaugaauaaauagauaa

SEQ ID NO: 2072377 - RNA, 13 nt, Staphylococcus aureus subsp. aureus Mu50
uauugauuauucu

SEQ ID NO: 2072378 - RNA, 23 nt, Staphylococcus aureus subsp. aureus Mu50
uauugccgguuaaauuauuuaau

SEQ ID NO: 2072379 - RNA, 14 nt, Staphylococcus aureus subsp. aureus Mu50
uauugagaauauuu

SEQ ID NO: 2072380 - RNA, 13 nt, Staphylococcus aureus subsp. aureus Mu50
uauugauauucua

SEQ ID NO: 2072381 - RNA, 16 nt, Staphylococcus aureus subsp. aureus Mu50
uauuuaaacuaguaau

SEQ ID NO: 2072382 - RNA, 19 nt, Staphylococcus aureus subsp. aureus Mu50
uauuuaaacucucuaaaaa

SEQ ID NO: 2072383 - RNA, 21 nt, Staphylococcus aureus subsp. aureus Mu50
uauuuaaacuaguaauagaau

SEQ ID NO: 2072384 - RNA, 17 nt, Staphylococcus aureus subsp. aureus Mu50
uauugguugaaauuaau

SEQ ID NO: 2072385 - RNA, 16 nt, Staphylococcus aureus subsp. aureus Mu50
uauuuaccuucuucua

SEQ ID NO: 2072386 - RNA, 19 nt, Staphylococcus aureus subsp. aureus Mu50
uauuuacuaagucguucaa

SEQ ID NO: 2072387 - RNA, 16 nt, Staphylococcus aureus subsp. aureus Mu50
uauuuagaauauuaac

SEQ ID NO: 2072388 - RNA, 16 nt, Staphylococcus aureus subsp. aureus Mu50
uauuuagaauucuaaa

SEQ ID NO: 2072389 - RNA, 17 nt, Staphylococcus aureus subsp. aureus Mu50
uauuuauauuaaauacu

SEQ ID NO: 2072390 - RNA, 19 nt, Staphylococcus aureus subsp. aureus Mu50
uauuuauacuauaaauaca

SEQ ID NO: 2072391 - RNA, 16 nt, Staphylococcus aureus subsp. aureus Mu50
uauuuauacuaaauug

SEQ ID NO: 2072392 - RNA, 18 nt, Staphylococcus aureus subsp. aureus Mu50
uauuuauaacuuuaaaaa

SEQ ID NO: 2072393 - RNA, 16 nt, Staphylococcus aureus subsp. aureus Mu50
uauuuagauuuauaac

SEQ ID NO: 2072394 - RNA, 15 nt, Staphylococcus aureus subsp. aureus Mu50
uauuuagauugguca

SEQ ID NO: 2072395 - RNA, 21 nt, Staphylococcus aureus subsp. aureus Mu50
uauuuagcaucuuuaccauau

SEQ ID NO: 2072396 - RNA, 14 nt, Staphylococcus aureus subsp. aureus Mu50
uauuucagcuuauu

SEQ ID NO: 2072397 - RNA, 16 nt, Staphylococcus aureus subsp. aureus Mu50
uauuucagcuuauuaa

SEQ ID NO: 2072398 - RNA, 15 nt, Staphylococcus aureus subsp. aureus Mu50
uauuucaacaaacau

SEQ ID NO: 2072399 - RNA, 16 nt, Staphylococcus aureus subsp. aureus Mu50
uauuucaacaaacaua

SEQ ID NO: 2072400 - RNA, 17 nt, Staphylococcus aureus subsp. aureus Mu50
uauuucaacaaacauaa

SEQ ID NO: 2072401 - RNA, 16 nt, Staphylococcus aureus subsp. aureus Mu50
uauuuaucaauaaauc

SEQ ID NO: 2072402 - RNA, 15 nt, Staphylococcus aureus subsp. aureus Mu50
uauuuaucauacuuc

SEQ ID NO: 2072403 - RNA, 18 nt, Staphylococcus aureus subsp. aureus Mu50
uauuuaucucuuucuuca

SEQ ID NO: 2072404 - RNA, 12 nt, Staphylococcus aureus subsp. aureus Mu50
uauuuaucuuua

SEQ ID NO: 2072405 - RNA, 17 nt, Staphylococcus aureus subsp. aureus Mu50
uauuuauuuuauaauaa

SEQ ID NO: 2072406 - RNA, 15 nt, Staphylococcus aureus subsp. aureus Mu50
uauuuauuuguacau

SEQ ID NO: 2072407 - RNA, 13 nt, Staphylococcus aureus subsp. aureus Mu50
uauuuauuuuaau

SEQ ID NO: 2072408 - RNA, 18 nt, Staphylococcus aureus subsp. aureus Mu50
uauuuauuuuaauagugu

SEQ ID NO: 2072409 - RNA, 15 nt, Staphylococcus aureus subsp. aureus Mu50
uauuuauuuuauaau

SEQ ID NO: 2072410 - RNA, 18 nt, Staphylococcus aureus subsp. aureus Mu50
uauuuauugagauagaaa

SEQ ID NO: 2072411 - RNA, 19 nt, Staphylococcus aureus subsp. aureus Mu50
uauuuauugagauagaaau

SEQ ID NO: 2072412 - RNA, 18 nt, Staphylococcus aureus subsp. aureus Mu50
ucaaaaccgcuauaaaau

SEQ ID NO: 2072413 - RNA, 21 nt, Staphylococcus aureus subsp. aureus Mu50
ucaaaacaauuuaaaaagcag

SEQ ID NO: 2072414 - RNA, 18 nt, Staphylococcus aureus subsp. aureus Mu50
ucaaaaaugcuuauauaa

SEQ ID NO: 2072415 - RNA, 13 nt, Staphylococcus aureus subsp. aureus Mu50
ucaaaaaauaaua

SEQ ID NO: 2072416 - RNA, 14 nt, Staphylococcus aureus subsp. aureus Mu50
ucaaaaaauuaauc

SEQ ID NO: 2072417 - RNA, 16 nt, Staphylococcus aureus subsp. aureus Mu50
ucaaaaacaguuacaa

SEQ ID NO: 2072418 - RNA, 21 nt, Staphylococcus aureus subsp. aureus Mu50
uauuuuuuggagcguaaaguu

SEQ ID NO: 2072419 - RNA, 13 nt, Staphylococcus aureus subsp. aureus Mu50
uauuuuuuuaaau

SEQ ID NO: 2072420 - RNA, 23 nt, Staphylococcus aureus subsp. aureus Mu50
uauuuuuuauguuuuaauuucuu

SEQ ID NO: 2072421 - RNA, 21 nt, Staphylococcus aureus subsp. aureus Mu50
uauuuuuugagcacuuaauaa

SEQ ID NO: 2072422 - RNA, 14 nt, Staphylococcus aureus subsp. aureus Mu50
uauuuuuuuacuuu

SEQ ID NO: 2072423 - RNA, 14 nt, Staphylococcus aureus subsp. aureus Mu50
uauuuuuuuaugcu

SEQ ID NO: 2072424 - RNA, 22 nt, Staphylococcus aureus subsp. aureus Mu50
uauuuuuuuguccaauaaauug

SEQ ID NO: 2072425 - RNA, 13 nt, Staphylococcus aureus subsp. aureus Mu50
uauuuuucaucau

SEQ ID NO: 2072426 - RNA, 23 nt, Staphylococcus aureus subsp. aureus Mu50
uauuuuugauagugguagccaau

SEQ ID NO: 2072427 - RNA, 13 nt, Staphylococcus aureus subsp. aureus Mu50
uauuuuuuaauaa

SEQ ID NO: 2072428 - RNA, 15 nt, Staphylococcus aureus subsp. aureus Mu50
uauuuuuuaaaauga

SEQ ID NO: 2072429 - RNA, 21 nt, Staphylococcus aureus subsp. aureus Mu50
uauuuuuuaaaaugauagcua

SEQ ID NO: 2072430 - RNA, 16 nt, Staphylococcus aureus subsp. aureus Mu50
ucaaauccaaaaucuu

SEQ ID NO: 2072431 - RNA, 14 nt, Staphylococcus aureus subsp. aureus Mu50
ucaaauaauauaaa

SEQ ID NO: 2072432 - RNA, 16 nt, Staphylococcus aureus subsp. aureus Mu50
ucaaauaauauaaaac

SEQ ID NO: 2072433 - RNA, 14 nt, Staphylococcus aureus subsp. aureus Mu50
ucaaauaaugaaua

SEQ ID NO: 2072434 - RNA, 21 nt, Staphylococcus aureus subsp. aureus Mu50
ucaaauaaugugaaaaaucuu

SEQ ID NO: 2072435 - RNA, 17 nt, Staphylococcus aureus subsp. aureus Mu50
ucaaauaaccuauuaau

SEQ ID NO: 2072436 - RNA, 22 nt, Staphylococcus aureus subsp. aureus Mu50
ucaaaguuuaauugcuguaaau

SEQ ID NO: 2072437 - RNA, 21 nt, Staphylococcus aureus subsp. aureus Mu50
ucaaaguuuucaggaauuguu

SEQ ID NO: 2072438 - RNA, 19 nt, Staphylococcus aureus subsp. aureus Mu50
ucaaaguuuucauuuaaca

SEQ ID NO: 2072439 - RNA, 21 nt, Staphylococcus aureus subsp. aureus Mu50
ucaaaguuuucauuuaacaug

SEQ ID NO: 2072440 - RNA, 17 nt, Staphylococcus aureus subsp. aureus Mu50
ucaaagaggcuuuaaaa

SEQ ID NO: 2072441 - RNA, 14 nt, Staphylococcus aureus subsp. aureus Mu50
ucaaaguagacauu

SEQ ID NO: 2072442 - RNA, 23 nt, Staphylococcus aureus subsp. aureus Mu50
ucaaaguagauauugaauggagu

SEQ ID NO: 2072443 - RNA, 22 nt, Staphylococcus aureus subsp. aureus Mu50
ucaaagguuuacuauuaaagga

SEQ ID NO: 2072444 - RNA, 13 nt, Staphylococcus aureus subsp. aureus Mu50
ucaaaauauaaaa

SEQ ID NO: 2072445 - RNA, 13 nt, Staphylococcus aureus subsp. aureus Mu50
ucaaaauaguaaa

SEQ ID NO: 2072446 - RNA, 12 nt, Staphylococcus aureus subsp. aureus Mu50
ucaaagaaaaag

SEQ ID NO: 2072447 - RNA, 13 nt, Staphylococcus aureus subsp. aureus Mu50
uauuuucuuuuuc

SEQ ID NO: 2072448 - RNA, 20 nt, Staphylococcus aureus subsp. aureus Mu50
uauuuucuucucaacaaauc

SEQ ID NO: 2072449 - RNA, 14 nt, Staphylococcus aureus subsp. aureus Mu50
uauuuucauuuuag

SEQ ID NO: 2072450 - RNA, 16 nt, Staphylococcus aureus subsp. aureus Mu50
uauuuuuaagcugcuc

SEQ ID NO: 2072451 - RNA, 14 nt, Staphylococcus aureus subsp. aureus Mu50
uauuuuuacauauu

SEQ ID NO: 2072452 - RNA, 19 nt, Staphylococcus aureus subsp. aureus Mu50
uauuuuguuuuaaaaaaca

SEQ ID NO: 2072453 - RNA, 16 nt, Staphylococcus aureus subsp. aureus Mu50
uauuuuguuuuaaaaa

SEQ ID NO: 2072454 - RNA, 15 nt, Staphylococcus aureus subsp. aureus Mu50
uauuuuguuaauaag

SEQ ID NO: 2072455 - RNA, 21 nt, Staphylococcus aureus subsp. aureus Mu50
uauuuucuuguguauuuuuau

SEQ ID NO: 2072456 - RNA, 13 nt, Staphylococcus aureus subsp. aureus Mu50
uauuuugcaauaa

SEQ ID NO: 2072457 - RNA, 22 nt, Staphylococcus aureus subsp. aureus Mu50
uauuuuggacugguacuacuau

SEQ ID NO: 2072458 - RNA, 24 nt, Staphylococcus aureus subsp. aureus Mu50
uauuuguuaugguauuuauagauu

SEQ ID NO: 2072459 - RNA, 12 nt, Staphylococcus aureus subsp. aureus Mu50
uauuuuaaaaau

SEQ ID NO: 2072460 - RNA, 15 nt, Staphylococcus aureus subsp. aureus Mu50
uauuuuaauagcauu

SEQ ID NO: 2072461 - RNA, 22 nt, Staphylococcus aureus subsp. aureus Mu50
uauuuuaaugggcgauaaaagu

SEQ ID NO: 2072462 - RNA, 13 nt, Staphylococcus aureus subsp. aureus Mu50
uauuuuaaacaug

SEQ ID NO: 2072463 - RNA, 14 nt, Staphylococcus aureus subsp. aureus Mu50
uauuuuauaagaau

SEQ ID NO: 2072464 - RNA, 19 nt, Staphylococcus aureus subsp. aureus Mu50
uauuuuauaagaauuuaaa

SEQ ID NO: 2072465 - RNA, 17 nt, Staphylococcus aureus subsp. aureus Mu50
uauuuuauaauaaauuu

SEQ ID NO: 2072466 - RNA, 20 nt, Staphylococcus aureus subsp. aureus Mu50
uauuuuauaagaauuuaaaa

SEQ ID NO: 2072467 - RNA, 19 nt, Staphylococcus aureus subsp. aureus Mu50
uauuuuaucaucuauucaa

SEQ ID NO: 2072468 - RNA, 20 nt, Staphylococcus aureus subsp. aureus Mu50
uauuuuaugacguaauuaau

SEQ ID NO: 2072469 - RNA, 18 nt, Staphylococcus aureus subsp. aureus Mu50
uauuuucaauauuugaua

SEQ ID NO: 2072470 - RNA, 16 nt, Staphylococcus aureus subsp. aureus Mu50
uauuuucaauuagaaa

SEQ ID NO: 2072471 - RNA, 20 nt, Staphylococcus aureus subsp. aureus Mu50
uauuucgguauuuuaaauuu

SEQ ID NO: 2072472 - RNA, 20 nt, Staphylococcus aureus subsp. aureus Mu50
uauuucgguuagucuuaauc

SEQ ID NO: 2072473 - RNA, 21 nt, Staphylococcus aureus subsp. aureus Mu50
uauuucuaaauuauuuauuca

SEQ ID NO: 2072474 - RNA, 19 nt, Staphylococcus aureus subsp. aureus Mu50
uauuucuauaucuauuuau

SEQ ID NO: 2072475 - RNA, 16 nt, Staphylococcus aureus subsp. aureus Mu50
uauuucuuaccauuua

SEQ ID NO: 2072476 - RNA, 22 nt, Staphylococcus aureus subsp. aureus Mu50
uauuucugacaacuuaauagaa

SEQ ID NO: 2072477 - RNA, 18 nt, Staphylococcus aureus subsp. aureus Mu50
uauuugccuuuugaauaa

SEQ ID NO: 2072478 - RNA, 17 nt, Staphylococcus aureus subsp. aureus Mu50
uauuugauuauucuuca

SEQ ID NO: 2072479 - RNA, 22 nt, Staphylococcus aureus subsp. aureus Mu50
uauuugcuagucauaauuuaaa

SEQ ID NO: 2072480 - RNA, 19 nt, Staphylococcus aureus subsp. aureus Mu50
uauuugacacauuauugaa

SEQ ID NO: 2072481 - RNA, 18 nt, Staphylococcus aureus subsp. aureus Mu50
uauuugaucguugaauac

SEQ ID NO: 2072482 - RNA, 20 nt, Staphylococcus aureus subsp. aureus Mu50
uauuugauauaguuauaugu

SEQ ID NO: 2072483 - RNA, 15 nt, Staphylococcus aureus subsp. aureus Mu50
uauuugauauuucau

SEQ ID NO: 2072484 - RNA, 23 nt, Staphylococcus aureus subsp. aureus Mu50
uauuugaaagacauuuaaauaua

SEQ ID NO: 2072485 - RNA, 17 nt, Staphylococcus aureus subsp. aureus Mu50
uauuugaaagguaagua

SEQ ID NO: 2072486 - RNA, 15 nt, Staphylococcus aureus subsp. aureus Mu50
uacaccacuuaggau

SEQ ID NO: 2072487 - RNA, 15 nt, Staphylococcus aureus subsp. aureus Mu50
uacaccuacaaauau

SEQ ID NO: 2072488 - RNA, 17 nt, Staphylococcus aureus subsp. aureus Mu50
uacacgacgcuaaacaa

SEQ ID NO: 2072489 - RNA, 14 nt, Staphylococcus aureus subsp. aureus Mu50
uacacgaguauuau

SEQ ID NO: 2072490 - RNA, 20 nt, Staphylococcus aureus subsp. aureus Mu50
uacacgaguauuaucacaua

SEQ ID NO: 2072491 - RNA, 20 nt, Staphylococcus aureus subsp. aureus Mu50
uacacuccccuuaucaaaac

SEQ ID NO: 2072492 - RNA, 15 nt, Staphylococcus aureus subsp. aureus Mu50
uacacugcacaucau

SEQ ID NO: 2072493 - RNA, 18 nt, Staphylococcus aureus subsp. aureus Mu50
uacacugcacaucauaau

SEQ ID NO: 2072494 - RNA, 21 nt, Staphylococcus aureus subsp. aureus Mu50
uacagagaaucaauuauugaa

SEQ ID NO: 2072495 - RNA, 18 nt, Staphylococcus aureus subsp. aureus Mu50
uacagauaaguaauaaua

SEQ ID NO: 2072496 - RNA, 18 nt, Staphylococcus aureus subsp. aureus Mu50
uacagauaggaaacuuaa

SEQ ID NO: 2072497 - RNA, 16 nt, Staphylococcus aureus subsp. aureus Mu50
uacacuuacaaauauu

SEQ ID NO: 2072498 - RNA, 15 nt, Staphylococcus aureus subsp. aureus Mu50
uacacuugauaaaac

SEQ ID NO: 2072499 - RNA, 14 nt, Staphylococcus aureus subsp. aureus Mu50
uacacuugauuauc

SEQ ID NO: 2072500 - RNA, 16 nt, Staphylococcus aureus subsp. aureus Mu50
uacacuugauuaucau

SEQ ID NO: 2072501 - RNA, 15 nt, Staphylococcus aureus subsp. aureus Mu50
uacacuuacaaauau

SEQ ID NO: 2072502 - RNA, 12 nt, Staphylococcus aureus subsp. aureus Mu50
uacacuuaauau

SEQ ID NO: 2072503 - RNA, 12 nt, Staphylococcus aureus subsp. aureus Mu50
uacacuuuugau

SEQ ID NO: 2072504 - RNA, 23 nt, Staphylococcus aureus subsp. aureus Mu50
uacacuuuugauuguuuaaacau

SEQ ID NO: 2072505 - RNA, 22 nt, Staphylococcus aureus subsp. aureus Mu50
uacaaccuuugcuuaaaccuua

SEQ ID NO: 2072506 - RNA, 23 nt, Staphylococcus aureus subsp. aureus Mu50
uacaacgacacgaacaacauuag

SEQ ID NO: 2072507 - RNA, 21 nt, Staphylococcus aureus subsp. aureus Mu50
uacaacgacacgaacaacauu

SEQ ID NO: 2072508 - RNA, 18 nt, Staphylococcus aureus subsp. aureus Mu50
uacaaguuuauaaucuuu

SEQ ID NO: 2072509 - RNA, 19 nt, Staphylococcus aureus subsp. aureus Mu50
uacaauaagcgcaauuaaa

SEQ ID NO: 2072510 - RNA, 20 nt, Staphylococcus aureus subsp. aureus Mu50
uacaauaagcgcaauuaaaa

SEQ ID NO: 2072511 - RNA, 21 nt, Staphylococcus aureus subsp. aureus Mu50
uacaauaagcgcaauuaaaag

SEQ ID NO: 2072512 - RNA, 22 nt, Staphylococcus aureus subsp. aureus Mu50
uacaauaaugugcaaguugggg

SEQ ID NO: 2072513 - RNA, 22 nt, Staphylococcus aureus subsp. aureus Mu50
uaauuucuugauggauauucaa

SEQ ID NO: 2072514 - RNA, 17 nt, Staphylococcus aureus subsp. aureus Mu50
uaauuuuaaaaauaaaa

SEQ ID NO: 2072515 - RNA, 13 nt, Staphylococcus aureus subsp. aureus Mu50
uaauuuucagaau

SEQ ID NO: 2072516 - RNA, 14 nt, Staphylococcus aureus subsp. aureus Mu50
uacaacauguguau

SEQ ID NO: 2072517 - RNA, 15 nt, Staphylococcus aureus subsp. aureus Mu50
uaauuuuauuuaauu

SEQ ID NO: 2072518 - RNA, 13 nt, Staphylococcus aureus subsp. aureus Mu50
uacaauauaauuu

SEQ ID NO: 2072519 - RNA, 15 nt, Staphylococcus aureus subsp. aureus Mu50
uacaauauagaaaau

SEQ ID NO: 2072520 - RNA, 15 nt, Staphylococcus aureus subsp. aureus Mu50
uacaauaugauuaau

SEQ ID NO: 2072521 - RNA, 16 nt, Staphylococcus aureus subsp. aureus Mu50
uacaauaugauuaaua

SEQ ID NO: 2072522 - RNA, 17 nt, Staphylococcus aureus subsp. aureus Mu50
uacaauauuaaaauuaa

SEQ ID NO: 2072523 - RNA, 18 nt, Staphylococcus aureus subsp. aureus Mu50
uacaauauuaaaauuaaa

SEQ ID NO: 2072524 - RNA, 13 nt, Staphylococcus aureus subsp. aureus Mu50
uacaaugaaaaaa

SEQ ID NO: 2072525 - RNA, 23 nt, Staphylococcus aureus subsp. aureus Mu50
uacaaugaauuguuaguuuucuu

SEQ ID NO: 2072526 - RNA, 17 nt, Staphylococcus aureus subsp. aureus Mu50
uacaaugaauuucuaau

SEQ ID NO: 2072527 - RNA, 17 nt, Staphylococcus aureus subsp. aureus Mu50
uacaaugcgguauugca

SEQ ID NO: 2072528 - RNA, 13 nt, Staphylococcus aureus subsp. aureus Mu50
uacaauuaauuac

SEQ ID NO: 2072529 - RNA, 17 nt, Staphylococcus aureus subsp. aureus Mu50
uacaauuauaaaugauu

SEQ ID NO: 2072530 - RNA, 21 nt, Staphylococcus aureus subsp. aureus Mu50
uacacaucgaucuaaauauau

SEQ ID NO: 2072531 - RNA, 22 nt, Staphylococcus aureus subsp. aureus Mu50
uacacaucgaucuaaauauauu

SEQ ID NO: 2072532 - RNA, 14 nt, Staphylococcus aureus subsp. aureus Mu50
uacaguuuuacuau

SEQ ID NO: 2072533 - RNA, 18 nt, Staphylococcus aureus subsp. aureus Mu50
uacagcuagcaagaauag

SEQ ID NO: 2072534 - RNA, 15 nt, Staphylococcus aureus subsp. aureus Mu50
uacagcguauuuuaa

SEQ ID NO: 2072535 - RNA, 23 nt, Staphylococcus aureus subsp. aureus Mu50
uacagcguauuuuaaugauuuuu

SEQ ID NO: 2072536 - RNA, 13 nt, Staphylococcus aureus subsp. aureus Mu50
uacagcauauaau

SEQ ID NO: 2072537 - RNA, 20 nt, Staphylococcus aureus subsp. aureus Mu50
uacagaucucaauccaauua

SEQ ID NO: 2072538 - RNA, 12 nt, Staphylococcus aureus subsp. aureus Mu50
uacagaugaugc

SEQ ID NO: 2072539 - RNA, 15 nt, Staphylococcus aureus subsp. aureus Mu50
uacauaaaucuaaua

SEQ ID NO: 2072540 - RNA, 18 nt, Staphylococcus aureus subsp. aureus Mu50
uacauaaaauggcaucug

SEQ ID NO: 2072541 - RNA, 16 nt, Staphylococcus aureus subsp. aureus Mu50
uacauauaucaacaug

SEQ ID NO: 2072542 - RNA, 23 nt, Staphylococcus aureus subsp. aureus Mu50
uacauaguugaaucggugucuuu

SEQ ID NO: 2072543 - RNA, 24 nt, Staphylococcus aureus subsp. aureus Mu50
uacauaguugaaucggugucuuua

SEQ ID NO: 2072544 - RNA, 17 nt, Staphylococcus aureus subsp. aureus Mu50
uacauauaagaauuguu

SEQ ID NO: 2072545 - RNA, 15 nt, Staphylococcus aureus subsp. aureus Mu50
uacaugacuccaugc

SEQ ID NO: 2072546 - RNA, 14 nt, Staphylococcus aureus subsp. aureus Mu50
uacauauuggcuug

SEQ ID NO: 2072547 - RNA, 16 nt, Staphylococcus aureus subsp. aureus Mu50
uacauaugcuauauuu

SEQ ID NO: 2072548 - RNA, 16 nt, Staphylococcus aureus subsp. aureus Mu50
uacauauucucugcuu

SEQ ID NO: 2072549 - RNA, 17 nt, Staphylococcus aureus subsp. aureus Mu50
uacauauucucugcuuc

SEQ ID NO: 2072550 - RNA, 18 nt, Staphylococcus aureus subsp. aureus Mu50
uaccaaagaaaucaccag

SEQ ID NO: 2072551 - RNA, 15 nt, Staphylococcus aureus subsp. aureus Mu50
uacauuuuuauacaa

SEQ ID NO: 2072552 - RNA, 22 nt, Staphylococcus aureus subsp. aureus Mu50
uacauuuuuaugagcuucuuua

SEQ ID NO: 2072553 - RNA, 15 nt, Staphylococcus aureus subsp. aureus Mu50
uaccaagaaauacuc

SEQ ID NO: 2072554 - RNA, 17 nt, Staphylococcus aureus subsp. aureus Mu50
uacauuguaaauauagu

SEQ ID NO: 2072555 - RNA, 22 nt, Staphylococcus aureus subsp. aureus Mu50
uacauuuaauggucuaauauca

SEQ ID NO: 2072556 - RNA, 16 nt, Staphylococcus aureus subsp. aureus Mu50
uacauuaaaacaauaa

SEQ ID NO: 2072557 - RNA, 21 nt, Staphylococcus aureus subsp. aureus Mu50
uacauuaaaacaauaauuuaa

SEQ ID NO: 2072558 - RNA, 22 nt, Staphylococcus aureus subsp. aureus Mu50
uacauuuauuuucaauaaauaa

SEQ ID NO: 2072559 - RNA, 16 nt, Staphylococcus aureus subsp. aureus Mu50
uacauuuaguacauau

SEQ ID NO: 2072560 - RNA, 23 nt, Staphylococcus aureus subsp. aureus Mu50
uacauuuaauggucuaauaucaa

SEQ ID NO: 2072561 - RNA, 21 nt, Staphylococcus aureus subsp. aureus Mu50
uacauuuauuuucaauaaaua

SEQ ID NO: 2072562 - RNA, 16 nt, Staphylococcus aureus subsp. aureus Mu50
uacauuuuaauaaaau

SEQ ID NO: 2072563 - RNA, 22 nt, Staphylococcus aureus subsp. aureus Mu50
uacauuuuaauaaaaucaucuu

SEQ ID NO: 2072564 - RNA, 23 nt, Staphylococcus aureus subsp. aureus Mu50
uaacgaugguugcuucacuguuu

SEQ ID NO: 2072565 - RNA, 18 nt, Staphylococcus aureus subsp. aureus Mu50
uaacgaguccauuuucuu

SEQ ID NO: 2072566 - RNA, 20 nt, Staphylococcus aureus subsp. aureus Mu50
uaacgagugcuuucaccuuu

SEQ ID NO: 2072567 - RNA, 14 nt, Staphylococcus aureus subsp. aureus Mu50
uaacgauagacauu

SEQ ID NO: 2072568 - RNA, 15 nt, Staphylococcus aureus subsp. aureus Mu50
uaaucgaacagaaaa

SEQ ID NO: 2072569 - RNA, 19 nt, Staphylococcus aureus subsp. aureus Mu50
uaaucguauucauaucauu

SEQ ID NO: 2072570 - RNA, 16 nt, Staphylococcus aureus subsp. aureus Mu50
uaaucgguaauuacuu

SEQ ID NO: 2072571 - RNA, 14 nt, Staphylococcus aureus subsp. aureus Mu50
uaaucguucccauu

SEQ ID NO: 2072572 - RNA, 16 nt, Staphylococcus aureus subsp. aureus Mu50
uaaucuaaauucaguu

SEQ ID NO: 2072573 - RNA, 19 nt, Staphylococcus aureus subsp. aureus Mu50
uaaucucuucaauuuauuu

SEQ ID NO: 2072574 - RNA, 14 nt, Staphylococcus aureus subsp. aureus Mu50
uaaucucauucuuu

SEQ ID NO: 2072575 - RNA, 16 nt, Staphylococcus aureus subsp. aureus Mu50
uaaucucuuuuugauu

SEQ ID NO: 2072576 - RNA, 22 nt, Staphylococcus aureus subsp. aureus Mu50
uaaucucuuuuugauuauauuu

SEQ ID NO: 2072577 - RNA, 14 nt, Staphylococcus aureus subsp. aureus Mu50
uaaucuauauauau

SEQ ID NO: 2072578 - RNA, 22 nt, Staphylococcus aureus subsp. aureus Mu50
uaaucuugauuauauuuuucuu

SEQ ID NO: 2072579 - RNA, 18 nt, Staphylococcus aureus subsp. aureus Mu50
uaaucuuuaacauuuauu

SEQ ID NO: 2072580 - RNA, 17 nt, Staphylococcus aureus subsp. aureus Mu50
uaaucuugauuauauuu

SEQ ID NO: 2072581 - RNA, 20 nt, Staphylococcus aureus subsp. aureus Mu50
uaaucuggguuguaaucuca

SEQ ID NO: 2072582 - RNA, 16 nt, Staphylococcus aureus subsp. aureus Mu50
uaaucuuaguuaaaau

SEQ ID NO: 2072583 - RNA, 18 nt, Staphylococcus aureus subsp. aureus Mu50
uaaugaauucauucaaua

SEQ ID NO: 2072584 - RNA, 16 nt, Staphylococcus aureus subsp. aureus Mu50
uaaugacaaauuauca

SEQ ID NO: 2072585 - RNA, 15 nt, Staphylococcus aureus subsp. aureus Mu50
uaaucuuuuuuuaau

SEQ ID NO: 2072586 - RNA, 20 nt, Staphylococcus aureus subsp. aureus Mu50
uaaugcuguacuauauucaa

SEQ ID NO: 2072587 - RNA, 19 nt, Staphylococcus aureus subsp. aureus Mu50
uaaugccguaguuuucucu

SEQ ID NO: 2072588 - RNA, 14 nt, Staphylococcus aureus subsp. aureus Mu50
uaauggcaacuaag

SEQ ID NO: 2072589 - RNA, 15 nt, Staphylococcus aureus subsp. aureus Mu50
uaaugccaaauauag

SEQ ID NO: 2072590 - RNA, 23 nt, Staphylococcus aureus subsp. aureus Mu50
uaaugccaaauauaguaauuguu

SEQ ID NO: 2072591 - RNA, 14 nt, Staphylococcus aureus subsp. aureus Mu50
uaaugccaaauaua

SEQ ID NO: 2072592 - RNA, 16 nt, Staphylococcus aureus subsp. aureus Mu50
uaaugacugacacuuu

SEQ ID NO: 2072593 - RNA, 16 nt, Staphylococcus aureus subsp. aureus Mu50
uaaugguauugauuau

SEQ ID NO: 2072594 - RNA, 22 nt, Staphylococcus aureus subsp. aureus Mu50
uaauggcgggcccccaacacaa

SEQ ID NO: 2072595 - RNA, 18 nt, Staphylococcus aureus subsp. aureus Mu50
uaauuaacacauucaaau

SEQ ID NO: 2072596 - RNA, 14 nt, Staphylococcus aureus subsp. aureus Mu50
uaauuaaauaacuu

SEQ ID NO: 2072597 - RNA, 22 nt, Staphylococcus aureus subsp. aureus Mu50
uaaugguucuauaauaaaucga

SEQ ID NO: 2072598 - RNA, 22 nt, Staphylococcus aureus subsp. aureus Mu50
uaauuaggauuuccggaacaau

SEQ ID NO: 2072599 - RNA, 21 nt, Staphylococcus aureus subsp. aureus Mu50
uaauuagguauaguguuugac

SEQ ID NO: 2072600 - RNA, 22 nt, Staphylococcus aureus subsp. aureus Mu50
uaauuagugcaaguaauuuaau

SEQ ID NO: 2072601 - RNA, 16 nt, Staphylococcus aureus subsp. aureus Mu50
uaauuaggauuaacau

SEQ ID NO: 2072602 - RNA, 22 nt, Staphylococcus aureus subsp. aureus Mu50
uaauuaauguucaaaaaaugaa

SEQ ID NO: 2072603 - RNA, 22 nt, Staphylococcus aureus subsp. aureus Mu50
uaauuaacacauucaaauaaau

SEQ ID NO: 2072604 - RNA, 20 nt, Staphylococcus aureus subsp. aureus Mu50
uaauuaacacauucaaauaa

SEQ ID NO: 2072605 - RNA, 22 nt, Staphylococcus aureus subsp. aureus Mu50
uaauuaacuuacuuuuguaaaa

SEQ ID NO: 2072606 - RNA, 17 nt, Staphylococcus aureus subsp. aureus Mu50
uaauuaagaaaaucauu

SEQ ID NO: 2072607 - RNA, 17 nt, Staphylococcus aureus subsp. aureus Mu50
uaauuaaguuaaaauaa

SEQ ID NO: 2072608 - RNA, 21 nt, Staphylococcus aureus subsp. aureus Mu50
uaauuaauacaucaauaucuu

SEQ ID NO: 2072609 - RNA, 13 nt, Staphylococcus aureus subsp. aureus Mu50
uaauuaauaauuu

SEQ ID NO: 2072610 - RNA, 16 nt, Staphylococcus aureus subsp. aureus Mu50
uaauuaguguuucaug

SEQ ID NO: 2072611 - RNA, 17 nt, Staphylococcus aureus subsp. aureus Mu50
uaauucaacuuaaaugg

SEQ ID NO: 2072612 - RNA, 17 nt, Staphylococcus aureus subsp. aureus Mu50
uaauuauauuaaugauu

SEQ ID NO: 2072613 - RNA, 16 nt, Staphylococcus aureus subsp. aureus Mu50
uaauuaucauauaaau

SEQ ID NO: 2072614 - RNA, 14 nt, Staphylococcus aureus subsp. aureus Mu50
uaauucaaugcuau

SEQ ID NO: 2072615 - RNA, 21 nt, Staphylococcus aureus subsp. aureus Mu50
uaauucaaugauuuuuaaaaa

SEQ ID NO: 2072616 - RNA, 19 nt, Staphylococcus aureus subsp. aureus Mu50
uaauucguaauuuaugauu

SEQ ID NO: 2072617 - RNA, 18 nt, Staphylococcus aureus subsp. aureus Mu50
uaauucguugauuuagca

SEQ ID NO: 2072618 - RNA, 23 nt, Staphylococcus aureus subsp. aureus Mu50
uaauucguuuugcuaaccaucau

SEQ ID NO: 2072619 - RNA, 13 nt, Staphylococcus aureus subsp. aureus Mu50
uaauucauauuca

SEQ ID NO: 2072620 - RNA, 21 nt, Staphylococcus aureus subsp. aureus Mu50
uaauucuaagucucuugucau

SEQ ID NO: 2072621 - RNA, 14 nt, Staphylococcus aureus subsp. aureus Mu50
uaauucugaaauca

SEQ ID NO: 2072622 - RNA, 14 nt, Staphylococcus aureus subsp. aureus Mu50
uaauuuccuaaaaa

SEQ ID NO: 2072623 - RNA, 17 nt, Staphylococcus aureus subsp. aureus Mu50
uaauuuccaauaucuuc

SEQ ID NO: 2072624 - RNA, 17 nt, Staphylococcus aureus subsp. aureus Mu50
uaauuuauaaacaauua

SEQ ID NO: 2072625 - RNA, 10 nt, Staphylococcus aureus subsp. aureus Mu50
uaauuucuau

SEQ ID NO: 2072626 - RNA, 18 nt, Staphylococcus aureus subsp. aureus Mu50
uaauuucugguaaaaaaa

SEQ ID NO: 2072627 - RNA, 16 nt, Staphylococcus aureus subsp. aureus Mu50
uaauuuaguacucaau

SEQ ID NO: 2072628 - RNA, 15 nt, Staphylococcus aureus subsp. aureus Mu50
uaauuuauaaaaaga

SEQ ID NO: 2072629 - RNA, 14 nt, Staphylococcus aureus subsp. aureus Mu50
uaauuuaauuuuag

SEQ ID NO: 2072630 - RNA, 16 nt, Staphylococcus aureus subsp. aureus Mu50
uaauuuaauauuuaga

SEQ ID NO: 2072631 - RNA, 21 nt, Staphylococcus aureus subsp. aureus Mu50
uaauuuaaaucuguacuucua

SEQ ID NO: 2072632 - RNA, 20 nt, Staphylococcus aureus subsp. aureus Mu50
uaauuuaaaauaguucuuua

SEQ ID NO: 2072633 - RNA, 11 nt, Staphylococcus aureus subsp. aureus Mu50
uaauuuaaaga

SEQ ID NO: 2072634 - RNA, 21 nt, Staphylococcus aureus subsp. aureus Mu50
uaauuuaaaggcauaauaacc

SEQ ID NO: 2072635 - RNA, 22 nt, Staphylococcus aureus subsp. aureus Mu50
uaauugaauugauuauaaugau

SEQ ID NO: 2072636 - RNA, 17 nt, Staphylococcus aureus subsp. aureus Mu50
uaauugcuuaauaucau

SEQ ID NO: 2072637 - RNA, 22 nt, Staphylococcus aureus subsp. aureus Mu50
uaauugaaguaugcacaucauu

SEQ ID NO: 2072638 - RNA, 12 nt, Staphylococcus aureus subsp. aureus Mu50
uaauugaaugaa

SEQ ID NO: 2072639 - RNA, 16 nt, Staphylococcus aureus subsp. aureus Mu50
uaauugaaugaaaaag

SEQ ID NO: 2072640 - RNA, 17 nt, Staphylococcus aureus subsp. aureus Mu50
uaauugaaugaaaauaa

SEQ ID NO: 2072641 - RNA, 15 nt, Staphylococcus aureus subsp. aureus Mu50
uaauugaaaaucuaa

SEQ ID NO: 2072642 - RNA, 22 nt, Staphylococcus aureus subsp. aureus Mu50
uaauugaaaugauagaugcugg

SEQ ID NO: 2072643 - RNA, 16 nt, Staphylococcus aureus subsp. aureus Mu50
uaauucuuaaucgagu

SEQ ID NO: 2072644 - RNA, 20 nt, Staphylococcus aureus subsp. aureus Mu50
uaauucuuaaucgagugauu

SEQ ID NO: 2072645 - RNA, 17 nt, Staphylococcus aureus subsp. aureus Mu50
uaauucuucaaccauuu

SEQ ID NO: 2072646 - RNA, 16 nt, Staphylococcus aureus subsp. aureus Mu50
uaauucugguuuaaug

SEQ ID NO: 2072647 - RNA, 15 nt, Staphylococcus aureus subsp. aureus Mu50
uaauuggauuaaaua

SEQ ID NO: 2072648 - RNA, 13 nt, Staphylococcus aureus subsp. aureus Mu50
uaauuggcagaua

SEQ ID NO: 2072649 - RNA, 20 nt, Staphylococcus aureus subsp. aureus Mu50
uaauugguucuucuuucaua

SEQ ID NO: 2072650 - RNA, 21 nt, Staphylococcus aureus subsp. aureus Mu50
uaauuggaaucaucuuuuuga

SEQ ID NO: 2072651 - RNA, 15 nt, Staphylococcus aureus subsp. aureus Mu50
uaauuggaaucaucu

SEQ ID NO: 2072652 - RNA, 17 nt, Staphylococcus aureus subsp. aureus Mu50
uaauuggaaucaucuuu

SEQ ID NO: 2072653 - RNA, 13 nt, Staphylococcus aureus subsp. aureus Mu50
uaauuguuaaauc

SEQ ID NO: 2072654 - RNA, 15 nt, Staphylococcus aureus subsp. aureus Mu50
uaauuguuaaaucac

SEQ ID NO: 2072655 - RNA, 14 nt, Staphylococcus aureus subsp. aureus Mu50
uaauugucuuuaua

SEQ ID NO: 2072656 - RNA, 17 nt, Staphylococcus aureus subsp. aureus Mu50
uaauuggguuuaauaac

SEQ ID NO: 2072657 - RNA, 19 nt, Staphylococcus aureus subsp. aureus Mu50
uaauuguaaucuauuuucu

SEQ ID NO: 2072658 - RNA, 16 nt, Staphylococcus aureus subsp. aureus Mu50
uacuuaauuaauaauu

SEQ ID NO: 2072659 - RNA, 21 nt, Staphylococcus aureus subsp. aureus Mu50
uacuuaauuuaaaucuguacu

SEQ ID NO: 2072660 - RNA, 20 nt, Staphylococcus aureus subsp. aureus Mu50
uacuuaauuuaaauugucac

SEQ ID NO: 2072661 - RNA, 14 nt, Staphylococcus aureus subsp. aureus Mu50
uacuuacugaaacu

SEQ ID NO: 2072662 - RNA, 22 nt, Staphylococcus aureus subsp. aureus Mu50
uacuuacugaaacuaaauuaaa

SEQ ID NO: 2072663 - RNA, 19 nt, Staphylococcus aureus subsp. aureus Mu50
uacuuaguaaggaauauuu

SEQ ID NO: 2072664 - RNA, 22 nt, Staphylococcus aureus subsp. aureus Mu50
uacuuacuuuucuaaacaacuu

SEQ ID NO: 2072665 - RNA, 21 nt, Staphylococcus aureus subsp. aureus Mu50
uacuguaguacuauagucauu

SEQ ID NO: 2072666 - RNA, 13 nt, Staphylococcus aureus subsp. aureus Mu50
uacuguauuuuaa

SEQ ID NO: 2072667 - RNA, 12 nt, Staphylococcus aureus subsp. aureus Mu50
uacuuaauauag

SEQ ID NO: 2072668 - RNA, 15 nt, Staphylococcus aureus subsp. aureus Mu50
uacuuucuaagauac

SEQ ID NO: 2072669 - RNA, 15 nt, Staphylococcus aureus subsp. aureus Mu50
uacuuuaaaauugua

SEQ ID NO: 2072670 - RNA, 15 nt, Staphylococcus aureus subsp. aureus Mu50
uacuuguaauuaaua

SEQ ID NO: 2072671 - RNA, 20 nt, Staphylococcus aureus subsp. aureus Mu50
uacuuguaauuaauacauca

SEQ ID NO: 2072672 - RNA, 23 nt, Staphylococcus aureus subsp. aureus Mu50
uacuuauauauucaauaauuauu

SEQ ID NO: 2072673 - RNA, 16 nt, Staphylococcus aureus subsp. aureus Mu50
uacuuccaauacuguu

SEQ ID NO: 2072674 - RNA, 19 nt, Staphylococcus aureus subsp. aureus Mu50
uacuucuaauuugcaaaau

SEQ ID NO: 2072675 - RNA, 18 nt, Staphylococcus aureus subsp. aureus Mu50
uacuucucccuuaaauac

SEQ ID NO: 2072676 - RNA, 23 nt, Staphylococcus aureus subsp. aureus Mu50
uacuuggaaaauacuauacugau

SEQ ID NO: 2072677 - RNA, 20 nt, Staphylococcus aureus subsp. aureus Mu50
uacuucuauuuuauaauaaa

SEQ ID NO: 2072678 - RNA, 22 nt, Staphylococcus aureus subsp. aureus Mu50
uacuuuggaaauuuauuauaaa

SEQ ID NO: 2072679 - RNA, 18 nt, Staphylococcus aureus subsp. aureus Mu50
uacuuuguucugcuuuuu

SEQ ID NO: 2072680 - RNA, 15 nt, Staphylococcus aureus subsp. aureus Mu50
uacuuuuauaaucuu

SEQ ID NO: 2072681 - RNA, 12 nt, Staphylococcus aureus subsp. aureus Mu50
uacuuuucuaaa

SEQ ID NO: 2072682 - RNA, 19 nt, Staphylococcus aureus subsp. aureus Mu50
uagaaaagggacagaaaag

SEQ ID NO: 2072683 - RNA, 15 nt, Staphylococcus aureus subsp. aureus Mu50
uagaaaaauuucaaa

SEQ ID NO: 2072684 - RNA, 19 nt, Staphylococcus aureus subsp. aureus Mu50
uagaaaaauuucaaaaaua

SEQ ID NO: 2072685 - RNA, 19 nt, Staphylococcus aureus subsp. aureus Mu50
uagaaaaagcaggcaagcu

SEQ ID NO: 2072686 - RNA, 15 nt, Staphylococcus aureus subsp. aureus Mu50
uagaaaugugcugug

SEQ ID NO: 2072687 - RNA, 20 nt, Staphylococcus aureus subsp. aureus Mu50
uagaaaugugcugugucuuu

SEQ ID NO: 2072688 - RNA, 19 nt, Staphylococcus aureus subsp. aureus Mu50
uagaaauuaccguuuauuu

SEQ ID NO: 2072689 - RNA, 17 nt, Staphylococcus aureus subsp. aureus Mu50
uagaaauagauuuagaa

SEQ ID NO: 2072690 - RNA, 18 nt, Staphylococcus aureus subsp. aureus Mu50
uagaaagugauucccaaa

SEQ ID NO: 2072691 - RNA, 15 nt, Staphylococcus aureus subsp. aureus Mu50
uagaaaguugugguc

SEQ ID NO: 2072692 - RNA, 16 nt, Staphylococcus aureus subsp. aureus Mu50
uagaaagcgcauuugu

SEQ ID NO: 2072693 - RNA, 22 nt, Staphylococcus aureus subsp. aureus Mu50
uagaaacuuccaacauauaaaa

SEQ ID NO: 2072694 - RNA, 15 nt, Staphylococcus aureus subsp. aureus Mu50
uagaaaccguaaaau

SEQ ID NO: 2072695 - RNA, 15 nt, Staphylococcus aureus subsp. aureus Mu50
uagaaagaaauuguu

SEQ ID NO: 2072696 - RNA, 12 nt, Staphylococcus aureus subsp. aureus Mu50
uagaaaauuaac

SEQ ID NO: 2072697 - RNA, 21 nt, Staphylococcus aureus subsp. aureus Mu50
uagagaagggaguaccaagaa

SEQ ID NO: 2072698 - RNA, 19 nt, Staphylococcus aureus subsp. aureus Mu50
uagagaaauacuauucuuu

SEQ ID NO: 2072699 - RNA, 13 nt, Staphylococcus aureus subsp. aureus Mu50
uagagaacagcag

SEQ ID NO: 2072700 - RNA, 15 nt, Staphylococcus aureus subsp. aureus Mu50
uagacgguaucaucu

SEQ ID NO: 2072701 - RNA, 20 nt, Staphylococcus aureus subsp. aureus Mu50
uagacaauuguaguaaugaa

SEQ ID NO: 2072702 - RNA, 23 nt, Staphylococcus aureus subsp. aureus Mu50
uagacaauguucuuuucaacauu

SEQ ID NO: 2072703 - RNA, 18 nt, Staphylococcus aureus subsp. aureus Mu50
uagacaguaguuaauuga

SEQ ID NO: 2072704 - RNA, 18 nt, Staphylococcus aureus subsp. aureus Mu50
uagacauaaaaaaagaga

SEQ ID NO: 2072705 - RNA, 18 nt, Staphylococcus aureus subsp. aureus Mu50
uagaagaacaauaauuga

SEQ ID NO: 2072706 - RNA, 14 nt, Staphylococcus aureus subsp. aureus Mu50
uagaaauuuuaaaa

SEQ ID NO: 2072707 - RNA, 18 nt, Staphylococcus aureus subsp. aureus Mu50
uagaauagucaauuaaug

SEQ ID NO: 2072708 - RNA, 17 nt, Staphylococcus aureus subsp. aureus Mu50
uagaauaguuaccaaaa

SEQ ID NO: 2072709 - RNA, 20 nt, Staphylococcus aureus subsp. aureus Mu50
uagaauauauguauaacauu

SEQ ID NO: 2072710 - RNA, 20 nt, Staphylococcus aureus subsp. aureus Mu50
uagaaucaaccguuuuauug

SEQ ID NO: 2072711 - RNA, 15 nt, Staphylococcus aureus subsp. aureus Mu50
uagaaguuuuuugau

SEQ ID NO: 2072712 - RNA, 23 nt, Staphylococcus aureus subsp. aureus Mu50
uagaaugaugaguauacuuacug

SEQ ID NO: 2072713 - RNA, 18 nt, Staphylococcus aureus subsp. aureus Mu50
uagaaugucgauauuucu

SEQ ID NO: 2072714 - RNA, 19 nt, Staphylococcus aureus subsp. aureus Mu50
uagaaugucgauauuucua

SEQ ID NO: 2072715 - RNA, 15 nt, Staphylococcus aureus subsp. aureus Mu50
uagaauuauuuagaa

SEQ ID NO: 2072716 - RNA, 19 nt, Staphylococcus aureus subsp. aureus Mu50
uagaauuauuuagaaacuu

SEQ ID NO: 2072717 - RNA, 17 nt, Staphylococcus aureus subsp. aureus Mu50
uagaauucuaaaagaau

SEQ ID NO: 2072718 - RNA, 18 nt, Staphylococcus aureus subsp. aureus Mu50
uagaauucuaaaagaauu

SEQ ID NO: 2072719 - RNA, 23 nt, Staphylococcus aureus subsp. aureus Mu50
uagaaugaaaccguauuauugga

SEQ ID NO: 2072720 - RNA, 16 nt, Staphylococcus aureus subsp. aureus Mu50
uacggagacaaguaua

SEQ ID NO: 2072721 - RNA, 16 nt, Staphylococcus aureus subsp. aureus Mu50
uacgguagucucccau

SEQ ID NO: 2072722 - RNA, 23 nt, Staphylococcus aureus subsp. aureus Mu50
uacguuacuaaacuuuucuucaa

SEQ ID NO: 2072723 - RNA, 15 nt, Staphylococcus aureus subsp. aureus Mu50
uacgguuauggugug

SEQ ID NO: 2072724 - RNA, 19 nt, Staphylococcus aureus subsp. aureus Mu50
uacgaucaaaaucaugcuc

SEQ ID NO: 2072725 - RNA, 16 nt, Staphylococcus aureus subsp. aureus Mu50
uacgauauagugcuug

SEQ ID NO: 2072726 - RNA, 15 nt, Staphylococcus aureus subsp. aureus Mu50
uacgcucauaugucu

SEQ ID NO: 2072727 - RNA, 14 nt, Staphylococcus aureus subsp. aureus Mu50
uacgauugcaauug

SEQ ID NO: 2072728 - RNA, 20 nt, Staphylococcus aureus subsp. aureus Mu50
uacgauugaguugaaaauaa

SEQ ID NO: 2072729 - RNA, 16 nt, Staphylococcus aureus subsp. aureus Mu50
uacgcugucucauuaa

SEQ ID NO: 2072730 - RNA, 15 nt, Staphylococcus aureus subsp. aureus Mu50
uacgcuuuuuaaaaa

SEQ ID NO: 2072731 - RNA, 15 nt, Staphylococcus aureus subsp. aureus Mu50
uacuauaauaauuaa

SEQ ID NO: 2072732 - RNA, 22 nt, Staphylococcus aureus subsp. aureus Mu50
uacuauaaauacgucaucuuua

SEQ ID NO: 2072733 - RNA, 24 nt, Staphylococcus aureus subsp. aureus Mu50
uacuauaaaaucaucguauuucau

SEQ ID NO: 2072734 - RNA, 21 nt, Staphylococcus aureus subsp. aureus Mu50
uacuauaaaaauuuauucaaa

SEQ ID NO: 2072735 - RNA, 20 nt, Staphylococcus aureus subsp. aureus Mu50
uacuauaaaaauuuauucaa

SEQ ID NO: 2072736 - RNA, 11 nt, Staphylococcus aureus subsp. aureus Mu50
uacuaaaacau

SEQ ID NO: 2072737 - RNA, 14 nt, Staphylococcus aureus subsp. aureus Mu50
uacuauaaauccua

SEQ ID NO: 2072738 - RNA, 13 nt, Staphylococcus aureus subsp. aureus Mu50
uacuauacugaug

SEQ ID NO: 2072739 - RNA, 13 nt, Staphylococcus aureus subsp. aureus Mu50
uacuauauauaau

SEQ ID NO: 2072740 - RNA, 13 nt, Staphylococcus aureus subsp. aureus Mu50
uacuauacuuuga

SEQ ID NO: 2072741 - RNA, 16 nt, Staphylococcus aureus subsp. aureus Mu50
uacuaucuucaucaua

SEQ ID NO: 2072742 - RNA, 19 nt, Staphylococcus aureus subsp. aureus Mu50
uacuaucuucaucauauuc

SEQ ID NO: 2072743 - RNA, 13 nt, Staphylococcus aureus subsp. aureus Mu50
uacuauauuuauu

SEQ ID NO: 2072744 - RNA, 19 nt, Staphylococcus aureus subsp. aureus Mu50
uacguuauuucaauaauaa

SEQ ID NO: 2072745 - RNA, 22 nt, Staphylococcus aureus subsp. aureus Mu50
uacguuauuuuuuggucaccaa

SEQ ID NO: 2072746 - RNA, 14 nt, Staphylococcus aureus subsp. aureus Mu50
uacguuuauaucuu

SEQ ID NO: 2072747 - RNA, 19 nt, Staphylococcus aureus subsp. aureus Mu50
uacguuuaauaaugguucu

SEQ ID NO: 2072748 - RNA, 19 nt, Staphylococcus aureus subsp. aureus Mu50
uacguuuuuuuaaauacau

SEQ ID NO: 2072749 - RNA, 17 nt, Staphylococcus aureus subsp. aureus Mu50
uacguuugcauauccuu

SEQ ID NO: 2072750 - RNA, 13 nt, Staphylococcus aureus subsp. aureus Mu50
uacuauuaaauaa

SEQ ID NO: 2072751 - RNA, 15 nt, Staphylococcus aureus subsp. aureus Mu50
uacucaaaccaucuu

SEQ ID NO: 2072752 - RNA, 13 nt, Staphylococcus aureus subsp. aureus Mu50
uacucacaaaaaa

SEQ ID NO: 2072753 - RNA, 20 nt, Staphylococcus aureus subsp. aureus Mu50
uacucacugcacuuaugaua

SEQ ID NO: 2072754 - RNA, 22 nt, Staphylococcus aureus subsp. aureus Mu50
uacucacugcacuuaugauacu

SEQ ID NO: 2072755 - RNA, 24 nt, Staphylococcus aureus subsp. aureus Mu50
uacuccaauuaccaaugaauaaau

SEQ ID NO: 2072756 - RNA, 14 nt, Staphylococcus aureus subsp. aureus Mu50
uacuccaaaguaac

SEQ ID NO: 2072757 - RNA, 18 nt, Staphylococcus aureus subsp. aureus Mu50
uacgaaaguagaauuauu

SEQ ID NO: 2072758 - RNA, 14 nt, Staphylococcus aureus subsp. aureus Mu50
uaccuuuauuauuu

SEQ ID NO: 2072759 - RNA, 14 nt, Staphylococcus aureus subsp. aureus Mu50
uaccuuuccaauuu

SEQ ID NO: 2072760 - RNA, 17 nt, Staphylococcus aureus subsp. aureus Mu50
uaccuuuccaauuuguu

SEQ ID NO: 2072761 - RNA, 16 nt, Staphylococcus aureus subsp. aureus Mu50
uaccuuuacuuucauu

SEQ ID NO: 2072762 - RNA, 15 nt, Staphylococcus aureus subsp. aureus Mu50
uaccuuuacuuucau

SEQ ID NO: 2072763 - RNA, 19 nt, Staphylococcus aureus subsp. aureus Mu50
uaccuuucaaauauaucua

SEQ ID NO: 2072764 - RNA, 18 nt, Staphylococcus aureus subsp. aureus Mu50
uaccuuuaauaauauuga

SEQ ID NO: 2072765 - RNA, 18 nt, Staphylococcus aureus subsp. aureus Mu50
uaccuuuaaaucuacuuu

SEQ ID NO: 2072766 - RNA, 20 nt, Staphylococcus aureus subsp. aureus Mu50
uaccuugauucauuucgauu

SEQ ID NO: 2072767 - RNA, 20 nt, Staphylococcus aureus subsp. aureus Mu50
uaccuggguuaccaaguaau

SEQ ID NO: 2072768 - RNA, 20 nt, Staphylococcus aureus subsp. aureus Mu50
uaccugguucgauuguaaua

SEQ ID NO: 2072769 - RNA, 14 nt, Staphylococcus aureus subsp. aureus Mu50
uaccuuaaauacaa

SEQ ID NO: 2072770 - RNA, 18 nt, Staphylococcus aureus subsp. aureus Mu50
uaccuuaaauacaaaccc

SEQ ID NO: 2072771 - RNA, 18 nt, Staphylococcus aureus subsp. aureus Mu50
uaccuccccaacuuaaua

SEQ ID NO: 2072772 - RNA, 17 nt, Staphylococcus aureus subsp. aureus Mu50
uaccuauuaauaucaua

SEQ ID NO: 2072773 - RNA, 21 nt, Staphylococcus aureus subsp. aureus Mu50
uaccuacagaauggauaccua

SEQ ID NO: 2072774 - RNA, 23 nt, Staphylococcus aureus subsp. aureus Mu50
uaccuaauucaauaccuaauuua

SEQ ID NO: 2072775 - RNA, 15 nt, Staphylococcus aureus subsp. aureus Mu50
uaccuacagaaugga

SEQ ID NO: 2072776 - RNA, 19 nt, Staphylococcus aureus subsp. aureus Mu50
uaccuaauugcuuaauauc

SEQ ID NO: 2072777 - RNA, 14 nt, Staphylococcus aureus subsp. aureus Mu50
uaccuacaaauaug

SEQ ID NO: 2072778 - RNA, 19 nt, Staphylococcus aureus subsp. aureus Mu50
uaccuacacggucccaaga

SEQ ID NO: 2072779 - RNA, 19 nt, Staphylococcus aureus subsp. aureus Mu50
uaccuaagcugauuaaaau

SEQ ID NO: 2072780 - RNA, 21 nt, Staphylococcus aureus subsp. aureus Mu50
uaccuaagcugauuaaaaugu

SEQ ID NO: 2072781 - RNA, 18 nt, Staphylococcus aureus subsp. aureus Mu50
uaccuaagcugauuaaaa

SEQ ID NO: 2072782 - RNA, 18 nt, Staphylococcus aureus subsp. aureus Mu50
uaccuaaagcuaauacac

SEQ ID NO: 2072783 - RNA, 14 nt, Staphylococcus aureus subsp. aureus Mu50
uaccuaaaauaccc

SEQ ID NO: 2072784 - RNA, 16 nt, Staphylococcus aureus subsp. aureus Mu50
uaccuaaaauagaaaa

SEQ ID NO: 2072785 - RNA, 18 nt, Staphylococcus aureus subsp. aureus Mu50
uaccuaaaauagaaaaau

SEQ ID NO: 2072786 - RNA, 19 nt, Staphylococcus aureus subsp. aureus Mu50
uaccuaaaauagaaaaauu

SEQ ID NO: 2072787 - RNA, 22 nt, Staphylococcus aureus subsp. aureus Mu50
uaccaaugaauaaauugauauu

SEQ ID NO: 2072788 - RNA, 17 nt, Staphylococcus aureus subsp. aureus Mu50
uaccaauugauuuugcu

SEQ ID NO: 2072789 - RNA, 13 nt, Staphylococcus aureus subsp. aureus Mu50
uagauaccaaacu

SEQ ID NO: 2072790 - RNA, 22 nt, Staphylococcus aureus subsp. aureus Mu50
uagauacucacugcacuuauga

SEQ ID NO: 2072791 - RNA, 17 nt, Staphylococcus aureus subsp. aureus Mu50
uagauagaaauugugcu

SEQ ID NO: 2072792 - RNA, 19 nt, Staphylococcus aureus subsp. aureus Mu50
uagauagaaauugugcuuu

SEQ ID NO: 2072793 - RNA, 23 nt, Staphylococcus aureus subsp. aureus Mu50
uagauaaucucauucuuuaauau

SEQ ID NO: 2072794 - RNA, 14 nt, Staphylococcus aureus subsp. aureus Mu50
uagauaaaaauuac

SEQ ID NO: 2072795 - RNA, 18 nt, Staphylococcus aureus subsp. aureus Mu50
uagauaaaucgauaaaau

SEQ ID NO: 2072796 - RNA, 23 nt, Staphylococcus aureus subsp. aureus Mu50
uagauaaaauaauuguucuucag

SEQ ID NO: 2072797 - RNA, 14 nt, Staphylococcus aureus subsp. aureus Mu50
uagagguaaaucua

SEQ ID NO: 2072798 - RNA, 14 nt, Staphylococcus aureus subsp. aureus Mu50
uagaguaauuuuac

SEQ ID NO: 2072799 - RNA, 23 nt, Staphylococcus aureus subsp. aureus Mu50
uagaugcuggcuuaguaguugua

SEQ ID NO: 2072800 - RNA, 15 nt, Staphylococcus aureus subsp. aureus Mu50
uagaugcauaaaaaa

SEQ ID NO: 2072801 - RNA, 18 nt, Staphylococcus aureus subsp. aureus Mu50
uagaugcauaaaaaaaga

SEQ ID NO: 2072802 - RNA, 14 nt, Staphylococcus aureus subsp. aureus Mu50
uagaugauauuuaa

SEQ ID NO: 2072803 - RNA, 14 nt, Staphylococcus aureus subsp. aureus Mu50
uagaugauacauuc

SEQ ID NO: 2072804 - RNA, 18 nt, Staphylococcus aureus subsp. aureus Mu50
uagaugaaugccuaauuu

SEQ ID NO: 2072805 - RNA, 21 nt, Staphylococcus aureus subsp. aureus Mu50
uagaugaaugccuaauuuugu

SEQ ID NO: 2072806 - RNA, 23 nt, Staphylococcus aureus subsp. aureus Mu50
uagaugaaauuguguugaaucaa

SEQ ID NO: 2072807 - RNA, 15 nt, Staphylococcus aureus subsp. aureus Mu50
uagaugaaaauuuaa

SEQ ID NO: 2072808 - RNA, 20 nt, Staphylococcus aureus subsp. aureus Mu50
uagauucugauacagaacca

SEQ ID NO: 2072809 - RNA, 18 nt, Staphylococcus aureus subsp. aureus Mu50
uagauugacuaaguuugu

SEQ ID NO: 2072810 - RNA, 13 nt, Staphylococcus aureus subsp. aureus Mu50
uagauugaaaaaa

SEQ ID NO: 2072811 - RNA, 20 nt, Staphylococcus aureus subsp. aureus Mu50
uagauaggauauuuuuuaau

SEQ ID NO: 2072812 - RNA, 17 nt, Staphylococcus aureus subsp. aureus Mu50
uagauagcggauuuauu

SEQ ID NO: 2072813 - RNA, 14 nt, Staphylococcus aureus subsp. aureus Mu50
uagauauuauaaaa

SEQ ID NO: 2072814 - RNA, 22 nt, Staphylococcus aureus subsp. aureus Mu50
uagauaucuuaaucuaaaaaua

SEQ ID NO: 2072815 - RNA, 16 nt, Staphylococcus aureus subsp. aureus Mu50
uagcaccauuauuaaa

SEQ ID NO: 2072816 - RNA, 22 nt, Staphylococcus aureus subsp. aureus Mu50
uagcaccguaacauauguacua

SEQ ID NO: 2072817 - RNA, 16 nt, Staphylococcus aureus subsp. aureus Mu50
uagcaaugaauuaaua

SEQ ID NO: 2072818 - RNA, 20 nt, Staphylococcus aureus subsp. aureus Mu50
uagcaacugaucauuuucau

SEQ ID NO: 2072819 - RNA, 21 nt, Staphylococcus aureus subsp. aureus Mu50
uagcaaaagcuuuuacgccuu

SEQ ID NO: 2072820 - RNA, 21 nt, Staphylococcus aureus subsp. aureus Mu50
uagcaaaauuauguaaaaaau

SEQ ID NO: 2072821 - RNA, 15 nt, Staphylococcus aureus subsp. aureus Mu50
uagcaaauauuucug

SEQ ID NO: 2072822 - RNA, 21 nt, Staphylococcus aureus subsp. aureus Mu50
uagcaaccauauuuuuagaaa

SEQ ID NO: 2072823 - RNA, 22 nt, Staphylococcus aureus subsp. aureus Mu50
uagcaaccauauuuuuagaaaa

SEQ ID NO: 2072824 - RNA, 17 nt, Staphylococcus aureus subsp. aureus Mu50
uagcaaauauuauuaaa

SEQ ID NO: 2072825 - RNA, 14 nt, Staphylococcus aureus subsp. aureus Mu50
uagauuuuaaauca

SEQ ID NO: 2072826 - RNA, 18 nt, Staphylococcus aureus subsp. aureus Mu50
uagauuuuaugcuuuacu

SEQ ID NO: 2072827 - RNA, 14 nt, Staphylococcus aureus subsp. aureus Mu50
uagauuuacgguua

SEQ ID NO: 2072828 - RNA, 13 nt, Staphylococcus aureus subsp. aureus Mu50
uagauuuaggaga

SEQ ID NO: 2072829 - RNA, 17 nt, Staphylococcus aureus subsp. aureus Mu50
uagauuuaggagagcca

SEQ ID NO: 2072830 - RNA, 19 nt, Staphylococcus aureus subsp. aureus Mu50
uagauuuaucaccuuuagg

SEQ ID NO: 2072831 - RNA, 15 nt, Staphylococcus aureus subsp. aureus Mu50
uagauuuaaaauguc

SEQ ID NO: 2072832 - RNA, 12 nt, Staphylococcus aureus subsp. aureus Mu50
uagauuuaaaga

SEQ ID NO: 2072833 - RNA, 16 nt, Staphylococcus aureus subsp. aureus Mu50
uagauugauuguauuu

SEQ ID NO: 2072834 - RNA, 13 nt, Staphylococcus aureus subsp. aureus Mu50
uagcaguuucuga

SEQ ID NO: 2072835 - RNA, 14 nt, Staphylococcus aureus subsp. aureus Mu50
uagcauacauuaag

SEQ ID NO: 2072836 - RNA, 12 nt, Staphylococcus aureus subsp. aureus Mu50
uagcauaaaauu

SEQ ID NO: 2072837 - RNA, 22 nt, Staphylococcus aureus subsp. aureus Mu50
uagcauaucuuuaucauuauuc

SEQ ID NO: 2072838 - RNA, 18 nt, Staphylococcus aureus subsp. aureus Mu50
uagcacuuggauuuuaau

SEQ ID NO: 2072839 - RNA, 11 nt, Staphylococcus aureus subsp. aureus Mu50
uagcagcaguu

SEQ ID NO: 2072840 - RNA, 17 nt, Staphylococcus aureus subsp. aureus Mu50
uagcaucaaaaauaaaa

SEQ ID NO: 2072841 - RNA, 19 nt, Staphylococcus aureus subsp. aureus Mu50
uagcauuacgccaccaguu

SEQ ID NO: 2072842 - RNA, 22 nt, Staphylococcus aureus subsp. aureus Mu50
uagcauuagcaaauauuauuaa

SEQ ID NO: 2072843 - RNA, 14 nt, Staphylococcus aureus subsp. aureus Mu50
uagcauuauuugcu

SEQ ID NO: 2072844 - RNA, 15 nt, Staphylococcus aureus subsp. aureus Mu50
uagcauuauuugcug

SEQ ID NO: 2072845 - RNA, 17 nt, Staphylococcus aureus subsp. aureus Mu50
uagcauuccuaauuaua

SEQ ID NO: 2072846 - RNA, 17 nt, Staphylococcus aureus subsp. aureus Mu50
uagcauguuuugagcaa

SEQ ID NO: 2072847 - RNA, 15 nt, Staphylococcus aureus subsp. aureus Mu50
uagcauugccccauc

SEQ ID NO: 2072848 - RNA, 16 nt, Staphylococcus aureus subsp. aureus Mu50
uaggacuaucuauaau

SEQ ID NO: 2072849 - RNA, 22 nt, Staphylococcus aureus subsp. aureus Mu50
uaggagagcuagaaauccucuu

SEQ ID NO: 2072850 - RNA, 20 nt, Staphylococcus aureus subsp. aureus Mu50
uaggagagauguauaaaacu

SEQ ID NO: 2072851 - RNA, 19 nt, Staphylococcus aureus subsp. aureus Mu50
uaggauauuuuuuaauaau

SEQ ID NO: 2072852 - RNA, 17 nt, Staphylococcus aureus subsp. aureus Mu50
uaggauguucaucaaca

SEQ ID NO: 2072853 - RNA, 16 nt, Staphylococcus aureus subsp. aureus Mu50
uaggaucuuuuccauu

SEQ ID NO: 2072854 - RNA, 14 nt, Staphylococcus aureus subsp. aureus Mu50
uaggaugaaaauau

SEQ ID NO: 2072855 - RNA, 18 nt, Staphylococcus aureus subsp. aureus Mu50
uaggauuuccggaacaau

SEQ ID NO: 2072856 - RNA, 13 nt, Staphylococcus aureus subsp. aureus Mu50
uaggcaagguauu

SEQ ID NO: 2072857 - RNA, 17 nt, Staphylococcus aureus subsp. aureus Mu50
uaggauuuacaccuaua

SEQ ID NO: 2072858 - RNA, 17 nt, Staphylococcus aureus subsp. aureus Mu50
uaggauuugcaccuaua

SEQ ID NO: 2072859 - RNA, 23 nt, Staphylococcus aureus subsp. aureus Mu50
uaggaauuguuaauuucaacauu

SEQ ID NO: 2072860 - RNA, 21 nt, Staphylococcus aureus subsp. aureus Mu50
uagcuugagcaucuuuuacug

SEQ ID NO: 2072861 - RNA, 18 nt, Staphylococcus aureus subsp. aureus Mu50
uagcuuucguuucuuuua

SEQ ID NO: 2072862 - RNA, 16 nt, Staphylococcus aureus subsp. aureus Mu50
uagcuuucuuuuucau

SEQ ID NO: 2072863 - RNA, 21 nt, Staphylococcus aureus subsp. aureus Mu50
uagcuucuuaaaucaacauca

SEQ ID NO: 2072864 - RNA, 15 nt, Staphylococcus aureus subsp. aureus Mu50
uagcuugaauaauau

SEQ ID NO: 2072865 - RNA, 17 nt, Staphylococcus aureus subsp. aureus Mu50
uagcuugaauaauauau

SEQ ID NO: 2072866 - RNA, 18 nt, Staphylococcus aureus subsp. aureus Mu50
uagcuugaauaauauauu

SEQ ID NO: 2072867 - RNA, 12 nt, Staphylococcus aureus subsp. aureus Mu50
uagcucuucuuu

SEQ ID NO: 2072868 - RNA, 14 nt, Staphylococcus aureus subsp. aureus Mu50
uagcucuucuuuuu

SEQ ID NO: 2072869 - RNA, 15 nt, Staphylococcus aureus subsp. aureus Mu50
uagcucuuuuuugau

SEQ ID NO: 2072870 - RNA, 16 nt, Staphylococcus aureus subsp. aureus Mu50
uagcuggcuuuuuaau

SEQ ID NO: 2072871 - RNA, 18 nt, Staphylococcus aureus subsp. aureus Mu50
uagcuucgucacguaaaa

SEQ ID NO: 2072872 - RNA, 20 nt, Staphylococcus aureus subsp. aureus Mu50
uagcuuagucaauguauauu

SEQ ID NO: 2072873 - RNA, 16 nt, Staphylococcus aureus subsp. aureus Mu50
uagcucaauugaaucu

SEQ ID NO: 2072874 - RNA, 18 nt, Staphylococcus aureus subsp. aureus Mu50
uagcucauuacaaagucu

SEQ ID NO: 2072875 - RNA, 17 nt, Staphylococcus aureus subsp. aureus Mu50
uagcuacaauuaaagug

SEQ ID NO: 2072876 - RNA, 18 nt, Staphylococcus aureus subsp. aureus Mu50
uagcuauauuuuuguauu

SEQ ID NO: 2072877 - RNA, 23 nt, Staphylococcus aureus subsp. aureus Mu50
uagcuauaacucuaaauauaaua

SEQ ID NO: 2072878 - RNA, 19 nt, Staphylococcus aureus subsp. aureus Mu50
uagcgugauuuuucauauu

SEQ ID NO: 2072879 - RNA, 17 nt, Staphylococcus aureus subsp. aureus Mu50
uagcuaagauacuuuua

SEQ ID NO: 2072880 - RNA, 20 nt, Staphylococcus aureus subsp. aureus Mu50
uagcuaagauacuuuuaaau

SEQ ID NO: 2072881 - RNA, 22 nt, Staphylococcus aureus subsp. aureus Mu50
uagcuaaugcauuauuauaaua

SEQ ID NO: 2072882 - RNA, 13 nt, Staphylococcus aureus subsp. aureus Mu50
uagcuaaagcuug

SEQ ID NO: 2072883 - RNA, 14 nt, Staphylococcus aureus subsp. aureus Mu50
uagccuauuuaaaa

SEQ ID NO: 2072884 - RNA, 20 nt, Staphylococcus aureus subsp. aureus Mu50
uagcgaaaguaucuaugaaa

SEQ ID NO: 2072885 - RNA, 22 nt, Staphylococcus aureus subsp. aureus Mu50
uagcgcaagagauaagaaaaua

SEQ ID NO: 2072886 - RNA, 22 nt, Staphylococcus aureus subsp. aureus Mu50
uagcgcucuggauuuuucuuau

SEQ ID NO: 2072887 - RNA, 21 nt, Staphylococcus aureus subsp. aureus Mu50
uagcgcgcuuauugaaaagau

SEQ ID NO: 2072888 - RNA, 22 nt, Staphylococcus aureus subsp. aureus Mu50
uagcguaauuauuauaauaaau

SEQ ID NO: 2072889 - RNA, 15 nt, Staphylococcus aureus subsp. aureus Mu50
uagcgucaaguuuuc

SEQ ID NO: 2072890 - RNA, 14 nt, Staphylococcus aureus subsp. aureus Mu50
uagcguagcgaaag

SEQ ID NO: 2072891 - RNA, 13 nt, Staphylococcus aureus subsp. aureus Mu50
uauaacugcaugu

SEQ ID NO: 2072892 - RNA, 16 nt, Staphylococcus aureus subsp. aureus Mu50
uauaacuuuaaaaauu

SEQ ID NO: 2072893 - RNA, 15 nt, Staphylococcus aureus subsp. aureus Mu50
uauaacuuuaaaaau

SEQ ID NO: 2072894 - RNA, 16 nt, Staphylococcus aureus subsp. aureus Mu50
uauacagguuuaauaa

SEQ ID NO: 2072895 - RNA, 20 nt, Staphylococcus aureus subsp. aureus Mu50
uauacagguuuaauaaauuu

SEQ ID NO: 2072896 - RNA, 18 nt, Staphylococcus aureus subsp. aureus Mu50
uauacaguuuuacuauaa

SEQ ID NO: 2072897 - RNA, 19 nt, Staphylococcus aureus subsp. aureus Mu50
uauacauaacccuaaaaug

SEQ ID NO: 2072898 - RNA, 21 nt, Staphylococcus aureus subsp. aureus Mu50
uauacauaccacacuuuaaac

SEQ ID NO: 2072899 - RNA, 17 nt, Staphylococcus aureus subsp. aureus Mu50
uauacauugauaaauuu

SEQ ID NO: 2072900 - RNA, 14 nt, Staphylococcus aureus subsp. aureus Mu50
uauaccaaccaaaa

SEQ ID NO: 2072901 - RNA, 22 nt, Staphylococcus aureus subsp. aureus Mu50
uauaccuagggaugauauaguu

SEQ ID NO: 2072902 - RNA, 17 nt, Staphylococcus aureus subsp. aureus Mu50
uauaccauuccaaaaau

SEQ ID NO: 2072903 - RNA, 20 nt, Staphylococcus aureus subsp. aureus Mu50
uauacgugcuuuaaaguugu

SEQ ID NO: 2072904 - RNA, 19 nt, Staphylococcus aureus subsp. aureus Mu50
uauacuaaacuuuuuucaa

SEQ ID NO: 2072905 - RNA, 14 nt, Staphylococcus aureus subsp. aureus Mu50
uauacucauuuucu

SEQ ID NO: 2072906 - RNA, 23 nt, Staphylococcus aureus subsp. aureus Mu50
uauagaaaaugaguacaacauag

SEQ ID NO: 2072907 - RNA, 17 nt, Staphylococcus aureus subsp. aureus Mu50
uauagaaaccaaaaaau

SEQ ID NO: 2072908 - RNA, 15 nt, Staphylococcus aureus subsp. aureus Mu50
uauacuuuuggucug

SEQ ID NO: 2072909 - RNA, 20 nt, Staphylococcus aureus subsp. aureus Mu50
uauacuuuuggucuguugaa

SEQ ID NO: 2072910 - RNA, 13 nt, Staphylococcus aureus subsp. aureus Mu50
uauacuuuuuaaa

SEQ ID NO: 2072911 - RNA, 19 nt, Staphylococcus aureus subsp. aureus Mu50
uauacuugaugaaacugau

SEQ ID NO: 2072912 - RNA, 15 nt, Staphylococcus aureus subsp. aureus Mu50
uauacuuuuauagaa

SEQ ID NO: 2072913 - RNA, 16 nt, Staphylococcus aureus subsp. aureus Mu50
uauacuuuuauagaaa

SEQ ID NO: 2072914 - RNA, 14 nt, Staphylococcus aureus subsp. aureus Mu50
uauagauuuaaaga

SEQ ID NO: 2072915 - RNA, 21 nt, Staphylococcus aureus subsp. aureus Mu50
uauagcaaauugauuaaauaa

SEQ ID NO: 2072916 - RNA, 20 nt, Staphylococcus aureus subsp. aureus Mu50
uauagcaccauuauuaaaug

SEQ ID NO: 2072917 - RNA, 20 nt, Staphylococcus aureus subsp. aureus Mu50
uauagauuuuguauuagcau

SEQ ID NO: 2072918 - RNA, 16 nt, Staphylococcus aureus subsp. aureus Mu50
uauagcaucuaugauu

SEQ ID NO: 2072919 - RNA, 18 nt, Staphylococcus aureus subsp. aureus Mu50
uauagcaucuaugauugu

SEQ ID NO: 2072920 - RNA, 21 nt, Staphylococcus aureus subsp. aureus Mu50
uauagccaaaggcaaaaugua

SEQ ID NO: 2072921 - RNA, 22 nt, Staphylococcus aureus subsp. aureus Mu50
uauagaauucacgcaauaucau

SEQ ID NO: 2072922 - RNA, 16 nt, Staphylococcus aureus subsp. aureus Mu50
uauagaccguugaaau

SEQ ID NO: 2072923 - RNA, 16 nt, Staphylococcus aureus subsp. aureus Mu50
uauagagccaugaaaa

SEQ ID NO: 2072924 - RNA, 17 nt, Staphylococcus aureus subsp. aureus Mu50
uauagauaggauauuuu

SEQ ID NO: 2072925 - RNA, 14 nt, Staphylococcus aureus subsp. aureus Mu50
uauagauugccauu

SEQ ID NO: 2072926 - RNA, 23 nt, Staphylococcus aureus subsp. aureus Mu50
uauagaugacuguagaaaacaug

SEQ ID NO: 2072927 - RNA, 17 nt, Staphylococcus aureus subsp. aureus Mu50
uauagauuguauuuaau

SEQ ID NO: 2072928 - RNA, 15 nt, Staphylococcus aureus subsp. aureus Mu50
uauagaugugucuuu

SEQ ID NO: 2072929 - RNA, 20 nt, Staphylococcus aureus subsp. aureus Mu50
uauauauucguuacaaauga

SEQ ID NO: 2072930 - RNA, 19 nt, Staphylococcus aureus subsp. aureus Mu50
uauaucaaauacauuucaa

SEQ ID NO: 2072931 - RNA, 23 nt, Staphylococcus aureus subsp. aureus Mu50
uauaucaaauacauuucaaaaaa

SEQ ID NO: 2072932 - RNA, 19 nt, Staphylococcus aureus subsp. aureus Mu50
uauaucaacguuaauauaa

SEQ ID NO: 2072933 - RNA, 20 nt, Staphylococcus aureus subsp. aureus Mu50
uauaucaacguuaauauaac

SEQ ID NO: 2072934 - RNA, 13 nt, Staphylococcus aureus subsp. aureus Mu50
uauauaauuuaaa

SEQ ID NO: 2072935 - RNA, 14 nt, Staphylococcus aureus subsp. aureus Mu50
uauauaauuuaaag

SEQ ID NO: 2072936 - RNA, 16 nt, Staphylococcus aureus subsp. aureus Mu50
uauauaauuuaaagaa

SEQ ID NO: 2072937 - RNA, 18 nt, Staphylococcus aureus subsp. aureus Mu50
uauauaauuuauaaaaag

SEQ ID NO: 2072938 - RNA, 16 nt, Staphylococcus aureus subsp. aureus Mu50
uauauaauuuauaaaa

SEQ ID NO: 2072939 - RNA, 20 nt, Staphylococcus aureus subsp. aureus Mu50
uauauacaaugacagcagac

SEQ ID NO: 2072940 - RNA, 18 nt, Staphylococcus aureus subsp. aureus Mu50
uauauacccaccacauuu

SEQ ID NO: 2072941 - RNA, 23 nt, Staphylococcus aureus subsp. aureus Mu50
uauauacgauugaguugaaaaua

SEQ ID NO: 2072942 - RNA, 23 nt, Staphylococcus aureus subsp. aureus Mu50
uauauaaugguucuauaauaaau

SEQ ID NO: 2072943 - RNA, 20 nt, Staphylococcus aureus subsp. aureus Mu50
uauagugucgagauuuuaua

SEQ ID NO: 2072944 - RNA, 14 nt, Staphylococcus aureus subsp. aureus Mu50
uauagugguaaaaa

SEQ ID NO: 2072945 - RNA, 22 nt, Staphylococcus aureus subsp. aureus Mu50
uauagugcuuguuuauuacaua

SEQ ID NO: 2072946 - RNA, 13 nt, Staphylococcus aureus subsp. aureus Mu50
uauagucauucau

SEQ ID NO: 2072947 - RNA, 16 nt, Staphylococcus aureus subsp. aureus Mu50
uauagucuuaaacaua

SEQ ID NO: 2072948 - RNA, 17 nt, Staphylococcus aureus subsp. aureus Mu50
uauagucuuaaacauaa

SEQ ID NO: 2072949 - RNA, 14 nt, Staphylococcus aureus subsp. aureus Mu50
uauauccauucaau

SEQ ID NO: 2072950 - RNA, 17 nt, Staphylococcus aureus subsp. aureus Mu50
uauauucguuacaaaug

SEQ ID NO: 2072951 - RNA, 19 nt, Staphylococcus aureus subsp. aureus Mu50
uauauugagacaacauugu

SEQ ID NO: 2072952 - RNA, 23 nt, Staphylococcus aureus subsp. aureus Mu50
uauaucacaacacauaaauuaag

SEQ ID NO: 2072953 - RNA, 14 nt, Staphylococcus aureus subsp. aureus Mu50
uauauauuuugcaa

SEQ ID NO: 2072954 - RNA, 16 nt, Staphylococcus aureus subsp. aureus Mu50
uauauccaguaaaguu

SEQ ID NO: 2072955 - RNA, 21 nt, Staphylococcus aureus subsp. aureus Mu50
uaucaaaaccgcuauaaaauu

SEQ ID NO: 2072956 - RNA, 20 nt, Staphylococcus aureus subsp. aureus Mu50
uaucaaaaccgcuauaaaau

SEQ ID NO: 2072957 - RNA, 16 nt, Staphylococcus aureus subsp. aureus Mu50
uauauuuuuguauuua

SEQ ID NO: 2072958 - RNA, 20 nt, Staphylococcus aureus subsp. aureus Mu50
uauauugucgacuuuuagau

SEQ ID NO: 2072959 - RNA, 16 nt, Staphylococcus aureus subsp. aureus Mu50
uauauuuuguuaauaa

SEQ ID NO: 2072960 - RNA, 14 nt, Staphylococcus aureus subsp. aureus Mu50
uauauuuuuauuaa

SEQ ID NO: 2072961 - RNA, 17 nt, Staphylococcus aureus subsp. aureus Mu50
uaucaacagcuucaaaa

SEQ ID NO: 2072962 - RNA, 15 nt, Staphylococcus aureus subsp. aureus Mu50
uaucaauagaugaaa

SEQ ID NO: 2072963 - RNA, 18 nt, Staphylococcus aureus subsp. aureus Mu50
uaucaaauuaccauucau

SEQ ID NO: 2072964 - RNA, 18 nt, Staphylococcus aureus subsp. aureus Mu50
uaucaaacggaauuaaag

SEQ ID NO: 2072965 - RNA, 21 nt, Staphylococcus aureus subsp. aureus Mu50
uaucaaacuuggcaaugaaau

SEQ ID NO: 2072966 - RNA, 17 nt, Staphylococcus aureus subsp. aureus Mu50
uaucaaaauauaaaauc

SEQ ID NO: 2072967 - RNA, 16 nt, Staphylococcus aureus subsp. aureus Mu50
uaucaaaauauaaaau

SEQ ID NO: 2072968 - RNA, 17 nt, Staphylococcus aureus subsp. aureus Mu50
uaucaauagaugaaaau

SEQ ID NO: 2072969 - RNA, 21 nt, Staphylococcus aureus subsp. aureus Mu50
uaucaugauagccgcuucauu

SEQ ID NO: 2072970 - RNA, 15 nt, Staphylococcus aureus subsp. aureus Mu50
uaucauguucuuaua

SEQ ID NO: 2072971 - RNA, 14 nt, Staphylococcus aureus subsp. aureus Mu50
uaucaugauuaauu

SEQ ID NO: 2072972 - RNA, 23 nt, Staphylococcus aureus subsp. aureus Mu50
uaucaugcaaaacuaaucaaauu

SEQ ID NO: 2072973 - RNA, 20 nt, Staphylococcus aureus subsp. aureus Mu50
uaucauuacagauaauuauu

SEQ ID NO: 2072974 - RNA, 15 nt, Staphylococcus aureus subsp. aureus Mu50
uaucaugcaaaauaa

SEQ ID NO: 2072975 - RNA, 14 nt, Staphylococcus aureus subsp. aureus Mu50
uaucaugcuuuuaa

SEQ ID NO: 2072976 - RNA, 13 nt, Staphylococcus aureus subsp. aureus Mu50
uaucauuaucaaa

SEQ ID NO: 2072977 - RNA, 18 nt, Staphylococcus aureus subsp. aureus Mu50
uaucauuaucaaauaacc

SEQ ID NO: 2072978 - RNA, 20 nt, Staphylococcus aureus subsp. aureus Mu50
uaucauuaucaaauaaccua

SEQ ID NO: 2072979 - RNA, 18 nt, Staphylococcus aureus subsp. aureus Mu50
uaucacuuauuauuuugu

SEQ ID NO: 2072980 - RNA, 15 nt, Staphylococcus aureus subsp. aureus Mu50
uaucaguaauaauac

SEQ ID NO: 2072981 - RNA, 18 nt, Staphylococcus aureus subsp. aureus Mu50
uaucauuguucauacgcu

SEQ ID NO: 2072982 - RNA, 17 nt, Staphylococcus aureus subsp. aureus Mu50
uaucauuuaaaauauuu

SEQ ID NO: 2072983 - RNA, 22 nt, Staphylococcus aureus subsp. aureus Mu50
uaucauuguguccauaaauauu

SEQ ID NO: 2072984 - RNA, 16 nt, Staphylococcus aureus subsp. aureus Mu50
uaucauuucaaauaag

SEQ ID NO: 2072985 - RNA, 20 nt, Staphylococcus aureus subsp. aureus Mu50
uauccaaggauguuauaaaa

SEQ ID NO: 2072986 - RNA, 21 nt, Staphylococcus aureus subsp. aureus Mu50
uauccaauacuaccuuccauu

SEQ ID NO: 2072987 - RNA, 21 nt, Staphylococcus aureus subsp. aureus Mu50
uaguuuucuuaaaagagcaag

SEQ ID NO: 2072988 - RNA, 21 nt, Staphylococcus aureus subsp. aureus Mu50
uaguuugauaugcucucuuca

SEQ ID NO: 2072989 - RNA, 20 nt, Staphylococcus aureus subsp. aureus Mu50
uaguuugacaucuauuucuu

SEQ ID NO: 2072990 - RNA, 15 nt, Staphylococcus aureus subsp. aureus Mu50
uaguuuguaauaauu

SEQ ID NO: 2072991 - RNA, 18 nt, Staphylococcus aureus subsp. aureus Mu50
uaguuucugacuuuuaaa

SEQ ID NO: 2072992 - RNA, 19 nt, Staphylococcus aureus subsp. aureus Mu50
uauaaaaaauuauuaaaaa

SEQ ID NO: 2072993 - RNA, 21 nt, Staphylococcus aureus subsp. aureus Mu50
uauaaaaagugcauauuuaau

SEQ ID NO: 2072994 - RNA, 20 nt, Staphylococcus aureus subsp. aureus Mu50
uauaaaaagaucauuaaaaa

SEQ ID NO: 2072995 - RNA, 23 nt, Staphylococcus aureus subsp. aureus Mu50
uauaaaaagucccgcuuaaaaug

SEQ ID NO: 2072996 - RNA, 14 nt, Staphylococcus aureus subsp. aureus Mu50
uauaaaaagaauau

SEQ ID NO: 2072997 - RNA, 23 nt, Staphylococcus aureus subsp. aureus Mu50
uauaaaaagaauaugauauugau

SEQ ID NO: 2072998 - RNA, 15 nt, Staphylococcus aureus subsp. aureus Mu50
uaguuuuuuuuauau

SEQ ID NO: 2072999 - RNA, 14 nt, Staphylococcus aureus subsp. aureus Mu50
uaguuuuuaaaauu

SEQ ID NO: 2073000 - RNA, 17 nt, Staphylococcus aureus subsp. aureus Mu50
uauaaaccgccaacuaa

SEQ ID NO: 2073001 - RNA, 22 nt, Staphylococcus aureus subsp. aureus Mu50
uauaaacgucacuuuauuaaau

SEQ ID NO: 2073002 - RNA, 13 nt, Staphylococcus aureus subsp. aureus Mu50
uauaaacauuuau

SEQ ID NO: 2073003 - RNA, 22 nt, Staphylococcus aureus subsp. aureus Mu50
uauaaaacagaauuucaucaaa

SEQ ID NO: 2073004 - RNA, 21 nt, Staphylococcus aureus subsp. aureus Mu50
uauaaaaauuuauucaaaauu

SEQ ID NO: 2073005 - RNA, 14 nt, Staphylococcus aureus subsp. aureus Mu50
uauaaauuauauuu

SEQ ID NO: 2073006 - RNA, 16 nt, Staphylococcus aureus subsp. aureus Mu50
uauaaauuauauuuau

SEQ ID NO: 2073007 - RNA, 18 nt, Staphylococcus aureus subsp. aureus Mu50
uauaaauuauauuuauuu

SEQ ID NO: 2073008 - RNA, 23 nt, Staphylococcus aureus subsp. aureus Mu50
uauaaagaaugauuuauaaaaaa

SEQ ID NO: 2073009 - RNA, 15 nt, Staphylococcus aureus subsp. aureus Mu50
uauaaaugucauagu

SEQ ID NO: 2073010 - RNA, 16 nt, Staphylococcus aureus subsp. aureus Mu50
uauaaauguuauugcu

SEQ ID NO: 2073011 - RNA, 20 nt, Staphylococcus aureus subsp. aureus Mu50
uauaaagaaugauuuauaaa

SEQ ID NO: 2073012 - RNA, 20 nt, Staphylococcus aureus subsp. aureus Mu50
uauaaagaaauaauuuaaag

SEQ ID NO: 2073013 - RNA, 16 nt, Staphylococcus aureus subsp. aureus Mu50
uauaacaccaauuaaa

SEQ ID NO: 2073014 - RNA, 20 nt, Staphylococcus aureus subsp. aureus Mu50
uauaacacuucguauugaau

SEQ ID NO: 2073015 - RNA, 15 nt, Staphylococcus aureus subsp. aureus Mu50
uauaaauuuugaauu

SEQ ID NO: 2073016 - RNA, 20 nt, Staphylococcus aureus subsp. aureus Mu50
uauaaauuuguaccaaauaa

SEQ ID NO: 2073017 - RNA, 18 nt, Staphylococcus aureus subsp. aureus Mu50
uauaacaauaguuuucuu

SEQ ID NO: 2073018 - RNA, 13 nt, Staphylococcus aureus subsp. aureus Mu50
uagugcucuugca

SEQ ID NO: 2073019 - RNA, 19 nt, Staphylococcus aureus subsp. aureus Mu50
uagugcgcuuauuuuacua

SEQ ID NO: 2073020 - RNA, 20 nt, Staphylococcus aureus subsp. aureus Mu50
uagugcgcgauaaauaauaa

SEQ ID NO: 2073021 - RNA, 16 nt, Staphylococcus aureus subsp. aureus Mu50
uagugauuuuuuacau

SEQ ID NO: 2073022 - RNA, 16 nt, Staphylococcus aureus subsp. aureus Mu50
uaguccggggccccaa

SEQ ID NO: 2073023 - RNA, 16 nt, Staphylococcus aureus subsp. aureus Mu50
uagucauuacaaauca

SEQ ID NO: 2073024 - RNA, 12 nt, Staphylococcus aureus subsp. aureus Mu50
uagucauguuug

SEQ ID NO: 2073025 - RNA, 18 nt, Staphylococcus aureus subsp. aureus Mu50
uaguauugguaccuuucc

SEQ ID NO: 2073026 - RNA, 22 nt, Staphylococcus aureus subsp. aureus Mu50
uaguuuauugccgguuaaauua

SEQ ID NO: 2073027 - RNA, 14 nt, Staphylococcus aureus subsp. aureus Mu50
uaguuuagguugau

SEQ ID NO: 2073028 - RNA, 13 nt, Staphylococcus aureus subsp. aureus Mu50
uaguuuauaaauu

SEQ ID NO: 2073029 - RNA, 14 nt, Staphylococcus aureus subsp. aureus Mu50
uaguguguuuaaaa

SEQ ID NO: 2073030 - RNA, 18 nt, Staphylococcus aureus subsp. aureus Mu50
uaguguucucauuauaau

SEQ ID NO: 2073031 - RNA, 20 nt, Staphylococcus aureus subsp. aureus Mu50
uaguucacaugaauuuuaau

SEQ ID NO: 2073032 - RNA, 12 nt, Staphylococcus aureus subsp. aureus Mu50
uaguuaaauaca

SEQ ID NO: 2073033 - RNA, 23 nt, Staphylococcus aureus subsp. aureus Mu50
uaguucaaauugaacuucuuuuu

SEQ ID NO: 2073034 - RNA, 16 nt, Staphylococcus aureus subsp. aureus Mu50
uagguacaacuaaaua

SEQ ID NO: 2073035 - RNA, 17 nt, Staphylococcus aureus subsp. aureus Mu50
uaggguauugaaauaau

SEQ ID NO: 2073036 - RNA, 21 nt, Staphylococcus aureus subsp. aureus Mu50
uaggucaacuguaguggaaga

SEQ ID NO: 2073037 - RNA, 19 nt, Staphylococcus aureus subsp. aureus Mu50
uagguauaguguuugacaa

SEQ ID NO: 2073038 - RNA, 15 nt, Staphylococcus aureus subsp. aureus Mu50
uagguauaaucauuu

SEQ ID NO: 2073039 - RNA, 18 nt, Staphylococcus aureus subsp. aureus Mu50
uaggucuacgaucaaaau

SEQ ID NO: 2073040 - RNA, 16 nt, Staphylococcus aureus subsp. aureus Mu50
uaguaguacacgaauu

SEQ ID NO: 2073041 - RNA, 15 nt, Staphylococcus aureus subsp. aureus Mu50
uaguagcuugaauag

SEQ ID NO: 2073042 - RNA, 16 nt, Staphylococcus aureus subsp. aureus Mu50
uaguagauuuauuaaa

SEQ ID NO: 2073043 - RNA, 23 nt, Staphylococcus aureus subsp. aureus Mu50
uaguacuaaaccgauuaauauaa

SEQ ID NO: 2073044 - RNA, 16 nt, Staphylococcus aureus subsp. aureus Mu50
uaguacucaauguuag

SEQ ID NO: 2073045 - RNA, 23 nt, Staphylococcus aureus subsp. aureus Mu50
uaguaaaauaaauacaauagaaa

SEQ ID NO: 2073046 - RNA, 21 nt, Staphylococcus aureus subsp. aureus Mu50
uaggcucuuaauguacuuuuc

SEQ ID NO: 2073047 - RNA, 16 nt, Staphylococcus aureus subsp. aureus Mu50
uagggauaauuuuauu

SEQ ID NO: 2073048 - RNA, 16 nt, Staphylococcus aureus subsp. aureus Mu50
uaggcaacugcaagug

SEQ ID NO: 2073049 - RNA, 20 nt, Staphylococcus aureus subsp. aureus Mu50
uaggcgccauaaucauuagu

SEQ ID NO: 2073050 - RNA, 16 nt, Staphylococcus aureus subsp. aureus Mu50
uaaaucaaagaggaac

SEQ ID NO: 2073051 - RNA, 16 nt, Staphylococcus aureus subsp. aureus Mu50
uaaauauuuuuuaaaa

SEQ ID NO: 2073052 - RNA, 15 nt, Staphylococcus aureus subsp. aureus Mu50
uaaauauuuuuaauu

SEQ ID NO: 2073053 - RNA, 15 nt, Staphylococcus aureus subsp. aureus Mu50
uaaauauuuuuuaaa

SEQ ID NO: 2073054 - RNA, 13 nt, Staphylococcus aureus subsp. aureus Mu50
uaaaucaagaaau

SEQ ID NO: 2073055 - RNA, 14 nt, Staphylococcus aureus subsp. aureus Mu50
uaaaucaagaaaug

SEQ ID NO: 2073056 - RNA, 18 nt, Staphylococcus aureus subsp. aureus Mu50
uaaaucuaagugguugaa

SEQ ID NO: 2073057 - RNA, 22 nt, Staphylococcus aureus subsp. aureus Mu50
uaaaucuaauacuuucaaacaa

SEQ ID NO: 2073058 - RNA, 17 nt, Staphylococcus aureus subsp. aureus Mu50
uaaaucaagaaauguua

SEQ ID NO: 2073059 - RNA, 16 nt, Staphylococcus aureus subsp. aureus Mu50
uaaaucugauucauua

SEQ ID NO: 2073060 - RNA, 23 nt, Staphylococcus aureus subsp. aureus Mu50
uaaaucuuguuggauuuuaacaa

SEQ ID NO: 2073061 - RNA, 21 nt, Staphylococcus aureus subsp. aureus Mu50
uaaaucuguuuaaauuuaaaa

SEQ ID NO: 2073062 - RNA, 19 nt, Staphylococcus aureus subsp. aureus Mu50
uaaaucuucuaguaauucu

SEQ ID NO: 2073063 - RNA, 15 nt, Staphylococcus aureus subsp. aureus Mu50
uaaaucuuuaaaugu

SEQ ID NO: 2073064 - RNA, 21 nt, Staphylococcus aureus subsp. aureus Mu50
uaaaugaaaguaccuaaaaua

SEQ ID NO: 2073065 - RNA, 23 nt, Staphylococcus aureus subsp. aureus Mu50
uaaaugaaaguaccuaaaauaga

SEQ ID NO: 2073066 - RNA, 16 nt, Staphylococcus aureus subsp. aureus Mu50
uaaauguauuaaacau

SEQ ID NO: 2073067 - RNA, 17 nt, Staphylococcus aureus subsp. aureus Mu50
uaaauguuaaauucuaa

SEQ ID NO: 2073068 - RNA, 14 nt, Staphylococcus aureus subsp. aureus Mu50
uaaaugugcaauua

SEQ ID NO: 2073069 - RNA, 19 nt, Staphylococcus aureus subsp. aureus Mu50
uaaaugugcaauuagaaua

SEQ ID NO: 2073070 - RNA, 18 nt, Staphylococcus aureus subsp. aureus Mu50
uaaauguuaaauucuaaa

SEQ ID NO: 2073071 - RNA, 19 nt, Staphylococcus aureus subsp. aureus Mu50
uaaauguuaaauucuaaaa

SEQ ID NO: 2073072 - RNA, 16 nt, Staphylococcus aureus subsp. aureus Mu50
uaaaugucacugcaaa

SEQ ID NO: 2073073 - RNA, 19 nt, Staphylococcus aureus subsp. aureus Mu50
uaaaugucacugcaaacac

SEQ ID NO: 2073074 - RNA, 21 nt, Staphylococcus aureus subsp. aureus Mu50
uaaaugucacugcaaacacag

SEQ ID NO: 2073075 - RNA, 14 nt, Staphylococcus aureus subsp. aureus Mu50
uaaaugucuuucaa

SEQ ID NO: 2073076 - RNA, 17 nt, Staphylococcus aureus subsp. aureus Mu50
uaaaugucuuucaaaua

SEQ ID NO: 2073077 - RNA, 21 nt, Staphylococcus aureus subsp. aureus Mu50
uaaaugucuuucaaauacaca

SEQ ID NO: 2073078 - RNA, 16 nt, Staphylococcus aureus subsp. aureus Mu50
uaaaugacuucacauu

SEQ ID NO: 2073079 - RNA, 18 nt, Staphylococcus aureus subsp. aureus Mu50
uaaaugacugaauuaaua

SEQ ID NO: 2073080 - RNA, 17 nt, Staphylococcus aureus subsp. aureus Mu50
uaaaugaugcaguaaaa

SEQ ID NO: 2073081 - RNA, 20 nt, Staphylococcus aureus subsp. aureus Mu50
uaaaugcccaccauguacau

SEQ ID NO: 2073082 - RNA, 16 nt, Staphylococcus aureus subsp. aureus Mu50
uaaaugcaauacauua

SEQ ID NO: 2073083 - RNA, 16 nt, Staphylococcus aureus subsp. aureus Mu50
uaaaugauuuaauaaa

SEQ ID NO: 2073084 - RNA, 18 nt, Staphylococcus aureus subsp. aureus Mu50
uaaaugaugcaguaaaac

SEQ ID NO: 2073085 - RNA, 20 nt, Staphylococcus aureus subsp. aureus Mu50
uaaaugaugcaguaaaacca

SEQ ID NO: 2073086 - RNA, 17 nt, Staphylococcus aureus subsp. aureus Mu50
uaaauuuuauauauccu

SEQ ID NO: 2073087 - RNA, 13 nt, Staphylococcus aureus subsp. aureus Mu50
uaacaaagucucu

SEQ ID NO: 2073088 - RNA, 20 nt, Staphylococcus aureus subsp. aureus Mu50
uaacaauagugacuuuuaua

SEQ ID NO: 2073089 - RNA, 20 nt, Staphylococcus aureus subsp. aureus Mu50
uaacaaccgucccauaaaag

SEQ ID NO: 2073090 - RNA, 21 nt, Staphylococcus aureus subsp. aureus Mu50
uaacaauacuacuuaaugacu

SEQ ID NO: 2073091 - RNA, 22 nt, Staphylococcus aureus subsp. aureus Mu50
uaaauuucuucauaguucaaau

SEQ ID NO: 2073092 - RNA, 14 nt, Staphylococcus aureus subsp. aureus Mu50
uaaauuuaguaucu

SEQ ID NO: 2073093 - RNA, 15 nt, Staphylococcus aureus subsp. aureus Mu50
uaaauuugaaaguaa

SEQ ID NO: 2073094 - RNA, 17 nt, Staphylococcus aureus subsp. aureus Mu50
uaaauuugaaaguaaau

SEQ ID NO: 2073095 - RNA, 19 nt, Staphylococcus aureus subsp. aureus Mu50
uaaauuuguaccaaauaaa

SEQ ID NO: 2073096 - RNA, 18 nt, Staphylococcus aureus subsp. aureus Mu50
uaaauuuuauauauccug

SEQ ID NO: 2073097 - RNA, 13 nt, Staphylococcus aureus subsp. aureus Mu50
uaaauuacuauau

SEQ ID NO: 2073098 - RNA, 15 nt, Staphylococcus aureus subsp. aureus Mu50
uaaauuacuauauuu

SEQ ID NO: 2073099 - RNA, 23 nt, Staphylococcus aureus subsp. aureus Mu50
uaaauuagugguuagcuauauuu

SEQ ID NO: 2073100 - RNA, 14 nt, Staphylococcus aureus subsp. aureus Mu50
uaaauugauucuuu

SEQ ID NO: 2073101 - RNA, 23 nt, Staphylococcus aureus subsp. aureus Mu50
uaaauuauggagcggaagauagg

SEQ ID NO: 2073102 - RNA, 18 nt, Staphylococcus aureus subsp. aureus Mu50
uaaauuaucuaaagaaau

SEQ ID NO: 2073103 - RNA, 13 nt, Staphylococcus aureus subsp. aureus Mu50
uaaauuauauacc

SEQ ID NO: 2073104 - RNA, 19 nt, Staphylococcus aureus subsp. aureus Mu50
uaaauuguaugaauaauau

SEQ ID NO: 2073105 - RNA, 15 nt, Staphylococcus aureus subsp. aureus Mu50
uaaauuguauuucuu

SEQ ID NO: 2073106 - RNA, 23 nt, Staphylococcus aureus subsp. aureus Mu50
uaaauugucacaaucuguucaua

SEQ ID NO: 2073107 - RNA, 18 nt, Staphylococcus aureus subsp. aureus Mu50
uaaauugcuugaaauuau

SEQ ID NO: 2073108 - RNA, 17 nt, Staphylococcus aureus subsp. aureus Mu50
uaaauuuaaaagaaaaa

SEQ ID NO: 2073109 - RNA, 14 nt, Staphylococcus aureus subsp. aureus Mu50
uaaauuuaaaagaa

SEQ ID NO: 2073110 - RNA, 16 nt, Staphylococcus aureus subsp. aureus Mu50
uaaauuuaaaauaaua

SEQ ID NO: 2073111 - RNA, 18 nt, Staphylococcus aureus subsp. aureus Mu50
uaaauuuaacguuauuca

SEQ ID NO: 2073112 - RNA, 15 nt, Staphylococcus aureus subsp. aureus Mu50
uaacaauauuaaauu

SEQ ID NO: 2073113 - RNA, 19 nt, Staphylococcus aureus subsp. aureus Mu50
uaacaauaguuuucuucac

SEQ ID NO: 2073114 - RNA, 17 nt, Staphylococcus aureus subsp. aureus Mu50
uaacaaucguuuuaaug

SEQ ID NO: 2073115 - RNA, 13 nt, Staphylococcus aureus subsp. aureus Mu50
uaacaaugcgauu

SEQ ID NO: 2073116 - RNA, 23 nt, Staphylococcus aureus subsp. aureus Mu50
uaacaaugcagcuguauuuaaua

SEQ ID NO: 2073117 - RNA, 21 nt, Staphylococcus aureus subsp. aureus Mu50
uaacaggugcuuacuuuuaaa

SEQ ID NO: 2073118 - RNA, 23 nt, Staphylococcus aureus subsp. aureus Mu50
uaacagcugcagucgcaauggca

SEQ ID NO: 2073119 - RNA, 18 nt, Staphylococcus aureus subsp. aureus Mu50
uaacagcuacaaauaaug

SEQ ID NO: 2073120 - RNA, 23 nt, Staphylococcus aureus subsp. aureus Mu50
uaacauguuuguggcaccucuuu

SEQ ID NO: 2073121 - RNA, 21 nt, Staphylococcus aureus subsp. aureus Mu50
uaacauuagcauuaaauucca

SEQ ID NO: 2073122 - RNA, 16 nt, Staphylococcus aureus subsp. aureus Mu50
uaacauucuucaaaaa

SEQ ID NO: 2073123 - RNA, 18 nt, Staphylococcus aureus subsp. aureus Mu50
uaacauucuucaaaaaau

SEQ ID NO: 2073124 - RNA, 19 nt, Staphylococcus aureus subsp. aureus Mu50
uaacauucuucaaaaaaua

SEQ ID NO: 2073125 - RNA, 21 nt, Staphylococcus aureus subsp. aureus Mu50
uaacauucuucaaaaaauaau

SEQ ID NO: 2073126 - RNA, 14 nt, Staphylococcus aureus subsp. aureus Mu50
uaacauuugucaua

SEQ ID NO: 2073127 - RNA, 20 nt, Staphylococcus aureus subsp. aureus Mu50
uaacauugaacgauaacaau

SEQ ID NO: 2073128 - RNA, 20 nt, Staphylococcus aureus subsp. aureus Mu50
uaacauacuauaaaaauuua

SEQ ID NO: 2073129 - RNA, 18 nt, Staphylococcus aureus subsp. aureus Mu50
uaacauagcuuaauaauu

SEQ ID NO: 2073130 - RNA, 17 nt, Staphylococcus aureus subsp. aureus Mu50
uaacauaaaaaugcuca

SEQ ID NO: 2073131 - RNA, 20 nt, Staphylococcus aureus subsp. aureus Mu50
uaacauaaaaaugcucaagu

SEQ ID NO: 2073132 - RNA, 15 nt, Staphylococcus aureus subsp. aureus Mu50
uaacauaucagcuuu

SEQ ID NO: 2073133 - RNA, 14 nt, Staphylococcus aureus subsp. aureus Mu50
uaaccgaugugauu

SEQ ID NO: 2073134 - RNA, 15 nt, Staphylococcus aureus subsp. aureus Mu50
uaacccacauuaaau

SEQ ID NO: 2073135 - RNA, 14 nt, Staphylococcus aureus subsp. aureus Mu50
uaaccauuaugauu

SEQ ID NO: 2073136 - RNA, 21 nt, Staphylococcus aureus subsp. aureus Mu50
uaaccauuaugauuaauccua

SEQ ID NO: 2073137 - RNA, 17 nt, Staphylococcus aureus subsp. aureus Mu50
uaaccuucgagugcuuu

SEQ ID NO: 2073138 - RNA, 16 nt, Staphylococcus aureus subsp. aureus Mu50
uaaccuuuaaaacauc

SEQ ID NO: 2073139 - RNA, 17 nt, Staphylococcus aureus subsp. aureus Mu50
uaaccuuuaaaacauca

SEQ ID NO: 2073140 - RNA, 19 nt, Staphylococcus aureus subsp. aureus Mu50
uaaccuuuaaaacaucauu

SEQ ID NO: 2073141 - RNA, 15 nt, Staphylococcus aureus subsp. aureus Mu50
uaaacuucuuuucuu

SEQ ID NO: 2073142 - RNA, 18 nt, Staphylococcus aureus subsp. aureus Mu50
uaaacguugcaccuauuu

SEQ ID NO: 2073143 - RNA, 19 nt, Staphylococcus aureus subsp. aureus Mu50
uaaacuaauagcauuugua

SEQ ID NO: 2073144 - RNA, 16 nt, Staphylococcus aureus subsp. aureus Mu50
uaaagaaauaauuuaa

SEQ ID NO: 2073145 - RNA, 20 nt, Staphylococcus aureus subsp. aureus Mu50
uaaagaacuauuuuaaauua

SEQ ID NO: 2073146 - RNA, 19 nt, Staphylococcus aureus subsp. aureus Mu50
uaaagaaacaugauugaaa

SEQ ID NO: 2073147 - RNA, 18 nt, Staphylococcus aureus subsp. aureus Mu50
uaaacuuuggcaaaguca

SEQ ID NO: 2073148 - RNA, 18 nt, Staphylococcus aureus subsp. aureus Mu50
uaaacauggucaaucacu

SEQ ID NO: 2073149 - RNA, 19 nt, Staphylococcus aureus subsp. aureus Mu50
uaaacauggucaaucacuc

SEQ ID NO: 2073150 - RNA, 19 nt, Staphylococcus aureus subsp. aureus Mu50
uaaaccauuuucaagagga

SEQ ID NO: 2073151 - RNA, 19 nt, Staphylococcus aureus subsp. aureus Mu50
uaaaccucuaaauaaaauu

SEQ ID NO: 2073152 - RNA, 11 nt, Staphylococcus aureus subsp. aureus Mu50
uaaaccuguua

SEQ ID NO: 2073153 - RNA, 15 nt, Staphylococcus aureus subsp. aureus Mu50
uaaaccuuaauaaug

SEQ ID NO: 2073154 - RNA, 17 nt, Staphylococcus aureus subsp. aureus Mu50
uaaaccuuuuuuaaguu

SEQ ID NO: 2073155 - RNA, 17 nt, Staphylococcus aureus subsp. aureus Mu50
uaaacguacauuuuuau

SEQ ID NO: 2073156 - RNA, 15 nt, Staphylococcus aureus subsp. aureus Mu50
uaaaauuuacaaaug

SEQ ID NO: 2073157 - RNA, 18 nt, Staphylococcus aureus subsp. aureus Mu50
uaaaauuuacaaauguau

SEQ ID NO: 2073158 - RNA, 20 nt, Staphylococcus aureus subsp. aureus Mu50
uaaaauuuacaaauguauaa

SEQ ID NO: 2073159 - RNA, 20 nt, Staphylococcus aureus subsp. aureus Mu50
uaaaauuucugcuucuuuua

SEQ ID NO: 2073160 - RNA, 16 nt, Staphylococcus aureus subsp. aureus Mu50
uaaaauuuguuaauuu

SEQ ID NO: 2073161 - RNA, 22 nt, Staphylococcus aureus subsp. aureus Mu50
uaaaauugccaguaucucuuuu

SEQ ID NO: 2073162 - RNA, 15 nt, Staphylococcus aureus subsp. aureus Mu50
uaaaauuguauagaa

SEQ ID NO: 2073163 - RNA, 16 nt, Staphylococcus aureus subsp. aureus Mu50
uaaaauuuaaaacaau

SEQ ID NO: 2073164 - RNA, 15 nt, Staphylococcus aureus subsp. aureus Mu50
uaaaauuuaaauauu

SEQ ID NO: 2073165 - RNA, 18 nt, Staphylococcus aureus subsp. aureus Mu50
uaaaauuaugauuauauu

SEQ ID NO: 2073166 - RNA, 11 nt, Staphylococcus aureus subsp. aureus Mu50
uaaaauucuuu

SEQ ID NO: 2073167 - RNA, 14 nt, Staphylococcus aureus subsp. aureus Mu50
uaaaauucucuuuu

SEQ ID NO: 2073168 - RNA, 22 nt, Staphylococcus aureus subsp. aureus Mu50
uaaaauucucuuuuaaauucuu

SEQ ID NO: 2073169 - RNA, 13 nt, Staphylococcus aureus subsp. aureus Mu50
uaaaauuaugauu

SEQ ID NO: 2073170 - RNA, 12 nt, Staphylococcus aureus subsp. aureus Mu50
uaaaauuaucaa

SEQ ID NO: 2073171 - RNA, 20 nt, Staphylococcus aureus subsp. aureus Mu50
uaaaauuacuugaauauuau

SEQ ID NO: 2073172 - RNA, 19 nt, Staphylococcus aureus subsp. aureus Mu50
uaaacaauuccccaaagcc

SEQ ID NO: 2073173 - RNA, 17 nt, Staphylococcus aureus subsp. aureus Mu50
uaaacaauacguuuucg

SEQ ID NO: 2073174 - RNA, 18 nt, Staphylococcus aureus subsp. aureus Mu50
uaaaauuuugaagaagug

SEQ ID NO: 2073175 - RNA, 14 nt, Staphylococcus aureus subsp. aureus Mu50
uaaaauuuuaauua

SEQ ID NO: 2073176 - RNA, 12 nt, Staphylococcus aureus subsp. aureus Mu50
uaaaauuuuaau

SEQ ID NO: 2073177 - RNA, 22 nt, Staphylococcus aureus subsp. aureus Mu50
uaaaauuuugaagaagugccgu

SEQ ID NO: 2073178 - RNA, 22 nt, Staphylococcus aureus subsp. aureus Mu50
uaaaauuuuuuucauaauuaau

SEQ ID NO: 2073179 - RNA, 18 nt, Staphylococcus aureus subsp. aureus Mu50
uaaacaugaacaaucaga

SEQ ID NO: 2073180 - RNA, 17 nt, Staphylococcus aureus subsp. aureus Mu50
uaaacauaaugacauca

SEQ ID NO: 2073181 - RNA, 12 nt, Staphylococcus aureus subsp. aureus Mu50
uaaacauauuua

SEQ ID NO: 2073182 - RNA, 17 nt, Staphylococcus aureus subsp. aureus Mu50
uaaacauauuuacuaag

SEQ ID NO: 2073183 - RNA, 22 nt, Staphylococcus aureus subsp. aureus Mu50
uaaacacgcgguaaaacgaagu

SEQ ID NO: 2073184 - RNA, 21 nt, Staphylococcus aureus subsp. aureus Mu50
uaaauacuugcucuaauucaa

SEQ ID NO: 2073185 - RNA, 22 nt, Staphylococcus aureus subsp. aureus Mu50
uaaauaguaagguuugaacucu

SEQ ID NO: 2073186 - RNA, 19 nt, Staphylococcus aureus subsp. aureus Mu50
uaaauaggugauuauauau

SEQ ID NO: 2073187 - RNA, 13 nt, Staphylococcus aureus subsp. aureus Mu50
uaaauaggaugaa

SEQ ID NO: 2073188 - RNA, 19 nt, Staphylococcus aureus subsp. aureus Mu50
uaaauaggaugaaaaagau

SEQ ID NO: 2073189 - RNA, 18 nt, Staphylococcus aureus subsp. aureus Mu50
uaaauagcuucuuaaauc

SEQ ID NO: 2073190 - RNA, 14 nt, Staphylococcus aureus subsp. aureus Mu50
uaaauauucuuauc

SEQ ID NO: 2073191 - RNA, 15 nt, Staphylococcus aureus subsp. aureus Mu50
uaaauauugauauaa

SEQ ID NO: 2073192 - RNA, 13 nt, Staphylococcus aureus subsp. aureus Mu50
uaaauauugaaca

SEQ ID NO: 2073193 - RNA, 16 nt, Staphylococcus aureus subsp. aureus Mu50
uaaauacaauguuauu

SEQ ID NO: 2073194 - RNA, 19 nt, Staphylococcus aureus subsp. aureus Mu50
uaaauacaauuucuucauu

SEQ ID NO: 2073195 - RNA, 13 nt, Staphylococcus aureus subsp. aureus Mu50
uaaauacaucgga

SEQ ID NO: 2073196 - RNA, 14 nt, Staphylococcus aureus subsp. aureus Mu50
uaaauacaaaaaua

SEQ ID NO: 2073197 - RNA, 14 nt, Staphylococcus aureus subsp. aureus Mu50
uaaauaaaauuguu

SEQ ID NO: 2073198 - RNA, 22 nt, Staphylococcus aureus subsp. aureus Mu50
uaaauaaaauuuuuuucauaau

SEQ ID NO: 2073199 - RNA, 14 nt, Staphylococcus aureus subsp. aureus Mu50
uaaauaaaaugcua

SEQ ID NO: 2073200 - RNA, 13 nt, Staphylococcus aureus subsp. aureus Mu50
uaaauaaaaugcu

SEQ ID NO: 2073201 - RNA, 20 nt, Staphylococcus aureus subsp. aureus Mu50
uaaauaaacuuuaugaaauu

SEQ ID NO: 2073202 - RNA, 15 nt, Staphylococcus aureus subsp. aureus Mu50
uaaaguaaaauauac

SEQ ID NO: 2073203 - RNA, 15 nt, Staphylococcus aureus subsp. aureus Mu50
uaaagagcaauuaaa

SEQ ID NO: 2073204 - RNA, 16 nt, Staphylococcus aureus subsp. aureus Mu50
uaaagagcaauuaaag

SEQ ID NO: 2073205 - RNA, 20 nt, Staphylococcus aureus subsp. aureus Mu50
uaaagagcaauuaaagucaa

SEQ ID NO: 2073206 - RNA, 13 nt, Staphylococcus aureus subsp. aureus Mu50
uaaagcaaauuau

SEQ ID NO: 2073207 - RNA, 19 nt, Staphylococcus aureus subsp. aureus Mu50
uaaagggcuauuugauaca

SEQ ID NO: 2073208 - RNA, 14 nt, Staphylococcus aureus subsp. aureus Mu50
uaaaggcaacaaau

SEQ ID NO: 2073209 - RNA, 19 nt, Staphylococcus aureus subsp. aureus Mu50
uaaaggguguuuagauagc

SEQ ID NO: 2073210 - RNA, 22 nt, Staphylococcus aureus subsp. aureus Mu50
uaaaggguguuuagauagcucu

SEQ ID NO: 2073211 - RNA, 18 nt, Staphylococcus aureus subsp. aureus Mu50
uaaagguuaaauauuuaa

SEQ ID NO: 2073212 - RNA, 15 nt, Staphylococcus aureus subsp. aureus Mu50
uaaagcgauaauaga

SEQ ID NO: 2073213 - RNA, 16 nt, Staphylococcus aureus subsp. aureus Mu50
uaaagcgauuuccauc

SEQ ID NO: 2073214 - RNA, 21 nt, Staphylococcus aureus subsp. aureus Mu50
uaaagcuaacauaccuaauaa

SEQ ID NO: 2073215 - RNA, 15 nt, Staphylococcus aureus subsp. aureus Mu50
uaaaaucaacaccaa

SEQ ID NO: 2073216 - RNA, 15 nt, Staphylococcus aureus subsp. aureus Mu50
uaaaaucaacuuuuc

SEQ ID NO: 2073217 - RNA, 16 nt, Staphylococcus aureus subsp. aureus Mu50
uaaaaucuauaccauu

SEQ ID NO: 2073218 - RNA, 23 nt, Staphylococcus aureus subsp. aureus Mu50
uaaaauccuaagcaucguaaaaa

SEQ ID NO: 2073219 - RNA, 20 nt, Staphylococcus aureus subsp. aureus Mu50
uaaaaucauuaauaauuaaa

SEQ ID NO: 2073220 - RNA, 19 nt, Staphylococcus aureus subsp. aureus Mu50
uaaaauccaagugcuaaga

SEQ ID NO: 2073221 - RNA, 19 nt, Staphylococcus aureus subsp. aureus Mu50
uaaaaucauaugucuuaac

SEQ ID NO: 2073222 - RNA, 16 nt, Staphylococcus aureus subsp. aureus Mu50
uaaaaugaaugaagac

SEQ ID NO: 2073223 - RNA, 20 nt, Staphylococcus aureus subsp. aureus Mu50
uaaaaugauaucugacauuu

SEQ ID NO: 2073224 - RNA, 19 nt, Staphylococcus aureus subsp. aureus Mu50
uaaaaugucuuugaaaaac

SEQ ID NO: 2073225 - RNA, 14 nt, Staphylococcus aureus subsp. aureus Mu50
uaaaauuaaaacag

SEQ ID NO: 2073226 - RNA, 15 nt, Staphylococcus aureus subsp. aureus Mu50
uaaaauuaaaacagc

SEQ ID NO: 2073227 - RNA, 17 nt, Staphylococcus aureus subsp. aureus Mu50
uaaaauuaacuuaaaau

SEQ ID NO: 2073228 - RNA, 23 nt, Staphylococcus aureus subsp. aureus Mu50
uaaaauguuaggugaaaccauac

SEQ ID NO: 2073229 - RNA, 14 nt, Staphylococcus aureus subsp. aureus Mu50
uaaaauuaaauaau

SEQ ID NO: 2073230 - RNA, 20 nt, Staphylococcus aureus subsp. aureus Mu50
uaaaaugcuacaauuuccua

SEQ ID NO: 2073231 - RNA, 18 nt, Staphylococcus aureus subsp. aureus Mu50
uaaaauggcaucuggcaa

SEQ ID NO: 2073232 - RNA, 20 nt, Staphylococcus aureus subsp. aureus Mu50
uaaaauggugcgaauaauaa

SEQ ID NO: 2073233 - RNA, 22 nt, Staphylococcus aureus subsp. aureus Mu50
uaaaaggaagcaucuccaauuu

SEQ ID NO: 2073234 - RNA, 21 nt, Staphylococcus aureus subsp. aureus Mu50
uaaaaggcgaaacauuaaaau

SEQ ID NO: 2073235 - RNA, 20 nt, Staphylococcus aureus subsp. aureus Mu50
uaaaaggaugugacaaauac

SEQ ID NO: 2073236 - RNA, 15 nt, Staphylococcus aureus subsp. aureus Mu50
uaaaaggcgaaacau

SEQ ID NO: 2073237 - RNA, 21 nt, Staphylococcus aureus subsp. aureus Mu50
uaaaaggugugggcuuuauua

SEQ ID NO: 2073238 - RNA, 22 nt, Staphylococcus aureus subsp. aureus Mu50
uaaaaguaacauacuauaaaaa

SEQ ID NO: 2073239 - RNA, 16 nt, Staphylococcus aureus subsp. aureus Mu50
uaaaaggggaaaucau

SEQ ID NO: 2073240 - RNA, 12 nt, Staphylococcus aureus subsp. aureus Mu50
uaaaauaaaaug

SEQ ID NO: 2073241 - RNA, 15 nt, Staphylococcus aureus subsp. aureus Mu50
uaaaauaaaaugcaa

SEQ ID NO: 2073242 - RNA, 20 nt, Staphylococcus aureus subsp. aureus Mu50
uaaaaguuguaauuuaaaau

SEQ ID NO: 2073243 - RNA, 22 nt, Staphylococcus aureus subsp. aureus Mu50
uaaaaguuguaauuuaaaauag

SEQ ID NO: 2073244 - RNA, 23 nt, Staphylococcus aureus subsp. aureus Mu50
uaaaaguuguaauuuaaaauagu

SEQ ID NO: 2073245 - RNA, 20 nt, Staphylococcus aureus subsp. aureus Mu50
uaaaauaaaaaaugcacuga

SEQ ID NO: 2073246 - RNA, 17 nt, Staphylococcus aureus subsp. aureus Mu50
uaaaauaaaaaaaugau

SEQ ID NO: 2073247 - RNA, 16 nt, Staphylococcus aureus subsp. aureus Mu50
uaaaauaaaaaaugca

SEQ ID NO: 2073248 - RNA, 18 nt, Staphylococcus aureus subsp. aureus Mu50
uaaaauaaaaaaugcacu

SEQ ID NO: 2073249 - RNA, 16 nt, Staphylococcus aureus subsp. aureus Mu50
uaaaaguauagauaga

SEQ ID NO: 2073250 - RNA, 17 nt, Staphylococcus aureus subsp. aureus Mu50
uaaaagucgauaaauau

SEQ ID NO: 2073251 - RNA, 20 nt, Staphylococcus aureus subsp. aureus Mu50
uaaaauacccauuuuuuucc

SEQ ID NO: 2073252 - RNA, 15 nt, Staphylococcus aureus subsp. aureus Mu50
uaaaauagaaaaauu

SEQ ID NO: 2073253 - RNA, 21 nt, Staphylococcus aureus subsp. aureus Mu50
uaaaauagaguagacguaagu

SEQ ID NO: 2073254 - RNA, 20 nt, Staphylococcus aureus subsp. aureus Mu50
uaaaauaguucuuuaaauua

SEQ ID NO: 2073255 - RNA, 21 nt, Staphylococcus aureus subsp. aureus Mu50
uaaaauaguucuuuaaauuau

SEQ ID NO: 2073256 - RNA, 22 nt, Staphylococcus aureus subsp. aureus Mu50
uaaaauaguucuuuaaauuaua

SEQ ID NO: 2073257 - RNA, 13 nt, Staphylococcus aureus subsp. aureus Mu50
uaaaauauaucuu

SEQ ID NO: 2073258 - RNA, 20 nt, Staphylococcus aureus subsp. aureus Mu50
uaaaauaucaaaauauaaaa

SEQ ID NO: 2073259 - RNA, 14 nt, Staphylococcus aureus subsp. aureus Mu50
uaaaauauaugaau

SEQ ID NO: 2073260 - RNA, 12 nt, Staphylococcus aureus subsp. aureus Mu50
uaaaauaaaucu

SEQ ID NO: 2073261 - RNA, 19 nt, Staphylococcus aureus subsp. aureus Mu50
uaaaauaaaguuugggcau

SEQ ID NO: 2073262 - RNA, 13 nt, Staphylococcus aureus subsp. aureus Mu50
uaaaauaaaucau

SEQ ID NO: 2073263 - RNA, 15 nt, Staphylococcus aureus subsp. aureus Mu50
uaaaauaagauauau

SEQ ID NO: 2073264 - RNA, 23 nt, Staphylococcus aureus subsp. aureus Mu50
uaaaauaacugcuaauuuuuuca

SEQ ID NO: 2073265 - RNA, 16 nt, Staphylococcus aureus subsp. aureus Mu50
uaaaauaauagauaau

SEQ ID NO: 2073266 - RNA, 15 nt, Staphylococcus aureus subsp. aureus Mu50
uaaaauaauuaaaua

SEQ ID NO: 2073267 - RNA, 16 nt, Staphylococcus aureus subsp. aureus Mu50
uaaaauaaucgguaau

SEQ ID NO: 2073268 - RNA, 15 nt, Staphylococcus aureus subsp. aureus Mu50
uaaaacgauaauaau

SEQ ID NO: 2073269 - RNA, 17 nt, Staphylococcus aureus subsp. aureus Mu50
uaaaacgauaauaauaa

SEQ ID NO: 2073270 - RNA, 16 nt, Staphylococcus aureus subsp. aureus Mu50
uaaaacgauaagaauu

SEQ ID NO: 2073271 - RNA, 18 nt, Staphylococcus aureus subsp. aureus Mu50
uaaaaccuuacccaaaaa

SEQ ID NO: 2073272 - RNA, 17 nt, Staphylococcus aureus subsp. aureus Mu50
uaaaaccuuuucaaauu

SEQ ID NO: 2073273 - RNA, 22 nt, Staphylococcus aureus subsp. aureus Mu50
uaaaaccuuuucaaauuauaac

SEQ ID NO: 2073274 - RNA, 15 nt, Staphylococcus aureus subsp. aureus Mu50
uaaaacuaaguuauu

SEQ ID NO: 2073275 - RNA, 16 nt, Staphylococcus aureus subsp. aureus Mu50
uaaaacuaaugauagu

SEQ ID NO: 2073276 - RNA, 23 nt, Staphylococcus aureus subsp. aureus Mu50
uaaaacuacugauuuauugauaa

SEQ ID NO: 2073277 - RNA, 16 nt, Staphylococcus aureus subsp. aureus Mu50
uaaaacuuauaacuga

SEQ ID NO: 2073278 - RNA, 16 nt, Staphylococcus aureus subsp. aureus Mu50
uaaaacuauaauaaag

SEQ ID NO: 2073279 - RNA, 13 nt, Staphylococcus aureus subsp. aureus Mu50
uaaaagaaaaauu

SEQ ID NO: 2073280 - RNA, 15 nt, Staphylococcus aureus subsp. aureus Mu50
uaaaagaauuauuca

SEQ ID NO: 2073281 - RNA, 14 nt, Staphylococcus aureus subsp. aureus Mu50
uaaaagacagaaau

SEQ ID NO: 2073282 - RNA, 22 nt, Staphylococcus aureus subsp. aureus Mu50
uaaaagagaauuuuaauuaauu

SEQ ID NO: 2073283 - RNA, 19 nt, Staphylococcus aureus subsp. aureus Mu50
uaaaacuuguaaauuuauu

SEQ ID NO: 2073284 - RNA, 20 nt, Staphylococcus aureus subsp. aureus Mu50
uaaaacuuauaacugauaau

SEQ ID NO: 2073285 - RNA, 13 nt, Staphylococcus aureus subsp. aureus Mu50
uaaaagccucuaa

SEQ ID NO: 2073286 - RNA, 19 nt, Staphylococcus aureus subsp. aureus Mu50
uaaaagccaucuuaccuuu

SEQ ID NO: 2073287 - RNA, 21 nt, Staphylococcus aureus subsp. aureus Mu50
uaaaacagcaaauaaaaucau

SEQ ID NO: 2073288 - RNA, 14 nt, Staphylococcus aureus subsp. aureus Mu50
uaaaacagcaaaua

SEQ ID NO: 2073289 - RNA, 20 nt, Staphylococcus aureus subsp. aureus Mu50
uaaaacaguaaguaauaaaa

SEQ ID NO: 2073290 - RNA, 22 nt, Staphylococcus aureus subsp. aureus Mu50
uaaaacaguaaguaauaaaaua

SEQ ID NO: 2073291 - RNA, 14 nt, Staphylococcus aureus subsp. aureus Mu50
uaaaacaucauuca

SEQ ID NO: 2073292 - RNA, 14 nt, Staphylococcus aureus subsp. aureus Mu50
uaaaacauguugau

SEQ ID NO: 2073293 - RNA, 15 nt, Staphylococcus aureus subsp. aureus Mu50
uaaaacaaauuauua

SEQ ID NO: 2073294 - RNA, 14 nt, Staphylococcus aureus subsp. aureus Mu50
uaaaacaaauuauu

SEQ ID NO: 2073295 - RNA, 18 nt, Staphylococcus aureus subsp. aureus Mu50
uaaaacaaauucauauua

SEQ ID NO: 2073296 - RNA, 21 nt, Staphylococcus aureus subsp. aureus Mu50
uaaaacagaauuucaucaaau

SEQ ID NO: 2073297 - RNA, 19 nt, Staphylococcus aureus subsp. aureus Mu50
uaaaacaaugauuaaaauu

SEQ ID NO: 2073298 - RNA, 16 nt, Staphylococcus aureus subsp. aureus Mu50
uaaaacaauaauuuaa

SEQ ID NO: 2073299 - RNA, 17 nt, Staphylococcus aureus subsp. aureus Mu50
uaaaacaauaauuuaau

SEQ ID NO: 2073300 - RNA, 20 nt, Staphylococcus aureus subsp. aureus Mu50
uaaaacaauaauuuaauauu

SEQ ID NO: 2073301 - RNA, 15 nt, Staphylococcus aureus subsp. aureus Mu50
uaaaaauuauauaaa

SEQ ID NO: 2073302 - RNA, 15 nt, Staphylococcus aureus subsp. aureus Mu50
uaaaaauuuaugucu

SEQ ID NO: 2073303 - RNA, 17 nt, Staphylococcus aureus subsp. aureus Mu50
uaaaaauuuauucaaaa

SEQ ID NO: 2073304 - RNA, 21 nt, Staphylococcus aureus subsp. aureus Mu50
uaaaaaucuuggugauagucu

SEQ ID NO: 2073305 - RNA, 20 nt, Staphylococcus aureus subsp. aureus Mu50
uaaaaaugcucaaguugauu

SEQ ID NO: 2073306 - RNA, 15 nt, Staphylococcus aureus subsp. aureus Mu50
uaaaaauccucacaa

SEQ ID NO: 2073307 - RNA, 16 nt, Staphylococcus aureus subsp. aureus Mu50
uaaaaaucuuaugaug

SEQ ID NO: 2073308 - RNA, 19 nt, Staphylococcus aureus subsp. aureus Mu50
uaaaaauaggaauacauga

SEQ ID NO: 2073309 - RNA, 13 nt, Staphylococcus aureus subsp. aureus Mu50
uaaaaauauauuu

SEQ ID NO: 2073310 - RNA, 11 nt, Staphylococcus aureus subsp. aureus Mu50
uaaaaaucaaa

SEQ ID NO: 2073311 - RNA, 19 nt, Staphylococcus aureus subsp. aureus Mu50
uaaaaaucaaagaggcuuu

SEQ ID NO: 2073312 - RNA, 13 nt, Staphylococcus aureus subsp. aureus Mu50
aaaucaguaauau

SEQ ID NO: 2073313 - RNA, 16 nt, Staphylococcus aureus subsp. aureus Mu50
aaaucaguaauaucaa

SEQ ID NO: 2073314 - RNA, 20 nt, Staphylococcus aureus subsp. aureus Mu50
aaaucaucguauuucauaua

SEQ ID NO: 2073315 - RNA, 22 nt, Staphylococcus aureus subsp. aureus Mu50
aaaucaugacauaaaacuuaca

SEQ ID NO: 2073316 - RNA, 11 nt, Staphylococcus aureus subsp. aureus Mu50
aaaucaucuua

SEQ ID NO: 2073317 - RNA, 13 nt, Staphylococcus aureus subsp. aureus Mu50
aaaucaucuuaac

SEQ ID NO: 2073318 - RNA, 14 nt, Staphylococcus aureus subsp. aureus Mu50
aaaucauuaauaau

SEQ ID NO: 2073319 - RNA, 17 nt, Staphylococcus aureus subsp. aureus Mu50
guuuuaucuacaguuuu

SEQ ID NO: 2073320 - RNA, 23 nt, Staphylococcus aureus subsp. aureus Mu50
guuuuauauuuauuuuauaauaa

SEQ ID NO: 2073321 - RNA, 15 nt, Staphylococcus aureus subsp. aureus Mu50
guuuugguucugaca

SEQ ID NO: 2073322 - RNA, 22 nt, Staphylococcus aureus subsp. aureus Mu50
guuuugguuguucuuuuuguug

SEQ ID NO: 2073323 - RNA, 15 nt, Staphylococcus aureus subsp. aureus Mu50
guuuucuuaaaagag

SEQ ID NO: 2073324 - RNA, 13 nt, Staphylococcus aureus subsp. aureus Mu50
guuuuuaaaauua

SEQ ID NO: 2073325 - RNA, 22 nt, Staphylococcus aureus subsp. aureus Mu50
guuuggaugaacaaaauaacau

SEQ ID NO: 2073326 - RNA, 13 nt, Staphylococcus aureus subsp. aureus Mu50
guuugauuucacu

SEQ ID NO: 2073327 - RNA, 15 nt, Staphylococcus aureus subsp. aureus Mu50
guuugaaucauuuga

SEQ ID NO: 2073328 - RNA, 20 nt, Staphylococcus aureus subsp. aureus Mu50
guuugaaggagauauuuucu

SEQ ID NO: 2073329 - RNA, 19 nt, Staphylococcus aureus subsp. aureus Mu50
guuugaacaacaucuuuug

SEQ ID NO: 2073330 - RNA, 20 nt, Staphylococcus aureus subsp. aureus Mu50
guuuuaauuucacuuuaacu

SEQ ID NO: 2073331 - RNA, 13 nt, Staphylococcus aureus subsp. aureus Mu50
guuuuaauuucuu

SEQ ID NO: 2073332 - RNA, 22 nt, Staphylococcus aureus subsp. aureus Mu50
guuuggucaccuacagauaaag

SEQ ID NO: 2073333 - RNA, 21 nt, Staphylococcus aureus subsp. aureus Mu50
guuuguaagacaacaaaucga

SEQ ID NO: 2073334 - RNA, 17 nt, Staphylococcus aureus subsp. aureus Mu50
guuuuaaauugaaaugu

SEQ ID NO: 2073335 - RNA, 18 nt, Staphylococcus aureus subsp. aureus Mu50
guuuuaaacuuauuaauu

SEQ ID NO: 2073336 - RNA, 12 nt, Staphylococcus aureus subsp. aureus Mu50
guuuuuuuaaau

SEQ ID NO: 2073337 - RNA, 18 nt, Staphylococcus aureus subsp. aureus Mu50
guuuuuugauuaguaaau

SEQ ID NO: 2073338 - RNA, 21 nt, Staphylococcus aureus subsp. aureus Mu50
guuuuuuagauuugaaauuua

SEQ ID NO: 2073339 - RNA, 13 nt, Staphylococcus aureus subsp. aureus Mu50
uaaaaaaguuauc

SEQ ID NO: 2073340 - RNA, 16 nt, Staphylococcus aureus subsp. aureus Mu50
uaaaaaaggaagaaca

SEQ ID NO: 2073341 - RNA, 16 nt, Staphylococcus aureus subsp. aureus Mu50
uaaaaaacgguacaga

SEQ ID NO: 2073342 - RNA, 13 nt, Staphylococcus aureus subsp. aureus Mu50
uaaaaaacaauag

SEQ ID NO: 2073343 - RNA, 16 nt, Staphylococcus aureus subsp. aureus Mu50
uaaaaaaccugaaaca

SEQ ID NO: 2073344 - RNA, 23 nt, Staphylococcus aureus subsp. aureus Mu50
uaaaaaaaaccacgcacaucuaa

SEQ ID NO: 2073345 - RNA, 23 nt, Staphylococcus aureus subsp. aureus Mu50
uaaaaaaacgucuuuccauuuau

SEQ ID NO: 2073346 - RNA, 12 nt, Staphylococcus aureus subsp. aureus Mu50
uaaaaaaauaau

SEQ ID NO: 2073347 - RNA, 21 nt, Staphylococcus aureus subsp. aureus Mu50
uaaaaaaaucacgcuaacauu

SEQ ID NO: 2073348 - RNA, 15 nt, Staphylococcus aureus subsp. aureus Mu50
uaaaaaaauuaacua

SEQ ID NO: 2073349 - RNA, 14 nt, Staphylococcus aureus subsp. aureus Mu50
uaaaaaccuauucc

SEQ ID NO: 2073350 - RNA, 18 nt, Staphylococcus aureus subsp. aureus Mu50
uaaaaacucuaaaaguug

SEQ ID NO: 2073351 - RNA, 15 nt, Staphylococcus aureus subsp. aureus Mu50
uaaaaacucuaaaag

SEQ ID NO: 2073352 - RNA, 21 nt, Staphylococcus aureus subsp. aureus Mu50
uaaaaaauuccuagcuuuuau

SEQ ID NO: 2073353 - RNA, 14 nt, Staphylococcus aureus subsp. aureus Mu50
uaaaaaauuuaaug

SEQ ID NO: 2073354 - RNA, 18 nt, Staphylococcus aureus subsp. aureus Mu50
uaaaaaauuuaaauaaua

SEQ ID NO: 2073355 - RNA, 20 nt, Staphylococcus aureus subsp. aureus Mu50
uaaaaaauuuaaauaauaau

SEQ ID NO: 2073356 - RNA, 16 nt, Staphylococcus aureus subsp. aureus Mu50
uaaaaaauuauuaaaa

SEQ ID NO: 2073357 - RNA, 18 nt, Staphylococcus aureus subsp. aureus Mu50
uaaaaaaugcgcuuccaa

SEQ ID NO: 2073358 - RNA, 18 nt, Staphylococcus aureus subsp. aureus Mu50
uaaaaaaguugauuaaaa

SEQ ID NO: 2073359 - RNA, 16 nt, Staphylococcus aureus subsp. aureus Mu50
uaaaaaguaauuaauu

SEQ ID NO: 2073360 - RNA, 19 nt, Staphylococcus aureus subsp. aureus Mu50
uaaaaaguuuaaaguauaa

SEQ ID NO: 2073361 - RNA, 12 nt, Staphylococcus aureus subsp. aureus Mu50
uaaaaaguuuaa

SEQ ID NO: 2073362 - RNA, 20 nt, Staphylococcus aureus subsp. aureus Mu50
uaaaaauacauaauaaaaag

SEQ ID NO: 2073363 - RNA, 19 nt, Staphylococcus aureus subsp. aureus Mu50
uaaaaagagguuuucauua

SEQ ID NO: 2073364 - RNA, 15 nt, Staphylococcus aureus subsp. aureus Mu50
uaaaaagcagcagua

SEQ ID NO: 2073365 - RNA, 20 nt, Staphylococcus aureus subsp. aureus Mu50
uaaaaacugugauucauucg

SEQ ID NO: 2073366 - RNA, 18 nt, Staphylococcus aureus subsp. aureus Mu50
uaaaaagagguuuucauu

SEQ ID NO: 2073367 - RNA, 18 nt, Staphylococcus aureus subsp. aureus Mu50
uaaaaagagaugggcuaa

SEQ ID NO: 2073368 - RNA, 22 nt, Staphylococcus aureus subsp. aureus Mu50
uaaaaagaauaugauauugauu

SEQ ID NO: 2073369 - RNA, 13 nt, Staphylococcus aureus subsp. aureus Mu50
guugucuuuacau

SEQ ID NO: 2073370 - RNA, 15 nt, Staphylococcus aureus subsp. aureus Mu50
guugugauauauagu

SEQ ID NO: 2073371 - RNA, 17 nt, Staphylococcus aureus subsp. aureus Mu50
guuggggcccacacccc

SEQ ID NO: 2073372 - RNA, 20 nt, Staphylococcus aureus subsp. aureus Mu50
guuggggaugggccccaaca

SEQ ID NO: 2073373 - RNA, 15 nt, Staphylococcus aureus subsp. aureus Mu50
guuggggcccacacc

SEQ ID NO: 2073374 - RNA, 22 nt, Staphylococcus aureus subsp. aureus Mu50
guugccauuaguucuguugaua

SEQ ID NO: 2073375 - RNA, 15 nt, Staphylococcus aureus subsp. aureus Mu50
guuuauuuagaauaa

SEQ ID NO: 2073376 - RNA, 18 nt, Staphylococcus aureus subsp. aureus Mu50
guuuauaaauuaauugcu

SEQ ID NO: 2073377 - RNA, 15 nt, Staphylococcus aureus subsp. aureus Mu50
guuuauaaucaguuu

SEQ ID NO: 2073378 - RNA, 15 nt, Staphylococcus aureus subsp. aureus Mu50
guuuauaaaaaauca

SEQ ID NO: 2073379 - RNA, 15 nt, Staphylococcus aureus subsp. aureus Mu50
guuuaauuuuaaaua

SEQ ID NO: 2073380 - RNA, 13 nt, Staphylococcus aureus subsp. aureus Mu50
guuuaccuuaaau

SEQ ID NO: 2073381 - RNA, 22 nt, Staphylococcus aureus subsp. aureus Mu50
guuguuauuuuugcuauuucaa

SEQ ID NO: 2073382 - RNA, 19 nt, Staphylococcus aureus subsp. aureus Mu50
guuguucccauuuuuaaaa

SEQ ID NO: 2073383 - RNA, 20 nt, Staphylococcus aureus subsp. aureus Mu50
guuguugcaacuugugguug

SEQ ID NO: 2073384 - RNA, 13 nt, Staphylococcus aureus subsp. aureus Mu50
guuguugaaauuu

SEQ ID NO: 2073385 - RNA, 14 nt, Staphylococcus aureus subsp. aureus Mu50
guuuaaaaauaugu

SEQ ID NO: 2073386 - RNA, 15 nt, Staphylococcus aureus subsp. aureus Mu50
guuuaaaguauaagg

SEQ ID NO: 2073387 - RNA, 18 nt, Staphylococcus aureus subsp. aureus Mu50
guuuaaaugugcaauuag

SEQ ID NO: 2073388 - RNA, 23 nt, Staphylococcus aureus subsp. aureus Mu50
guuuaauuaaaauacaaauuaca

SEQ ID NO: 2073389 - RNA, 13 nt, Staphylococcus aureus subsp. aureus Mu50
guuuaaauauuca

SEQ ID NO: 2073390 - RNA, 17 nt, Staphylococcus aureus subsp. aureus Mu50
guugaauuucuuuaagu

SEQ ID NO: 2073391 - RNA, 16 nt, Staphylococcus aureus subsp. aureus Mu50
guugaauuaacaauau

SEQ ID NO: 2073392 - RNA, 15 nt, Staphylococcus aureus subsp. aureus Mu50
guugaagcuaauuca

SEQ ID NO: 2073393 - RNA, 21 nt, Staphylococcus aureus subsp. aureus Mu50
guugaacgguuguauuucauc

SEQ ID NO: 2073394 - RNA, 16 nt, Staphylococcus aureus subsp. aureus Mu50
guugacuguaaaacaa

SEQ ID NO: 2073395 - RNA, 23 nt, Staphylococcus aureus subsp. aureus Mu50
guugacguugugucaugcugaau

SEQ ID NO: 2073396 - RNA, 18 nt, Staphylococcus aureus subsp. aureus Mu50
guugcauaaucaauuuca

SEQ ID NO: 2073397 - RNA, 21 nt, Staphylococcus aureus subsp. aureus Mu50
guugauugcaugacagcaaau

SEQ ID NO: 2073398 - RNA, 19 nt, Staphylococcus aureus subsp. aureus Mu50
guugauauauauuuugcaa

SEQ ID NO: 2073399 - RNA, 14 nt, Staphylococcus aureus subsp. aureus Mu50
guucuuauaaaaaa

SEQ ID NO: 2073400 - RNA, 13 nt, Staphylococcus aureus subsp. aureus Mu50
guucuugagcugu

SEQ ID NO: 2073401 - RNA, 17 nt, Staphylococcus aureus subsp. aureus Mu50
guucuugguauuuuuua

SEQ ID NO: 2073402 - RNA, 18 nt, Staphylococcus aureus subsp. aureus Mu50
guucuuucuuguucuaaa

SEQ ID NO: 2073403 - RNA, 16 nt, Staphylococcus aureus subsp. aureus Mu50
guucuuuacuccaaag

SEQ ID NO: 2073404 - RNA, 17 nt, Staphylococcus aureus subsp. aureus Mu50
guugaaaaccucuuuuu

SEQ ID NO: 2073405 - RNA, 14 nt, Staphylococcus aureus subsp. aureus Mu50
guucugcuuuuucu

SEQ ID NO: 2073406 - RNA, 17 nt, Staphylococcus aureus subsp. aureus Mu50
guucacaugaauuuuaa

SEQ ID NO: 2073407 - RNA, 16 nt, Staphylococcus aureus subsp. aureus Mu50
guucaauauuuaucaa

SEQ ID NO: 2073408 - RNA, 12 nt, Staphylococcus aureus subsp. aureus Mu50
guucaaguauau

SEQ ID NO: 2073409 - RNA, 18 nt, Staphylococcus aureus subsp. aureus Mu50
guucaagcuuuauuuuuu

SEQ ID NO: 2073410 - RNA, 18 nt, Staphylococcus aureus subsp. aureus Mu50
guucaucaaacaacauca

SEQ ID NO: 2073411 - RNA, 22 nt, Staphylococcus aureus subsp. aureus Mu50
guucauaaugaucaaguaguua

SEQ ID NO: 2073412 - RNA, 18 nt, Staphylococcus aureus subsp. aureus Mu50
guucagauuuguauuuug

SEQ ID NO: 2073413 - RNA, 17 nt, Staphylococcus aureus subsp. aureus Mu50
guucaugguuuaauuca

SEQ ID NO: 2073414 - RNA, 16 nt, Staphylococcus aureus subsp. aureus Mu50
guucaucaaacaacau

SEQ ID NO: 2073415 - RNA, 14 nt, Staphylococcus aureus subsp. aureus Mu50
guucggaugagaaa

SEQ ID NO: 2073416 - RNA, 19 nt, Staphylococcus aureus subsp. aureus Mu50
guucgauuguaauaaccau

SEQ ID NO: 2073417 - RNA, 19 nt, Staphylococcus aureus subsp. aureus Mu50
guguccuagacgaucuuua

SEQ ID NO: 2073418 - RNA, 17 nt, Staphylococcus aureus subsp. aureus Mu50
guguuggggcccacacc

SEQ ID NO: 2073419 - RNA, 23 nt, Staphylococcus aureus subsp. aureus Mu50
guuaaagaugucgaaaaguauau

SEQ ID NO: 2073420 - RNA, 15 nt, Staphylococcus aureus subsp. aureus Mu50
guuaaaguuuuguuc

SEQ ID NO: 2073421 - RNA, 19 nt, Staphylococcus aureus subsp. aureus Mu50
guuaaaguacuuacaaaua

SEQ ID NO: 2073422 - RNA, 22 nt, Staphylococcus aureus subsp. aureus Mu50
guuaaagucuguugguuuauca

SEQ ID NO: 2073423 - RNA, 14 nt, Staphylococcus aureus subsp. aureus Mu50
guuaaauucuaaaa

SEQ ID NO: 2073424 - RNA, 21 nt, Staphylococcus aureus subsp. aureus Mu50
guuaaaucuuuaacuucugau

SEQ ID NO: 2073425 - RNA, 21 nt, Staphylococcus aureus subsp. aureus Mu50
guuaaacgcugauuuuauaaa

SEQ ID NO: 2073426 - RNA, 20 nt, Staphylococcus aureus subsp. aureus Mu50
guguuuuuaauguuugcuuu

SEQ ID NO: 2073427 - RNA, 11 nt, Staphylococcus aureus subsp. aureus Mu50
guguuugcuuu

SEQ ID NO: 2073428 - RNA, 14 nt, Staphylococcus aureus subsp. aureus Mu50
guguuucuuuuauu

SEQ ID NO: 2073429 - RNA, 19 nt, Staphylococcus aureus subsp. aureus Mu50
guguuucuuuuauuuucau

SEQ ID NO: 2073430 - RNA, 14 nt, Staphylococcus aureus subsp. aureus Mu50
guuaaucaaaauua

SEQ ID NO: 2073431 - RNA, 23 nt, Staphylococcus aureus subsp. aureus Mu50
guuaauauucuuucguuuucauc

SEQ ID NO: 2073432 - RNA, 18 nt, Staphylococcus aureus subsp. aureus Mu50
guuaauauaauuaaacau

SEQ ID NO: 2073433 - RNA, 21 nt, Staphylococcus aureus subsp. aureus Mu50
guuaauauaauuaaacauuua

SEQ ID NO: 2073434 - RNA, 18 nt, Staphylococcus aureus subsp. aureus Mu50
guuaauauaacuucuauu

SEQ ID NO: 2073435 - RNA, 13 nt, Staphylococcus aureus subsp. aureus Mu50
guuaauauaauua

SEQ ID NO: 2073436 - RNA, 13 nt, Staphylococcus aureus subsp. aureus Mu50
guuaaauucaucu

SEQ ID NO: 2073437 - RNA, 18 nt, Staphylococcus aureus subsp. aureus Mu50
guuacagguuuuaaaauu

SEQ ID NO: 2073438 - RNA, 19 nt, Staphylococcus aureus subsp. aureus Mu50
guuaccaaaauuugaaaua

SEQ ID NO: 2073439 - RNA, 17 nt, Staphylococcus aureus subsp. aureus Mu50
guuaccaaguaaugaua

SEQ ID NO: 2073440 - RNA, 20 nt, Staphylococcus aureus subsp. aureus Mu50
guuacuaaacuuuucuucaa

SEQ ID NO: 2073441 - RNA, 16 nt, Staphylococcus aureus subsp. aureus Mu50
guuagcuauauuuuuu

SEQ ID NO: 2073442 - RNA, 19 nt, Staphylococcus aureus subsp. aureus Mu50
guuauaaauuauauuuauu

SEQ ID NO: 2073443 - RNA, 22 nt, Staphylococcus aureus subsp. aureus Mu50
guuauaaaggaagacauacuca

SEQ ID NO: 2073444 - RNA, 17 nt, Staphylococcus aureus subsp. aureus Mu50
guuauuaucguaaaaaa

SEQ ID NO: 2073445 - RNA, 16 nt, Staphylococcus aureus subsp. aureus Mu50
guuauuauaaaauaaa

SEQ ID NO: 2073446 - RNA, 15 nt, Staphylococcus aureus subsp. aureus Mu50
guucaaaauacucaa

SEQ ID NO: 2073447 - RNA, 14 nt, Staphylococcus aureus subsp. aureus Mu50
guuaucuaaugauc

SEQ ID NO: 2073448 - RNA, 19 nt, Staphylococcus aureus subsp. aureus Mu50
guggcuuuuuuuauggugu

SEQ ID NO: 2073449 - RNA, 20 nt, Staphylococcus aureus subsp. aureus Mu50
guggcuuuuuuuauggugug

SEQ ID NO: 2073450 - RNA, 12 nt, Staphylococcus aureus subsp. aureus Mu50
gugguacuuuuu

SEQ ID NO: 2073451 - RNA, 16 nt, Staphylococcus aureus subsp. aureus Mu50
gugguaugacugcaaa

SEQ ID NO: 2073452 - RNA, 20 nt, Staphylococcus aureus subsp. aureus Mu50
guguaaauauaaauaugaau

SEQ ID NO: 2073453 - RNA, 20 nt, Staphylococcus aureus subsp. aureus Mu50
guguaaucucguuuuuacau

SEQ ID NO: 2073454 - RNA, 22 nt, Staphylococcus aureus subsp. aureus Mu50
guguaugauagaauacuaaaag

SEQ ID NO: 2073455 - RNA, 14 nt, Staphylococcus aureus subsp. aureus Mu50
guguauauuauuuu

SEQ ID NO: 2073456 - RNA, 20 nt, Staphylococcus aureus subsp. aureus Mu50
gugcuauuaauuugauaaau

SEQ ID NO: 2073457 - RNA, 16 nt, Staphylococcus aureus subsp. aureus Mu50
gugcuaccuacuuguu

SEQ ID NO: 2073458 - RNA, 20 nt, Staphylococcus aureus subsp. aureus Mu50
gugcucuugcaauagcaaca

SEQ ID NO: 2073459 - RNA, 13 nt, Staphylococcus aureus subsp. aureus Mu50
gugcuuacuuuua

SEQ ID NO: 2073460 - RNA, 14 nt, Staphylococcus aureus subsp. aureus Mu50
gugcuuuaaaguug

SEQ ID NO: 2073461 - RNA, 23 nt, Staphylococcus aureus subsp. aureus Mu50
gugcuuucaccuuugaauauagu

SEQ ID NO: 2073462 - RNA, 16 nt, Staphylococcus aureus subsp. aureus Mu50
gugcuuuguuuaucaa

SEQ ID NO: 2073463 - RNA, 12 nt, Staphylococcus aureus subsp. aureus Mu50
gugcuuuuucaa

SEQ ID NO: 2073464 - RNA, 21 nt, Staphylococcus aureus subsp. aureus Mu50
gugcuuuuccauaaauauuua

SEQ ID NO: 2073465 - RNA, 15 nt, Staphylococcus aureus subsp. aureus Mu50
gugcgugaagagaug

SEQ ID NO: 2073466 - RNA, 12 nt, Staphylococcus aureus subsp. aureus Mu50
gugauaucuugc

SEQ ID NO: 2073467 - RNA, 21 nt, Staphylococcus aureus subsp. aureus Mu50
gugauauuaauugaaaaacca

SEQ ID NO: 2073468 - RNA, 18 nt, Staphylococcus aureus subsp. aureus Mu50
gucucacuuaauaaauaa

SEQ ID NO: 2073469 - RNA, 19 nt, Staphylococcus aureus subsp. aureus Mu50
gucuaucgccuaaaaauaa

SEQ ID NO: 2073470 - RNA, 21 nt, Staphylococcus aureus subsp. aureus Mu50
gucuaucuccgcuacaauuau

SEQ ID NO: 2073471 - RNA, 10 nt, Staphylococcus aureus subsp. aureus Mu50
gucuaugaau

SEQ ID NO: 2073472 - RNA, 22 nt, Staphylococcus aureus subsp. aureus Mu50
gucuaugaauaauguuuucauu

SEQ ID NO: 2073473 - RNA, 15 nt, Staphylococcus aureus subsp. aureus Mu50
gucuauguacaauaa

SEQ ID NO: 2073474 - RNA, 21 nt, Staphylococcus aureus subsp. aureus Mu50
gucuauuguaaaaacguucaa

SEQ ID NO: 2073475 - RNA, 22 nt, Staphylococcus aureus subsp. aureus Mu50
gugauuuuggaacauauucaua

SEQ ID NO: 2073476 - RNA, 17 nt, Staphylococcus aureus subsp. aureus Mu50
gugauuuguuacuucua

SEQ ID NO: 2073477 - RNA, 13 nt, Staphylococcus aureus subsp. aureus Mu50
gugcauuuagaug

SEQ ID NO: 2073478 - RNA, 17 nt, Staphylococcus aureus subsp. aureus Mu50
aaauauaguaauaaaag

SEQ ID NO: 2073479 - RNA, 18 nt, Staphylococcus aureus subsp. aureus Mu50
aaauauaguaauaaaagu

SEQ ID NO: 2073480 - RNA, 17 nt, Staphylococcus aureus subsp. aureus Mu50
aaauauaguaauuguua

SEQ ID NO: 2073481 - RNA, 12 nt, Staphylococcus aureus subsp. aureus Mu50
gugcaugacgau

SEQ ID NO: 2073482 - RNA, 23 nt, Staphylococcus aureus subsp. aureus Mu50
aaauauacuuuuaccauugugaa

SEQ ID NO: 2073483 - RNA, 17 nt, Staphylococcus aureus subsp. aureus Mu50
gugcauauuuaauacau

SEQ ID NO: 2073484 - RNA, 22 nt, Staphylococcus aureus subsp. aureus Mu50
gugcaacaaacgcugauuuaau

SEQ ID NO: 2073485 - RNA, 22 nt, Staphylococcus aureus subsp. aureus Mu50
gugccggcuuuuucuuuuguuu

SEQ ID NO: 2073486 - RNA, 15 nt, Staphylococcus aureus subsp. aureus Mu50
gugccucauccuuuu

SEQ ID NO: 2073487 - RNA, 14 nt, Staphylococcus aureus subsp. aureus Mu50
gucauuucaaucau

SEQ ID NO: 2073488 - RNA, 21 nt, Staphylococcus aureus subsp. aureus Mu50
gucauugguggagauuguaaa

SEQ ID NO: 2073489 - RNA, 20 nt, Staphylococcus aureus subsp. aureus Mu50
gucauaguauacauaauuca

SEQ ID NO: 2073490 - RNA, 18 nt, Staphylococcus aureus subsp. aureus Mu50
gucauacuaucuacaaua

SEQ ID NO: 2073491 - RNA, 19 nt, Staphylococcus aureus subsp. aureus Mu50
gucauacuaucuacaauaa

SEQ ID NO: 2073492 - RNA, 14 nt, Staphylococcus aureus subsp. aureus Mu50
gucauaccuuuuaa

SEQ ID NO: 2073493 - RNA, 23 nt, Staphylococcus aureus subsp. aureus Mu50
gucauacgcaaugauuauaaaua

SEQ ID NO: 2073494 - RNA, 13 nt, Staphylococcus aureus subsp. aureus Mu50
gucauaaaauacc

SEQ ID NO: 2073495 - RNA, 20 nt, Staphylococcus aureus subsp. aureus Mu50
gucauauacuauaugucuua

SEQ ID NO: 2073496 - RNA, 23 nt, Staphylococcus aureus subsp. aureus Mu50
gucaugaauuuucaucauuaaac

SEQ ID NO: 2073497 - RNA, 21 nt, Staphylococcus aureus subsp. aureus Mu50
gucaugcguuguguaacuuua

SEQ ID NO: 2073498 - RNA, 18 nt, Staphylococcus aureus subsp. aureus Mu50
guccauaaucuuuauuaa

SEQ ID NO: 2073499 - RNA, 17 nt, Staphylococcus aureus subsp. aureus Mu50
guccauuuccaugaaua

SEQ ID NO: 2073500 - RNA, 15 nt, Staphylococcus aureus subsp. aureus Mu50
guccgacuugauaaa

SEQ ID NO: 2073501 - RNA, 19 nt, Staphylococcus aureus subsp. aureus Mu50
guccgacuugauaaaaaau

SEQ ID NO: 2073502 - RNA, 17 nt, Staphylococcus aureus subsp. aureus Mu50
gucaauaauuuuaucua

SEQ ID NO: 2073503 - RNA, 17 nt, Staphylococcus aureus subsp. aureus Mu50
gucaaguaaauguuuua

SEQ ID NO: 2073504 - RNA, 17 nt, Staphylococcus aureus subsp. aureus Mu50
gucuaaagcuuauuaaa

SEQ ID NO: 2073505 - RNA, 14 nt, Staphylococcus aureus subsp. aureus Mu50
gucuacgaucaaaa

SEQ ID NO: 2073506 - RNA, 16 nt, Staphylococcus aureus subsp. aureus Mu50
gucuaauguuggaaaa

SEQ ID NO: 2073507 - RNA, 15 nt, Staphylococcus aureus subsp. aureus Mu50
gucgaauguuucuuc

SEQ ID NO: 2073508 - RNA, 21 nt, Staphylococcus aureus subsp. aureus Mu50
guauuuuguucaguuaaaucu

SEQ ID NO: 2073509 - RNA, 23 nt, Staphylococcus aureus subsp. aureus Mu50
guauuuuauuuauuuugauuaac

SEQ ID NO: 2073510 - RNA, 15 nt, Staphylococcus aureus subsp. aureus Mu50
guauuuuucaaauaa

SEQ ID NO: 2073511 - RNA, 22 nt, Staphylococcus aureus subsp. aureus Mu50
guauuucugaaaugauacauua

SEQ ID NO: 2073512 - RNA, 20 nt, Staphylococcus aureus subsp. aureus Mu50
guauuuuaaugauuuuucau

SEQ ID NO: 2073513 - RNA, 13 nt, Staphylococcus aureus subsp. aureus Mu50
guauuuuaaauuu

SEQ ID NO: 2073514 - RNA, 16 nt, Staphylococcus aureus subsp. aureus Mu50
guauuuaccuucuucu

SEQ ID NO: 2073515 - RNA, 18 nt, Staphylococcus aureus subsp. aureus Mu50
guauuuauacuauaaaua

SEQ ID NO: 2073516 - RNA, 15 nt, Staphylococcus aureus subsp. aureus Mu50
guauuuauagauuua

SEQ ID NO: 2073517 - RNA, 21 nt, Staphylococcus aureus subsp. aureus Mu50
guauugcauguuuaaauauca

SEQ ID NO: 2073518 - RNA, 17 nt, Staphylococcus aureus subsp. aureus Mu50
guauugccaaauuucuc

SEQ ID NO: 2073519 - RNA, 22 nt, Staphylococcus aureus subsp. aureus Mu50
guauucaaauaaacacaucuau

SEQ ID NO: 2073520 - RNA, 19 nt, Staphylococcus aureus subsp. aureus Mu50
guauuauucucucauuugu

SEQ ID NO: 2073521 - RNA, 15 nt, Staphylococcus aureus subsp. aureus Mu50
guauucaaaaaauau

SEQ ID NO: 2073522 - RNA, 23 nt, Staphylococcus aureus subsp. aureus Mu50
guauucagucaguaaaaauacau

SEQ ID NO: 2073523 - RNA, 19 nt, Staphylococcus aureus subsp. aureus Mu50
guauucuuggcguauuuuu

SEQ ID NO: 2073524 - RNA, 12 nt, Staphylococcus aureus subsp. aureus Mu50
guauugauucaa

SEQ ID NO: 2073525 - RNA, 19 nt, Staphylococcus aureus subsp. aureus Mu50
guauucuauuuuucaauuc

SEQ ID NO: 2073526 - RNA, 15 nt, Staphylococcus aureus subsp. aureus Mu50
guauucuauuuuuca

SEQ ID NO: 2073527 - RNA, 19 nt, Staphylococcus aureus subsp. aureus Mu50
guauuagccaauaaaaugu

SEQ ID NO: 2073528 - RNA, 15 nt, Staphylococcus aureus subsp. aureus Mu50
guauuaaacauugcu

SEQ ID NO: 2073529 - RNA, 22 nt, Staphylococcus aureus subsp. aureus Mu50
guaugcuuguacaaaaaauugu

SEQ ID NO: 2073530 - RNA, 21 nt, Staphylococcus aureus subsp. aureus Mu50
guaugauagaugauacauucu

SEQ ID NO: 2073531 - RNA, 20 nt, Staphylococcus aureus subsp. aureus Mu50
guaugcaucaguuaauaauu

SEQ ID NO: 2073532 - RNA, 17 nt, Staphylococcus aureus subsp. aureus Mu50
guaucauaauuuuguuu

SEQ ID NO: 2073533 - RNA, 20 nt, Staphylococcus aureus subsp. aureus Mu50
guaucauuguguccauaaau

SEQ ID NO: 2073534 - RNA, 12 nt, Staphylococcus aureus subsp. aureus Mu50
guaucauuuaaa

SEQ ID NO: 2073535 - RNA, 15 nt, Staphylococcus aureus subsp. aureus Mu50
guaucauuuaaaaua

SEQ ID NO: 2073536 - RNA, 16 nt, Staphylococcus aureus subsp. aureus Mu50
guaucaucaaaguuua

SEQ ID NO: 2073537 - RNA, 16 nt, Staphylococcus aureus subsp. aureus Mu50
guaucaacauuaauaa

SEQ ID NO: 2073538 - RNA, 17 nt, Staphylococcus aureus subsp. aureus Mu50
guaucaacauuaauaaa

SEQ ID NO: 2073539 - RNA, 16 nt, Staphylococcus aureus subsp. aureus Mu50
guaucaagaaaaaguu

SEQ ID NO: 2073540 - RNA, 22 nt, Staphylococcus aureus subsp. aureus Mu50
guaucaagaaaaaguuuuucug

SEQ ID NO: 2073541 - RNA, 14 nt, Staphylococcus aureus subsp. aureus Mu50
guaucgccaucauu

SEQ ID NO: 2073542 - RNA, 15 nt, Staphylococcus aureus subsp. aureus Mu50
guaucgccaaucuau

SEQ ID NO: 2073543 - RNA, 17 nt, Staphylococcus aureus subsp. aureus Mu50
guaucgccaaucuauug

SEQ ID NO: 2073544 - RNA, 15 nt, Staphylococcus aureus subsp. aureus Mu50
guaucguuaccuuuu

SEQ ID NO: 2073545 - RNA, 14 nt, Staphylococcus aureus subsp. aureus Mu50
guaucuauaaaaag

SEQ ID NO: 2073546 - RNA, 23 nt, Staphylococcus aureus subsp. aureus Mu50
guaucuaguguucucauuauaau

SEQ ID NO: 2073547 - RNA, 14 nt, Staphylococcus aureus subsp. aureus Mu50
guaugagucaaauu

SEQ ID NO: 2073548 - RNA, 16 nt, Staphylococcus aureus subsp. aureus Mu50
guaucuugucauuuga

SEQ ID NO: 2073549 - RNA, 16 nt, Staphylococcus aureus subsp. aureus Mu50
guaucuauaaaaagaa

SEQ ID NO: 2073550 - RNA, 22 nt, Staphylococcus aureus subsp. aureus Mu50
guaucucugaaaaacuucuuaa

SEQ ID NO: 2073551 - RNA, 20 nt, Staphylococcus aureus subsp. aureus Mu50
guaucucugaaaaacuucuu

SEQ ID NO: 2073552 - RNA, 21 nt, Staphylococcus aureus subsp. aureus Mu50
guaucucugaaaaacuucuua

SEQ ID NO: 2073553 - RNA, 22 nt, Staphylococcus aureus subsp. aureus Mu50
guauagauuguauuuaauaagu

SEQ ID NO: 2073554 - RNA, 13 nt, Staphylococcus aureus subsp. aureus Mu50
guaucaaaauuuu

SEQ ID NO: 2073555 - RNA, 17 nt, Staphylococcus aureus subsp. aureus Mu50
guauauggcgauaacaa

SEQ ID NO: 2073556 - RNA, 19 nt, Staphylococcus aureus subsp. aureus Mu50
guauaugaauuuuauaaau

SEQ ID NO: 2073557 - RNA, 17 nt, Staphylococcus aureus subsp. aureus Mu50
guauauaaguuaaaauu

SEQ ID NO: 2073558 - RNA, 22 nt, Staphylococcus aureus subsp. aureus Mu50
guauauaaguuaaaauugguuu

SEQ ID NO: 2073559 - RNA, 20 nt, Staphylococcus aureus subsp. aureus Mu50
guauauauauauuaaaacaa

SEQ ID NO: 2073560 - RNA, 14 nt, Staphylococcus aureus subsp. aureus Mu50
guaguuuauaucaa

SEQ ID NO: 2073561 - RNA, 20 nt, Staphylococcus aureus subsp. aureus Mu50
guaguuccucgguauucaau

SEQ ID NO: 2073562 - RNA, 22 nt, Staphylococcus aureus subsp. aureus Mu50
guauaaagggcuauuugauaca

SEQ ID NO: 2073563 - RNA, 18 nt, Staphylococcus aureus subsp. aureus Mu50
guauaaauaaaaauacau

SEQ ID NO: 2073564 - RNA, 12 nt, Staphylococcus aureus subsp. aureus Mu50
guauaaauaaaa

SEQ ID NO: 2073565 - RNA, 14 nt, Staphylococcus aureus subsp. aureus Mu50
guauaaaacagaau

SEQ ID NO: 2073566 - RNA, 21 nt, Staphylococcus aureus subsp. aureus Mu50
guauaagggguauauuaaaaa

SEQ ID NO: 2073567 - RNA, 19 nt, Staphylococcus aureus subsp. aureus Mu50
guauaaccauaaugaacag

SEQ ID NO: 2073568 - RNA, 17 nt, Staphylococcus aureus subsp. aureus Mu50
guauaaccauguauauc

SEQ ID NO: 2073569 - RNA, 14 nt, Staphylococcus aureus subsp. aureus Mu50
guauaaccauaaug

SEQ ID NO: 2073570 - RNA, 22 nt, Staphylococcus aureus subsp. aureus Mu50
guauaaauaucauaaaugcaua

SEQ ID NO: 2073571 - RNA, 17 nt, Staphylococcus aureus subsp. aureus Mu50
guauaaaugcagcugua

SEQ ID NO: 2073572 - RNA, 21 nt, Staphylococcus aureus subsp. aureus Mu50
guauaauggacgguauuuuca

SEQ ID NO: 2073573 - RNA, 22 nt, Staphylococcus aureus subsp. aureus Mu50
guauaauggacgguauuuucaa

SEQ ID NO: 2073574 - RNA, 14 nt, Staphylococcus aureus subsp. aureus Mu50
guauaauuaaacua

SEQ ID NO: 2073575 - RNA, 16 nt, Staphylococcus aureus subsp. aureus Mu50
guaggauaauuucaau

SEQ ID NO: 2073576 - RNA, 18 nt, Staphylococcus aureus subsp. aureus Mu50
guaggaggcuuuugcuuu

SEQ ID NO: 2073577 - RNA, 14 nt, Staphylococcus aureus subsp. aureus Mu50
guagcuugaauaau

SEQ ID NO: 2073578 - RNA, 22 nt, Staphylococcus aureus subsp. aureus Mu50
guagcuuaacguugcagagaau

SEQ ID NO: 2073579 - RNA, 20 nt, Staphylococcus aureus subsp. aureus Mu50
guaggggagucuuauuuuua

SEQ ID NO: 2073580 - RNA, 19 nt, Staphylococcus aureus subsp. aureus Mu50
guaguacacgaauucauua

SEQ ID NO: 2073581 - RNA, 16 nt, Staphylococcus aureus subsp. aureus Mu50
guaguacuauagucau

SEQ ID NO: 2073582 - RNA, 15 nt, Staphylococcus aureus subsp. aureus Mu50
guagucaaaauugug

SEQ ID NO: 2073583 - RNA, 13 nt, Staphylococcus aureus subsp. aureus Mu50
guaguuaauauaa

SEQ ID NO: 2073584 - RNA, 18 nt, Staphylococcus aureus subsp. aureus Mu50
guagauucaaauugguuu

SEQ ID NO: 2073585 - RNA, 18 nt, Staphylococcus aureus subsp. aureus Mu50
guagauuuauuaaauaua

SEQ ID NO: 2073586 - RNA, 20 nt, Staphylococcus aureus subsp. aureus Mu50
guagcaacauuauuuuuguc

SEQ ID NO: 2073587 - RNA, 19 nt, Staphylococcus aureus subsp. aureus Mu50
guagauaaaucgauaaaau

SEQ ID NO: 2073588 - RNA, 16 nt, Staphylococcus aureus subsp. aureus Mu50
guagauauugaaugga

SEQ ID NO: 2073589 - RNA, 18 nt, Staphylococcus aureus subsp. aureus Mu50
guagaaacacaaggaaua

SEQ ID NO: 2073590 - RNA, 16 nt, Staphylococcus aureus subsp. aureus Mu50
guacuuaaaaauagga

SEQ ID NO: 2073591 - RNA, 14 nt, Staphylococcus aureus subsp. aureus Mu50
guacuuacaaauau

SEQ ID NO: 2073592 - RNA, 21 nt, Staphylococcus aureus subsp. aureus Mu50
guacuuaccuuucaaauauau

SEQ ID NO: 2073593 - RNA, 22 nt, Staphylococcus aureus subsp. aureus Mu50
guacuuuuauguuguuauaaag

SEQ ID NO: 2073594 - RNA, 23 nt, Staphylococcus aureus subsp. aureus Mu50
guacuuugauaucuacagagaau

SEQ ID NO: 2073595 - RNA, 20 nt, Staphylococcus aureus subsp. aureus Mu50
guacguuuuuuuaaauacau

SEQ ID NO: 2073596 - RNA, 19 nt, Staphylococcus aureus subsp. aureus Mu50
guacuauuaucuauccauu

SEQ ID NO: 2073597 - RNA, 21 nt, Staphylococcus aureus subsp. aureus Mu50
guacuguguuuagguauauaa

SEQ ID NO: 2073598 - RNA, 21 nt, Staphylococcus aureus subsp. aureus Mu50
guaaaaugcucccuucaaagu

SEQ ID NO: 2073599 - RNA, 23 nt, Staphylococcus aureus subsp. aureus Mu50
guaaaccgaggugucaauaaauu

SEQ ID NO: 2073600 - RNA, 23 nt, Staphylococcus aureus subsp. aureus Mu50
guaaaauuuucguguuaauaacc

SEQ ID NO: 2073601 - RNA, 14 nt, Staphylococcus aureus subsp. aureus Mu50
guaaagcaugaaua

SEQ ID NO: 2073602 - RNA, 16 nt, Staphylococcus aureus subsp. aureus Mu50
guaaagccaccuaaau

SEQ ID NO: 2073603 - RNA, 22 nt, Staphylococcus aureus subsp. aureus Mu50
guaaauuaauagagaaagaaua

SEQ ID NO: 2073604 - RNA, 16 nt, Staphylococcus aureus subsp. aureus Mu50
guaaauguuaaauucu

SEQ ID NO: 2073605 - RNA, 21 nt, Staphylococcus aureus subsp. aureus Mu50
guaaaucgugcuguuaucaug

SEQ ID NO: 2073606 - RNA, 19 nt, Staphylococcus aureus subsp. aureus Mu50
guaaauaaaaauuauauaa

SEQ ID NO: 2073607 - RNA, 12 nt, Staphylococcus aureus subsp. aureus Mu50
guaaauauaaau

SEQ ID NO: 2073608 - RNA, 18 nt, Staphylococcus aureus subsp. aureus Mu50
guaaaucacgauuuucaa

SEQ ID NO: 2073609 - RNA, 22 nt, Staphylococcus aureus subsp. aureus Mu50
guaaauauuuuuuaaaaugaua

SEQ ID NO: 2073610 - RNA, 21 nt, Staphylococcus aureus subsp. aureus Mu50
guaaauccuuuauauucuaau

SEQ ID NO: 2073611 - RNA, 18 nt, Staphylococcus aureus subsp. aureus Mu50
guaacaauuuagcaaaua

SEQ ID NO: 2073612 - RNA, 14 nt, Staphylococcus aureus subsp. aureus Mu50
guaaauuuaaaaua

SEQ ID NO: 2073613 - RNA, 12 nt, Staphylococcus aureus subsp. aureus Mu50
guaaauuuauca

SEQ ID NO: 2073614 - RNA, 18 nt, Staphylococcus aureus subsp. aureus Mu50
guaacauuaaaaauaaaa

SEQ ID NO: 2073615 - RNA, 13 nt, Staphylococcus aureus subsp. aureus Mu50
guaacauuuaaaa

SEQ ID NO: 2073616 - RNA, 15 nt, Staphylococcus aureus subsp. aureus Mu50
guaacauaucagcuu

SEQ ID NO: 2073617 - RNA, 17 nt, Staphylococcus aureus subsp. aureus Mu50
guaacauaucagcuuuu

SEQ ID NO: 2073618 - RNA, 22 nt, Staphylococcus aureus subsp. aureus Mu50
guaauagaacgaaauaguucaa

SEQ ID NO: 2073619 - RNA, 21 nt, Staphylococcus aureus subsp. aureus Mu50
guaauagaacgaaauaguuca

SEQ ID NO: 2073620 - RNA, 19 nt, Staphylococcus aureus subsp. aureus Mu50
guaauacuauaugaaaaga

SEQ ID NO: 2073621 - RNA, 21 nt, Staphylococcus aureus subsp. aureus Mu50
guaauacuauaugaaaagaga

SEQ ID NO: 2073622 - RNA, 15 nt, Staphylococcus aureus subsp. aureus Mu50
guaauauauaaaagu

SEQ ID NO: 2073623 - RNA, 12 nt, Staphylococcus aureus subsp. aureus Mu50
guaauauuuuug

SEQ ID NO: 2073624 - RNA, 20 nt, Staphylococcus aureus subsp. aureus Mu50
guaauauuuuuguugcaauu

SEQ ID NO: 2073625 - RNA, 19 nt, Staphylococcus aureus subsp. aureus Mu50
guaauacaucaucaaguuc

SEQ ID NO: 2073626 - RNA, 16 nt, Staphylococcus aureus subsp. aureus Mu50
guaauaaguaauaauu

SEQ ID NO: 2073627 - RNA, 19 nt, Staphylococcus aureus subsp. aureus Mu50
guaauaauucagaugaaua

SEQ ID NO: 2073628 - RNA, 14 nt, Staphylococcus aureus subsp. aureus Mu50
guaauaauuuacag

SEQ ID NO: 2073629 - RNA, 23 nt, Staphylococcus aureus subsp. aureus Mu50
guaauaaaagucgauaaauauga

SEQ ID NO: 2073630 - RNA, 20 nt, Staphylococcus aureus subsp. aureus Mu50
guaagcuucuguguuggggc

SEQ ID NO: 2073631 - RNA, 21 nt, Staphylococcus aureus subsp. aureus Mu50
guaagcuucuguguuggggcc

SEQ ID NO: 2073632 - RNA, 16 nt, Staphylococcus aureus subsp. aureus Mu50
guaaguaauaaaauaa

SEQ ID NO: 2073633 - RNA, 20 nt, Staphylococcus aureus subsp. aureus Mu50
guaaguuuaguucaaagcga

SEQ ID NO: 2073634 - RNA, 13 nt, Staphylococcus aureus subsp. aureus Mu50
guaagugcucaaa

SEQ ID NO: 2073635 - RNA, 13 nt, Staphylococcus aureus subsp. aureus Mu50
guaacugauuuug

SEQ ID NO: 2073636 - RNA, 14 nt, Staphylococcus aureus subsp. aureus Mu50
guaagaacgaaacu

SEQ ID NO: 2073637 - RNA, 17 nt, Staphylococcus aureus subsp. aureus Mu50
guaacuuuaucacugua

SEQ ID NO: 2073638 - RNA, 20 nt, Staphylococcus aureus subsp. aureus Mu50
guaacuuuuuacauuuucaa

SEQ ID NO: 2073639 - RNA, 19 nt, Staphylococcus aureus subsp. aureus Mu50
guaagaccccgaaaagagg

SEQ ID NO: 2073640 - RNA, 17 nt, Staphylococcus aureus subsp. aureus Mu50
guaagcagagccauaau

SEQ ID NO: 2073641 - RNA, 13 nt, Staphylococcus aureus subsp. aureus Mu50
guaacuaaaaugu

SEQ ID NO: 2073642 - RNA, 14 nt, Staphylococcus aureus subsp. aureus Mu50
guaacuaaaauguc

SEQ ID NO: 2073643 - RNA, 17 nt, Staphylococcus aureus subsp. aureus Mu50
guaacgcgcaaugagua

SEQ ID NO: 2073644 - RNA, 15 nt, Staphylococcus aureus subsp. aureus Mu50
guaaccuuaaauaua

SEQ ID NO: 2073645 - RNA, 17 nt, Staphylococcus aureus subsp. aureus Mu50
guaaccauuuuuuuauc

SEQ ID NO: 2073646 - RNA, 11 nt, Staphylococcus aureus subsp. aureus Mu50
guaauuguaau

SEQ ID NO: 2073647 - RNA, 15 nt, Staphylococcus aureus subsp. aureus Mu50
guaauuguaaucuau

SEQ ID NO: 2073648 - RNA, 17 nt, Staphylococcus aureus subsp. aureus Mu50
guaauuuaauugguucu

SEQ ID NO: 2073649 - RNA, 13 nt, Staphylococcus aureus subsp. aureus Mu50
guaauuucuccaa

SEQ ID NO: 2073650 - RNA, 19 nt, Staphylococcus aureus subsp. aureus Mu50
guaauuuaaaauaguucuu

SEQ ID NO: 2073651 - RNA, 17 nt, Staphylococcus aureus subsp. aureus Mu50
guaauuguaaucuauuu

SEQ ID NO: 2073652 - RNA, 13 nt, Staphylococcus aureus subsp. aureus Mu50
guaauuuaaaaua

SEQ ID NO: 2073653 - RNA, 14 nt, Staphylococcus aureus subsp. aureus Mu50
guaauuauuauaau

SEQ ID NO: 2073654 - RNA, 13 nt, Staphylococcus aureus subsp. aureus Mu50
guaauuauuuuuc

SEQ ID NO: 2073655 - RNA, 23 nt, Staphylococcus aureus subsp. aureus Mu50
guaauuauuuuucucaacaguuu

SEQ ID NO: 2073656 - RNA, 20 nt, Staphylococcus aureus subsp. aureus Mu50
guaauguuccccugaaaaga

SEQ ID NO: 2073657 - RNA, 21 nt, Staphylococcus aureus subsp. aureus Mu50
guaauguuccccugaaaagaa

SEQ ID NO: 2073658 - RNA, 17 nt, Staphylococcus aureus subsp. aureus Mu50
guaauuuuuaaaucuac

SEQ ID NO: 2073659 - RNA, 12 nt, Staphylococcus aureus subsp. aureus Mu50
guacaaauaaua

SEQ ID NO: 2073660 - RNA, 21 nt, Staphylococcus aureus subsp. aureus Mu50
guacaauaauaccuucaauug

SEQ ID NO: 2073661 - RNA, 19 nt, Staphylococcus aureus subsp. aureus Mu50
guacacauccucauaauua

SEQ ID NO: 2073662 - RNA, 19 nt, Staphylococcus aureus subsp. aureus Mu50
aaauagauugaaaaaauaa

SEQ ID NO: 2073663 - RNA, 20 nt, Staphylococcus aureus subsp. aureus Mu50
guaaucuaauacauacggca

SEQ ID NO: 2073664 - RNA, 11 nt, Staphylococcus aureus subsp. aureus Mu50
guaaucuauuu

SEQ ID NO: 2073665 - RNA, 18 nt, Staphylococcus aureus subsp. aureus Mu50
guaaugaagauuuuguug

SEQ ID NO: 2073666 - RNA, 12 nt, Staphylococcus aureus subsp. aureus Mu50
guaaucuuuuaa

SEQ ID NO: 2073667 - RNA, 17 nt, Staphylococcus aureus subsp. aureus Mu50
guaaugaaucaauugca

SEQ ID NO: 2073668 - RNA, 22 nt, Staphylococcus aureus subsp. aureus Mu50
guaaugaccggcauauaaucca

SEQ ID NO: 2073669 - RNA, 12 nt, Staphylococcus aureus subsp. aureus Mu50
guaaugauuuug

SEQ ID NO: 2073670 - RNA, 16 nt, Staphylococcus aureus subsp. aureus Mu50
guaaugcuugagcuuu

SEQ ID NO: 2073671 - RNA, 15 nt, Staphylococcus aureus subsp. aureus Mu50
guaaucccauuuuaa

SEQ ID NO: 2073672 - RNA, 21 nt, Staphylococcus aureus subsp. aureus Mu50
guaaucagguuuaaacaguuu

SEQ ID NO: 2073673 - RNA, 18 nt, Staphylococcus aureus subsp. aureus Mu50
guaaucauagcaacaucg

SEQ ID NO: 2073674 - RNA, 18 nt, Staphylococcus aureus subsp. aureus Mu50
aaauagacaccaaaaaac

SEQ ID NO: 2073675 - RNA, 22 nt, Staphylococcus aureus subsp. aureus Mu50
aaauagacaccaaaaaacagag

SEQ ID NO: 2073676 - RNA, 16 nt, Staphylococcus aureus subsp. aureus Mu50
aaauagaugagaaagu

SEQ ID NO: 2073677 - RNA, 20 nt, Staphylococcus aureus subsp. aureus Mu50
aaauagacugccaauaaaau

SEQ ID NO: 2073678 - RNA, 16 nt, Staphylococcus aureus subsp. aureus Mu50
guacauguauuggcca

SEQ ID NO: 2073679 - RNA, 17 nt, Staphylococcus aureus subsp. aureus Mu50
guacauauguuguuucu

SEQ ID NO: 2073680 - RNA, 15 nt, Staphylococcus aureus subsp. aureus Mu50
guacaguaauauuca

SEQ ID NO: 2073681 - RNA, 17 nt, Staphylococcus aureus subsp. aureus Mu50
guacauaaaugcuaaaa

SEQ ID NO: 2073682 - RNA, 17 nt, Staphylococcus aureus subsp. aureus Mu50
guacacuuuugauuguu

SEQ ID NO: 2073683 - RNA, 14 nt, Staphylococcus aureus subsp. aureus Mu50
guacagauaagaau

SEQ ID NO: 2073684 - RNA, 15 nt, Staphylococcus aureus subsp. aureus Mu50
guaccaccccaacuu

SEQ ID NO: 2073685 - RNA, 14 nt, Staphylococcus aureus subsp. aureus Mu50
guaccaauuagcau

SEQ ID NO: 2073686 - RNA, 15 nt, Staphylococcus aureus subsp. aureus Mu50
guaccaauuagcaug

SEQ ID NO: 2073687 - RNA, 16 nt, Staphylococcus aureus subsp. aureus Mu50
guacauuuauuuucaa

SEQ ID NO: 2073688 - RNA, 15 nt, Staphylococcus aureus subsp. aureus Mu50
guacauugguuuuua

SEQ ID NO: 2073689 - RNA, 13 nt, Staphylococcus aureus subsp. aureus Mu50
guaccaaauaaau

SEQ ID NO: 2073690 - RNA, 16 nt, Staphylococcus aureus subsp. aureus Mu50
guacauuguaaauaua

SEQ ID NO: 2073691 - RNA, 22 nt, Staphylococcus aureus subsp. aureus Mu50
guacauuuauuuucaauaaaua

SEQ ID NO: 2073692 - RNA, 18 nt, Staphylococcus aureus subsp. aureus Mu50
guaccaucucuauuuuuu

SEQ ID NO: 2073693 - RNA, 21 nt, Staphylococcus aureus subsp. aureus Mu50
guaccacucauaaucaagucu

SEQ ID NO: 2073694 - RNA, 13 nt, Staphylococcus aureus subsp. aureus Mu50
guaccguauuuua

SEQ ID NO: 2073695 - RNA, 19 nt, Staphylococcus aureus subsp. aureus Mu50
guacgcaauuuaauauuau

SEQ ID NO: 2073696 - RNA, 15 nt, Staphylococcus aureus subsp. aureus Mu50
guacgaggaccaucu

SEQ ID NO: 2073697 - RNA, 20 nt, Staphylococcus aureus subsp. aureus Mu50
guacggcugcuuuaacugua

SEQ ID NO: 2073698 - RNA, 21 nt, Staphylococcus aureus subsp. aureus Mu50
ggugcuuuuggaugauuggua

SEQ ID NO: 2073699 - RNA, 20 nt, Staphylococcus aureus subsp. aureus Mu50
ggugagggccccaacacaga

SEQ ID NO: 2073700 - RNA, 17 nt, Staphylococcus aureus subsp. aureus Mu50
ggugaguguuucauaau

SEQ ID NO: 2073701 - RNA, 13 nt, Staphylococcus aureus subsp. aureus Mu50
ggugagggcccca

SEQ ID NO: 2073702 - RNA, 18 nt, Staphylococcus aureus subsp. aureus Mu50
gguuucuuauuaaauaag

SEQ ID NO: 2073703 - RNA, 19 nt, Staphylococcus aureus subsp. aureus Mu50
gguuuucuuaauuauggua

SEQ ID NO: 2073704 - RNA, 11 nt, Staphylococcus aureus subsp. aureus Mu50
gguuugagaau

SEQ ID NO: 2073705 - RNA, 20 nt, Staphylococcus aureus subsp. aureus Mu50
guaaaaccaaaucguuucau

SEQ ID NO: 2073706 - RNA, 21 nt, Staphylococcus aureus subsp. aureus Mu50
guaaaacauucccuuaauaau

SEQ ID NO: 2073707 - RNA, 23 nt, Staphylococcus aureus subsp. aureus Mu50
guaaaacaaauuacacccuuuaa

SEQ ID NO: 2073708 - RNA, 17 nt, Staphylococcus aureus subsp. aureus Mu50
gguuuuuuauuuucaua

SEQ ID NO: 2073709 - RNA, 18 nt, Staphylococcus aureus subsp. aureus Mu50
guaaaaacguucaaucgu

SEQ ID NO: 2073710 - RNA, 15 nt, Staphylococcus aureus subsp. aureus Mu50
gguucuucaauaugc

SEQ ID NO: 2073711 - RNA, 19 nt, Staphylococcus aureus subsp. aureus Mu50
gguuguuuuucaucauuaa

SEQ ID NO: 2073712 - RNA, 21 nt, Staphylococcus aureus subsp. aureus Mu50
gguuuaaucuauauauauaug

SEQ ID NO: 2073713 - RNA, 23 nt, Staphylococcus aureus subsp. aureus Mu50
gguguagauaaaucgauaaaaug

SEQ ID NO: 2073714 - RNA, 15 nt, Staphylococcus aureus subsp. aureus Mu50
gguguuuaacuaaac

SEQ ID NO: 2073715 - RNA, 16 nt, Staphylococcus aureus subsp. aureus Mu50
gguguggugugaugua

SEQ ID NO: 2073716 - RNA, 12 nt, Staphylococcus aureus subsp. aureus Mu50
gguuauuugaua

SEQ ID NO: 2073717 - RNA, 12 nt, Staphylococcus aureus subsp. aureus Mu50
gguucaucuaaa

SEQ ID NO: 2073718 - RNA, 11 nt, Staphylococcus aureus subsp. aureus Mu50
gccuggcaacg

SEQ ID NO: 2073719 - RNA, 13 nt, Staphylococcus aureus subsp. aureus Mu50
gccuucauuagcc

SEQ ID NO: 2073720 - RNA, 17 nt, Staphylococcus aureus subsp. aureus Mu50
gccuuuuuuauuguaau

SEQ ID NO: 2073721 - RNA, 22 nt, Staphylococcus aureus subsp. aureus Mu50
gccuucuguacguuuuaaauaa

SEQ ID NO: 2073722 - RNA, 23 nt, Staphylococcus aureus subsp. aureus Mu50
gccugcaucaccugaugaauaga

SEQ ID NO: 2073723 - RNA, 16 nt, Staphylococcus aureus subsp. aureus Mu50
gcgacuuaacuuaagc

SEQ ID NO: 2073724 - RNA, 18 nt, Staphylococcus aureus subsp. aureus Mu50
gcgacauuuguaaauauu

SEQ ID NO: 2073725 - RNA, 19 nt, Staphylococcus aureus subsp. aureus Mu50
gcgacauguccauaauauc

SEQ ID NO: 2073726 - RNA, 15 nt, Staphylococcus aureus subsp. aureus Mu50
gcgacauguccuguu

SEQ ID NO: 2073727 - RNA, 20 nt, Staphylococcus aureus subsp. aureus Mu50
aaagcuauaaaaaaucuuuu

SEQ ID NO: 2073728 - RNA, 23 nt, Staphylococcus aureus subsp. aureus Mu50
aaagcuauaaaaaaucuuuugau

SEQ ID NO: 2073729 - RNA, 15 nt, Staphylococcus aureus subsp. aureus Mu50
aaagcuauaaaaaau

SEQ ID NO: 2073730 - RNA, 23 nt, Staphylococcus aureus subsp. aureus Mu50
aaagcuauauaugaauugaguau

SEQ ID NO: 2073731 - RNA, 22 nt, Staphylococcus aureus subsp. aureus Mu50
aaagcguccucuugugaaauua

SEQ ID NO: 2073732 - RNA, 13 nt, Staphylococcus aureus subsp. aureus Mu50
aaagcuaauuuuu

SEQ ID NO: 2073733 - RNA, 21 nt, Staphylococcus aureus subsp. aureus Mu50
gccaucuaggucacuuuuaug

SEQ ID NO: 2073734 - RNA, 23 nt, Staphylococcus aureus subsp. aureus Mu50
gccauuuuuauuuaacacuucag

SEQ ID NO: 2073735 - RNA, 17 nt, Staphylococcus aureus subsp. aureus Mu50
gccauagaaaugugcug

SEQ ID NO: 2073736 - RNA, 16 nt, Staphylococcus aureus subsp. aureus Mu50
gccaucaauuucugua

SEQ ID NO: 2073737 - RNA, 21 nt, Staphylococcus aureus subsp. aureus Mu50
gccaucaauauugauaucgaa

SEQ ID NO: 2073738 - RNA, 14 nt, Staphylococcus aureus subsp. aureus Mu50
gccaguccauuauu

SEQ ID NO: 2073739 - RNA, 15 nt, Staphylococcus aureus subsp. aureus Mu50
gccccaacaaagaga

SEQ ID NO: 2073740 - RNA, 12 nt, Staphylococcus aureus subsp. aureus Mu50
gccccaacacag

SEQ ID NO: 2073741 - RNA, 13 nt, Staphylococcus aureus subsp. aureus Mu50
gccccaacacaga

SEQ ID NO: 2073742 - RNA, 17 nt, Staphylococcus aureus subsp. aureus Mu50
gccccaacacagagaau

SEQ ID NO: 2073743 - RNA, 15 nt, Staphylococcus aureus subsp. aureus Mu50
gcccgacaucauaaa

SEQ ID NO: 2073744 - RNA, 22 nt, Staphylococcus aureus subsp. aureus Mu50
gccaccuuguuuaaguuuuuca

SEQ ID NO: 2073745 - RNA, 14 nt, Staphylococcus aureus subsp. aureus Mu50
gccaauaaaauguc

SEQ ID NO: 2073746 - RNA, 17 nt, Staphylococcus aureus subsp. aureus Mu50
gccacaacauguuugga

SEQ ID NO: 2073747 - RNA, 13 nt, Staphylococcus aureus subsp. aureus Mu50
gccaauuaaaauu

SEQ ID NO: 2073748 - RNA, 20 nt, Staphylococcus aureus subsp. aureus Mu50
gccaacaucuucaacauaac

SEQ ID NO: 2073749 - RNA, 13 nt, Staphylococcus aureus subsp. aureus Mu50
gccaacaguaauu

SEQ ID NO: 2073750 - RNA, 21 nt, Staphylococcus aureus subsp. aureus Mu50
gccaaacaaccugugauaaaa

SEQ ID NO: 2073751 - RNA, 22 nt, Staphylococcus aureus subsp. aureus Mu50
gcauauaaagucauacuuauga

SEQ ID NO: 2073752 - RNA, 14 nt, Staphylococcus aureus subsp. aureus Mu50
gcaguaauuuucau

SEQ ID NO: 2073753 - RNA, 22 nt, Staphylococcus aureus subsp. aureus Mu50
gcaguaguugacugaacgaaaa

SEQ ID NO: 2073754 - RNA, 16 nt, Staphylococcus aureus subsp. aureus Mu50
gcauaccuauaaacau

SEQ ID NO: 2073755 - RNA, 15 nt, Staphylococcus aureus subsp. aureus Mu50
gcauucuuccaacac

SEQ ID NO: 2073756 - RNA, 20 nt, Staphylococcus aureus subsp. aureus Mu50
gcauuguaauaccaauuuuu

SEQ ID NO: 2073757 - RNA, 19 nt, Staphylococcus aureus subsp. aureus Mu50
gcauuuuuauguuaaaucg

SEQ ID NO: 2073758 - RNA, 13 nt, Staphylococcus aureus subsp. aureus Mu50
gcauuuuguuuca

SEQ ID NO: 2073759 - RNA, 18 nt, Staphylococcus aureus subsp. aureus Mu50
gcauuuuuucauuauuaa

SEQ ID NO: 2073760 - RNA, 18 nt, Staphylococcus aureus subsp. aureus Mu50
gcauuacuaucuucauca

SEQ ID NO: 2073761 - RNA, 20 nt, Staphylococcus aureus subsp. aureus Mu50
gcauuauuauuucauuagaa

SEQ ID NO: 2073762 - RNA, 21 nt, Staphylococcus aureus subsp. aureus Mu50
gcauuauuauuucauuagaaa

SEQ ID NO: 2073763 - RNA, 17 nt, Staphylococcus aureus subsp. aureus Mu50
gcaugacagcaaauuuu

SEQ ID NO: 2073764 - RNA, 19 nt, Staphylococcus aureus subsp. aureus Mu50
gcaugaaucgcauuuaaau

SEQ ID NO: 2073765 - RNA, 14 nt, Staphylococcus aureus subsp. aureus Mu50
gcaugacuguaagu

SEQ ID NO: 2073766 - RNA, 15 nt, Staphylococcus aureus subsp. aureus Mu50
gcaugacuguaagua

SEQ ID NO: 2073767 - RNA, 21 nt, Staphylococcus aureus subsp. aureus Mu50
gcaucuuuuacugcuucgaca

SEQ ID NO: 2073768 - RNA, 13 nt, Staphylococcus aureus subsp. aureus Mu50
gcagggugcuaaa

SEQ ID NO: 2073769 - RNA, 13 nt, Staphylococcus aureus subsp. aureus Mu50
gcagcaucauaau

SEQ ID NO: 2073770 - RNA, 15 nt, Staphylococcus aureus subsp. aureus Mu50
gcagauugauauaaa

SEQ ID NO: 2073771 - RNA, 16 nt, Staphylococcus aureus subsp. aureus Mu50
gcacuucaaaagaaau

SEQ ID NO: 2073772 - RNA, 18 nt, Staphylococcus aureus subsp. aureus Mu50
gcacuucuauauuaauag

SEQ ID NO: 2073773 - RNA, 20 nt, Staphylococcus aureus subsp. aureus Mu50
gcacuucuauauuaauagaa

SEQ ID NO: 2073774 - RNA, 19 nt, Staphylococcus aureus subsp. aureus Mu50
gcacuuggauuuuaauuau

SEQ ID NO: 2073775 - RNA, 12 nt, Staphylococcus aureus subsp. aureus Mu50
gcacuuggauuu

SEQ ID NO: 2073776 - RNA, 20 nt, Staphylococcus aureus subsp. aureus Mu50
gcacuugguucauaaugauc

SEQ ID NO: 2073777 - RNA, 22 nt, Staphylococcus aureus subsp. aureus Mu50
gcacuuuauuaaaaauccucac

SEQ ID NO: 2073778 - RNA, 13 nt, Staphylococcus aureus subsp. aureus Mu50
gcacuaucuuuug

SEQ ID NO: 2073779 - RNA, 21 nt, Staphylococcus aureus subsp. aureus Mu50
gcacuauaaaauucaccaacu

SEQ ID NO: 2073780 - RNA, 16 nt, Staphylococcus aureus subsp. aureus Mu50
gcacggauaccuacug

SEQ ID NO: 2073781 - RNA, 20 nt, Staphylococcus aureus subsp. aureus Mu50
gcaccuggucguacuuucaa

SEQ ID NO: 2073782 - RNA, 17 nt, Staphylococcus aureus subsp. aureus Mu50
gcacgauaaaaauaaaa

SEQ ID NO: 2073783 - RNA, 15 nt, Staphylococcus aureus subsp. aureus Mu50
gcacgagacaauaau

SEQ ID NO: 2073784 - RNA, 16 nt, Staphylococcus aureus subsp. aureus Mu50
gcacgagacaauaaug

SEQ ID NO: 2073785 - RNA, 13 nt, Staphylococcus aureus subsp. aureus Mu50
gcaccaugugccu

SEQ ID NO: 2073786 - RNA, 12 nt, Staphylococcus aureus subsp. aureus Mu50
gcaccauuauua

SEQ ID NO: 2073787 - RNA, 14 nt, Staphylococcus aureus subsp. aureus Mu50
gcaccaaugacgac

SEQ ID NO: 2073788 - RNA, 20 nt, Staphylococcus aureus subsp. aureus Mu50
gcacaacugcauaaaagccu

SEQ ID NO: 2073789 - RNA, 14 nt, Staphylococcus aureus subsp. aureus Mu50
gcacaagcaucuac

SEQ ID NO: 2073790 - RNA, 14 nt, Staphylococcus aureus subsp. aureus Mu50
gcacaacugcauaa

SEQ ID NO: 2073791 - RNA, 16 nt, Staphylococcus aureus subsp. aureus Mu50
gcacaucauaauaaau

SEQ ID NO: 2073792 - RNA, 19 nt, Staphylococcus aureus subsp. aureus Mu50
gcacagcggaauacagaug

SEQ ID NO: 2073793 - RNA, 19 nt, Staphylococcus aureus subsp. aureus Mu50
gcaauuuuucacuuauaac

SEQ ID NO: 2073794 - RNA, 13 nt, Staphylococcus aureus subsp. aureus Mu50
gcaauuuguaaua

SEQ ID NO: 2073795 - RNA, 16 nt, Staphylococcus aureus subsp. aureus Mu50
gcaauugcaaugaaua

SEQ ID NO: 2073796 - RNA, 16 nt, Staphylococcus aureus subsp. aureus Mu50
gcaauuauuuuucaaa

SEQ ID NO: 2073797 - RNA, 14 nt, Staphylococcus aureus subsp. aureus Mu50
gcaauuagaauaua

SEQ ID NO: 2073798 - RNA, 15 nt, Staphylococcus aureus subsp. aureus Mu50
gcaauguaaugguua

SEQ ID NO: 2073799 - RNA, 22 nt, Staphylococcus aureus subsp. aureus Mu50
gcaauuaaaacuauaauaaaga

SEQ ID NO: 2073800 - RNA, 14 nt, Staphylococcus aureus subsp. aureus Mu50
gcaauuaaagucaa

SEQ ID NO: 2073801 - RNA, 16 nt, Staphylococcus aureus subsp. aureus Mu50
gcaaugcgaguugggg

SEQ ID NO: 2073802 - RNA, 18 nt, Staphylococcus aureus subsp. aureus Mu50
gcaaucguugaaaaauau

SEQ ID NO: 2073803 - RNA, 18 nt, Staphylococcus aureus subsp. aureus Mu50
gcaaugauuauaaauaca

SEQ ID NO: 2073804 - RNA, 20 nt, Staphylococcus aureus subsp. aureus Mu50
gcaaugauaucuuuuccaaa

SEQ ID NO: 2073805 - RNA, 13 nt, Staphylococcus aureus subsp. aureus Mu50
gcaaugaaauuac

SEQ ID NO: 2073806 - RNA, 18 nt, Staphylococcus aureus subsp. aureus Mu50
gcaagccuucuauauagu

SEQ ID NO: 2073807 - RNA, 14 nt, Staphylococcus aureus subsp. aureus Mu50
gcaagccaucaaua

SEQ ID NO: 2073808 - RNA, 14 nt, Staphylococcus aureus subsp. aureus Mu50
gcaauaaaauuagc

SEQ ID NO: 2073809 - RNA, 19 nt, Staphylococcus aureus subsp. aureus Mu50
gcaauaacaccaauugaau

SEQ ID NO: 2073810 - RNA, 14 nt, Staphylococcus aureus subsp. aureus Mu50
gcaaguuggcgggg

SEQ ID NO: 2073811 - RNA, 22 nt, Staphylococcus aureus subsp. aureus Mu50
gcaagugcuuccacuucaucua

SEQ ID NO: 2073812 - RNA, 19 nt, Staphylococcus aureus subsp. aureus Mu50
gcaagguuuucgccaauaa

SEQ ID NO: 2073813 - RNA, 15 nt, Staphylococcus aureus subsp. aureus Mu50
gcaauagcuauaacu

SEQ ID NO: 2073814 - RNA, 16 nt, Staphylococcus aureus subsp. aureus Mu50
gcaauaggaugaaacu

SEQ ID NO: 2073815 - RNA, 24 nt, Staphylococcus aureus subsp. aureus Mu50
gaucaauuaaacuuaagaauacau

SEQ ID NO: 2073816 - RNA, 14 nt, Staphylococcus aureus subsp. aureus Mu50
gaucacacgacaug

SEQ ID NO: 2073817 - RNA, 18 nt, Staphylococcus aureus subsp. aureus Mu50
gcaacugaucauuuucau

SEQ ID NO: 2073818 - RNA, 21 nt, Staphylococcus aureus subsp. aureus Mu50
gcaacuaaaacuaucugauua

SEQ ID NO: 2073819 - RNA, 12 nt, Staphylococcus aureus subsp. aureus Mu50
gcaacuaagaug

SEQ ID NO: 2073820 - RNA, 16 nt, Staphylococcus aureus subsp. aureus Mu50
aaagcggacugaaaga

SEQ ID NO: 2073821 - RNA, 17 nt, Staphylococcus aureus subsp. aureus Mu50
gcgcuucuaacucaccu

SEQ ID NO: 2073822 - RNA, 19 nt, Staphylococcus aureus subsp. aureus Mu50
gcggggccccaacacagag

SEQ ID NO: 2073823 - RNA, 16 nt, Staphylococcus aureus subsp. aureus Mu50
gcgucugauucucuaa

SEQ ID NO: 2073824 - RNA, 18 nt, Staphylococcus aureus subsp. aureus Mu50
gcguauccccauuuaugu

SEQ ID NO: 2073825 - RNA, 13 nt, Staphylococcus aureus subsp. aureus Mu50
gcguauuuuaaug

SEQ ID NO: 2073826 - RNA, 22 nt, Staphylococcus aureus subsp. aureus Mu50
gcuggcgcaaugauaucuuuuc

SEQ ID NO: 2073827 - RNA, 15 nt, Staphylococcus aureus subsp. aureus Mu50
gcuggcccccaacac

SEQ ID NO: 2073828 - RNA, 18 nt, Staphylococcus aureus subsp. aureus Mu50
gcuggguaauaaauugua

SEQ ID NO: 2073829 - RNA, 15 nt, Staphylococcus aureus subsp. aureus Mu50
aaagcugucaacuug

SEQ ID NO: 2073830 - RNA, 14 nt, Staphylococcus aureus subsp. aureus Mu50
aaagcugucaacuu

SEQ ID NO: 2073831 - RNA, 19 nt, Staphylococcus aureus subsp. aureus Mu50
gcugguaauauuuuuguug

SEQ ID NO: 2073832 - RNA, 20 nt, Staphylococcus aureus subsp. aureus Mu50
aaagcuucgucaaugacuaa

SEQ ID NO: 2073833 - RNA, 21 nt, Staphylococcus aureus subsp. aureus Mu50
aaagcuugauuuaacaaccuc

SEQ ID NO: 2073834 - RNA, 14 nt, Staphylococcus aureus subsp. aureus Mu50
aaagcuugauuuaa

SEQ ID NO: 2073835 - RNA, 18 nt, Staphylococcus aureus subsp. aureus Mu50
aaagcuugauuuaacaac

SEQ ID NO: 2073836 - RNA, 21 nt, Staphylococcus aureus subsp. aureus Mu50
aaagcuuuuuugcuuuuauaa

SEQ ID NO: 2073837 - RNA, 16 nt, Staphylococcus aureus subsp. aureus Mu50
gcugauacauaaaaug

SEQ ID NO: 2073838 - RNA, 13 nt, Staphylococcus aureus subsp. aureus Mu50
gcugauaauaaaa

SEQ ID NO: 2073839 - RNA, 15 nt, Staphylococcus aureus subsp. aureus Mu50
gcugauaauuuuucu

SEQ ID NO: 2073840 - RNA, 22 nt, Staphylococcus aureus subsp. aureus Mu50
gcucuggauuuuucuuauaaaa

SEQ ID NO: 2073841 - RNA, 15 nt, Staphylococcus aureus subsp. aureus Mu50
gcucuggauuuuucu

SEQ ID NO: 2073842 - RNA, 22 nt, Staphylococcus aureus subsp. aureus Mu50
gcucuuaauguacuuuucuguc

SEQ ID NO: 2073843 - RNA, 22 nt, Staphylococcus aureus subsp. aureus Mu50
gcucuuauaaagacaccuucaa

SEQ ID NO: 2073844 - RNA, 20 nt, Staphylococcus aureus subsp. aureus Mu50
gcucguuaaaucacauauga

SEQ ID NO: 2073845 - RNA, 20 nt, Staphylococcus aureus subsp. aureus Mu50
gcucuaaacuucuauuaaua

SEQ ID NO: 2073846 - RNA, 17 nt, Staphylococcus aureus subsp. aureus Mu50
gcuagcuuucuuuuuca

SEQ ID NO: 2073847 - RNA, 15 nt, Staphylococcus aureus subsp. aureus Mu50
gcuaguucagcuucu

SEQ ID NO: 2073848 - RNA, 20 nt, Staphylococcus aureus subsp. aureus Mu50
gcuagucauaauuuaaaaga

SEQ ID NO: 2073849 - RNA, 19 nt, Staphylococcus aureus subsp. aureus Mu50
gcuacuuuuucaucuuuca

SEQ ID NO: 2073850 - RNA, 11 nt, Staphylococcus aureus subsp. aureus Mu50
gcuauaaaagu

SEQ ID NO: 2073851 - RNA, 20 nt, Staphylococcus aureus subsp. aureus Mu50
gcuauaaaaguacuuuaaaa

SEQ ID NO: 2073852 - RNA, 20 nt, Staphylococcus aureus subsp. aureus Mu50
gcuauaaaauuuugaagaag

SEQ ID NO: 2073853 - RNA, 19 nt, Staphylococcus aureus subsp. aureus Mu50
gcucaaguugauuauucua

SEQ ID NO: 2073854 - RNA, 18 nt, Staphylococcus aureus subsp. aureus Mu50
gcuauuuuggauaauaug

SEQ ID NO: 2073855 - RNA, 23 nt, Staphylococcus aureus subsp. aureus Mu50
gcuauuuuggauaauaugagaca

SEQ ID NO: 2073856 - RNA, 12 nt, Staphylococcus aureus subsp. aureus Mu50
gcuauuucaaca

SEQ ID NO: 2073857 - RNA, 19 nt, Staphylococcus aureus subsp. aureus Mu50
gcuauuucaacaaacauaa

SEQ ID NO: 2073858 - RNA, 15 nt, Staphylococcus aureus subsp. aureus Mu50
gcuaugaagaaaucu

SEQ ID NO: 2073859 - RNA, 14 nt, Staphylococcus aureus subsp. aureus Mu50
gcguucaacauuac

SEQ ID NO: 2073860 - RNA, 13 nt, Staphylococcus aureus subsp. aureus Mu50
gcuaaaaaaauua

SEQ ID NO: 2073861 - RNA, 15 nt, Staphylococcus aureus subsp. aureus Mu50
gcguugguauucauc

SEQ ID NO: 2073862 - RNA, 23 nt, Staphylococcus aureus subsp. aureus Mu50
gcuaaugcaacuaaaacuaucug

SEQ ID NO: 2073863 - RNA, 21 nt, Staphylococcus aureus subsp. aureus Mu50
gcuaauguguacuuaaaaaua

SEQ ID NO: 2073864 - RNA, 23 nt, Staphylococcus aureus subsp. aureus Mu50
gcuaccuacuuguucaauacuuc

SEQ ID NO: 2073865 - RNA, 18 nt, Staphylococcus aureus subsp. aureus Mu50
gcuaauaacgcugcaccu

SEQ ID NO: 2073866 - RNA, 18 nt, Staphylococcus aureus subsp. aureus Mu50
gcuaaugcaacuaaaacu

SEQ ID NO: 2073867 - RNA, 18 nt, Staphylococcus aureus subsp. aureus Mu50
gcuaaugcauuauuauaa

SEQ ID NO: 2073868 - RNA, 23 nt, Staphylococcus aureus subsp. aureus Mu50
gcuaaugcauuauuauaauagcu

SEQ ID NO: 2073869 - RNA, 20 nt, Staphylococcus aureus subsp. aureus Mu50
gcuaaucguuugccauaauu

SEQ ID NO: 2073870 - RNA, 12 nt, Staphylococcus aureus subsp. aureus Mu50
gcuaaucuauuu

SEQ ID NO: 2073871 - RNA, 22 nt, Staphylococcus aureus subsp. aureus Mu50
gcuaacgaaucgccuacuauaa

SEQ ID NO: 2073872 - RNA, 12 nt, Staphylococcus aureus subsp. aureus Mu50
gcuaaacaaagg

SEQ ID NO: 2073873 - RNA, 14 nt, Staphylococcus aureus subsp. aureus Mu50
gcuaaacaaagggg

SEQ ID NO: 2073874 - RNA, 18 nt, Staphylococcus aureus subsp. aureus Mu50
gcuaaacgcaauacgaau

SEQ ID NO: 2073875 - RNA, 16 nt, Staphylococcus aureus subsp. aureus Mu50
gcuaacauaccuaaua

SEQ ID NO: 2073876 - RNA, 23 nt, Staphylococcus aureus subsp. aureus Mu50
gcuaaauguuaaugcuucguaau

SEQ ID NO: 2073877 - RNA, 18 nt, Staphylococcus aureus subsp. aureus Mu50
gcuuuuaugcaugcgcaa

SEQ ID NO: 2073878 - RNA, 14 nt, Staphylococcus aureus subsp. aureus Mu50
gcuuuuauuuauau

SEQ ID NO: 2073879 - RNA, 18 nt, Staphylococcus aureus subsp. aureus Mu50
gcuuuuccauaaauauuu

SEQ ID NO: 2073880 - RNA, 18 nt, Staphylococcus aureus subsp. aureus Mu50
gcuuuuucaaauaauaua

SEQ ID NO: 2073881 - RNA, 15 nt, Staphylococcus aureus subsp. aureus Mu50
gcuuuuuauuuuguu

SEQ ID NO: 2073882 - RNA, 23 nt, Staphylococcus aureus subsp. aureus Mu50
gcuuuuuauuuuguuuaucugua

SEQ ID NO: 2073883 - RNA, 18 nt, Staphylococcus aureus subsp. aureus Mu50
gcuuuuucaaaaucuuua

SEQ ID NO: 2073884 - RNA, 17 nt, Staphylococcus aureus subsp. aureus Mu50
gcuuuuguaaagcuuua

SEQ ID NO: 2073885 - RNA, 16 nt, Staphylococcus aureus subsp. aureus Mu50
ggaaaaagaugaaaaa

SEQ ID NO: 2073886 - RNA, 15 nt, Staphylococcus aureus subsp. aureus Mu50
ggaaaaagaugaaaa

SEQ ID NO: 2073887 - RNA, 15 nt, Staphylococcus aureus subsp. aureus Mu50
gcuuuuuuuuauaag

SEQ ID NO: 2073888 - RNA, 15 nt, Staphylococcus aureus subsp. aureus Mu50
gcuuuuuuuacaaua

SEQ ID NO: 2073889 - RNA, 12 nt, Staphylococcus aureus subsp. aureus Mu50
gcuuuuuguuuu

SEQ ID NO: 2073890 - RNA, 21 nt, Staphylococcus aureus subsp. aureus Mu50
gcuuuuuuauucuaauacaaa

SEQ ID NO: 2073891 - RNA, 21 nt, Staphylococcus aureus subsp. aureus Mu50
gcuuuuuugugauuuuuaaua

SEQ ID NO: 2073892 - RNA, 23 nt, Staphylococcus aureus subsp. aureus Mu50
gcuuucuuuuuugcuguauauau

SEQ ID NO: 2073893 - RNA, 20 nt, Staphylococcus aureus subsp. aureus Mu50
gcuuucuuuuucaucuuuca

SEQ ID NO: 2073894 - RNA, 21 nt, Staphylococcus aureus subsp. aureus Mu50
gcuuugcauacauaucuuuug

SEQ ID NO: 2073895 - RNA, 19 nt, Staphylococcus aureus subsp. aureus Mu50
gcuuugcugcuuuuccagu

SEQ ID NO: 2073896 - RNA, 19 nt, Staphylococcus aureus subsp. aureus Mu50
gcuuugaagggagcauuuc

SEQ ID NO: 2073897 - RNA, 20 nt, Staphylococcus aureus subsp. aureus Mu50
gcuuuuaauauuauaaaccu

SEQ ID NO: 2073898 - RNA, 23 nt, Staphylococcus aureus subsp. aureus Mu50
gcuuugucacgauagauuuauca

SEQ ID NO: 2073899 - RNA, 15 nt, Staphylococcus aureus subsp. aureus Mu50
ggaauauaaaacugu

SEQ ID NO: 2073900 - RNA, 19 nt, Staphylococcus aureus subsp. aureus Mu50
ggaauauuaacaccagaua

SEQ ID NO: 2073901 - RNA, 16 nt, Staphylococcus aureus subsp. aureus Mu50
ggaaaucaguaauauc

SEQ ID NO: 2073902 - RNA, 17 nt, Staphylococcus aureus subsp. aureus Mu50
ggaaauauuccuuacua

SEQ ID NO: 2073903 - RNA, 16 nt, Staphylococcus aureus subsp. aureus Mu50
ggaaauaucuuacugc

SEQ ID NO: 2073904 - RNA, 13 nt, Staphylococcus aureus subsp. aureus Mu50
ggaaagucagcuu

SEQ ID NO: 2073905 - RNA, 17 nt, Staphylococcus aureus subsp. aureus Mu50
ggaaaguaauaaguaau

SEQ ID NO: 2073906 - RNA, 13 nt, Staphylococcus aureus subsp. aureus Mu50
ggaaagaugggau

SEQ ID NO: 2073907 - RNA, 23 nt, Staphylococcus aureus subsp. aureus Mu50
ggaaaauacuauacugaugaaaa

SEQ ID NO: 2073908 - RNA, 19 nt, Staphylococcus aureus subsp. aureus Mu50
ggaaaauaaaaaccagcua

SEQ ID NO: 2073909 - RNA, 15 nt, Staphylococcus aureus subsp. aureus Mu50
ggagugggacagaaa

SEQ ID NO: 2073910 - RNA, 19 nt, Staphylococcus aureus subsp. aureus Mu50
ggaucacguuuuucuuuaa

SEQ ID NO: 2073911 - RNA, 18 nt, Staphylococcus aureus subsp. aureus Mu50
ggagcggaagauaggauu

SEQ ID NO: 2073912 - RNA, 18 nt, Staphylococcus aureus subsp. aureus Mu50
aaaguaaaauauacuuga

SEQ ID NO: 2073913 - RNA, 13 nt, Staphylococcus aureus subsp. aureus Mu50
aaaguaaauuaca

SEQ ID NO: 2073914 - RNA, 12 nt, Staphylococcus aureus subsp. aureus Mu50
ggagaaccuuua

SEQ ID NO: 2073915 - RNA, 12 nt, Staphylococcus aureus subsp. aureus Mu50
ggagaaccuuuu

SEQ ID NO: 2073916 - RNA, 20 nt, Staphylococcus aureus subsp. aureus Mu50
aaagguuguuuuucaucauu

SEQ ID NO: 2073917 - RNA, 23 nt, Staphylococcus aureus subsp. aureus Mu50
ggacgauaacagcuacaaauaau

SEQ ID NO: 2073918 - RNA, 19 nt, Staphylococcus aureus subsp. aureus Mu50
ggacauagguauaaucauu

SEQ ID NO: 2073919 - RNA, 14 nt, Staphylococcus aureus subsp. aureus Mu50
aaagggcaaaaaag

SEQ ID NO: 2073920 - RNA, 14 nt, Staphylococcus aureus subsp. aureus Mu50
ggcaaauucaacuu

SEQ ID NO: 2073921 - RNA, 15 nt, Staphylococcus aureus subsp. aureus Mu50
ggcaaagucauuaaa

SEQ ID NO: 2073922 - RNA, 21 nt, Staphylococcus aureus subsp. aureus Mu50
ggcaaagcuucauuucccuua

SEQ ID NO: 2073923 - RNA, 16 nt, Staphylococcus aureus subsp. aureus Mu50
ggcaauagcaccauac

SEQ ID NO: 2073924 - RNA, 15 nt, Staphylococcus aureus subsp. aureus Mu50
ggcacauaaaucaau

SEQ ID NO: 2073925 - RNA, 21 nt, Staphylococcus aureus subsp. aureus Mu50
aaaguaucuaugaaauuuuuu

SEQ ID NO: 2073926 - RNA, 22 nt, Staphylococcus aureus subsp. aureus Mu50
aaaguaucgccaaucuauugca

SEQ ID NO: 2073927 - RNA, 19 nt, Staphylococcus aureus subsp. aureus Mu50
aaaguacuuuaaaauugua

SEQ ID NO: 2073928 - RNA, 21 nt, Staphylococcus aureus subsp. aureus Mu50
ggcacuuaagcuuuaaucaua

SEQ ID NO: 2073929 - RNA, 14 nt, Staphylococcus aureus subsp. aureus Mu50
ggcauccauaucca

SEQ ID NO: 2073930 - RNA, 22 nt, Staphylococcus aureus subsp. aureus Mu50
ggcagcuaaaaaguauacuaaa

SEQ ID NO: 2073931 - RNA, 22 nt, Staphylococcus aureus subsp. aureus Mu50
ggcauuuugacgccagaauaaa

SEQ ID NO: 2073932 - RNA, 12 nt, Staphylococcus aureus subsp. aureus Mu50
ggcguaaugaua

SEQ ID NO: 2073933 - RNA, 17 nt, Staphylococcus aureus subsp. aureus Mu50
aaauacaauuucuucau

SEQ ID NO: 2073934 - RNA, 16 nt, Staphylococcus aureus subsp. aureus Mu50
aaauacaacucccuuu

SEQ ID NO: 2073935 - RNA, 21 nt, Staphylococcus aureus subsp. aureus Mu50
aaauacaacucccuuuuauaa

SEQ ID NO: 2073936 - RNA, 18 nt, Staphylococcus aureus subsp. aureus Mu50
aaauacaaugaauuguua

SEQ ID NO: 2073937 - RNA, 14 nt, Staphylococcus aureus subsp. aureus Mu50
aaauacaaauauau

SEQ ID NO: 2073938 - RNA, 13 nt, Staphylococcus aureus subsp. aureus Mu50
aaauacguuuaau

SEQ ID NO: 2073939 - RNA, 18 nt, Staphylococcus aureus subsp. aureus Mu50
ggcgaauagcgauuuuaa

SEQ ID NO: 2073940 - RNA, 14 nt, Staphylococcus aureus subsp. aureus Mu50
aaauaaauauaaaa

SEQ ID NO: 2073941 - RNA, 22 nt, Staphylococcus aureus subsp. aureus Mu50
aaauaaaugacuucacauuuau

SEQ ID NO: 2073942 - RNA, 22 nt, Staphylococcus aureus subsp. aureus Mu50
aaauaaauguccgacuugauaa

SEQ ID NO: 2073943 - RNA, 13 nt, Staphylococcus aureus subsp. aureus Mu50
aaauaaaaauuau

SEQ ID NO: 2073944 - RNA, 19 nt, Staphylococcus aureus subsp. aureus Mu50
aaauaaaacgcuucauaua

SEQ ID NO: 2073945 - RNA, 13 nt, Staphylococcus aureus subsp. aureus Mu50
aaauaaaacaaga

SEQ ID NO: 2073946 - RNA, 22 nt, Staphylococcus aureus subsp. aureus Mu50
aaauaaaauuuuuuucauaauu

SEQ ID NO: 2073947 - RNA, 19 nt, Staphylococcus aureus subsp. aureus Mu50
aaauaaacacaucuaugug

SEQ ID NO: 2073948 - RNA, 17 nt, Staphylococcus aureus subsp. aureus Mu50
ggccuccucuuuuauuu

SEQ ID NO: 2073949 - RNA, 13 nt, Staphylococcus aureus subsp. aureus Mu50
aaaguuucuccac

SEQ ID NO: 2073950 - RNA, 11 nt, Staphylococcus aureus subsp. aureus Mu50
aaaguuucucc

SEQ ID NO: 2073951 - RNA, 18 nt, Staphylococcus aureus subsp. aureus Mu50
aaaguuuucauuuaacau

SEQ ID NO: 2073952 - RNA, 22 nt, Staphylococcus aureus subsp. aureus Mu50
aaaguuuucauuuaacauguau

SEQ ID NO: 2073953 - RNA, 22 nt, Staphylococcus aureus subsp. aureus Mu50
aaaguuuugaaccuaaauucca

SEQ ID NO: 2073954 - RNA, 14 nt, Staphylococcus aureus subsp. aureus Mu50
aaaguuaaagacua

SEQ ID NO: 2073955 - RNA, 13 nt, Staphylococcus aureus subsp. aureus Mu50
aaaguguuucaac

SEQ ID NO: 2073956 - RNA, 16 nt, Staphylococcus aureus subsp. aureus Mu50
aaaguguuaugaauua

SEQ ID NO: 2073957 - RNA, 14 nt, Staphylococcus aureus subsp. aureus Mu50
aaaguuauaaauua

SEQ ID NO: 2073958 - RNA, 15 nt, Staphylococcus aureus subsp. aureus Mu50
aaaguuauaaauuau

SEQ ID NO: 2073959 - RNA, 19 nt, Staphylococcus aureus subsp. aureus Mu50
aaaguuauaucaucaacaa

SEQ ID NO: 2073960 - RNA, 18 nt, Staphylococcus aureus subsp. aureus Mu50
aaaguucauuacaaacuu

SEQ ID NO: 2073961 - RNA, 21 nt, Staphylococcus aureus subsp. aureus Mu50
aaaguguaauguuccccugaa

SEQ ID NO: 2073962 - RNA, 14 nt, Staphylococcus aureus subsp. aureus Mu50
aaagugguuuuacu

SEQ ID NO: 2073963 - RNA, 18 nt, Staphylococcus aureus subsp. aureus Mu50
aaagugcgguuauuuaua

SEQ ID NO: 2073964 - RNA, 15 nt, Staphylococcus aureus subsp. aureus Mu50
ggcccacaccccaac

SEQ ID NO: 2073965 - RNA, 17 nt, Staphylococcus aureus subsp. aureus Mu50
aaagugcauauuuaaua

SEQ ID NO: 2073966 - RNA, 21 nt, Staphylococcus aureus subsp. aureus Mu50
aaaguuuaauugcuguaaaua

SEQ ID NO: 2073967 - RNA, 14 nt, Staphylococcus aureus subsp. aureus Mu50
aaaguuuauacuua

SEQ ID NO: 2073968 - RNA, 16 nt, Staphylococcus aureus subsp. aureus Mu50
aaaguuguauucugaa

SEQ ID NO: 2073969 - RNA, 17 nt, Staphylococcus aureus subsp. aureus Mu50
aaaguuguaauuuaaaa

SEQ ID NO: 2073970 - RNA, 18 nt, Staphylococcus aureus subsp. aureus Mu50
aaaguuguaauuuaaaau

SEQ ID NO: 2073971 - RNA, 16 nt, Staphylococcus aureus subsp. aureus Mu50
aaaguuguaauuuaaa

SEQ ID NO: 2073972 - RNA, 21 nt, Staphylococcus aureus subsp. aureus Mu50
aaaguugcacuugguucauaa

SEQ ID NO: 2073973 - RNA, 20 nt, Staphylococcus aureus subsp. aureus Mu50
gagcuugggacagaaaacaa

SEQ ID NO: 2073974 - RNA, 15 nt, Staphylococcus aureus subsp. aureus Mu50
gagcugcuucaacua

SEQ ID NO: 2073975 - RNA, 13 nt, Staphylococcus aureus subsp. aureus Mu50
gaggauuucuagc

SEQ ID NO: 2073976 - RNA, 22 nt, Staphylococcus aureus subsp. aureus Mu50
gaggcacagcggaauacagaug

SEQ ID NO: 2073977 - RNA, 22 nt, Staphylococcus aureus subsp. aureus Mu50
gaggcacaguggauuacagaug

SEQ ID NO: 2073978 - RNA, 16 nt, Staphylococcus aureus subsp. aureus Mu50
gagggccccaacacag

SEQ ID NO: 2073979 - RNA, 21 nt, Staphylococcus aureus subsp. aureus Mu50
gauaaaaaauaaagucauaug

SEQ ID NO: 2073980 - RNA, 20 nt, Staphylococcus aureus subsp. aureus Mu50
gauaaauaaacucaccaagu

SEQ ID NO: 2073981 - RNA, 22 nt, Staphylococcus aureus subsp. aureus Mu50
gauaaauauugaacaauuuuug

SEQ ID NO: 2073982 - RNA, 20 nt, Staphylococcus aureus subsp. aureus Mu50
gauaaauucccauguauucu

SEQ ID NO: 2073983 - RNA, 16 nt, Staphylococcus aureus subsp. aureus Mu50
gauaaaugaauugucu

SEQ ID NO: 2073984 - RNA, 20 nt, Staphylococcus aureus subsp. aureus Mu50
gauaaauuuuuaguuaaagu

SEQ ID NO: 2073985 - RNA, 21 nt, Staphylococcus aureus subsp. aureus Mu50
gauaacaagaaguaauguuaa

SEQ ID NO: 2073986 - RNA, 16 nt, Staphylococcus aureus subsp. aureus Mu50
gaguucaauuaaauua

SEQ ID NO: 2073987 - RNA, 19 nt, Staphylococcus aureus subsp. aureus Mu50
gaguuggcaucagacuaaa

SEQ ID NO: 2073988 - RNA, 20 nt, Staphylococcus aureus subsp. aureus Mu50
gaguucuuuuugaugaucau

SEQ ID NO: 2073989 - RNA, 20 nt, Staphylococcus aureus subsp. aureus Mu50
gaguauacuuacugaaacua

SEQ ID NO: 2073990 - RNA, 22 nt, Staphylococcus aureus subsp. aureus Mu50
gaguagcccuauuuuuaaugua

SEQ ID NO: 2073991 - RNA, 19 nt, Staphylococcus aureus subsp. aureus Mu50
gagguguggaguaaagauc

SEQ ID NO: 2073992 - RNA, 15 nt, Staphylococcus aureus subsp. aureus Mu50
gagugaaaauaagau

SEQ ID NO: 2073993 - RNA, 14 nt, Staphylococcus aureus subsp. aureus Mu50
gagucuuauuuuua

SEQ ID NO: 2073994 - RNA, 16 nt, Staphylococcus aureus subsp. aureus Mu50
gauauuaggcuuaaau

SEQ ID NO: 2073995 - RNA, 21 nt, Staphylococcus aureus subsp. aureus Mu50
gauaucuaagucgauaaguuu

SEQ ID NO: 2073996 - RNA, 15 nt, Staphylococcus aureus subsp. aureus Mu50
gauaucugaaguaga

SEQ ID NO: 2073997 - RNA, 20 nt, Staphylococcus aureus subsp. aureus Mu50
gauauucauguucuuguaau

SEQ ID NO: 2073998 - RNA, 19 nt, Staphylococcus aureus subsp. aureus Mu50
gauauucuaaaaaauuaaa

SEQ ID NO: 2073999 - RNA, 18 nt, Staphylococcus aureus subsp. aureus Mu50
gauauuucaucugacuga

SEQ ID NO: 2074000 - RNA, 23 nt, Staphylococcus aureus subsp. aureus Mu50
gauauuucaacuuuuuaauaaua

SEQ ID NO: 2074001 - RNA, 13 nt, Staphylococcus aureus subsp. aureus Mu50
gauauuuaacaaa

SEQ ID NO: 2074002 - RNA, 20 nt, Staphylococcus aureus subsp. aureus Mu50
gauauuuuuuaauaaucaaa

SEQ ID NO: 2074003 - RNA, 14 nt, Staphylococcus aureus subsp. aureus Mu50
gaucaacaaugcca

SEQ ID NO: 2074004 - RNA, 19 nt, Staphylococcus aureus subsp. aureus Mu50
gauagcggauuuauuuuuu

SEQ ID NO: 2074005 - RNA, 18 nt, Staphylococcus aureus subsp. aureus Mu50
gauagccguuaacaucag

SEQ ID NO: 2074006 - RNA, 21 nt, Staphylococcus aureus subsp. aureus Mu50
gauaucaaaguacuaacguuu

SEQ ID NO: 2074007 - RNA, 18 nt, Staphylococcus aureus subsp. aureus Mu50
gauauaaugaaguuauga

SEQ ID NO: 2074008 - RNA, 23 nt, Staphylococcus aureus subsp. aureus Mu50
gauaccucauccgccaauuaaaa

SEQ ID NO: 2074009 - RNA, 21 nt, Staphylococcus aureus subsp. aureus Mu50
gauacgugguuuuauuugauu

SEQ ID NO: 2074010 - RNA, 17 nt, Staphylococcus aureus subsp. aureus Mu50
gauacuauacuuaaaau

SEQ ID NO: 2074011 - RNA, 17 nt, Staphylococcus aureus subsp. aureus Mu50
gauaaucacaauacgaa

SEQ ID NO: 2074012 - RNA, 16 nt, Staphylococcus aureus subsp. aureus Mu50
gauaaucguuaaaaca

SEQ ID NO: 2074013 - RNA, 22 nt, Staphylococcus aureus subsp. aureus Mu50
gauaaucucauucuuuaauaua

SEQ ID NO: 2074014 - RNA, 22 nt, Staphylococcus aureus subsp. aureus Mu50
gauaauguaauuguuuuuucuu

SEQ ID NO: 2074015 - RNA, 21 nt, Staphylococcus aureus subsp. aureus Mu50
gauaaugcaccugugauaacu

SEQ ID NO: 2074016 - RNA, 17 nt, Staphylococcus aureus subsp. aureus Mu50
gauaauacuguuuaaau

SEQ ID NO: 2074017 - RNA, 18 nt, Staphylococcus aureus subsp. aureus Mu50
gauaauacuguuuaaaua

SEQ ID NO: 2074018 - RNA, 23 nt, Staphylococcus aureus subsp. aureus Mu50
gauaauagccauucgaugcuaaa

SEQ ID NO: 2074019 - RNA, 19 nt, Staphylococcus aureus subsp. aureus Mu50
gauaaguggauuuucuccc

SEQ ID NO: 2074020 - RNA, 18 nt, Staphylococcus aureus subsp. aureus Mu50
gauaauaaggaagcguau

SEQ ID NO: 2074021 - RNA, 16 nt, Staphylococcus aureus subsp. aureus Mu50
gauaacagcuacaaau

SEQ ID NO: 2074022 - RNA, 19 nt, Staphylococcus aureus subsp. aureus Mu50
gauaacagcuacaaauaau

SEQ ID NO: 2074023 - RNA, 14 nt, Staphylococcus aureus subsp. aureus Mu50
gauacauaaaucua

SEQ ID NO: 2074024 - RNA, 23 nt, Staphylococcus aureus subsp. aureus Mu50
gauacauauucucugcuucuaaa

SEQ ID NO: 2074025 - RNA, 14 nt, Staphylococcus aureus subsp. aureus Mu50
gauacauaaaacau

SEQ ID NO: 2074026 - RNA, 13 nt, Staphylococcus aureus subsp. aureus Mu50
gauacagaaccaa

SEQ ID NO: 2074027 - RNA, 15 nt, Staphylococcus aureus subsp. aureus Mu50
gauaauuuuuaacag

SEQ ID NO: 2074028 - RNA, 23 nt, Staphylococcus aureus subsp. aureus Mu50
gauaauuucuucuucuguaauau

SEQ ID NO: 2074029 - RNA, 21 nt, Staphylococcus aureus subsp. aureus Mu50
aaagcaucuucaauauuuaaa

SEQ ID NO: 2074030 - RNA, 22 nt, Staphylococcus aureus subsp. aureus Mu50
aaagcaucuucaauauuuaaau

SEQ ID NO: 2074031 - RNA, 17 nt, Staphylococcus aureus subsp. aureus Mu50
aaagcagucgaacaaug

SEQ ID NO: 2074032 - RNA, 19 nt, Staphylococcus aureus subsp. aureus Mu50
gauaauuugagaaaugaaa

SEQ ID NO: 2074033 - RNA, 21 nt, Staphylococcus aureus subsp. aureus Mu50
gauacacguaacgcaguugaa

SEQ ID NO: 2074034 - RNA, 22 nt, Staphylococcus aureus subsp. aureus Mu50
aaagcaugauacucaauaaaau

SEQ ID NO: 2074035 - RNA, 23 nt, Staphylococcus aureus subsp. aureus Mu50
aaagcaucuucaauauuuaaauu

SEQ ID NO: 2074036 - RNA, 12 nt, Staphylococcus aureus subsp. aureus Mu50
aaagcaucuuua

SEQ ID NO: 2074037 - RNA, 17 nt, Staphylococcus aureus subsp. aureus Mu50
aaagcaggcaagcuauc

SEQ ID NO: 2074038 - RNA, 18 nt, Staphylococcus aureus subsp. aureus Mu50
gagccauuauuauuuuuu

SEQ ID NO: 2074039 - RNA, 21 nt, Staphylococcus aureus subsp. aureus Mu50
gagcccgagacauaaauuaau

SEQ ID NO: 2074040 - RNA, 22 nt, Staphylococcus aureus subsp. aureus Mu50
gagcaguauauaucaaauacau

SEQ ID NO: 2074041 - RNA, 15 nt, Staphylococcus aureus subsp. aureus Mu50
gagcacuaucuuuug

SEQ ID NO: 2074042 - RNA, 20 nt, Staphylococcus aureus subsp. aureus Mu50
gagaugaggcgauaaaagaa

SEQ ID NO: 2074043 - RNA, 14 nt, Staphylococcus aureus subsp. aureus Mu50
gagcaauucuucaa

SEQ ID NO: 2074044 - RNA, 14 nt, Staphylococcus aureus subsp. aureus Mu50
gagcacgagaaaug

SEQ ID NO: 2074045 - RNA, 14 nt, Staphylococcus aureus subsp. aureus Mu50
gagauauaaaggaa

SEQ ID NO: 2074046 - RNA, 16 nt, Staphylococcus aureus subsp. aureus Mu50
gagacguuuuccauga

SEQ ID NO: 2074047 - RNA, 17 nt, Staphylococcus aureus subsp. aureus Mu50
gagagauguauaaaacu

SEQ ID NO: 2074048 - RNA, 22 nt, Staphylococcus aureus subsp. aureus Mu50
gagaaucgaaccaaauuuuaua

SEQ ID NO: 2074049 - RNA, 14 nt, Staphylococcus aureus subsp. aureus Mu50
gagaagcugucuua

SEQ ID NO: 2074050 - RNA, 14 nt, Staphylococcus aureus subsp. aureus Mu50
gagacaacauuguu

SEQ ID NO: 2074051 - RNA, 17 nt, Staphylococcus aureus subsp. aureus Mu50
gagaauuucgaaaagaa

SEQ ID NO: 2074052 - RNA, 18 nt, Staphylococcus aureus subsp. aureus Mu50
gagacaaaaauaaaccau

SEQ ID NO: 2074053 - RNA, 16 nt, Staphylococcus aureus subsp. aureus Mu50
gagaaugugcuuguaa

SEQ ID NO: 2074054 - RNA, 17 nt, Staphylococcus aureus subsp. aureus Mu50
gagaaugugcuuguaac

SEQ ID NO: 2074055 - RNA, 17 nt, Staphylococcus aureus subsp. aureus Mu50
gagacauuuuaucugaa

SEQ ID NO: 2074056 - RNA, 16 nt, Staphylococcus aureus subsp. aureus Mu50
aaagcaaauuauauag

SEQ ID NO: 2074057 - RNA, 20 nt, Staphylococcus aureus subsp. aureus Mu50
gagaaccauccauaggauuc

SEQ ID NO: 2074058 - RNA, 14 nt, Staphylococcus aureus subsp. aureus Mu50
gagaaccuuuaaaa

SEQ ID NO: 2074059 - RNA, 19 nt, Staphylococcus aureus subsp. aureus Mu50
gagaaauucgaaaagaaau

SEQ ID NO: 2074060 - RNA, 16 nt, Staphylococcus aureus subsp. aureus Mu50
gagaaauacuauucuu

SEQ ID NO: 2074061 - RNA, 23 nt, Staphylococcus aureus subsp. aureus Mu50
gacuuuuacagaacguucauaua

SEQ ID NO: 2074062 - RNA, 23 nt, Staphylococcus aureus subsp. aureus Mu50
gacuuaauaucauauucaaaaua

SEQ ID NO: 2074063 - RNA, 20 nt, Staphylococcus aureus subsp. aureus Mu50
gacuuauucaacguauaagu

SEQ ID NO: 2074064 - RNA, 18 nt, Staphylococcus aureus subsp. aureus Mu50
gacuuauuuuucaucauu

SEQ ID NO: 2074065 - RNA, 18 nt, Staphylococcus aureus subsp. aureus Mu50
gacuuuuaaaaaacauac

SEQ ID NO: 2074066 - RNA, 15 nt, Staphylococcus aureus subsp. aureus Mu50
gacuuugucauacua

SEQ ID NO: 2074067 - RNA, 15 nt, Staphylococcus aureus subsp. aureus Mu50
gacuucuuucaauua

SEQ ID NO: 2074068 - RNA, 15 nt, Staphylococcus aureus subsp. aureus Mu50
gacuugauaaaaaau

SEQ ID NO: 2074069 - RNA, 17 nt, Staphylococcus aureus subsp. aureus Mu50
gacuugauaaaaaauga

SEQ ID NO: 2074070 - RNA, 16 nt, Staphylococcus aureus subsp. aureus Mu50
gacuugauagcauuuc

SEQ ID NO: 2074071 - RNA, 17 nt, Staphylococcus aureus subsp. aureus Mu50
gacucuuaauuuugcaa

SEQ ID NO: 2074072 - RNA, 16 nt, Staphylococcus aureus subsp. aureus Mu50
gacucuccaaauauug

SEQ ID NO: 2074073 - RNA, 12 nt, Staphylococcus aureus subsp. aureus Mu50
gacguuuuccau

SEQ ID NO: 2074074 - RNA, 17 nt, Staphylococcus aureus subsp. aureus Mu50
gacguuuugguuguucu

SEQ ID NO: 2074075 - RNA, 15 nt, Staphylococcus aureus subsp. aureus Mu50
gacugacuaauaaaa

SEQ ID NO: 2074076 - RNA, 15 nt, Staphylococcus aureus subsp. aureus Mu50
gacugaacgaaaaug

SEQ ID NO: 2074077 - RNA, 21 nt, Staphylococcus aureus subsp. aureus Mu50
gaccucagguuguuaggggcu

SEQ ID NO: 2074078 - RNA, 15 nt, Staphylococcus aureus subsp. aureus Mu50
gaccuucuucucuaa

SEQ ID NO: 2074079 - RNA, 16 nt, Staphylococcus aureus subsp. aureus Mu50
gaccuucuucucuaau

SEQ ID NO: 2074080 - RNA, 19 nt, Staphylococcus aureus subsp. aureus Mu50
gacgauuuauuaguuuuua

SEQ ID NO: 2074081 - RNA, 15 nt, Staphylococcus aureus subsp. aureus Mu50
gacauauaaauguug

SEQ ID NO: 2074082 - RNA, 16 nt, Staphylococcus aureus subsp. aureus Mu50
gacauaugcagugacu

SEQ ID NO: 2074083 - RNA, 18 nt, Staphylococcus aureus subsp. aureus Mu50
gacauagaucaauauucu

SEQ ID NO: 2074084 - RNA, 18 nt, Staphylococcus aureus subsp. aureus Mu50
gacaucaauaucuucuuc

SEQ ID NO: 2074085 - RNA, 23 nt, Staphylococcus aureus subsp. aureus Mu50
gacauuaaugauagcaaugaauu

SEQ ID NO: 2074086 - RNA, 20 nt, Staphylococcus aureus subsp. aureus Mu50
gacauucauuuaguuaaaua

SEQ ID NO: 2074087 - RNA, 18 nt, Staphylococcus aureus subsp. aureus Mu50
gacaguuuccauaaauaa

SEQ ID NO: 2074088 - RNA, 14 nt, Staphylococcus aureus subsp. aureus Mu50
gacauaaaaaauaa

SEQ ID NO: 2074089 - RNA, 14 nt, Staphylococcus aureus subsp. aureus Mu50
gacauaaggucuug

SEQ ID NO: 2074090 - RNA, 13 nt, Staphylococcus aureus subsp. aureus Mu50
gacauaaauaugg

SEQ ID NO: 2074091 - RNA, 22 nt, Staphylococcus aureus subsp. aureus Mu50
gacauacucacaaaaaacacua

SEQ ID NO: 2074092 - RNA, 13 nt, Staphylococcus aureus subsp. aureus Mu50
gacagcuacaauu

SEQ ID NO: 2074093 - RNA, 19 nt, Staphylococcus aureus subsp. aureus Mu50
gacagcuacaauuuucuca

SEQ ID NO: 2074094 - RNA, 17 nt, Staphylococcus aureus subsp. aureus Mu50
gacacauuuacuuaaga

SEQ ID NO: 2074095 - RNA, 18 nt, Staphylococcus aureus subsp. aureus Mu50
gacacuuaacuuguguua

SEQ ID NO: 2074096 - RNA, 18 nt, Staphylococcus aureus subsp. aureus Mu50
gacauuacauuuaguaca

SEQ ID NO: 2074097 - RNA, 13 nt, Staphylococcus aureus subsp. aureus Mu50
gacauugaauaaa

SEQ ID NO: 2074098 - RNA, 13 nt, Staphylococcus aureus subsp. aureus Mu50
gaccaaguaugag

SEQ ID NO: 2074099 - RNA, 22 nt, Staphylococcus aureus subsp. aureus Mu50
gaccacuuuuguuaaaaaaugg

SEQ ID NO: 2074100 - RNA, 18 nt, Staphylococcus aureus subsp. aureus Mu50
gaccacucaauucucuaa

SEQ ID NO: 2074101 - RNA, 14 nt, Staphylococcus aureus subsp. aureus Mu50
gaccaaguaugaga

SEQ ID NO: 2074102 - RNA, 17 nt, Staphylococcus aureus subsp. aureus Mu50
gaccauuuuauauuuua

SEQ ID NO: 2074103 - RNA, 18 nt, Staphylococcus aureus subsp. aureus Mu50
gaccagucgcauauuuug

SEQ ID NO: 2074104 - RNA, 18 nt, Staphylococcus aureus subsp. aureus Mu50
gaauuucuaauuaaacgc

SEQ ID NO: 2074105 - RNA, 23 nt, Staphylococcus aureus subsp. aureus Mu50
gaauuucguuauuaaacuacgaa

SEQ ID NO: 2074106 - RNA, 19 nt, Staphylococcus aureus subsp. aureus Mu50
gaauuucguuauuaaacua

SEQ ID NO: 2074107 - RNA, 17 nt, Staphylococcus aureus subsp. aureus Mu50
gaauuucgaaaagaaau

SEQ ID NO: 2074108 - RNA, 18 nt, Staphylococcus aureus subsp. aureus Mu50
gaauuucgaaaagaaauu

SEQ ID NO: 2074109 - RNA, 16 nt, Staphylococcus aureus subsp. aureus Mu50
gaauugaguauuaaau

SEQ ID NO: 2074110 - RNA, 11 nt, Staphylococcus aureus subsp. aureus Mu50
gaauugaguau

SEQ ID NO: 2074111 - RNA, 13 nt, Staphylococcus aureus subsp. aureus Mu50
gaauucucgauuu

SEQ ID NO: 2074112 - RNA, 21 nt, Staphylococcus aureus subsp. aureus Mu50
gaauucuaaaagaauuauuca

SEQ ID NO: 2074113 - RNA, 14 nt, Staphylococcus aureus subsp. aureus Mu50
gaauggcaaauaug

SEQ ID NO: 2074114 - RNA, 11 nt, Staphylococcus aureus subsp. aureus Mu50
gaauucaacgu

SEQ ID NO: 2074115 - RNA, 22 nt, Staphylococcus aureus subsp. aureus Mu50
gaauucaacgucgaauguuucu

SEQ ID NO: 2074116 - RNA, 16 nt, Staphylococcus aureus subsp. aureus Mu50
gaauucaaccaauuau

SEQ ID NO: 2074117 - RNA, 13 nt, Staphylococcus aureus subsp. aureus Mu50
gaaugguauaauu

SEQ ID NO: 2074118 - RNA, 18 nt, Staphylococcus aureus subsp. aureus Mu50
gaauucauucaauacgaa

SEQ ID NO: 2074119 - RNA, 14 nt, Staphylococcus aureus subsp. aureus Mu50
gacaacugauuuaa

SEQ ID NO: 2074120 - RNA, 15 nt, Staphylococcus aureus subsp. aureus Mu50
gacaacugauuuaau

SEQ ID NO: 2074121 - RNA, 13 nt, Staphylococcus aureus subsp. aureus Mu50
gacaaauuaaaaa

SEQ ID NO: 2074122 - RNA, 13 nt, Staphylococcus aureus subsp. aureus Mu50
gacaaauguucua

SEQ ID NO: 2074123 - RNA, 14 nt, Staphylococcus aureus subsp. aureus Mu50
gacaaauuaaaaaa

SEQ ID NO: 2074124 - RNA, 19 nt, Staphylococcus aureus subsp. aureus Mu50
gacaacauaacaaagaacc

SEQ ID NO: 2074125 - RNA, 21 nt, Staphylococcus aureus subsp. aureus Mu50
gacaaaguucacaacaaagug

SEQ ID NO: 2074126 - RNA, 17 nt, Staphylococcus aureus subsp. aureus Mu50
aaagaugauauauucau

SEQ ID NO: 2074127 - RNA, 14 nt, Staphylococcus aureus subsp. aureus Mu50
aaagaugaaaaagu

SEQ ID NO: 2074128 - RNA, 13 nt, Staphylococcus aureus subsp. aureus Mu50
gaauacuuuuuaa

SEQ ID NO: 2074129 - RNA, 16 nt, Staphylococcus aureus subsp. aureus Mu50
gaauacuuuuuaacug

SEQ ID NO: 2074130 - RNA, 13 nt, Staphylococcus aureus subsp. aureus Mu50
gaauauaacgaau

SEQ ID NO: 2074131 - RNA, 13 nt, Staphylococcus aureus subsp. aureus Mu50
aaagaugucgaaa

SEQ ID NO: 2074132 - RNA, 20 nt, Staphylococcus aureus subsp. aureus Mu50
gaauauacuaaaguucaaca

SEQ ID NO: 2074133 - RNA, 19 nt, Staphylococcus aureus subsp. aureus Mu50
gaauauaauaacaaucaaa

SEQ ID NO: 2074134 - RNA, 19 nt, Staphylococcus aureus subsp. aureus Mu50
gaauauuaagauguauaug

SEQ ID NO: 2074135 - RNA, 23 nt, Staphylococcus aureus subsp. aureus Mu50
gaauauuaacguuaguauaaacg

SEQ ID NO: 2074136 - RNA, 21 nt, Staphylococcus aureus subsp. aureus Mu50
gaauauuguauugaucuacau

SEQ ID NO: 2074137 - RNA, 23 nt, Staphylococcus aureus subsp. aureus Mu50
gaauaugaauugcuuguuuuaaa

SEQ ID NO: 2074138 - RNA, 23 nt, Staphylococcus aureus subsp. aureus Mu50
gaauauagauuuuguauuagcau

SEQ ID NO: 2074139 - RNA, 14 nt, Staphylococcus aureus subsp. aureus Mu50
gaaugauagauuua

SEQ ID NO: 2074140 - RNA, 13 nt, Staphylococcus aureus subsp. aureus Mu50
gaaugaugaguau

SEQ ID NO: 2074141 - RNA, 15 nt, Staphylococcus aureus subsp. aureus Mu50
aaagauauagaauuc

SEQ ID NO: 2074142 - RNA, 16 nt, Staphylococcus aureus subsp. aureus Mu50
aaagauauaaacauuu

SEQ ID NO: 2074143 - RNA, 13 nt, Staphylococcus aureus subsp. aureus Mu50
aaagauauacuua

SEQ ID NO: 2074144 - RNA, 14 nt, Staphylococcus aureus subsp. aureus Mu50
aaagauauaaacau

SEQ ID NO: 2074145 - RNA, 12 nt, Staphylococcus aureus subsp. aureus Mu50
aaagauacugcu

SEQ ID NO: 2074146 - RNA, 18 nt, Staphylococcus aureus subsp. aureus Mu50
aaagauaagaagagccag

SEQ ID NO: 2074147 - RNA, 18 nt, Staphylococcus aureus subsp. aureus Mu50
gaauaauguuuucauugg

SEQ ID NO: 2074148 - RNA, 13 nt, Staphylococcus aureus subsp. aureus Mu50
gaauaacaagaaa

SEQ ID NO: 2074149 - RNA, 14 nt, Staphylococcus aureus subsp. aureus Mu50
gaauaaaucgggca

SEQ ID NO: 2074150 - RNA, 18 nt, Staphylococcus aureus subsp. aureus Mu50
gaauaauugcuaaaauau

SEQ ID NO: 2074151 - RNA, 18 nt, Staphylococcus aureus subsp. aureus Mu50
gaauaauuuuaaaaauaa

SEQ ID NO: 2074152 - RNA, 17 nt, Staphylococcus aureus subsp. aureus Mu50
gaauaauuuuaaaaaua

SEQ ID NO: 2074153 - RNA, 13 nt, Staphylococcus aureus subsp. aureus Mu50
gaauaauuaaaaa

SEQ ID NO: 2074154 - RNA, 18 nt, Staphylococcus aureus subsp. aureus Mu50
gaauacagaugaugcuuc

SEQ ID NO: 2074155 - RNA, 15 nt, Staphylococcus aureus subsp. aureus Mu50
gaauacaaauauuaa

SEQ ID NO: 2074156 - RNA, 22 nt, Staphylococcus aureus subsp. aureus Mu50
gaauacacgacgcuaaacaaag

SEQ ID NO: 2074157 - RNA, 16 nt, Staphylococcus aureus subsp. aureus Mu50
gaagggaguauuuuuu

SEQ ID NO: 2074158 - RNA, 18 nt, Staphylococcus aureus subsp. aureus Mu50
gaagcugucuuacugcug

SEQ ID NO: 2074159 - RNA, 14 nt, Staphylococcus aureus subsp. aureus Mu50
gaacaucuaguuau

SEQ ID NO: 2074160 - RNA, 18 nt, Staphylococcus aureus subsp. aureus Mu50
gaacaugguaucuuuaau

SEQ ID NO: 2074161 - RNA, 22 nt, Staphylococcus aureus subsp. aureus Mu50
gaagaauccuaugccaaauaac

SEQ ID NO: 2074162 - RNA, 13 nt, Staphylococcus aureus subsp. aureus Mu50
gaagaccauuuua

SEQ ID NO: 2074163 - RNA, 15 nt, Staphylococcus aureus subsp. aureus Mu50
gaagagaugaaagau

SEQ ID NO: 2074164 - RNA, 14 nt, Staphylococcus aureus subsp. aureus Mu50
gaagagaugaaaga

SEQ ID NO: 2074165 - RNA, 23 nt, Staphylococcus aureus subsp. aureus Mu50
gaaagucuuuaacccaaauugau

SEQ ID NO: 2074166 - RNA, 15 nt, Staphylococcus aureus subsp. aureus Mu50
gaaaguguaugcaug

SEQ ID NO: 2074167 - RNA, 14 nt, Staphylococcus aureus subsp. aureus Mu50
gaaauaaaaaauaa

SEQ ID NO: 2074168 - RNA, 19 nt, Staphylococcus aureus subsp. aureus Mu50
gaaaguuucgacguaccaa

SEQ ID NO: 2074169 - RNA, 18 nt, Staphylococcus aureus subsp. aureus Mu50
gaaauaaaacaagacuac

SEQ ID NO: 2074170 - RNA, 18 nt, Staphylococcus aureus subsp. aureus Mu50
gaaauaggcgcuuguaaa

SEQ ID NO: 2074171 - RNA, 16 nt, Staphylococcus aureus subsp. aureus Mu50
gaaauauauugucgac

SEQ ID NO: 2074172 - RNA, 19 nt, Staphylococcus aureus subsp. aureus Mu50
gaaauccgcauaaauuaga

SEQ ID NO: 2074173 - RNA, 14 nt, Staphylococcus aureus subsp. aureus Mu50
gaaacuuuaauacu

SEQ ID NO: 2074174 - RNA, 15 nt, Staphylococcus aureus subsp. aureus Mu50
gaaacuuuaauacua

SEQ ID NO: 2074175 - RNA, 21 nt, Staphylococcus aureus subsp. aureus Mu50
gaaagacguuuuuuuauaaau

SEQ ID NO: 2074176 - RNA, 21 nt, Staphylococcus aureus subsp. aureus Mu50
gaacagauauacuacuuguuu

SEQ ID NO: 2074177 - RNA, 17 nt, Staphylococcus aureus subsp. aureus Mu50
gaacaguuagugcuugu

SEQ ID NO: 2074178 - RNA, 13 nt, Staphylococcus aureus subsp. aureus Mu50
aaagagcguguua

SEQ ID NO: 2074179 - RNA, 17 nt, Staphylococcus aureus subsp. aureus Mu50
gaaauuagaaccaucau

SEQ ID NO: 2074180 - RNA, 13 nt, Staphylococcus aureus subsp. aureus Mu50
gaaauuaaauuca

SEQ ID NO: 2074181 - RNA, 13 nt, Staphylococcus aureus subsp. aureus Mu50
gaaauuuauuaua

SEQ ID NO: 2074182 - RNA, 21 nt, Staphylococcus aureus subsp. aureus Mu50
gaaauuuauuauaaaauagaa

SEQ ID NO: 2074183 - RNA, 16 nt, Staphylococcus aureus subsp. aureus Mu50
gaaauuuauuauaauu

SEQ ID NO: 2074184 - RNA, 21 nt, Staphylococcus aureus subsp. aureus Mu50
gaaauuguguugaaucaacag

SEQ ID NO: 2074185 - RNA, 13 nt, Staphylococcus aureus subsp. aureus Mu50
gaaauggaaagua

SEQ ID NO: 2074186 - RNA, 21 nt, Staphylococcus aureus subsp. aureus Mu50
gaaauguaugauauaaaccau

SEQ ID NO: 2074187 - RNA, 11 nt, Staphylococcus aureus subsp. aureus Mu50
gaaauguagau

SEQ ID NO: 2074188 - RNA, 17 nt, Staphylococcus aureus subsp. aureus Mu50
gaaauguagauuacuuu

SEQ ID NO: 2074189 - RNA, 18 nt, Staphylococcus aureus subsp. aureus Mu50
gaaaucucggcauuuuua

SEQ ID NO: 2074190 - RNA, 15 nt, Staphylococcus aureus subsp. aureus Mu50
cuuuuacaaacuuca

SEQ ID NO: 2074191 - RNA, 12 nt, Staphylococcus aureus subsp. aureus Mu50
cuuuuagauuau

SEQ ID NO: 2074192 - RNA, 18 nt, Staphylococcus aureus subsp. aureus Mu50
cuuuuagauuaucuuuca

SEQ ID NO: 2074193 - RNA, 16 nt, Staphylococcus aureus subsp. aureus Mu50
cuuuuagaguuuuuau

SEQ ID NO: 2074194 - RNA, 21 nt, Staphylococcus aureus subsp. aureus Mu50
cuuuuauccaauguauaaaac

SEQ ID NO: 2074195 - RNA, 12 nt, Staphylococcus aureus subsp. aureus Mu50
cuuuuauagaaa

SEQ ID NO: 2074196 - RNA, 14 nt, Staphylococcus aureus subsp. aureus Mu50
cuuuugauuuugaa

SEQ ID NO: 2074197 - RNA, 19 nt, Staphylococcus aureus subsp. aureus Mu50
cuuuugauagcuaaugcau

SEQ ID NO: 2074198 - RNA, 19 nt, Staphylococcus aureus subsp. aureus Mu50
cuuuugauccaaaguacuc

SEQ ID NO: 2074199 - RNA, 13 nt, Staphylococcus aureus subsp. aureus Mu50
cuuuugauagcua

SEQ ID NO: 2074200 - RNA, 15 nt, Staphylococcus aureus subsp. aureus Mu50
cuuuugauagcuaau

SEQ ID NO: 2074201 - RNA, 21 nt, Staphylococcus aureus subsp. aureus Mu50
cuuuugagacguuuuccauga

SEQ ID NO: 2074202 - RNA, 13 nt, Staphylococcus aureus subsp. aureus Mu50
cuuuuuacauuuu

SEQ ID NO: 2074203 - RNA, 20 nt, Staphylococcus aureus subsp. aureus Mu50
cuuuuuacuauguaacuuua

SEQ ID NO: 2074204 - RNA, 22 nt, Staphylococcus aureus subsp. aureus Mu50
cuuuuuaucaugauuaauuaaa

SEQ ID NO: 2074205 - RNA, 14 nt, Staphylococcus aureus subsp. aureus Mu50
cuuuuuauuuuuug

SEQ ID NO: 2074206 - RNA, 14 nt, Staphylococcus aureus subsp. aureus Mu50
cuuuuuauuuuguu

SEQ ID NO: 2074207 - RNA, 17 nt, Staphylococcus aureus subsp. aureus Mu50
cuuuuuauuuuaauauu

SEQ ID NO: 2074208 - RNA, 23 nt, Staphylococcus aureus subsp. aureus Mu50
cuuuuuauuuauaacuuuaaaaa

SEQ ID NO: 2074209 - RNA, 14 nt, Staphylococcus aureus subsp. aureus Mu50
cuuuuuaaaugauu

SEQ ID NO: 2074210 - RNA, 23 nt, Staphylococcus aureus subsp. aureus Mu50
cuuuuuaacuauguuacuuauau

SEQ ID NO: 2074211 - RNA, 12 nt, Staphylococcus aureus subsp. aureus Mu50
cuuuuuaaagga

SEQ ID NO: 2074212 - RNA, 21 nt, Staphylococcus aureus subsp. aureus Mu50
cuuuuguaaagcuuuaguuaa

SEQ ID NO: 2074213 - RNA, 22 nt, Staphylococcus aureus subsp. aureus Mu50
cuuuugggaagcgucuuuuuug

SEQ ID NO: 2074214 - RNA, 13 nt, Staphylococcus aureus subsp. aureus Mu50
cuuuuggucuguu

SEQ ID NO: 2074215 - RNA, 21 nt, Staphylococcus aureus subsp. aureus Mu50
gaaaaacuucuuaacuugaaa

SEQ ID NO: 2074216 - RNA, 14 nt, Staphylococcus aureus subsp. aureus Mu50
gaaaaacuuuucau

SEQ ID NO: 2074217 - RNA, 18 nt, Staphylococcus aureus subsp. aureus Mu50
gaaaaacugcucauugug

SEQ ID NO: 2074218 - RNA, 12 nt, Staphylococcus aureus subsp. aureus Mu50
gaaaaaccaagu

SEQ ID NO: 2074219 - RNA, 19 nt, Staphylococcus aureus subsp. aureus Mu50
gaaaaaccugggacauuaa

SEQ ID NO: 2074220 - RNA, 13 nt, Staphylococcus aureus subsp. aureus Mu50
cuuuuuugugauu

SEQ ID NO: 2074221 - RNA, 17 nt, Staphylococcus aureus subsp. aureus Mu50
cuuuuuuuauaaguauu

SEQ ID NO: 2074222 - RNA, 15 nt, Staphylococcus aureus subsp. aureus Mu50
cuuuuuguguaucug

SEQ ID NO: 2074223 - RNA, 20 nt, Staphylococcus aureus subsp. aureus Mu50
cuuuuuucucuucuugaggu

SEQ ID NO: 2074224 - RNA, 15 nt, Staphylococcus aureus subsp. aureus Mu50
cuuuuugcuuaguac

SEQ ID NO: 2074225 - RNA, 15 nt, Staphylococcus aureus subsp. aureus Mu50
cuuuuugauuauauu

SEQ ID NO: 2074226 - RNA, 17 nt, Staphylococcus aureus subsp. aureus Mu50
cuuuuugcguuuuuaaa

SEQ ID NO: 2074227 - RNA, 16 nt, Staphylococcus aureus subsp. aureus Mu50
cuuuuugaucaacuau

SEQ ID NO: 2074228 - RNA, 13 nt, Staphylococcus aureus subsp. aureus Mu50
cuuuuucaucuuu

SEQ ID NO: 2074229 - RNA, 15 nt, Staphylococcus aureus subsp. aureus Mu50
cuuuuucauagaaca

SEQ ID NO: 2074230 - RNA, 21 nt, Staphylococcus aureus subsp. aureus Mu50
cuuuuucauagaacaaaaugu

SEQ ID NO: 2074231 - RNA, 15 nt, Staphylococcus aureus subsp. aureus Mu50
cuuuuucacauugcc

SEQ ID NO: 2074232 - RNA, 22 nt, Staphylococcus aureus subsp. aureus Mu50
cuuuuucacgauuuuuaaaaug

SEQ ID NO: 2074233 - RNA, 21 nt, Staphylococcus aureus subsp. aureus Mu50
gaaaccgcuucucgccuaauu

SEQ ID NO: 2074234 - RNA, 21 nt, Staphylococcus aureus subsp. aureus Mu50
gaaacaagaaguuuccaacgu

SEQ ID NO: 2074235 - RNA, 19 nt, Staphylococcus aureus subsp. aureus Mu50
gaaacaaaacaaaaaauau

SEQ ID NO: 2074236 - RNA, 13 nt, Staphylococcus aureus subsp. aureus Mu50
gaaacaaauuagu

SEQ ID NO: 2074237 - RNA, 16 nt, Staphylococcus aureus subsp. aureus Mu50
gaaacaucuugauauu

SEQ ID NO: 2074238 - RNA, 11 nt, Staphylococcus aureus subsp. aureus Mu50
gaaaaauaauu

SEQ ID NO: 2074239 - RNA, 20 nt, Staphylococcus aureus subsp. aureus Mu50
gaaaaauuucaaaaauagcg

SEQ ID NO: 2074240 - RNA, 16 nt, Staphylococcus aureus subsp. aureus Mu50
gaaaaauuucaaaaau

SEQ ID NO: 2074241 - RNA, 20 nt, Staphylococcus aureus subsp. aureus Mu50
gaaaagggaauggauuacag

SEQ ID NO: 2074242 - RNA, 20 nt, Staphylococcus aureus subsp. aureus Mu50
gaaaaggucaaaaaauuaau

SEQ ID NO: 2074243 - RNA, 14 nt, Staphylococcus aureus subsp. aureus Mu50
gaaaaguauaugaa

SEQ ID NO: 2074244 - RNA, 16 nt, Staphylococcus aureus subsp. aureus Mu50
gaaaagucacagugua

SEQ ID NO: 2074245 - RNA, 19 nt, Staphylococcus aureus subsp. aureus Mu50
gaaaagucagcuuacaaua

SEQ ID NO: 2074246 - RNA, 18 nt, Staphylococcus aureus subsp. aureus Mu50
gaaaauagcuauuaaaau

SEQ ID NO: 2074247 - RNA, 21 nt, Staphylococcus aureus subsp. aureus Mu50
gaaaauagcuauuaaaauaga

SEQ ID NO: 2074248 - RNA, 22 nt, Staphylococcus aureus subsp. aureus Mu50
gaaaaguuuuuuacuuuucauc

SEQ ID NO: 2074249 - RNA, 18 nt, Staphylococcus aureus subsp. aureus Mu50
gaaaagugcgauuaucag

SEQ ID NO: 2074250 - RNA, 13 nt, Staphylococcus aureus subsp. aureus Mu50
gaaaauaugauaa

SEQ ID NO: 2074251 - RNA, 12 nt, Staphylococcus aureus subsp. aureus Mu50
gaaaauaucauu

SEQ ID NO: 2074252 - RNA, 12 nt, Staphylococcus aureus subsp. aureus Mu50
gaaaauuaacuc

SEQ ID NO: 2074253 - RNA, 17 nt, Staphylococcus aureus subsp. aureus Mu50
gaaaauucgcuuguaac

SEQ ID NO: 2074254 - RNA, 17 nt, Staphylococcus aureus subsp. aureus Mu50
gaaaauuauacaaauua

SEQ ID NO: 2074255 - RNA, 22 nt, Staphylococcus aureus subsp. aureus Mu50
gaaaauucgcuuguaacaagcu

SEQ ID NO: 2074256 - RNA, 18 nt, Staphylococcus aureus subsp. aureus Mu50
gaaaauugaguauauuca

SEQ ID NO: 2074257 - RNA, 19 nt, Staphylococcus aureus subsp. aureus Mu50
cuuucaaaugcuuaauaaa

SEQ ID NO: 2074258 - RNA, 18 nt, Staphylococcus aureus subsp. aureus Mu50
cuuucaaauauaucuaau

SEQ ID NO: 2074259 - RNA, 12 nt, Staphylococcus aureus subsp. aureus Mu50
cuuuauuuuuug

SEQ ID NO: 2074260 - RNA, 21 nt, Staphylococcus aureus subsp. aureus Mu50
cuuuacuugcuuuuucaaaua

SEQ ID NO: 2074261 - RNA, 13 nt, Staphylococcus aureus subsp. aureus Mu50
cuuuacuuucauu

SEQ ID NO: 2074262 - RNA, 23 nt, Staphylococcus aureus subsp. aureus Mu50
cuuuacuugcuuuuucaaauaau

SEQ ID NO: 2074263 - RNA, 13 nt, Staphylococcus aureus subsp. aureus Mu50
cuuuagguaaaag

SEQ ID NO: 2074264 - RNA, 15 nt, Staphylococcus aureus subsp. aureus Mu50
cuuuagguaaaagag

SEQ ID NO: 2074265 - RNA, 16 nt, Staphylococcus aureus subsp. aureus Mu50
cuuuaugaaucauuuu

SEQ ID NO: 2074266 - RNA, 14 nt, Staphylococcus aureus subsp. aureus Mu50
cuuuauuaaaaauc

SEQ ID NO: 2074267 - RNA, 18 nt, Staphylococcus aureus subsp. aureus Mu50
cuuuauuuuaaacaugaa

SEQ ID NO: 2074268 - RNA, 22 nt, Staphylococcus aureus subsp. aureus Mu50
cuuuauuuucuuguguauuuuu

SEQ ID NO: 2074269 - RNA, 17 nt, Staphylococcus aureus subsp. aureus Mu50
cuuuaauuuuucauuaa

SEQ ID NO: 2074270 - RNA, 15 nt, Staphylococcus aureus subsp. aureus Mu50
cuuuaccaauaucau

SEQ ID NO: 2074271 - RNA, 20 nt, Staphylococcus aureus subsp. aureus Mu50
cuuuacauucuuuguauuua

SEQ ID NO: 2074272 - RNA, 19 nt, Staphylococcus aureus subsp. aureus Mu50
cuuuacuccaaaguaacau

SEQ ID NO: 2074273 - RNA, 19 nt, Staphylococcus aureus subsp. aureus Mu50
cuuuacucuacacucaaac

SEQ ID NO: 2074274 - RNA, 23 nt, Staphylococcus aureus subsp. aureus Mu50
cuuuaacuguacgauucaauuua

SEQ ID NO: 2074275 - RNA, 17 nt, Staphylococcus aureus subsp. aureus Mu50
cuuuaacuuuaauuaaa

SEQ ID NO: 2074276 - RNA, 16 nt, Staphylococcus aureus subsp. aureus Mu50
cuuuaauuuagugaaa

SEQ ID NO: 2074277 - RNA, 13 nt, Staphylococcus aureus subsp. aureus Mu50
cuuuaauuuucuu

SEQ ID NO: 2074278 - RNA, 14 nt, Staphylococcus aureus subsp. aureus Mu50
cuuuaagcuuaaau

SEQ ID NO: 2074279 - RNA, 16 nt, Staphylococcus aureus subsp. aureus Mu50
cuuuaagcccuucccc

SEQ ID NO: 2074280 - RNA, 21 nt, Staphylococcus aureus subsp. aureus Mu50
cuuuaagugacacaccaccac

SEQ ID NO: 2074281 - RNA, 18 nt, Staphylococcus aureus subsp. aureus Mu50
cuuuaauuaaaguuaaag

SEQ ID NO: 2074282 - RNA, 16 nt, Staphylococcus aureus subsp. aureus Mu50
aaagaauuauucaagu

SEQ ID NO: 2074283 - RNA, 16 nt, Staphylococcus aureus subsp. aureus Mu50
aaagaaugauuuauaa

SEQ ID NO: 2074284 - RNA, 18 nt, Staphylococcus aureus subsp. aureus Mu50
aaagaauuucgaaaagaa

SEQ ID NO: 2074285 - RNA, 16 nt, Staphylococcus aureus subsp. aureus Mu50
cuuuaaaucuuguucu

SEQ ID NO: 2074286 - RNA, 18 nt, Staphylococcus aureus subsp. aureus Mu50
aaagaaggggagaguuaa

SEQ ID NO: 2074287 - RNA, 22 nt, Staphylococcus aureus subsp. aureus Mu50
aaagaaggggagaguuaauccu

SEQ ID NO: 2074288 - RNA, 17 nt, Staphylococcus aureus subsp. aureus Mu50
aaagaauaaauguuaaa

SEQ ID NO: 2074289 - RNA, 22 nt, Staphylococcus aureus subsp. aureus Mu50
aaagaauccuuaauugcucuuc

SEQ ID NO: 2074290 - RNA, 23 nt, Staphylococcus aureus subsp. aureus Mu50
cuuucugaucgacuaauuuuucu

SEQ ID NO: 2074291 - RNA, 16 nt, Staphylococcus aureus subsp. aureus Mu50
cuuucguccaacaugu

SEQ ID NO: 2074292 - RNA, 18 nt, Staphylococcus aureus subsp. aureus Mu50
cuuugaagggguuuuuuc

SEQ ID NO: 2074293 - RNA, 19 nt, Staphylococcus aureus subsp. aureus Mu50
cuuugaagggguuuuuucu

SEQ ID NO: 2074294 - RNA, 20 nt, Staphylococcus aureus subsp. aureus Mu50
cuuugaagggguuuuuucuu

SEQ ID NO: 2074295 - RNA, 19 nt, Staphylococcus aureus subsp. aureus Mu50
cuuugaacauauuauaaaa

SEQ ID NO: 2074296 - RNA, 19 nt, Staphylococcus aureus subsp. aureus Mu50
cuuugaagggagcauuuca

SEQ ID NO: 2074297 - RNA, 13 nt, Staphylococcus aureus subsp. aureus Mu50
cuuucgauaaacu

SEQ ID NO: 2074298 - RNA, 21 nt, Staphylococcus aureus subsp. aureus Mu50
cuuuccucacuagauaguuua

SEQ ID NO: 2074299 - RNA, 17 nt, Staphylococcus aureus subsp. aureus Mu50
cuuugauauguuuccuc

SEQ ID NO: 2074300 - RNA, 19 nt, Staphylococcus aureus subsp. aureus Mu50
cuuugauaacaauuuuaaa

SEQ ID NO: 2074301 - RNA, 20 nt, Staphylococcus aureus subsp. aureus Mu50
cuuugauaacaauuuuaaau

SEQ ID NO: 2074302 - RNA, 20 nt, Staphylococcus aureus subsp. aureus Mu50
cuuugaauggcucguuuuuu

SEQ ID NO: 2074303 - RNA, 21 nt, Staphylococcus aureus subsp. aureus Mu50
cuuuuaauauuugauaacaaa

SEQ ID NO: 2074304 - RNA, 16 nt, Staphylococcus aureus subsp. aureus Mu50
cuuuuaauucuuaauc

SEQ ID NO: 2074305 - RNA, 14 nt, Staphylococcus aureus subsp. aureus Mu50
cuuuguaaauuuuu

SEQ ID NO: 2074306 - RNA, 18 nt, Staphylococcus aureus subsp. aureus Mu50
cuuuguaaccuaaaaaca

SEQ ID NO: 2074307 - RNA, 14 nt, Staphylococcus aureus subsp. aureus Mu50
cuuuggcaccagua

SEQ ID NO: 2074308 - RNA, 15 nt, Staphylococcus aureus subsp. aureus Mu50
cuuuggauuucuuuu

SEQ ID NO: 2074309 - RNA, 18 nt, Staphylococcus aureus subsp. aureus Mu50
cuuuggauuucuuuuuaa

SEQ ID NO: 2074310 - RNA, 14 nt, Staphylococcus aureus subsp. aureus Mu50
cuuuggcuauuuua

SEQ ID NO: 2074311 - RNA, 23 nt, Staphylococcus aureus subsp. aureus Mu50
cuugguacaccuacaaauauuuc

SEQ ID NO: 2074312 - RNA, 17 nt, Staphylococcus aureus subsp. aureus Mu50
cuugggcugacauuuuu

SEQ ID NO: 2074313 - RNA, 17 nt, Staphylococcus aureus subsp. aureus Mu50
cuugguauuuuuuaaau

SEQ ID NO: 2074314 - RNA, 13 nt, Staphylococcus aureus subsp. aureus Mu50
cuugguauuuuuu

SEQ ID NO: 2074315 - RNA, 16 nt, Staphylococcus aureus subsp. aureus Mu50
cuuguaaauuuaaaug

SEQ ID NO: 2074316 - RNA, 19 nt, Staphylococcus aureus subsp. aureus Mu50
cuuguaaauuuauuuuuaa

SEQ ID NO: 2074317 - RNA, 15 nt, Staphylococcus aureus subsp. aureus Mu50
cuuguaaacuucuuu

SEQ ID NO: 2074318 - RNA, 18 nt, Staphylococcus aureus subsp. aureus Mu50
cuuggugguuuugaugua

SEQ ID NO: 2074319 - RNA, 21 nt, Staphylococcus aureus subsp. aureus Mu50
cuuguaacaagcuuuuuucaa

SEQ ID NO: 2074320 - RNA, 12 nt, Staphylococcus aureus subsp. aureus Mu50
cuuguaacaagc

SEQ ID NO: 2074321 - RNA, 22 nt, Staphylococcus aureus subsp. aureus Mu50
cuuguaauauuauaaccaccag

SEQ ID NO: 2074322 - RNA, 17 nt, Staphylococcus aureus subsp. aureus Mu50
cuuguaauccuuguucu

SEQ ID NO: 2074323 - RNA, 15 nt, Staphylococcus aureus subsp. aureus Mu50
cuuguaauauaacaa

SEQ ID NO: 2074324 - RNA, 15 nt, Staphylococcus aureus subsp. aureus Mu50
cuuguacacauccuc

SEQ ID NO: 2074325 - RNA, 17 nt, Staphylococcus aureus subsp. aureus Mu50
cuuggcuuaaucucuuu

SEQ ID NO: 2074326 - RNA, 17 nt, Staphylococcus aureus subsp. aureus Mu50
cuuggcgacauuuguaa

SEQ ID NO: 2074327 - RNA, 20 nt, Staphylococcus aureus subsp. aureus Mu50
cuuggcguauuuuuuguucu

SEQ ID NO: 2074328 - RNA, 13 nt, Staphylococcus aureus subsp. aureus Mu50
cuuggcguauuuu

SEQ ID NO: 2074329 - RNA, 17 nt, Staphylococcus aureus subsp. aureus Mu50
cuuggauuuuuugguuu

SEQ ID NO: 2074330 - RNA, 23 nt, Staphylococcus aureus subsp. aureus Mu50
cuuggcaaugaaauuaccaacac

SEQ ID NO: 2074331 - RNA, 22 nt, Staphylococcus aureus subsp. aureus Mu50
cuuggaauaauacguuuugcua

SEQ ID NO: 2074332 - RNA, 19 nt, Staphylococcus aureus subsp. aureus Mu50
cuuggccaauuaacuugau

SEQ ID NO: 2074333 - RNA, 14 nt, Staphylococcus aureus subsp. aureus Mu50
cuugugugaaauua

SEQ ID NO: 2074334 - RNA, 19 nt, Staphylococcus aureus subsp. aureus Mu50
cuugugguuggaagucugc

SEQ ID NO: 2074335 - RNA, 15 nt, Staphylococcus aureus subsp. aureus Mu50
cuugugcuuaagaac

SEQ ID NO: 2074336 - RNA, 19 nt, Staphylococcus aureus subsp. aureus Mu50
cuugugauaauucuucaac

SEQ ID NO: 2074337 - RNA, 14 nt, Staphylococcus aureus subsp. aureus Mu50
cuugugaaauuaga

SEQ ID NO: 2074338 - RNA, 12 nt, Staphylococcus aureus subsp. aureus Mu50
aaagaaaaguuu

SEQ ID NO: 2074339 - RNA, 18 nt, Staphylococcus aureus subsp. aureus Mu50
aaagaaagcuaauaucaa

SEQ ID NO: 2074340 - RNA, 13 nt, Staphylococcus aureus subsp. aureus Mu50
cuuguuuuaaacu

SEQ ID NO: 2074341 - RNA, 21 nt, Staphylococcus aureus subsp. aureus Mu50
cuuguuguucuguaaugauau

SEQ ID NO: 2074342 - RNA, 23 nt, Staphylococcus aureus subsp. aureus Mu50
cuuuaaaacguuaguacuuugau

SEQ ID NO: 2074343 - RNA, 19 nt, Staphylococcus aureus subsp. aureus Mu50
cuuuaaaacaucauucaca

SEQ ID NO: 2074344 - RNA, 22 nt, Staphylococcus aureus subsp. aureus Mu50
cuuuaaaacaucauucacaagu

SEQ ID NO: 2074345 - RNA, 14 nt, Staphylococcus aureus subsp. aureus Mu50
cuuuaaaauucucu

SEQ ID NO: 2074346 - RNA, 19 nt, Staphylococcus aureus subsp. aureus Mu50
cuuuaaaauuguauagaau

SEQ ID NO: 2074347 - RNA, 14 nt, Staphylococcus aureus subsp. aureus Mu50
cuuuaaacaagcau

SEQ ID NO: 2074348 - RNA, 11 nt, Staphylococcus aureus subsp. aureus Mu50
cuuuaaacucg

SEQ ID NO: 2074349 - RNA, 16 nt, Staphylococcus aureus subsp. aureus Mu50
cuuuaaaucuacuuug

SEQ ID NO: 2074350 - RNA, 16 nt, Staphylococcus aureus subsp. aureus Mu50
aaagaacuauuuuaaa

SEQ ID NO: 2074351 - RNA, 22 nt, Staphylococcus aureus subsp. aureus Mu50
aaagaacuaacauaauuuuuau

SEQ ID NO: 2074352 - RNA, 16 nt, Staphylococcus aureus subsp. aureus Mu50
cuuguuggauuuuaac

SEQ ID NO: 2074353 - RNA, 13 nt, Staphylococcus aureus subsp. aureus Mu50
cuuguucuaauug

SEQ ID NO: 2074354 - RNA, 14 nt, Staphylococcus aureus subsp. aureus Mu50
aaagaaauaauuua

SEQ ID NO: 2074355 - RNA, 16 nt, Staphylococcus aureus subsp. aureus Mu50
aaagaaauaauuuaaa

SEQ ID NO: 2074356 - RNA, 14 nt, Staphylococcus aureus subsp. aureus Mu50
aaagaaaucaccag

SEQ ID NO: 2074357 - RNA, 19 nt, Staphylococcus aureus subsp. aureus Mu50
cuucaccaucuguaacuaa

SEQ ID NO: 2074358 - RNA, 19 nt, Staphylococcus aureus subsp. aureus Mu50
cuucaaucgucacaucacg

SEQ ID NO: 2074359 - RNA, 16 nt, Staphylococcus aureus subsp. aureus Mu50
cuucaauccaagcaau

SEQ ID NO: 2074360 - RNA, 13 nt, Staphylococcus aureus subsp. aureus Mu50
cuucaauauuuaa

SEQ ID NO: 2074361 - RNA, 19 nt, Staphylococcus aureus subsp. aureus Mu50
cuucaagagaaccaccuac

SEQ ID NO: 2074362 - RNA, 16 nt, Staphylococcus aureus subsp. aureus Mu50
cuucaacgucaucugc

SEQ ID NO: 2074363 - RNA, 22 nt, Staphylococcus aureus subsp. aureus Mu50
cuucaacuucgauaugauuaaa

SEQ ID NO: 2074364 - RNA, 19 nt, Staphylococcus aureus subsp. aureus Mu50
cuuauuuuguuuuaaaaaa

SEQ ID NO: 2074365 - RNA, 12 nt, Staphylococcus aureus subsp. aureus Mu50
cuuauuuuucau

SEQ ID NO: 2074366 - RNA, 15 nt, Staphylococcus aureus subsp. aureus Mu50
cuuauuuuguuuuaa

SEQ ID NO: 2074367 - RNA, 17 nt, Staphylococcus aureus subsp. aureus Mu50
cuucaaaaaauaauagc

SEQ ID NO: 2074368 - RNA, 15 nt, Staphylococcus aureus subsp. aureus Mu50
cuucaaacaaagggg

SEQ ID NO: 2074369 - RNA, 22 nt, Staphylococcus aureus subsp. aureus Mu50
cuucauuaguugccccuagcaa

SEQ ID NO: 2074370 - RNA, 16 nt, Staphylococcus aureus subsp. aureus Mu50
cuucaguaauuucucc

SEQ ID NO: 2074371 - RNA, 20 nt, Staphylococcus aureus subsp. aureus Mu50
cuucaucauuguaaaacaaa

SEQ ID NO: 2074372 - RNA, 21 nt, Staphylococcus aureus subsp. aureus Mu50
cuucaucaauaaauauugauu

SEQ ID NO: 2074373 - RNA, 13 nt, Staphylococcus aureus subsp. aureus Mu50
cuucaucaauaac

SEQ ID NO: 2074374 - RNA, 16 nt, Staphylococcus aureus subsp. aureus Mu50
cuucaucaauaacuau

SEQ ID NO: 2074375 - RNA, 13 nt, Staphylococcus aureus subsp. aureus Mu50
cuucaucaauaaa

SEQ ID NO: 2074376 - RNA, 19 nt, Staphylococcus aureus subsp. aureus Mu50
cuucaggaauaucuuucaa

SEQ ID NO: 2074377 - RNA, 15 nt, Staphylococcus aureus subsp. aureus Mu50
cuucagguguaguag

SEQ ID NO: 2074378 - RNA, 22 nt, Staphylococcus aureus subsp. aureus Mu50
cuuccuuacagacaaacauuac

SEQ ID NO: 2074379 - RNA, 12 nt, Staphylococcus aureus subsp. aureus Mu50
cuuccuuccauu

SEQ ID NO: 2074380 - RNA, 20 nt, Staphylococcus aureus subsp. aureus Mu50
cuuccuuccauucggauaaa

SEQ ID NO: 2074381 - RNA, 14 nt, Staphylococcus aureus subsp. aureus Mu50
cuuccacuucaucu

SEQ ID NO: 2074382 - RNA, 22 nt, Staphylococcus aureus subsp. aureus Mu50
aaacuuccugcuuuuuuuauaa

SEQ ID NO: 2074383 - RNA, 17 nt, Staphylococcus aureus subsp. aureus Mu50
cuuccaacacccauaua

SEQ ID NO: 2074384 - RNA, 16 nt, Staphylococcus aureus subsp. aureus Mu50
cuuccccuacaaaguu

SEQ ID NO: 2074385 - RNA, 13 nt, Staphylococcus aureus subsp. aureus Mu50
cuuauuaaauaag

SEQ ID NO: 2074386 - RNA, 18 nt, Staphylococcus aureus subsp. aureus Mu50
cuuaugggggauuuuuuu

SEQ ID NO: 2074387 - RNA, 16 nt, Staphylococcus aureus subsp. aureus Mu50
cuuaugucauauacua

SEQ ID NO: 2074388 - RNA, 20 nt, Staphylococcus aureus subsp. aureus Mu50
cuuauguggaggacacauuu

SEQ ID NO: 2074389 - RNA, 19 nt, Staphylococcus aureus subsp. aureus Mu50
cuuaugucauauacuauau

SEQ ID NO: 2074390 - RNA, 14 nt, Staphylococcus aureus subsp. aureus Mu50
cuuauuucuuuuca

SEQ ID NO: 2074391 - RNA, 13 nt, Staphylococcus aureus subsp. aureus Mu50
cuuauuuauuuua

SEQ ID NO: 2074392 - RNA, 14 nt, Staphylococcus aureus subsp. aureus Mu50
cuuauuuguuuauu

SEQ ID NO: 2074393 - RNA, 16 nt, Staphylococcus aureus subsp. aureus Mu50
cuuauuuguuuauuag

SEQ ID NO: 2074394 - RNA, 21 nt, Staphylococcus aureus subsp. aureus Mu50
cuuaucagcauuaaucguauu

SEQ ID NO: 2074395 - RNA, 16 nt, Staphylococcus aureus subsp. aureus Mu50
cuuaucaacagcuuca

SEQ ID NO: 2074396 - RNA, 16 nt, Staphylococcus aureus subsp. aureus Mu50
cuuauauauucaauaa

SEQ ID NO: 2074397 - RNA, 22 nt, Staphylococcus aureus subsp. aureus Mu50
cuuauauauucaauaauuauua

SEQ ID NO: 2074398 - RNA, 18 nt, Staphylococcus aureus subsp. aureus Mu50
cuuaguaaggaauauuuc

SEQ ID NO: 2074399 - RNA, 22 nt, Staphylococcus aureus subsp. aureus Mu50
cuuaggugucaucgcuuuaauu

SEQ ID NO: 2074400 - RNA, 21 nt, Staphylococcus aureus subsp. aureus Mu50
cuuaccuuuauguucaaaugu

SEQ ID NO: 2074401 - RNA, 18 nt, Staphylococcus aureus subsp. aureus Mu50
cuuacuacgcauuauuaa

SEQ ID NO: 2074402 - RNA, 19 nt, Staphylococcus aureus subsp. aureus Mu50
cuuacuacgcauuauuaag

SEQ ID NO: 2074403 - RNA, 17 nt, Staphylococcus aureus subsp. aureus Mu50
cuuacugaaacuaaauu

SEQ ID NO: 2074404 - RNA, 23 nt, Staphylococcus aureus subsp. aureus Mu50
cuuacugaaacuaaauuaaaagu

SEQ ID NO: 2074405 - RNA, 22 nt, Staphylococcus aureus subsp. aureus Mu50
cuuacugcuguuuuuuauagua

SEQ ID NO: 2074406 - RNA, 17 nt, Staphylococcus aureus subsp. aureus Mu50
cuuacugugaaaauacc

SEQ ID NO: 2074407 - RNA, 16 nt, Staphylococcus aureus subsp. aureus Mu50
cuuagcaaucucuuua

SEQ ID NO: 2074408 - RNA, 22 nt, Staphylococcus aureus subsp. aureus Mu50
cuuaaucagcuauaaaaguacu

SEQ ID NO: 2074409 - RNA, 14 nt, Staphylococcus aureus subsp. aureus Mu50
cuuaaugcuucaaa

SEQ ID NO: 2074410 - RNA, 17 nt, Staphylococcus aureus subsp. aureus Mu50
cuuaaucgcucuaaaua

SEQ ID NO: 2074411 - RNA, 21 nt, Staphylococcus aureus subsp. aureus Mu50
cuuaaugguaaacaaaaaacu

SEQ ID NO: 2074412 - RNA, 16 nt, Staphylococcus aureus subsp. aureus Mu50
cuuacauuuuaauaaa

SEQ ID NO: 2074413 - RNA, 19 nt, Staphylococcus aureus subsp. aureus Mu50
cuuacauuuuaauaaaauc

SEQ ID NO: 2074414 - RNA, 15 nt, Staphylococcus aureus subsp. aureus Mu50
cuuacccaaaaaauu

SEQ ID NO: 2074415 - RNA, 17 nt, Staphylococcus aureus subsp. aureus Mu50
cuuacccaaaaaauugu

SEQ ID NO: 2074416 - RNA, 17 nt, Staphylococcus aureus subsp. aureus Mu50
cuuacauaggauaucua

SEQ ID NO: 2074417 - RNA, 16 nt, Staphylococcus aureus subsp. aureus Mu50
cuuacauuacauauau

SEQ ID NO: 2074418 - RNA, 19 nt, Staphylococcus aureus subsp. aureus Mu50
cuuaaaaacgcuuuuaaac

SEQ ID NO: 2074419 - RNA, 19 nt, Staphylococcus aureus subsp. aureus Mu50
cuguuugagauauauuaau

SEQ ID NO: 2074420 - RNA, 19 nt, Staphylococcus aureus subsp. aureus Mu50
cuuaaauacaaacccuuua

SEQ ID NO: 2074421 - RNA, 21 nt, Staphylococcus aureus subsp. aureus Mu50
cuuaaauacaauuucuucauu

SEQ ID NO: 2074422 - RNA, 23 nt, Staphylococcus aureus subsp. aureus Mu50
cuuaaauacaauuucuucauuuu

SEQ ID NO: 2074423 - RNA, 18 nt, Staphylococcus aureus subsp. aureus Mu50
cuuaaauagugcuuuuuc

SEQ ID NO: 2074424 - RNA, 19 nt, Staphylococcus aureus subsp. aureus Mu50
cuuaaauagugcuuuuuca

SEQ ID NO: 2074425 - RNA, 13 nt, Staphylococcus aureus subsp. aureus Mu50
cuuaaauuaagaa

SEQ ID NO: 2074426 - RNA, 18 nt, Staphylococcus aureus subsp. aureus Mu50
cuuaaauaucgacaaauu

SEQ ID NO: 2074427 - RNA, 15 nt, Staphylococcus aureus subsp. aureus Mu50
cuuaaauauaaugau

SEQ ID NO: 2074428 - RNA, 21 nt, Staphylococcus aureus subsp. aureus Mu50
cuuaaagauuuacccauuaca

SEQ ID NO: 2074429 - RNA, 20 nt, Staphylococcus aureus subsp. aureus Mu50
cuuaacaacaugauuucuuc

SEQ ID NO: 2074430 - RNA, 22 nt, Staphylococcus aureus subsp. aureus Mu50
cuuaaccauuuaaaaauugaag

SEQ ID NO: 2074431 - RNA, 21 nt, Staphylococcus aureus subsp. aureus Mu50
cuuaauaggauaugcuaaaca

SEQ ID NO: 2074432 - RNA, 20 nt, Staphylococcus aureus subsp. aureus Mu50
cuuaauauaacgacacuuuu

SEQ ID NO: 2074433 - RNA, 15 nt, Staphylococcus aureus subsp. aureus Mu50
cuguuacgagugcac

SEQ ID NO: 2074434 - RNA, 23 nt, Staphylococcus aureus subsp. aureus Mu50
cuguuaugaaguauccuuauuug

SEQ ID NO: 2074435 - RNA, 20 nt, Staphylococcus aureus subsp. aureus Mu50
cuguuuaaauuuaaaagaaa

SEQ ID NO: 2074436 - RNA, 22 nt, Staphylococcus aureus subsp. aureus Mu50
cuugcuucauuauauaauucuu

SEQ ID NO: 2074437 - RNA, 20 nt, Staphylococcus aureus subsp. aureus Mu50
cuugcuuacaauaaucacuu

SEQ ID NO: 2074438 - RNA, 18 nt, Staphylococcus aureus subsp. aureus Mu50
cuugcuguucaacaucuu

SEQ ID NO: 2074439 - RNA, 16 nt, Staphylococcus aureus subsp. aureus Mu50
cuugcucaugagcaca

SEQ ID NO: 2074440 - RNA, 20 nt, Staphylococcus aureus subsp. aureus Mu50
aaacuuuauggguauccuuc

SEQ ID NO: 2074441 - RNA, 17 nt, Staphylococcus aureus subsp. aureus Mu50
aaacuuucagagauauu

SEQ ID NO: 2074442 - RNA, 22 nt, Staphylococcus aureus subsp. aureus Mu50
aaacuuguaaauuuauuuuuaa

SEQ ID NO: 2074443 - RNA, 16 nt, Staphylococcus aureus subsp. aureus Mu50
aaacuuggcaaugaaa

SEQ ID NO: 2074444 - RNA, 19 nt, Staphylococcus aureus subsp. aureus Mu50
aaacuuggcaaugaaauua

SEQ ID NO: 2074445 - RNA, 12 nt, Staphylococcus aureus subsp. aureus Mu50
aaacuugauuau

SEQ ID NO: 2074446 - RNA, 12 nt, Staphylococcus aureus subsp. aureus Mu50
aaacuucuuuuc

SEQ ID NO: 2074447 - RNA, 17 nt, Staphylococcus aureus subsp. aureus Mu50
cuugcgauaaguucauc

SEQ ID NO: 2074448 - RNA, 14 nt, Staphylococcus aureus subsp. aureus Mu50
cuugccuuuuuagg

SEQ ID NO: 2074449 - RNA, 14 nt, Staphylococcus aureus subsp. aureus Mu50
cuugccuggcaacg

SEQ ID NO: 2074450 - RNA, 22 nt, Staphylococcus aureus subsp. aureus Mu50
cuugccuggcaacguucuacuc

SEQ ID NO: 2074451 - RNA, 20 nt, Staphylococcus aureus subsp. aureus Mu50
cuugcauacgaauuaaaaua

SEQ ID NO: 2074452 - RNA, 17 nt, Staphylococcus aureus subsp. aureus Mu50
cuugauuuuauaaauca

SEQ ID NO: 2074453 - RNA, 15 nt, Staphylococcus aureus subsp. aureus Mu50
cuugauuuaauuuuu

SEQ ID NO: 2074454 - RNA, 17 nt, Staphylococcus aureus subsp. aureus Mu50
cuugauuuaauuuuuaa

SEQ ID NO: 2074455 - RNA, 12 nt, Staphylococcus aureus subsp. aureus Mu50
cuugauuuaguu

SEQ ID NO: 2074456 - RNA, 17 nt, Staphylococcus aureus subsp. aureus Mu50
cuugcaauaccucccca

SEQ ID NO: 2074457 - RNA, 18 nt, Staphylococcus aureus subsp. aureus Mu50
cuugcaaauauaucaucu

SEQ ID NO: 2074458 - RNA, 21 nt, Staphylococcus aureus subsp. aureus Mu50
cuugcaaauauaucaucucua

SEQ ID NO: 2074459 - RNA, 22 nt, Staphylococcus aureus subsp. aureus Mu50
cuugcaaauauaucaucucuau

SEQ ID NO: 2074460 - RNA, 19 nt, Staphylococcus aureus subsp. aureus Mu50
cuugauuauauuuuucuuc

SEQ ID NO: 2074461 - RNA, 20 nt, Staphylococcus aureus subsp. aureus Mu50
cuugaccuacuuuuucaaua

SEQ ID NO: 2074462 - RNA, 15 nt, Staphylococcus aureus subsp. aureus Mu50
cuugaccuucaguuu

SEQ ID NO: 2074463 - RNA, 16 nt, Staphylococcus aureus subsp. aureus Mu50
cuugauaaaaaaugaa

SEQ ID NO: 2074464 - RNA, 22 nt, Staphylococcus aureus subsp. aureus Mu50
cuugagcuuuguuagcaucugc

SEQ ID NO: 2074465 - RNA, 18 nt, Staphylococcus aureus subsp. aureus Mu50
cuugaucauuauaaaaug

SEQ ID NO: 2074466 - RNA, 16 nt, Staphylococcus aureus subsp. aureus Mu50
cuugaagcaucgauuu

SEQ ID NO: 2074467 - RNA, 16 nt, Staphylococcus aureus subsp. aureus Mu50
cuugaaccccauucac

SEQ ID NO: 2074468 - RNA, 18 nt, Staphylococcus aureus subsp. aureus Mu50
cuugaccacuuuuguuaa

SEQ ID NO: 2074469 - RNA, 15 nt, Staphylococcus aureus subsp. aureus Mu50
cuugaauuuaauaag

SEQ ID NO: 2074470 - RNA, 16 nt, Staphylococcus aureus subsp. aureus Mu50
cuugaauuuaauaagu

SEQ ID NO: 2074471 - RNA, 14 nt, Staphylococcus aureus subsp. aureus Mu50
cuugaauguuugaa

SEQ ID NO: 2074472 - RNA, 15 nt, Staphylococcus aureus subsp. aureus Mu50
cuugaauaauauauu

SEQ ID NO: 2074473 - RNA, 22 nt, Staphylococcus aureus subsp. aureus Mu50
cuugaauaccuuuuauuauuuu

SEQ ID NO: 2074474 - RNA, 16 nt, Staphylococcus aureus subsp. aureus Mu50
cuugaauaauauauuu

SEQ ID NO: 2074475 - RNA, 15 nt, Staphylococcus aureus subsp. aureus Mu50
cuucuuuugcaaaac

SEQ ID NO: 2074476 - RNA, 20 nt, Staphylococcus aureus subsp. aureus Mu50
cuucuuuuuguccccagccc

SEQ ID NO: 2074477 - RNA, 22 nt, Staphylococcus aureus subsp. aureus Mu50
cuugaaaauagccauauucaua

SEQ ID NO: 2074478 - RNA, 17 nt, Staphylococcus aureus subsp. aureus Mu50
cuugaaauuauuauuua

SEQ ID NO: 2074479 - RNA, 16 nt, Staphylococcus aureus subsp. aureus Mu50
cuucuuucaauuaauc

SEQ ID NO: 2074480 - RNA, 13 nt, Staphylococcus aureus subsp. aureus Mu50
cuucuuuuaaguu

SEQ ID NO: 2074481 - RNA, 22 nt, Staphylococcus aureus subsp. aureus Mu50
cuucuuuguuuuuaauuuuuaa

SEQ ID NO: 2074482 - RNA, 13 nt, Staphylococcus aureus subsp. aureus Mu50
cuucuuuucuuug

SEQ ID NO: 2074483 - RNA, 18 nt, Staphylococcus aureus subsp. aureus Mu50
cuucuguguuggggccca

SEQ ID NO: 2074484 - RNA, 23 nt, Staphylococcus aureus subsp. aureus Mu50
cuucuggauagguaucacuagga

SEQ ID NO: 2074485 - RNA, 14 nt, Staphylococcus aureus subsp. aureus Mu50
cuucuuaucuuuuu

SEQ ID NO: 2074486 - RNA, 21 nt, Staphylococcus aureus subsp. aureus Mu50
cuucuucaggaauaucuuuca

SEQ ID NO: 2074487 - RNA, 23 nt, Staphylococcus aureus subsp. aureus Mu50
cuucuguguuggggcccacaccc

SEQ ID NO: 2074488 - RNA, 16 nt, Staphylococcus aureus subsp. aureus Mu50
cuucuuacugcaauua

SEQ ID NO: 2074489 - RNA, 22 nt, Staphylococcus aureus subsp. aureus Mu50
cuucuucuaaccacuucuucac

SEQ ID NO: 2074490 - RNA, 17 nt, Staphylococcus aureus subsp. aureus Mu50
cuucuauuuuauaauaa

SEQ ID NO: 2074491 - RNA, 16 nt, Staphylococcus aureus subsp. aureus Mu50
cuucuauuuuauaaua

SEQ ID NO: 2074492 - RNA, 14 nt, Staphylococcus aureus subsp. aureus Mu50
cuucuaucucuuua

SEQ ID NO: 2074493 - RNA, 14 nt, Staphylococcus aureus subsp. aureus Mu50
cuucuaucuuuauu

SEQ ID NO: 2074494 - RNA, 14 nt, Staphylococcus aureus subsp. aureus Mu50
cuucuauuaagaaa

SEQ ID NO: 2074495 - RNA, 13 nt, Staphylococcus aureus subsp. aureus Mu50
cuucuauauuaau

SEQ ID NO: 2074496 - RNA, 21 nt, Staphylococcus aureus subsp. aureus Mu50
cuucuaauuugcaaaaucaac

SEQ ID NO: 2074497 - RNA, 17 nt, Staphylococcus aureus subsp. aureus Mu50
cuucuaauuugcaaaau

SEQ ID NO: 2074498 - RNA, 21 nt, Staphylococcus aureus subsp. aureus Mu50
cuucuacccauaauuuaaaug

SEQ ID NO: 2074499 - RNA, 17 nt, Staphylococcus aureus subsp. aureus Mu50
cuucuaaccacuucuuc

SEQ ID NO: 2074500 - RNA, 17 nt, Staphylococcus aureus subsp. aureus Mu50
cuucuaacucaccugca

SEQ ID NO: 2074501 - RNA, 15 nt, Staphylococcus aureus subsp. aureus Mu50
cuucuaaguaauaua

SEQ ID NO: 2074502 - RNA, 17 nt, Staphylococcus aureus subsp. aureus Mu50
cuucuaaucguuaauaa

SEQ ID NO: 2074503 - RNA, 12 nt, Staphylococcus aureus subsp. aureus Mu50
cuucguuuuaau

SEQ ID NO: 2074504 - RNA, 19 nt, Staphylococcus aureus subsp. aureus Mu50
cuucuaaaacuaaagguau

SEQ ID NO: 2074505 - RNA, 23 nt, Staphylococcus aureus subsp. aureus Mu50
cuucgucgcuaagaaccuuucuu

SEQ ID NO: 2074506 - RNA, 22 nt, Staphylococcus aureus subsp. aureus Mu50
cuucucaauuuaguauaaauaa

SEQ ID NO: 2074507 - RNA, 13 nt, Staphylococcus aureus subsp. aureus Mu50
cuucucaucauuu

SEQ ID NO: 2074508 - RNA, 18 nt, Staphylococcus aureus subsp. aureus Mu50
cuucucaucauuuucaau

SEQ ID NO: 2074509 - RNA, 23 nt, Staphylococcus aureus subsp. aureus Mu50
cuucuccguauuuaccuucuucu

SEQ ID NO: 2074510 - RNA, 12 nt, Staphylococcus aureus subsp. aureus Mu50
cuucucuaauca

SEQ ID NO: 2074511 - RNA, 20 nt, Staphylococcus aureus subsp. aureus Mu50
cuucuggagccccuuguucu

SEQ ID NO: 2074512 - RNA, 20 nt, Staphylococcus aureus subsp. aureus Mu50
cuucuggauagguaucacua

SEQ ID NO: 2074513 - RNA, 16 nt, Staphylococcus aureus subsp. aureus Mu50
cuucugcauagcgcuc

SEQ ID NO: 2074514 - RNA, 20 nt, Staphylococcus aureus subsp. aureus Mu50
cuucucucuuauuaaaaaag

SEQ ID NO: 2074515 - RNA, 21 nt, Staphylococcus aureus subsp. aureus Mu50
cggggccccaacaaaaagaau

SEQ ID NO: 2074516 - RNA, 23 nt, Staphylococcus aureus subsp. aureus Mu50
cgggggacauagguauaaucauu

SEQ ID NO: 2074517 - RNA, 18 nt, Staphylococcus aureus subsp. aureus Mu50
aaacuaaagguauucuau

SEQ ID NO: 2074518 - RNA, 16 nt, Staphylococcus aureus subsp. aureus Mu50
aaacuaaauuaaaagu

SEQ ID NO: 2074519 - RNA, 15 nt, Staphylococcus aureus subsp. aureus Mu50
aaacuaaguuauuua

SEQ ID NO: 2074520 - RNA, 15 nt, Staphylococcus aureus subsp. aureus Mu50
aaacuacauuugguu

SEQ ID NO: 2074521 - RNA, 15 nt, Staphylococcus aureus subsp. aureus Mu50
aaacuagaaaacaua

SEQ ID NO: 2074522 - RNA, 18 nt, Staphylococcus aureus subsp. aureus Mu50
aaacuagcaguaauaugu

SEQ ID NO: 2074523 - RNA, 15 nt, Staphylococcus aureus subsp. aureus Mu50
cgguauuuucauuuu

SEQ ID NO: 2074524 - RNA, 15 nt, Staphylococcus aureus subsp. aureus Mu50
cgguauuuaauguuu

SEQ ID NO: 2074525 - RNA, 14 nt, Staphylococcus aureus subsp. aureus Mu50
cgguauuuucaaaa

SEQ ID NO: 2074526 - RNA, 18 nt, Staphylococcus aureus subsp. aureus Mu50
cgguaggaccucuuauuu

SEQ ID NO: 2074527 - RNA, 22 nt, Staphylococcus aureus subsp. aureus Mu50
cgguacagauaggaaacuuaaa

SEQ ID NO: 2074528 - RNA, 19 nt, Staphylococcus aureus subsp. aureus Mu50
aaacuauaauaaagauuau

SEQ ID NO: 2074529 - RNA, 16 nt, Staphylococcus aureus subsp. aureus Mu50
cgggcccccaacacaa

SEQ ID NO: 2074530 - RNA, 13 nt, Staphylococcus aureus subsp. aureus Mu50
cggcuuuguaaaa

SEQ ID NO: 2074531 - RNA, 21 nt, Staphylococcus aureus subsp. aureus Mu50
cggcucuuuuuguuuaucuga

SEQ ID NO: 2074532 - RNA, 13 nt, Staphylococcus aureus subsp. aureus Mu50
cuaaaucuuuaaa

SEQ ID NO: 2074533 - RNA, 17 nt, Staphylococcus aureus subsp. aureus Mu50
cuaaaugauuuauucua

SEQ ID NO: 2074534 - RNA, 21 nt, Staphylococcus aureus subsp. aureus Mu50
cuaaaugaauugcuuguucuu

SEQ ID NO: 2074535 - RNA, 23 nt, Staphylococcus aureus subsp. aureus Mu50
cuaaaugauuuauucuaaauaua

SEQ ID NO: 2074536 - RNA, 13 nt, Staphylococcus aureus subsp. aureus Mu50
cuaaauuuauaua

SEQ ID NO: 2074537 - RNA, 21 nt, Staphylococcus aureus subsp. aureus Mu50
cuaaauuuauauagucuauga

SEQ ID NO: 2074538 - RNA, 16 nt, Staphylococcus aureus subsp. aureus Mu50
cuaaauucuuuuuguu

SEQ ID NO: 2074539 - RNA, 18 nt, Staphylococcus aureus subsp. aureus Mu50
cuaaauucaauaaucuua

SEQ ID NO: 2074540 - RNA, 22 nt, Staphylococcus aureus subsp. aureus Mu50
cuaaauuauuuauucauuauag

SEQ ID NO: 2074541 - RNA, 19 nt, Staphylococcus aureus subsp. aureus Mu50
cuaaauucaauaaucuuag

SEQ ID NO: 2074542 - RNA, 16 nt, Staphylococcus aureus subsp. aureus Mu50
cuaaagcuaauacacc

SEQ ID NO: 2074543 - RNA, 17 nt, Staphylococcus aureus subsp. aureus Mu50
cuaaagcgauuuccauc

SEQ ID NO: 2074544 - RNA, 17 nt, Staphylococcus aureus subsp. aureus Mu50
cuaaagcuauaaaaaau

SEQ ID NO: 2074545 - RNA, 24 nt, Staphylococcus aureus subsp. aureus Mu50
cuaaagcuauaaaaaaucuuuuga

SEQ ID NO: 2074546 - RNA, 14 nt, Staphylococcus aureus subsp. aureus Mu50
cuaaaguaaauaac

SEQ ID NO: 2074547 - RNA, 19 nt, Staphylococcus aureus subsp. aureus Mu50
cuaaaguguagccaaauaa

SEQ ID NO: 2074548 - RNA, 19 nt, Staphylococcus aureus subsp. aureus Mu50
cuaaaguuauaaauuauau

SEQ ID NO: 2074549 - RNA, 21 nt, Staphylococcus aureus subsp. aureus Mu50
cuaaaguuauaaauuauauuu

SEQ ID NO: 2074550 - RNA, 19 nt, Staphylococcus aureus subsp. aureus Mu50
cuaaaauagaaaaauuuca

SEQ ID NO: 2074551 - RNA, 21 nt, Staphylococcus aureus subsp. aureus Mu50
cuaaaauagaaaaauuucaaa

SEQ ID NO: 2074552 - RNA, 13 nt, Staphylococcus aureus subsp. aureus Mu50
cuaaaauaacaac

SEQ ID NO: 2074553 - RNA, 23 nt, Staphylococcus aureus subsp. aureus Mu50
cuaaaauaucaaaauauaaaauc

SEQ ID NO: 2074554 - RNA, 20 nt, Staphylococcus aureus subsp. aureus Mu50
cuaaaaacggacaaguugca

SEQ ID NO: 2074555 - RNA, 13 nt, Staphylococcus aureus subsp. aureus Mu50
cuaaaaacuguga

SEQ ID NO: 2074556 - RNA, 20 nt, Staphylococcus aureus subsp. aureus Mu50
cuaaaacaugauacgugguu

SEQ ID NO: 2074557 - RNA, 21 nt, Staphylococcus aureus subsp. aureus Mu50
cuaaaaagcgugguucccaau

SEQ ID NO: 2074558 - RNA, 14 nt, Staphylococcus aureus subsp. aureus Mu50
cuaaaaauaaaauc

SEQ ID NO: 2074559 - RNA, 19 nt, Staphylococcus aureus subsp. aureus Mu50
cguuugaagaauguuucau

SEQ ID NO: 2074560 - RNA, 12 nt, Staphylococcus aureus subsp. aureus Mu50
cguuuaauaaug

SEQ ID NO: 2074561 - RNA, 20 nt, Staphylococcus aureus subsp. aureus Mu50
cguuaauaaaccuacaauau

SEQ ID NO: 2074562 - RNA, 21 nt, Staphylococcus aureus subsp. aureus Mu50
cguucuugguauuuuuuaaau

SEQ ID NO: 2074563 - RNA, 13 nt, Staphylococcus aureus subsp. aureus Mu50
cguguucuaaaag

SEQ ID NO: 2074564 - RNA, 12 nt, Staphylococcus aureus subsp. aureus Mu50
cguguguaguag

SEQ ID NO: 2074565 - RNA, 17 nt, Staphylococcus aureus subsp. aureus Mu50
cgugguaugauuuuuga

SEQ ID NO: 2074566 - RNA, 16 nt, Staphylococcus aureus subsp. aureus Mu50
cgugcauuuagaugau

SEQ ID NO: 2074567 - RNA, 18 nt, Staphylococcus aureus subsp. aureus Mu50
cgugcauuguaauaccaa

SEQ ID NO: 2074568 - RNA, 17 nt, Staphylococcus aureus subsp. aureus Mu50
cgucuuaauucuucugu

SEQ ID NO: 2074569 - RNA, 15 nt, Staphylococcus aureus subsp. aureus Mu50
cgguuaaauuauuua

SEQ ID NO: 2074570 - RNA, 14 nt, Staphylococcus aureus subsp. aureus Mu50
cgguucaucuaaaa

SEQ ID NO: 2074571 - RNA, 17 nt, Staphylococcus aureus subsp. aureus Mu50
cgguucaucuaaaauga

SEQ ID NO: 2074572 - RNA, 17 nt, Staphylococcus aureus subsp. aureus Mu50
cgguuguauuucaucau

SEQ ID NO: 2074573 - RNA, 18 nt, Staphylococcus aureus subsp. aureus Mu50
cguaaacauaaugacauc

SEQ ID NO: 2074574 - RNA, 18 nt, Staphylococcus aureus subsp. aureus Mu50
cguaacauuuaaaaaaug

SEQ ID NO: 2074575 - RNA, 19 nt, Staphylococcus aureus subsp. aureus Mu50
cguaacucuuuaauuuuac

SEQ ID NO: 2074576 - RNA, 12 nt, Staphylococcus aureus subsp. aureus Mu50
cguauguuucuu

SEQ ID NO: 2074577 - RNA, 12 nt, Staphylococcus aureus subsp. aureus Mu50
cucgcuuacuca

SEQ ID NO: 2074578 - RNA, 12 nt, Staphylococcus aureus subsp. aureus Mu50
cucucguaaauu

SEQ ID NO: 2074579 - RNA, 17 nt, Staphylococcus aureus subsp. aureus Mu50
cucugaaaaacuucuua

SEQ ID NO: 2074580 - RNA, 22 nt, Staphylococcus aureus subsp. aureus Mu50
cucugcgauuucuaaagcgauu

SEQ ID NO: 2074581 - RNA, 17 nt, Staphylococcus aureus subsp. aureus Mu50
cucuauuuuuuauguuu

SEQ ID NO: 2074582 - RNA, 15 nt, Staphylococcus aureus subsp. aureus Mu50
cucuauuuuaugauu

SEQ ID NO: 2074583 - RNA, 16 nt, Staphylococcus aureus subsp. aureus Mu50
cucucaacauuuugau

SEQ ID NO: 2074584 - RNA, 16 nt, Staphylococcus aureus subsp. aureus Mu50
cucuauuaauuuacuc

SEQ ID NO: 2074585 - RNA, 17 nt, Staphylococcus aureus subsp. aureus Mu50
cucuauagcaacagcaa

SEQ ID NO: 2074586 - RNA, 21 nt, Staphylococcus aureus subsp. aureus Mu50
cucucaaugcauuuaauuuaa

SEQ ID NO: 2074587 - RNA, 21 nt, Staphylococcus aureus subsp. aureus Mu50
cucgauacaaaggauuauuaa

SEQ ID NO: 2074588 - RNA, 20 nt, Staphylococcus aureus subsp. aureus Mu50
cuccuucaauguucaauuca

SEQ ID NO: 2074589 - RNA, 13 nt, Staphylococcus aureus subsp. aureus Mu50
cuccuuacaauaa

SEQ ID NO: 2074590 - RNA, 12 nt, Staphylococcus aureus subsp. aureus Mu50
cuccuuacaaua

SEQ ID NO: 2074591 - RNA, 23 nt, Staphylococcus aureus subsp. aureus Mu50
cucgaaaauaaaacaaauuauua

SEQ ID NO: 2074592 - RNA, 15 nt, Staphylococcus aureus subsp. aureus Mu50
cuccucuauuuuaug

SEQ ID NO: 2074593 - RNA, 13 nt, Staphylococcus aureus subsp. aureus Mu50
cuccucuauuuua

SEQ ID NO: 2074594 - RNA, 16 nt, Staphylococcus aureus subsp. aureus Mu50
cuccaguggaaaugau

SEQ ID NO: 2074595 - RNA, 18 nt, Staphylococcus aureus subsp. aureus Mu50
cucccuuaaauacaauuu

SEQ ID NO: 2074596 - RNA, 17 nt, Staphylococcus aureus subsp. aureus Mu50
cucaguguugggggcca

SEQ ID NO: 2074597 - RNA, 17 nt, Staphylococcus aureus subsp. aureus Mu50
cucagugcauuuuuuau

SEQ ID NO: 2074598 - RNA, 14 nt, Staphylococcus aureus subsp. aureus Mu50
cucauaaucaaguc

SEQ ID NO: 2074599 - RNA, 12 nt, Staphylococcus aureus subsp. aureus Mu50
cucauaauaauu

SEQ ID NO: 2074600 - RNA, 14 nt, Staphylococcus aureus subsp. aureus Mu50
cucauacaaauuuu

SEQ ID NO: 2074601 - RNA, 16 nt, Staphylococcus aureus subsp. aureus Mu50
cucauaccaaaaacau

SEQ ID NO: 2074602 - RNA, 19 nt, Staphylococcus aureus subsp. aureus Mu50
cucauaccaaaaacauuaa

SEQ ID NO: 2074603 - RNA, 20 nt, Staphylococcus aureus subsp. aureus Mu50
cucaucgaguuuguuucuaa

SEQ ID NO: 2074604 - RNA, 18 nt, Staphylococcus aureus subsp. aureus Mu50
cucaucccucuaucaaau

SEQ ID NO: 2074605 - RNA, 21 nt, Staphylococcus aureus subsp. aureus Mu50
cucaucuguccgauaucuuuu

SEQ ID NO: 2074606 - RNA, 18 nt, Staphylococcus aureus subsp. aureus Mu50
cucaucuaauuuaugaau

SEQ ID NO: 2074607 - RNA, 17 nt, Staphylococcus aureus subsp. aureus Mu50
cucaucuucuaaaucaa

SEQ ID NO: 2074608 - RNA, 15 nt, Staphylococcus aureus subsp. aureus Mu50
cucauagucaucuua

SEQ ID NO: 2074609 - RNA, 14 nt, Staphylococcus aureus subsp. aureus Mu50
cuauuaaugcucua

SEQ ID NO: 2074610 - RNA, 19 nt, Staphylococcus aureus subsp. aureus Mu50
cuauuaauuacgucauaaa

SEQ ID NO: 2074611 - RNA, 14 nt, Staphylococcus aureus subsp. aureus Mu50
cuauuaauuuacuc

SEQ ID NO: 2074612 - RNA, 17 nt, Staphylococcus aureus subsp. aureus Mu50
cucaacacgauagucau

SEQ ID NO: 2074613 - RNA, 12 nt, Staphylococcus aureus subsp. aureus Mu50
cucaacauuuug

SEQ ID NO: 2074614 - RNA, 17 nt, Staphylococcus aureus subsp. aureus Mu50
cucacgauuaauaaaau

SEQ ID NO: 2074615 - RNA, 23 nt, Staphylococcus aureus subsp. aureus Mu50
cucaagugauuucccacgugccu

SEQ ID NO: 2074616 - RNA, 18 nt, Staphylococcus aureus subsp. aureus Mu50
cucacagacuuuuuacua

SEQ ID NO: 2074617 - RNA, 13 nt, Staphylococcus aureus subsp. aureus Mu50
cucaccaaguuca

SEQ ID NO: 2074618 - RNA, 16 nt, Staphylococcus aureus subsp. aureus Mu50
cuaucgccuaaaaaua

SEQ ID NO: 2074619 - RNA, 16 nt, Staphylococcus aureus subsp. aureus Mu50
cuauccgauuuaaguu

SEQ ID NO: 2074620 - RNA, 17 nt, Staphylococcus aureus subsp. aureus Mu50
cuauccauguauuuuuc

SEQ ID NO: 2074621 - RNA, 11 nt, Staphylococcus aureus subsp. aureus Mu50
cuaugauauau

SEQ ID NO: 2074622 - RNA, 23 nt, Staphylococcus aureus subsp. aureus Mu50
cuaugaugcuucuaacugaauua

SEQ ID NO: 2074623 - RNA, 13 nt, Staphylococcus aureus subsp. aureus Mu50
cuauuaaaaaaaa

SEQ ID NO: 2074624 - RNA, 19 nt, Staphylococcus aureus subsp. aureus Mu50
cuauuaaacauuuuugaau

SEQ ID NO: 2074625 - RNA, 13 nt, Staphylococcus aureus subsp. aureus Mu50
cuauuaaaggaaa

SEQ ID NO: 2074626 - RNA, 21 nt, Staphylococcus aureus subsp. aureus Mu50
cuauuaaaggaaaucaaucca

SEQ ID NO: 2074627 - RNA, 13 nt, Staphylococcus aureus subsp. aureus Mu50
cuauguaacuuua

SEQ ID NO: 2074628 - RNA, 12 nt, Staphylococcus aureus subsp. aureus Mu50
cuauguaacuuu

SEQ ID NO: 2074629 - RNA, 16 nt, Staphylococcus aureus subsp. aureus Mu50
cuauguaaaauuauug

SEQ ID NO: 2074630 - RNA, 11 nt, Staphylococcus aureus subsp. aureus Mu50
cuauaugcaua

SEQ ID NO: 2074631 - RNA, 13 nt, Staphylococcus aureus subsp. aureus Mu50
cuauauuuauuag

SEQ ID NO: 2074632 - RNA, 22 nt, Staphylococcus aureus subsp. aureus Mu50
cuauauuucgguauuuuaaauu

SEQ ID NO: 2074633 - RNA, 14 nt, Staphylococcus aureus subsp. aureus Mu50
cuaucaaugacauc

SEQ ID NO: 2074634 - RNA, 17 nt, Staphylococcus aureus subsp. aureus Mu50
cuaucaaugacauccau

SEQ ID NO: 2074635 - RNA, 18 nt, Staphylococcus aureus subsp. aureus Mu50
cuauauuuuuguauuuau

SEQ ID NO: 2074636 - RNA, 13 nt, Staphylococcus aureus subsp. aureus Mu50
cuauauaaaaacu

SEQ ID NO: 2074637 - RNA, 23 nt, Staphylococcus aureus subsp. aureus Mu50
cuauauaaauguuuauaucuuuu

SEQ ID NO: 2074638 - RNA, 18 nt, Staphylococcus aureus subsp. aureus Mu50
cuauauaguaaaauaaau

SEQ ID NO: 2074639 - RNA, 14 nt, Staphylococcus aureus subsp. aureus Mu50
cuauauaauuuauu

SEQ ID NO: 2074640 - RNA, 13 nt, Staphylococcus aureus subsp. aureus Mu50
cuauauaauuuau

SEQ ID NO: 2074641 - RNA, 18 nt, Staphylococcus aureus subsp. aureus Mu50
cuauauaauuuauaaaaa

SEQ ID NO: 2074642 - RNA, 14 nt, Staphylococcus aureus subsp. aureus Mu50
cuauauaguaaaau

SEQ ID NO: 2074643 - RNA, 21 nt, Staphylococcus aureus subsp. aureus Mu50
cuauaccauuccaaaaauugu

SEQ ID NO: 2074644 - RNA, 13 nt, Staphylococcus aureus subsp. aureus Mu50
cuauaccauuuuu

SEQ ID NO: 2074645 - RNA, 19 nt, Staphylococcus aureus subsp. aureus Mu50
cuauacaaucauaaagugc

SEQ ID NO: 2074646 - RNA, 18 nt, Staphylococcus aureus subsp. aureus Mu50
cuauacaacaguaaucau

SEQ ID NO: 2074647 - RNA, 16 nt, Staphylococcus aureus subsp. aureus Mu50
cuauacaacaguaauc

SEQ ID NO: 2074648 - RNA, 17 nt, Staphylococcus aureus subsp. aureus Mu50
cuauaauuucuuaauua

SEQ ID NO: 2074649 - RNA, 19 nt, Staphylococcus aureus subsp. aureus Mu50
cuauagguuuauaaaaaau

SEQ ID NO: 2074650 - RNA, 17 nt, Staphylococcus aureus subsp. aureus Mu50
cuauaaucauuaaguaa

SEQ ID NO: 2074651 - RNA, 17 nt, Staphylococcus aureus subsp. aureus Mu50
cuagguuagaauuauuu

SEQ ID NO: 2074652 - RNA, 14 nt, Staphylococcus aureus subsp. aureus Mu50
cuaggguuaaaauu

SEQ ID NO: 2074653 - RNA, 23 nt, Staphylococcus aureus subsp. aureus Mu50
cuagcuaagauacuuuuaaauua

SEQ ID NO: 2074654 - RNA, 22 nt, Staphylococcus aureus subsp. aureus Mu50
cuagcuaaugcacgugagaaac

SEQ ID NO: 2074655 - RNA, 21 nt, Staphylococcus aureus subsp. aureus Mu50
cuagcaaaaauacuuuuugau

SEQ ID NO: 2074656 - RNA, 22 nt, Staphylococcus aureus subsp. aureus Mu50
cuagcaaaaauacuuuuugaug

SEQ ID NO: 2074657 - RNA, 23 nt, Staphylococcus aureus subsp. aureus Mu50
cuaggauguucaucaacaugaua

SEQ ID NO: 2074658 - RNA, 17 nt, Staphylococcus aureus subsp. aureus Mu50
cuaggauguucaucaac

SEQ ID NO: 2074659 - RNA, 17 nt, Staphylococcus aureus subsp. aureus Mu50
cuaggauuaaaagcauc

SEQ ID NO: 2074660 - RNA, 15 nt, Staphylococcus aureus subsp. aureus Mu50
cuagauuuuaaauca

SEQ ID NO: 2074661 - RNA, 18 nt, Staphylococcus aureus subsp. aureus Mu50
cuagauaccaaacugccu

SEQ ID NO: 2074662 - RNA, 21 nt, Staphylococcus aureus subsp. aureus Mu50
cuacuugauucuacuucaccu

SEQ ID NO: 2074663 - RNA, 19 nt, Staphylococcus aureus subsp. aureus Mu50
cuacuuccuuacagacaaa

SEQ ID NO: 2074664 - RNA, 20 nt, Staphylococcus aureus subsp. aureus Mu50
cuacuuuauaaauaucuuuu

SEQ ID NO: 2074665 - RNA, 14 nt, Staphylococcus aureus subsp. aureus Mu50
cuacuuguucaaua

SEQ ID NO: 2074666 - RNA, 19 nt, Staphylococcus aureus subsp. aureus Mu50
cuacuuugauauguuuccu

SEQ ID NO: 2074667 - RNA, 18 nt, Staphylococcus aureus subsp. aureus Mu50
cuacuuugucugcaauuu

SEQ ID NO: 2074668 - RNA, 17 nt, Staphylococcus aureus subsp. aureus Mu50
cuacuuuuucaacugua

SEQ ID NO: 2074669 - RNA, 15 nt, Staphylococcus aureus subsp. aureus Mu50
cuacuauuaaauaau

SEQ ID NO: 2074670 - RNA, 14 nt, Staphylococcus aureus subsp. aureus Mu50
cuacuauuaaauaa

SEQ ID NO: 2074671 - RNA, 14 nt, Staphylococcus aureus subsp. aureus Mu50
cuacugcuugugug

SEQ ID NO: 2074672 - RNA, 18 nt, Staphylococcus aureus subsp. aureus Mu50
cuacuuaauuaauaauuu

SEQ ID NO: 2074673 - RNA, 24 nt, Staphylococcus aureus subsp. aureus Mu50
cuacuuaaauuaagaauaaucgaa

SEQ ID NO: 2074674 - RNA, 18 nt, Staphylococcus aureus subsp. aureus Mu50
cuacugucucaucuucua

SEQ ID NO: 2074675 - RNA, 12 nt, Staphylococcus aureus subsp. aureus Mu50
cuaaccaaauaa

SEQ ID NO: 2074676 - RNA, 14 nt, Staphylococcus aureus subsp. aureus Mu50
cuaaccaaauaauu

SEQ ID NO: 2074677 - RNA, 18 nt, Staphylococcus aureus subsp. aureus Mu50
cuaacagcuuaauuuuau

SEQ ID NO: 2074678 - RNA, 14 nt, Staphylococcus aureus subsp. aureus Mu50
cuaaauuuacgaaa

SEQ ID NO: 2074679 - RNA, 18 nt, Staphylococcus aureus subsp. aureus Mu50
cuaaauuuucuaaaugug

SEQ ID NO: 2074680 - RNA, 15 nt, Staphylococcus aureus subsp. aureus Mu50
cuacuaaucguugug

SEQ ID NO: 2074681 - RNA, 15 nt, Staphylococcus aureus subsp. aureus Mu50
cuacgcccaucauca

SEQ ID NO: 2074682 - RNA, 13 nt, Staphylococcus aureus subsp. aureus Mu50
cuacuaaucuuag

SEQ ID NO: 2074683 - RNA, 15 nt, Staphylococcus aureus subsp. aureus Mu50
cuacuaaucuuuuuu

SEQ ID NO: 2074684 - RNA, 16 nt, Staphylococcus aureus subsp. aureus Mu50
cuacgaaguuauauug

SEQ ID NO: 2074685 - RNA, 16 nt, Staphylococcus aureus subsp. aureus Mu50
cuaaccacuucuucac

SEQ ID NO: 2074686 - RNA, 19 nt, Staphylococcus aureus subsp. aureus Mu50
cugccuaaucgcacucugc

SEQ ID NO: 2074687 - RNA, 13 nt, Staphylococcus aureus subsp. aureus Mu50
cugccauauguuu

SEQ ID NO: 2074688 - RNA, 23 nt, Staphylococcus aureus subsp. aureus Mu50
cugccaauaaaaugcaauuuuuc

SEQ ID NO: 2074689 - RNA, 15 nt, Staphylococcus aureus subsp. aureus Mu50
cugcaguugauugca

SEQ ID NO: 2074690 - RNA, 17 nt, Staphylococcus aureus subsp. aureus Mu50
cugcaauuauuuuucaa

SEQ ID NO: 2074691 - RNA, 21 nt, Staphylococcus aureus subsp. aureus Mu50
cugcaauuauuuuucaaauau

SEQ ID NO: 2074692 - RNA, 18 nt, Staphylococcus aureus subsp. aureus Mu50
cugcauuacgcugucuca

SEQ ID NO: 2074693 - RNA, 13 nt, Staphylococcus aureus subsp. aureus Mu50
cugccaaaaagua

SEQ ID NO: 2074694 - RNA, 16 nt, Staphylococcus aureus subsp. aureus Mu50
cugccaaaaugguuaa

SEQ ID NO: 2074695 - RNA, 18 nt, Staphylococcus aureus subsp. aureus Mu50
cugcuaaaauaaaauuaa

SEQ ID NO: 2074696 - RNA, 21 nt, Staphylococcus aureus subsp. aureus Mu50
cugcucuuuauauauaaaauc

SEQ ID NO: 2074697 - RNA, 19 nt, Staphylococcus aureus subsp. aureus Mu50
aaacuauuuuaaaaaugcu

SEQ ID NO: 2074698 - RNA, 20 nt, Staphylococcus aureus subsp. aureus Mu50
cuggauuuuucuuauaaaaa

SEQ ID NO: 2074699 - RNA, 21 nt, Staphylococcus aureus subsp. aureus Mu50
cuggaaaugauaauuuaauaa

SEQ ID NO: 2074700 - RNA, 20 nt, Staphylococcus aureus subsp. aureus Mu50
cugcuuuuuauuauuaugug

SEQ ID NO: 2074701 - RNA, 19 nt, Staphylococcus aureus subsp. aureus Mu50
cugcuucaacuacuucauc

SEQ ID NO: 2074702 - RNA, 23 nt, Staphylococcus aureus subsp. aureus Mu50
cugcaagucguucucuuaaauau

SEQ ID NO: 2074703 - RNA, 21 nt, Staphylococcus aureus subsp. aureus Mu50
cugcaagugcuuccacuucau

SEQ ID NO: 2074704 - RNA, 22 nt, Staphylococcus aureus subsp. aureus Mu50
cugaugcuagcuuucuuuuuca

SEQ ID NO: 2074705 - RNA, 16 nt, Staphylococcus aureus subsp. aureus Mu50
cugauuuaauagcuaa

SEQ ID NO: 2074706 - RNA, 23 nt, Staphylococcus aureus subsp. aureus Mu50
cugauugaauguuugguaacacu

SEQ ID NO: 2074707 - RNA, 22 nt, Staphylococcus aureus subsp. aureus Mu50
cugauaauuuuucuucuuuuuu

SEQ ID NO: 2074708 - RNA, 13 nt, Staphylococcus aureus subsp. aureus Mu50
cugaguucaauua

SEQ ID NO: 2074709 - RNA, 18 nt, Staphylococcus aureus subsp. aureus Mu50
cugaguucaauuaaauua

SEQ ID NO: 2074710 - RNA, 20 nt, Staphylococcus aureus subsp. aureus Mu50
cugaaggagacauuucccau

SEQ ID NO: 2074711 - RNA, 17 nt, Staphylococcus aureus subsp. aureus Mu50
cugaagcgcuuggauuu

SEQ ID NO: 2074712 - RNA, 22 nt, Staphylococcus aureus subsp. aureus Mu50
cugacucguugaccuuguucuu

SEQ ID NO: 2074713 - RNA, 18 nt, Staphylococcus aureus subsp. aureus Mu50
cugagaaaaauauuucua

SEQ ID NO: 2074714 - RNA, 23 nt, Staphylococcus aureus subsp. aureus Mu50
cugagcaacaaaagauguugcuc

SEQ ID NO: 2074715 - RNA, 16 nt, Staphylococcus aureus subsp. aureus Mu50
cugaaaagccuacuuu

SEQ ID NO: 2074716 - RNA, 13 nt, Staphylococcus aureus subsp. aureus Mu50
cugaaaaaauuaa

SEQ ID NO: 2074717 - RNA, 17 nt, Staphylococcus aureus subsp. aureus Mu50
cugaaacuuuaauacua

SEQ ID NO: 2074718 - RNA, 20 nt, Staphylococcus aureus subsp. aureus Mu50
cucuuuucacgaauaucuua

SEQ ID NO: 2074719 - RNA, 23 nt, Staphylococcus aureus subsp. aureus Mu50
cucuuuuaccucugauaaaugaa

SEQ ID NO: 2074720 - RNA, 23 nt, Staphylococcus aureus subsp. aureus Mu50
cucuuuguuggggcccacacccc

SEQ ID NO: 2074721 - RNA, 16 nt, Staphylococcus aureus subsp. aureus Mu50
cucuuuuugauuauau

SEQ ID NO: 2074722 - RNA, 14 nt, Staphylococcus aureus subsp. aureus Mu50
cucuuucaagaccu

SEQ ID NO: 2074723 - RNA, 23 nt, Staphylococcus aureus subsp. aureus Mu50
cucuuugaagggguuuuuucuua

SEQ ID NO: 2074724 - RNA, 15 nt, Staphylococcus aureus subsp. aureus Mu50
cugaaauuuuuuagu

SEQ ID NO: 2074725 - RNA, 12 nt, Staphylococcus aureus subsp. aureus Mu50
cugaaauuuuuu

SEQ ID NO: 2074726 - RNA, 18 nt, Staphylococcus aureus subsp. aureus Mu50
cugaaaucaguuuuugaa

SEQ ID NO: 2074727 - RNA, 16 nt, Staphylococcus aureus subsp. aureus Mu50
cugaaaucuagaccuu

SEQ ID NO: 2074728 - RNA, 14 nt, Staphylococcus aureus subsp. aureus Mu50
cucuguuuaacagg

SEQ ID NO: 2074729 - RNA, 16 nt, Staphylococcus aureus subsp. aureus Mu50
cucuucaaaguagaua

SEQ ID NO: 2074730 - RNA, 22 nt, Staphylococcus aureus subsp. aureus Mu50
cucuuauuaaaaaagaacauaa

SEQ ID NO: 2074731 - RNA, 13 nt, Staphylococcus aureus subsp. aureus Mu50
cucuuaguuuuaa

SEQ ID NO: 2074732 - RNA, 22 nt, Staphylococcus aureus subsp. aureus Mu50
cucuuauaaagacaccuucaau

SEQ ID NO: 2074733 - RNA, 23 nt, Staphylococcus aureus subsp. aureus Mu50
cucuucaguacgaacaacuaaca

SEQ ID NO: 2074734 - RNA, 11 nt, Staphylococcus aureus subsp. aureus Mu50
cucuucaaucu

SEQ ID NO: 2074735 - RNA, 22 nt, Staphylococcus aureus subsp. aureus Mu50
cucuucaaucuaccaauacguu

SEQ ID NO: 2074736 - RNA, 21 nt, Staphylococcus aureus subsp. aureus Mu50
cucuggauuuuucuuauaaaa

SEQ ID NO: 2074737 - RNA, 22 nt, Staphylococcus aureus subsp. aureus Mu50
cucuggauuuuucuuauaaaaa

SEQ ID NO: 2074738 - RNA, 19 nt, Staphylococcus aureus subsp. aureus Mu50
cucuuccuccgccaucaau

SEQ ID NO: 2074739 - RNA, 14 nt, Staphylococcus aureus subsp. aureus Mu50
cucuucguuuuaau

SEQ ID NO: 2074740 - RNA, 16 nt, Staphylococcus aureus subsp. aureus Mu50
cucuugauaaaauaaa

SEQ ID NO: 2074741 - RNA, 14 nt, Staphylococcus aureus subsp. aureus Mu50
cucuugcaauagca

SEQ ID NO: 2074742 - RNA, 22 nt, Staphylococcus aureus subsp. aureus Mu50
cucuuuaaacucguaaauuuua

SEQ ID NO: 2074743 - RNA, 18 nt, Staphylococcus aureus subsp. aureus Mu50
cucuugggaauugaccac

SEQ ID NO: 2074744 - RNA, 12 nt, Staphylococcus aureus subsp. aureus Mu50
aaaaaaaucucc

SEQ ID NO: 2074745 - RNA, 12 nt, Staphylococcus aureus subsp. aureus Mu50
aaaaaacaauag

SEQ ID NO: 2074746 - RNA, 21 nt, Staphylococcus aureus subsp. aureus Mu50
aaaaaaguuaucugcuuuucu

SEQ ID NO: 2074747 - RNA, 23 nt, Staphylococcus aureus subsp. aureus Mu50
aaaaaauacuaagauuagcuaug

SEQ ID NO: 2074748 - RNA, 12 nt, Staphylococcus aureus subsp. aureus Mu50
aaaaaauaauag

SEQ ID NO: 2074749 - RNA, 22 nt, Staphylococcus aureus subsp. aureus Mu50
aaaaaagauuaguagccacaau

SEQ ID NO: 2074750 - RNA, 18 nt, Staphylococcus aureus subsp. aureus Mu50
aaaaacaauaaaauuacu

SEQ ID NO: 2074751 - RNA, 16 nt, Staphylococcus aureus subsp. aureus Mu50
aaaaacagcaguaaga

SEQ ID NO: 2074752 - RNA, 14 nt, Staphylococcus aureus subsp. aureus Mu50
aaaaacaauaaaau

SEQ ID NO: 2074753 - RNA, 19 nt, Staphylococcus aureus subsp. aureus Mu50
aaaaacaaaaaaaccgaac

SEQ ID NO: 2074754 - RNA, 13 nt, Staphylococcus aureus subsp. aureus Mu50
aaaaacaaaaaaa

SEQ ID NO: 2074755 - RNA, 17 nt, Staphylococcus aureus subsp. aureus Mu50
aaaaaauuuaauguuuu

SEQ ID NO: 2074756 - RNA, 12 nt, Staphylococcus aureus subsp. aureus Mu50
aaaaaauuuaaa

SEQ ID NO: 2074757 - RNA, 16 nt, Staphylococcus aureus subsp. aureus Mu50
aaaaaauuuaaauaau

SEQ ID NO: 2074758 - RNA, 16 nt, Staphylococcus aureus subsp. aureus Mu50
aaaaaauuaaaauguu

SEQ ID NO: 2074759 - RNA, 12 nt, Staphylococcus aureus subsp. aureus Mu50
aaaaaauuauua

SEQ ID NO: 2074760 - RNA, 15 nt, Staphylococcus aureus subsp. aureus Mu50
aaaaaauuaauaauu

SEQ ID NO: 2074761 - RNA, 14 nt, Staphylococcus aureus subsp. aureus Mu50
aaaaaccacgcaca

SEQ ID NO: 2074762 - RNA, 13 nt, Staphylococcus aureus subsp. aureus Mu50
aaaaaaucgaauu

SEQ ID NO: 2074763 - RNA, 18 nt, Staphylococcus aureus subsp. aureus Mu50
aaaaaaucaguuuuuaaa

SEQ ID NO: 2074764 - RNA, 17 nt, Staphylococcus aureus subsp. aureus Mu50
aaaaaaguugauuaaaa

SEQ ID NO: 2074765 - RNA, 14 nt, Staphylococcus aureus subsp. aureus Mu50
aaaaaauauuuaca

SEQ ID NO: 2074766 - RNA, 18 nt, Staphylococcus aureus subsp. aureus Mu50
aaaaaaucgaacaaauga

SEQ ID NO: 2074767 - RNA, 22 nt, Staphylococcus aureus subsp. aureus Mu50
aaaaaaggaugaugugaauguu

SEQ ID NO: 2074768 - RNA, 16 nt, Staphylococcus aureus subsp. aureus Mu50
aaaaaaucgaacaaau

SEQ ID NO: 2074769 - RNA, 14 nt, Staphylococcus aureus subsp. aureus Mu50
aaaaaaugaauguu

SEQ ID NO: 2074770 - RNA, 20 nt, Staphylococcus aureus subsp. aureus Mu50
aaaaacaucauuucugaagu

SEQ ID NO: 2074771 - RNA, 18 nt, Staphylococcus aureus subsp. aureus Mu50
aaaaacaguguagcacaa

SEQ ID NO: 2074772 - RNA, 13 nt, Staphylococcus aureus subsp. aureus Mu50
aaaaacauaaaaa

SEQ ID NO: 2074773 - RNA, 14 nt, Staphylococcus aureus subsp. aureus Mu50
aaaaacauaaaaau

SEQ ID NO: 2074774 - RNA, 14 nt, Staphylococcus aureus subsp. aureus Mu50
aaaaauaauagcaa

SEQ ID NO: 2074775 - RNA, 15 nt, Staphylococcus aureus subsp. aureus Mu50
aaaaauaauagcaaa

SEQ ID NO: 2074776 - RNA, 20 nt, Staphylococcus aureus subsp. aureus Mu50
aaaaauaaagucauaugguu

SEQ ID NO: 2074777 - RNA, 16 nt, Staphylococcus aureus subsp. aureus Mu50
aaaaauaacuccucca

SEQ ID NO: 2074778 - RNA, 20 nt, Staphylococcus aureus subsp. aureus Mu50
aaaaauaacuguaaaacauu

SEQ ID NO: 2074779 - RNA, 13 nt, Staphylococcus aureus subsp. aureus Mu50
aaaaaguuuuucu

SEQ ID NO: 2074780 - RNA, 16 nt, Staphylococcus aureus subsp. aureus Mu50
aaaaauaaaaccgagg

SEQ ID NO: 2074781 - RNA, 15 nt, Staphylococcus aureus subsp. aureus Mu50
aaaaacaucauuucu

SEQ ID NO: 2074782 - RNA, 20 nt, Staphylococcus aureus subsp. aureus Mu50
aaaaacaucuacaucaaauu

SEQ ID NO: 2074783 - RNA, 14 nt, Staphylococcus aureus subsp. aureus Mu50
aaaaacaguuacaa

SEQ ID NO: 2074784 - RNA, 14 nt, Staphylococcus aureus subsp. aureus Mu50
aaaaauaauuaaau

SEQ ID NO: 2074785 - RNA, 11 nt, Staphylococcus aureus subsp. aureus Mu50
aaaaauaauug

SEQ ID NO: 2074786 - RNA, 12 nt, Staphylococcus aureus subsp. aureus Mu50
aaaaauacuuuu

SEQ ID NO: 2074787 - RNA, 21 nt, Staphylococcus aureus subsp. aureus Mu50
aaaaauacguuuaauguauaa

SEQ ID NO: 2074788 - RNA, 15 nt, Staphylococcus aureus subsp. aureus Mu50
aaaaauauauuucaa

SEQ ID NO: 2074789 - RNA, 17 nt, Staphylococcus aureus subsp. aureus Mu50
aaaaaucauccauaaaa

SEQ ID NO: 2074790 - RNA, 18 nt, Staphylococcus aureus subsp. aureus Mu50
aaaaaucauaaauaacac

SEQ ID NO: 2074791 - RNA, 21 nt, Staphylococcus aureus subsp. aureus Mu50
aaaaaucgaacuagacaagau

SEQ ID NO: 2074792 - RNA, 23 nt, Staphylococcus aureus subsp. aureus Mu50
aaaaaucgaauuuucaaagacgu

SEQ ID NO: 2074793 - RNA, 12 nt, Staphylococcus aureus subsp. aureus Mu50
aaaaauuaaaaa

SEQ ID NO: 2074794 - RNA, 15 nt, Staphylococcus aureus subsp. aureus Mu50
aaaaauuaaaaaaca

SEQ ID NO: 2074795 - RNA, 22 nt, Staphylococcus aureus subsp. aureus Mu50
aaaaauccggaacauuaaaagg

SEQ ID NO: 2074796 - RNA, 14 nt, Staphylococcus aureus subsp. aureus Mu50
aaaaauuaaaaugu

SEQ ID NO: 2074797 - RNA, 14 nt, Staphylococcus aureus subsp. aureus Mu50
aaaaauuaaaaauu

SEQ ID NO: 2074798 - RNA, 23 nt, Staphylococcus aureus subsp. aureus Mu50
aaaaauuaacuauacuuuuauag

SEQ ID NO: 2074799 - RNA, 12 nt, Staphylococcus aureus subsp. aureus Mu50
aaaaauuucaau

SEQ ID NO: 2074800 - RNA, 14 nt, Staphylococcus aureus subsp. aureus Mu50
aaaaauuucaauaa

SEQ ID NO: 2074801 - RNA, 16 nt, Staphylococcus aureus subsp. aureus Mu50
aaaaauuucaaaaaua

SEQ ID NO: 2074802 - RNA, 13 nt, Staphylococcus aureus subsp. aureus Mu50
aaaaauucauaau

SEQ ID NO: 2074803 - RNA, 18 nt, Staphylococcus aureus subsp. aureus Mu50
aaaaauuauuaaaaaaau

SEQ ID NO: 2074804 - RNA, 22 nt, Staphylococcus aureus subsp. aureus Mu50
aaaaauuucgccucaucuaauu

SEQ ID NO: 2074805 - RNA, 17 nt, Staphylococcus aureus subsp. aureus Mu50
aaaacaauaaaauuacu

SEQ ID NO: 2074806 - RNA, 19 nt, Staphylococcus aureus subsp. aureus Mu50
aaaacagaauuucaucaaa

SEQ ID NO: 2074807 - RNA, 13 nt, Staphylococcus aureus subsp. aureus Mu50
aaaacaauauuga

SEQ ID NO: 2074808 - RNA, 13 nt, Staphylococcus aureus subsp. aureus Mu50
aaaacaaugauua

SEQ ID NO: 2074809 - RNA, 17 nt, Staphylococcus aureus subsp. aureus Mu50
aaaacaaugauuaaaau

SEQ ID NO: 2074810 - RNA, 21 nt, Staphylococcus aureus subsp. aureus Mu50
aaaacaauaauuuaauauuua

SEQ ID NO: 2074811 - RNA, 23 nt, Staphylococcus aureus subsp. aureus Mu50
aaaacaauaauuuaauauuuaga

SEQ ID NO: 2074812 - RNA, 16 nt, Staphylococcus aureus subsp. aureus Mu50
aaaacauuauuaagug

SEQ ID NO: 2074813 - RNA, 22 nt, Staphylococcus aureus subsp. aureus Mu50
aaaacagaggucuucgcaauca

SEQ ID NO: 2074814 - RNA, 15 nt, Staphylococcus aureus subsp. aureus Mu50
aaaacagcaaauaaa

SEQ ID NO: 2074815 - RNA, 15 nt, Staphylococcus aureus subsp. aureus Mu50
aaaacaucuacauca

SEQ ID NO: 2074816 - RNA, 14 nt, Staphylococcus aureus subsp. aureus Mu50
aaaagagaauuuua

SEQ ID NO: 2074817 - RNA, 12 nt, Staphylococcus aureus subsp. aureus Mu50
aaaagagaccuu

SEQ ID NO: 2074818 - RNA, 16 nt, Staphylococcus aureus subsp. aureus Mu50
aaaagacagcaguagg

SEQ ID NO: 2074819 - RNA, 22 nt, Staphylococcus aureus subsp. aureus Mu50
aaaagaauuucgaaaagaaauu

SEQ ID NO: 2074820 - RNA, 18 nt, Staphylococcus aureus subsp. aureus Mu50
aaaagaauuauucaagua

SEQ ID NO: 2074821 - RNA, 12 nt, Staphylococcus aureus subsp. aureus Mu50
aaaagaaauucu

SEQ ID NO: 2074822 - RNA, 16 nt, Staphylococcus aureus subsp. aureus Mu50
aaaagaaauucuacag

SEQ ID NO: 2074823 - RNA, 17 nt, Staphylococcus aureus subsp. aureus Mu50
aaaagaaauucuacagg

SEQ ID NO: 2074824 - RNA, 20 nt, Staphylococcus aureus subsp. aureus Mu50
aaaagaacuacgcauuuuaa

SEQ ID NO: 2074825 - RNA, 13 nt, Staphylococcus aureus subsp. aureus Mu50
aaaagauuaguag

SEQ ID NO: 2074826 - RNA, 21 nt, Staphylococcus aureus subsp. aureus Mu50
aaaagauguugcucgugcauu

SEQ ID NO: 2074827 - RNA, 14 nt, Staphylococcus aureus subsp. aureus Mu50
aaaagaucgauacu

SEQ ID NO: 2074828 - RNA, 17 nt, Staphylococcus aureus subsp. aureus Mu50
aaaagauauaaacauuu

SEQ ID NO: 2074829 - RNA, 16 nt, Staphylococcus aureus subsp. aureus Mu50
aaaagauaaauaaaag

SEQ ID NO: 2074830 - RNA, 17 nt, Staphylococcus aureus subsp. aureus Mu50
aaaagauucggaaaaua

SEQ ID NO: 2074831 - RNA, 16 nt, Staphylococcus aureus subsp. aureus Mu50
aaaacgugacauuuuc

SEQ ID NO: 2074832 - RNA, 21 nt, Staphylococcus aureus subsp. aureus Mu50
aaaacgugcaaauaaaaaagu

SEQ ID NO: 2074833 - RNA, 14 nt, Staphylococcus aureus subsp. aureus Mu50
aaaacuaaagggac

SEQ ID NO: 2074834 - RNA, 12 nt, Staphylococcus aureus subsp. aureus Mu50
aaaacguuuaau

SEQ ID NO: 2074835 - RNA, 13 nt, Staphylococcus aureus subsp. aureus Mu50
aaaacuaaugaua

SEQ ID NO: 2074836 - RNA, 13 nt, Staphylococcus aureus subsp. aureus Mu50
aaaacuauuuuaa

SEQ ID NO: 2074837 - RNA, 21 nt, Staphylococcus aureus subsp. aureus Mu50
aaaacuucccuuuggaagcaa

SEQ ID NO: 2074838 - RNA, 15 nt, Staphylococcus aureus subsp. aureus Mu50
aaaacuuguaaucau

SEQ ID NO: 2074839 - RNA, 16 nt, Staphylococcus aureus subsp. aureus Mu50
aaaacucuaaaaguug

SEQ ID NO: 2074840 - RNA, 16 nt, Staphylococcus aureus subsp. aureus Mu50
aaaacuauaauaaaga

SEQ ID NO: 2074841 - RNA, 18 nt, Staphylococcus aureus subsp. aureus Mu50
aaaagcaugauacucaau

SEQ ID NO: 2074842 - RNA, 23 nt, Staphylococcus aureus subsp. aureus Mu50
aaaagcaugauacucaauaaaau

SEQ ID NO: 2074843 - RNA, 13 nt, Staphylococcus aureus subsp. aureus Mu50
aaaagcaucuuua

SEQ ID NO: 2074844 - RNA, 17 nt, Staphylococcus aureus subsp. aureus Mu50
aaaagcaggcaagcuau

SEQ ID NO: 2074845 - RNA, 23 nt, Staphylococcus aureus subsp. aureus Mu50
aaaagccucuaaugauuaaaaau

SEQ ID NO: 2074846 - RNA, 22 nt, Staphylococcus aureus subsp. aureus Mu50
aaaagccucuaaugauuaaaaa

SEQ ID NO: 2074847 - RNA, 22 nt, Staphylococcus aureus subsp. aureus Mu50
aaaagccuacuuugucugcaau

SEQ ID NO: 2074848 - RNA, 17 nt, Staphylococcus aureus subsp. aureus Mu50
aaaaguaauuaaauacu

SEQ ID NO: 2074849 - RNA, 14 nt, Staphylococcus aureus subsp. aureus Mu50
aaaaguaaguaaaa

SEQ ID NO: 2074850 - RNA, 15 nt, Staphylococcus aureus subsp. aureus Mu50
aaaaguaaguaaaau

SEQ ID NO: 2074851 - RNA, 21 nt, Staphylococcus aureus subsp. aureus Mu50
aaaaguauugccguuauuuuc

SEQ ID NO: 2074852 - RNA, 20 nt, Staphylococcus aureus subsp. aureus Mu50
aaaagugcauauuuaauaca

SEQ ID NO: 2074853 - RNA, 13 nt, Staphylococcus aureus subsp. aureus Mu50
aaaaguguaaugu

SEQ ID NO: 2074854 - RNA, 20 nt, Staphylococcus aureus subsp. aureus Mu50
aaaaguuaggcgacuuaacu

SEQ ID NO: 2074855 - RNA, 22 nt, Staphylococcus aureus subsp. aureus Mu50
aaaaguguugacuuuaucaauu

SEQ ID NO: 2074856 - RNA, 12 nt, Staphylococcus aureus subsp. aureus Mu50
aaaauaaaaacc

SEQ ID NO: 2074857 - RNA, 12 nt, Staphylococcus aureus subsp. aureus Mu50
aaaauaaaaaau

SEQ ID NO: 2074858 - RNA, 13 nt, Staphylococcus aureus subsp. aureus Mu50
aaaauaaaaacca

SEQ ID NO: 2074859 - RNA, 13 nt, Staphylococcus aureus subsp. aureus Mu50
aaaauaaaaccga

SEQ ID NO: 2074860 - RNA, 22 nt, Staphylococcus aureus subsp. aureus Mu50
aaaauaaaaccgaggaaauccu

SEQ ID NO: 2074861 - RNA, 16 nt, Staphylococcus aureus subsp. aureus Mu50
aaaauaauagauaaua

SEQ ID NO: 2074862 - RNA, 19 nt, Staphylococcus aureus subsp. aureus Mu50
aaaauaaaauuaacgagcu

SEQ ID NO: 2074863 - RNA, 17 nt, Staphylococcus aureus subsp. aureus Mu50
aaaauaaaaugcaaaga

SEQ ID NO: 2074864 - RNA, 15 nt, Staphylococcus aureus subsp. aureus Mu50
aaaauagauugaaaa

SEQ ID NO: 2074865 - RNA, 20 nt, Staphylococcus aureus subsp. aureus Mu50
aaaauagccauauucauauu

SEQ ID NO: 2074866 - RNA, 16 nt, Staphylococcus aureus subsp. aureus Mu50
aaaauagcuauuaaaa

SEQ ID NO: 2074867 - RNA, 20 nt, Staphylococcus aureus subsp. aureus Mu50
aaaauagcuauuaaaauaga

SEQ ID NO: 2074868 - RNA, 20 nt, Staphylococcus aureus subsp. aureus Mu50
aaaauaguaaagugaaauaa

SEQ ID NO: 2074869 - RNA, 16 nt, Staphylococcus aureus subsp. aureus Mu50
aaaauaauuaaauaaa

SEQ ID NO: 2074870 - RNA, 14 nt, Staphylococcus aureus subsp. aureus Mu50
aaaauagaaaaauu

SEQ ID NO: 2074871 - RNA, 19 nt, Staphylococcus aureus subsp. aureus Mu50
aaaauagaaaaauuucaaa

SEQ ID NO: 2074872 - RNA, 15 nt, Staphylococcus aureus subsp. aureus Mu50
aaaaucaacuuuucu

SEQ ID NO: 2074873 - RNA, 15 nt, Staphylococcus aureus subsp. aureus Mu50
aaaauauaugaauaa

SEQ ID NO: 2074874 - RNA, 16 nt, Staphylococcus aureus subsp. aureus Mu50
aaacaaaucuuuuaaa

SEQ ID NO: 2074875 - RNA, 14 nt, Staphylococcus aureus subsp. aureus Mu50
aaacaaauaaaugu

SEQ ID NO: 2074876 - RNA, 12 nt, Staphylococcus aureus subsp. aureus Mu50
aaacaacaucac

SEQ ID NO: 2074877 - RNA, 13 nt, Staphylococcus aureus subsp. aureus Mu50
aaacaaauuacac

SEQ ID NO: 2074878 - RNA, 13 nt, Staphylococcus aureus subsp. aureus Mu50
aaacaaaaaauau

SEQ ID NO: 2074879 - RNA, 19 nt, Staphylococcus aureus subsp. aureus Mu50
aaaauuuuuaaaaaaauaa

SEQ ID NO: 2074880 - RNA, 14 nt, Staphylococcus aureus subsp. aureus Mu50
aaaauuuugaagaa

SEQ ID NO: 2074881 - RNA, 15 nt, Staphylococcus aureus subsp. aureus Mu50
aaacaaaaaucuacu

SEQ ID NO: 2074882 - RNA, 20 nt, Staphylococcus aureus subsp. aureus Mu50
aaacaaaaaucuacuaagug

SEQ ID NO: 2074883 - RNA, 14 nt, Staphylococcus aureus subsp. aureus Mu50
aaacaaaacaaaaa

SEQ ID NO: 2074884 - RNA, 14 nt, Staphylococcus aureus subsp. aureus Mu50
aaaauucaauauua

SEQ ID NO: 2074885 - RNA, 19 nt, Staphylococcus aureus subsp. aureus Mu50
aaaauucaauauuaaucau

SEQ ID NO: 2074886 - RNA, 20 nt, Staphylococcus aureus subsp. aureus Mu50
aaaauucgcuuguaacaagc

SEQ ID NO: 2074887 - RNA, 16 nt, Staphylococcus aureus subsp. aureus Mu50
aaaauuuauucaaaau

SEQ ID NO: 2074888 - RNA, 19 nt, Staphylococcus aureus subsp. aureus Mu50
aaaauuuauucaaaauuca

SEQ ID NO: 2074889 - RNA, 23 nt, Staphylococcus aureus subsp. aureus Mu50
aaaaucucauaauaauucaguaa

SEQ ID NO: 2074890 - RNA, 14 nt, Staphylococcus aureus subsp. aureus Mu50
aaaaugaugcacua

SEQ ID NO: 2074891 - RNA, 23 nt, Staphylococcus aureus subsp. aureus Mu50
aaaaugcaauuuuucacuuauaa

SEQ ID NO: 2074892 - RNA, 21 nt, Staphylococcus aureus subsp. aureus Mu50
aaaaugauucuuaucuuuaau

SEQ ID NO: 2074893 - RNA, 22 nt, Staphylococcus aureus subsp. aureus Mu50
aaaaugauuguuuuaaguggga

SEQ ID NO: 2074894 - RNA, 21 nt, Staphylococcus aureus subsp. aureus Mu50
aaaauccuaagcaucguaaaa

SEQ ID NO: 2074895 - RNA, 15 nt, Staphylococcus aureus subsp. aureus Mu50
aaaauccugaaauua

SEQ ID NO: 2074896 - RNA, 22 nt, Staphylococcus aureus subsp. aureus Mu50
aaaaucgcgucugauucucuaa

SEQ ID NO: 2074897 - RNA, 20 nt, Staphylococcus aureus subsp. aureus Mu50
aaaaucgguuugauuaaaau

SEQ ID NO: 2074898 - RNA, 10 nt, Staphylococcus aureus subsp. aureus Mu50
aaaauuauuu

SEQ ID NO: 2074899 - RNA, 21 nt, Staphylococcus aureus subsp. aureus Mu50
aaaauuauugaauuugaauaa

SEQ ID NO: 2074900 - RNA, 16 nt, Staphylococcus aureus subsp. aureus Mu50
aaaauuauguaaaaaa

SEQ ID NO: 2074901 - RNA, 16 nt, Staphylococcus aureus subsp. aureus Mu50
aaaauuauuaaaaaaa

SEQ ID NO: 2074902 - RNA, 14 nt, Staphylococcus aureus subsp. aureus Mu50
aaaauuauuaaaaa

SEQ ID NO: 2074903 - RNA, 17 nt, Staphylococcus aureus subsp. aureus Mu50
aaaaugcuuuuuugaaa

SEQ ID NO: 2074904 - RNA, 12 nt, Staphylococcus aureus subsp. aureus Mu50
aaaauuaucaau

SEQ ID NO: 2074905 - RNA, 17 nt, Staphylococcus aureus subsp. aureus Mu50
aaaauuauacaaauuau

SEQ ID NO: 2074906 - RNA, 22 nt, Staphylococcus aureus subsp. aureus Mu50
aaaauuagccuaauugagagaa

SEQ ID NO: 2074907 - RNA, 13 nt, Staphylococcus aureus subsp. aureus Mu50
aaaaugcucaagu

SEQ ID NO: 2074908 - RNA, 23 nt, Staphylococcus aureus subsp. aureus Mu50
aaaaugcgcuuccaauuuaaaau

SEQ ID NO: 2074909 - RNA, 16 nt, Staphylococcus aureus subsp. aureus Mu50
aaaaugcauuacuacu

SEQ ID NO: 2074910 - RNA, 13 nt, Staphylococcus aureus subsp. aureus Mu50
aaaaugcacugag

SEQ ID NO: 2074911 - RNA, 18 nt, Staphylococcus aureus subsp. aureus Mu50
aaaaugccaacuauaccu

SEQ ID NO: 2074912 - RNA, 14 nt, Staphylococcus aureus subsp. aureus Mu50
aaaugcuguuuuau

SEQ ID NO: 2074913 - RNA, 18 nt, Staphylococcus aureus subsp. aureus Mu50
aaaugcuuaagaaauuuu

SEQ ID NO: 2074914 - RNA, 20 nt, Staphylococcus aureus subsp. aureus Mu50
aaaugcuuaagaaauuuuuu

SEQ ID NO: 2074915 - RNA, 20 nt, Staphylococcus aureus subsp. aureus Mu50
aaaugcuuauauaaacaaaa

SEQ ID NO: 2074916 - RNA, 20 nt, Staphylococcus aureus subsp. aureus Mu50
aaaugcuuaauaaaaucaaa

SEQ ID NO: 2074917 - RNA, 12 nt, Staphylococcus aureus subsp. aureus Mu50
aaaugcuuauau

SEQ ID NO: 2074918 - RNA, 19 nt, Staphylococcus aureus subsp. aureus Mu50
aaaugcucaaguugauuau

SEQ ID NO: 2074919 - RNA, 22 nt, Staphylococcus aureus subsp. aureus Mu50
aaaugcucaaguugauuauucu

SEQ ID NO: 2074920 - RNA, 20 nt, Staphylococcus aureus subsp. aureus Mu50
aaaugccgagauuauuaugu

SEQ ID NO: 2074921 - RNA, 21 nt, Staphylococcus aureus subsp. aureus Mu50
aaaugcgcuuccaauuuaaaa

SEQ ID NO: 2074922 - RNA, 20 nt, Staphylococcus aureus subsp. aureus Mu50
aaaugaaaauaccucuacau

SEQ ID NO: 2074923 - RNA, 22 nt, Staphylococcus aureus subsp. aureus Mu50
aaaugaaaguaccuaaaauaga

SEQ ID NO: 2074924 - RNA, 22 nt, Staphylococcus aureus subsp. aureus Mu50
aaaucuuuugagacguuuucca

SEQ ID NO: 2074925 - RNA, 14 nt, Staphylococcus aureus subsp. aureus Mu50
aaaucuuuuaaauu

SEQ ID NO: 2074926 - RNA, 22 nt, Staphylococcus aureus subsp. aureus Mu50
aaaucuuuuaaauuuaguaucu

SEQ ID NO: 2074927 - RNA, 21 nt, Staphylococcus aureus subsp. aureus Mu50
aaaucuuaugaugucauguau

SEQ ID NO: 2074928 - RNA, 20 nt, Staphylococcus aureus subsp. aureus Mu50
aaaugauguaacguuucuuu

SEQ ID NO: 2074929 - RNA, 19 nt, Staphylococcus aureus subsp. aureus Mu50
aaaugaugcaguaaaacca

SEQ ID NO: 2074930 - RNA, 16 nt, Staphylococcus aureus subsp. aureus Mu50
aaaugauuaauaacau

SEQ ID NO: 2074931 - RNA, 14 nt, Staphylococcus aureus subsp. aureus Mu50
aaaugauuucacuu

SEQ ID NO: 2074932 - RNA, 19 nt, Staphylococcus aureus subsp. aureus Mu50
aaaugauuuauucuaaaua

SEQ ID NO: 2074933 - RNA, 22 nt, Staphylococcus aureus subsp. aureus Mu50
aaaugauuuauucuaaauauau

SEQ ID NO: 2074934 - RNA, 18 nt, Staphylococcus aureus subsp. aureus Mu50
aaaugcaaagacuaaaaa

SEQ ID NO: 2074935 - RNA, 14 nt, Staphylococcus aureus subsp. aureus Mu50
aaaugaaauaggcg

SEQ ID NO: 2074936 - RNA, 15 nt, Staphylococcus aureus subsp. aureus Mu50
aaaucuguuuaaauu

SEQ ID NO: 2074937 - RNA, 20 nt, Staphylococcus aureus subsp. aureus Mu50
aaaucuguuuaaauuuaaaa

SEQ ID NO: 2074938 - RNA, 14 nt, Staphylococcus aureus subsp. aureus Mu50
aaaucucauaauaa

SEQ ID NO: 2074939 - RNA, 22 nt, Staphylococcus aureus subsp. aureus Mu50
aaaucucauaauaauucaguaa

SEQ ID NO: 2074940 - RNA, 19 nt, Staphylococcus aureus subsp. aureus Mu50
aaaucguuaaggaaagcuu

SEQ ID NO: 2074941 - RNA, 15 nt, Staphylococcus aureus subsp. aureus Mu50
aaaucguuauaagua

SEQ ID NO: 2074942 - RNA, 12 nt, Staphylococcus aureus subsp. aureus Mu50
aaaucguuucau

SEQ ID NO: 2074943 - RNA, 23 nt, Staphylococcus aureus subsp. aureus Mu50
aaaucuaauccugguauaaugga

SEQ ID NO: 2074944 - RNA, 13 nt, Staphylococcus aureus subsp. aureus Mu50
aaaucuacaauau

SEQ ID NO: 2074945 - RNA, 21 nt, Staphylococcus aureus subsp. aureus Mu50
aaaucuauaccauuccaaaaa

SEQ ID NO: 2074946 - RNA, 13 nt, Staphylococcus aureus subsp. aureus Mu50
aaaucuaucuacu

SEQ ID NO: 2074947 - RNA, 14 nt, Staphylococcus aureus subsp. aureus Mu50
aaaucuaucuacuc

SEQ ID NO: 2074948 - RNA, 15 nt, Staphylococcus aureus subsp. aureus Mu50
aaaucuauauaaagu

SEQ ID NO: 2074949 - RNA, 14 nt, Staphylococcus aureus subsp. aureus Mu50
aaaucgauuaagaa

SEQ ID NO: 2074950 - RNA, 22 nt, Staphylococcus aureus subsp. aureus Mu50
aaaucgauacuggguuuuacca

SEQ ID NO: 2074951 - RNA, 17 nt, Staphylococcus aureus subsp. aureus Mu50
aaaucauuuaaauuagu

SEQ ID NO: 2074952 - RNA, 15 nt, Staphylococcus aureus subsp. aureus Mu50
aaaucauuaauaauu

SEQ ID NO: 2074953 - RNA, 19 nt, Staphylococcus aureus subsp. aureus Mu50
aaaucauuaauaauuaaac

SEQ ID NO: 2074954 - RNA, 19 nt, Staphylococcus aureus subsp. aureus Mu50
aaaucauucuuuauagaaa

SEQ ID NO: 2074955 - RNA, 13 nt, Staphylococcus aureus subsp. aureus Mu50
aaaucauuaauaa

SEQ ID NO: 2074956 - RNA, 18 nt, Staphylococcus aureus subsp. aureus Mu50
aaaucauuaguuguauca

SEQ ID NO: 2074957 - RNA, 16 nt, Staphylococcus aureus subsp. aureus Mu50
aaaucauccauaaaaa

SEQ ID NO: 2074958 - RNA, 21 nt, Staphylococcus aureus subsp. aureus Mu50
aaaucaucuuaugacugcuuu

SEQ ID NO: 2074959 - RNA, 15 nt, Staphylococcus aureus subsp. aureus Mu50
aaaaagcucaauccu

SEQ ID NO: 2074960 - RNA, 14 nt, Staphylococcus aureus subsp. aureus Mu50
aaauuacacccuuu

SEQ ID NO: 2074961 - RNA, 19 nt, Staphylococcus aureus subsp. aureus Mu50
aaauuacacccuuuaaauu

SEQ ID NO: 2074962 - RNA, 23 nt, Staphylococcus aureus subsp. aureus Mu50
aaauuacacccuuuaaauuuaac

SEQ ID NO: 2074963 - RNA, 16 nt, Staphylococcus aureus subsp. aureus Mu50
aaauuaauugcuuuca

SEQ ID NO: 2074964 - RNA, 15 nt, Staphylococcus aureus subsp. aureus Mu50
aaauuaagaauaauc

SEQ ID NO: 2074965 - RNA, 19 nt, Staphylococcus aureus subsp. aureus Mu50
aaaaaggaagaacagcaca

SEQ ID NO: 2074966 - RNA, 13 nt, Staphylococcus aureus subsp. aureus Mu50
aaauuaacuagug

SEQ ID NO: 2074967 - RNA, 14 nt, Staphylococcus aureus subsp. aureus Mu50
aaauuaacuuaaaa

SEQ ID NO: 2074968 - RNA, 22 nt, Staphylococcus aureus subsp. aureus Mu50
aaauuaacuuaaaauuuaaaua

SEQ ID NO: 2074969 - RNA, 21 nt, Staphylococcus aureus subsp. aureus Mu50
aaauuaacuuagguuauuaua

SEQ ID NO: 2074970 - RNA, 20 nt, Staphylococcus aureus subsp. aureus Mu50
aaaaagcaguaaguugauuu

SEQ ID NO: 2074971 - RNA, 15 nt, Staphylococcus aureus subsp. aureus Mu50
aaauuaagaagaaau

SEQ ID NO: 2074972 - RNA, 17 nt, Staphylococcus aureus subsp. aureus Mu50
aaauguugaauguggaa

SEQ ID NO: 2074973 - RNA, 15 nt, Staphylococcus aureus subsp. aureus Mu50
aaauuaaauuuuguu

SEQ ID NO: 2074974 - RNA, 20 nt, Staphylococcus aureus subsp. aureus Mu50
aaauuaaagcuagaaacaau

SEQ ID NO: 2074975 - RNA, 15 nt, Staphylococcus aureus subsp. aureus Mu50
aaauguuacacaaau

SEQ ID NO: 2074976 - RNA, 22 nt, Staphylococcus aureus subsp. aureus Mu50
aaauguuaucaauaucuucgcc

SEQ ID NO: 2074977 - RNA, 15 nt, Staphylococcus aureus subsp. aureus Mu50
aaauguuaaagauua

SEQ ID NO: 2074978 - RNA, 21 nt, Staphylococcus aureus subsp. aureus Mu50
aaauguuaaagauuauuauua

SEQ ID NO: 2074979 - RNA, 19 nt, Staphylococcus aureus subsp. aureus Mu50
aaauguuauuaaccaucau

SEQ ID NO: 2074980 - RNA, 15 nt, Staphylococcus aureus subsp. aureus Mu50
aaauguuauugcuua

SEQ ID NO: 2074981 - RNA, 22 nt, Staphylococcus aureus subsp. aureus Mu50
aaauguuauugcuuauuuuugu

SEQ ID NO: 2074982 - RNA, 20 nt, Staphylococcus aureus subsp. aureus Mu50
aaauguucuggaauaccuaa

SEQ ID NO: 2074983 - RNA, 18 nt, Staphylococcus aureus subsp. aureus Mu50
aaauuauauagaaaacua

SEQ ID NO: 2074984 - RNA, 17 nt, Staphylococcus aureus subsp. aureus Mu50
aaauuauugaauuugaa

SEQ ID NO: 2074985 - RNA, 16 nt, Staphylococcus aureus subsp. aureus Mu50
aaauuauguaaaaaau

SEQ ID NO: 2074986 - RNA, 22 nt, Staphylococcus aureus subsp. aureus Mu50
aaauuaugauuauauuuucuca

SEQ ID NO: 2074987 - RNA, 15 nt, Staphylococcus aureus subsp. aureus Mu50
aaauucaacuuuaau

SEQ ID NO: 2074988 - RNA, 18 nt, Staphylococcus aureus subsp. aureus Mu50
aaauucaacgucaucaaa

SEQ ID NO: 2074989 - RNA, 14 nt, Staphylococcus aureus subsp. aureus Mu50
aaauucaacuauga

SEQ ID NO: 2074990 - RNA, 17 nt, Staphylococcus aureus subsp. aureus Mu50
aaauucaacuaugaaau

SEQ ID NO: 2074991 - RNA, 17 nt, Staphylococcus aureus subsp. aureus Mu50
aaauucgaaaagaaauu

SEQ ID NO: 2074992 - RNA, 19 nt, Staphylococcus aureus subsp. aureus Mu50
aaauucgacucaaacaaua

SEQ ID NO: 2074993 - RNA, 18 nt, Staphylococcus aureus subsp. aureus Mu50
aaauucgcuuguaacaag

SEQ ID NO: 2074994 - RNA, 15 nt, Staphylococcus aureus subsp. aureus Mu50
aaauucgaaaagaaa

SEQ ID NO: 2074995 - RNA, 16 nt, Staphylococcus aureus subsp. aureus Mu50
aaauucgaaaagaaau

SEQ ID NO: 2074996 - RNA, 17 nt, Staphylococcus aureus subsp. aureus Mu50
aaauucuacaggcaaug

SEQ ID NO: 2074997 - RNA, 21 nt, Staphylococcus aureus subsp. aureus Mu50
aaauucuacaggcaaugcaag

SEQ ID NO: 2074998 - RNA, 14 nt, Staphylococcus aureus subsp. aureus Mu50
aaauucucaauuaa

SEQ ID NO: 2074999 - RNA, 22 nt, Staphylococcus aureus subsp. aureus Mu50
aaauucuacagguaaugcaagu

SEQ ID NO: 2075000 - RNA, 21 nt, Staphylococcus aureus subsp. aureus Mu50
aaauucuauaauuuuaauuau

SEQ ID NO: 2075001 - RNA, 22 nt, Staphylococcus aureus subsp. aureus Mu50
aaauaauaacccgaacacaaaa

SEQ ID NO: 2075002 - RNA, 16 nt, Staphylococcus aureus subsp. aureus Mu50
aaauaagugauaaaua

SEQ ID NO: 2075003 - RNA, 23 nt, Staphylococcus aureus subsp. aureus Mu50
aaauaauaaguugaauauaaaaa

SEQ ID NO: 2075004 - RNA, 18 nt, Staphylococcus aureus subsp. aureus Mu50
aaauaagcaaucauaaua

SEQ ID NO: 2075005 - RNA, 18 nt, Staphylococcus aureus subsp. aureus Mu50
aaauaagcuuguaacaag

SEQ ID NO: 2075006 - RNA, 14 nt, Staphylococcus aureus subsp. aureus Mu50
aaauaacuucguuu

SEQ ID NO: 2075007 - RNA, 21 nt, Staphylococcus aureus subsp. aureus Mu50
aaauaacguuaauauaauuaa

SEQ ID NO: 2075008 - RNA, 12 nt, Staphylococcus aureus subsp. aureus Mu50
aaauaaauuaaa

SEQ ID NO: 2075009 - RNA, 15 nt, Staphylococcus aureus subsp. aureus Mu50
aaauaaauuaaauuu

SEQ ID NO: 2075010 - RNA, 19 nt, Staphylococcus aureus subsp. aureus Mu50
aaauaaaugacauuuaaua

SEQ ID NO: 2075011 - RNA, 19 nt, Staphylococcus aureus subsp. aureus Mu50
aaauaaauuuuacgaaaau

SEQ ID NO: 2075012 - RNA, 22 nt, Staphylococcus aureus subsp. aureus Mu50
aaauaaacgauugauuaucaua

SEQ ID NO: 2075013 - RNA, 16 nt, Staphylococcus aureus subsp. aureus Mu50
aaauaacaaacauuaa

SEQ ID NO: 2075014 - RNA, 15 nt, Staphylococcus aureus subsp. aureus Mu50
aaagucauuaaaugu

SEQ ID NO: 2075015 - RNA, 17 nt, Staphylococcus aureus subsp. aureus Mu50
aaagucauuaaauguac

SEQ ID NO: 2075016 - RNA, 21 nt, Staphylococcus aureus subsp. aureus Mu50
aaauaaaacgacucauuauaa

SEQ ID NO: 2075017 - RNA, 15 nt, Staphylococcus aureus subsp. aureus Mu50
aaauaaaauuaaaac

SEQ ID NO: 2075018 - RNA, 12 nt, Staphylococcus aureus subsp. aureus Mu50
aaauaaaaugcu

SEQ ID NO: 2075019 - RNA, 14 nt, Staphylococcus aureus subsp. aureus Mu50
aaauaaaauuaaaa

SEQ ID NO: 2075020 - RNA, 12 nt, Staphylococcus aureus subsp. aureus Mu50
aaauaaaauuuu

SEQ ID NO: 2075021 - RNA, 21 nt, Staphylococcus aureus subsp. aureus Mu50
aaauacuugaauuuaauaagu

SEQ ID NO: 2075022 - RNA, 22 nt, Staphylococcus aureus subsp. aureus Mu50
aaauacuuguuuaccuaaaucu

SEQ ID NO: 2075023 - RNA, 20 nt, Staphylococcus aureus subsp. aureus Mu50
aaauagccauauucauauua

SEQ ID NO: 2075024 - RNA, 22 nt, Staphylococcus aureus subsp. aureus Mu50
aaauagcugcaaucguugaaaa

SEQ ID NO: 2075025 - RNA, 15 nt, Staphylococcus aureus subsp. aureus Mu50
aaauagcuauuaaaa

SEQ ID NO: 2075026 - RNA, 16 nt, Staphylococcus aureus subsp. aureus Mu50
aaauagcuauuaaaau

SEQ ID NO: 2075027 - RNA, 17 nt, Staphylococcus aureus subsp. aureus Mu50
aaauagcuauuaaaaua

SEQ ID NO: 2075028 - RNA, 17 nt, Staphylococcus aureus subsp. aureus Mu50
aaauagcguaauuauua

SEQ ID NO: 2075029 - RNA, 16 nt, Staphylococcus aureus subsp. aureus Mu50
aaauacgguacagaua

SEQ ID NO: 2075030 - RNA, 20 nt, Staphylococcus aureus subsp. aureus Mu50
aaauacguaucaagaaaaag

SEQ ID NO: 2075031 - RNA, 23 nt, Staphylococcus aureus subsp. aureus Mu50
aaauaaugauauauuacaccauu

SEQ ID NO: 2075032 - RNA, 21 nt, Staphylococcus aureus subsp. aureus Mu50
aaauaaugaugcauaagauuu

SEQ ID NO: 2075033 - RNA, 19 nt, Staphylococcus aureus subsp. aureus Mu50
aaauacucccuucaacaua

SEQ ID NO: 2075034 - RNA, 14 nt, Staphylococcus aureus subsp. aureus Mu50
aaauacuauacuga

SEQ ID NO: 2075035 - RNA, 15 nt, Staphylococcus aureus subsp. aureus Mu50
aaauacuauacugau

SEQ ID NO: 2075036 - RNA, 20 nt, Staphylococcus aureus subsp. aureus Mu50
aaauacuauacugaugaaaa

SEQ ID NO: 2075037 - RNA, 18 nt, Staphylococcus aureus subsp. aureus Mu50
aaauacuauauauaauga

SEQ ID NO: 2075038 - RNA, 16 nt, Staphylococcus aureus subsp. aureus Mu50
aaauacuauucuuucu

SEQ ID NO: 2075039 - RNA, 15 nt, Staphylococcus aureus subsp. aureus Mu50
aaauacuaacaauua

SEQ ID NO: 2075040 - RNA, 15 nt, Staphylococcus aureus subsp. aureus Mu50
aaauacuaagauuag

SEQ ID NO: 2075041 - RNA, 15 nt, Staphylococcus aureus subsp. aureus Mu50
aaauaaucucuucaa

SEQ ID NO: 2075042 - RNA, 11 nt, Staphylococcus aureus subsp. aureus Mu50
aaauaaugaau

SEQ ID NO: 2075043 - RNA, 17 nt, Staphylococcus aureus subsp. aureus Mu50
aaauaaucgaacagaaa

SEQ ID NO: 2075044 - RNA, 19 nt, Staphylococcus aureus subsp. aureus Mu50
aaauaaucgaacagaaaau

SEQ ID NO: 2075045 - RNA, 13 nt, Staphylococcus aureus subsp. aureus Mu50
aaauaaucgaaga

SEQ ID NO: 2075046 - RNA, 17 nt, Staphylococcus aureus subsp. aureus Mu50
aaauaaucccaaccauu

SEQ ID NO: 2075047 - RNA, 14 nt, Staphylococcus aureus subsp. aureus Mu50
aaauaauauaaaaa

SEQ ID NO: 2075048 - RNA, 16 nt, Staphylococcus aureus subsp. aureus Mu50
aaauaauauaaaacga

SEQ ID NO: 2075049 - RNA, 22 nt, Staphylococcus aureus subsp. aureus Mu50
aaauaauaugaauuuagaugca

SEQ ID NO: 2075050 - RNA, 16 nt, Staphylococcus aureus subsp. aureus Mu50
aaauauuggaauacuc

SEQ ID NO: 2075051 - RNA, 14 nt, Staphylococcus aureus subsp. aureus Mu50
aaauauucuuaucu

SEQ ID NO: 2075052 - RNA, 14 nt, Staphylococcus aureus subsp. aureus Mu50
aaauauugaacaau

SEQ ID NO: 2075053 - RNA, 18 nt, Staphylococcus aureus subsp. aureus Mu50
aaauauuauuaaaucaaa

SEQ ID NO: 2075054 - RNA, 19 nt, Staphylococcus aureus subsp. aureus Mu50
aaauauugcguuuaauuua

SEQ ID NO: 2075055 - RNA, 16 nt, Staphylococcus aureus subsp. aureus Mu50
aaauauuuaaaauauu

SEQ ID NO: 2075056 - RNA, 15 nt, Staphylococcus aureus subsp. aureus Mu50
aaauauuuaucuuua

SEQ ID NO: 2075057 - RNA, 20 nt, Staphylococcus aureus subsp. aureus Mu50
aaauauuuaaccuuuaaaac

SEQ ID NO: 2075058 - RNA, 11 nt, Staphylococcus aureus subsp. aureus Mu50
aaauauuuaau

SEQ ID NO: 2075059 - RNA, 21 nt, Staphylococcus aureus subsp. aureus Mu50
aaauauuuacauugccacuuu

SEQ ID NO: 2075060 - RNA, 23 nt, Staphylococcus aureus subsp. aureus Mu50
aaauauuuuuaauuauuuuaaaa

SEQ ID NO: 2075061 - RNA, 20 nt, Staphylococcus aureus subsp. aureus Mu50
aaauauuugaaaauuucacc

SEQ ID NO: 2075062 - RNA, 15 nt, Staphylococcus aureus subsp. aureus Mu50
aaauauuuaaacuag

SEQ ID NO: 2075063 - RNA, 12 nt, Staphylococcus aureus subsp. aureus Mu50
aaauauuugaaa

SEQ ID NO: 2075064 - RNA, 13 nt, Staphylococcus aureus subsp. aureus Mu50
aaauauuugaaaa

SEQ ID NO: 2075065 - RNA, 15 nt, Staphylococcus aureus subsp. aureus Mu50
aaauauuuuaucugu

SEQ ID NO: 2075066 - RNA, 18 nt, Staphylococcus aureus subsp. aureus Mu50
aaauauuuuaucuguaaa

SEQ ID NO: 2075067 - RNA, 14 nt, Staphylococcus aureus subsp. aureus Mu50
aaaucaaaaauaau

SEQ ID NO: 2075068 - RNA, 18 nt, Staphylococcus aureus subsp. aureus Mu50
aaauagucggggccccaa

SEQ ID NO: 2075069 - RNA, 18 nt, Staphylococcus aureus subsp. aureus Mu50
aaauaguuaagauuuuaa

SEQ ID NO: 2075070 - RNA, 22 nt, Staphylococcus aureus subsp. aureus Mu50
aaauaggcgcuuguaaaauuuu

SEQ ID NO: 2075071 - RNA, 18 nt, Staphylococcus aureus subsp. aureus Mu50
aaauaggcgcuuguaaaa

SEQ ID NO: 2075072 - RNA, 11 nt, Staphylococcus aureus subsp. aureus Mu50
aaauauuauuu

SEQ ID NO: 2075073 - RNA, 13 nt, Staphylococcus aureus subsp. aureus Mu50
aaauauuauuaaa

SEQ ID NO: 2075074 - RNA, 15 nt, Staphylococcus aureus subsp. aureus Mu50
aaauauuauuaaauc

SEQ ID NO: 2075075 - RNA, 15 nt, Staphylococcus aureus subsp. aureus Mu50
aaauaugauuuaaaa

SEQ ID NO: 2075076 - RNA, 15 nt, Staphylococcus aureus subsp. aureus Mu50
aaauauggauuuuga

SEQ ID NO: 2075077 - RNA, 15 nt, Staphylococcus aureus subsp. aureus Mu50
aaauaugacacauac

SEQ ID NO: 2075078 - RNA, 12 nt, Staphylococcus aureus subsp. aureus Mu50
aaaucaccaaca

SEQ ID NO: 2075079 - RNA, 20 nt, Staphylococcus aureus subsp. aureus Mu50
aaaucacauaugauaauuaa

SEQ ID NO: 2075080 - RNA, 15 nt, Staphylococcus aureus subsp. aureus Mu50
aaaucaauccaucaa

SEQ ID NO: 2075081 - RNA, 12 nt, Staphylococcus aureus subsp. aureus Mu50
aaaucaagaaau

SEQ ID NO: 2075082 - RNA, 14 nt, Staphylococcus aureus subsp. aureus Mu50
aaaucaaguguugu

SEQ ID NO: 2075083 - RNA, 21 nt, Staphylococcus aureus subsp. aureus Mu50
aaaucaaauauacuuuuacca

SEQ ID NO: 2075084 - RNA, 12 nt, Staphylococcus aureus subsp. aureus Mu50
aaaucaauccau

SEQ ID NO: 2075085 - RNA, 13 nt, Staphylococcus aureus subsp. aureus Mu50
aaaucaauaccaa

SEQ ID NO: 2075086 - RNA, 15 nt, Staphylococcus aureus subsp. aureus Mu50
aaaucaguaauauca

SEQ ID NO: 2075087 - RNA, 13 nt, Staphylococcus aureus subsp. aureus Mu50
aaaucauaaauaa

SEQ ID NO: 2075088 - RNA, 18 nt, Staphylococcus aureus subsp. aureus Mu50
aaaucaguuuuuaaauca

SEQ ID NO: 2075089 - RNA, 18 nt, Staphylococcus aureus subsp. aureus Mu50
aaaucagucauucacaua

SEQ ID NO: 2075090 - RNA, 14 nt, Staphylococcus aureus subsp. aureus Mu50
aaaucauaaauaac

SEQ ID NO: 2075091 - RNA, 15 nt, Staphylococcus aureus subsp. aureus Mu50
aaaucacugcuuuca

SEQ ID NO: 2075092 - RNA, 17 nt, Staphylococcus aureus subsp. aureus Mu50
aaaucaccuuuuuuaac

SEQ ID NO: 2075093 - RNA, 19 nt, Staphylococcus aureus subsp. aureus Mu50
aaaucacugcuuucaagua

SEQ ID NO: 2075094 - RNA, 13 nt, Staphylococcus aureus subsp. aureus Mu50
aaaguauauugcu

SEQ ID NO: 2075095 - RNA, 15 nt, Staphylococcus aureus subsp. aureus Mu50
aaaguaucagucauu

SEQ ID NO: 2075096 - RNA, 19 nt, Staphylococcus aureus subsp. aureus Mu50
aaaguacuuacaaauauac

SEQ ID NO: 2075097 - RNA, 15 nt, Staphylococcus aureus subsp. aureus Mu50
aaaguauauugcuua

SEQ ID NO: 2075098 - RNA, 12 nt, Staphylococcus aureus subsp. aureus Mu50
aaaguacucaag

SEQ ID NO: 2075099 - RNA, 17 nt, Staphylococcus aureus subsp. aureus Mu50
aaaguaccuaaaauaga

SEQ ID NO: 2075100 - RNA, 17 nt, Staphylococcus aureus subsp. aureus Mu50
aaaguaauuaaauacuu

SEQ ID NO: 2075101 - RNA, 14 nt, Staphylococcus aureus subsp. aureus Mu50
aaagucaauuuaaa

SEQ ID NO: 2075102 - RNA, 20 nt, Staphylococcus aureus subsp. aureus Mu50
aaagucauaggcuugccaau

SEQ ID NO: 2075103 - RNA, 13 nt, Staphylococcus aureus subsp. aureus Mu50
aaagucaacaauu

SEQ ID NO: 2075104 - RNA, 14 nt, Staphylococcus aureus subsp. aureus Mu50
aaaguauuacuuua

SEQ ID NO: 2075105 - RNA, 22 nt, Staphylococcus aureus subsp. aureus Mu50
aaaguaucuaugaaauuuuuua

SEQ ID NO: 2075106 - RNA, 15 nt, Staphylococcus aureus subsp. aureus Mu50
aaaggcauucuucca

SEQ ID NO: 2075107 - RNA, 17 nt, Staphylococcus aureus subsp. aureus Mu50
aaagggcuauuugauac

SEQ ID NO: 2075108 - RNA, 14 nt, Staphylococcus aureus subsp. aureus Mu50
aaagguuaaauauu

SEQ ID NO: 2075109 - RNA, 21 nt, Staphylococcus aureus subsp. aureus Mu50
aaagguuuacuauuaaaggaa

SEQ ID NO: 2075110 - RNA, 23 nt, Staphylococcus aureus subsp. aureus Mu50
aaagguuguuuuucaucauuaaa

SEQ ID NO: 2075111 - RNA, 22 nt, Staphylococcus aureus subsp. aureus Mu50
aaagcccuauuguuuuuuauaa

SEQ ID NO: 2075112 - RNA, 15 nt, Staphylococcus aureus subsp. aureus Mu50
aaagcccuaagcucg

SEQ ID NO: 2075113 - RNA, 14 nt, Staphylococcus aureus subsp. aureus Mu50
aaagcuaaugcaag

SEQ ID NO: 2075114 - RNA, 13 nt, Staphylococcus aureus subsp. aureus Mu50
aaagcuauaaaaa

SEQ ID NO: 2075115 - RNA, 18 nt, Staphylococcus aureus subsp. aureus Mu50
aaagcuauaaaaaaucuu

SEQ ID NO: 2075116 - RNA, 16 nt, Staphylococcus aureus subsp. aureus Mu50
aaagcgugguucccaa

SEQ ID NO: 2075117 - RNA, 17 nt, Staphylococcus aureus subsp. aureus Mu50
aaagcguucaauuuuug

SEQ ID NO: 2075118 - RNA, 23 nt, Staphylococcus aureus subsp. aureus Mu50
aaagcuggggaagaccauuuuau

SEQ ID NO: 2075119 - RNA, 20 nt, Staphylococcus aureus subsp. aureus Mu50
aaaggaaggauuuuagauuu

SEQ ID NO: 2075120 - RNA, 12 nt, Staphylococcus aureus subsp. aureus Mu50
aaagauauaaac

SEQ ID NO: 2075121 - RNA, 14 nt, Staphylococcus aureus subsp. aureus Mu50
aaagauauagaauu

SEQ ID NO: 2075122 - RNA, 21 nt, Staphylococcus aureus subsp. aureus Mu50
aaagauauguuuauauugcaa

SEQ ID NO: 2075123 - RNA, 15 nt, Staphylococcus aureus subsp. aureus Mu50
aaagcaaaggcgcac

SEQ ID NO: 2075124 - RNA, 19 nt, Staphylococcus aureus subsp. aureus Mu50
aaagcaaauuauauagaaa

SEQ ID NO: 2075125 - RNA, 11 nt, Staphylococcus aureus subsp. aureus Mu50
aaagauuucag

SEQ ID NO: 2075126 - RNA, 14 nt, Staphylococcus aureus subsp. aureus Mu50
aaagaucauuaaaa

SEQ ID NO: 2075127 - RNA, 13 nt, Staphylococcus aureus subsp. aureus Mu50
aaagaucauuaaa

SEQ ID NO: 2075128 - RNA, 21 nt, Staphylococcus aureus subsp. aureus Mu50
aaagcacccuaauuuguuagu

SEQ ID NO: 2075129 - RNA, 15 nt, Staphylococcus aureus subsp. aureus Mu50
aaagccaauuaauaa

SEQ ID NO: 2075130 - RNA, 18 nt, Staphylococcus aureus subsp. aureus Mu50
aaagccaccuaaaucucc

SEQ ID NO: 2075131 - RNA, 18 nt, Staphylococcus aureus subsp. aureus Mu50
aaagacguuuuuuuauaa

SEQ ID NO: 2075132 - RNA, 19 nt, Staphylococcus aureus subsp. aureus Mu50
aaagacuagccauaccuua

SEQ ID NO: 2075133 - RNA, 22 nt, Staphylococcus aureus subsp. aureus Mu50
aaagacgauuuauuaguuuuua

SEQ ID NO: 2075134 - RNA, 12 nt, Staphylococcus aureus subsp. aureus Mu50
aaagaauaugau

SEQ ID NO: 2075135 - RNA, 16 nt, Staphylococcus aureus subsp. aureus Mu50
aaagacucauacacaa

SEQ ID NO: 2075136 - RNA, 22 nt, Staphylococcus aureus subsp. aureus Mu50
aaagacucaauuucauuugaaa

SEQ ID NO: 2075137 - RNA, 23 nt, Staphylococcus aureus subsp. aureus Mu50
aaagagaaucgaaccaaauuuua

SEQ ID NO: 2075138 - RNA, 19 nt, Staphylococcus aureus subsp. aureus Mu50
aaagagccagacgccaaga

SEQ ID NO: 2075139 - RNA, 19 nt, Staphylococcus aureus subsp. aureus Mu50
aaacuucuuuucuuugaua

SEQ ID NO: 2075140 - RNA, 14 nt, Staphylococcus aureus subsp. aureus Mu50
aaacuucuuuucuu

SEQ ID NO: 2075141 - RNA, 17 nt, Staphylococcus aureus subsp. aureus Mu50
aaacuucuuuucuuuga

SEQ ID NO: 2075142 - RNA, 22 nt, Staphylococcus aureus subsp. aureus Mu50
aaacuucuuguuucaaacaaag

SEQ ID NO: 2075143 - RNA, 10 nt, Staphylococcus aureus subsp. aureus Mu50
aaacuucuuu

SEQ ID NO: 2075144 - RNA, 15 nt, Staphylococcus aureus subsp. aureus Mu50
aaacuuauaacuuua

SEQ ID NO: 2075145 - RNA, 14 nt, Staphylococcus aureus subsp. aureus Mu50
aaacuuaagaauac

SEQ ID NO: 2075146 - RNA, 17 nt, Staphylococcus aureus subsp. aureus Mu50
aaacuuacauuacauau

SEQ ID NO: 2075147 - RNA, 20 nt, Staphylococcus aureus subsp. aureus Mu50
aaacugauugggcugauaau

SEQ ID NO: 2075148 - RNA, 22 nt, Staphylococcus aureus subsp. aureus Mu50
aaacugaguucaauuaaauuau

SEQ ID NO: 2075149 - RNA, 17 nt, Staphylococcus aureus subsp. aureus Mu50
aaacugugcaugacgau

SEQ ID NO: 2075150 - RNA, 23 nt, Staphylococcus aureus subsp. aureus Mu50
aaacuuaaauauucuuaucugua

SEQ ID NO: 2075151 - RNA, 20 nt, Staphylococcus aureus subsp. aureus Mu50
aaacucaugcauaagaaaua

SEQ ID NO: 2075152 - RNA, 23 nt, Staphylococcus aureus subsp. aureus Mu50
aaacucauccauugaucuuuuau

SEQ ID NO: 2075153 - RNA, 22 nt, Staphylococcus aureus subsp. aureus Mu50
aaacucguaaauuuuaucuaaa

SEQ ID NO: 2075154 - RNA, 18 nt, Staphylococcus aureus subsp. aureus Mu50
aaacucguaaauuuuauc

SEQ ID NO: 2075155 - RNA, 17 nt, Staphylococcus aureus subsp. aureus Mu50
aaacuacaaguggauau

SEQ ID NO: 2075156 - RNA, 22 nt, Staphylococcus aureus subsp. aureus Mu50
aaacuaauaauuuguaauuccu

SEQ ID NO: 2075157 - RNA, 12 nt, Staphylococcus aureus subsp. aureus Mu50
aaacuaauagca

SEQ ID NO: 2075158 - RNA, 15 nt, Staphylococcus aureus subsp. aureus Mu50
aaacuacgaauucuc

SEQ ID NO: 2075159 - RNA, 13 nt, Staphylococcus aureus subsp. aureus Mu50
aaacuagcaguaa

SEQ ID NO: 2075160 - RNA, 21 nt, Staphylococcus aureus subsp. aureus Mu50
aaacuauaauaauuggaauca

SEQ ID NO: 2075161 - RNA, 14 nt, Staphylococcus aureus subsp. aureus Mu50
aaacgccuuuccau

SEQ ID NO: 2075162 - RNA, 20 nt, Staphylococcus aureus subsp. aureus Mu50
aaacgguacagauaagaaua

SEQ ID NO: 2075163 - RNA, 22 nt, Staphylococcus aureus subsp. aureus Mu50
aaacguaucauuuaaaauauuu

SEQ ID NO: 2075164 - RNA, 17 nt, Staphylococcus aureus subsp. aureus Mu50
aaacgugacauuuucaa

SEQ ID NO: 2075165 - RNA, 15 nt, Staphylococcus aureus subsp. aureus Mu50
aaacuaaauuaaaag

SEQ ID NO: 2075166 - RNA, 14 nt, Staphylococcus aureus subsp. aureus Mu50
aaacuaaauuaaaa

SEQ ID NO: 2075167 - RNA, 16 nt, Staphylococcus aureus subsp. aureus Mu50
aaaccugggacauuaa

SEQ ID NO: 2075168 - RNA, 17 nt, Staphylococcus aureus subsp. aureus Mu50
aaaccugggacauuaau

SEQ ID NO: 2075169 - RNA, 19 nt, Staphylococcus aureus subsp. aureus Mu50
aaacaagccuuaaaauauu

SEQ ID NO: 2075170 - RNA, 18 nt, Staphylococcus aureus subsp. aureus Mu50
aaaccuuuucaaauuaua

SEQ ID NO: 2075171 - RNA, 19 nt, Staphylococcus aureus subsp. aureus Mu50
aaacgacucauuauaaaug

SEQ ID NO: 2075172 - RNA, 16 nt, Staphylococcus aureus subsp. aureus Mu50
aaacgagacaucaucu

SEQ ID NO: 2075173 - RNA, 20 nt, Staphylococcus aureus subsp. aureus Mu50
aaacgagcuggugagaaauu

SEQ ID NO: 2075174 - RNA, 22 nt, Staphylococcus aureus subsp. aureus Mu50
aaacgauauagaccguugaaau

SEQ ID NO: 2075175 - RNA, 15 nt, Staphylococcus aureus subsp. aureus Mu50
aaacgauauagaccg

SEQ ID NO: 2075176 - RNA, 19 nt, Staphylococcus aureus subsp. aureus Mu50
aaacgauaagaauuaacaa

SEQ ID NO: 2075177 - RNA, 21 nt, Staphylococcus aureus subsp. aureus Mu50
aaacgcacuaucaaugacauc

SEQ ID NO: 2075178 - RNA, 19 nt, Staphylococcus aureus subsp. aureus Mu50
aaacgcacuauuuuuauaa

SEQ ID NO: 2075179 - RNA, 21 nt, Staphylococcus aureus subsp. aureus Mu50
aaacgcaauacgaauaucugu

SEQ ID NO: 2075180 - RNA, 15 nt, Staphylococcus aureus subsp. aureus Mu50
aaacgccucaacacu

SEQ ID NO: 2075181 - RNA, 19 nt, Staphylococcus aureus subsp. aureus Mu50
auuuaacauguauuuagua

SEQ ID NO: 2075182 - RNA, 23 nt, Staphylococcus aureus subsp. aureus Mu50
auuuaaccaguucgaaaauuaua

SEQ ID NO: 2075183 - RNA, 15 nt, Staphylococcus aureus subsp. aureus Mu50
auuuaaccuuuaaaa

SEQ ID NO: 2075184 - RNA, 13 nt, Staphylococcus aureus subsp. aureus Mu50
auuuaauaacgaa

SEQ ID NO: 2075185 - RNA, 14 nt, Staphylococcus aureus subsp. aureus Mu50
auuuaauaaaccag

SEQ ID NO: 2075186 - RNA, 18 nt, Staphylococcus aureus subsp. aureus Mu50
auuuaauaaaccagugcg

SEQ ID NO: 2075187 - RNA, 20 nt, Staphylococcus aureus subsp. aureus Mu50
auuuaauaaguuaauguaau

SEQ ID NO: 2075188 - RNA, 13 nt, Staphylococcus aureus subsp. aureus Mu50
auuuaauaaugcu

SEQ ID NO: 2075189 - RNA, 20 nt, Staphylococcus aureus subsp. aureus Mu50
auuuaauaacguacauuuau

SEQ ID NO: 2075190 - RNA, 19 nt, Staphylococcus aureus subsp. aureus Mu50
auuuaauaucacgaucuuu

SEQ ID NO: 2075191 - RNA, 20 nt, Staphylococcus aureus subsp. aureus Mu50
auuuaauacuuuucucgauu

SEQ ID NO: 2075192 - RNA, 18 nt, Staphylococcus aureus subsp. aureus Mu50
auuuauacugaucaaaug

SEQ ID NO: 2075193 - RNA, 21 nt, Staphylococcus aureus subsp. aureus Mu50
auuuauacuugaugaaacuga

SEQ ID NO: 2075194 - RNA, 15 nt, Staphylococcus aureus subsp. aureus Mu50
auuuauacagugaau

SEQ ID NO: 2075195 - RNA, 15 nt, Staphylococcus aureus subsp. aureus Mu50
auuuauacuauaaau

SEQ ID NO: 2075196 - RNA, 16 nt, Staphylococcus aureus subsp. aureus Mu50
auuuauacuauaaaua

SEQ ID NO: 2075197 - RNA, 13 nt, Staphylococcus aureus subsp. aureus Mu50
auuuauagauuua

SEQ ID NO: 2075198 - RNA, 21 nt, Staphylococcus aureus subsp. aureus Mu50
auuuauauagucuaugaauaa

SEQ ID NO: 2075199 - RNA, 19 nt, Staphylococcus aureus subsp. aureus Mu50
auuuauauagucuaugaau

SEQ ID NO: 2075200 - RNA, 21 nt, Staphylococcus aureus subsp. aureus Mu50
auuuauaugauguucaauauu

SEQ ID NO: 2075201 - RNA, 17 nt, Staphylococcus aureus subsp. aureus Mu50
auuuauaugauguucaa

SEQ ID NO: 2075202 - RNA, 19 nt, Staphylococcus aureus subsp. aureus Mu50
aaaagucccgcuuaaaaug

SEQ ID NO: 2075203 - RNA, 23 nt, Staphylococcus aureus subsp. aureus Mu50
aaaaguauugccguuauuuucaa

SEQ ID NO: 2075204 - RNA, 21 nt, Staphylococcus aureus subsp. aureus Mu50
aaaagucagcuuacaauaaug

SEQ ID NO: 2075205 - RNA, 14 nt, Staphylococcus aureus subsp. aureus Mu50
aaaaguauuacuuu

SEQ ID NO: 2075206 - RNA, 17 nt, Staphylococcus aureus subsp. aureus Mu50
auuuaucaauuucuauu

SEQ ID NO: 2075207 - RNA, 17 nt, Staphylococcus aureus subsp. aureus Mu50
auuuaucaccuuuaggc

SEQ ID NO: 2075208 - RNA, 22 nt, Staphylococcus aureus subsp. aureus Mu50
auuuaucgcgauuauuaccaua

SEQ ID NO: 2075209 - RNA, 17 nt, Staphylococcus aureus subsp. aureus Mu50
auuuauuuuugauagug

SEQ ID NO: 2075210 - RNA, 17 nt, Staphylococcus aureus subsp. aureus Mu50
auuuauuuauaaaauaa

SEQ ID NO: 2075211 - RNA, 20 nt, Staphylococcus aureus subsp. aureus Mu50
auuuauuuauaaaauaaaau

SEQ ID NO: 2075212 - RNA, 15 nt, Staphylococcus aureus subsp. aureus Mu50
auuuauuuucuuugg

SEQ ID NO: 2075213 - RNA, 19 nt, Staphylococcus aureus subsp. aureus Mu50
auuuauuuucaauaaauaa

SEQ ID NO: 2075214 - RNA, 20 nt, Staphylococcus aureus subsp. aureus Mu50
auuucaaugagaagcugucu

SEQ ID NO: 2075215 - RNA, 13 nt, Staphylococcus aureus subsp. aureus Mu50
auuucaauuugga

SEQ ID NO: 2075216 - RNA, 17 nt, Staphylococcus aureus subsp. aureus Mu50
auuucaauuuggaaaua

SEQ ID NO: 2075217 - RNA, 15 nt, Staphylococcus aureus subsp. aureus Mu50
auuuauuauaaaaua

SEQ ID NO: 2075218 - RNA, 14 nt, Staphylococcus aureus subsp. aureus Mu50
auuuauuauuacca

SEQ ID NO: 2075219 - RNA, 18 nt, Staphylococcus aureus subsp. aureus Mu50
auuuauuauaauuguuca

SEQ ID NO: 2075220 - RNA, 14 nt, Staphylococcus aureus subsp. aureus Mu50
auuuauuauaaaau

SEQ ID NO: 2075221 - RNA, 15 nt, Staphylococcus aureus subsp. aureus Mu50
auuuauguuuucuag

SEQ ID NO: 2075222 - RNA, 14 nt, Staphylococcus aureus subsp. aureus Mu50
auuuauuaaauaua

SEQ ID NO: 2075223 - RNA, 14 nt, Staphylococcus aureus subsp. aureus Mu50
auuuauuaaggcaa

SEQ ID NO: 2075224 - RNA, 16 nt, Staphylococcus aureus subsp. aureus Mu50
auuuauucuaaauaua

SEQ ID NO: 2075225 - RNA, 21 nt, Staphylococcus aureus subsp. aureus Mu50
auuuaucuuuagagacuuauu

SEQ ID NO: 2075226 - RNA, 17 nt, Staphylococcus aureus subsp. aureus Mu50
auuuaucuuuuaaaauc

SEQ ID NO: 2075227 - RNA, 17 nt, Staphylococcus aureus subsp. aureus Mu50
auuuauguguuggcuuu

SEQ ID NO: 2075228 - RNA, 20 nt, Staphylococcus aureus subsp. aureus Mu50
auuuaucuugauuuuauaaa

SEQ ID NO: 2075229 - RNA, 17 nt, Staphylococcus aureus subsp. aureus Mu50
aaaagugcgauuaucag

SEQ ID NO: 2075230 - RNA, 23 nt, Staphylococcus aureus subsp. aureus Mu50
aaaagugcaaguccaaauaauau

SEQ ID NO: 2075231 - RNA, 23 nt, Staphylococcus aureus subsp. aureus Mu50
aaaagugaaaguauuagauauau

SEQ ID NO: 2075232 - RNA, 22 nt, Staphylococcus aureus subsp. aureus Mu50
auuucgcuuuuuuuauuuuucu

SEQ ID NO: 2075233 - RNA, 18 nt, Staphylococcus aureus subsp. aureus Mu50
auuucacgcugaaauuuu

SEQ ID NO: 2075234 - RNA, 21 nt, Staphylococcus aureus subsp. aureus Mu50
auuucacgcugaaauuuuuua

SEQ ID NO: 2075235 - RNA, 14 nt, Staphylococcus aureus subsp. aureus Mu50
auuucaauuuggaa

SEQ ID NO: 2075236 - RNA, 20 nt, Staphylococcus aureus subsp. aureus Mu50
auuucaggcguuaauacaua

SEQ ID NO: 2075237 - RNA, 19 nt, Staphylococcus aureus subsp. aureus Mu50
auuucaguaccauguuuuu

SEQ ID NO: 2075238 - RNA, 15 nt, Staphylococcus aureus subsp. aureus Mu50
auuucaguucaucau

SEQ ID NO: 2075239 - RNA, 18 nt, Staphylococcus aureus subsp. aureus Mu50
auuucgguauuuuaaauu

SEQ ID NO: 2075240 - RNA, 16 nt, Staphylococcus aureus subsp. aureus Mu50
auuucugaauuuuuca

SEQ ID NO: 2075241 - RNA, 22 nt, Staphylococcus aureus subsp. aureus Mu50
auuucugaaaugauacauuauu

SEQ ID NO: 2075242 - RNA, 20 nt, Staphylococcus aureus subsp. aureus Mu50
auuucucguuucgucagauu

SEQ ID NO: 2075243 - RNA, 18 nt, Staphylococcus aureus subsp. aureus Mu50
auuucuguaccaaauuug

SEQ ID NO: 2075244 - RNA, 15 nt, Staphylococcus aureus subsp. aureus Mu50
auuugaaauauacca

SEQ ID NO: 2075245 - RNA, 19 nt, Staphylococcus aureus subsp. aureus Mu50
auuucuuaacauccuuuga

SEQ ID NO: 2075246 - RNA, 14 nt, Staphylococcus aureus subsp. aureus Mu50
auuuucaucauuaa

SEQ ID NO: 2075247 - RNA, 23 nt, Staphylococcus aureus subsp. aureus Mu50
auuuucaagaccaaauauuuuau

SEQ ID NO: 2075248 - RNA, 21 nt, Staphylococcus aureus subsp. aureus Mu50
auuuucaauaaauuuuauaua

SEQ ID NO: 2075249 - RNA, 13 nt, Staphylococcus aureus subsp. aureus Mu50
auuuucaauacuu

SEQ ID NO: 2075250 - RNA, 16 nt, Staphylococcus aureus subsp. aureus Mu50
auuuucaauaaaaaug

SEQ ID NO: 2075251 - RNA, 16 nt, Staphylococcus aureus subsp. aureus Mu50
auuuucaauaaauuuu

SEQ ID NO: 2075252 - RNA, 19 nt, Staphylococcus aureus subsp. aureus Mu50
auuuucaauaaauuuuaua

SEQ ID NO: 2075253 - RNA, 22 nt, Staphylococcus aureus subsp. aureus Mu50
auuuucaaugauuaaaucuucu

SEQ ID NO: 2075254 - RNA, 23 nt, Staphylococcus aureus subsp. aureus Mu50
auuuucacaaucauagauauaag

SEQ ID NO: 2075255 - RNA, 21 nt, Staphylococcus aureus subsp. aureus Mu50
auuuucacaaucauagauaua

SEQ ID NO: 2075256 - RNA, 11 nt, Staphylococcus aureus subsp. aureus Mu50
auuuucaaaac

SEQ ID NO: 2075257 - RNA, 15 nt, Staphylococcus aureus subsp. aureus Mu50
auuuucaaaacugcc

SEQ ID NO: 2075258 - RNA, 19 nt, Staphylococcus aureus subsp. aureus Mu50
auuuucaaaaccaauuaau

SEQ ID NO: 2075259 - RNA, 20 nt, Staphylococcus aureus subsp. aureus Mu50
auuuucaacacacuauuaua

SEQ ID NO: 2075260 - RNA, 16 nt, Staphylococcus aureus subsp. aureus Mu50
auuuucaacacacuau

SEQ ID NO: 2075261 - RNA, 19 nt, Staphylococcus aureus subsp. aureus Mu50
auuuucaagaccaaauauu

SEQ ID NO: 2075262 - RNA, 14 nt, Staphylococcus aureus subsp. aureus Mu50
auuuuauaaaguuu

SEQ ID NO: 2075263 - RNA, 22 nt, Staphylococcus aureus subsp. aureus Mu50
auuuuauaagaauuuaaaagag

SEQ ID NO: 2075264 - RNA, 18 nt, Staphylococcus aureus subsp. aureus Mu50
auuuuauacauaaauauu

SEQ ID NO: 2075265 - RNA, 14 nt, Staphylococcus aureus subsp. aureus Mu50
auuuuauauaaaaa

SEQ ID NO: 2075266 - RNA, 18 nt, Staphylococcus aureus subsp. aureus Mu50
auuuuauauaaaaagaag

SEQ ID NO: 2075267 - RNA, 16 nt, Staphylococcus aureus subsp. aureus Mu50
auuuuaucugaaaaua

SEQ ID NO: 2075268 - RNA, 22 nt, Staphylococcus aureus subsp. aureus Mu50
auuuuaucuaaagcuauaaaaa

SEQ ID NO: 2075269 - RNA, 15 nt, Staphylococcus aureus subsp. aureus Mu50
auuuuaucaaauuca

SEQ ID NO: 2075270 - RNA, 17 nt, Staphylococcus aureus subsp. aureus Mu50
auuuuaggcaauguaau

SEQ ID NO: 2075271 - RNA, 19 nt, Staphylococcus aureus subsp. aureus Mu50
auuuuaggcaauguaaugg

SEQ ID NO: 2075272 - RNA, 15 nt, Staphylococcus aureus subsp. aureus Mu50
auuuuaguucacaug

SEQ ID NO: 2075273 - RNA, 20 nt, Staphylococcus aureus subsp. aureus Mu50
auuuuaguucacaugaauuu

SEQ ID NO: 2075274 - RNA, 21 nt, Staphylococcus aureus subsp. aureus Mu50
auuuuagucgucgaaaugccu

SEQ ID NO: 2075275 - RNA, 18 nt, Staphylococcus aureus subsp. aureus Mu50
auuuuagauuuaguuuuu

SEQ ID NO: 2075276 - RNA, 16 nt, Staphylococcus aureus subsp. aureus Mu50
auuuuagcaaaagcuu

SEQ ID NO: 2075277 - RNA, 14 nt, Staphylococcus aureus subsp. aureus Mu50
auuuuaccaucaau

SEQ ID NO: 2075278 - RNA, 18 nt, Staphylococcus aureus subsp. aureus Mu50
auuuuacaaaauauggaa

SEQ ID NO: 2075279 - RNA, 19 nt, Staphylococcus aureus subsp. aureus Mu50
auuuuaauuaauuauuaua

SEQ ID NO: 2075280 - RNA, 15 nt, Staphylococcus aureus subsp. aureus Mu50
auuuuaauauuuucu

SEQ ID NO: 2075281 - RNA, 14 nt, Staphylococcus aureus subsp. aureus Mu50
auuuuaauauauuu

SEQ ID NO: 2075282 - RNA, 21 nt, Staphylococcus aureus subsp. aureus Mu50
auuuuacuugaauauagcugu

SEQ ID NO: 2075283 - RNA, 19 nt, Staphylococcus aureus subsp. aureus Mu50
auuuuacgaaaauaucauu

SEQ ID NO: 2075284 - RNA, 21 nt, Staphylococcus aureus subsp. aureus Mu50
auuuuaccuguuucuuuacuu

SEQ ID NO: 2075285 - RNA, 21 nt, Staphylococcus aureus subsp. aureus Mu50
auuuuaccuucgcauacuuuu

SEQ ID NO: 2075286 - RNA, 19 nt, Staphylococcus aureus subsp. aureus Mu50
auuuuaccaucaaugagca

SEQ ID NO: 2075287 - RNA, 17 nt, Staphylococcus aureus subsp. aureus Mu50
auuuuaccauguuuuac

SEQ ID NO: 2075288 - RNA, 19 nt, Staphylococcus aureus subsp. aureus Mu50
auuuuaacuuaauuaaaaa

SEQ ID NO: 2075289 - RNA, 22 nt, Staphylococcus aureus subsp. aureus Mu50
auuuuaaauucaacuaugaaau

SEQ ID NO: 2075290 - RNA, 19 nt, Staphylococcus aureus subsp. aureus Mu50
auuuuaaaaauucauaauc

SEQ ID NO: 2075291 - RNA, 12 nt, Staphylococcus aureus subsp. aureus Mu50
auuugaucaacc

SEQ ID NO: 2075292 - RNA, 14 nt, Staphylococcus aureus subsp. aureus Mu50
auuugaucguugaa

SEQ ID NO: 2075293 - RNA, 21 nt, Staphylococcus aureus subsp. aureus Mu50
auuuguuugauuuauuauuuc

SEQ ID NO: 2075294 - RNA, 16 nt, Staphylococcus aureus subsp. aureus Mu50
auuuguuuuaaauacu

SEQ ID NO: 2075295 - RNA, 18 nt, Staphylococcus aureus subsp. aureus Mu50
auuugaggauacauaaau

SEQ ID NO: 2075296 - RNA, 14 nt, Staphylococcus aureus subsp. aureus Mu50
auuugagaaaugaa

SEQ ID NO: 2075297 - RNA, 21 nt, Staphylococcus aureus subsp. aureus Mu50
auuugaggauacauaaaucua

SEQ ID NO: 2075298 - RNA, 17 nt, Staphylococcus aureus subsp. aureus Mu50
auuugauaagugaugug

SEQ ID NO: 2075299 - RNA, 22 nt, Staphylococcus aureus subsp. aureus Mu50
auuugauacaacuauauguguc

SEQ ID NO: 2075300 - RNA, 22 nt, Staphylococcus aureus subsp. aureus Mu50
auuuuuccauaguggaauacuu

SEQ ID NO: 2075301 - RNA, 16 nt, Staphylococcus aureus subsp. aureus Mu50
auuuuucaauuaaaug

SEQ ID NO: 2075302 - RNA, 17 nt, Staphylococcus aureus subsp. aureus Mu50
auuuuuaaauuacuaua

SEQ ID NO: 2075303 - RNA, 15 nt, Staphylococcus aureus subsp. aureus Mu50
auuuuuaauuauuuu

SEQ ID NO: 2075304 - RNA, 14 nt, Staphylococcus aureus subsp. aureus Mu50
auuuuguucaguua

SEQ ID NO: 2075305 - RNA, 23 nt, Staphylococcus aureus subsp. aureus Mu50
auuuuguugaaacgguaucaaca

SEQ ID NO: 2075306 - RNA, 18 nt, Staphylococcus aureus subsp. aureus Mu50
auuuuguuucaacauuuc

SEQ ID NO: 2075307 - RNA, 14 nt, Staphylococcus aureus subsp. aureus Mu50
auuuuguuucacua

SEQ ID NO: 2075308 - RNA, 15 nt, Staphylococcus aureus subsp. aureus Mu50
auuuuuaaaauuaug

SEQ ID NO: 2075309 - RNA, 11 nt, Staphylococcus aureus subsp. aureus Mu50
auuuuuaaaau

SEQ ID NO: 2075310 - RNA, 15 nt, Staphylococcus aureus subsp. aureus Mu50
auuuugugaauuuau

SEQ ID NO: 2075311 - RNA, 17 nt, Staphylococcus aureus subsp. aureus Mu50
auuuugucuuuuauauu

SEQ ID NO: 2075312 - RNA, 17 nt, Staphylococcus aureus subsp. aureus Mu50
auuuugcuuuauuuucu

SEQ ID NO: 2075313 - RNA, 17 nt, Staphylococcus aureus subsp. aureus Mu50
auuuuggcacauaaauc

SEQ ID NO: 2075314 - RNA, 11 nt, Staphylococcus aureus subsp. aureus Mu50
auuuucauuuu

SEQ ID NO: 2075315 - RNA, 13 nt, Staphylococcus aureus subsp. aureus Mu50
auuuucauuuuag

SEQ ID NO: 2075316 - RNA, 14 nt, Staphylococcus aureus subsp. aureus Mu50
auuuucuaaauaua

SEQ ID NO: 2075317 - RNA, 17 nt, Staphylococcus aureus subsp. aureus Mu50
auuuuugauuuaauaau

SEQ ID NO: 2075318 - RNA, 15 nt, Staphylococcus aureus subsp. aureus Mu50
auuuuucuucuuuuu

SEQ ID NO: 2075319 - RNA, 16 nt, Staphylococcus aureus subsp. aureus Mu50
auuuuugacuguuaaa

SEQ ID NO: 2075320 - RNA, 16 nt, Staphylococcus aureus subsp. aureus Mu50
auuuuucuaaaugauu

SEQ ID NO: 2075321 - RNA, 14 nt, Staphylococcus aureus subsp. aureus Mu50
auuuuucuuauaaa

SEQ ID NO: 2075322 - RNA, 16 nt, Staphylococcus aureus subsp. aureus Mu50
auuuuucuuauaaaaa

SEQ ID NO: 2075323 - RNA, 20 nt, Staphylococcus aureus subsp. aureus Mu50
auuuuucuuauaaaaaucuu

SEQ ID NO: 2075324 - RNA, 21 nt, Staphylococcus aureus subsp. aureus Mu50
caaaaaaaccgaacaucugaa

SEQ ID NO: 2075325 - RNA, 18 nt, Staphylococcus aureus subsp. aureus Mu50
auuuuuucaugauuuacu

SEQ ID NO: 2075326 - RNA, 11 nt, Staphylococcus aureus subsp. aureus Mu50
caaaaaauauc

SEQ ID NO: 2075327 - RNA, 19 nt, Staphylococcus aureus subsp. aureus Mu50
caaaaaaucgaacaaauga

SEQ ID NO: 2075328 - RNA, 14 nt, Staphylococcus aureus subsp. aureus Mu50
caaaaaaugaauau

SEQ ID NO: 2075329 - RNA, 19 nt, Staphylococcus aureus subsp. aureus Mu50
caaaaaauuguaagucgaa

SEQ ID NO: 2075330 - RNA, 15 nt, Staphylococcus aureus subsp. aureus Mu50
caaaaaauuguauaa

SEQ ID NO: 2075331 - RNA, 21 nt, Staphylococcus aureus subsp. aureus Mu50
caaaaaauaauagcaaaauua

SEQ ID NO: 2075332 - RNA, 20 nt, Staphylococcus aureus subsp. aureus Mu50
auugggagcaaucaauacaa

SEQ ID NO: 2075333 - RNA, 14 nt, Staphylococcus aureus subsp. aureus Mu50
auuggcuugcuuca

SEQ ID NO: 2075334 - RNA, 18 nt, Staphylococcus aureus subsp. aureus Mu50
auugcuguaaccccuugu

SEQ ID NO: 2075335 - RNA, 15 nt, Staphylococcus aureus subsp. aureus Mu50
aaaaggucaaaaaau

SEQ ID NO: 2075336 - RNA, 13 nt, Staphylococcus aureus subsp. aureus Mu50
auugguuucauca

SEQ ID NO: 2075337 - RNA, 18 nt, Staphylococcus aureus subsp. aureus Mu50
auugguuuucauguguca

SEQ ID NO: 2075338 - RNA, 21 nt, Staphylococcus aureus subsp. aureus Mu50
auuguaaaaacguucaaucgu

SEQ ID NO: 2075339 - RNA, 13 nt, Staphylococcus aureus subsp. aureus Mu50
auuguaaaaugcu

SEQ ID NO: 2075340 - RNA, 20 nt, Staphylococcus aureus subsp. aureus Mu50
auugguuuuuagugaaaaga

SEQ ID NO: 2075341 - RNA, 18 nt, Staphylococcus aureus subsp. aureus Mu50
auuguaaaucuuguugga

SEQ ID NO: 2075342 - RNA, 21 nt, Staphylococcus aureus subsp. aureus Mu50
auuguaaagcaugaauagcuu

SEQ ID NO: 2075343 - RNA, 13 nt, Staphylococcus aureus subsp. aureus Mu50
auuguaaaaugua

SEQ ID NO: 2075344 - RNA, 16 nt, Staphylococcus aureus subsp. aureus Mu50
auuguaaucuauuuuc

SEQ ID NO: 2075345 - RNA, 21 nt, Staphylococcus aureus subsp. aureus Mu50
auuguacgcuucaauuauuuc

SEQ ID NO: 2075346 - RNA, 22 nt, Staphylococcus aureus subsp. aureus Mu50
auuguacgcuucaauuauuuca

SEQ ID NO: 2075347 - RNA, 15 nt, Staphylococcus aureus subsp. aureus Mu50
auuguaccaguaaca

SEQ ID NO: 2075348 - RNA, 19 nt, Staphylococcus aureus subsp. aureus Mu50
auuguaccaguaacaauaa

SEQ ID NO: 2075349 - RNA, 18 nt, Staphylococcus aureus subsp. aureus Mu50
auugucgacuuuuagauu

SEQ ID NO: 2075350 - RNA, 18 nt, Staphylococcus aureus subsp. aureus Mu50
auuguuucaccagcuugu

SEQ ID NO: 2075351 - RNA, 14 nt, Staphylococcus aureus subsp. aureus Mu50
auuuaaagcaucau

SEQ ID NO: 2075352 - RNA, 13 nt, Staphylococcus aureus subsp. aureus Mu50
auuuaaacuagua

SEQ ID NO: 2075353 - RNA, 17 nt, Staphylococcus aureus subsp. aureus Mu50
auuguuuaauaacaaaa

SEQ ID NO: 2075354 - RNA, 18 nt, Staphylococcus aureus subsp. aureus Mu50
auuguuuaauaacaaaau

SEQ ID NO: 2075355 - RNA, 20 nt, Staphylococcus aureus subsp. aureus Mu50
auuguuuaauaacaaaauua

SEQ ID NO: 2075356 - RNA, 21 nt, Staphylococcus aureus subsp. aureus Mu50
auuguugcuaaucucagauuu

SEQ ID NO: 2075357 - RNA, 20 nt, Staphylococcus aureus subsp. aureus Mu50
auuguugcaaaauacgauuu

SEQ ID NO: 2075358 - RNA, 21 nt, Staphylococcus aureus subsp. aureus Mu50
auuuaaaugucuuucaaauac

SEQ ID NO: 2075359 - RNA, 13 nt, Staphylococcus aureus subsp. aureus Mu50
auuuaaaugucuu

SEQ ID NO: 2075360 - RNA, 20 nt, Staphylococcus aureus subsp. aureus Mu50
auuuaaaugucuuucaaaua

SEQ ID NO: 2075361 - RNA, 20 nt, Staphylococcus aureus subsp. aureus Mu50
auuuaaaggcauaauaacca

SEQ ID NO: 2075362 - RNA, 17 nt, Staphylococcus aureus subsp. aureus Mu50
auuuaaagucuucaucu

SEQ ID NO: 2075363 - RNA, 14 nt, Staphylococcus aureus subsp. aureus Mu50
auuuaacauaaaaa

SEQ ID NO: 2075364 - RNA, 17 nt, Staphylococcus aureus subsp. aureus Mu50
auuuaacauaaaaaugc

SEQ ID NO: 2075365 - RNA, 17 nt, Staphylococcus aureus subsp. aureus Mu50
auuuaacaucaauuacu

SEQ ID NO: 2075366 - RNA, 18 nt, Staphylococcus aureus subsp. aureus Mu50
auuuaaauugacuuuaau

SEQ ID NO: 2075367 - RNA, 20 nt, Staphylococcus aureus subsp. aureus Mu50
auuguguaaugagauuauuc

SEQ ID NO: 2075368 - RNA, 17 nt, Staphylococcus aureus subsp. aureus Mu50
auuguguugaaucaaca

SEQ ID NO: 2075369 - RNA, 20 nt, Staphylococcus aureus subsp. aureus Mu50
auugucuagguuagaauuau

SEQ ID NO: 2075370 - RNA, 13 nt, Staphylococcus aureus subsp. aureus Mu50
auuguuauuauaa

SEQ ID NO: 2075371 - RNA, 19 nt, Staphylococcus aureus subsp. aureus Mu50
auuguuaaacccucauuuu

SEQ ID NO: 2075372 - RNA, 16 nt, Staphylococcus aureus subsp. aureus Mu50
auuguuaaaucaccaa

SEQ ID NO: 2075373 - RNA, 14 nt, Staphylococcus aureus subsp. aureus Mu50
auuguugauaaaug

SEQ ID NO: 2075374 - RNA, 18 nt, Staphylococcus aureus subsp. aureus Mu50
auuguucaugguuuaauu

SEQ ID NO: 2075375 - RNA, 15 nt, Staphylococcus aureus subsp. aureus Mu50
auugccauagaaaug

SEQ ID NO: 2075376 - RNA, 16 nt, Staphylococcus aureus subsp. aureus Mu50
auugccauagaaaugu

SEQ ID NO: 2075377 - RNA, 14 nt, Staphylococcus aureus subsp. aureus Mu50
auugccauauaccg

SEQ ID NO: 2075378 - RNA, 23 nt, Staphylococcus aureus subsp. aureus Mu50
auugcugccacuguagaaacaca

SEQ ID NO: 2075379 - RNA, 23 nt, Staphylococcus aureus subsp. aureus Mu50
auugcugcuguacaauuucgcuu

SEQ ID NO: 2075380 - RNA, 18 nt, Staphylococcus aureus subsp. aureus Mu50
auugccgguuaaauuauu

SEQ ID NO: 2075381 - RNA, 16 nt, Staphylococcus aureus subsp. aureus Mu50
auugccuaaccuguuu

SEQ ID NO: 2075382 - RNA, 19 nt, Staphylococcus aureus subsp. aureus Mu50
auugccuaaccuguuugag

SEQ ID NO: 2075383 - RNA, 16 nt, Staphylococcus aureus subsp. aureus Mu50
auugccuguagaauuu

SEQ ID NO: 2075384 - RNA, 23 nt, Staphylococcus aureus subsp. aureus Mu50
auugcacuaugcauaauaccaau

SEQ ID NO: 2075385 - RNA, 21 nt, Staphylococcus aureus subsp. aureus Mu50
auugcacuaugcauaauacca

SEQ ID NO: 2075386 - RNA, 22 nt, Staphylococcus aureus subsp. aureus Mu50
auugcaaaacuugcgcaugcuu

SEQ ID NO: 2075387 - RNA, 14 nt, Staphylococcus aureus subsp. aureus Mu50
auugaaaauagaaa

SEQ ID NO: 2075388 - RNA, 16 nt, Staphylococcus aureus subsp. aureus Mu50
auugaaaaaauaacug

SEQ ID NO: 2075389 - RNA, 15 nt, Staphylococcus aureus subsp. aureus Mu50
auucuuuaauauaaa

SEQ ID NO: 2075390 - RNA, 23 nt, Staphylococcus aureus subsp. aureus Mu50
auucuuuauagaaaccaaaaaau

SEQ ID NO: 2075391 - RNA, 20 nt, Staphylococcus aureus subsp. aureus Mu50
auugaugucaauuucacgcu

SEQ ID NO: 2075392 - RNA, 15 nt, Staphylococcus aureus subsp. aureus Mu50
auugaugaauaaaua

SEQ ID NO: 2075393 - RNA, 21 nt, Staphylococcus aureus subsp. aureus Mu50
auugaugaauaaauagauaau

SEQ ID NO: 2075394 - RNA, 19 nt, Staphylococcus aureus subsp. aureus Mu50
auugaucuuuuauaaugaa

SEQ ID NO: 2075395 - RNA, 20 nt, Staphylococcus aureus subsp. aureus Mu50
auugaugaaagacugacuaa

SEQ ID NO: 2075396 - RNA, 17 nt, Staphylococcus aureus subsp. aureus Mu50
auucuucauuuauaaca

SEQ ID NO: 2075397 - RNA, 16 nt, Staphylococcus aureus subsp. aureus Mu50
auucuuggcguauuuu

SEQ ID NO: 2075398 - RNA, 18 nt, Staphylococcus aureus subsp. aureus Mu50
auucuugguuuuuuagau

SEQ ID NO: 2075399 - RNA, 18 nt, Staphylococcus aureus subsp. aureus Mu50
auucuuguuugauuuuag

SEQ ID NO: 2075400 - RNA, 14 nt, Staphylococcus aureus subsp. aureus Mu50
auucuugaauaaau

SEQ ID NO: 2075401 - RNA, 18 nt, Staphylococcus aureus subsp. aureus Mu50
auucuugaauaaauuuua

SEQ ID NO: 2075402 - RNA, 22 nt, Staphylococcus aureus subsp. aureus Mu50
auucucuuuauugggagcaauc

SEQ ID NO: 2075403 - RNA, 20 nt, Staphylococcus aureus subsp. aureus Mu50
auucucuuuguuggggccca

SEQ ID NO: 2075404 - RNA, 12 nt, Staphylococcus aureus subsp. aureus Mu50
auucucuuuuaa

SEQ ID NO: 2075405 - RNA, 16 nt, Staphylococcus aureus subsp. aureus Mu50
auucugaaacuuuaau

SEQ ID NO: 2075406 - RNA, 19 nt, Staphylococcus aureus subsp. aureus Mu50
auucucuaacgauuucuag

SEQ ID NO: 2075407 - RNA, 17 nt, Staphylococcus aureus subsp. aureus Mu50
auucucuaacuuuacca

SEQ ID NO: 2075408 - RNA, 14 nt, Staphylococcus aureus subsp. aureus Mu50
auucugauacagaa

SEQ ID NO: 2075409 - RNA, 14 nt, Staphylococcus aureus subsp. aureus Mu50
auucuaaguuaaaa

SEQ ID NO: 2075410 - RNA, 14 nt, Staphylococcus aureus subsp. aureus Mu50
auucuaacugcaaa

SEQ ID NO: 2075411 - RNA, 12 nt, Staphylococcus aureus subsp. aureus Mu50
auucuacaggca

SEQ ID NO: 2075412 - RNA, 21 nt, Staphylococcus aureus subsp. aureus Mu50
auucuacaaacaaugcaaguu

SEQ ID NO: 2075413 - RNA, 21 nt, Staphylococcus aureus subsp. aureus Mu50
auucuacagguaaugcaaguu

SEQ ID NO: 2075414 - RNA, 21 nt, Staphylococcus aureus subsp. aureus Mu50
auucuacaggcaaugcaaguu

SEQ ID NO: 2075415 - RNA, 14 nt, Staphylococcus aureus subsp. aureus Mu50
auucucgauuuuuu

SEQ ID NO: 2075416 - RNA, 14 nt, Staphylococcus aureus subsp. aureus Mu50
auucuauauaagaa

SEQ ID NO: 2075417 - RNA, 11 nt, Staphylococcus aureus subsp. aureus Mu50
auucuauuuuu

SEQ ID NO: 2075418 - RNA, 13 nt, Staphylococcus aureus subsp. aureus Mu50
auucuauuuuuca

SEQ ID NO: 2075419 - RNA, 13 nt, Staphylococcus aureus subsp. aureus Mu50
auucguuaacaau

SEQ ID NO: 2075420 - RNA, 23 nt, Staphylococcus aureus subsp. aureus Mu50
auucguaccaacucgcuauaugu

SEQ ID NO: 2075421 - RNA, 17 nt, Staphylococcus aureus subsp. aureus Mu50
auucgcuuguaacaagc

SEQ ID NO: 2075422 - RNA, 17 nt, Staphylococcus aureus subsp. aureus Mu50
auucgcuuguucaguaa

SEQ ID NO: 2075423 - RNA, 13 nt, Staphylococcus aureus subsp. aureus Mu50
auucgaaaagaaa

SEQ ID NO: 2075424 - RNA, 15 nt, Staphylococcus aureus subsp. aureus Mu50
auucgaaaagaaauu

SEQ ID NO: 2075425 - RNA, 22 nt, Staphylococcus aureus subsp. aureus Mu50
auucauuuucuuuuucuugaag

SEQ ID NO: 2075426 - RNA, 16 nt, Staphylococcus aureus subsp. aureus Mu50
auucauuuauuuucuu

SEQ ID NO: 2075427 - RNA, 19 nt, Staphylococcus aureus subsp. aureus Mu50
auucauuuaaaaaucaaag

SEQ ID NO: 2075428 - RNA, 21 nt, Staphylococcus aureus subsp. aureus Mu50
auucauuccuaagaauguaau

SEQ ID NO: 2075429 - RNA, 13 nt, Staphylococcus aureus subsp. aureus Mu50
auucauuaagcuu

SEQ ID NO: 2075430 - RNA, 13 nt, Staphylococcus aureus subsp. aureus Mu50
auucauucaauac

SEQ ID NO: 2075431 - RNA, 14 nt, Staphylococcus aureus subsp. aureus Mu50
auucauuacauguu

SEQ ID NO: 2075432 - RNA, 16 nt, Staphylococcus aureus subsp. aureus Mu50
auucauguaaauaguu

SEQ ID NO: 2075433 - RNA, 15 nt, Staphylococcus aureus subsp. aureus Mu50
auucaugauauguuc

SEQ ID NO: 2075434 - RNA, 12 nt, Staphylococcus aureus subsp. aureus Mu50
auucaugaauaa

SEQ ID NO: 2075435 - RNA, 14 nt, Staphylococcus aureus subsp. aureus Mu50
auucaucuucaaac

SEQ ID NO: 2075436 - RNA, 23 nt, Staphylococcus aureus subsp. aureus Mu50
auucaucuugcaaguauuuucuu

SEQ ID NO: 2075437 - RNA, 14 nt, Staphylococcus aureus subsp. aureus Mu50
auucaucuuaucaa

SEQ ID NO: 2075438 - RNA, 17 nt, Staphylococcus aureus subsp. aureus Mu50
auucaucuuaucaagaa

SEQ ID NO: 2075439 - RNA, 15 nt, Staphylococcus aureus subsp. aureus Mu50
auucaucgucucacu

SEQ ID NO: 2075440 - RNA, 19 nt, Staphylococcus aureus subsp. aureus Mu50
auucaucgucucacuuaau

SEQ ID NO: 2075441 - RNA, 17 nt, Staphylococcus aureus subsp. aureus Mu50
auucauauuuauauuua

SEQ ID NO: 2075442 - RNA, 16 nt, Staphylococcus aureus subsp. aureus Mu50
auucauauucaaauuu

SEQ ID NO: 2075443 - RNA, 19 nt, Staphylococcus aureus subsp. aureus Mu50
auucauaucuuucaauuaa

SEQ ID NO: 2075444 - RNA, 15 nt, Staphylococcus aureus subsp. aureus Mu50
auuccuagcuuuuau

SEQ ID NO: 2075445 - RNA, 17 nt, Staphylococcus aureus subsp. aureus Mu50
auuccaugucaauuuuu

SEQ ID NO: 2075446 - RNA, 14 nt, Staphylococcus aureus subsp. aureus Mu50
auuccacuacaauc

SEQ ID NO: 2075447 - RNA, 21 nt, Staphylococcus aureus subsp. aureus Mu50
auuccaaaaauuguaaaaccu

SEQ ID NO: 2075448 - RNA, 17 nt, Staphylococcus aureus subsp. aureus Mu50
auuccaagagaauuaau

SEQ ID NO: 2075449 - RNA, 17 nt, Staphylococcus aureus subsp. aureus Mu50
aaaagcggacugaaaga

SEQ ID NO: 2075450 - RNA, 13 nt, Staphylococcus aureus subsp. aureus Mu50
auuagauauauuu

SEQ ID NO: 2075451 - RNA, 15 nt, Staphylococcus aureus subsp. aureus Mu50
auuagauaucuuaau

SEQ ID NO: 2075452 - RNA, 21 nt, Staphylococcus aureus subsp. aureus Mu50
auuagagagcacgagaaaugu

SEQ ID NO: 2075453 - RNA, 23 nt, Staphylococcus aureus subsp. aureus Mu50
auuagagagcacgagaaauguca

SEQ ID NO: 2075454 - RNA, 15 nt, Staphylococcus aureus subsp. aureus Mu50
auuagcaaauauuau

SEQ ID NO: 2075455 - RNA, 18 nt, Staphylococcus aureus subsp. aureus Mu50
auuagaugaaauggaaag

SEQ ID NO: 2075456 - RNA, 16 nt, Staphylococcus aureus subsp. aureus Mu50
auuagaugauauuuaa

SEQ ID NO: 2075457 - RNA, 14 nt, Staphylococcus aureus subsp. aureus Mu50
auuagauuuuaugc

SEQ ID NO: 2075458 - RNA, 16 nt, Staphylococcus aureus subsp. aureus Mu50
auuagauuuuguugua

SEQ ID NO: 2075459 - RNA, 21 nt, Staphylococcus aureus subsp. aureus Mu50
auuacuguuugcuuuaucaau

SEQ ID NO: 2075460 - RNA, 13 nt, Staphylococcus aureus subsp. aureus Mu50
auuacuuaucugu

SEQ ID NO: 2075461 - RNA, 17 nt, Staphylococcus aureus subsp. aureus Mu50
auuacuguaaauaugaa

SEQ ID NO: 2075462 - RNA, 18 nt, Staphylococcus aureus subsp. aureus Mu50
auuacuuauuucuuuuca

SEQ ID NO: 2075463 - RNA, 18 nt, Staphylococcus aureus subsp. aureus Mu50
auuacuugaauauuauuc

SEQ ID NO: 2075464 - RNA, 19 nt, Staphylococcus aureus subsp. aureus Mu50
auuacuugaauauuauuca

SEQ ID NO: 2075465 - RNA, 19 nt, Staphylococcus aureus subsp. aureus Mu50
auuagacguguaaauguua

SEQ ID NO: 2075466 - RNA, 14 nt, Staphylococcus aureus subsp. aureus Mu50
auuagaaccaucau

SEQ ID NO: 2075467 - RNA, 16 nt, Staphylococcus aureus subsp. aureus Mu50
auuagaaaauuucuca

SEQ ID NO: 2075468 - RNA, 21 nt, Staphylococcus aureus subsp. aureus Mu50
auuagaaaaggcucauuuguu

SEQ ID NO: 2075469 - RNA, 23 nt, Staphylococcus aureus subsp. aureus Mu50
auuacaugcaccuuuacaacaua

SEQ ID NO: 2075470 - RNA, 17 nt, Staphylococcus aureus subsp. aureus Mu50
auuacauuuuaugucca

SEQ ID NO: 2075471 - RNA, 16 nt, Staphylococcus aureus subsp. aureus Mu50
auuacaucuauauuug

SEQ ID NO: 2075472 - RNA, 19 nt, Staphylococcus aureus subsp. aureus Mu50
auuacauauaagauagaua

SEQ ID NO: 2075473 - RNA, 22 nt, Staphylococcus aureus subsp. aureus Mu50
auuacauaauuuaucugcaaaa

SEQ ID NO: 2075474 - RNA, 14 nt, Staphylococcus aureus subsp. aureus Mu50
auuacauaauuuau

SEQ ID NO: 2075475 - RNA, 15 nt, Staphylococcus aureus subsp. aureus Mu50
auuaauagaaagugc

SEQ ID NO: 2075476 - RNA, 21 nt, Staphylococcus aureus subsp. aureus Mu50
auuaauagagaaagaauaaau

SEQ ID NO: 2075477 - RNA, 16 nt, Staphylococcus aureus subsp. aureus Mu50
auuaauagguuauuug

SEQ ID NO: 2075478 - RNA, 17 nt, Staphylococcus aureus subsp. aureus Mu50
auuaauaguacagucau

SEQ ID NO: 2075479 - RNA, 21 nt, Staphylococcus aureus subsp. aureus Mu50
aaaagcccaccuaaaaaguac

SEQ ID NO: 2075480 - RNA, 20 nt, Staphylococcus aureus subsp. aureus Mu50
auuaccuggguauacagguu

SEQ ID NO: 2075481 - RNA, 15 nt, Staphylococcus aureus subsp. aureus Mu50
auuacucuuuuucuu

SEQ ID NO: 2075482 - RNA, 16 nt, Staphylococcus aureus subsp. aureus Mu50
auuacucuuuuucuuu

SEQ ID NO: 2075483 - RNA, 15 nt, Staphylococcus aureus subsp. aureus Mu50
auuacucaaaauuaa

SEQ ID NO: 2075484 - RNA, 17 nt, Staphylococcus aureus subsp. aureus Mu50
auuacuauaaaaaacag

SEQ ID NO: 2075485 - RNA, 17 nt, Staphylococcus aureus subsp. aureus Mu50
auuacuaucuucaucau

SEQ ID NO: 2075486 - RNA, 17 nt, Staphylococcus aureus subsp. aureus Mu50
auuacuauauuuaaauu

SEQ ID NO: 2075487 - RNA, 14 nt, Staphylococcus aureus subsp. aureus Mu50
auuacuauaaaaaa

SEQ ID NO: 2075488 - RNA, 20 nt, Staphylococcus aureus subsp. aureus Mu50
auuacuacuuuauaaauauc

SEQ ID NO: 2075489 - RNA, 23 nt, Staphylococcus aureus subsp. aureus Mu50
auuacuacuuuauaaauaucuuu

SEQ ID NO: 2075490 - RNA, 16 nt, Staphylococcus aureus subsp. aureus Mu50
auuacguuuacuagaa

SEQ ID NO: 2075491 - RNA, 16 nt, Staphylococcus aureus subsp. aureus Mu50
auuacuaauugaucag

SEQ ID NO: 2075492 - RNA, 19 nt, Staphylococcus aureus subsp. aureus Mu50
auuacuaacguaaagguga

SEQ ID NO: 2075493 - RNA, 19 nt, Staphylococcus aureus subsp. aureus Mu50
auuauuuaauuuuucuaaa

SEQ ID NO: 2075494 - RNA, 16 nt, Staphylococcus aureus subsp. aureus Mu50
auuauuuaauuuuucu

SEQ ID NO: 2075495 - RNA, 14 nt, Staphylococcus aureus subsp. aureus Mu50
auuauuuaaaacuu

SEQ ID NO: 2075496 - RNA, 14 nt, Staphylococcus aureus subsp. aureus Mu50
auuauuuaaaaugc

SEQ ID NO: 2075497 - RNA, 14 nt, Staphylococcus aureus subsp. aureus Mu50
auuauuuagaauuc

SEQ ID NO: 2075498 - RNA, 23 nt, Staphylococcus aureus subsp. aureus Mu50
auuauuuagaauucuaaaagaau

SEQ ID NO: 2075499 - RNA, 17 nt, Staphylococcus aureus subsp. aureus Mu50
auuauuuagauaaaaau

SEQ ID NO: 2075500 - RNA, 16 nt, Staphylococcus aureus subsp. aureus Mu50
auuauuuauauuuuau

SEQ ID NO: 2075501 - RNA, 13 nt, Staphylococcus aureus subsp. aureus Mu50
auuauuuauauuu

SEQ ID NO: 2075502 - RNA, 21 nt, Staphylococcus aureus subsp. aureus Mu50
auuauuuagauaaaaauuacu

SEQ ID NO: 2075503 - RNA, 18 nt, Staphylococcus aureus subsp. aureus Mu50
auuauugucaucauguuc

SEQ ID NO: 2075504 - RNA, 17 nt, Staphylococcus aureus subsp. aureus Mu50
auuauugguugaaauua

SEQ ID NO: 2075505 - RNA, 15 nt, Staphylococcus aureus subsp. aureus Mu50
auuauuggauuugaa

SEQ ID NO: 2075506 - RNA, 14 nt, Staphylococcus aureus subsp. aureus Mu50
auuauuaacuguac

SEQ ID NO: 2075507 - RNA, 18 nt, Staphylococcus aureus subsp. aureus Mu50
auuauuaacuguaccugc

SEQ ID NO: 2075508 - RNA, 22 nt, Staphylococcus aureus subsp. aureus Mu50
auuauuaacuguaccugcuaca

SEQ ID NO: 2075509 - RNA, 15 nt, Staphylococcus aureus subsp. aureus Mu50
auuauuaacuuuaau

SEQ ID NO: 2075510 - RNA, 15 nt, Staphylococcus aureus subsp. aureus Mu50
auuauuuuguauuuu

SEQ ID NO: 2075511 - RNA, 18 nt, Staphylococcus aureus subsp. aureus Mu50
auuauuuuguauuuuuca

SEQ ID NO: 2075512 - RNA, 22 nt, Staphylococcus aureus subsp. aureus Mu50
auuauuucucuuuccacugcaa

SEQ ID NO: 2075513 - RNA, 23 nt, Staphylococcus aureus subsp. aureus Mu50
auuauuuggcucuauaucaaauu

SEQ ID NO: 2075514 - RNA, 17 nt, Staphylococcus aureus subsp. aureus Mu50
auuauuugcgauaucag

SEQ ID NO: 2075515 - RNA, 22 nt, Staphylococcus aureus subsp. aureus Mu50
auuauuucccuggaaaaugauu

SEQ ID NO: 2075516 - RNA, 16 nt, Staphylococcus aureus subsp. aureus Mu50
auuauuucauuagaaa

SEQ ID NO: 2075517 - RNA, 13 nt, Staphylococcus aureus subsp. aureus Mu50
auuauuugauaaa

SEQ ID NO: 2075518 - RNA, 15 nt, Staphylococcus aureus subsp. aureus Mu50
auucaauaauuauua

SEQ ID NO: 2075519 - RNA, 22 nt, Staphylococcus aureus subsp. aureus Mu50
auucaacguauaagugauauca

SEQ ID NO: 2075520 - RNA, 15 nt, Staphylococcus aureus subsp. aureus Mu50
auucaacuaauuuaa

SEQ ID NO: 2075521 - RNA, 17 nt, Staphylococcus aureus subsp. aureus Mu50
auucaacuuauuauuua

SEQ ID NO: 2075522 - RNA, 17 nt, Staphylococcus aureus subsp. aureus Mu50
auucaacuaugaaauug

SEQ ID NO: 2075523 - RNA, 19 nt, Staphylococcus aureus subsp. aureus Mu50
auucaacuuuaaucaaaaa

SEQ ID NO: 2075524 - RNA, 22 nt, Staphylococcus aureus subsp. aureus Mu50
auuauuuuuuuaaaucuauaua

SEQ ID NO: 2075525 - RNA, 14 nt, Staphylococcus aureus subsp. aureus Mu50
auucaaaauaacuu

SEQ ID NO: 2075526 - RNA, 13 nt, Staphylococcus aureus subsp. aureus Mu50
auuauuaaaucaa

SEQ ID NO: 2075527 - RNA, 14 nt, Staphylococcus aureus subsp. aureus Mu50
auuauguguauauu

SEQ ID NO: 2075528 - RNA, 17 nt, Staphylococcus aureus subsp. aureus Mu50
auuauguuauaaauucu

SEQ ID NO: 2075529 - RNA, 13 nt, Staphylococcus aureus subsp. aureus Mu50
auuaugugacaua

SEQ ID NO: 2075530 - RNA, 21 nt, Staphylococcus aureus subsp. aureus Mu50
auuaugucgagguguuuuuuu

SEQ ID NO: 2075531 - RNA, 23 nt, Staphylococcus aureus subsp. aureus Mu50
auuauguaucuauacaacaguaa

SEQ ID NO: 2075532 - RNA, 13 nt, Staphylococcus aureus subsp. aureus Mu50
auuauguauuuuu

SEQ ID NO: 2075533 - RNA, 19 nt, Staphylococcus aureus subsp. aureus Mu50
auuauggagcggaagauag

SEQ ID NO: 2075534 - RNA, 16 nt, Staphylococcus aureus subsp. aureus Mu50
auuauguaaaaaauau

SEQ ID NO: 2075535 - RNA, 18 nt, Staphylococcus aureus subsp. aureus Mu50
auuauguaaaaaauaucu

SEQ ID NO: 2075536 - RNA, 22 nt, Staphylococcus aureus subsp. aureus Mu50
auuauguaaaaaauaucuuguc

SEQ ID NO: 2075537 - RNA, 15 nt, Staphylococcus aureus subsp. aureus Mu50
auuaucguaaaaaaa

SEQ ID NO: 2075538 - RNA, 22 nt, Staphylococcus aureus subsp. aureus Mu50
auuaucuauccauuugguuuaa

SEQ ID NO: 2075539 - RNA, 19 nt, Staphylococcus aureus subsp. aureus Mu50
auuaugccuuugauuuuac

SEQ ID NO: 2075540 - RNA, 11 nt, Staphylococcus aureus subsp. aureus Mu50
auuauggagcg

SEQ ID NO: 2075541 - RNA, 15 nt, Staphylococcus aureus subsp. aureus Mu50
auuauggagcggaag

SEQ ID NO: 2075542 - RNA, 20 nt, Staphylococcus aureus subsp. aureus Mu50
auuagugucacaaagaaauu

SEQ ID NO: 2075543 - RNA, 17 nt, Staphylococcus aureus subsp. aureus Mu50
auuaguucuggcaaaga

SEQ ID NO: 2075544 - RNA, 13 nt, Staphylococcus aureus subsp. aureus Mu50
auuaguuauacua

SEQ ID NO: 2075545 - RNA, 21 nt, Staphylococcus aureus subsp. aureus Mu50
auuaguucuggcaaagaaucc

SEQ ID NO: 2075546 - RNA, 20 nt, Staphylococcus aureus subsp. aureus Mu50
auuaguucuguugauauuuc

SEQ ID NO: 2075547 - RNA, 18 nt, Staphylococcus aureus subsp. aureus Mu50
auuaguaaugauuaacuu

SEQ ID NO: 2075548 - RNA, 20 nt, Staphylococcus aureus subsp. aureus Mu50
aaaagcguucaauuuuuguu

SEQ ID NO: 2075549 - RNA, 19 nt, Staphylococcus aureus subsp. aureus Mu50
auuaguaauuuuuaaaucu

SEQ ID NO: 2075550 - RNA, 15 nt, Staphylococcus aureus subsp. aureus Mu50
auuaguauaauuuau

SEQ ID NO: 2075551 - RNA, 13 nt, Staphylococcus aureus subsp. aureus Mu50
auuaguaugacuu

SEQ ID NO: 2075552 - RNA, 19 nt, Staphylococcus aureus subsp. aureus Mu50
auuaguaugacuuaccuaa

SEQ ID NO: 2075553 - RNA, 19 nt, Staphylococcus aureus subsp. aureus Mu50
auuaguauucaaaaaauau

SEQ ID NO: 2075554 - RNA, 18 nt, Staphylococcus aureus subsp. aureus Mu50
auuaucgaauuagauuua

SEQ ID NO: 2075555 - RNA, 22 nt, Staphylococcus aureus subsp. aureus Mu50
auuaucgaagaaacauuauaua

SEQ ID NO: 2075556 - RNA, 21 nt, Staphylococcus aureus subsp. aureus Mu50
auuauaugguucguccauuca

SEQ ID NO: 2075557 - RNA, 16 nt, Staphylococcus aureus subsp. aureus Mu50
auuauauaauucuuca

SEQ ID NO: 2075558 - RNA, 15 nt, Staphylococcus aureus subsp. aureus Mu50
auuauauauauuaaa

SEQ ID NO: 2075559 - RNA, 20 nt, Staphylococcus aureus subsp. aureus Mu50
auuauaucgucguaacucuu

SEQ ID NO: 2075560 - RNA, 16 nt, Staphylococcus aureus subsp. aureus Mu50
auuauagucuuaaaca

SEQ ID NO: 2075561 - RNA, 23 nt, Staphylococcus aureus subsp. aureus Mu50
auuauagcagguggcauccauau

SEQ ID NO: 2075562 - RNA, 21 nt, Staphylococcus aureus subsp. aureus Mu50
auuauagaugacuguagaaaa

SEQ ID NO: 2075563 - RNA, 19 nt, Staphylococcus aureus subsp. aureus Mu50
auuauagucuuaaacauaa

SEQ ID NO: 2075564 - RNA, 19 nt, Staphylococcus aureus subsp. aureus Mu50
auuauauacccaccacauu

SEQ ID NO: 2075565 - RNA, 18 nt, Staphylococcus aureus subsp. aureus Mu50
auuaacgucaacagcaua

SEQ ID NO: 2075566 - RNA, 20 nt, Staphylococcus aureus subsp. aureus Mu50
auuaacuguguauggcauaa

SEQ ID NO: 2075567 - RNA, 22 nt, Staphylococcus aureus subsp. aureus Mu50
auuaacuguuagacuugguuac

SEQ ID NO: 2075568 - RNA, 18 nt, Staphylococcus aureus subsp. aureus Mu50
auuaacuuaaaauuuaaa

SEQ ID NO: 2075569 - RNA, 22 nt, Staphylococcus aureus subsp. aureus Mu50
auuaacuuaaaauuuaaauauu

SEQ ID NO: 2075570 - RNA, 21 nt, Staphylococcus aureus subsp. aureus Mu50
auuaacuuacuuuuguaaaaa

SEQ ID NO: 2075571 - RNA, 19 nt, Staphylococcus aureus subsp. aureus Mu50
auuaaauguacauuguaaa

SEQ ID NO: 2075572 - RNA, 18 nt, Staphylococcus aureus subsp. aureus Mu50
auuaauaagcauuaaugu

SEQ ID NO: 2075573 - RNA, 14 nt, Staphylococcus aureus subsp. aureus Mu50
auuaagcuuuguuu

SEQ ID NO: 2075574 - RNA, 21 nt, Staphylococcus aureus subsp. aureus Mu50
auuaagccaucccaacuuaau

SEQ ID NO: 2075575 - RNA, 19 nt, Staphylococcus aureus subsp. aureus Mu50
auuaagauguauaugaauu

SEQ ID NO: 2075576 - RNA, 17 nt, Staphylococcus aureus subsp. aureus Mu50
auuaagauguauaugaa

SEQ ID NO: 2075577 - RNA, 22 nt, Staphylococcus aureus subsp. aureus Mu50
auuaaauccgcuuguucaacua

SEQ ID NO: 2075578 - RNA, 20 nt, Staphylococcus aureus subsp. aureus Mu50
auuaaaucuucuaguaauuc

SEQ ID NO: 2075579 - RNA, 19 nt, Staphylococcus aureus subsp. aureus Mu50
auuaaaugaugcaguaaaa

SEQ ID NO: 2075580 - RNA, 22 nt, Staphylococcus aureus subsp. aureus Mu50
auuaaaugaugcaguaaaacca

SEQ ID NO: 2075581 - RNA, 12 nt, Staphylococcus aureus subsp. aureus Mu50
auuaaaugcaau

SEQ ID NO: 2075582 - RNA, 16 nt, Staphylococcus aureus subsp. aureus Mu50
auuaaaggaaaucaau

SEQ ID NO: 2075583 - RNA, 23 nt, Staphylococcus aureus subsp. aureus Mu50
auuaaagcgauaauagauaccau

SEQ ID NO: 2075584 - RNA, 16 nt, Staphylococcus aureus subsp. aureus Mu50
auuaaagcaaauuaua

SEQ ID NO: 2075585 - RNA, 20 nt, Staphylococcus aureus subsp. aureus Mu50
auuaaagcaucuucaauauu

SEQ ID NO: 2075586 - RNA, 18 nt, Staphylococcus aureus subsp. aureus Mu50
auuaaaacagcaaauaaa

SEQ ID NO: 2075587 - RNA, 14 nt, Staphylococcus aureus subsp. aureus Mu50
auuaaaaauuucaa

SEQ ID NO: 2075588 - RNA, 17 nt, Staphylococcus aureus subsp. aureus Mu50
auuaaaaauuucaauaa

SEQ ID NO: 2075589 - RNA, 17 nt, Staphylococcus aureus subsp. aureus Mu50
auguuuucuaguuuaac

SEQ ID NO: 2075590 - RNA, 18 nt, Staphylococcus aureus subsp. aureus Mu50
auguuuguaaaucaagug

SEQ ID NO: 2075591 - RNA, 17 nt, Staphylococcus aureus subsp. aureus Mu50
auguuuggcauaauaau

SEQ ID NO: 2075592 - RNA, 23 nt, Staphylococcus aureus subsp. aureus Mu50
auguuugggauauagaaaaggga

SEQ ID NO: 2075593 - RNA, 14 nt, Staphylococcus aureus subsp. aureus Mu50
auguugauaaaaag

SEQ ID NO: 2075594 - RNA, 18 nt, Staphylococcus aureus subsp. aureus Mu50
auguuugcaacauauuuu

SEQ ID NO: 2075595 - RNA, 16 nt, Staphylococcus aureus subsp. aureus Mu50
auguuugccagguaaa

SEQ ID NO: 2075596 - RNA, 17 nt, Staphylococcus aureus subsp. aureus Mu50
auguuuggaugaacaaa

SEQ ID NO: 2075597 - RNA, 16 nt, Staphylococcus aureus subsp. aureus Mu50
auguuuggaugaacaa

SEQ ID NO: 2075598 - RNA, 18 nt, Staphylococcus aureus subsp. aureus Mu50
auguucuuauaaaaaaca

SEQ ID NO: 2075599 - RNA, 13 nt, Staphylococcus aureus subsp. aureus Mu50
auguuacugauga

SEQ ID NO: 2075600 - RNA, 14 nt, Staphylococcus aureus subsp. aureus Mu50
auguuacugaugaa

SEQ ID NO: 2075601 - RNA, 16 nt, Staphylococcus aureus subsp. aureus Mu50
auguuacuuauauauu

SEQ ID NO: 2075602 - RNA, 17 nt, Staphylococcus aureus subsp. aureus Mu50
auguuacuuauauauuc

SEQ ID NO: 2075603 - RNA, 17 nt, Staphylococcus aureus subsp. aureus Mu50
auguuaacugcaaacuu

SEQ ID NO: 2075604 - RNA, 15 nt, Staphylococcus aureus subsp. aureus Mu50
auguuauaaaaugaa

SEQ ID NO: 2075605 - RNA, 14 nt, Staphylococcus aureus subsp. aureus Mu50
auguuaaacaauac

SEQ ID NO: 2075606 - RNA, 21 nt, Staphylococcus aureus subsp. aureus Mu50
auguguuuucaacaguuuuaa

SEQ ID NO: 2075607 - RNA, 18 nt, Staphylococcus aureus subsp. aureus Mu50
auguguuucuagcuuguu

SEQ ID NO: 2075608 - RNA, 12 nt, Staphylococcus aureus subsp. aureus Mu50
auguuaucaaua

SEQ ID NO: 2075609 - RNA, 13 nt, Staphylococcus aureus subsp. aureus Mu50
auguuaucgauau

SEQ ID NO: 2075610 - RNA, 20 nt, Staphylococcus aureus subsp. aureus Mu50
auguuaucgauauagcauaa

SEQ ID NO: 2075611 - RNA, 22 nt, Staphylococcus aureus subsp. aureus Mu50
auguuaucgauauagcauaaaa

SEQ ID NO: 2075612 - RNA, 18 nt, Staphylococcus aureus subsp. aureus Mu50
auguuauuaaccaucaug

SEQ ID NO: 2075613 - RNA, 18 nt, Staphylococcus aureus subsp. aureus Mu50
auguuccgcuacaaaaca

SEQ ID NO: 2075614 - RNA, 16 nt, Staphylococcus aureus subsp. aureus Mu50
auguuccauauaaccu

SEQ ID NO: 2075615 - RNA, 17 nt, Staphylococcus aureus subsp. aureus Mu50
auguggaacaugauuca

SEQ ID NO: 2075616 - RNA, 14 nt, Staphylococcus aureus subsp. aureus Mu50
auguggcacucaua

SEQ ID NO: 2075617 - RNA, 14 nt, Staphylococcus aureus subsp. aureus Mu50
augugcuuuaucaa

SEQ ID NO: 2075618 - RNA, 21 nt, Staphylococcus aureus subsp. aureus Mu50
augugcuuguaacaagcuuuu

SEQ ID NO: 2075619 - RNA, 15 nt, Staphylococcus aureus subsp. aureus Mu50
augugcuaccuacuu

SEQ ID NO: 2075620 - RNA, 16 nt, Staphylococcus aureus subsp. aureus Mu50
augugcuaaucuauuu

SEQ ID NO: 2075621 - RNA, 15 nt, Staphylococcus aureus subsp. aureus Mu50
augugccuuugcuuu

SEQ ID NO: 2075622 - RNA, 17 nt, Staphylococcus aureus subsp. aureus Mu50
augugcgucacucacuu

SEQ ID NO: 2075623 - RNA, 17 nt, Staphylococcus aureus subsp. aureus Mu50
auguggguguaccaauu

SEQ ID NO: 2075624 - RNA, 14 nt, Staphylococcus aureus subsp. aureus Mu50
auguguugugauau

SEQ ID NO: 2075625 - RNA, 16 nt, Staphylococcus aureus subsp. aureus Mu50
auguguugugauauau

SEQ ID NO: 2075626 - RNA, 22 nt, Staphylococcus aureus subsp. aureus Mu50
auguguugcauuacuaucuuca

SEQ ID NO: 2075627 - RNA, 22 nt, Staphylococcus aureus subsp. aureus Mu50
auguguuaaucaacguauauaa

SEQ ID NO: 2075628 - RNA, 24 nt, Staphylococcus aureus subsp. aureus Mu50
auguguuaaucaacguauauaagu

SEQ ID NO: 2075629 - RNA, 15 nt, Staphylococcus aureus subsp. aureus Mu50
auguguuaaaccaac

SEQ ID NO: 2075630 - RNA, 22 nt, Staphylococcus aureus subsp. aureus Mu50
augugucauaauccauucuucu

SEQ ID NO: 2075631 - RNA, 18 nt, Staphylococcus aureus subsp. aureus Mu50
augugucauaauccauuc

SEQ ID NO: 2075632 - RNA, 20 nt, Staphylococcus aureus subsp. aureus Mu50
augugucauaauccauucuu

SEQ ID NO: 2075633 - RNA, 13 nt, Staphylococcus aureus subsp. aureus Mu50
augucuuucaaau

SEQ ID NO: 2075634 - RNA, 23 nt, Staphylococcus aureus subsp. aureus Mu50
augugaagugcgggggauuauuu

SEQ ID NO: 2075635 - RNA, 15 nt, Staphylococcus aureus subsp. aureus Mu50
augugacauaccagu

SEQ ID NO: 2075636 - RNA, 21 nt, Staphylococcus aureus subsp. aureus Mu50
augugauuaauuucauguuca

SEQ ID NO: 2075637 - RNA, 22 nt, Staphylococcus aureus subsp. aureus Mu50
auguaccacucauaaucaaguc

SEQ ID NO: 2075638 - RNA, 16 nt, Staphylococcus aureus subsp. aureus Mu50
augucgauauuucuag

SEQ ID NO: 2075639 - RNA, 17 nt, Staphylococcus aureus subsp. aureus Mu50
augucgaucuaacaauu

SEQ ID NO: 2075640 - RNA, 18 nt, Staphylococcus aureus subsp. aureus Mu50
augucgcacuauaaaauu

SEQ ID NO: 2075641 - RNA, 16 nt, Staphylococcus aureus subsp. aureus Mu50
augucuagauuuuaaa

SEQ ID NO: 2075642 - RNA, 21 nt, Staphylococcus aureus subsp. aureus Mu50
augguuaucacuuauuauuuu

SEQ ID NO: 2075643 - RNA, 17 nt, Staphylococcus aureus subsp. aureus Mu50
augguucuauaauaaau

SEQ ID NO: 2075644 - RNA, 15 nt, Staphylococcus aureus subsp. aureus Mu50
augguugaucgaaua

SEQ ID NO: 2075645 - RNA, 20 nt, Staphylococcus aureus subsp. aureus Mu50
augguugauuacaauuguuc

SEQ ID NO: 2075646 - RNA, 14 nt, Staphylococcus aureus subsp. aureus Mu50
auguacaauuuuuu

SEQ ID NO: 2075647 - RNA, 18 nt, Staphylococcus aureus subsp. aureus Mu50
auguacaauuuuuaaaaa

SEQ ID NO: 2075648 - RNA, 13 nt, Staphylococcus aureus subsp. aureus Mu50
auguaacauaaag

SEQ ID NO: 2075649 - RNA, 19 nt, Staphylococcus aureus subsp. aureus Mu50
auguaacauuaaaaauaaa

SEQ ID NO: 2075650 - RNA, 22 nt, Staphylococcus aureus subsp. aureus Mu50
auguaaaucgugcuguuaucau

SEQ ID NO: 2075651 - RNA, 18 nt, Staphylococcus aureus subsp. aureus Mu50
auguaaauaaaaauuaua

SEQ ID NO: 2075652 - RNA, 17 nt, Staphylococcus aureus subsp. aureus Mu50
auguaaauaguuaguuu

SEQ ID NO: 2075653 - RNA, 19 nt, Staphylococcus aureus subsp. aureus Mu50
auguaaauaaaaauuauau

SEQ ID NO: 2075654 - RNA, 19 nt, Staphylococcus aureus subsp. aureus Mu50
auguaaagccaccuaaauc

SEQ ID NO: 2075655 - RNA, 15 nt, Staphylococcus aureus subsp. aureus Mu50
auguaaauaaaaauu

SEQ ID NO: 2075656 - RNA, 19 nt, Staphylococcus aureus subsp. aureus Mu50
auguaaagaguacagcggu

SEQ ID NO: 2075657 - RNA, 15 nt, Staphylococcus aureus subsp. aureus Mu50
auguaaaauuagcaa

SEQ ID NO: 2075658 - RNA, 19 nt, Staphylococcus aureus subsp. aureus Mu50
auggugguaccacauacau

SEQ ID NO: 2075659 - RNA, 13 nt, Staphylococcus aureus subsp. aureus Mu50
augguguuaaguu

SEQ ID NO: 2075660 - RNA, 22 nt, Staphylococcus aureus subsp. aureus Mu50
augguaucuuuaauuucauuua

SEQ ID NO: 2075661 - RNA, 21 nt, Staphylococcus aureus subsp. aureus Mu50
augguaucaauagccauuucc

SEQ ID NO: 2075662 - RNA, 18 nt, Staphylococcus aureus subsp. aureus Mu50
augguaaguauaauuaaa

SEQ ID NO: 2075663 - RNA, 15 nt, Staphylococcus aureus subsp. aureus Mu50
auggcagcgaucuuu

SEQ ID NO: 2075664 - RNA, 20 nt, Staphylococcus aureus subsp. aureus Mu50
auggcuagucuuuaacuuua

SEQ ID NO: 2075665 - RNA, 17 nt, Staphylococcus aureus subsp. aureus Mu50
auggaaaggcguuuuuu

SEQ ID NO: 2075666 - RNA, 16 nt, Staphylococcus aureus subsp. aureus Mu50
auggaaaaguuuuuua

SEQ ID NO: 2075667 - RNA, 15 nt, Staphylococcus aureus subsp. aureus Mu50
auggaaaaguuuuuu

SEQ ID NO: 2075668 - RNA, 13 nt, Staphylococcus aureus subsp. aureus Mu50
auggagcaugauu

SEQ ID NO: 2075669 - RNA, 17 nt, Staphylococcus aureus subsp. aureus Mu50
auggacuaagauauaag

SEQ ID NO: 2075670 - RNA, 22 nt, Staphylococcus aureus subsp. aureus Mu50
auggcacuuaauauaaggaaga

SEQ ID NO: 2075671 - RNA, 23 nt, Staphylococcus aureus subsp. aureus Mu50
auggauuacagcguaacuaaaga

SEQ ID NO: 2075672 - RNA, 16 nt, Staphylococcus aureus subsp. aureus Mu50
auggauacuuaaagau

SEQ ID NO: 2075673 - RNA, 13 nt, Staphylococcus aureus subsp. aureus Mu50
auggauauucaau

SEQ ID NO: 2075674 - RNA, 20 nt, Staphylococcus aureus subsp. aureus Mu50
augcuuuaugugcagcuuga

SEQ ID NO: 2075675 - RNA, 15 nt, Staphylococcus aureus subsp. aureus Mu50
augcuugaauguuug

SEQ ID NO: 2075676 - RNA, 17 nt, Staphylococcus aureus subsp. aureus Mu50
augcuuuaauuaaaguu

SEQ ID NO: 2075677 - RNA, 22 nt, Staphylococcus aureus subsp. aureus Mu50
augcuuguacaaaaaauuguaa

SEQ ID NO: 2075678 - RNA, 15 nt, Staphylococcus aureus subsp. aureus Mu50
augcuuaaaaacaau

SEQ ID NO: 2075679 - RNA, 19 nt, Staphylococcus aureus subsp. aureus Mu50
augcuucucacaacugcau

SEQ ID NO: 2075680 - RNA, 16 nt, Staphylococcus aureus subsp. aureus Mu50
augcuucugguucuuc

SEQ ID NO: 2075681 - RNA, 21 nt, Staphylococcus aureus subsp. aureus Mu50
augcuucugguucuucaauau

SEQ ID NO: 2075682 - RNA, 19 nt, Staphylococcus aureus subsp. aureus Mu50
augcuucgcaucacugcau

SEQ ID NO: 2075683 - RNA, 15 nt, Staphylococcus aureus subsp. aureus Mu50
augcuucuaacugaa

SEQ ID NO: 2075684 - RNA, 15 nt, Staphylococcus aureus subsp. aureus Mu50
augcuucaaagucaa

SEQ ID NO: 2075685 - RNA, 19 nt, Staphylococcus aureus subsp. aureus Mu50
augcucuauauauccauuc

SEQ ID NO: 2075686 - RNA, 21 nt, Staphylococcus aureus subsp. aureus Mu50
augcugcuucuucagguguuu

SEQ ID NO: 2075687 - RNA, 14 nt, Staphylococcus aureus subsp. aureus Mu50
augcagauucuuca

SEQ ID NO: 2075688 - RNA, 21 nt, Staphylococcus aureus subsp. aureus Mu50
augccaucuuuguaaccuaaa

SEQ ID NO: 2075689 - RNA, 16 nt, Staphylococcus aureus subsp. aureus Mu50
augccauuguuaucca

SEQ ID NO: 2075690 - RNA, 17 nt, Staphylococcus aureus subsp. aureus Mu50
augccauaccugcaccu

SEQ ID NO: 2075691 - RNA, 23 nt, Staphylococcus aureus subsp. aureus Mu50
augccugcccuuuagucauguuu

SEQ ID NO: 2075692 - RNA, 19 nt, Staphylococcus aureus subsp. aureus Mu50
augccuugucuauuguaaa

SEQ ID NO: 2075693 - RNA, 17 nt, Staphylococcus aureus subsp. aureus Mu50
augccuuugauuuuacu

SEQ ID NO: 2075694 - RNA, 18 nt, Staphylococcus aureus subsp. aureus Mu50
augccucaguuagaagau

SEQ ID NO: 2075695 - RNA, 15 nt, Staphylococcus aureus subsp. aureus Mu50
augaugacaucaaua

SEQ ID NO: 2075696 - RNA, 14 nt, Staphylococcus aureus subsp. aureus Mu50
augaugaauuguug

SEQ ID NO: 2075697 - RNA, 19 nt, Staphylococcus aureus subsp. aureus Mu50
augaugagauaaaaucaua

SEQ ID NO: 2075698 - RNA, 14 nt, Staphylococcus aureus subsp. aureus Mu50
augaugauuuaagu

SEQ ID NO: 2075699 - RNA, 20 nt, Staphylococcus aureus subsp. aureus Mu50
augaugggaaaucaguaaua

SEQ ID NO: 2075700 - RNA, 22 nt, Staphylococcus aureus subsp. aureus Mu50
augauggguauuuuguucaguu

SEQ ID NO: 2075701 - RNA, 16 nt, Staphylococcus aureus subsp. aureus Mu50
augaugucauguauug

SEQ ID NO: 2075702 - RNA, 21 nt, Staphylococcus aureus subsp. aureus Mu50
augauguuaaaaaauauguau

SEQ ID NO: 2075703 - RNA, 13 nt, Staphylococcus aureus subsp. aureus Mu50
augauuauauuuu

SEQ ID NO: 2075704 - RNA, 18 nt, Staphylococcus aureus subsp. aureus Mu50
augauuauucucuuuauu

SEQ ID NO: 2075705 - RNA, 20 nt, Staphylococcus aureus subsp. aureus Mu50
augauuacuuuaagauuauu

SEQ ID NO: 2075706 - RNA, 14 nt, Staphylococcus aureus subsp. aureus Mu50
augauuaguaauga

SEQ ID NO: 2075707 - RNA, 19 nt, Staphylococcus aureus subsp. aureus Mu50
augauuacuccaauuacca

SEQ ID NO: 2075708 - RNA, 14 nt, Staphylococcus aureus subsp. aureus Mu50
augauuaauuaaag

SEQ ID NO: 2075709 - RNA, 18 nt, Staphylococcus aureus subsp. aureus Mu50
augauuacaacuuauucu

SEQ ID NO: 2075710 - RNA, 21 nt, Staphylococcus aureus subsp. aureus Mu50
augauuaaaguguuucaacau

SEQ ID NO: 2075711 - RNA, 17 nt, Staphylococcus aureus subsp. aureus Mu50
augauuaaaaaucaaag

SEQ ID NO: 2075712 - RNA, 21 nt, Staphylococcus aureus subsp. aureus Mu50
augauugguauacaguuuuac

SEQ ID NO: 2075713 - RNA, 16 nt, Staphylococcus aureus subsp. aureus Mu50
augauugcauugauuu

SEQ ID NO: 2075714 - RNA, 23 nt, Staphylococcus aureus subsp. aureus Mu50
augauuugauuuggguaauguuu

SEQ ID NO: 2075715 - RNA, 18 nt, Staphylococcus aureus subsp. aureus Mu50
augauuugugguaaucau

SEQ ID NO: 2075716 - RNA, 21 nt, Staphylococcus aureus subsp. aureus Mu50
augauuucacuucauaaagcg

SEQ ID NO: 2075717 - RNA, 15 nt, Staphylococcus aureus subsp. aureus Mu50
augauuuauaaaaac

SEQ ID NO: 2075718 - RNA, 16 nt, Staphylococcus aureus subsp. aureus Mu50
augauuuauaaaaacu

SEQ ID NO: 2075719 - RNA, 19 nt, Staphylococcus aureus subsp. aureus Mu50
augcaacuuauaauauuaa

SEQ ID NO: 2075720 - RNA, 18 nt, Staphylococcus aureus subsp. aureus Mu50
augauuuuuaaaaauaca

SEQ ID NO: 2075721 - RNA, 22 nt, Staphylococcus aureus subsp. aureus Mu50
augcacaccagccucuauaagu

SEQ ID NO: 2075722 - RNA, 19 nt, Staphylococcus aureus subsp. aureus Mu50
augcaagcgacgauuggaa

SEQ ID NO: 2075723 - RNA, 12 nt, Staphylococcus aureus subsp. aureus Mu50
augcaauacauu

SEQ ID NO: 2075724 - RNA, 14 nt, Staphylococcus aureus subsp. aureus Mu50
augcaauacauuaa

SEQ ID NO: 2075725 - RNA, 19 nt, Staphylococcus aureus subsp. aureus Mu50
augcaauacauuaauauaa

SEQ ID NO: 2075726 - RNA, 20 nt, Staphylococcus aureus subsp. aureus Mu50
augcaaguuggcggggcccc

SEQ ID NO: 2075727 - RNA, 14 nt, Staphylococcus aureus subsp. aureus Mu50
caauuccuuggugu

SEQ ID NO: 2075728 - RNA, 21 nt, Staphylococcus aureus subsp. aureus Mu50
caauucgcucacaugugaaau

SEQ ID NO: 2075729 - RNA, 12 nt, Staphylococcus aureus subsp. aureus Mu50
caauucuucaau

SEQ ID NO: 2075730 - RNA, 17 nt, Staphylococcus aureus subsp. aureus Mu50
caauucuuacaccugca

SEQ ID NO: 2075731 - RNA, 20 nt, Staphylococcus aureus subsp. aureus Mu50
caauucauuuuauaaaucaa

SEQ ID NO: 2075732 - RNA, 19 nt, Staphylococcus aureus subsp. aureus Mu50
caauuuauuaacuguguau

SEQ ID NO: 2075733 - RNA, 22 nt, Staphylococcus aureus subsp. aureus Mu50
caauuuauuauuaacuguaccu

SEQ ID NO: 2075734 - RNA, 22 nt, Staphylococcus aureus subsp. aureus Mu50
caauuucuaggccacuaagacc

SEQ ID NO: 2075735 - RNA, 18 nt, Staphylococcus aureus subsp. aureus Mu50
caauuucuucauuuucau

SEQ ID NO: 2075736 - RNA, 15 nt, Staphylococcus aureus subsp. aureus Mu50
caauuucuucauuuu

SEQ ID NO: 2075737 - RNA, 13 nt, Staphylococcus aureus subsp. aureus Mu50
caauugcuuuacc

SEQ ID NO: 2075738 - RNA, 15 nt, Staphylococcus aureus subsp. aureus Mu50
caaugacugagaaaa

SEQ ID NO: 2075739 - RNA, 17 nt, Staphylococcus aureus subsp. aureus Mu50
caaugcugauaccuaag

SEQ ID NO: 2075740 - RNA, 17 nt, Staphylococcus aureus subsp. aureus Mu50
caaugaauucauuuuau

SEQ ID NO: 2075741 - RNA, 14 nt, Staphylococcus aureus subsp. aureus Mu50
caaugaauuuacuc

SEQ ID NO: 2075742 - RNA, 22 nt, Staphylococcus aureus subsp. aureus Mu50
caaugaauuucuaauuuaguau

SEQ ID NO: 2075743 - RNA, 19 nt, Staphylococcus aureus subsp. aureus Mu50
caaugaauaacaagaaaaa

SEQ ID NO: 2075744 - RNA, 19 nt, Staphylococcus aureus subsp. aureus Mu50
caaugaauaaugacaaauu

SEQ ID NO: 2075745 - RNA, 17 nt, Staphylococcus aureus subsp. aureus Mu50
caaugacauccauacaa

SEQ ID NO: 2075746 - RNA, 13 nt, Staphylococcus aureus subsp. aureus Mu50
caauguauauuua

SEQ ID NO: 2075747 - RNA, 16 nt, Staphylococcus aureus subsp. aureus Mu50
caauggaucuguuaca

SEQ ID NO: 2075748 - RNA, 14 nt, Staphylococcus aureus subsp. aureus Mu50
caauggccauuuga

SEQ ID NO: 2075749 - RNA, 23 nt, Staphylococcus aureus subsp. aureus Mu50
cacaacauguuuggaugaacaaa

SEQ ID NO: 2075750 - RNA, 18 nt, Staphylococcus aureus subsp. aureus Mu50
caauuuggucauauaaac

SEQ ID NO: 2075751 - RNA, 21 nt, Staphylococcus aureus subsp. aureus Mu50
cacaacgauagauaucauuuu

SEQ ID NO: 2075752 - RNA, 20 nt, Staphylococcus aureus subsp. aureus Mu50
cacaauccuuucaucugcaa

SEQ ID NO: 2075753 - RNA, 17 nt, Staphylococcus aureus subsp. aureus Mu50
cacaauaauccaagaua

SEQ ID NO: 2075754 - RNA, 23 nt, Staphylococcus aureus subsp. aureus Mu50
cacaaguuuacagguugaauaaa

SEQ ID NO: 2075755 - RNA, 22 nt, Staphylococcus aureus subsp. aureus Mu50
cacaagcaucuacaauauucaa

SEQ ID NO: 2075756 - RNA, 17 nt, Staphylococcus aureus subsp. aureus Mu50
cacaaugauugaauauu

SEQ ID NO: 2075757 - RNA, 20 nt, Staphylococcus aureus subsp. aureus Mu50
cacacagguaaauuuaaaau

SEQ ID NO: 2075758 - RNA, 21 nt, Staphylococcus aureus subsp. aureus Mu50
cacacagguaaauuuaaaaua

SEQ ID NO: 2075759 - RNA, 13 nt, Staphylococcus aureus subsp. aureus Mu50
cacacaugauaau

SEQ ID NO: 2075760 - RNA, 18 nt, Staphylococcus aureus subsp. aureus Mu50
caccagauaucauaauau

SEQ ID NO: 2075761 - RNA, 14 nt, Staphylococcus aureus subsp. aureus Mu50
caccaccugugaca

SEQ ID NO: 2075762 - RNA, 13 nt, Staphylococcus aureus subsp. aureus Mu50
aaaauaaaauuaa

SEQ ID NO: 2075763 - RNA, 14 nt, Staphylococcus aureus subsp. aureus Mu50
aaaauaaaacaaau

SEQ ID NO: 2075764 - RNA, 15 nt, Staphylococcus aureus subsp. aureus Mu50
aaaauaaaaaugccg

SEQ ID NO: 2075765 - RNA, 17 nt, Staphylococcus aureus subsp. aureus Mu50
aaaauaaaaaaugcacu

SEQ ID NO: 2075766 - RNA, 13 nt, Staphylococcus aureus subsp. aureus Mu50
aaaauaaaaacuu

SEQ ID NO: 2075767 - RNA, 20 nt, Staphylococcus aureus subsp. aureus Mu50
aaaaguguuaaugucuucau

SEQ ID NO: 2075768 - RNA, 15 nt, Staphylococcus aureus subsp. aureus Mu50
aaaaguguaauguuc

SEQ ID NO: 2075769 - RNA, 14 nt, Staphylococcus aureus subsp. aureus Mu50
cacauauguccaua

SEQ ID NO: 2075770 - RNA, 15 nt, Staphylococcus aureus subsp. aureus Mu50
cacauagaguaauuu

SEQ ID NO: 2075771 - RNA, 14 nt, Staphylococcus aureus subsp. aureus Mu50
cacgacauguaggu

SEQ ID NO: 2075772 - RNA, 18 nt, Staphylococcus aureus subsp. aureus Mu50
cacgagcaacaucuuuug

SEQ ID NO: 2075773 - RNA, 14 nt, Staphylococcus aureus subsp. aureus Mu50
cacgagcugcuuca

SEQ ID NO: 2075774 - RNA, 13 nt, Staphylococcus aureus subsp. aureus Mu50
aaaauagaaaaau

SEQ ID NO: 2075775 - RNA, 20 nt, Staphylococcus aureus subsp. aureus Mu50
aaaauagaaaaauuucaaaa

SEQ ID NO: 2075776 - RNA, 15 nt, Staphylococcus aureus subsp. aureus Mu50
cacgaacaacauuag

SEQ ID NO: 2075777 - RNA, 15 nt, Staphylococcus aureus subsp. aureus Mu50
aaaauagcuauuaaa

SEQ ID NO: 2075778 - RNA, 21 nt, Staphylococcus aureus subsp. aureus Mu50
aaaauagcguaauuauuauaa

SEQ ID NO: 2075779 - RNA, 23 nt, Staphylococcus aureus subsp. aureus Mu50
aaaauagccauauucauauuacu

SEQ ID NO: 2075780 - RNA, 22 nt, Staphylococcus aureus subsp. aureus Mu50
aaaauagauugaaaaaauaacu

SEQ ID NO: 2075781 - RNA, 13 nt, Staphylococcus aureus subsp. aureus Mu50
aaaauagaaagaa

SEQ ID NO: 2075782 - RNA, 23 nt, Staphylococcus aureus subsp. aureus Mu50
caccuggucguacuuucaaauaa

SEQ ID NO: 2075783 - RNA, 15 nt, Staphylococcus aureus subsp. aureus Mu50
aaaauacuauacuga

SEQ ID NO: 2075784 - RNA, 23 nt, Staphylococcus aureus subsp. aureus Mu50
caccuuaucacuuggaauaauac

SEQ ID NO: 2075785 - RNA, 16 nt, Staphylococcus aureus subsp. aureus Mu50
aaaauacgauuuguuc

SEQ ID NO: 2075786 - RNA, 21 nt, Staphylococcus aureus subsp. aureus Mu50
caccuguuacuugagaaccau

SEQ ID NO: 2075787 - RNA, 14 nt, Staphylococcus aureus subsp. aureus Mu50
aaaauacauaauua

SEQ ID NO: 2075788 - RNA, 15 nt, Staphylococcus aureus subsp. aureus Mu50
aaaauaauuguucuu

SEQ ID NO: 2075789 - RNA, 20 nt, Staphylococcus aureus subsp. aureus Mu50
aaaauaauuguucuucagaa

SEQ ID NO: 2075790 - RNA, 13 nt, Staphylococcus aureus subsp. aureus Mu50
aaaauaauuaaau

SEQ ID NO: 2075791 - RNA, 13 nt, Staphylococcus aureus subsp. aureus Mu50
aaaauaauuuuau

SEQ ID NO: 2075792 - RNA, 14 nt, Staphylococcus aureus subsp. aureus Mu50
cacgauuuuuaaaa

SEQ ID NO: 2075793 - RNA, 14 nt, Staphylococcus aureus subsp. aureus Mu50
cacgcaauaucaua

SEQ ID NO: 2075794 - RNA, 16 nt, Staphylococcus aureus subsp. aureus Mu50
aaaauaguucuuuaaa

SEQ ID NO: 2075795 - RNA, 19 nt, Staphylococcus aureus subsp. aureus Mu50
aaaauaguucuuuaaauua

SEQ ID NO: 2075796 - RNA, 23 nt, Staphylococcus aureus subsp. aureus Mu50
aaaauagucggggccccaacaca

SEQ ID NO: 2075797 - RNA, 21 nt, Staphylococcus aureus subsp. aureus Mu50
aaaauaguucuuuaaauuaua

SEQ ID NO: 2075798 - RNA, 23 nt, Staphylococcus aureus subsp. aureus Mu50
cacgcuaacauucagugcaauga

SEQ ID NO: 2075799 - RNA, 20 nt, Staphylococcus aureus subsp. aureus Mu50
caccgcguguuuuuaacaua

SEQ ID NO: 2075800 - RNA, 23 nt, Staphylococcus aureus subsp. aureus Mu50
aaaauaacauguuuguggcaccu

SEQ ID NO: 2075801 - RNA, 13 nt, Staphylococcus aureus subsp. aureus Mu50
caccuaaaugauu

SEQ ID NO: 2075802 - RNA, 13 nt, Staphylococcus aureus subsp. aureus Mu50
caccuaauaccau

SEQ ID NO: 2075803 - RNA, 13 nt, Staphylococcus aureus subsp. aureus Mu50
caccuacaaauau

SEQ ID NO: 2075804 - RNA, 15 nt, Staphylococcus aureus subsp. aureus Mu50
cacccauuugucuua

SEQ ID NO: 2075805 - RNA, 22 nt, Staphylococcus aureus subsp. aureus Mu50
caccaguagucacuguuugcca

SEQ ID NO: 2075806 - RNA, 20 nt, Staphylococcus aureus subsp. aureus Mu50
caaagccuucuaucucuuua

SEQ ID NO: 2075807 - RNA, 19 nt, Staphylococcus aureus subsp. aureus Mu50
caaagauuccuguaacaag

SEQ ID NO: 2075808 - RNA, 16 nt, Staphylococcus aureus subsp. aureus Mu50
caaagacucaauuuca

SEQ ID NO: 2075809 - RNA, 21 nt, Staphylococcus aureus subsp. aureus Mu50
caaagacucaauuucauuuga

SEQ ID NO: 2075810 - RNA, 15 nt, Staphylococcus aureus subsp. aureus Mu50
caaagacauacaguc

SEQ ID NO: 2075811 - RNA, 15 nt, Staphylococcus aureus subsp. aureus Mu50
caaagaaaucaccag

SEQ ID NO: 2075812 - RNA, 19 nt, Staphylococcus aureus subsp. aureus Mu50
caaagaaacggaaaugacu

SEQ ID NO: 2075813 - RNA, 14 nt, Staphylococcus aureus subsp. aureus Mu50
caaacguauguaca

SEQ ID NO: 2075814 - RNA, 17 nt, Staphylococcus aureus subsp. aureus Mu50
caaacuuggcaaugaaa

SEQ ID NO: 2075815 - RNA, 15 nt, Staphylococcus aureus subsp. aureus Mu50
caaacaauacauaau

SEQ ID NO: 2075816 - RNA, 18 nt, Staphylococcus aureus subsp. aureus Mu50
caaacaaagcucaauaaa

SEQ ID NO: 2075817 - RNA, 11 nt, Staphylococcus aureus subsp. aureus Mu50
caaacaaaggg

SEQ ID NO: 2075818 - RNA, 15 nt, Staphylococcus aureus subsp. aureus Mu50
caaacaaagggguau

SEQ ID NO: 2075819 - RNA, 22 nt, Staphylococcus aureus subsp. aureus Mu50
caaacaaccugugauaaaaauc

SEQ ID NO: 2075820 - RNA, 21 nt, Staphylococcus aureus subsp. aureus Mu50
caaacaaccugugauaaaaau

SEQ ID NO: 2075821 - RNA, 20 nt, Staphylococcus aureus subsp. aureus Mu50
caaaagauguuucaaaauaa

SEQ ID NO: 2075822 - RNA, 21 nt, Staphylococcus aureus subsp. aureus Mu50
caaaagauguuucaaaauaau

SEQ ID NO: 2075823 - RNA, 23 nt, Staphylococcus aureus subsp. aureus Mu50
caaaagauguuucaaaauaauuu

SEQ ID NO: 2075824 - RNA, 21 nt, Staphylococcus aureus subsp. aureus Mu50
caaaacuuguaaucauaccag

SEQ ID NO: 2075825 - RNA, 12 nt, Staphylococcus aureus subsp. aureus Mu50
caaaagaaauuc

SEQ ID NO: 2075826 - RNA, 19 nt, Staphylococcus aureus subsp. aureus Mu50
caaaacuuuuacuuucuca

SEQ ID NO: 2075827 - RNA, 18 nt, Staphylococcus aureus subsp. aureus Mu50
caaaaagcccuauuguuu

SEQ ID NO: 2075828 - RNA, 22 nt, Staphylococcus aureus subsp. aureus Mu50
caaaaagcccuauuguuuuuua

SEQ ID NO: 2075829 - RNA, 16 nt, Staphylococcus aureus subsp. aureus Mu50
caaaaacgguaauuuc

SEQ ID NO: 2075830 - RNA, 18 nt, Staphylococcus aureus subsp. aureus Mu50
caaaacgcauuucaugug

SEQ ID NO: 2075831 - RNA, 20 nt, Staphylococcus aureus subsp. aureus Mu50
caaaacgcauuucauguguc

SEQ ID NO: 2075832 - RNA, 13 nt, Staphylococcus aureus subsp. aureus Mu50
caaaaguaugauu

SEQ ID NO: 2075833 - RNA, 21 nt, Staphylococcus aureus subsp. aureus Mu50
caaaaguaugauuuguuugau

SEQ ID NO: 2075834 - RNA, 18 nt, Staphylococcus aureus subsp. aureus Mu50
caaaauuauguaaaaaau

SEQ ID NO: 2075835 - RNA, 16 nt, Staphylococcus aureus subsp. aureus Mu50
caaaauauaaaauccu

SEQ ID NO: 2075836 - RNA, 15 nt, Staphylococcus aureus subsp. aureus Mu50
caacacccauauaau

SEQ ID NO: 2075837 - RNA, 19 nt, Staphylococcus aureus subsp. aureus Mu50
caacacccauauaauuugg

SEQ ID NO: 2075838 - RNA, 13 nt, Staphylococcus aureus subsp. aureus Mu50
caacaaauauaau

SEQ ID NO: 2075839 - RNA, 22 nt, Staphylococcus aureus subsp. aureus Mu50
caacaucgauuuaucauuauuu

SEQ ID NO: 2075840 - RNA, 22 nt, Staphylococcus aureus subsp. aureus Mu50
caacaucuuuuguugcucagug

SEQ ID NO: 2075841 - RNA, 21 nt, Staphylococcus aureus subsp. aureus Mu50
caacaguuuuauuaucuuugu

SEQ ID NO: 2075842 - RNA, 14 nt, Staphylococcus aureus subsp. aureus Mu50
caacaguuuuaaag

SEQ ID NO: 2075843 - RNA, 22 nt, Staphylococcus aureus subsp. aureus Mu50
caaccgcuugggcugacauuuu

SEQ ID NO: 2075844 - RNA, 12 nt, Staphylococcus aureus subsp. aureus Mu50
caacauguuugg

SEQ ID NO: 2075845 - RNA, 14 nt, Staphylococcus aureus subsp. aureus Mu50
caacauguuuggau

SEQ ID NO: 2075846 - RNA, 22 nt, Staphylococcus aureus subsp. aureus Mu50
caacauguuuggaugaacaaaa

SEQ ID NO: 2075847 - RNA, 22 nt, Staphylococcus aureus subsp. aureus Mu50
caacauguuccgcuacaaaaca

SEQ ID NO: 2075848 - RNA, 18 nt, Staphylococcus aureus subsp. aureus Mu50
caacauuacuaauugauc

SEQ ID NO: 2075849 - RNA, 16 nt, Staphylococcus aureus subsp. aureus Mu50
caacauuaauaaauaa

SEQ ID NO: 2075850 - RNA, 17 nt, Staphylococcus aureus subsp. aureus Mu50
caacauuaauaaauaau

SEQ ID NO: 2075851 - RNA, 19 nt, Staphylococcus aureus subsp. aureus Mu50
caacauuaauaaauaauaa

SEQ ID NO: 2075852 - RNA, 15 nt, Staphylococcus aureus subsp. aureus Mu50
caacauuauuuuugu

SEQ ID NO: 2075853 - RNA, 15 nt, Staphylococcus aureus subsp. aureus Mu50
caacauuauuuauau

SEQ ID NO: 2075854 - RNA, 20 nt, Staphylococcus aureus subsp. aureus Mu50
caaaucggaauaaaauaaau

SEQ ID NO: 2075855 - RNA, 16 nt, Staphylococcus aureus subsp. aureus Mu50
caaaucggaauaaaau

SEQ ID NO: 2075856 - RNA, 23 nt, Staphylococcus aureus subsp. aureus Mu50
caaaucgauuaauuauaaguagu

SEQ ID NO: 2075857 - RNA, 21 nt, Staphylococcus aureus subsp. aureus Mu50
caaauaguuaagauuuuaacu

SEQ ID NO: 2075858 - RNA, 21 nt, Staphylococcus aureus subsp. aureus Mu50
caaauauacuugccuucaaau

SEQ ID NO: 2075859 - RNA, 17 nt, Staphylococcus aureus subsp. aureus Mu50
caaauaucaguaauaau

SEQ ID NO: 2075860 - RNA, 13 nt, Staphylococcus aureus subsp. aureus Mu50
caaauauacuuuu

SEQ ID NO: 2075861 - RNA, 15 nt, Staphylococcus aureus subsp. aureus Mu50
caaauaucaguaaua

SEQ ID NO: 2075862 - RNA, 14 nt, Staphylococcus aureus subsp. aureus Mu50
caaaucaaauacau

SEQ ID NO: 2075863 - RNA, 13 nt, Staphylococcus aureus subsp. aureus Mu50
caaauaugagugg

SEQ ID NO: 2075864 - RNA, 15 nt, Staphylococcus aureus subsp. aureus Mu50
caaauauuucuaaac

SEQ ID NO: 2075865 - RNA, 18 nt, Staphylococcus aureus subsp. aureus Mu50
caaauauuauuaaaucaa

SEQ ID NO: 2075866 - RNA, 23 nt, Staphylococcus aureus subsp. aureus Mu50
caaaguacucaaguaaucaagca

SEQ ID NO: 2075867 - RNA, 16 nt, Staphylococcus aureus subsp. aureus Mu50
caaaguauauacuaau

SEQ ID NO: 2075868 - RNA, 17 nt, Staphylococcus aureus subsp. aureus Mu50
caaagucucuaguaucu

SEQ ID NO: 2075869 - RNA, 16 nt, Staphylococcus aureus subsp. aureus Mu50
caaauucauauuaacu

SEQ ID NO: 2075870 - RNA, 16 nt, Staphylococcus aureus subsp. aureus Mu50
caaauuaaaaaacaau

SEQ ID NO: 2075871 - RNA, 19 nt, Staphylococcus aureus subsp. aureus Mu50
caaauucgacucaaacaau

SEQ ID NO: 2075872 - RNA, 21 nt, Staphylococcus aureus subsp. aureus Mu50
caaauuggauaauuucuucuu

SEQ ID NO: 2075873 - RNA, 13 nt, Staphylococcus aureus subsp. aureus Mu50
caaauuucucuuu

SEQ ID NO: 2075874 - RNA, 16 nt, Staphylococcus aureus subsp. aureus Mu50
caaauguauaaauaau

SEQ ID NO: 2075875 - RNA, 23 nt, Staphylococcus aureus subsp. aureus Mu50
caaaugugguggguauauaauuu

SEQ ID NO: 2075876 - RNA, 20 nt, Staphylococcus aureus subsp. aureus Mu50
caaauguugaauguggaaca

SEQ ID NO: 2075877 - RNA, 17 nt, Staphylococcus aureus subsp. aureus Mu50
caaaugacauuuuaaau

SEQ ID NO: 2075878 - RNA, 20 nt, Staphylococcus aureus subsp. aureus Mu50
caaaugaauggagcaugauu

SEQ ID NO: 2075879 - RNA, 17 nt, Staphylococcus aureus subsp. aureus Mu50
caaaugagcguuccauu

SEQ ID NO: 2075880 - RNA, 14 nt, Staphylococcus aureus subsp. aureus Mu50
caaaucuuuuaaau

SEQ ID NO: 2075881 - RNA, 22 nt, Staphylococcus aureus subsp. aureus Mu50
caaaucucgucacauauaaaua

SEQ ID NO: 2075882 - RNA, 19 nt, Staphylococcus aureus subsp. aureus Mu50
caaaucucgucacauauaa

SEQ ID NO: 2075883 - RNA, 14 nt, Staphylococcus aureus subsp. aureus Mu50
caacugcuuuuuau

SEQ ID NO: 2075884 - RNA, 13 nt, Staphylococcus aureus subsp. aureus Mu50
caacuuaauagaa

SEQ ID NO: 2075885 - RNA, 13 nt, Staphylococcus aureus subsp. aureus Mu50
caacuuagaauuu

SEQ ID NO: 2075886 - RNA, 13 nt, Staphylococcus aureus subsp. aureus Mu50
caacuuauuauuu

SEQ ID NO: 2075887 - RNA, 18 nt, Staphylococcus aureus subsp. aureus Mu50
caacugcugcuaaaauaa

SEQ ID NO: 2075888 - RNA, 14 nt, Staphylococcus aureus subsp. aureus Mu50
caacucuaacagcu

SEQ ID NO: 2075889 - RNA, 14 nt, Staphylococcus aureus subsp. aureus Mu50
caacucguuuuucc

SEQ ID NO: 2075890 - RNA, 21 nt, Staphylococcus aureus subsp. aureus Mu50
caacguauauaaguuaaaauu

SEQ ID NO: 2075891 - RNA, 15 nt, Staphylococcus aureus subsp. aureus Mu50
caacuacuuaaauua

SEQ ID NO: 2075892 - RNA, 20 nt, Staphylococcus aureus subsp. aureus Mu50
caagaugcucauugcauuuc

SEQ ID NO: 2075893 - RNA, 21 nt, Staphylococcus aureus subsp. aureus Mu50
caagauuaugacaacauaaca

SEQ ID NO: 2075894 - RNA, 15 nt, Staphylococcus aureus subsp. aureus Mu50
caagccguugguugu

SEQ ID NO: 2075895 - RNA, 18 nt, Staphylococcus aureus subsp. aureus Mu50
caagcguuucuugaucua

SEQ ID NO: 2075896 - RNA, 17 nt, Staphylococcus aureus subsp. aureus Mu50
caagaaguaauguuaaa

SEQ ID NO: 2075897 - RNA, 17 nt, Staphylococcus aureus subsp. aureus Mu50
caagaaucucuaucaua

SEQ ID NO: 2075898 - RNA, 23 nt, Staphylococcus aureus subsp. aureus Mu50
caagaauuauggcagauccauaa

SEQ ID NO: 2075899 - RNA, 16 nt, Staphylococcus aureus subsp. aureus Mu50
caagagauaagaaaau

SEQ ID NO: 2075900 - RNA, 23 nt, Staphylococcus aureus subsp. aureus Mu50
caagagauaagaaaauaccuaau

SEQ ID NO: 2075901 - RNA, 18 nt, Staphylococcus aureus subsp. aureus Mu50
caagagaauuaauaauuu

SEQ ID NO: 2075902 - RNA, 15 nt, Staphylococcus aureus subsp. aureus Mu50
caaucuauuuuaaac

SEQ ID NO: 2075903 - RNA, 14 nt, Staphylococcus aureus subsp. aureus Mu50
caaucuauauaaau

SEQ ID NO: 2075904 - RNA, 18 nt, Staphylococcus aureus subsp. aureus Mu50
caaucguugaaaaauauc

SEQ ID NO: 2075905 - RNA, 23 nt, Staphylococcus aureus subsp. aureus Mu50
caaucguuucuuccgcacugccu

SEQ ID NO: 2075906 - RNA, 13 nt, Staphylococcus aureus subsp. aureus Mu50
caaucgauuuuau

SEQ ID NO: 2075907 - RNA, 12 nt, Staphylococcus aureus subsp. aureus Mu50
caaucauaauac

SEQ ID NO: 2075908 - RNA, 20 nt, Staphylococcus aureus subsp. aureus Mu50
caaucacuccucuauuuuau

SEQ ID NO: 2075909 - RNA, 17 nt, Staphylococcus aureus subsp. aureus Mu50
caaucaguaauaaugua

SEQ ID NO: 2075910 - RNA, 23 nt, Staphylococcus aureus subsp. aureus Mu50
caaucaacgagucauaaauauaa

SEQ ID NO: 2075911 - RNA, 15 nt, Staphylococcus aureus subsp. aureus Mu50
caaucaacuucauau

SEQ ID NO: 2075912 - RNA, 22 nt, Staphylococcus aureus subsp. aureus Mu50
caauaucuucuuuuaauauuug

SEQ ID NO: 2075913 - RNA, 15 nt, Staphylococcus aureus subsp. aureus Mu50
caauauuuuuacaua

SEQ ID NO: 2075914 - RNA, 20 nt, Staphylococcus aureus subsp. aureus Mu50
caauauuuuuacauauuuau

SEQ ID NO: 2075915 - RNA, 14 nt, Staphylococcus aureus subsp. aureus Mu50
caaucacagcaaua

SEQ ID NO: 2075916 - RNA, 17 nt, Staphylococcus aureus subsp. aureus Mu50
caaucacagcaauaaua

SEQ ID NO: 2075917 - RNA, 13 nt, Staphylococcus aureus subsp. aureus Mu50
caaucacaauaua

SEQ ID NO: 2075918 - RNA, 13 nt, Staphylococcus aureus subsp. aureus Mu50
caauaucauauuu

SEQ ID NO: 2075919 - RNA, 20 nt, Staphylococcus aureus subsp. aureus Mu50
caauauauucaccuacaaca

SEQ ID NO: 2075920 - RNA, 15 nt, Staphylococcus aureus subsp. aureus Mu50
caauauauucaccua

SEQ ID NO: 2075921 - RNA, 13 nt, Staphylococcus aureus subsp. aureus Mu50
caauacgcaaugu

SEQ ID NO: 2075922 - RNA, 17 nt, Staphylococcus aureus subsp. aureus Mu50
caauacgauugcaauug

SEQ ID NO: 2075923 - RNA, 23 nt, Staphylococcus aureus subsp. aureus Mu50
caauacgaugaugauuuauaaaa

SEQ ID NO: 2075924 - RNA, 21 nt, Staphylococcus aureus subsp. aureus Mu50
caauauagaaaaugaguacaa

SEQ ID NO: 2075925 - RNA, 20 nt, Staphylococcus aureus subsp. aureus Mu50
caauacuaccuuccauuucg

SEQ ID NO: 2075926 - RNA, 14 nt, Staphylococcus aureus subsp. aureus Mu50
caauacgaaaucaa

SEQ ID NO: 2075927 - RNA, 17 nt, Staphylococcus aureus subsp. aureus Mu50
caauacagaacuuuaau

SEQ ID NO: 2075928 - RNA, 12 nt, Staphylococcus aureus subsp. aureus Mu50
caauaauuuuau

SEQ ID NO: 2075929 - RNA, 12 nt, Staphylococcus aureus subsp. aureus Mu50
caauaauuuaau

SEQ ID NO: 2075930 - RNA, 14 nt, Staphylococcus aureus subsp. aureus Mu50
caauaauaaaucac

SEQ ID NO: 2075931 - RNA, 19 nt, Staphylococcus aureus subsp. aureus Mu50
caauaaaaaaccaagugca

SEQ ID NO: 2075932 - RNA, 22 nt, Staphylococcus aureus subsp. aureus Mu50
caaguuucauggggcuuaugca

SEQ ID NO: 2075933 - RNA, 24 nt, Staphylococcus aureus subsp. aureus Mu50
caaguuuaguaucuccaucaaagu

SEQ ID NO: 2075934 - RNA, 20 nt, Staphylococcus aureus subsp. aureus Mu50
caaguucaccguaaucuuuu

SEQ ID NO: 2075935 - RNA, 11 nt, Staphylococcus aureus subsp. aureus Mu50
caauaaaaaug

SEQ ID NO: 2075936 - RNA, 19 nt, Staphylococcus aureus subsp. aureus Mu50
caaguuuucggcuagauuu

SEQ ID NO: 2075937 - RNA, 10 nt, Staphylococcus aureus subsp. aureus Mu50
caauaaaauu

SEQ ID NO: 2075938 - RNA, 22 nt, Staphylococcus aureus subsp. aureus Mu50
caagucguucucuuaaauauga

SEQ ID NO: 2075939 - RNA, 15 nt, Staphylococcus aureus subsp. aureus Mu50
caagucuaacaguua

SEQ ID NO: 2075940 - RNA, 20 nt, Staphylococcus aureus subsp. aureus Mu50
caagugcuugguuaaaguua

SEQ ID NO: 2075941 - RNA, 22 nt, Staphylococcus aureus subsp. aureus Mu50
caaggauguuauaaaaugaaua

SEQ ID NO: 2075942 - RNA, 16 nt, Staphylococcus aureus subsp. aureus Mu50
caaggauguuauaaaa

SEQ ID NO: 2075943 - RNA, 20 nt, Staphylococcus aureus subsp. aureus Mu50
caaguaugagacgcauugca

SEQ ID NO: 2075944 - RNA, 15 nt, Staphylococcus aureus subsp. aureus Mu50
aucagggaaaucauc

SEQ ID NO: 2075945 - RNA, 16 nt, Staphylococcus aureus subsp. aureus Mu50
aucaguaccaaagaaa

SEQ ID NO: 2075946 - RNA, 20 nt, Staphylococcus aureus subsp. aureus Mu50
aucaguauaaucagcaaugu

SEQ ID NO: 2075947 - RNA, 18 nt, Staphylococcus aureus subsp. aureus Mu50
aaaacgacucauuauaaa

SEQ ID NO: 2075948 - RNA, 16 nt, Staphylococcus aureus subsp. aureus Mu50
aaaacgauaagaauua

SEQ ID NO: 2075949 - RNA, 16 nt, Staphylococcus aureus subsp. aureus Mu50
aucaguugagucaauu

SEQ ID NO: 2075950 - RNA, 23 nt, Staphylococcus aureus subsp. aureus Mu50
aucagucucuaaaacuuuuucaa

SEQ ID NO: 2075951 - RNA, 18 nt, Staphylococcus aureus subsp. aureus Mu50
aucaguccgcuuuuucau

SEQ ID NO: 2075952 - RNA, 18 nt, Staphylococcus aureus subsp. aureus Mu50
aucagucauucacauaca

SEQ ID NO: 2075953 - RNA, 13 nt, Staphylococcus aureus subsp. aureus Mu50
aucagucauucac

SEQ ID NO: 2075954 - RNA, 17 nt, Staphylococcus aureus subsp. aureus Mu50
aucaguauuuacuuuuc

SEQ ID NO: 2075955 - RNA, 20 nt, Staphylococcus aureus subsp. aureus Mu50
aucaguuguguaauaaagca

SEQ ID NO: 2075956 - RNA, 21 nt, Staphylococcus aureus subsp. aureus Mu50
aucaguuucaucaaguauaaa

SEQ ID NO: 2075957 - RNA, 17 nt, Staphylococcus aureus subsp. aureus Mu50
aucagcuauaaaaguac

SEQ ID NO: 2075958 - RNA, 14 nt, Staphylococcus aureus subsp. aureus Mu50
aucagcucuuaaau

SEQ ID NO: 2075959 - RNA, 17 nt, Staphylococcus aureus subsp. aureus Mu50
aucaccuuuuuuaacuu

SEQ ID NO: 2075960 - RNA, 14 nt, Staphylococcus aureus subsp. aureus Mu50
aucaccagauuuua

SEQ ID NO: 2075961 - RNA, 17 nt, Staphylococcus aureus subsp. aureus Mu50
aucaccauacuaaaaca

SEQ ID NO: 2075962 - RNA, 15 nt, Staphylococcus aureus subsp. aureus Mu50
aucaauuucucuuuc

SEQ ID NO: 2075963 - RNA, 19 nt, Staphylococcus aureus subsp. aureus Mu50
aucaauuucuguaauaaua

SEQ ID NO: 2075964 - RNA, 17 nt, Staphylococcus aureus subsp. aureus Mu50
aucaauuucuguaauaa

SEQ ID NO: 2075965 - RNA, 22 nt, Staphylococcus aureus subsp. aureus Mu50
aucaauuuauuauuaacuguac

SEQ ID NO: 2075966 - RNA, 15 nt, Staphylococcus aureus subsp. aureus Mu50
aucacaacacauaaa

SEQ ID NO: 2075967 - RNA, 23 nt, Staphylococcus aureus subsp. aureus Mu50
aucacaauacgaaaucaaaaaua

SEQ ID NO: 2075968 - RNA, 13 nt, Staphylococcus aureus subsp. aureus Mu50
aucacaucauacc

SEQ ID NO: 2075969 - RNA, 22 nt, Staphylococcus aureus subsp. aureus Mu50
aucacacgacauguagguaauu

SEQ ID NO: 2075970 - RNA, 20 nt, Staphylococcus aureus subsp. aureus Mu50
aucacacgcauacaggaaau

SEQ ID NO: 2075971 - RNA, 14 nt, Staphylococcus aureus subsp. aureus Mu50
auauuauuaaauca

SEQ ID NO: 2075972 - RNA, 20 nt, Staphylococcus aureus subsp. aureus Mu50
auauuaucguaauuguuaaa

SEQ ID NO: 2075973 - RNA, 22 nt, Staphylococcus aureus subsp. aureus Mu50
auauuaugauacgcuuuuuaaa

SEQ ID NO: 2075974 - RNA, 13 nt, Staphylococcus aureus subsp. aureus Mu50
auauuagugacau

SEQ ID NO: 2075975 - RNA, 19 nt, Staphylococcus aureus subsp. aureus Mu50
auauuagugauauuuuucg

SEQ ID NO: 2075976 - RNA, 23 nt, Staphylococcus aureus subsp. aureus Mu50
auauuauaacccucguaggcaua

SEQ ID NO: 2075977 - RNA, 17 nt, Staphylococcus aureus subsp. aureus Mu50
auauuaggcuuaaauau

SEQ ID NO: 2075978 - RNA, 18 nt, Staphylococcus aureus subsp. aureus Mu50
auauuacuucucaucgaa

SEQ ID NO: 2075979 - RNA, 16 nt, Staphylococcus aureus subsp. aureus Mu50
auauucgcuuaaaaac

SEQ ID NO: 2075980 - RNA, 16 nt, Staphylococcus aureus subsp. aureus Mu50
auauucaaauuuacca

SEQ ID NO: 2075981 - RNA, 13 nt, Staphylococcus aureus subsp. aureus Mu50
auauuauuucaau

SEQ ID NO: 2075982 - RNA, 18 nt, Staphylococcus aureus subsp. aureus Mu50
auauuauuuugcuuuaau

SEQ ID NO: 2075983 - RNA, 18 nt, Staphylococcus aureus subsp. aureus Mu50
auauuaaauuauggagcg

SEQ ID NO: 2075984 - RNA, 12 nt, Staphylococcus aureus subsp. aureus Mu50
auauuaaauuca

SEQ ID NO: 2075985 - RNA, 13 nt, Staphylococcus aureus subsp. aureus Mu50
auauuaaauuucu

SEQ ID NO: 2075986 - RNA, 15 nt, Staphylococcus aureus subsp. aureus Mu50
auauuaacaacuuua

SEQ ID NO: 2075987 - RNA, 15 nt, Staphylococcus aureus subsp. aureus Mu50
auauuaacaccagau

SEQ ID NO: 2075988 - RNA, 16 nt, Staphylococcus aureus subsp. aureus Mu50
auauuaaaguaaaaua

SEQ ID NO: 2075989 - RNA, 13 nt, Staphylococcus aureus subsp. aureus Mu50
auauuaaaguaaa

SEQ ID NO: 2075990 - RNA, 15 nt, Staphylococcus aureus subsp. aureus Mu50
auauuaaacuuauaa

SEQ ID NO: 2075991 - RNA, 18 nt, Staphylococcus aureus subsp. aureus Mu50
auauuaacuguuagacuu

SEQ ID NO: 2075992 - RNA, 19 nt, Staphylococcus aureus subsp. aureus Mu50
auauuaacguuaguauaaa

SEQ ID NO: 2075993 - RNA, 21 nt, Staphylococcus aureus subsp. aureus Mu50
auauuacucaaaauuaaagcu

SEQ ID NO: 2075994 - RNA, 21 nt, Staphylococcus aureus subsp. aureus Mu50
auauuacuaaccuauuaaaaa

SEQ ID NO: 2075995 - RNA, 19 nt, Staphylococcus aureus subsp. aureus Mu50
auauuacuucucaucgaau

SEQ ID NO: 2075996 - RNA, 19 nt, Staphylococcus aureus subsp. aureus Mu50
auauuagauaucuuaaucu

SEQ ID NO: 2075997 - RNA, 14 nt, Staphylococcus aureus subsp. aureus Mu50
auauuaauugaaaa

SEQ ID NO: 2075998 - RNA, 22 nt, Staphylococcus aureus subsp. aureus Mu50
auauuaaucguuaauguauaaa

SEQ ID NO: 2075999 - RNA, 18 nt, Staphylococcus aureus subsp. aureus Mu50
auauuaagcgucuaucuc

SEQ ID NO: 2076000 - RNA, 17 nt, Staphylococcus aureus subsp. aureus Mu50
auauuaaggucauuuuu

SEQ ID NO: 2076001 - RNA, 18 nt, Staphylococcus aureus subsp. aureus Mu50
auauuaaggucauuuuua

SEQ ID NO: 2076002 - RNA, 19 nt, Staphylococcus aureus subsp. aureus Mu50
auauuaaggucauuuuuaa

SEQ ID NO: 2076003 - RNA, 21 nt, Staphylococcus aureus subsp. aureus Mu50
auauuaaggucauuuuuaauu

SEQ ID NO: 2076004 - RNA, 16 nt, Staphylococcus aureus subsp. aureus Mu50
auauuaagucuagcau

SEQ ID NO: 2076005 - RNA, 22 nt, Staphylococcus aureus subsp. aureus Mu50
auaugugcuuuuguaaauuaca

SEQ ID NO: 2076006 - RNA, 19 nt, Staphylococcus aureus subsp. aureus Mu50
auaugugguggcuauauaa

SEQ ID NO: 2076007 - RNA, 12 nt, Staphylococcus aureus subsp. aureus Mu50
auaugugagcaa

SEQ ID NO: 2076008 - RNA, 21 nt, Staphylococcus aureus subsp. aureus Mu50
auauguuuuaugauuuucuuu

SEQ ID NO: 2076009 - RNA, 22 nt, Staphylococcus aureus subsp. aureus Mu50
auauguuuuauaauaaauguca

SEQ ID NO: 2076010 - RNA, 21 nt, Staphylococcus aureus subsp. aureus Mu50
auauuaaaauuaaaacuuuca

SEQ ID NO: 2076011 - RNA, 21 nt, Staphylococcus aureus subsp. aureus Mu50
auaugguuagagaaaaaucug

SEQ ID NO: 2076012 - RNA, 13 nt, Staphylococcus aureus subsp. aureus Mu50
auauguaaucaga

SEQ ID NO: 2076013 - RNA, 19 nt, Staphylococcus aureus subsp. aureus Mu50
auauguauaacauuauuaa

SEQ ID NO: 2076014 - RNA, 15 nt, Staphylococcus aureus subsp. aureus Mu50
auauguaaaugaaau

SEQ ID NO: 2076015 - RNA, 16 nt, Staphylococcus aureus subsp. aureus Mu50
auauguaaaugaaaua

SEQ ID NO: 2076016 - RNA, 22 nt, Staphylococcus aureus subsp. aureus Mu50
auaugccgauugcucuaaucca

SEQ ID NO: 2076017 - RNA, 13 nt, Staphylococcus aureus subsp. aureus Mu50
auaugcaucaaca

SEQ ID NO: 2076018 - RNA, 12 nt, Staphylococcus aureus subsp. aureus Mu50
auaugcauauau

SEQ ID NO: 2076019 - RNA, 15 nt, Staphylococcus aureus subsp. aureus Mu50
auauccuguuucaua

SEQ ID NO: 2076020 - RNA, 23 nt, Staphylococcus aureus subsp. aureus Mu50
auaugcuuguugugaauaaaauu

SEQ ID NO: 2076021 - RNA, 22 nt, Staphylococcus aureus subsp. aureus Mu50
auaugcuuuaggugaguuucca

SEQ ID NO: 2076022 - RNA, 16 nt, Staphylococcus aureus subsp. aureus Mu50
auauggaauacuacac

SEQ ID NO: 2076023 - RNA, 20 nt, Staphylococcus aureus subsp. aureus Mu50
auaugcuauauuuaguuaau

SEQ ID NO: 2076024 - RNA, 14 nt, Staphylococcus aureus subsp. aureus Mu50
auauggauuuugaa

SEQ ID NO: 2076025 - RNA, 14 nt, Staphylococcus aureus subsp. aureus Mu50
auauggaauuguau

SEQ ID NO: 2076026 - RNA, 21 nt, Staphylococcus aureus subsp. aureus Mu50
aucaaaguaucagucauugca

SEQ ID NO: 2076027 - RNA, 19 nt, Staphylococcus aureus subsp. aureus Mu50
aucaaaguacuaacguuuu

SEQ ID NO: 2076028 - RNA, 14 nt, Staphylococcus aureus subsp. aureus Mu50
aucaaagaggcaca

SEQ ID NO: 2076029 - RNA, 20 nt, Staphylococcus aureus subsp. aureus Mu50
aucaaagaggcacagcggaa

SEQ ID NO: 2076030 - RNA, 18 nt, Staphylococcus aureus subsp. aureus Mu50
aucaaagaggcuuuaaaa

SEQ ID NO: 2076031 - RNA, 14 nt, Staphylococcus aureus subsp. aureus Mu50
aucaaaaauaaaaa

SEQ ID NO: 2076032 - RNA, 14 nt, Staphylococcus aureus subsp. aureus Mu50
aucaaagaggaaca

SEQ ID NO: 2076033 - RNA, 24 nt, Staphylococcus aureus subsp. aureus Mu50
aucaaaguuuucaggaauuguuaa

SEQ ID NO: 2076034 - RNA, 19 nt, Staphylococcus aureus subsp. aureus Mu50
aucaaauagacaccaaaaa

SEQ ID NO: 2076035 - RNA, 18 nt, Staphylococcus aureus subsp. aureus Mu50
aucaaauagacaccaaaa

SEQ ID NO: 2076036 - RNA, 17 nt, Staphylococcus aureus subsp. aureus Mu50
aucaaauacauuucaaa

SEQ ID NO: 2076037 - RNA, 23 nt, Staphylococcus aureus subsp. aureus Mu50
aucaaauccaaaaucuuuacuug

SEQ ID NO: 2076038 - RNA, 11 nt, Staphylococcus aureus subsp. aureus Mu50
aucaaauuacc

SEQ ID NO: 2076039 - RNA, 13 nt, Staphylococcus aureus subsp. aureus Mu50
aucaaauuaccau

SEQ ID NO: 2076040 - RNA, 17 nt, Staphylococcus aureus subsp. aureus Mu50
aucaacauaaaauuuaa

SEQ ID NO: 2076041 - RNA, 21 nt, Staphylococcus aureus subsp. aureus Mu50
aucaaauuagucauccaaaga

SEQ ID NO: 2076042 - RNA, 13 nt, Staphylococcus aureus subsp. aureus Mu50
aucaaauuuuucg

SEQ ID NO: 2076043 - RNA, 22 nt, Staphylococcus aureus subsp. aureus Mu50
auauuuauuguuuuuaaaaucu

SEQ ID NO: 2076044 - RNA, 13 nt, Staphylococcus aureus subsp. aureus Mu50
auauuuauuaagg

SEQ ID NO: 2076045 - RNA, 18 nt, Staphylococcus aureus subsp. aureus Mu50
auauuuagaauaagaaau

SEQ ID NO: 2076046 - RNA, 13 nt, Staphylococcus aureus subsp. aureus Mu50
auauuuagauacu

SEQ ID NO: 2076047 - RNA, 21 nt, Staphylococcus aureus subsp. aureus Mu50
auauuuagauacugaauuuua

SEQ ID NO: 2076048 - RNA, 20 nt, Staphylococcus aureus subsp. aureus Mu50
auauucguagcaugacauua

SEQ ID NO: 2076049 - RNA, 15 nt, Staphylococcus aureus subsp. aureus Mu50
auauucuuuaauaua

SEQ ID NO: 2076050 - RNA, 18 nt, Staphylococcus aureus subsp. aureus Mu50
auauucuuucguuuucau

SEQ ID NO: 2076051 - RNA, 16 nt, Staphylococcus aureus subsp. aureus Mu50
auauuugauaacaaaa

SEQ ID NO: 2076052 - RNA, 20 nt, Staphylococcus aureus subsp. aureus Mu50
auauuuuuaauuauuuuaaa

SEQ ID NO: 2076053 - RNA, 16 nt, Staphylococcus aureus subsp. aureus Mu50
auauuuuuacauauuu

SEQ ID NO: 2076054 - RNA, 21 nt, Staphylococcus aureus subsp. aureus Mu50
auauuugaaagguaaguacuu

SEQ ID NO: 2076055 - RNA, 21 nt, Staphylococcus aureus subsp. aureus Mu50
auauuugaacgagcaccuuuu

SEQ ID NO: 2076056 - RNA, 13 nt, Staphylococcus aureus subsp. aureus Mu50
auauuucuuacca

SEQ ID NO: 2076057 - RNA, 16 nt, Staphylococcus aureus subsp. aureus Mu50
auauuugaaaauuuca

SEQ ID NO: 2076058 - RNA, 19 nt, Staphylococcus aureus subsp. aureus Mu50
auauuuuucuucaguuaaa

SEQ ID NO: 2076059 - RNA, 13 nt, Staphylococcus aureus subsp. aureus Mu50
auauuuuuagaaa

SEQ ID NO: 2076060 - RNA, 14 nt, Staphylococcus aureus subsp. aureus Mu50
auauuuuuuaaauu

SEQ ID NO: 2076061 - RNA, 12 nt, Staphylococcus aureus subsp. aureus Mu50
auauuuuuuaau

SEQ ID NO: 2076062 - RNA, 13 nt, Staphylococcus aureus subsp. aureus Mu50
aucaaaaauaaaa

SEQ ID NO: 2076063 - RNA, 19 nt, Staphylococcus aureus subsp. aureus Mu50
aucaaaaauaauuaugaaa

SEQ ID NO: 2076064 - RNA, 22 nt, Staphylococcus aureus subsp. aureus Mu50
auauaaccgugaugaugugcaa

SEQ ID NO: 2076065 - RNA, 19 nt, Staphylococcus aureus subsp. aureus Mu50
auauaaaucaaauauacuu

SEQ ID NO: 2076066 - RNA, 16 nt, Staphylococcus aureus subsp. aureus Mu50
auauaaccuauuucau

SEQ ID NO: 2076067 - RNA, 17 nt, Staphylococcus aureus subsp. aureus Mu50
auauaaauuaucagaau

SEQ ID NO: 2076068 - RNA, 16 nt, Staphylococcus aureus subsp. aureus Mu50
auaguuaagauuuuaa

SEQ ID NO: 2076069 - RNA, 15 nt, Staphylococcus aureus subsp. aureus Mu50
auauaaaucaaauau

SEQ ID NO: 2076070 - RNA, 14 nt, Staphylococcus aureus subsp. aureus Mu50
auaguccuucccac

SEQ ID NO: 2076071 - RNA, 16 nt, Staphylococcus aureus subsp. aureus Mu50
auagucuuaaacauaa

SEQ ID NO: 2076072 - RNA, 18 nt, Staphylococcus aureus subsp. aureus Mu50
auagugugucauaaugaa

SEQ ID NO: 2076073 - RNA, 17 nt, Staphylococcus aureus subsp. aureus Mu50
auagugucgagauuuua

SEQ ID NO: 2076074 - RNA, 16 nt, Staphylococcus aureus subsp. aureus Mu50
auagugguaaaaaguu

SEQ ID NO: 2076075 - RNA, 23 nt, Staphylococcus aureus subsp. aureus Mu50
auagugguaaaaaguuuaaagua

SEQ ID NO: 2076076 - RNA, 13 nt, Staphylococcus aureus subsp. aureus Mu50
auauaccaaccaa

SEQ ID NO: 2076077 - RNA, 14 nt, Staphylococcus aureus subsp. aureus Mu50
auauaccaaccaaa

SEQ ID NO: 2076078 - RNA, 23 nt, Staphylococcus aureus subsp. aureus Mu50
auauagauuugaauuaaagugga

SEQ ID NO: 2076079 - RNA, 13 nt, Staphylococcus aureus subsp. aureus Mu50
auauagauuaaac

SEQ ID NO: 2076080 - RNA, 13 nt, Staphylococcus aureus subsp. aureus Mu50
auauaauuuauuu

SEQ ID NO: 2076081 - RNA, 24 nt, Staphylococcus aureus subsp. aureus Mu50
auauaauuuccuaaaaacugugau

SEQ ID NO: 2076082 - RNA, 18 nt, Staphylococcus aureus subsp. aureus Mu50
auauaauuuauaaaaaga

SEQ ID NO: 2076083 - RNA, 13 nt, Staphylococcus aureus subsp. aureus Mu50
auauaauuuaaag

SEQ ID NO: 2076084 - RNA, 14 nt, Staphylococcus aureus subsp. aureus Mu50
auauaauuuaaaga

SEQ ID NO: 2076085 - RNA, 20 nt, Staphylococcus aureus subsp. aureus Mu50
auauaacuauggucaucaau

SEQ ID NO: 2076086 - RNA, 22 nt, Staphylococcus aureus subsp. aureus Mu50
auauaacuucuauuaagaaaua

SEQ ID NO: 2076087 - RNA, 15 nt, Staphylococcus aureus subsp. aureus Mu50
auauaacgacacuuu

SEQ ID NO: 2076088 - RNA, 21 nt, Staphylococcus aureus subsp. aureus Mu50
auauagcgcgcuuauugaaaa

SEQ ID NO: 2076089 - RNA, 21 nt, Staphylococcus aureus subsp. aureus Mu50
auauaguaggguauugaaaua

SEQ ID NO: 2076090 - RNA, 19 nt, Staphylococcus aureus subsp. aureus Mu50
auauaguaaaauaaauaca

SEQ ID NO: 2076091 - RNA, 22 nt, Staphylococcus aureus subsp. aureus Mu50
auauaguggugguacuuuuuug

SEQ ID NO: 2076092 - RNA, 14 nt, Staphylococcus aureus subsp. aureus Mu50
auauagucaaugaa

SEQ ID NO: 2076093 - RNA, 19 nt, Staphylococcus aureus subsp. aureus Mu50
auauagucaaugaauaaug

SEQ ID NO: 2076094 - RNA, 14 nt, Staphylococcus aureus subsp. aureus Mu50
auauaguuggcaau

SEQ ID NO: 2076095 - RNA, 15 nt, Staphylococcus aureus subsp. aureus Mu50
auaucaauaaugcug

SEQ ID NO: 2076096 - RNA, 20 nt, Staphylococcus aureus subsp. aureus Mu50
auaucaauuguugcaaaaua

SEQ ID NO: 2076097 - RNA, 18 nt, Staphylococcus aureus subsp. aureus Mu50
auaucaauuuuuacuaaa

SEQ ID NO: 2076098 - RNA, 21 nt, Staphylococcus aureus subsp. aureus Mu50
auaucaauuuauuauuaacug

SEQ ID NO: 2076099 - RNA, 16 nt, Staphylococcus aureus subsp. aureus Mu50
auaucaauaaugcugc

SEQ ID NO: 2076100 - RNA, 18 nt, Staphylococcus aureus subsp. aureus Mu50
auaucaauaauucguuga

SEQ ID NO: 2076101 - RNA, 13 nt, Staphylococcus aureus subsp. aureus Mu50
auaucaaauacau

SEQ ID NO: 2076102 - RNA, 13 nt, Staphylococcus aureus subsp. aureus Mu50
auauauucguuac

SEQ ID NO: 2076103 - RNA, 15 nt, Staphylococcus aureus subsp. aureus Mu50
auauauucaucucuu

SEQ ID NO: 2076104 - RNA, 15 nt, Staphylococcus aureus subsp. aureus Mu50
auauauguaacauaa

SEQ ID NO: 2076105 - RNA, 19 nt, Staphylococcus aureus subsp. aureus Mu50
auauauguaacauaaagcu

SEQ ID NO: 2076106 - RNA, 22 nt, Staphylococcus aureus subsp. aureus Mu50
auauauuacuaaccuauuaaaa

SEQ ID NO: 2076107 - RNA, 15 nt, Staphylococcus aureus subsp. aureus Mu50
auauauuagugauau

SEQ ID NO: 2076108 - RNA, 22 nt, Staphylococcus aureus subsp. aureus Mu50
auauauuaucguaauuguuaaa

SEQ ID NO: 2076109 - RNA, 20 nt, Staphylococcus aureus subsp. aureus Mu50
auauauucaauaauuauuaa

SEQ ID NO: 2076110 - RNA, 19 nt, Staphylococcus aureus subsp. aureus Mu50
auauauaaaaucauuaaua

SEQ ID NO: 2076111 - RNA, 13 nt, Staphylococcus aureus subsp. aureus Mu50
auauauaaagaaa

SEQ ID NO: 2076112 - RNA, 12 nt, Staphylococcus aureus subsp. aureus Mu50
auauaugauaaa

SEQ ID NO: 2076113 - RNA, 16 nt, Staphylococcus aureus subsp. aureus Mu50
auauauaaagaaauaa

SEQ ID NO: 2076114 - RNA, 15 nt, Staphylococcus aureus subsp. aureus Mu50
auauauaaugaaggu

SEQ ID NO: 2076115 - RNA, 17 nt, Staphylococcus aureus subsp. aureus Mu50
auaucacugaaugcuaa

SEQ ID NO: 2076116 - RNA, 20 nt, Staphylococcus aureus subsp. aureus Mu50
auaucagcuaaguuaaauau

SEQ ID NO: 2076117 - RNA, 13 nt, Staphylococcus aureus subsp. aureus Mu50
auaucauucugug

SEQ ID NO: 2076118 - RNA, 21 nt, Staphylococcus aureus subsp. aureus Mu50
auaucauucuguguaaauaua

SEQ ID NO: 2076119 - RNA, 22 nt, Staphylococcus aureus subsp. aureus Mu50
auaucagcuaaguuaaauauca

SEQ ID NO: 2076120 - RNA, 15 nt, Staphylococcus aureus subsp. aureus Mu50
auaucaugcaaaaua

SEQ ID NO: 2076121 - RNA, 17 nt, Staphylococcus aureus subsp. aureus Mu50
auauccacgguuuacca

SEQ ID NO: 2076122 - RNA, 12 nt, Staphylococcus aureus subsp. aureus Mu50
auagucaucuua

SEQ ID NO: 2076123 - RNA, 22 nt, Staphylococcus aureus subsp. aureus Mu50
auagucauucauaauuuguuga

SEQ ID NO: 2076124 - RNA, 23 nt, Staphylococcus aureus subsp. aureus Mu50
auaguauuaacuauaaauagaag

SEQ ID NO: 2076125 - RNA, 17 nt, Staphylococcus aureus subsp. aureus Mu50
auaguacuuaauuuaaa

SEQ ID NO: 2076126 - RNA, 13 nt, Staphylococcus aureus subsp. aureus Mu50
auaguacagucau

SEQ ID NO: 2076127 - RNA, 16 nt, Staphylococcus aureus subsp. aureus Mu50
auaguacagucaucuu

SEQ ID NO: 2076128 - RNA, 19 nt, Staphylococcus aureus subsp. aureus Mu50
auaguacauuuauuuucaa

SEQ ID NO: 2076129 - RNA, 14 nt, Staphylococcus aureus subsp. aureus Mu50
auaggcuugccaau

SEQ ID NO: 2076130 - RNA, 19 nt, Staphylococcus aureus subsp. aureus Mu50
auagguaaccuuaaauaua

SEQ ID NO: 2076131 - RNA, 14 nt, Staphylococcus aureus subsp. aureus Mu50
auagguaacuaaaa

SEQ ID NO: 2076132 - RNA, 22 nt, Staphylococcus aureus subsp. aureus Mu50
auaggugauuauauauauuaaa

SEQ ID NO: 2076133 - RNA, 16 nt, Staphylococcus aureus subsp. aureus Mu50
auagcuuucguuucuu

SEQ ID NO: 2076134 - RNA, 14 nt, Staphylococcus aureus subsp. aureus Mu50
auaggaaacuuaaa

SEQ ID NO: 2076135 - RNA, 16 nt, Staphylococcus aureus subsp. aureus Mu50
auaggauuuacaccua

SEQ ID NO: 2076136 - RNA, 24 nt, Staphylococcus aureus subsp. aureus Mu50
auaggauuuacaccuauaccucgu

SEQ ID NO: 2076137 - RNA, 16 nt, Staphylococcus aureus subsp. aureus Mu50
auaggaaacuuaaaua

SEQ ID NO: 2076138 - RNA, 17 nt, Staphylococcus aureus subsp. aureus Mu50
auaggaaacuuaaauau

SEQ ID NO: 2076139 - RNA, 15 nt, Staphylococcus aureus subsp. aureus Mu50
auaggaauacaugag

SEQ ID NO: 2076140 - RNA, 21 nt, Staphylococcus aureus subsp. aureus Mu50
auagcgcucuggauuuuucuu

SEQ ID NO: 2076141 - RNA, 17 nt, Staphylococcus aureus subsp. aureus Mu50
auagaggcacaguggau

SEQ ID NO: 2076142 - RNA, 19 nt, Staphylococcus aureus subsp. aureus Mu50
auacaguuguuauuuuugc

SEQ ID NO: 2076143 - RNA, 13 nt, Staphylococcus aureus subsp. aureus Mu50
auacauaaauauu

SEQ ID NO: 2076144 - RNA, 14 nt, Staphylococcus aureus subsp. aureus Mu50
auacauauaagaau

SEQ ID NO: 2076145 - RNA, 12 nt, Staphylococcus aureus subsp. aureus Mu50
auacauaucuuu

SEQ ID NO: 2076146 - RNA, 14 nt, Staphylococcus aureus subsp. aureus Mu50
auaauuauuaauuu

SEQ ID NO: 2076147 - RNA, 13 nt, Staphylococcus aureus subsp. aureus Mu50
auaauucaacuua

SEQ ID NO: 2076148 - RNA, 16 nt, Staphylococcus aureus subsp. aureus Mu50
auaauucaacuuaaau

SEQ ID NO: 2076149 - RNA, 14 nt, Staphylococcus aureus subsp. aureus Mu50
auaauucauaaaug

SEQ ID NO: 2076150 - RNA, 13 nt, Staphylococcus aureus subsp. aureus Mu50
auaauucaucuug

SEQ ID NO: 2076151 - RNA, 17 nt, Staphylococcus aureus subsp. aureus Mu50
auacaugccaauggaag

SEQ ID NO: 2076152 - RNA, 16 nt, Staphylococcus aureus subsp. aureus Mu50
auacaucaucgccagc

SEQ ID NO: 2076153 - RNA, 20 nt, Staphylococcus aureus subsp. aureus Mu50
auacauccauacuucuauuu

SEQ ID NO: 2076154 - RNA, 15 nt, Staphylococcus aureus subsp. aureus Mu50
auacauuaauauaaa

SEQ ID NO: 2076155 - RNA, 19 nt, Staphylococcus aureus subsp. aureus Mu50
auacaugugggauaucuuc

SEQ ID NO: 2076156 - RNA, 15 nt, Staphylococcus aureus subsp. aureus Mu50
auacauuauuaaaua

SEQ ID NO: 2076157 - RNA, 13 nt, Staphylococcus aureus subsp. aureus Mu50
auacauuucaaaa

SEQ ID NO: 2076158 - RNA, 15 nt, Staphylococcus aureus subsp. aureus Mu50
auacauuucaaaaaa

SEQ ID NO: 2076159 - RNA, 16 nt, Staphylococcus aureus subsp. aureus Mu50
auacauuuuuauacaa

SEQ ID NO: 2076160 - RNA, 15 nt, Staphylococcus aureus subsp. aureus Mu50
auacauuuugcucua

SEQ ID NO: 2076161 - RNA, 14 nt, Staphylococcus aureus subsp. aureus Mu50
auaccaaaaacauu

SEQ ID NO: 2076162 - RNA, 16 nt, Staphylococcus aureus subsp. aureus Mu50
auaccaaaaacauuaa

SEQ ID NO: 2076163 - RNA, 18 nt, Staphylococcus aureus subsp. aureus Mu50
auaccauuccaaaaauug

SEQ ID NO: 2076164 - RNA, 20 nt, Staphylococcus aureus subsp. aureus Mu50
auaccauugugaugauaauu

SEQ ID NO: 2076165 - RNA, 12 nt, Staphylococcus aureus subsp. aureus Mu50
auaccaaacugc

SEQ ID NO: 2076166 - RNA, 18 nt, Staphylococcus aureus subsp. aureus Mu50
auaccaaccaaaaccaaa

SEQ ID NO: 2076167 - RNA, 21 nt, Staphylococcus aureus subsp. aureus Mu50
auaccaacugucgguucaucu

SEQ ID NO: 2076168 - RNA, 22 nt, Staphylococcus aureus subsp. aureus Mu50
auaccaaccaaaaccaaaugaa

SEQ ID NO: 2076169 - RNA, 22 nt, Staphylococcus aureus subsp. aureus Mu50
auaccaauugcugauauaauag

SEQ ID NO: 2076170 - RNA, 23 nt, Staphylococcus aureus subsp. aureus Mu50
auaccacaucgcauaauaucuua

SEQ ID NO: 2076171 - RNA, 19 nt, Staphylococcus aureus subsp. aureus Mu50
auaccacuugaauacuuuu

SEQ ID NO: 2076172 - RNA, 22 nt, Staphylococcus aureus subsp. aureus Mu50
auaccacuuaaucguucccauu

SEQ ID NO: 2076173 - RNA, 19 nt, Staphylococcus aureus subsp. aureus Mu50
auagaaagaaauuguuccu

SEQ ID NO: 2076174 - RNA, 14 nt, Staphylococcus aureus subsp. aureus Mu50
auacuguuuaaaua

SEQ ID NO: 2076175 - RNA, 19 nt, Staphylococcus aureus subsp. aureus Mu50
auacuguuuaaauaaaauu

SEQ ID NO: 2076176 - RNA, 20 nt, Staphylococcus aureus subsp. aureus Mu50
auagaagaacgaagaaugau

SEQ ID NO: 2076177 - RNA, 19 nt, Staphylococcus aureus subsp. aureus Mu50
auagaaaugacgauaccuu

SEQ ID NO: 2076178 - RNA, 13 nt, Staphylococcus aureus subsp. aureus Mu50
auagaccuaugaa

SEQ ID NO: 2076179 - RNA, 12 nt, Staphylococcus aureus subsp. aureus Mu50
auagaaggggac

SEQ ID NO: 2076180 - RNA, 14 nt, Staphylococcus aureus subsp. aureus Mu50
auagaaguuuuuug

SEQ ID NO: 2076181 - RNA, 18 nt, Staphylococcus aureus subsp. aureus Mu50
auagaaguuuuuugauua

SEQ ID NO: 2076182 - RNA, 16 nt, Staphylococcus aureus subsp. aureus Mu50
auacuaccguuuuuau

SEQ ID NO: 2076183 - RNA, 16 nt, Staphylococcus aureus subsp. aureus Mu50
auacuaccuuccauuu

SEQ ID NO: 2076184 - RNA, 20 nt, Staphylococcus aureus subsp. aureus Mu50
auacuaccuuccauuucgaa

SEQ ID NO: 2076185 - RNA, 13 nt, Staphylococcus aureus subsp. aureus Mu50
auacuacauauaa

SEQ ID NO: 2076186 - RNA, 14 nt, Staphylococcus aureus subsp. aureus Mu50
auacugauauuuag

SEQ ID NO: 2076187 - RNA, 20 nt, Staphylococcus aureus subsp. aureus Mu50
auacguuauuucaauaauaa

SEQ ID NO: 2076188 - RNA, 21 nt, Staphylococcus aureus subsp. aureus Mu50
auacuaaaaguguuaugaauu

SEQ ID NO: 2076189 - RNA, 13 nt, Staphylococcus aureus subsp. aureus Mu50
auacuaaauugag

SEQ ID NO: 2076190 - RNA, 21 nt, Staphylococcus aureus subsp. aureus Mu50
auacuaacugaagacaccuua

SEQ ID NO: 2076191 - RNA, 13 nt, Staphylococcus aureus subsp. aureus Mu50
auacuaacuauau

SEQ ID NO: 2076192 - RNA, 13 nt, Staphylococcus aureus subsp. aureus Mu50
auacuaacaauua

SEQ ID NO: 2076193 - RNA, 18 nt, Staphylococcus aureus subsp. aureus Mu50
auacuaauaucuucuuua

SEQ ID NO: 2076194 - RNA, 15 nt, Staphylococcus aureus subsp. aureus Mu50
auaccuauuccuauu

SEQ ID NO: 2076195 - RNA, 14 nt, Staphylococcus aureus subsp. aureus Mu50
auacgcuuuuuaaa

SEQ ID NO: 2076196 - RNA, 13 nt, Staphylococcus aureus subsp. aureus Mu50
auacguaaauggu

SEQ ID NO: 2076197 - RNA, 17 nt, Staphylococcus aureus subsp. aureus Mu50
auacguaucaaaauuuu

SEQ ID NO: 2076198 - RNA, 20 nt, Staphylococcus aureus subsp. aureus Mu50
auacguaucaagaaaaaguu

SEQ ID NO: 2076199 - RNA, 22 nt, Staphylococcus aureus subsp. aureus Mu50
auaccguacaaagguaauagaa

SEQ ID NO: 2076200 - RNA, 20 nt, Staphylococcus aureus subsp. aureus Mu50
auaccguuaguacggcugcu

SEQ ID NO: 2076201 - RNA, 17 nt, Staphylococcus aureus subsp. aureus Mu50
auaccuaaaauacccau

SEQ ID NO: 2076202 - RNA, 22 nt, Staphylococcus aureus subsp. aureus Mu50
auaccuacugugugaucauacg

SEQ ID NO: 2076203 - RNA, 14 nt, Staphylococcus aureus subsp. aureus Mu50
auaccuaauugcuu

SEQ ID NO: 2076204 - RNA, 13 nt, Staphylococcus aureus subsp. aureus Mu50
augaagauuuugu

SEQ ID NO: 2076205 - RNA, 20 nt, Staphylococcus aureus subsp. aureus Mu50
augaacuuaaugcuucaaau

SEQ ID NO: 2076206 - RNA, 15 nt, Staphylococcus aureus subsp. aureus Mu50
augaaaccguauuau

SEQ ID NO: 2076207 - RNA, 19 nt, Staphylococcus aureus subsp. aureus Mu50
augaaugccuaauuuugug

SEQ ID NO: 2076208 - RNA, 21 nt, Staphylococcus aureus subsp. aureus Mu50
augaaugccuaauuuugugaa

SEQ ID NO: 2076209 - RNA, 15 nt, Staphylococcus aureus subsp. aureus Mu50
augaauaauuaaaaa

SEQ ID NO: 2076210 - RNA, 17 nt, Staphylococcus aureus subsp. aureus Mu50
augaauaauuaaaaaac

SEQ ID NO: 2076211 - RNA, 16 nt, Staphylococcus aureus subsp. aureus Mu50
augaauaacaagaaaa

SEQ ID NO: 2076212 - RNA, 13 nt, Staphylococcus aureus subsp. aureus Mu50
augaauaacaaga

SEQ ID NO: 2076213 - RNA, 21 nt, Staphylococcus aureus subsp. aureus Mu50
augaagcaguuguugguuuug

SEQ ID NO: 2076214 - RNA, 16 nt, Staphylococcus aureus subsp. aureus Mu50
augaauugaguauuaa

SEQ ID NO: 2076215 - RNA, 20 nt, Staphylococcus aureus subsp. aureus Mu50
augaauugaguauuaaauuu

SEQ ID NO: 2076216 - RNA, 16 nt, Staphylococcus aureus subsp. aureus Mu50
augaauguuaagacau

SEQ ID NO: 2076217 - RNA, 14 nt, Staphylococcus aureus subsp. aureus Mu50
augaauuaauagcu

SEQ ID NO: 2076218 - RNA, 19 nt, Staphylococcus aureus subsp. aureus Mu50
augaauugucuuaauaugc

SEQ ID NO: 2076219 - RNA, 20 nt, Staphylococcus aureus subsp. aureus Mu50
augaauugucuuaauaugca

SEQ ID NO: 2076220 - RNA, 19 nt, Staphylococcus aureus subsp. aureus Mu50
augaauugcuuguuuuaaa

SEQ ID NO: 2076221 - RNA, 20 nt, Staphylococcus aureus subsp. aureus Mu50
augaauugcuuguuuuaaau

SEQ ID NO: 2076222 - RNA, 21 nt, Staphylococcus aureus subsp. aureus Mu50
augagacgcauugcaagacuu

SEQ ID NO: 2076223 - RNA, 22 nt, Staphylococcus aureus subsp. aureus Mu50
augagaagcugucuuacugcug

SEQ ID NO: 2076224 - RNA, 14 nt, Staphylococcus aureus subsp. aureus Mu50
augagauuauucug

SEQ ID NO: 2076225 - RNA, 21 nt, Staphylococcus aureus subsp. aureus Mu50
augagaguaauguuccauaua

SEQ ID NO: 2076226 - RNA, 23 nt, Staphylococcus aureus subsp. aureus Mu50
augacauuuuaaaucuaauuauu

SEQ ID NO: 2076227 - RNA, 13 nt, Staphylococcus aureus subsp. aureus Mu50
augaccaauauuc

SEQ ID NO: 2076228 - RNA, 14 nt, Staphylococcus aureus subsp. aureus Mu50
augacacauacacc

SEQ ID NO: 2076229 - RNA, 19 nt, Staphylococcus aureus subsp. aureus Mu50
augaccaugauauauaaca

SEQ ID NO: 2076230 - RNA, 22 nt, Staphylococcus aureus subsp. aureus Mu50
augaccauugucaugccuucau

SEQ ID NO: 2076231 - RNA, 16 nt, Staphylococcus aureus subsp. aureus Mu50
augaccuuaauauaac

SEQ ID NO: 2076232 - RNA, 20 nt, Staphylococcus aureus subsp. aureus Mu50
aucuucuaguaauucuucau

SEQ ID NO: 2076233 - RNA, 16 nt, Staphylococcus aureus subsp. aureus Mu50
aucuguugucaucaug

SEQ ID NO: 2076234 - RNA, 14 nt, Staphylococcus aureus subsp. aureus Mu50
aucuucuaauucca

SEQ ID NO: 2076235 - RNA, 23 nt, Staphylococcus aureus subsp. aureus Mu50
aucuucuaauucguuuugcuaac

SEQ ID NO: 2076236 - RNA, 17 nt, Staphylococcus aureus subsp. aureus Mu50
aucuucuaguaauucuu

SEQ ID NO: 2076237 - RNA, 19 nt, Staphylococcus aureus subsp. aureus Mu50
aucuucuaguaauucuuca

SEQ ID NO: 2076238 - RNA, 14 nt, Staphylococcus aureus subsp. aureus Mu50
aucuguaacauaaa

SEQ ID NO: 2076239 - RNA, 16 nt, Staphylococcus aureus subsp. aureus Mu50
aucuugauuauauuuu

SEQ ID NO: 2076240 - RNA, 16 nt, Staphylococcus aureus subsp. aureus Mu50
aucuugcuuggauaau

SEQ ID NO: 2076241 - RNA, 21 nt, Staphylococcus aureus subsp. aureus Mu50
aucuucuuuuaauauuugaua

SEQ ID NO: 2076242 - RNA, 15 nt, Staphylococcus aureus subsp. aureus Mu50
aucuucuuuuucuac

SEQ ID NO: 2076243 - RNA, 15 nt, Staphylococcus aureus subsp. aureus Mu50
aucuugagauuuuca

SEQ ID NO: 2076244 - RNA, 14 nt, Staphylococcus aureus subsp. aureus Mu50
aucuuuuugaaauu

SEQ ID NO: 2076245 - RNA, 15 nt, Staphylococcus aureus subsp. aureus Mu50
aucuuuuugaaauuu

SEQ ID NO: 2076246 - RNA, 22 nt, Staphylococcus aureus subsp. aureus Mu50
aucuuuuuuuaauuaaguuaaa

SEQ ID NO: 2076247 - RNA, 19 nt, Staphylococcus aureus subsp. aureus Mu50
aucuuuugcuguaucuuca

SEQ ID NO: 2076248 - RNA, 14 nt, Staphylococcus aureus subsp. aureus Mu50
aucuuuuuaaaagg

SEQ ID NO: 2076249 - RNA, 19 nt, Staphylococcus aureus subsp. aureus Mu50
aucuuuugguuuaucuguu

SEQ ID NO: 2076250 - RNA, 21 nt, Staphylococcus aureus subsp. aureus Mu50
aucuuuugguuuaucuguugu

SEQ ID NO: 2076251 - RNA, 13 nt, Staphylococcus aureus subsp. aureus Mu50
aucuuuugcuucg

SEQ ID NO: 2076252 - RNA, 19 nt, Staphylococcus aureus subsp. aureus Mu50
aucuuuguaaauuuuuaag

SEQ ID NO: 2076253 - RNA, 15 nt, Staphylococcus aureus subsp. aureus Mu50
aucuuucuuuguguu

SEQ ID NO: 2076254 - RNA, 23 nt, Staphylococcus aureus subsp. aureus Mu50
aucuugucuaguucgauuuuuua

SEQ ID NO: 2076255 - RNA, 20 nt, Staphylococcus aureus subsp. aureus Mu50
aucuuuaacauuuauucuuu

SEQ ID NO: 2076256 - RNA, 14 nt, Staphylococcus aureus subsp. aureus Mu50
aucuuuaaucaaag

SEQ ID NO: 2076257 - RNA, 22 nt, Staphylococcus aureus subsp. aureus Mu50
aucuuuagagacuuauuuuaua

SEQ ID NO: 2076258 - RNA, 20 nt, Staphylococcus aureus subsp. aureus Mu50
aucuuuacgauaaacuaaaa

SEQ ID NO: 2076259 - RNA, 18 nt, Staphylococcus aureus subsp. aureus Mu50
aucuuuacgauaaacuaa

SEQ ID NO: 2076260 - RNA, 17 nt, Staphylococcus aureus subsp. aureus Mu50
aucugauaccguuagua

SEQ ID NO: 2076261 - RNA, 13 nt, Staphylococcus aureus subsp. aureus Mu50
aucugauuucacu

SEQ ID NO: 2076262 - RNA, 17 nt, Staphylococcus aureus subsp. aureus Mu50
aucugcaacgauuuuaa

SEQ ID NO: 2076263 - RNA, 13 nt, Staphylococcus aureus subsp. aureus Mu50
aucugcauuuaau

SEQ ID NO: 2076264 - RNA, 23 nt, Staphylococcus aureus subsp. aureus Mu50
aucugcuuuauuuuaucaucuau

SEQ ID NO: 2076265 - RNA, 19 nt, Staphylococcus aureus subsp. aureus Mu50
aucuccgcuacaauuauau

SEQ ID NO: 2076266 - RNA, 14 nt, Staphylococcus aureus subsp. aureus Mu50
aucucaaaauuucg

SEQ ID NO: 2076267 - RNA, 14 nt, Staphylococcus aureus subsp. aureus Mu50
aucuauuuaucaua

SEQ ID NO: 2076268 - RNA, 18 nt, Staphylococcus aureus subsp. aureus Mu50
aucuauuuaauaauguau

SEQ ID NO: 2076269 - RNA, 19 nt, Staphylococcus aureus subsp. aureus Mu50
aucuauuuuaaacucaucc

SEQ ID NO: 2076270 - RNA, 18 nt, Staphylococcus aureus subsp. aureus Mu50
aucucuucaauuuauuuu

SEQ ID NO: 2076271 - RNA, 18 nt, Staphylococcus aureus subsp. aureus Mu50
aucucuauuuuuuauguu

SEQ ID NO: 2076272 - RNA, 16 nt, Staphylococcus aureus subsp. aureus Mu50
aucgugcccauaugau

SEQ ID NO: 2076273 - RNA, 17 nt, Staphylococcus aureus subsp. aureus Mu50
aucgugcccauaugauu

SEQ ID NO: 2076274 - RNA, 14 nt, Staphylococcus aureus subsp. aureus Mu50
aucguucccauucu

SEQ ID NO: 2076275 - RNA, 20 nt, Staphylococcus aureus subsp. aureus Mu50
aucguuaauguauaaaaagu

SEQ ID NO: 2076276 - RNA, 22 nt, Staphylococcus aureus subsp. aureus Mu50
aucguuaauaaaccuacaauau

SEQ ID NO: 2076277 - RNA, 17 nt, Staphylococcus aureus subsp. aureus Mu50
aucguuaaggaaagcuu

SEQ ID NO: 2076278 - RNA, 21 nt, Staphylococcus aureus subsp. aureus Mu50
aucguuaauaaaccuacaaua

SEQ ID NO: 2076279 - RNA, 21 nt, Staphylococcus aureus subsp. aureus Mu50
aucguuaaaacacccugcuua

SEQ ID NO: 2076280 - RNA, 20 nt, Staphylococcus aureus subsp. aureus Mu50
aucguguauuauugaaacua

SEQ ID NO: 2076281 - RNA, 21 nt, Staphylococcus aureus subsp. aureus Mu50
aucuauuauuauguuauaaau

SEQ ID NO: 2076282 - RNA, 21 nt, Staphylococcus aureus subsp. aureus Mu50
aucuauggaaaauguuaucaa

SEQ ID NO: 2076283 - RNA, 21 nt, Staphylococcus aureus subsp. aureus Mu50
aucuacuuuguucugcuuuuu

SEQ ID NO: 2076284 - RNA, 22 nt, Staphylococcus aureus subsp. aureus Mu50
aucuaauucuguuucaaagcug

SEQ ID NO: 2076285 - RNA, 17 nt, Staphylococcus aureus subsp. aureus Mu50
aucuaauacuucaccac

SEQ ID NO: 2076286 - RNA, 12 nt, Staphylococcus aureus subsp. aureus Mu50
aucguuucuucc

SEQ ID NO: 2076287 - RNA, 14 nt, Staphylococcus aureus subsp. aureus Mu50
aucguugaaaaaua

SEQ ID NO: 2076288 - RNA, 17 nt, Staphylococcus aureus subsp. aureus Mu50
aucguuguaccacccca

SEQ ID NO: 2076289 - RNA, 22 nt, Staphylococcus aureus subsp. aureus Mu50
aucuaaaaugaguuguucagau

SEQ ID NO: 2076290 - RNA, 17 nt, Staphylococcus aureus subsp. aureus Mu50
aucuaaagcuauaaaaa

SEQ ID NO: 2076291 - RNA, 17 nt, Staphylococcus aureus subsp. aureus Mu50
aucuaaacuauaauaau

SEQ ID NO: 2076292 - RNA, 15 nt, Staphylococcus aureus subsp. aureus Mu50
aucuaaacuauaaua

SEQ ID NO: 2076293 - RNA, 16 nt, Staphylococcus aureus subsp. aureus Mu50
aucgcaaauacauaau

SEQ ID NO: 2076294 - RNA, 15 nt, Staphylococcus aureus subsp. aureus Mu50
aucgaucuaaauaua

SEQ ID NO: 2076295 - RNA, 23 nt, Staphylococcus aureus subsp. aureus Mu50
aucgaucgguauuuucauuuuag

SEQ ID NO: 2076296 - RNA, 22 nt, Staphylococcus aureus subsp. aureus Mu50
aucgauuuaacauaaaaaugcu

SEQ ID NO: 2076297 - RNA, 20 nt, Staphylococcus aureus subsp. aureus Mu50
aucgauuaagaaugcaccaa

SEQ ID NO: 2076298 - RNA, 16 nt, Staphylococcus aureus subsp. aureus Mu50
aucgccuaaaaauaaa

SEQ ID NO: 2076299 - RNA, 13 nt, Staphylococcus aureus subsp. aureus Mu50
aucgccuaaaaau

SEQ ID NO: 2076300 - RNA, 18 nt, Staphylococcus aureus subsp. aureus Mu50
aucgccuaaaaauaaaau

SEQ ID NO: 2076301 - RNA, 21 nt, Staphylococcus aureus subsp. aureus Mu50
auccucgguauuuaauguuuu

SEQ ID NO: 2076302 - RNA, 23 nt, Staphylococcus aureus subsp. aureus Mu50
auccucgguauuuaauguuuuag

SEQ ID NO: 2076303 - RNA, 13 nt, Staphylococcus aureus subsp. aureus Mu50
auccucauaauua

SEQ ID NO: 2076304 - RNA, 16 nt, Staphylococcus aureus subsp. aureus Mu50
auccucauaauuauca

SEQ ID NO: 2076305 - RNA, 17 nt, Staphylococcus aureus subsp. aureus Mu50
auccucauuaauaaauu

SEQ ID NO: 2076306 - RNA, 24 nt, Staphylococcus aureus subsp. aureus Mu50
auccucacaaauuugaauauacuu

SEQ ID NO: 2076307 - RNA, 24 nt, Staphylococcus aureus subsp. aureus Mu50
auccugauuuaauguuaaacaaua

SEQ ID NO: 2076308 - RNA, 20 nt, Staphylococcus aureus subsp. aureus Mu50
auccuuaccuuuuaaaccug

SEQ ID NO: 2076309 - RNA, 11 nt, Staphylococcus aureus subsp. aureus Mu50
auccuuaaaug

SEQ ID NO: 2076310 - RNA, 20 nt, Staphylococcus aureus subsp. aureus Mu50
auccuucaaagauuuuaccu

SEQ ID NO: 2076311 - RNA, 14 nt, Staphylococcus aureus subsp. aureus Mu50
auccuuuuugacuc

SEQ ID NO: 2076312 - RNA, 17 nt, Staphylococcus aureus subsp. aureus Mu50
auccuaaauuauaaaua

SEQ ID NO: 2076313 - RNA, 18 nt, Staphylococcus aureus subsp. aureus Mu50
auccuaaaaagcucaauc

SEQ ID NO: 2076314 - RNA, 20 nt, Staphylococcus aureus subsp. aureus Mu50
auccuaaaaagcucaauccu

SEQ ID NO: 2076315 - RNA, 17 nt, Staphylococcus aureus subsp. aureus Mu50
auccuaagcauaauuca

SEQ ID NO: 2076316 - RNA, 18 nt, Staphylococcus aureus subsp. aureus Mu50
aucccgaaaguuagacua

SEQ ID NO: 2076317 - RNA, 13 nt, Staphylococcus aureus subsp. aureus Mu50
auccauaaaaaua

SEQ ID NO: 2076318 - RNA, 15 nt, Staphylococcus aureus subsp. aureus Mu50
auccauaaaaauacg

SEQ ID NO: 2076319 - RNA, 15 nt, Staphylococcus aureus subsp. aureus Mu50
auccaucaauaccau

SEQ ID NO: 2076320 - RNA, 15 nt, Staphylococcus aureus subsp. aureus Mu50
auccacgguuuacca

SEQ ID NO: 2076321 - RNA, 14 nt, Staphylococcus aureus subsp. aureus Mu50
auccaccaaauaca

SEQ ID NO: 2076322 - RNA, 16 nt, Staphylococcus aureus subsp. aureus Mu50
auccaaauauuaaaaa

SEQ ID NO: 2076323 - RNA, 11 nt, Staphylococcus aureus subsp. aureus Mu50
auccaaaccaa

SEQ ID NO: 2076324 - RNA, 16 nt, Staphylococcus aureus subsp. aureus Mu50
auccaaagacauacag

SEQ ID NO: 2076325 - RNA, 22 nt, Staphylococcus aureus subsp. aureus Mu50
aaaagaauuauucaaguaauau

SEQ ID NO: 2076326 - RNA, 23 nt, Staphylococcus aureus subsp. aureus Mu50
aucaugugucuuccaaucaacuu

SEQ ID NO: 2076327 - RNA, 23 nt, Staphylococcus aureus subsp. aureus Mu50
aucauguuccccauuaauuaaca

SEQ ID NO: 2076328 - RNA, 16 nt, Staphylococcus aureus subsp. aureus Mu50
aucauguucuuauaaa

SEQ ID NO: 2076329 - RNA, 17 nt, Staphylococcus aureus subsp. aureus Mu50
aaaacuguaaaucauca

SEQ ID NO: 2076330 - RNA, 18 nt, Staphylococcus aureus subsp. aureus Mu50
aaaacuguaaaucaucau

SEQ ID NO: 2076331 - RNA, 14 nt, Staphylococcus aureus subsp. aureus Mu50
aucaugcuuuuaau

SEQ ID NO: 2076332 - RNA, 20 nt, Staphylococcus aureus subsp. aureus Mu50
aucaugcuuuuaauauuaua

SEQ ID NO: 2076333 - RNA, 23 nt, Staphylococcus aureus subsp. aureus Mu50
aucauguauauggcaucaucacc

SEQ ID NO: 2076334 - RNA, 19 nt, Staphylococcus aureus subsp. aureus Mu50
aucauguacaguuacuuuc

SEQ ID NO: 2076335 - RNA, 16 nt, Staphylococcus aureus subsp. aureus Mu50
aucaugacauaaaacu

SEQ ID NO: 2076336 - RNA, 19 nt, Staphylococcus aureus subsp. aureus Mu50
aucaugacuauuucgcuuu

SEQ ID NO: 2076337 - RNA, 14 nt, Staphylococcus aureus subsp. aureus Mu50
aucaugcacaauau

SEQ ID NO: 2076338 - RNA, 17 nt, Staphylococcus aureus subsp. aureus Mu50
aucaugauagccgcuuc

SEQ ID NO: 2076339 - RNA, 19 nt, Staphylococcus aureus subsp. aureus Mu50
aucaucuuuaauuuucuug

SEQ ID NO: 2076340 - RNA, 19 nt, Staphylococcus aureus subsp. aureus Mu50
aucaucuucuggauaggua

SEQ ID NO: 2076341 - RNA, 21 nt, Staphylococcus aureus subsp. aureus Mu50
aucaucucugcuuuaauauaa

SEQ ID NO: 2076342 - RNA, 16 nt, Staphylococcus aureus subsp. aureus Mu50
aucaucuauauuuaau

SEQ ID NO: 2076343 - RNA, 20 nt, Staphylococcus aureus subsp. aureus Mu50
aucaucucugcuuuaauaua

SEQ ID NO: 2076344 - RNA, 19 nt, Staphylococcus aureus subsp. aureus Mu50
aucauaauucccuguuaug

SEQ ID NO: 2076345 - RNA, 19 nt, Staphylococcus aureus subsp. aureus Mu50
aucauaccagcaaguguau

SEQ ID NO: 2076346 - RNA, 14 nt, Staphylococcus aureus subsp. aureus Mu50
aucauaauuuuguu

SEQ ID NO: 2076347 - RNA, 15 nt, Staphylococcus aureus subsp. aureus Mu50
aucauacgagaaauu

SEQ ID NO: 2076348 - RNA, 16 nt, Staphylococcus aureus subsp. aureus Mu50
aucauacgagaaauua

SEQ ID NO: 2076349 - RNA, 16 nt, Staphylococcus aureus subsp. aureus Mu50
aaaacgugcaaauaaa

SEQ ID NO: 2076350 - RNA, 14 nt, Staphylococcus aureus subsp. aureus Mu50
aaaacguucaaucg

SEQ ID NO: 2076351 - RNA, 16 nt, Staphylococcus aureus subsp. aureus Mu50
aucauaaucugcugcu

SEQ ID NO: 2076352 - RNA, 22 nt, Staphylococcus aureus subsp. aureus Mu50
aucauaaugaauaauuaaaaaa

SEQ ID NO: 2076353 - RNA, 14 nt, Staphylococcus aureus subsp. aureus Mu50
aucauagaggcaca

SEQ ID NO: 2076354 - RNA, 16 nt, Staphylococcus aureus subsp. aureus Mu50
aaaacuagaacuuagu

SEQ ID NO: 2076355 - RNA, 18 nt, Staphylococcus aureus subsp. aureus Mu50
aaaacuauuuuaaaaaug

SEQ ID NO: 2076356 - RNA, 15 nt, Staphylococcus aureus subsp. aureus Mu50
aucauacuucaauaa

SEQ ID NO: 2076357 - RNA, 12 nt, Staphylococcus aureus subsp. aureus Mu50
auaaauaaaaug

SEQ ID NO: 2076358 - RNA, 12 nt, Staphylococcus aureus subsp. aureus Mu50
auaaauaaaauu

SEQ ID NO: 2076359 - RNA, 13 nt, Staphylococcus aureus subsp. aureus Mu50
auaaauaaaauuu

SEQ ID NO: 2076360 - RNA, 14 nt, Staphylococcus aureus subsp. aureus Mu50
auaaauaaaagcca

SEQ ID NO: 2076361 - RNA, 15 nt, Staphylococcus aureus subsp. aureus Mu50
auaaauaaaaauaca

SEQ ID NO: 2076362 - RNA, 15 nt, Staphylococcus aureus subsp. aureus Mu50
auaaaguuuauuuau

SEQ ID NO: 2076363 - RNA, 19 nt, Staphylococcus aureus subsp. aureus Mu50
auaaaguugacaauacaaa

SEQ ID NO: 2076364 - RNA, 13 nt, Staphylococcus aureus subsp. aureus Mu50
auaaaucaucauu

SEQ ID NO: 2076365 - RNA, 22 nt, Staphylococcus aureus subsp. aureus Mu50
auaaaucaguaguuuuaaaagu

SEQ ID NO: 2076366 - RNA, 19 nt, Staphylococcus aureus subsp. aureus Mu50
auaaaucauacgagaaauu

SEQ ID NO: 2076367 - RNA, 14 nt, Staphylococcus aureus subsp. aureus Mu50
auaaaucaaagagg

SEQ ID NO: 2076368 - RNA, 23 nt, Staphylococcus aureus subsp. aureus Mu50
auaaaucacgccauaaucuucau

SEQ ID NO: 2076369 - RNA, 15 nt, Staphylococcus aureus subsp. aureus Mu50
auaaaugaauugucu

SEQ ID NO: 2076370 - RNA, 13 nt, Staphylococcus aureus subsp. aureus Mu50
auaaaugacauuu

SEQ ID NO: 2076371 - RNA, 19 nt, Staphylococcus aureus subsp. aureus Mu50
auaaaugacauuuaauacu

SEQ ID NO: 2076372 - RNA, 19 nt, Staphylococcus aureus subsp. aureus Mu50
auaaaugaauuauuuaaaa

SEQ ID NO: 2076373 - RNA, 14 nt, Staphylococcus aureus subsp. aureus Mu50
auaaauaaaaugcu

SEQ ID NO: 2076374 - RNA, 18 nt, Staphylococcus aureus subsp. aureus Mu50
auaaauaaacaacugcaa

SEQ ID NO: 2076375 - RNA, 14 nt, Staphylococcus aureus subsp. aureus Mu50
auaaaucaaacuuu

SEQ ID NO: 2076376 - RNA, 13 nt, Staphylococcus aureus subsp. aureus Mu50
auaaauauuuuua

SEQ ID NO: 2076377 - RNA, 14 nt, Staphylococcus aureus subsp. aureus Mu50
auaaauauuuaaaa

SEQ ID NO: 2076378 - RNA, 19 nt, Staphylococcus aureus subsp. aureus Mu50
auaaauauuuaaaauauua

SEQ ID NO: 2076379 - RNA, 18 nt, Staphylococcus aureus subsp. aureus Mu50
auaaaucacgccauaauc

SEQ ID NO: 2076380 - RNA, 15 nt, Staphylococcus aureus subsp. aureus Mu50
auaaauuaauaugaa

SEQ ID NO: 2076381 - RNA, 15 nt, Staphylococcus aureus subsp. aureus Mu50
auaaauuaauugcuu

SEQ ID NO: 2076382 - RNA, 16 nt, Staphylococcus aureus subsp. aureus Mu50
auaaauuagaugaaau

SEQ ID NO: 2076383 - RNA, 14 nt, Staphylococcus aureus subsp. aureus Mu50
auaaauuaguuuuu

SEQ ID NO: 2076384 - RNA, 18 nt, Staphylococcus aureus subsp. aureus Mu50
auaaauucucuaauuucu

SEQ ID NO: 2076385 - RNA, 13 nt, Staphylococcus aureus subsp. aureus Mu50
auaaauugauauu

SEQ ID NO: 2076386 - RNA, 20 nt, Staphylococcus aureus subsp. aureus Mu50
auaaauugaaguacauuaaa

SEQ ID NO: 2076387 - RNA, 23 nt, Staphylococcus aureus subsp. aureus Mu50
auaaauugaguuuuuuaaaauaa

SEQ ID NO: 2076388 - RNA, 22 nt, Staphylococcus aureus subsp. aureus Mu50
auaaauguccgacuugauaaaa

SEQ ID NO: 2076389 - RNA, 19 nt, Staphylococcus aureus subsp. aureus Mu50
auaaauguuaaagauuauu

SEQ ID NO: 2076390 - RNA, 18 nt, Staphylococcus aureus subsp. aureus Mu50
auaaauguuauugcuuau

SEQ ID NO: 2076391 - RNA, 13 nt, Staphylococcus aureus subsp. aureus Mu50
auaaauuaaauuu

SEQ ID NO: 2076392 - RNA, 19 nt, Staphylococcus aureus subsp. aureus Mu50
auaaauguuauugcuuauu

SEQ ID NO: 2076393 - RNA, 19 nt, Staphylococcus aureus subsp. aureus Mu50
auaaaugcuauauuuagaa

SEQ ID NO: 2076394 - RNA, 13 nt, Staphylococcus aureus subsp. aureus Mu50
auaaaugauuaaa

SEQ ID NO: 2076395 - RNA, 22 nt, Staphylococcus aureus subsp. aureus Mu50
auaaaugaauuauuuaaaaugc

SEQ ID NO: 2076396 - RNA, 17 nt, Staphylococcus aureus subsp. aureus Mu50
auaaaugacugaauuaa

SEQ ID NO: 2076397 - RNA, 18 nt, Staphylococcus aureus subsp. aureus Mu50
auaaagauagaaugaaua

SEQ ID NO: 2076398 - RNA, 17 nt, Staphylococcus aureus subsp. aureus Mu50
auaaagauuauaucuuu

SEQ ID NO: 2076399 - RNA, 20 nt, Staphylococcus aureus subsp. aureus Mu50
auaaagcugcgauauaacua

SEQ ID NO: 2076400 - RNA, 17 nt, Staphylococcus aureus subsp. aureus Mu50
auaaagcuuugacauau

SEQ ID NO: 2076401 - RNA, 14 nt, Staphylococcus aureus subsp. aureus Mu50
auaaaggcaacaaa

SEQ ID NO: 2076402 - RNA, 20 nt, Staphylococcus aureus subsp. aureus Mu50
auaaaggcaacaaauauaau

SEQ ID NO: 2076403 - RNA, 15 nt, Staphylococcus aureus subsp. aureus Mu50
auaaacuuuaugaaa

SEQ ID NO: 2076404 - RNA, 16 nt, Staphylococcus aureus subsp. aureus Mu50
auaaacuuuaugaaau

SEQ ID NO: 2076405 - RNA, 13 nt, Staphylococcus aureus subsp. aureus Mu50
auaaagaaugauu

SEQ ID NO: 2076406 - RNA, 13 nt, Staphylococcus aureus subsp. aureus Mu50
auaaaauaaaaug

SEQ ID NO: 2076407 - RNA, 12 nt, Staphylococcus aureus subsp. aureus Mu50
auaaaauaaaau

SEQ ID NO: 2076408 - RNA, 13 nt, Staphylococcus aureus subsp. aureus Mu50
auaaaauaaaaaa

SEQ ID NO: 2076409 - RNA, 16 nt, Staphylococcus aureus subsp. aureus Mu50
auaaaaguuaggcgac

SEQ ID NO: 2076410 - RNA, 17 nt, Staphylococcus aureus subsp. aureus Mu50
auaaaaguguaauguuc

SEQ ID NO: 2076411 - RNA, 23 nt, Staphylococcus aureus subsp. aureus Mu50
auaaaaguuaccuacuacauucu

SEQ ID NO: 2076412 - RNA, 14 nt, Staphylococcus aureus subsp. aureus Mu50
auaaacuacacacg

SEQ ID NO: 2076413 - RNA, 12 nt, Staphylococcus aureus subsp. aureus Mu50
auaaacguccaa

SEQ ID NO: 2076414 - RNA, 16 nt, Staphylococcus aureus subsp. aureus Mu50
aguuuucuucacugcu

SEQ ID NO: 2076415 - RNA, 14 nt, Staphylococcus aureus subsp. aureus Mu50
aguugguuuagaca

SEQ ID NO: 2076416 - RNA, 19 nt, Staphylococcus aureus subsp. aureus Mu50
aguuuugaagaauaaaaaa

SEQ ID NO: 2076417 - RNA, 18 nt, Staphylococcus aureus subsp. aureus Mu50
aguuggggaugggcccca

SEQ ID NO: 2076418 - RNA, 16 nt, Staphylococcus aureus subsp. aureus Mu50
aguuggcggggcccca

SEQ ID NO: 2076419 - RNA, 13 nt, Staphylococcus aureus subsp. aureus Mu50
auaaaaaaagaga

SEQ ID NO: 2076420 - RNA, 16 nt, Staphylococcus aureus subsp. aureus Mu50
aguuuuuuuaaaguuu

SEQ ID NO: 2076421 - RNA, 17 nt, Staphylococcus aureus subsp. aureus Mu50
auaaaaaaccaagugca

SEQ ID NO: 2076422 - RNA, 15 nt, Staphylococcus aureus subsp. aureus Mu50
auaaaaaaauuaacu

SEQ ID NO: 2076423 - RNA, 14 nt, Staphylococcus aureus subsp. aureus Mu50
auaaaaaauaacuc

SEQ ID NO: 2076424 - RNA, 13 nt, Staphylococcus aureus subsp. aureus Mu50
aguuuuuuaaaau

SEQ ID NO: 2076425 - RNA, 21 nt, Staphylococcus aureus subsp. aureus Mu50
aguuuuuuaaaauaaugauau

SEQ ID NO: 2076426 - RNA, 16 nt, Staphylococcus aureus subsp. aureus Mu50
auaaaaagugaaagua

SEQ ID NO: 2076427 - RNA, 21 nt, Staphylococcus aureus subsp. aureus Mu50
auaaaaaggagcgacaaugga

SEQ ID NO: 2076428 - RNA, 18 nt, Staphylococcus aureus subsp. aureus Mu50
auaaaaaggagcgacaau

SEQ ID NO: 2076429 - RNA, 13 nt, Staphylococcus aureus subsp. aureus Mu50
auaaaaaauuauu

SEQ ID NO: 2076430 - RNA, 14 nt, Staphylococcus aureus subsp. aureus Mu50
auaaaaaaucuuuu

SEQ ID NO: 2076431 - RNA, 19 nt, Staphylococcus aureus subsp. aureus Mu50
auaaaaacagcagugaagu

SEQ ID NO: 2076432 - RNA, 18 nt, Staphylococcus aureus subsp. aureus Mu50
auaaaaagaucauuaaaa

SEQ ID NO: 2076433 - RNA, 14 nt, Staphylococcus aureus subsp. aureus Mu50
auaaaacaaauuau

SEQ ID NO: 2076434 - RNA, 13 nt, Staphylococcus aureus subsp. aureus Mu50
auaaaacagaauu

SEQ ID NO: 2076435 - RNA, 16 nt, Staphylococcus aureus subsp. aureus Mu50
auaaaaccgguacuuu

SEQ ID NO: 2076436 - RNA, 23 nt, Staphylococcus aureus subsp. aureus Mu50
auaaaacaguaaguaauaaaaua

SEQ ID NO: 2076437 - RNA, 15 nt, Staphylococcus aureus subsp. aureus Mu50
auaaaacaucaucgu

SEQ ID NO: 2076438 - RNA, 13 nt, Staphylococcus aureus subsp. aureus Mu50
auaaaaaucuuau

SEQ ID NO: 2076439 - RNA, 17 nt, Staphylococcus aureus subsp. aureus Mu50
auaaaaauuauauaaau

SEQ ID NO: 2076440 - RNA, 17 nt, Staphylococcus aureus subsp. aureus Mu50
auaaaaauuuauucaaa

SEQ ID NO: 2076441 - RNA, 15 nt, Staphylococcus aureus subsp. aureus Mu50
auaaaacgauaagaa

SEQ ID NO: 2076442 - RNA, 22 nt, Staphylococcus aureus subsp. aureus Mu50
auaaaacgugcaaauaaaaaag

SEQ ID NO: 2076443 - RNA, 20 nt, Staphylococcus aureus subsp. aureus Mu50
auaaaacgacucauuauaaa

SEQ ID NO: 2076444 - RNA, 22 nt, Staphylococcus aureus subsp. aureus Mu50
auaaaacuauguguauaugugg

SEQ ID NO: 2076445 - RNA, 23 nt, Staphylococcus aureus subsp. aureus Mu50
auaaaacuuacauuacauauauc

SEQ ID NO: 2076446 - RNA, 13 nt, Staphylococcus aureus subsp. aureus Mu50
auaaaacuuacau

SEQ ID NO: 2076447 - RNA, 20 nt, Staphylococcus aureus subsp. aureus Mu50
auaaaacuuacauuacauau

SEQ ID NO: 2076448 - RNA, 22 nt, Staphylococcus aureus subsp. aureus Mu50
auaaaaggcuuuguuaaacaca

SEQ ID NO: 2076449 - RNA, 20 nt, Staphylococcus aureus subsp. aureus Mu50
auaaaaggggaaaucauuug

SEQ ID NO: 2076450 - RNA, 16 nt, Staphylococcus aureus subsp. aureus Mu50
auaaaagucgauaaau

SEQ ID NO: 2076451 - RNA, 23 nt, Staphylococcus aureus subsp. aureus Mu50
auaaaaguacuuuaaaauuguau

SEQ ID NO: 2076452 - RNA, 19 nt, Staphylococcus aureus subsp. aureus Mu50
auaaaagucgauaaauaug

SEQ ID NO: 2076453 - RNA, 18 nt, Staphylococcus aureus subsp. aureus Mu50
auaaaagccucuaaugau

SEQ ID NO: 2076454 - RNA, 14 nt, Staphylococcus aureus subsp. aureus Mu50
auaaaagcaacaau

SEQ ID NO: 2076455 - RNA, 20 nt, Staphylococcus aureus subsp. aureus Mu50
auaaaagccaugauacgaug

SEQ ID NO: 2076456 - RNA, 17 nt, Staphylococcus aureus subsp. aureus Mu50
auaaaagcccaccuaaa

SEQ ID NO: 2076457 - RNA, 15 nt, Staphylococcus aureus subsp. aureus Mu50
auaauccaagauaua

SEQ ID NO: 2076458 - RNA, 20 nt, Staphylococcus aureus subsp. aureus Mu50
auaaucccaaccauucuacc

SEQ ID NO: 2076459 - RNA, 19 nt, Staphylococcus aureus subsp. aureus Mu50
auaauccauucuucuuguu

SEQ ID NO: 2076460 - RNA, 15 nt, Staphylococcus aureus subsp. aureus Mu50
auaaucaagaauaua

SEQ ID NO: 2076461 - RNA, 22 nt, Staphylococcus aureus subsp. aureus Mu50
auaaucaagucugcauuaauuu

SEQ ID NO: 2076462 - RNA, 15 nt, Staphylococcus aureus subsp. aureus Mu50
auaauauuggacuuu

SEQ ID NO: 2076463 - RNA, 17 nt, Staphylococcus aureus subsp. aureus Mu50
auaaucaaaccaccaaa

SEQ ID NO: 2076464 - RNA, 12 nt, Staphylococcus aureus subsp. aureus Mu50
auaauauuuaac

SEQ ID NO: 2076465 - RNA, 16 nt, Staphylococcus aureus subsp. aureus Mu50
auaauacguuuugcua

SEQ ID NO: 2076466 - RNA, 13 nt, Staphylococcus aureus subsp. aureus Mu50
auaauagaaauaa

SEQ ID NO: 2076467 - RNA, 15 nt, Staphylococcus aureus subsp. aureus Mu50
auaauacuguuuaaa

SEQ ID NO: 2076468 - RNA, 17 nt, Staphylococcus aureus subsp. aureus Mu50
auaauacuguuuaaaua

SEQ ID NO: 2076469 - RNA, 19 nt, Staphylococcus aureus subsp. aureus Mu50
auaauagacuuauauuaau

SEQ ID NO: 2076470 - RNA, 13 nt, Staphylococcus aureus subsp. aureus Mu50
auaauauauuuag

SEQ ID NO: 2076471 - RNA, 13 nt, Staphylococcus aureus subsp. aureus Mu50
auaauauauuaac

SEQ ID NO: 2076472 - RNA, 22 nt, Staphylococcus aureus subsp. aureus Mu50
auaaguagcucaaaacaauuua

SEQ ID NO: 2076473 - RNA, 19 nt, Staphylococcus aureus subsp. aureus Mu50
auaauacgcuugauaaaag

SEQ ID NO: 2076474 - RNA, 16 nt, Staphylococcus aureus subsp. aureus Mu50
auaaguaaauaauagu

SEQ ID NO: 2076475 - RNA, 13 nt, Staphylococcus aureus subsp. aureus Mu50
auaaguaaauaau

SEQ ID NO: 2076476 - RNA, 15 nt, Staphylococcus aureus subsp. aureus Mu50
auaaguacaaauaau

SEQ ID NO: 2076477 - RNA, 20 nt, Staphylococcus aureus subsp. aureus Mu50
auaaguacaaauaauacagg

SEQ ID NO: 2076478 - RNA, 17 nt, Staphylococcus aureus subsp. aureus Mu50
auaaguaauaauuuauu

SEQ ID NO: 2076479 - RNA, 16 nt, Staphylococcus aureus subsp. aureus Mu50
auaauuagauuuaaaa

SEQ ID NO: 2076480 - RNA, 21 nt, Staphylococcus aureus subsp. aureus Mu50
auaauuagauuuaaaauguca

SEQ ID NO: 2076481 - RNA, 13 nt, Staphylococcus aureus subsp. aureus Mu50
auaauuaugaaaa

SEQ ID NO: 2076482 - RNA, 14 nt, Staphylococcus aureus subsp. aureus Mu50
auaauuaauaacau

SEQ ID NO: 2076483 - RNA, 21 nt, Staphylococcus aureus subsp. aureus Mu50
auaauuaccuuuccauucgua

SEQ ID NO: 2076484 - RNA, 23 nt, Staphylococcus aureus subsp. aureus Mu50
auaauuaccuuuccauucguaua

SEQ ID NO: 2076485 - RNA, 18 nt, Staphylococcus aureus subsp. aureus Mu50
auaauuaauuaaaauucu

SEQ ID NO: 2076486 - RNA, 14 nt, Staphylococcus aureus subsp. aureus Mu50
auaauuaaauaacu

SEQ ID NO: 2076487 - RNA, 14 nt, Staphylococcus aureus subsp. aureus Mu50
auaauuaacacauu

SEQ ID NO: 2076488 - RNA, 14 nt, Staphylococcus aureus subsp. aureus Mu50
auaauuaaauauaa

SEQ ID NO: 2076489 - RNA, 15 nt, Staphylococcus aureus subsp. aureus Mu50
auaauuaaauaacuu

SEQ ID NO: 2076490 - RNA, 16 nt, Staphylococcus aureus subsp. aureus Mu50
auaauuaaauauaaag

SEQ ID NO: 2076491 - RNA, 20 nt, Staphylococcus aureus subsp. aureus Mu50
auaauguuuccugauauuuc

SEQ ID NO: 2076492 - RNA, 21 nt, Staphylococcus aureus subsp. aureus Mu50
auaauguuuccugauauuuca

SEQ ID NO: 2076493 - RNA, 21 nt, Staphylococcus aureus subsp. aureus Mu50
auaauuaaaauaagauauaua

SEQ ID NO: 2076494 - RNA, 12 nt, Staphylococcus aureus subsp. aureus Mu50
auaauuaaacua

SEQ ID NO: 2076495 - RNA, 12 nt, Staphylococcus aureus subsp. aureus Mu50
auaaucuaucuu

SEQ ID NO: 2076496 - RNA, 19 nt, Staphylococcus aureus subsp. aureus Mu50
auaaucguauucauaucau

SEQ ID NO: 2076497 - RNA, 14 nt, Staphylococcus aureus subsp. aureus Mu50
auaaugauuuuuau

SEQ ID NO: 2076498 - RNA, 20 nt, Staphylococcus aureus subsp. aureus Mu50
auaaugcacgcgugccaaca

SEQ ID NO: 2076499 - RNA, 14 nt, Staphylococcus aureus subsp. aureus Mu50
auaaugcuauauuu

SEQ ID NO: 2076500 - RNA, 15 nt, Staphylococcus aureus subsp. aureus Mu50
auaaugcuauauuuc

SEQ ID NO: 2076501 - RNA, 19 nt, Staphylococcus aureus subsp. aureus Mu50
auaaugcuacuauuaaaua

SEQ ID NO: 2076502 - RNA, 22 nt, Staphylococcus aureus subsp. aureus Mu50
auaauguauaaaacagaauuuc

SEQ ID NO: 2076503 - RNA, 20 nt, Staphylococcus aureus subsp. aureus Mu50
auaaugucuuacuuuuaaau

SEQ ID NO: 2076504 - RNA, 22 nt, Staphylococcus aureus subsp. aureus Mu50
auaaugucuuacuuuuaaauua

SEQ ID NO: 2076505 - RNA, 21 nt, Staphylococcus aureus subsp. aureus Mu50
auaagggguauauuaaaaauu

SEQ ID NO: 2076506 - RNA, 17 nt, Staphylococcus aureus subsp. aureus Mu50
auaagcuuguaacaagc

SEQ ID NO: 2076507 - RNA, 21 nt, Staphylococcus aureus subsp. aureus Mu50
auaagcuuguaacaagcauuu

SEQ ID NO: 2076508 - RNA, 15 nt, Staphylococcus aureus subsp. aureus Mu50
auaaggauaucugaa

SEQ ID NO: 2076509 - RNA, 18 nt, Staphylococcus aureus subsp. aureus Mu50
auaagccuuuucaaacau

SEQ ID NO: 2076510 - RNA, 14 nt, Staphylococcus aureus subsp. aureus Mu50
auaaggaaaaggau

SEQ ID NO: 2076511 - RNA, 18 nt, Staphylococcus aureus subsp. aureus Mu50
auaagcacgauaaaaaua

SEQ ID NO: 2076512 - RNA, 16 nt, Staphylococcus aureus subsp. aureus Mu50
auaagccuuuucaaac

SEQ ID NO: 2076513 - RNA, 19 nt, Staphylococcus aureus subsp. aureus Mu50
auaacgagcaguauauauc

SEQ ID NO: 2076514 - RNA, 17 nt, Staphylococcus aureus subsp. aureus Mu50
auaaauuguaugaauaa

SEQ ID NO: 2076515 - RNA, 21 nt, Staphylococcus aureus subsp. aureus Mu50
auaaauuucaagguauacaca

SEQ ID NO: 2076516 - RNA, 22 nt, Staphylococcus aureus subsp. aureus Mu50
auaaauuuaacguuauucauuu

SEQ ID NO: 2076517 - RNA, 23 nt, Staphylococcus aureus subsp. aureus Mu50
auaaauuuguaccaaauaaauua

SEQ ID NO: 2076518 - RNA, 19 nt, Staphylococcus aureus subsp. aureus Mu50
auaaauuugguacauaaua

SEQ ID NO: 2076519 - RNA, 22 nt, Staphylococcus aureus subsp. aureus Mu50
auaaauuucaagguauacacaa

SEQ ID NO: 2076520 - RNA, 19 nt, Staphylococcus aureus subsp. aureus Mu50
auaaauuuuacgaaaauau

SEQ ID NO: 2076521 - RNA, 14 nt, Staphylococcus aureus subsp. aureus Mu50
auaacuccuccaaa

SEQ ID NO: 2076522 - RNA, 15 nt, Staphylococcus aureus subsp. aureus Mu50
auaacuucguuuuaa

SEQ ID NO: 2076523 - RNA, 16 nt, Staphylococcus aureus subsp. aureus Mu50
auaacuuuaaaaauua

SEQ ID NO: 2076524 - RNA, 15 nt, Staphylococcus aureus subsp. aureus Mu50
auaacuuuaaaaauu

SEQ ID NO: 2076525 - RNA, 15 nt, Staphylococcus aureus subsp. aureus Mu50
auaacuuuauauaua

SEQ ID NO: 2076526 - RNA, 21 nt, Staphylococcus aureus subsp. aureus Mu50
auaacuuuauauauaaagaaa

SEQ ID NO: 2076527 - RNA, 13 nt, Staphylococcus aureus subsp. aureus Mu50
auaacuuguaaua

SEQ ID NO: 2076528 - RNA, 19 nt, Staphylococcus aureus subsp. aureus Mu50
auaagacuucccuauaugu

SEQ ID NO: 2076529 - RNA, 19 nt, Staphylococcus aureus subsp. aureus Mu50
aguucaucuggugcaauau

SEQ ID NO: 2076530 - RNA, 13 nt, Staphylococcus aureus subsp. aureus Mu50
aguucacaugaau

SEQ ID NO: 2076531 - RNA, 16 nt, Staphylococcus aureus subsp. aureus Mu50
aguucaggaucaagug

SEQ ID NO: 2076532 - RNA, 23 nt, Staphylococcus aureus subsp. aureus Mu50
aguuccucgguauucaauucugu

SEQ ID NO: 2076533 - RNA, 20 nt, Staphylococcus aureus subsp. aureus Mu50
aguuaagugucuauguugaa

SEQ ID NO: 2076534 - RNA, 21 nt, Staphylococcus aureus subsp. aureus Mu50
aguuaggcgacuuaacuuaag

SEQ ID NO: 2076535 - RNA, 16 nt, Staphylococcus aureus subsp. aureus Mu50
aguuauaaauuauauu

SEQ ID NO: 2076536 - RNA, 19 nt, Staphylococcus aureus subsp. aureus Mu50
aguucaaauugaacuucuu

SEQ ID NO: 2076537 - RNA, 15 nt, Staphylococcus aureus subsp. aureus Mu50
aguuauaugugcuuu

SEQ ID NO: 2076538 - RNA, 14 nt, Staphylococcus aureus subsp. aureus Mu50
aguuauauuguuaa

SEQ ID NO: 2076539 - RNA, 16 nt, Staphylococcus aureus subsp. aureus Mu50
aguucgaacacacacu

SEQ ID NO: 2076540 - RNA, 23 nt, Staphylococcus aureus subsp. aureus Mu50
aguucgacacgcccgacaucaua

SEQ ID NO: 2076541 - RNA, 12 nt, Staphylococcus aureus subsp. aureus Mu50
aguucuuuaaau

SEQ ID NO: 2076542 - RNA, 23 nt, Staphylococcus aureus subsp. aureus Mu50
aguugaaaauaaucgaacagaaa

SEQ ID NO: 2076543 - RNA, 15 nt, Staphylococcus aureus subsp. aureus Mu50
aguugaauauaaaaa

SEQ ID NO: 2076544 - RNA, 16 nt, Staphylococcus aureus subsp. aureus Mu50
aguugaauauaaaaaa

SEQ ID NO: 2076545 - RNA, 14 nt, Staphylococcus aureus subsp. aureus Mu50
aguugacaauacaa

SEQ ID NO: 2076546 - RNA, 15 nt, Staphylococcus aureus subsp. aureus Mu50
aguuaacuauaacaa

SEQ ID NO: 2076547 - RNA, 20 nt, Staphylococcus aureus subsp. aureus Mu50
aguuaacggcguauucaauu

SEQ ID NO: 2076548 - RNA, 18 nt, Staphylococcus aureus subsp. aureus Mu50
aguuaaagucauaggcuu

SEQ ID NO: 2076549 - RNA, 18 nt, Staphylococcus aureus subsp. aureus Mu50
aguuaaauaucauaccgu

SEQ ID NO: 2076550 - RNA, 19 nt, Staphylococcus aureus subsp. aureus Mu50
aguuaaaauucaguaucua

SEQ ID NO: 2076551 - RNA, 19 nt, Staphylococcus aureus subsp. aureus Mu50
aguuaaaauugguuuggau

SEQ ID NO: 2076552 - RNA, 23 nt, Staphylococcus aureus subsp. aureus Mu50
aguuaaaaccuuuucaaauuaua

SEQ ID NO: 2076553 - RNA, 18 nt, Staphylococcus aureus subsp. aureus Mu50
aguuaaaaccuuuucaaa

SEQ ID NO: 2076554 - RNA, 20 nt, Staphylococcus aureus subsp. aureus Mu50
aguuaaaaccuuuucaaauu

SEQ ID NO: 2076555 - RNA, 16 nt, Staphylococcus aureus subsp. aureus Mu50
aguuaaaaauguaaau

SEQ ID NO: 2076556 - RNA, 13 nt, Staphylococcus aureus subsp. aureus Mu50
aguguuauauugu

SEQ ID NO: 2076557 - RNA, 16 nt, Staphylococcus aureus subsp. aureus Mu50
aguguagcacaagauu

SEQ ID NO: 2076558 - RNA, 17 nt, Staphylococcus aureus subsp. aureus Mu50
aguguagccaaauaaau

SEQ ID NO: 2076559 - RNA, 16 nt, Staphylococcus aureus subsp. aureus Mu50
agugucgagauuuuau

SEQ ID NO: 2076560 - RNA, 20 nt, Staphylococcus aureus subsp. aureus Mu50
agugucgagauuuuauaagu

SEQ ID NO: 2076561 - RNA, 18 nt, Staphylococcus aureus subsp. aureus Mu50
agugguuuucuuuauuuu

SEQ ID NO: 2076562 - RNA, 16 nt, Staphylococcus aureus subsp. aureus Mu50
agugcuuuuaaucaaa

SEQ ID NO: 2076563 - RNA, 17 nt, Staphylococcus aureus subsp. aureus Mu50
aguggaagacaaugauu

SEQ ID NO: 2076564 - RNA, 21 nt, Staphylococcus aureus subsp. aureus Mu50
agugauaauuaaaauaagaua

SEQ ID NO: 2076565 - RNA, 15 nt, Staphylococcus aureus subsp. aureus Mu50
agugauaauuaaaau

SEQ ID NO: 2076566 - RNA, 13 nt, Staphylococcus aureus subsp. aureus Mu50
agugcuaagaggu

SEQ ID NO: 2076567 - RNA, 19 nt, Staphylococcus aureus subsp. aureus Mu50
agugcuugauuaacauuuu

SEQ ID NO: 2076568 - RNA, 16 nt, Staphylococcus aureus subsp. aureus Mu50
agugagcguauuauua

SEQ ID NO: 2076569 - RNA, 20 nt, Staphylococcus aureus subsp. aureus Mu50
agugaguuuuauuuauaaac

SEQ ID NO: 2076570 - RNA, 16 nt, Staphylococcus aureus subsp. aureus Mu50
agucuaugaauaaugu

SEQ ID NO: 2076571 - RNA, 20 nt, Staphylococcus aureus subsp. aureus Mu50
agucuaggacauugauuucu

SEQ ID NO: 2076572 - RNA, 19 nt, Staphylococcus aureus subsp. aureus Mu50
agucguucucuuaaauaug

SEQ ID NO: 2076573 - RNA, 22 nt, Staphylococcus aureus subsp. aureus Mu50
agucuacaguaaauugauucuu

SEQ ID NO: 2076574 - RNA, 20 nt, Staphylococcus aureus subsp. aureus Mu50
agucguucaauuguugauuu

SEQ ID NO: 2076575 - RNA, 18 nt, Staphylococcus aureus subsp. aureus Mu50
agucguuuguacuucacu

SEQ ID NO: 2076576 - RNA, 17 nt, Staphylococcus aureus subsp. aureus Mu50
agugaaaucauuuaaau

SEQ ID NO: 2076577 - RNA, 22 nt, Staphylococcus aureus subsp. aureus Mu50
agugaaagucguuguugaaauu

SEQ ID NO: 2076578 - RNA, 15 nt, Staphylococcus aureus subsp. aureus Mu50
agugacacuguaacg

SEQ ID NO: 2076579 - RNA, 14 nt, Staphylococcus aureus subsp. aureus Mu50
agugaccucagguu

SEQ ID NO: 2076580 - RNA, 17 nt, Staphylococcus aureus subsp. aureus Mu50
agugaccucagguuguu

SEQ ID NO: 2076581 - RNA, 13 nt, Staphylococcus aureus subsp. aureus Mu50
agucuguugguuu

SEQ ID NO: 2076582 - RNA, 16 nt, Staphylococcus aureus subsp. aureus Mu50
agucuuaaacauaaca

SEQ ID NO: 2076583 - RNA, 22 nt, Staphylococcus aureus subsp. aureus Mu50
agucuuagacauuguaaaaugc

SEQ ID NO: 2076584 - RNA, 15 nt, Staphylococcus aureus subsp. aureus Mu50
agucuggugaaaacc

SEQ ID NO: 2076585 - RNA, 21 nt, Staphylococcus aureus subsp. aureus Mu50
agucuguauauggcgauaaca

SEQ ID NO: 2076586 - RNA, 16 nt, Staphylococcus aureus subsp. aureus Mu50
agucuucuuacugcaa

SEQ ID NO: 2076587 - RNA, 22 nt, Staphylococcus aureus subsp. aureus Mu50
agucuucuuacugcaauuauuu

SEQ ID NO: 2076588 - RNA, 17 nt, Staphylococcus aureus subsp. aureus Mu50
agucuucuuuuuuuaac

SEQ ID NO: 2076589 - RNA, 19 nt, Staphylococcus aureus subsp. aureus Mu50
agucuucuuuuuuuaacuu

SEQ ID NO: 2076590 - RNA, 17 nt, Staphylococcus aureus subsp. aureus Mu50
agucauaaauauaaaau

SEQ ID NO: 2076591 - RNA, 15 nt, Staphylococcus aureus subsp. aureus Mu50
agucauaauuuaaaa

SEQ ID NO: 2076592 - RNA, 21 nt, Staphylococcus aureus subsp. aureus Mu50
agucauaaauugauuucuaau

SEQ ID NO: 2076593 - RNA, 14 nt, Staphylococcus aureus subsp. aureus Mu50
agucaggggcccca

SEQ ID NO: 2076594 - RNA, 19 nt, Staphylococcus aureus subsp. aureus Mu50
agucaggggccccaacaca

SEQ ID NO: 2076595 - RNA, 20 nt, Staphylococcus aureus subsp. aureus Mu50
agucaggggccccaacacag

SEQ ID NO: 2076596 - RNA, 22 nt, Staphylococcus aureus subsp. aureus Mu50
agucaucuugagauuuucaaca

SEQ ID NO: 2076597 - RNA, 17 nt, Staphylococcus aureus subsp. aureus Mu50
agucauuguauaaaaag

SEQ ID NO: 2076598 - RNA, 13 nt, Staphylococcus aureus subsp. aureus Mu50
agucauuacaaau

SEQ ID NO: 2076599 - RNA, 14 nt, Staphylococcus aureus subsp. aureus Mu50
aguccauuuucuuu

SEQ ID NO: 2076600 - RNA, 15 nt, Staphylococcus aureus subsp. aureus Mu50
aguccauuuucuuuu

SEQ ID NO: 2076601 - RNA, 21 nt, Staphylococcus aureus subsp. aureus Mu50
aguacuuucgaguaauacuuu

SEQ ID NO: 2076602 - RNA, 16 nt, Staphylococcus aureus subsp. aureus Mu50
aguacuuuaaaauugu

SEQ ID NO: 2076603 - RNA, 17 nt, Staphylococcus aureus subsp. aureus Mu50
aguacuaagcuuucauu

SEQ ID NO: 2076604 - RNA, 19 nt, Staphylococcus aureus subsp. aureus Mu50
aguacuuaauuuaaauugu

SEQ ID NO: 2076605 - RNA, 21 nt, Staphylococcus aureus subsp. aureus Mu50
aguacuuaauuuaaauuguca

SEQ ID NO: 2076606 - RNA, 14 nt, Staphylococcus aureus subsp. aureus Mu50
agucaacugcugcu

SEQ ID NO: 2076607 - RNA, 17 nt, Staphylococcus aureus subsp. aureus Mu50
agucaacugcugcuaaa

SEQ ID NO: 2076608 - RNA, 14 nt, Staphylococcus aureus subsp. aureus Mu50
aguagaauuauuua

SEQ ID NO: 2076609 - RNA, 18 nt, Staphylococcus aureus subsp. aureus Mu50
aguagaauuauuuagaaa

SEQ ID NO: 2076610 - RNA, 19 nt, Staphylococcus aureus subsp. aureus Mu50
agucaacaucguauucuuu

SEQ ID NO: 2076611 - RNA, 18 nt, Staphylococcus aureus subsp. aureus Mu50
agucaauguauauuuaac

SEQ ID NO: 2076612 - RNA, 16 nt, Staphylococcus aureus subsp. aureus Mu50
agucaauguauauuua

SEQ ID NO: 2076613 - RNA, 15 nt, Staphylococcus aureus subsp. aureus Mu50
agucaauuuuuucau

SEQ ID NO: 2076614 - RNA, 17 nt, Staphylococcus aureus subsp. aureus Mu50
agucaauuuaaauaagu

SEQ ID NO: 2076615 - RNA, 21 nt, Staphylococcus aureus subsp. aureus Mu50
agucaccugcuuuuuauuauu

SEQ ID NO: 2076616 - RNA, 13 nt, Staphylococcus aureus subsp. aureus Mu50
agucagaaagaau

SEQ ID NO: 2076617 - RNA, 12 nt, Staphylococcus aureus subsp. aureus Mu50
agguaaauuuaa

SEQ ID NO: 2076618 - RNA, 13 nt, Staphylococcus aureus subsp. aureus Mu50
agguaaauuuaaa

SEQ ID NO: 2076619 - RNA, 19 nt, Staphylococcus aureus subsp. aureus Mu50
agguaaauuuaaaauaaua

SEQ ID NO: 2076620 - RNA, 11 nt, Staphylococcus aureus subsp. aureus Mu50
agguauucaaa

SEQ ID NO: 2076621 - RNA, 19 nt, Staphylococcus aureus subsp. aureus Mu50
aggucaaaaaauuaaucaa

SEQ ID NO: 2076622 - RNA, 13 nt, Staphylococcus aureus subsp. aureus Mu50
aggucaaaaaauu

SEQ ID NO: 2076623 - RNA, 19 nt, Staphylococcus aureus subsp. aureus Mu50
agguauuucauugauaagu

SEQ ID NO: 2076624 - RNA, 14 nt, Staphylococcus aureus subsp. aureus Mu50
agguuauauuuaaa

SEQ ID NO: 2076625 - RNA, 16 nt, Staphylococcus aureus subsp. aureus Mu50
agguuauauuuaaaug

SEQ ID NO: 2076626 - RNA, 13 nt, Staphylococcus aureus subsp. aureus Mu50
aguaccuaaaaua

SEQ ID NO: 2076627 - RNA, 19 nt, Staphylococcus aureus subsp. aureus Mu50
aguaccuaaaauagaaaaa

SEQ ID NO: 2076628 - RNA, 15 nt, Staphylococcus aureus subsp. aureus Mu50
aguacgaacaacuaa

SEQ ID NO: 2076629 - RNA, 21 nt, Staphylococcus aureus subsp. aureus Mu50
aguacuaaaccgauuaauaua

SEQ ID NO: 2076630 - RNA, 22 nt, Staphylococcus aureus subsp. aureus Mu50
aguacucaauguuaggugcuug

SEQ ID NO: 2076631 - RNA, 17 nt, Staphylococcus aureus subsp. aureus Mu50
aguacaguuaguggcau

SEQ ID NO: 2076632 - RNA, 19 nt, Staphylococcus aureus subsp. aureus Mu50
aguaagauuauuuucaauu

SEQ ID NO: 2076633 - RNA, 22 nt, Staphylococcus aureus subsp. aureus Mu50
aguaaucuuguuuucauuuaaa

SEQ ID NO: 2076634 - RNA, 14 nt, Staphylococcus aureus subsp. aureus Mu50
aguaaugaagcuuc

SEQ ID NO: 2076635 - RNA, 14 nt, Staphylococcus aureus subsp. aureus Mu50
aguaaauguuuuau

SEQ ID NO: 2076636 - RNA, 12 nt, Staphylococcus aureus subsp. aureus Mu50
aguaaauguuuu

SEQ ID NO: 2076637 - RNA, 18 nt, Staphylococcus aureus subsp. aureus Mu50
aguaagauauuuccaaau

SEQ ID NO: 2076638 - RNA, 17 nt, Staphylococcus aureus subsp. aureus Mu50
aguaagauuauuuucaa

SEQ ID NO: 2076639 - RNA, 16 nt, Staphylococcus aureus subsp. aureus Mu50
aguaagacgauuucaa

SEQ ID NO: 2076640 - RNA, 14 nt, Staphylococcus aureus subsp. aureus Mu50
agguuuuaugaauu

SEQ ID NO: 2076641 - RNA, 16 nt, Staphylococcus aureus subsp. aureus Mu50
agguuuucgccaauaa

SEQ ID NO: 2076642 - RNA, 14 nt, Staphylococcus aureus subsp. aureus Mu50
agguugaauuucuu

SEQ ID NO: 2076643 - RNA, 16 nt, Staphylococcus aureus subsp. aureus Mu50
agguucaguagaauug

SEQ ID NO: 2076644 - RNA, 16 nt, Staphylococcus aureus subsp. aureus Mu50
agguucaucuuuaugc

SEQ ID NO: 2076645 - RNA, 15 nt, Staphylococcus aureus subsp. aureus Mu50
aggcuuauuaacuuu

SEQ ID NO: 2076646 - RNA, 19 nt, Staphylococcus aureus subsp. aureus Mu50
aggcuuaaauauaaugauc

SEQ ID NO: 2076647 - RNA, 17 nt, Staphylococcus aureus subsp. aureus Mu50
aggcuuaaauauaauga

SEQ ID NO: 2076648 - RNA, 16 nt, Staphylococcus aureus subsp. aureus Mu50
agggggcuucuuuguu

SEQ ID NO: 2076649 - RNA, 19 nt, Staphylococcus aureus subsp. aureus Mu50
aggguuucuggcucuucuu

SEQ ID NO: 2076650 - RNA, 13 nt, Staphylococcus aureus subsp. aureus Mu50
agggguaaaacuu

SEQ ID NO: 2076651 - RNA, 16 nt, Staphylococcus aureus subsp. aureus Mu50
aggggcuuuuaugcau

SEQ ID NO: 2076652 - RNA, 14 nt, Staphylococcus aureus subsp. aureus Mu50
aggggcuuuuaugc

SEQ ID NO: 2076653 - RNA, 23 nt, Staphylococcus aureus subsp. aureus Mu50
aggggacuuaaccauuuaaaaau

SEQ ID NO: 2076654 - RNA, 14 nt, Staphylococcus aureus subsp. aureus Mu50
aggcgucuuaaauu

SEQ ID NO: 2076655 - RNA, 23 nt, Staphylococcus aureus subsp. aureus Mu50
aggcugaguauaccaauugcuga

SEQ ID NO: 2076656 - RNA, 18 nt, Staphylococcus aureus subsp. aureus Mu50
aggauguuauaaaaugaa

SEQ ID NO: 2076657 - RNA, 19 nt, Staphylococcus aureus subsp. aureus Mu50
aggauggaaugauacgccu

SEQ ID NO: 2076658 - RNA, 14 nt, Staphylococcus aureus subsp. aureus Mu50
aggcaauauuaaaa

SEQ ID NO: 2076659 - RNA, 17 nt, Staphylococcus aureus subsp. aureus Mu50
aggcaaugcaaguuggc

SEQ ID NO: 2076660 - RNA, 15 nt, Staphylococcus aureus subsp. aureus Mu50
aggcaauauuaaaau

SEQ ID NO: 2076661 - RNA, 12 nt, Staphylococcus aureus subsp. aureus Mu50
aggcaaugcaag

SEQ ID NO: 2076662 - RNA, 13 nt, Staphylococcus aureus subsp. aureus Mu50
aggcaaugcaagu

SEQ ID NO: 2076663 - RNA, 23 nt, Staphylococcus aureus subsp. aureus Mu50
aggcaaugcaaguuggcggggcc

SEQ ID NO: 2076664 - RNA, 23 nt, Staphylococcus aureus subsp. aureus Mu50
aggcauaauuugugguaugacug

SEQ ID NO: 2076665 - RNA, 15 nt, Staphylococcus aureus subsp. aureus Mu50
aggaugaguuuaaaa

SEQ ID NO: 2076666 - RNA, 14 nt, Staphylococcus aureus subsp. aureus Mu50
aggaugaguuuaaa

SEQ ID NO: 2076667 - RNA, 23 nt, Staphylococcus aureus subsp. aureus Mu50
aggauauuuauucuaaguuaaaa

SEQ ID NO: 2076668 - RNA, 22 nt, Staphylococcus aureus subsp. aureus Mu50
aggaucacguuuuucuuuaaac

SEQ ID NO: 2076669 - RNA, 21 nt, Staphylococcus aureus subsp. aureus Mu50
aggauaugcuguguaucauca

SEQ ID NO: 2076670 - RNA, 15 nt, Staphylococcus aureus subsp. aureus Mu50
aggauaucuacgccu

SEQ ID NO: 2076671 - RNA, 18 nt, Staphylococcus aureus subsp. aureus Mu50
aggauaguucuuugucug

SEQ ID NO: 2076672 - RNA, 18 nt, Staphylococcus aureus subsp. aureus Mu50
aggauacauaaaucuaau

SEQ ID NO: 2076673 - RNA, 16 nt, Staphylococcus aureus subsp. aureus Mu50
aggauaagaacgagaa

SEQ ID NO: 2076674 - RNA, 12 nt, Staphylococcus aureus subsp. aureus Mu50
aggauaagaacg

SEQ ID NO: 2076675 - RNA, 14 nt, Staphylococcus aureus subsp. aureus Mu50
aggaaaauaaaaac

SEQ ID NO: 2076676 - RNA, 18 nt, Staphylococcus aureus subsp. aureus Mu50
aggaauaauuuuaaaaau

SEQ ID NO: 2076677 - RNA, 17 nt, Staphylococcus aureus subsp. aureus Mu50
aggaauaccacuuaauc

SEQ ID NO: 2076678 - RNA, 19 nt, Staphylococcus aureus subsp. aureus Mu50
aggaauacaugaguaaaac

SEQ ID NO: 2076679 - RNA, 18 nt, Staphylococcus aureus subsp. aureus Mu50
aggaauaucuuucaaauu

SEQ ID NO: 2076680 - RNA, 21 nt, Staphylococcus aureus subsp. aureus Mu50
aggaauaauuuuaaaaauaaa

SEQ ID NO: 2076681 - RNA, 22 nt, Staphylococcus aureus subsp. aureus Mu50
agcuuauuaagcuugaaacaag

SEQ ID NO: 2076682 - RNA, 19 nt, Staphylococcus aureus subsp. aureus Mu50
agcuugaauaauauauuua

SEQ ID NO: 2076683 - RNA, 15 nt, Staphylococcus aureus subsp. aureus Mu50
agcuucuuuaacaau

SEQ ID NO: 2076684 - RNA, 14 nt, Staphylococcus aureus subsp. aureus Mu50
agcuugcuguucaa

SEQ ID NO: 2076685 - RNA, 18 nt, Staphylococcus aureus subsp. aureus Mu50
agcuugcuguucaacauc

SEQ ID NO: 2076686 - RNA, 14 nt, Staphylococcus aureus subsp. aureus Mu50
agcuuuaauuuuuu

SEQ ID NO: 2076687 - RNA, 18 nt, Staphylococcus aureus subsp. aureus Mu50
agcugauuccauuucgau

SEQ ID NO: 2076688 - RNA, 19 nt, Staphylococcus aureus subsp. aureus Mu50
agcugauuucuaucaaaua

SEQ ID NO: 2076689 - RNA, 21 nt, Staphylococcus aureus subsp. aureus Mu50
agcuguuggugaguguuucau

SEQ ID NO: 2076690 - RNA, 16 nt, Staphylococcus aureus subsp. aureus Mu50
agcucuuuuuugauuu

SEQ ID NO: 2076691 - RNA, 20 nt, Staphylococcus aureus subsp. aureus Mu50
agcucuuuuuugauuuggaa

SEQ ID NO: 2076692 - RNA, 15 nt, Staphylococcus aureus subsp. aureus Mu50
agcucguuuuuucau

SEQ ID NO: 2076693 - RNA, 16 nt, Staphylococcus aureus subsp. aureus Mu50
agcucguuaaaucaca

SEQ ID NO: 2076694 - RNA, 22 nt, Staphylococcus aureus subsp. aureus Mu50
agcucugaaggagacauuuccc

SEQ ID NO: 2076695 - RNA, 22 nt, Staphylococcus aureus subsp. aureus Mu50
accgacacuccacaaguggaac

SEQ ID NO: 2076696 - RNA, 19 nt, Staphylococcus aureus subsp. aureus Mu50
accgacaauuauaauaaaa

SEQ ID NO: 2076697 - RNA, 21 nt, Staphylococcus aureus subsp. aureus Mu50
acccuuuaaacauauuuacua

SEQ ID NO: 2076698 - RNA, 20 nt, Staphylococcus aureus subsp. aureus Mu50
acccuugucaguuuuuuuau

SEQ ID NO: 2076699 - RNA, 23 nt, Staphylococcus aureus subsp. aureus Mu50
acccuaauuuguuaguuuaaguc

SEQ ID NO: 2076700 - RNA, 21 nt, Staphylococcus aureus subsp. aureus Mu50
accccuccuggugcugcacca

SEQ ID NO: 2076701 - RNA, 16 nt, Staphylococcus aureus subsp. aureus Mu50
accccgaaaagaggga

SEQ ID NO: 2076702 - RNA, 20 nt, Staphylococcus aureus subsp. aureus Mu50
accccaacuugcacauuauc

SEQ ID NO: 2076703 - RNA, 13 nt, Staphylococcus aureus subsp. aureus Mu50
acccauauaauuu

SEQ ID NO: 2076704 - RNA, 21 nt, Staphylococcus aureus subsp. aureus Mu50
acccagaugaauuuuuauuuu

SEQ ID NO: 2076705 - RNA, 19 nt, Staphylococcus aureus subsp. aureus Mu50
accaucuuuaauacgaauu

SEQ ID NO: 2076706 - RNA, 20 nt, Staphylococcus aureus subsp. aureus Mu50
accaucucaacuaaucgugu

SEQ ID NO: 2076707 - RNA, 15 nt, Staphylococcus aureus subsp. aureus Mu50
accagcuaacaaaag

SEQ ID NO: 2076708 - RNA, 14 nt, Staphylococcus aureus subsp. aureus Mu50
accaguuucuggua

SEQ ID NO: 2076709 - RNA, 14 nt, Staphylococcus aureus subsp. aureus Mu50
accagucguaauga

SEQ ID NO: 2076710 - RNA, 14 nt, Staphylococcus aureus subsp. aureus Mu50
accauaaauguaac

SEQ ID NO: 2076711 - RNA, 16 nt, Staphylococcus aureus subsp. aureus Mu50
accauauuuuuagaaa

SEQ ID NO: 2076712 - RNA, 17 nt, Staphylococcus aureus subsp. aureus Mu50
accgauuguuaauuuaa

SEQ ID NO: 2076713 - RNA, 19 nt, Staphylococcus aureus subsp. aureus Mu50
accgcuucucgccuaauua

SEQ ID NO: 2076714 - RNA, 18 nt, Staphylococcus aureus subsp. aureus Mu50
accgcuucuuuuaaguua

SEQ ID NO: 2076715 - RNA, 19 nt, Staphylococcus aureus subsp. aureus Mu50
accgucaaacuuaaaacua

SEQ ID NO: 2076716 - RNA, 15 nt, Staphylococcus aureus subsp. aureus Mu50
accguaaucuuuuaa

SEQ ID NO: 2076717 - RNA, 19 nt, Staphylococcus aureus subsp. aureus Mu50
accguaacuauaugaaaug

SEQ ID NO: 2076718 - RNA, 18 nt, Staphylococcus aureus subsp. aureus Mu50
accuaagcaagauaauag

SEQ ID NO: 2076719 - RNA, 16 nt, Staphylococcus aureus subsp. aureus Mu50
accuaaguuaauuuau

SEQ ID NO: 2076720 - RNA, 19 nt, Staphylococcus aureus subsp. aureus Mu50
accuaagcugauuaaaaug

SEQ ID NO: 2076721 - RNA, 14 nt, Staphylococcus aureus subsp. aureus Mu50
accuacaaauauuu

SEQ ID NO: 2076722 - RNA, 14 nt, Staphylococcus aureus subsp. aureus Mu50
accuacaacaccaa

SEQ ID NO: 2076723 - RNA, 16 nt, Staphylococcus aureus subsp. aureus Mu50
accuaauucauauaua

SEQ ID NO: 2076724 - RNA, 20 nt, Staphylococcus aureus subsp. aureus Mu50
accuaauucgccaucuuuuu

SEQ ID NO: 2076725 - RNA, 18 nt, Staphylococcus aureus subsp. aureus Mu50
accuaaaauacccauuuu

SEQ ID NO: 2076726 - RNA, 12 nt, Staphylococcus aureus subsp. aureus Mu50
accuaaaauacc

SEQ ID NO: 2076727 - RNA, 19 nt, Staphylococcus aureus subsp. aureus Mu50
accuaaaugauuaauaaca

SEQ ID NO: 2076728 - RNA, 21 nt, Staphylococcus aureus subsp. aureus Mu50
accuaaaugauuaauaacaua

SEQ ID NO: 2076729 - RNA, 18 nt, Staphylococcus aureus subsp. aureus Mu50
accguuuuucaucaaucc

SEQ ID NO: 2076730 - RNA, 21 nt, Staphylococcus aureus subsp. aureus Mu50
accuacgauucgaaauaggua

SEQ ID NO: 2076731 - RNA, 17 nt, Staphylococcus aureus subsp. aureus Mu50
accuacacggucccaag

SEQ ID NO: 2076732 - RNA, 19 nt, Staphylococcus aureus subsp. aureus Mu50
accuacuuugauauguuuc

SEQ ID NO: 2076733 - RNA, 22 nt, Staphylococcus aureus subsp. aureus Mu50
accuacuuugauauguuuccuc

SEQ ID NO: 2076734 - RNA, 16 nt, Staphylococcus aureus subsp. aureus Mu50
accuauuaauaucaua

SEQ ID NO: 2076735 - RNA, 17 nt, Staphylococcus aureus subsp. aureus Mu50
accuauuccuaauaaau

SEQ ID NO: 2076736 - RNA, 20 nt, Staphylococcus aureus subsp. aureus Mu50
accucauccgccaauuaaaa

SEQ ID NO: 2076737 - RNA, 12 nt, Staphylococcus aureus subsp. aureus Mu50
accuauuguauu

SEQ ID NO: 2076738 - RNA, 19 nt, Staphylococcus aureus subsp. aureus Mu50
accguguuguugaauaauu

SEQ ID NO: 2076739 - RNA, 17 nt, Staphylococcus aureus subsp. aureus Mu50
acgaauuaaaauaacuc

SEQ ID NO: 2076740 - RNA, 12 nt, Staphylococcus aureus subsp. aureus Mu50
acgacaauucca

SEQ ID NO: 2076741 - RNA, 18 nt, Staphylococcus aureus subsp. aureus Mu50
acgaaaguagaauuauuu

SEQ ID NO: 2076742 - RNA, 16 nt, Staphylococcus aureus subsp. aureus Mu50
acgaaauaaauuuuac

SEQ ID NO: 2076743 - RNA, 13 nt, Staphylococcus aureus subsp. aureus Mu50
accuuugucuuuu

SEQ ID NO: 2076744 - RNA, 22 nt, Staphylococcus aureus subsp. aureus Mu50
accuuuugauguuuaugacaaa

SEQ ID NO: 2076745 - RNA, 16 nt, Staphylococcus aureus subsp. aureus Mu50
acgacgaaauaaauuu

SEQ ID NO: 2076746 - RNA, 22 nt, Staphylococcus aureus subsp. aureus Mu50
acgagugcacuuguaauauuau

SEQ ID NO: 2076747 - RNA, 20 nt, Staphylococcus aureus subsp. aureus Mu50
acgaguguuuuaaucuuauu

SEQ ID NO: 2076748 - RNA, 14 nt, Staphylococcus aureus subsp. aureus Mu50
acgauaagaauuaa

SEQ ID NO: 2076749 - RNA, 21 nt, Staphylococcus aureus subsp. aureus Mu50
acgauaacagcuacaaauaau

SEQ ID NO: 2076750 - RNA, 19 nt, Staphylococcus aureus subsp. aureus Mu50
acgacucuccaaauauugu

SEQ ID NO: 2076751 - RNA, 16 nt, Staphylococcus aureus subsp. aureus Mu50
acgagcaguauauauc

SEQ ID NO: 2076752 - RNA, 22 nt, Staphylococcus aureus subsp. aureus Mu50
accuuucgcagcuucuuuaaca

SEQ ID NO: 2076753 - RNA, 14 nt, Staphylococcus aureus subsp. aureus Mu50
accuuguuaaaaua

SEQ ID NO: 2076754 - RNA, 15 nt, Staphylococcus aureus subsp. aureus Mu50
accuucaguuucuac

SEQ ID NO: 2076755 - RNA, 19 nt, Staphylococcus aureus subsp. aureus Mu50
accuucaguuucuacugua

SEQ ID NO: 2076756 - RNA, 12 nt, Staphylococcus aureus subsp. aureus Mu50
accugugauaac

SEQ ID NO: 2076757 - RNA, 16 nt, Staphylococcus aureus subsp. aureus Mu50
accugcauauguguuu

SEQ ID NO: 2076758 - RNA, 21 nt, Staphylococcus aureus subsp. aureus Mu50
accugcaauauagcaauuuuc

SEQ ID NO: 2076759 - RNA, 17 nt, Staphylococcus aureus subsp. aureus Mu50
accugcgccuucuuuuu

SEQ ID NO: 2076760 - RNA, 16 nt, Staphylococcus aureus subsp. aureus Mu50
acgcuguaccuucuga

SEQ ID NO: 2076761 - RNA, 14 nt, Staphylococcus aureus subsp. aureus Mu50
acgucaacagcaua

SEQ ID NO: 2076762 - RNA, 17 nt, Staphylococcus aureus subsp. aureus Mu50
acguauauaaguuaaaa

SEQ ID NO: 2076763 - RNA, 18 nt, Staphylococcus aureus subsp. aureus Mu50
acguauauaaguuaaaau

SEQ ID NO: 2076764 - RNA, 17 nt, Staphylococcus aureus subsp. aureus Mu50
acguaucaagaaaaagu

SEQ ID NO: 2076765 - RNA, 16 nt, Staphylococcus aureus subsp. aureus Mu50
acguaucauuuaaaau

SEQ ID NO: 2076766 - RNA, 16 nt, Staphylococcus aureus subsp. aureus Mu50
acguauacaaauugau

SEQ ID NO: 2076767 - RNA, 20 nt, Staphylococcus aureus subsp. aureus Mu50
acguauagaugcuaauguaa

SEQ ID NO: 2076768 - RNA, 15 nt, Staphylococcus aureus subsp. aureus Mu50
acgguuauggugugu

SEQ ID NO: 2076769 - RNA, 15 nt, Staphylococcus aureus subsp. aureus Mu50
acgucacuuuauuaa

SEQ ID NO: 2076770 - RNA, 14 nt, Staphylococcus aureus subsp. aureus Mu50
acgucauuuuuaau

SEQ ID NO: 2076771 - RNA, 16 nt, Staphylococcus aureus subsp. aureus Mu50
acguccaaacacaaau

SEQ ID NO: 2076772 - RNA, 19 nt, Staphylococcus aureus subsp. aureus Mu50
acgucauauguuuuauaau

SEQ ID NO: 2076773 - RNA, 22 nt, Staphylococcus aureus subsp. aureus Mu50
acgucgcaacaggaccacucaa

SEQ ID NO: 2076774 - RNA, 20 nt, Staphylococcus aureus subsp. aureus Mu50
acgucgaauguuucuucguu

SEQ ID NO: 2076775 - RNA, 10 nt, Staphylococcus aureus subsp. aureus Mu50
acgucuaccu

SEQ ID NO: 2076776 - RNA, 22 nt, Staphylococcus aureus subsp. aureus Mu50
acgugaggcccauaaauuacuu

SEQ ID NO: 2076777 - RNA, 20 nt, Staphylococcus aureus subsp. aureus Mu50
acgugauaaugacucaagug

SEQ ID NO: 2076778 - RNA, 21 nt, Staphylococcus aureus subsp. aureus Mu50
acguguguuuucuuuucaaaa

SEQ ID NO: 2076779 - RNA, 18 nt, Staphylococcus aureus subsp. aureus Mu50
acgugcauuguaauacca

SEQ ID NO: 2076780 - RNA, 23 nt, Staphylococcus aureus subsp. aureus Mu50
acgcgauugacguggucuacuuc

SEQ ID NO: 2076781 - RNA, 15 nt, Staphylococcus aureus subsp. aureus Mu50
acgcugguaauauuu

SEQ ID NO: 2076782 - RNA, 16 nt, Staphylococcus aureus subsp. aureus Mu50
acgcugguaauauuuu

SEQ ID NO: 2076783 - RNA, 17 nt, Staphylococcus aureus subsp. aureus Mu50
acgcuaauuuuacucug

SEQ ID NO: 2076784 - RNA, 23 nt, Staphylococcus aureus subsp. aureus Mu50
acgcucaugaguuucucaucuac

SEQ ID NO: 2076785 - RNA, 22 nt, Staphylococcus aureus subsp. aureus Mu50
acgcuaauggaugaauauauug

SEQ ID NO: 2076786 - RNA, 15 nt, Staphylococcus aureus subsp. aureus Mu50
acgcuaauuuuacuc

SEQ ID NO: 2076787 - RNA, 17 nt, Staphylococcus aureus subsp. aureus Mu50
acgcuaaacaaagggga

SEQ ID NO: 2076788 - RNA, 14 nt, Staphylococcus aureus subsp. aureus Mu50
acgccauucaucau

SEQ ID NO: 2076789 - RNA, 20 nt, Staphylococcus aureus subsp. aureus Mu50
acgaucaacugcuucacgau

SEQ ID NO: 2076790 - RNA, 21 nt, Staphylococcus aureus subsp. aureus Mu50
acgccucaacacuuucuacuc

SEQ ID NO: 2076791 - RNA, 21 nt, Staphylococcus aureus subsp. aureus Mu50
acuguauggucuggaauaaau

SEQ ID NO: 2076792 - RNA, 15 nt, Staphylococcus aureus subsp. aureus Mu50
acuguaguacuauag

SEQ ID NO: 2076793 - RNA, 19 nt, Staphylococcus aureus subsp. aureus Mu50
acuguguuuagguauauaa

SEQ ID NO: 2076794 - RNA, 22 nt, Staphylococcus aureus subsp. aureus Mu50
acuguuaaagucuguugguuua

SEQ ID NO: 2076795 - RNA, 16 nt, Staphylococcus aureus subsp. aureus Mu50
acuguuugcuuuauca

SEQ ID NO: 2076796 - RNA, 20 nt, Staphylococcus aureus subsp. aureus Mu50
acuguuuguuuauugagaau

SEQ ID NO: 2076797 - RNA, 18 nt, Staphylococcus aureus subsp. aureus Mu50
acuguuuuauuaugaauu

SEQ ID NO: 2076798 - RNA, 23 nt, Staphylococcus aureus subsp. aureus Mu50
acuuaaugacuucuuuauauuua

SEQ ID NO: 2076799 - RNA, 16 nt, Staphylococcus aureus subsp. aureus Mu50
acuuaaucguucccau

SEQ ID NO: 2076800 - RNA, 22 nt, Staphylococcus aureus subsp. aureus Mu50
acugcuuuggacacaauaccuu

SEQ ID NO: 2076801 - RNA, 16 nt, Staphylococcus aureus subsp. aureus Mu50
acugcuuucaaguaau

SEQ ID NO: 2076802 - RNA, 13 nt, Staphylococcus aureus subsp. aureus Mu50
acuguaaaacaau

SEQ ID NO: 2076803 - RNA, 15 nt, Staphylococcus aureus subsp. aureus Mu50
acugaaauuuuuccg

SEQ ID NO: 2076804 - RNA, 12 nt, Staphylococcus aureus subsp. aureus Mu50
acugaauuuuaa

SEQ ID NO: 2076805 - RNA, 17 nt, Staphylococcus aureus subsp. aureus Mu50
acugacuaauaaaacuu

SEQ ID NO: 2076806 - RNA, 17 nt, Staphylococcus aureus subsp. aureus Mu50
acugagaaaucuuaaag

SEQ ID NO: 2076807 - RNA, 21 nt, Staphylococcus aureus subsp. aureus Mu50
acugaugaaaacuuaaaaaug

SEQ ID NO: 2076808 - RNA, 19 nt, Staphylococcus aureus subsp. aureus Mu50
acugcacaucauaauaaau

SEQ ID NO: 2076809 - RNA, 18 nt, Staphylococcus aureus subsp. aureus Mu50
acugcacggauaccuacu

SEQ ID NO: 2076810 - RNA, 20 nt, Staphylococcus aureus subsp. aureus Mu50
acugcaccgauaucauauaa

SEQ ID NO: 2076811 - RNA, 22 nt, Staphylococcus aureus subsp. aureus Mu50
acugauucaccagguuuuuuau

SEQ ID NO: 2076812 - RNA, 12 nt, Staphylococcus aureus subsp. aureus Mu50
acugauugaaug

SEQ ID NO: 2076813 - RNA, 13 nt, Staphylococcus aureus subsp. aureus Mu50
acugauuaaacug

SEQ ID NO: 2076814 - RNA, 16 nt, Staphylococcus aureus subsp. aureus Mu50
acugccauauguuuua

SEQ ID NO: 2076815 - RNA, 18 nt, Staphylococcus aureus subsp. aureus Mu50
acugcuaauauuagauau

SEQ ID NO: 2076816 - RNA, 16 nt, Staphylococcus aureus subsp. aureus Mu50
acugcuaauuuuuuca

SEQ ID NO: 2076817 - RNA, 16 nt, Staphylococcus aureus subsp. aureus Mu50
acucggggaauuuuua

SEQ ID NO: 2076818 - RNA, 19 nt, Staphylococcus aureus subsp. aureus Mu50
acuccuuaaacaaauaaau

SEQ ID NO: 2076819 - RNA, 15 nt, Staphylococcus aureus subsp. aureus Mu50
acuccuuacaauaaa

SEQ ID NO: 2076820 - RNA, 19 nt, Staphylococcus aureus subsp. aureus Mu50
acucaguuauauuaagguc

SEQ ID NO: 2076821 - RNA, 16 nt, Staphylococcus aureus subsp. aureus Mu50
acucaguuuauugagg

SEQ ID NO: 2076822 - RNA, 19 nt, Staphylococcus aureus subsp. aureus Mu50
acucauaaccgcuucuuuu

SEQ ID NO: 2076823 - RNA, 17 nt, Staphylococcus aureus subsp. aureus Mu50
acucaggcuuaauuaau

SEQ ID NO: 2076824 - RNA, 16 nt, Staphylococcus aureus subsp. aureus Mu50
acucauaccaaaaaca

SEQ ID NO: 2076825 - RNA, 19 nt, Staphylococcus aureus subsp. aureus Mu50
acucauaccaaaaacauua

SEQ ID NO: 2076826 - RNA, 16 nt, Staphylococcus aureus subsp. aureus Mu50
acucaggcuuaauuaa

SEQ ID NO: 2076827 - RNA, 20 nt, Staphylococcus aureus subsp. aureus Mu50
acucagaaucuuacauugau

SEQ ID NO: 2076828 - RNA, 20 nt, Staphylococcus aureus subsp. aureus Mu50
acuaucuacaauaaccauuu

SEQ ID NO: 2076829 - RNA, 18 nt, Staphylococcus aureus subsp. aureus Mu50
acuaucuucaucauauuc

SEQ ID NO: 2076830 - RNA, 13 nt, Staphylococcus aureus subsp. aureus Mu50
acuaucuguuguu

SEQ ID NO: 2076831 - RNA, 18 nt, Staphylococcus aureus subsp. aureus Mu50
acuaucuguuguuauaua

SEQ ID NO: 2076832 - RNA, 18 nt, Staphylococcus aureus subsp. aureus Mu50
acuaguuuguaauaauua

SEQ ID NO: 2076833 - RNA, 19 nt, Staphylococcus aureus subsp. aureus Mu50
acuaguuuguaauaauuaa

SEQ ID NO: 2076834 - RNA, 20 nt, Staphylococcus aureus subsp. aureus Mu50
acuagucuuuuuauuuuaau

SEQ ID NO: 2076835 - RNA, 22 nt, Staphylococcus aureus subsp. aureus Mu50
acuaguucuaaguguugaccau

SEQ ID NO: 2076836 - RNA, 14 nt, Staphylococcus aureus subsp. aureus Mu50
acuacuuuuucaac

SEQ ID NO: 2076837 - RNA, 16 nt, Staphylococcus aureus subsp. aureus Mu50
acuacuacauuauuac

SEQ ID NO: 2076838 - RNA, 15 nt, Staphylococcus aureus subsp. aureus Mu50
acuacuauugauauu

SEQ ID NO: 2076839 - RNA, 21 nt, Staphylococcus aureus subsp. aureus Mu50
acguucgauaacguugccaua

SEQ ID NO: 2076840 - RNA, 15 nt, Staphylococcus aureus subsp. aureus Mu50
acuacgcauuuuaaa

SEQ ID NO: 2076841 - RNA, 17 nt, Staphylococcus aureus subsp. aureus Mu50
acucaaagauauacuua

SEQ ID NO: 2076842 - RNA, 23 nt, Staphylococcus aureus subsp. aureus Mu50
acucaaaauguuuaacaauaaua

SEQ ID NO: 2076843 - RNA, 17 nt, Staphylococcus aureus subsp. aureus Mu50
acucaaaauuaaagcuu

SEQ ID NO: 2076844 - RNA, 20 nt, Staphylococcus aureus subsp. aureus Mu50
acuaugcauaauaccaauug

SEQ ID NO: 2076845 - RNA, 14 nt, Staphylococcus aureus subsp. aureus Mu50
acuaugcaaaugaa

SEQ ID NO: 2076846 - RNA, 13 nt, Staphylococcus aureus subsp. aureus Mu50
acuauggcauuau

SEQ ID NO: 2076847 - RNA, 12 nt, Staphylococcus aureus subsp. aureus Mu50
acuaugugaagu

SEQ ID NO: 2076848 - RNA, 17 nt, Staphylococcus aureus subsp. aureus Mu50
acuauguuacuuauaua

SEQ ID NO: 2076849 - RNA, 19 nt, Staphylococcus aureus subsp. aureus Mu50
acuauguuacuuauauauu

SEQ ID NO: 2076850 - RNA, 22 nt, Staphylococcus aureus subsp. aureus Mu50
acucaauaugaaaccuuugguu

SEQ ID NO: 2076851 - RNA, 15 nt, Staphylococcus aureus subsp. aureus Mu50
acucaccugcagcau

SEQ ID NO: 2076852 - RNA, 18 nt, Staphylococcus aureus subsp. aureus Mu50
acucacagacuuuuuacu

SEQ ID NO: 2076853 - RNA, 12 nt, Staphylococcus aureus subsp. aureus Mu50
acucaauucucu

SEQ ID NO: 2076854 - RNA, 15 nt, Staphylococcus aureus subsp. aureus Mu50
acucaauucucuaac

SEQ ID NO: 2076855 - RNA, 19 nt, Staphylococcus aureus subsp. aureus Mu50
agcaagucuucuaaaaaau

SEQ ID NO: 2076856 - RNA, 20 nt, Staphylococcus aureus subsp. aureus Mu50
agauucaaacguuuucacuu

SEQ ID NO: 2076857 - RNA, 15 nt, Staphylococcus aureus subsp. aureus Mu50
agauuauauuaucau

SEQ ID NO: 2076858 - RNA, 15 nt, Staphylococcus aureus subsp. aureus Mu50
agauuaugacaacau

SEQ ID NO: 2076859 - RNA, 18 nt, Staphylococcus aureus subsp. aureus Mu50
agauuauugguugaaauu

SEQ ID NO: 2076860 - RNA, 13 nt, Staphylococcus aureus subsp. aureus Mu50
agauuauuaugug

SEQ ID NO: 2076861 - RNA, 22 nt, Staphylococcus aureus subsp. aureus Mu50
agauuauuauuacaaugaaaaa

SEQ ID NO: 2076862 - RNA, 19 nt, Staphylococcus aureus subsp. aureus Mu50
agcaauucuucaauuucau

SEQ ID NO: 2076863 - RNA, 22 nt, Staphylococcus aureus subsp. aureus Mu50
agcaauuucgauugcguuuucu

SEQ ID NO: 2076864 - RNA, 22 nt, Staphylococcus aureus subsp. aureus Mu50
agcaauuaaagucaauuuaaau

SEQ ID NO: 2076865 - RNA, 20 nt, Staphylococcus aureus subsp. aureus Mu50
agcaauuaaagucaauuuaa

SEQ ID NO: 2076866 - RNA, 16 nt, Staphylococcus aureus subsp. aureus Mu50
agcacgagacaauaau

SEQ ID NO: 2076867 - RNA, 21 nt, Staphylococcus aureus subsp. aureus Mu50
agcacauuuuuaguuagaaag

SEQ ID NO: 2076868 - RNA, 17 nt, Staphylococcus aureus subsp. aureus Mu50
agcacagcgauuaaaug

SEQ ID NO: 2076869 - RNA, 20 nt, Staphylococcus aureus subsp. aureus Mu50
agcacagcgauuaaaugaug

SEQ ID NO: 2076870 - RNA, 17 nt, Staphylococcus aureus subsp. aureus Mu50
agcaccauuauuaaaug

SEQ ID NO: 2076871 - RNA, 22 nt, Staphylococcus aureus subsp. aureus Mu50
agcauugagauggucuuuuaau

SEQ ID NO: 2076872 - RNA, 20 nt, Staphylococcus aureus subsp. aureus Mu50
agcauugggacauaaaauua

SEQ ID NO: 2076873 - RNA, 23 nt, Staphylococcus aureus subsp. aureus Mu50
agcaucugcaugguuugcugguu

SEQ ID NO: 2076874 - RNA, 20 nt, Staphylococcus aureus subsp. aureus Mu50
agcauuaaauuccaugucaa

SEQ ID NO: 2076875 - RNA, 19 nt, Staphylococcus aureus subsp. aureus Mu50
agcauuaaucguauuuuua

SEQ ID NO: 2076876 - RNA, 17 nt, Staphylococcus aureus subsp. aureus Mu50
agcauuacgccaccagu

SEQ ID NO: 2076877 - RNA, 20 nt, Staphylococcus aureus subsp. aureus Mu50
agcauuacgccaccaguuuc

SEQ ID NO: 2076878 - RNA, 13 nt, Staphylococcus aureus subsp. aureus Mu50
agccaaauuacug

SEQ ID NO: 2076879 - RNA, 16 nt, Staphylococcus aureus subsp. aureus Mu50
agccaacacauaaaug

SEQ ID NO: 2076880 - RNA, 23 nt, Staphylococcus aureus subsp. aureus Mu50
agccaaaucuuuaauaaccuuua

SEQ ID NO: 2076881 - RNA, 21 nt, Staphylococcus aureus subsp. aureus Mu50
agcaguugacuguaaaacaau

SEQ ID NO: 2076882 - RNA, 21 nt, Staphylococcus aureus subsp. aureus Mu50
agcaguugcacaaauugcaau

SEQ ID NO: 2076883 - RNA, 14 nt, Staphylococcus aureus subsp. aureus Mu50
agcaucauuuuucg

SEQ ID NO: 2076884 - RNA, 15 nt, Staphylococcus aureus subsp. aureus Mu50
agcaucaaaaauaaa

SEQ ID NO: 2076885 - RNA, 17 nt, Staphylococcus aureus subsp. aureus Mu50
agcauaucucaagauau

SEQ ID NO: 2076886 - RNA, 19 nt, Staphylococcus aureus subsp. aureus Mu50
aaaaccuuacccaaaaaau

SEQ ID NO: 2076887 - RNA, 13 nt, Staphylococcus aureus subsp. aureus Mu50
aaaaccucuuuuu

SEQ ID NO: 2076888 - RNA, 18 nt, Staphylococcus aureus subsp. aureus Mu50
aaaaccugggacauuaau

SEQ ID NO: 2076889 - RNA, 14 nt, Staphylococcus aureus subsp. aureus Mu50
aaaaccugaaacaa

SEQ ID NO: 2076890 - RNA, 20 nt, Staphylococcus aureus subsp. aureus Mu50
aaaaccuauuccuaauaaau

SEQ ID NO: 2076891 - RNA, 21 nt, Staphylococcus aureus subsp. aureus Mu50
aaaaccuauuccuaauaaaua

SEQ ID NO: 2076892 - RNA, 17 nt, Staphylococcus aureus subsp. aureus Mu50
agcgcagugaccucagg

SEQ ID NO: 2076893 - RNA, 20 nt, Staphylococcus aureus subsp. aureus Mu50
agcgcauaaauuuucuguuu

SEQ ID NO: 2076894 - RNA, 17 nt, Staphylococcus aureus subsp. aureus Mu50
agcgcaggcgaaccgaa

SEQ ID NO: 2076895 - RNA, 16 nt, Staphylococcus aureus subsp. aureus Mu50
agcguauuuuaaugau

SEQ ID NO: 2076896 - RNA, 19 nt, Staphylococcus aureus subsp. aureus Mu50
agcggaauacagaugaugc

SEQ ID NO: 2076897 - RNA, 20 nt, Staphylococcus aureus subsp. aureus Mu50
agcggaaauaugauugaaug

SEQ ID NO: 2076898 - RNA, 13 nt, Staphylococcus aureus subsp. aureus Mu50
agccuauccauuc

SEQ ID NO: 2076899 - RNA, 20 nt, Staphylococcus aureus subsp. aureus Mu50
agccuacuuugucugcaauu

SEQ ID NO: 2076900 - RNA, 22 nt, Staphylococcus aureus subsp. aureus Mu50
agccuauuuaaaagacaaucuc

SEQ ID NO: 2076901 - RNA, 14 nt, Staphylococcus aureus subsp. aureus Mu50
agcccuauuuuuaa

SEQ ID NO: 2076902 - RNA, 21 nt, Staphylococcus aureus subsp. aureus Mu50
acuuggcgacauuuguaaaua

SEQ ID NO: 2076903 - RNA, 13 nt, Staphylococcus aureus subsp. aureus Mu50
acuuggauuuuaa

SEQ ID NO: 2076904 - RNA, 21 nt, Staphylococcus aureus subsp. aureus Mu50
acuugguauugguaaauuuau

SEQ ID NO: 2076905 - RNA, 15 nt, Staphylococcus aureus subsp. aureus Mu50
acuuguaaauuuauu

SEQ ID NO: 2076906 - RNA, 19 nt, Staphylococcus aureus subsp. aureus Mu50
acuuguaaauuuauuuuua

SEQ ID NO: 2076907 - RNA, 15 nt, Staphylococcus aureus subsp. aureus Mu50
acuuguaauauaaca

SEQ ID NO: 2076908 - RNA, 17 nt, Staphylococcus aureus subsp. aureus Mu50
acuugucguauucuuca

SEQ ID NO: 2076909 - RNA, 23 nt, Staphylococcus aureus subsp. aureus Mu50
acuugugacaaucgcuugcuucu

SEQ ID NO: 2076910 - RNA, 21 nt, Staphylococcus aureus subsp. aureus Mu50
acuuguccguuuuauauuuau

SEQ ID NO: 2076911 - RNA, 14 nt, Staphylococcus aureus subsp. aureus Mu50
acuuguaauauuau

SEQ ID NO: 2076912 - RNA, 15 nt, Staphylococcus aureus subsp. aureus Mu50
acuuguaauauuaua

SEQ ID NO: 2076913 - RNA, 23 nt, Staphylococcus aureus subsp. aureus Mu50
acuuguaauauuauaaccaccag

SEQ ID NO: 2076914 - RNA, 18 nt, Staphylococcus aureus subsp. aureus Mu50
acuugugauauauaacca

SEQ ID NO: 2076915 - RNA, 20 nt, Staphylococcus aureus subsp. aureus Mu50
acuugugcgcgacguuuaaa

SEQ ID NO: 2076916 - RNA, 13 nt, Staphylococcus aureus subsp. aureus Mu50
acuuaucaucaca

SEQ ID NO: 2076917 - RNA, 23 nt, Staphylococcus aureus subsp. aureus Mu50
acuuauauacguugauuaacaca

SEQ ID NO: 2076918 - RNA, 13 nt, Staphylococcus aureus subsp. aureus Mu50
acuuauauauuca

SEQ ID NO: 2076919 - RNA, 20 nt, Staphylococcus aureus subsp. aureus Mu50
acuuauauauucaauaauua

SEQ ID NO: 2076920 - RNA, 17 nt, Staphylococcus aureus subsp. aureus Mu50
acuuggaaauguauaug

SEQ ID NO: 2076921 - RNA, 20 nt, Staphylococcus aureus subsp. aureus Mu50
acuuucaaacaaaucuuuua

SEQ ID NO: 2076922 - RNA, 22 nt, Staphylococcus aureus subsp. aureus Mu50
acuuuauuucuauaucuauuua

SEQ ID NO: 2076923 - RNA, 15 nt, Staphylococcus aureus subsp. aureus Mu50
acuuucacuuuuuau

SEQ ID NO: 2076924 - RNA, 14 nt, Staphylococcus aureus subsp. aureus Mu50
acuuuaugaaauuu

SEQ ID NO: 2076925 - RNA, 12 nt, Staphylococcus aureus subsp. aureus Mu50
acuuuauauaua

SEQ ID NO: 2076926 - RNA, 20 nt, Staphylococcus aureus subsp. aureus Mu50
acuuuauauauaaagaaaua

SEQ ID NO: 2076927 - RNA, 14 nt, Staphylococcus aureus subsp. aureus Mu50
acuuuaguauuaua

SEQ ID NO: 2076928 - RNA, 15 nt, Staphylococcus aureus subsp. aureus Mu50
acuuuauaauuuuug

SEQ ID NO: 2076929 - RNA, 15 nt, Staphylococcus aureus subsp. aureus Mu50
acuuuagaaagugau

SEQ ID NO: 2076930 - RNA, 22 nt, Staphylococcus aureus subsp. aureus Mu50
acuuuagaaagugauucccaaa

SEQ ID NO: 2076931 - RNA, 23 nt, Staphylococcus aureus subsp. aureus Mu50
acuuuagaaagugauucccaaag

SEQ ID NO: 2076932 - RNA, 20 nt, Staphylococcus aureus subsp. aureus Mu50
acuuuaauaccagcauccau

SEQ ID NO: 2076933 - RNA, 21 nt, Staphylococcus aureus subsp. aureus Mu50
acuuuaauacuaccguuuuua

SEQ ID NO: 2076934 - RNA, 22 nt, Staphylococcus aureus subsp. aureus Mu50
acuuuaauaccagcauccauug

SEQ ID NO: 2076935 - RNA, 21 nt, Staphylococcus aureus subsp. aureus Mu50
acuuuaauuuagugaaacaau

SEQ ID NO: 2076936 - RNA, 20 nt, Staphylococcus aureus subsp. aureus Mu50
acuuuaauugcucuuuaaca

SEQ ID NO: 2076937 - RNA, 18 nt, Staphylococcus aureus subsp. aureus Mu50
acuuuacccucuuuaguu

SEQ ID NO: 2076938 - RNA, 13 nt, Staphylococcus aureus subsp. aureus Mu50
acuuuaauuuuuc

SEQ ID NO: 2076939 - RNA, 14 nt, Staphylococcus aureus subsp. aureus Mu50
acuuuaauuuuuca

SEQ ID NO: 2076940 - RNA, 11 nt, Staphylococcus aureus subsp. aureus Mu50
acuuuaccauc

SEQ ID NO: 2076941 - RNA, 11 nt, Staphylococcus aureus subsp. aureus Mu50
acuuuaacuuc

SEQ ID NO: 2076942 - RNA, 16 nt, Staphylococcus aureus subsp. aureus Mu50
acuuuaacuucuuuug

SEQ ID NO: 2076943 - RNA, 13 nt, Staphylococcus aureus subsp. aureus Mu50
acuuguuuccuac

SEQ ID NO: 2076944 - RNA, 16 nt, Staphylococcus aureus subsp. aureus Mu50
acuuuaaaauuguaua

SEQ ID NO: 2076945 - RNA, 19 nt, Staphylococcus aureus subsp. aureus Mu50
acuuuuuucauuucuuugu

SEQ ID NO: 2076946 - RNA, 20 nt, Staphylococcus aureus subsp. aureus Mu50
acuuuuuugagcauuuuuau

SEQ ID NO: 2076947 - RNA, 18 nt, Staphylococcus aureus subsp. aureus Mu50
acuuuuuugugauuauua

SEQ ID NO: 2076948 - RNA, 20 nt, Staphylococcus aureus subsp. aureus Mu50
agaaacaaaacaaaaaauau

SEQ ID NO: 2076949 - RNA, 18 nt, Staphylococcus aureus subsp. aureus Mu50
agaaaaugaguacaacau

SEQ ID NO: 2076950 - RNA, 15 nt, Staphylococcus aureus subsp. aureus Mu50
agaaaaugaguacaa

SEQ ID NO: 2076951 - RNA, 20 nt, Staphylococcus aureus subsp. aureus Mu50
acuuuuauuuguauuguaua

SEQ ID NO: 2076952 - RNA, 17 nt, Staphylococcus aureus subsp. aureus Mu50
acuuuuagaguuuuuau

SEQ ID NO: 2076953 - RNA, 22 nt, Staphylococcus aureus subsp. aureus Mu50
acuuuuauugcacuuuuuucau

SEQ ID NO: 2076954 - RNA, 15 nt, Staphylococcus aureus subsp. aureus Mu50
acuuuuauagaaaau

SEQ ID NO: 2076955 - RNA, 20 nt, Staphylococcus aureus subsp. aureus Mu50
acuuuuccuugauucuuaua

SEQ ID NO: 2076956 - RNA, 14 nt, Staphylococcus aureus subsp. aureus Mu50
acuuuucuaaacaa

SEQ ID NO: 2076957 - RNA, 14 nt, Staphylococcus aureus subsp. aureus Mu50
acuuuuucaucuuu

SEQ ID NO: 2076958 - RNA, 22 nt, Staphylococcus aureus subsp. aureus Mu50
acuuuuugaguauccaauacua

SEQ ID NO: 2076959 - RNA, 22 nt, Staphylococcus aureus subsp. aureus Mu50
acuuuuugacauauuuuuuaaa

SEQ ID NO: 2076960 - RNA, 17 nt, Staphylococcus aureus subsp. aureus Mu50
acuuuuucaucuuucac

SEQ ID NO: 2076961 - RNA, 21 nt, Staphylococcus aureus subsp. aureus Mu50
acuuucuacucugauuacaua

SEQ ID NO: 2076962 - RNA, 22 nt, Staphylococcus aureus subsp. aureus Mu50
acuuucucaucuauuuaauaau

SEQ ID NO: 2076963 - RNA, 20 nt, Staphylococcus aureus subsp. aureus Mu50
acuuugauaucuacagagaa

SEQ ID NO: 2076964 - RNA, 17 nt, Staphylococcus aureus subsp. aureus Mu50
acuuuccgccuucaauc

SEQ ID NO: 2076965 - RNA, 15 nt, Staphylococcus aureus subsp. aureus Mu50
acuuucccuacugcu

SEQ ID NO: 2076966 - RNA, 14 nt, Staphylococcus aureus subsp. aureus Mu50
acuuucgaucuucu

SEQ ID NO: 2076967 - RNA, 16 nt, Staphylococcus aureus subsp. aureus Mu50
acuuucgcuugcaaag

SEQ ID NO: 2076968 - RNA, 15 nt, Staphylococcus aureus subsp. aureus Mu50
acuuuggcaaaguca

SEQ ID NO: 2076969 - RNA, 17 nt, Staphylococcus aureus subsp. aureus Mu50
acuuuggacuuuaaagu

SEQ ID NO: 2076970 - RNA, 21 nt, Staphylococcus aureus subsp. aureus Mu50
acuuuuaccauugugaauaau

SEQ ID NO: 2076971 - RNA, 23 nt, Staphylococcus aureus subsp. aureus Mu50
acuuuuacuuucucaucuauuua

SEQ ID NO: 2076972 - RNA, 22 nt, Staphylococcus aureus subsp. aureus Mu50
acuuuguucugcuuuuucuuua

SEQ ID NO: 2076973 - RNA, 17 nt, Staphylococcus aureus subsp. aureus Mu50
agaaucagcuaaauauu

SEQ ID NO: 2076974 - RNA, 19 nt, Staphylococcus aureus subsp. aureus Mu50
agaaucaauuauugaaaac

SEQ ID NO: 2076975 - RNA, 17 nt, Staphylococcus aureus subsp. aureus Mu50
agaaucaaguaauucau

SEQ ID NO: 2076976 - RNA, 13 nt, Staphylococcus aureus subsp. aureus Mu50
agaaucaucuaaa

SEQ ID NO: 2076977 - RNA, 21 nt, Staphylococcus aureus subsp. aureus Mu50
agaauaguuaccaaaauuuga

SEQ ID NO: 2076978 - RNA, 11 nt, Staphylococcus aureus subsp. aureus Mu50
agaauauuaag

SEQ ID NO: 2076979 - RNA, 22 nt, Staphylococcus aureus subsp. aureus Mu50
agaauauuaagauguauaugaa

SEQ ID NO: 2076980 - RNA, 13 nt, Staphylococcus aureus subsp. aureus Mu50
agaauauucagau

SEQ ID NO: 2076981 - RNA, 15 nt, Staphylococcus aureus subsp. aureus Mu50
agaaucuccauuuaa

SEQ ID NO: 2076982 - RNA, 16 nt, Staphylococcus aureus subsp. aureus Mu50
agaauucaauuucuca

SEQ ID NO: 2076983 - RNA, 14 nt, Staphylococcus aureus subsp. aureus Mu50
agaauuauuuugga

SEQ ID NO: 2076984 - RNA, 12 nt, Staphylococcus aureus subsp. aureus Mu50
agaauuauucaa

SEQ ID NO: 2076985 - RNA, 15 nt, Staphylococcus aureus subsp. aureus Mu50
agaauuaaugaaaua

SEQ ID NO: 2076986 - RNA, 20 nt, Staphylococcus aureus subsp. aureus Mu50
agaauuaguacuugaaacau

SEQ ID NO: 2076987 - RNA, 15 nt, Staphylococcus aureus subsp. aureus Mu50
agaaguuuuuugauu

SEQ ID NO: 2076988 - RNA, 14 nt, Staphylococcus aureus subsp. aureus Mu50
agaaguuguuuaga

SEQ ID NO: 2076989 - RNA, 18 nt, Staphylococcus aureus subsp. aureus Mu50
agaagccucuugccuuga

SEQ ID NO: 2076990 - RNA, 16 nt, Staphylococcus aureus subsp. aureus Mu50
agaauaguuaccaaaa

SEQ ID NO: 2076991 - RNA, 17 nt, Staphylococcus aureus subsp. aureus Mu50
agaauaguuaccaaaau

SEQ ID NO: 2076992 - RNA, 17 nt, Staphylococcus aureus subsp. aureus Mu50
agaauacuaaaaguguu

SEQ ID NO: 2076993 - RNA, 13 nt, Staphylococcus aureus subsp. aureus Mu50
agaauaaaaaagu

SEQ ID NO: 2076994 - RNA, 14 nt, Staphylococcus aureus subsp. aureus Mu50
agaauacaaauauu

SEQ ID NO: 2076995 - RNA, 16 nt, Staphylococcus aureus subsp. aureus Mu50
agaauacaaauauuaa

SEQ ID NO: 2076996 - RNA, 17 nt, Staphylococcus aureus subsp. aureus Mu50
agaauacaaauauuaag

SEQ ID NO: 2076997 - RNA, 20 nt, Staphylococcus aureus subsp. aureus Mu50
agaauaacgucauauguuuu

SEQ ID NO: 2076998 - RNA, 20 nt, Staphylococcus aureus subsp. aureus Mu50
agaaacacaaggaauauaca

SEQ ID NO: 2076999 - RNA, 22 nt, Staphylococcus aureus subsp. aureus Mu50
agaaacaaugcgaagaaaucau

SEQ ID NO: 2077000 - RNA, 13 nt, Staphylococcus aureus subsp. aureus Mu50
agaaacacaagga

SEQ ID NO: 2077001 - RNA, 23 nt, Staphylococcus aureus subsp. aureus Mu50
agaaacuauuaucgaagaaacau

SEQ ID NO: 2077002 - RNA, 22 nt, Staphylococcus aureus subsp. aureus Mu50
agaaauguuaacgauagacauu

SEQ ID NO: 2077003 - RNA, 20 nt, Staphylococcus aureus subsp. aureus Mu50
agaaauuguguuucuuuuau

SEQ ID NO: 2077004 - RNA, 13 nt, Staphylococcus aureus subsp. aureus Mu50
agaaauuuuaaaa

SEQ ID NO: 2077005 - RNA, 12 nt, Staphylococcus aureus subsp. aureus Mu50
agaacaaaaugu

SEQ ID NO: 2077006 - RNA, 14 nt, Staphylococcus aureus subsp. aureus Mu50
agaaaucuuaaaga

SEQ ID NO: 2077007 - RNA, 17 nt, Staphylococcus aureus subsp. aureus Mu50
agaaaucucuaucgccu

SEQ ID NO: 2077008 - RNA, 14 nt, Staphylococcus aureus subsp. aureus Mu50
agaaaucaccagau

SEQ ID NO: 2077009 - RNA, 13 nt, Staphylococcus aureus subsp. aureus Mu50
agaagaaauauau

SEQ ID NO: 2077010 - RNA, 15 nt, Staphylococcus aureus subsp. aureus Mu50
agaacguucuaaggu

SEQ ID NO: 2077011 - RNA, 15 nt, Staphylococcus aureus subsp. aureus Mu50
agaacguucauauau

SEQ ID NO: 2077012 - RNA, 23 nt, Staphylococcus aureus subsp. aureus Mu50
agaacuuuaaaaauugcaaugcu

SEQ ID NO: 2077013 - RNA, 19 nt, Staphylococcus aureus subsp. aureus Mu50
agaaccuuuuuguuuucaa

SEQ ID NO: 2077014 - RNA, 15 nt, Staphylococcus aureus subsp. aureus Mu50
agaaccuuuaaaagu

SEQ ID NO: 2077015 - RNA, 21 nt, Staphylococcus aureus subsp. aureus Mu50
agaaccuuuaaaaguaacaua

SEQ ID NO: 2077016 - RNA, 17 nt, Staphylococcus aureus subsp. aureus Mu50
agaacgaaacuuuaauu

SEQ ID NO: 2077017 - RNA, 15 nt, Staphylococcus aureus subsp. aureus Mu50
agaaccaacaauaaa

SEQ ID NO: 2077018 - RNA, 14 nt, Staphylococcus aureus subsp. aureus Mu50
agaaccaacaauaa

SEQ ID NO: 2077019 - RNA, 16 nt, Staphylococcus aureus subsp. aureus Mu50
agaaccaaaaauuagc

SEQ ID NO: 2077020 - RNA, 15 nt, Staphylococcus aureus subsp. aureus Mu50
agaaccaaaauuaua

SEQ ID NO: 2077021 - RNA, 22 nt, Staphylococcus aureus subsp. aureus Mu50
agaaccacgcaucauguauaug

SEQ ID NO: 2077022 - RNA, 21 nt, Staphylococcus aureus subsp. aureus Mu50
agaaccaucauucauauggaa

SEQ ID NO: 2077023 - RNA, 13 nt, Staphylococcus aureus subsp. aureus Mu50
agaaauuuuucac

SEQ ID NO: 2077024 - RNA, 23 nt, Staphylococcus aureus subsp. aureus Mu50
agaacaugauacugaaauuucau

SEQ ID NO: 2077025 - RNA, 14 nt, Staphylococcus aureus subsp. aureus Mu50
agauaauuauuucu

SEQ ID NO: 2077026 - RNA, 19 nt, Staphylococcus aureus subsp. aureus Mu50
agauaggaaacuuaaauau

SEQ ID NO: 2077027 - RNA, 15 nt, Staphylococcus aureus subsp. aureus Mu50
agauaggaaacuuaa

SEQ ID NO: 2077028 - RNA, 16 nt, Staphylococcus aureus subsp. aureus Mu50
agauacacguaacgca

SEQ ID NO: 2077029 - RNA, 15 nt, Staphylococcus aureus subsp. aureus Mu50
agauaggauuugcac

SEQ ID NO: 2077030 - RNA, 23 nt, Staphylococcus aureus subsp. aureus Mu50
agauauagcaucuaugauuguau

SEQ ID NO: 2077031 - RNA, 23 nt, Staphylococcus aureus subsp. aureus Mu50
agaguaguucggaugagaaaugu

SEQ ID NO: 2077032 - RNA, 13 nt, Staphylococcus aureus subsp. aureus Mu50
aaaaccacgcaca

SEQ ID NO: 2077033 - RNA, 17 nt, Staphylococcus aureus subsp. aureus Mu50
agaguuuuuauuauuag

SEQ ID NO: 2077034 - RNA, 20 nt, Staphylococcus aureus subsp. aureus Mu50
agaguuuuuauuauuaggcg

SEQ ID NO: 2077035 - RNA, 15 nt, Staphylococcus aureus subsp. aureus Mu50
agauaacuagcaaau

SEQ ID NO: 2077036 - RNA, 15 nt, Staphylococcus aureus subsp. aureus Mu50
agauaagaauauuua

SEQ ID NO: 2077037 - RNA, 21 nt, Staphylococcus aureus subsp. aureus Mu50
agaucucaauccaauuaaaua

SEQ ID NO: 2077038 - RNA, 13 nt, Staphylococcus aureus subsp. aureus Mu50
agaucuaacaaua

SEQ ID NO: 2077039 - RNA, 14 nt, Staphylococcus aureus subsp. aureus Mu50
agaucuaacaauau

SEQ ID NO: 2077040 - RNA, 15 nt, Staphylococcus aureus subsp. aureus Mu50
agaugcuaauguaau

SEQ ID NO: 2077041 - RNA, 19 nt, Staphylococcus aureus subsp. aureus Mu50
agauuaaaauaugacacau

SEQ ID NO: 2077042 - RNA, 21 nt, Staphylococcus aureus subsp. aureus Mu50
agauguugguucaucaaacaa

SEQ ID NO: 2077043 - RNA, 16 nt, Staphylococcus aureus subsp. aureus Mu50
agauguugaugaagua

SEQ ID NO: 2077044 - RNA, 17 nt, Staphylococcus aureus subsp. aureus Mu50
agauggcugcaucaaua

SEQ ID NO: 2077045 - RNA, 17 nt, Staphylococcus aureus subsp. aureus Mu50
agaugcuuuaauuaaag

SEQ ID NO: 2077046 - RNA, 17 nt, Staphylococcus aureus subsp. aureus Mu50
agauggcuuuuuuugcu

SEQ ID NO: 2077047 - RNA, 17 nt, Staphylococcus aureus subsp. aureus Mu50
agagacuuauuuuauac

SEQ ID NO: 2077048 - RNA, 12 nt, Staphylococcus aureus subsp. aureus Mu50
agagacauuuua

SEQ ID NO: 2077049 - RNA, 20 nt, Staphylococcus aureus subsp. aureus Mu50
agagaauuucgaaaagaaau

SEQ ID NO: 2077050 - RNA, 13 nt, Staphylococcus aureus subsp. aureus Mu50
agagaaucaauua

SEQ ID NO: 2077051 - RNA, 20 nt, Staphylococcus aureus subsp. aureus Mu50
agagaaucaauuauugaaaa

SEQ ID NO: 2077052 - RNA, 19 nt, Staphylococcus aureus subsp. aureus Mu50
agagaaucgaaccaaauuu

SEQ ID NO: 2077053 - RNA, 12 nt, Staphylococcus aureus subsp. aureus Mu50
agagaacagcag

SEQ ID NO: 2077054 - RNA, 21 nt, Staphylococcus aureus subsp. aureus Mu50
agagaaacaaaacaaaaaaua

SEQ ID NO: 2077055 - RNA, 17 nt, Staphylococcus aureus subsp. aureus Mu50
agagaaacgugacggua

SEQ ID NO: 2077056 - RNA, 16 nt, Staphylococcus aureus subsp. aureus Mu50
agagaacgcuuuauua

SEQ ID NO: 2077057 - RNA, 22 nt, Staphylococcus aureus subsp. aureus Mu50
agacuuucuugaugaauuaaac

SEQ ID NO: 2077058 - RNA, 15 nt, Staphylococcus aureus subsp. aureus Mu50
agagccacuaaugau

SEQ ID NO: 2077059 - RNA, 15 nt, Staphylococcus aureus subsp. aureus Mu50
agagccagaaacccu

SEQ ID NO: 2077060 - RNA, 15 nt, Staphylococcus aureus subsp. aureus Mu50
agacugccaauaaaa

SEQ ID NO: 2077061 - RNA, 20 nt, Staphylococcus aureus subsp. aureus Mu50
agacugccaauaaaaugcaa

SEQ ID NO: 2077062 - RNA, 17 nt, Staphylococcus aureus subsp. aureus Mu50
agacuguuuuuuuguuu

SEQ ID NO: 2077063 - RNA, 19 nt, Staphylococcus aureus subsp. aureus Mu50
agacuuauuugaaugcaaa

SEQ ID NO: 2077064 - RNA, 15 nt, Staphylococcus aureus subsp. aureus Mu50
agacucaauuucauu

SEQ ID NO: 2077065 - RNA, 22 nt, Staphylococcus aureus subsp. aureus Mu50
agacucaauuucauuugaaaua

SEQ ID NO: 2077066 - RNA, 16 nt, Staphylococcus aureus subsp. aureus Mu50
agacgcuguuuuaaau

SEQ ID NO: 2077067 - RNA, 20 nt, Staphylococcus aureus subsp. aureus Mu50
agaauuuuaauuaauuauca

SEQ ID NO: 2077068 - RNA, 17 nt, Staphylococcus aureus subsp. aureus Mu50
agaauuucgaaaagaaa

SEQ ID NO: 2077069 - RNA, 13 nt, Staphylococcus aureus subsp. aureus Mu50
agaauucauuaau

SEQ ID NO: 2077070 - RNA, 16 nt, Staphylococcus aureus subsp. aureus Mu50
agaauucuaaaagaau

SEQ ID NO: 2077071 - RNA, 17 nt, Staphylococcus aureus subsp. aureus Mu50
agaauuucaucaaaucc

SEQ ID NO: 2077072 - RNA, 19 nt, Staphylococcus aureus subsp. aureus Mu50
agaauuucgaaaagaaauu

SEQ ID NO: 2077073 - RNA, 18 nt, Staphylococcus aureus subsp. aureus Mu50
agaauuucgaaaagaaau

SEQ ID NO: 2077074 - RNA, 14 nt, Staphylococcus aureus subsp. aureus Mu50
agaccccgaaaaga

SEQ ID NO: 2077075 - RNA, 13 nt, Staphylococcus aureus subsp. aureus Mu50
agaccuaugaauu

SEQ ID NO: 2077076 - RNA, 17 nt, Staphylococcus aureus subsp. aureus Mu50
agaccuucuucucuaau

SEQ ID NO: 2077077 - RNA, 12 nt, Staphylococcus aureus subsp. aureus Mu50
agacgaacauca

SEQ ID NO: 2077078 - RNA, 14 nt, Staphylococcus aureus subsp. aureus Mu50
acagcaaauaaaau

SEQ ID NO: 2077079 - RNA, 19 nt, Staphylococcus aureus subsp. aureus Mu50
acaguguaugaugaacuua

SEQ ID NO: 2077080 - RNA, 20 nt, Staphylococcus aureus subsp. aureus Mu50
acaguuaugccugaagcgcu

SEQ ID NO: 2077081 - RNA, 14 nt, Staphylococcus aureus subsp. aureus Mu50
acaguuauauauuc

SEQ ID NO: 2077082 - RNA, 20 nt, Staphylococcus aureus subsp. aureus Mu50
acaguuucuuggucugcugu

SEQ ID NO: 2077083 - RNA, 22 nt, Staphylococcus aureus subsp. aureus Mu50
acaguuucuuggucugcuguau

SEQ ID NO: 2077084 - RNA, 19 nt, Staphylococcus aureus subsp. aureus Mu50
acaguuuccauaaauaaaa

SEQ ID NO: 2077085 - RNA, 23 nt, Staphylococcus aureus subsp. aureus Mu50
acaguuuuauuaucuuuguaaau

SEQ ID NO: 2077086 - RNA, 15 nt, Staphylococcus aureus subsp. aureus Mu50
acauaaaauuaacuu

SEQ ID NO: 2077087 - RNA, 19 nt, Staphylococcus aureus subsp. aureus Mu50
acauaaaaaugcucaaguu

SEQ ID NO: 2077088 - RNA, 16 nt, Staphylococcus aureus subsp. aureus Mu50
acauaaaaauaauccc

SEQ ID NO: 2077089 - RNA, 23 nt, Staphylococcus aureus subsp. aureus Mu50
acauaaaucuaauacuuucaaac

SEQ ID NO: 2077090 - RNA, 14 nt, Staphylococcus aureus subsp. aureus Mu50
acauaacacaaguu

SEQ ID NO: 2077091 - RNA, 15 nt, Staphylococcus aureus subsp. aureus Mu50
acauaaccuugcuuu

SEQ ID NO: 2077092 - RNA, 18 nt, Staphylococcus aureus subsp. aureus Mu50
acauaaccgaugugauuu

SEQ ID NO: 2077093 - RNA, 14 nt, Staphylococcus aureus subsp. aureus Mu50
acauaaauaaacuu

SEQ ID NO: 2077094 - RNA, 22 nt, Staphylococcus aureus subsp. aureus Mu50
acauaaauaagcaguaagauga

SEQ ID NO: 2077095 - RNA, 18 nt, Staphylococcus aureus subsp. aureus Mu50
acauaaaugcuaaaagua

SEQ ID NO: 2077096 - RNA, 21 nt, Staphylococcus aureus subsp. aureus Mu50
acauaaauauggauuuugaag

SEQ ID NO: 2077097 - RNA, 16 nt, Staphylococcus aureus subsp. aureus Mu50
acauaaauacaaaaau

SEQ ID NO: 2077098 - RNA, 17 nt, Staphylococcus aureus subsp. aureus Mu50
acauaaauacaaaaaua

SEQ ID NO: 2077099 - RNA, 20 nt, Staphylococcus aureus subsp. aureus Mu50
acagucccaaccccuuuauu

SEQ ID NO: 2077100 - RNA, 22 nt, Staphylococcus aureus subsp. aureus Mu50
acagucaacugcugcuaaaaua

SEQ ID NO: 2077101 - RNA, 14 nt, Staphylococcus aureus subsp. aureus Mu50
acaguaucuucagu

SEQ ID NO: 2077102 - RNA, 22 nt, Staphylococcus aureus subsp. aureus Mu50
acaguaguuaauugaaugaaaa

SEQ ID NO: 2077103 - RNA, 21 nt, Staphylococcus aureus subsp. aureus Mu50
acaguacgauuauuuggauaa

SEQ ID NO: 2077104 - RNA, 18 nt, Staphylococcus aureus subsp. aureus Mu50
acaguaaauugauucuuu

SEQ ID NO: 2077105 - RNA, 15 nt, Staphylococcus aureus subsp. aureus Mu50
acagggguaaaacuu

SEQ ID NO: 2077106 - RNA, 17 nt, Staphylococcus aureus subsp. aureus Mu50
acaggugcuuacuuuua

SEQ ID NO: 2077107 - RNA, 22 nt, Staphylococcus aureus subsp. aureus Mu50
acauccucauaauuaucauaua

SEQ ID NO: 2077108 - RNA, 17 nt, Staphylococcus aureus subsp. aureus Mu50
acaucauuaaauauuua

SEQ ID NO: 2077109 - RNA, 15 nt, Staphylococcus aureus subsp. aureus Mu50
acaucauucacaagu

SEQ ID NO: 2077110 - RNA, 22 nt, Staphylococcus aureus subsp. aureus Mu50
acauccaauuauguuuaucuac

SEQ ID NO: 2077111 - RNA, 23 nt, Staphylococcus aureus subsp. aureus Mu50
acauccaauuauguuuaucuacu

SEQ ID NO: 2077112 - RNA, 22 nt, Staphylococcus aureus subsp. aureus Mu50
acaucauugauagauagaaauu

SEQ ID NO: 2077113 - RNA, 17 nt, Staphylococcus aureus subsp. aureus Mu50
acaucaucgccagcauu

SEQ ID NO: 2077114 - RNA, 17 nt, Staphylococcus aureus subsp. aureus Mu50
acaucaucuuuaauuuu

SEQ ID NO: 2077115 - RNA, 21 nt, Staphylococcus aureus subsp. aureus Mu50
acaucacuauacgcaaucauu

SEQ ID NO: 2077116 - RNA, 14 nt, Staphylococcus aureus subsp. aureus Mu50
acaucaauuacucu

SEQ ID NO: 2077117 - RNA, 13 nt, Staphylococcus aureus subsp. aureus Mu50
acaucaauaucuu

SEQ ID NO: 2077118 - RNA, 17 nt, Staphylococcus aureus subsp. aureus Mu50
acaucaauaucuucuuc

SEQ ID NO: 2077119 - RNA, 22 nt, Staphylococcus aureus subsp. aureus Mu50
acauaauuaacuuucuuuuguu

SEQ ID NO: 2077120 - RNA, 16 nt, Staphylococcus aureus subsp. aureus Mu50
acauaaucauugugua

SEQ ID NO: 2077121 - RNA, 12 nt, Staphylococcus aureus subsp. aureus Mu50
acauaaugacau

SEQ ID NO: 2077122 - RNA, 22 nt, Staphylococcus aureus subsp. aureus Mu50
acaugacauucauuuaguuaaa

SEQ ID NO: 2077123 - RNA, 23 nt, Staphylococcus aureus subsp. aureus Mu50
acaugaggaucaacugaaauuuu

SEQ ID NO: 2077124 - RNA, 15 nt, Staphylococcus aureus subsp. aureus Mu50
acaugaguaaaacuc

SEQ ID NO: 2077125 - RNA, 16 nt, Staphylococcus aureus subsp. aureus Mu50
acaugguuuucaccag

SEQ ID NO: 2077126 - RNA, 18 nt, Staphylococcus aureus subsp. aureus Mu50
acauguacaauuuuuaaa

SEQ ID NO: 2077127 - RNA, 13 nt, Staphylococcus aureus subsp. aureus Mu50
acauguacaauuu

SEQ ID NO: 2077128 - RNA, 18 nt, Staphylococcus aureus subsp. aureus Mu50
acauguauuuaguaucau

SEQ ID NO: 2077129 - RNA, 18 nt, Staphylococcus aureus subsp. aureus Mu50
acauguauuggccaaaca

SEQ ID NO: 2077130 - RNA, 12 nt, Staphylococcus aureus subsp. aureus Mu50
acaugugaaaua

SEQ ID NO: 2077131 - RNA, 16 nt, Staphylococcus aureus subsp. aureus Mu50
acaucuaauaaauaua

SEQ ID NO: 2077132 - RNA, 16 nt, Staphylococcus aureus subsp. aureus Mu50
acaucuaaauuugcca

SEQ ID NO: 2077133 - RNA, 14 nt, Staphylococcus aureus subsp. aureus Mu50
acaucuaauaaaua

SEQ ID NO: 2077134 - RNA, 22 nt, Staphylococcus aureus subsp. aureus Mu50
acaucuagaugaaauuguguug

SEQ ID NO: 2077135 - RNA, 21 nt, Staphylococcus aureus subsp. aureus Mu50
acaucuauguggcuacuugaa

SEQ ID NO: 2077136 - RNA, 16 nt, Staphylococcus aureus subsp. aureus Mu50
acaugacauucauuua

SEQ ID NO: 2077137 - RNA, 14 nt, Staphylococcus aureus subsp. aureus Mu50
acauuugauaacca

SEQ ID NO: 2077138 - RNA, 19 nt, Staphylococcus aureus subsp. aureus Mu50
acauuugguggagaaccuu

SEQ ID NO: 2077139 - RNA, 15 nt, Staphylococcus aureus subsp. aureus Mu50
acauuugguucuucu

SEQ ID NO: 2077140 - RNA, 20 nt, Staphylococcus aureus subsp. aureus Mu50
acauuugaccaaguaugaga

SEQ ID NO: 2077141 - RNA, 14 nt, Staphylococcus aureus subsp. aureus Mu50
acauuuaauacuuu

SEQ ID NO: 2077142 - RNA, 22 nt, Staphylococcus aureus subsp. aureus Mu50
acauuuaagaaacgucuuaauu

SEQ ID NO: 2077143 - RNA, 22 nt, Staphylococcus aureus subsp. aureus Mu50
acauuuguaaauauuuuuuaaa

SEQ ID NO: 2077144 - RNA, 20 nt, Staphylococcus aureus subsp. aureus Mu50
acauuuguaaauauuuuuua

SEQ ID NO: 2077145 - RNA, 22 nt, Staphylococcus aureus subsp. aureus Mu50
acauuuuaaaucuaauuauuca

SEQ ID NO: 2077146 - RNA, 15 nt, Staphylococcus aureus subsp. aureus Mu50
acauuuuaauaaaau

SEQ ID NO: 2077147 - RNA, 22 nt, Staphylococcus aureus subsp. aureus Mu50
acauugaacgauaacaauuuau

SEQ ID NO: 2077148 - RNA, 15 nt, Staphylococcus aureus subsp. aureus Mu50
acauugauaaauuuu

SEQ ID NO: 2077149 - RNA, 18 nt, Staphylococcus aureus subsp. aureus Mu50
acauugagauuaucuuua

SEQ ID NO: 2077150 - RNA, 20 nt, Staphylococcus aureus subsp. aureus Mu50
acauugaugucaauuucacg

SEQ ID NO: 2077151 - RNA, 12 nt, Staphylococcus aureus subsp. aureus Mu50
acauuuaaaaaa

SEQ ID NO: 2077152 - RNA, 19 nt, Staphylococcus aureus subsp. aureus Mu50
acauuaaugauagcaauga

SEQ ID NO: 2077153 - RNA, 17 nt, Staphylococcus aureus subsp. aureus Mu50
acauuaauuggauuaaa

SEQ ID NO: 2077154 - RNA, 22 nt, Staphylococcus aureus subsp. aureus Mu50
acauuaaugauagcaaugaauu

SEQ ID NO: 2077155 - RNA, 15 nt, Staphylococcus aureus subsp. aureus Mu50
acaugugggauaucu

SEQ ID NO: 2077156 - RNA, 16 nt, Staphylococcus aureus subsp. aureus Mu50
acauuagcaugauaaa

SEQ ID NO: 2077157 - RNA, 17 nt, Staphylococcus aureus subsp. aureus Mu50
acauuagcaugauaaag

SEQ ID NO: 2077158 - RNA, 14 nt, Staphylococcus aureus subsp. aureus Mu50
acauucuucaaaaa

SEQ ID NO: 2077159 - RNA, 15 nt, Staphylococcus aureus subsp. aureus Mu50
accaaaaaauccaag

SEQ ID NO: 2077160 - RNA, 16 nt, Staphylococcus aureus subsp. aureus Mu50
acauuuuugugcaaaa

SEQ ID NO: 2077161 - RNA, 18 nt, Staphylococcus aureus subsp. aureus Mu50
acauuuuugugcaaaagu

SEQ ID NO: 2077162 - RNA, 21 nt, Staphylococcus aureus subsp. aureus Mu50
acauuuuugaauuuaauacua

SEQ ID NO: 2077163 - RNA, 15 nt, Staphylococcus aureus subsp. aureus Mu50
accaaaaaucaucca

SEQ ID NO: 2077164 - RNA, 16 nt, Staphylococcus aureus subsp. aureus Mu50
accaaacaauacauaa

SEQ ID NO: 2077165 - RNA, 16 nt, Staphylococcus aureus subsp. aureus Mu50
accaaauaaauuaaau

SEQ ID NO: 2077166 - RNA, 15 nt, Staphylococcus aureus subsp. aureus Mu50
accaaauaaauuaaa

SEQ ID NO: 2077167 - RNA, 18 nt, Staphylococcus aureus subsp. aureus Mu50
accaacaccuaauauuuu

SEQ ID NO: 2077168 - RNA, 21 nt, Staphylococcus aureus subsp. aureus Mu50
accaacaauagguacaacuaa

SEQ ID NO: 2077169 - RNA, 17 nt, Staphylococcus aureus subsp. aureus Mu50
accaacaccuaauauuu

SEQ ID NO: 2077170 - RNA, 14 nt, Staphylococcus aureus subsp. aureus Mu50
accaaauuuuauac

SEQ ID NO: 2077171 - RNA, 17 nt, Staphylococcus aureus subsp. aureus Mu50
acaaccgucccauaaaa

SEQ ID NO: 2077172 - RNA, 18 nt, Staphylococcus aureus subsp. aureus Mu50
acaacaugauuucuucuc

SEQ ID NO: 2077173 - RNA, 21 nt, Staphylococcus aureus subsp. aureus Mu50
acaacaugauuucuucuccuu

SEQ ID NO: 2077174 - RNA, 21 nt, Staphylococcus aureus subsp. aureus Mu50
acaacauuauuuauauuuaga

SEQ ID NO: 2077175 - RNA, 19 nt, Staphylococcus aureus subsp. aureus Mu50
acaaauuugaauauacuua

SEQ ID NO: 2077176 - RNA, 23 nt, Staphylococcus aureus subsp. aureus Mu50
acaaauuugaauauacuuaauuu

SEQ ID NO: 2077177 - RNA, 22 nt, Staphylococcus aureus subsp. aureus Mu50
acaaauugcaauggcaaccuuu

SEQ ID NO: 2077178 - RNA, 14 nt, Staphylococcus aureus subsp. aureus Mu50
acaacacauaaauu

SEQ ID NO: 2077179 - RNA, 21 nt, Staphylococcus aureus subsp. aureus Mu50
acaaaggggaugggagaaauu

SEQ ID NO: 2077180 - RNA, 19 nt, Staphylococcus aureus subsp. aureus Mu50
acaaagugauuuaaaaaau

SEQ ID NO: 2077181 - RNA, 23 nt, Staphylococcus aureus subsp. aureus Mu50
acaaagugauuuaaaaaauuuaa

SEQ ID NO: 2077182 - RNA, 19 nt, Staphylococcus aureus subsp. aureus Mu50
acaaagugcaauuauuuca

SEQ ID NO: 2077183 - RNA, 12 nt, Staphylococcus aureus subsp. aureus Mu50
acaaauauguaa

SEQ ID NO: 2077184 - RNA, 23 nt, Staphylococcus aureus subsp. aureus Mu50
acaaauauaauguauaaaacaga

SEQ ID NO: 2077185 - RNA, 22 nt, Staphylococcus aureus subsp. aureus Mu50
acaaaugaagguguugaaaagu

SEQ ID NO: 2077186 - RNA, 19 nt, Staphylococcus aureus subsp. aureus Mu50
acaaaucgauuaauuauaa

SEQ ID NO: 2077187 - RNA, 16 nt, Staphylococcus aureus subsp. aureus Mu50
acaaaucuauaaauau

SEQ ID NO: 2077188 - RNA, 18 nt, Staphylococcus aureus subsp. aureus Mu50
acaaaucguaaacauaau

SEQ ID NO: 2077189 - RNA, 16 nt, Staphylococcus aureus subsp. aureus Mu50
acaaauuaucacucau

SEQ ID NO: 2077190 - RNA, 19 nt, Staphylococcus aureus subsp. aureus Mu50
acaaauguauaaauaauaa

SEQ ID NO: 2077191 - RNA, 15 nt, Staphylococcus aureus subsp. aureus Mu50
acaaauguauaaaua

SEQ ID NO: 2077192 - RNA, 22 nt, Staphylococcus aureus subsp. aureus Mu50
acaaauuaaaaaacaauaaaau

SEQ ID NO: 2077193 - RNA, 18 nt, Staphylococcus aureus subsp. aureus Mu50
acaaauuaaaaagguacu

SEQ ID NO: 2077194 - RNA, 19 nt, Staphylococcus aureus subsp. aureus Mu50
acaaagcucaauaaauuau

SEQ ID NO: 2077195 - RNA, 21 nt, Staphylococcus aureus subsp. aureus Mu50
acaaaggauuauuaacuuuaa

SEQ ID NO: 2077196 - RNA, 13 nt, Staphylococcus aureus subsp. aureus Mu50
acaaacuucacau

SEQ ID NO: 2077197 - RNA, 13 nt, Staphylococcus aureus subsp. aureus Mu50
acaaagaaauuaa

SEQ ID NO: 2077198 - RNA, 21 nt, Staphylococcus aureus subsp. aureus Mu50
acaaagaaccacgcaucaugu

SEQ ID NO: 2077199 - RNA, 22 nt, Staphylococcus aureus subsp. aureus Mu50
acaaagaauuucgaaaagaaau

SEQ ID NO: 2077200 - RNA, 20 nt, Staphylococcus aureus subsp. aureus Mu50
acaaagaauuucgaaaagaa

SEQ ID NO: 2077201 - RNA, 15 nt, Staphylococcus aureus subsp. aureus Mu50
acaaacaaaagcacc

SEQ ID NO: 2077202 - RNA, 21 nt, Staphylococcus aureus subsp. aureus Mu50
acaaacauuacccuuuaaacu

SEQ ID NO: 2077203 - RNA, 23 nt, Staphylococcus aureus subsp. aureus Mu50
acaaacauaaauaagcaguaaga

SEQ ID NO: 2077204 - RNA, 15 nt, Staphylococcus aureus subsp. aureus Mu50
acaaacgacuaacca

SEQ ID NO: 2077205 - RNA, 17 nt, Staphylococcus aureus subsp. aureus Mu50
acaaacgcugauuuaau

SEQ ID NO: 2077206 - RNA, 15 nt, Staphylococcus aureus subsp. aureus Mu50
acaaaaucaccuuuu

SEQ ID NO: 2077207 - RNA, 19 nt, Staphylococcus aureus subsp. aureus Mu50
acaaaaguaugauuuguuu

SEQ ID NO: 2077208 - RNA, 14 nt, Staphylococcus aureus subsp. aureus Mu50
acaaaauaacaugu

SEQ ID NO: 2077209 - RNA, 23 nt, Staphylococcus aureus subsp. aureus Mu50
acaaaagaggcgccacaacaugu

SEQ ID NO: 2077210 - RNA, 17 nt, Staphylococcus aureus subsp. aureus Mu50
acaaaagaaaguuaauu

SEQ ID NO: 2077211 - RNA, 10 nt, Staphylococcus aureus subsp. aureus Mu50
acaaaagaaa

SEQ ID NO: 2077212 - RNA, 13 nt, Staphylococcus aureus subsp. aureus Mu50
acaaaaaaaccga

SEQ ID NO: 2077213 - RNA, 17 nt, Staphylococcus aureus subsp. aureus Mu50
aauuuauaaaaagagau

SEQ ID NO: 2077214 - RNA, 15 nt, Staphylococcus aureus subsp. aureus Mu50
aauuuaguccuucuu

SEQ ID NO: 2077215 - RNA, 13 nt, Staphylococcus aureus subsp. aureus Mu50
aauuuagugaaac

SEQ ID NO: 2077216 - RNA, 16 nt, Staphylococcus aureus subsp. aureus Mu50
aauuuagugaaacaau

SEQ ID NO: 2077217 - RNA, 19 nt, Staphylococcus aureus subsp. aureus Mu50
acaaaaagaauuucgaaaa

SEQ ID NO: 2077218 - RNA, 12 nt, Staphylococcus aureus subsp. aureus Mu50
acaaaacauauu

SEQ ID NO: 2077219 - RNA, 17 nt, Staphylococcus aureus subsp. aureus Mu50
acaaaaauauagcuauu

SEQ ID NO: 2077220 - RNA, 16 nt, Staphylococcus aureus subsp. aureus Mu50
acaaaaauaaaccaug

SEQ ID NO: 2077221 - RNA, 22 nt, Staphylococcus aureus subsp. aureus Mu50
acaccaauugaauauuuuucaa

SEQ ID NO: 2077222 - RNA, 18 nt, Staphylococcus aureus subsp. aureus Mu50
acacccauuugucuuaau

SEQ ID NO: 2077223 - RNA, 12 nt, Staphylococcus aureus subsp. aureus Mu50
acacccaaauuu

SEQ ID NO: 2077224 - RNA, 12 nt, Staphylococcus aureus subsp. aureus Mu50
acaccccaacuc

SEQ ID NO: 2077225 - RNA, 12 nt, Staphylococcus aureus subsp. aureus Mu50
acaccccaacuu

SEQ ID NO: 2077226 - RNA, 22 nt, Staphylococcus aureus subsp. aureus Mu50
acacauuauugaaauuuuuaau

SEQ ID NO: 2077227 - RNA, 21 nt, Staphylococcus aureus subsp. aureus Mu50
acacauguacguuuuuuuaaa

SEQ ID NO: 2077228 - RNA, 17 nt, Staphylococcus aureus subsp. aureus Mu50
acacauucuuauuugaa

SEQ ID NO: 2077229 - RNA, 22 nt, Staphylococcus aureus subsp. aureus Mu50
acacaaagaauuucgaaaagaa

SEQ ID NO: 2077230 - RNA, 14 nt, Staphylococcus aureus subsp. aureus Mu50
acacaacgauagau

SEQ ID NO: 2077231 - RNA, 13 nt, Staphylococcus aureus subsp. aureus Mu50
acaauuuuuaaaa

SEQ ID NO: 2077232 - RNA, 16 nt, Staphylococcus aureus subsp. aureus Mu50
acaauuuuuaaaaacc

SEQ ID NO: 2077233 - RNA, 20 nt, Staphylococcus aureus subsp. aureus Mu50
acaauuuugacuacuaaucu

SEQ ID NO: 2077234 - RNA, 16 nt, Staphylococcus aureus subsp. aureus Mu50
acaauuuucucauuaa

SEQ ID NO: 2077235 - RNA, 19 nt, Staphylococcus aureus subsp. aureus Mu50
acaauuuuugggaagaaua

SEQ ID NO: 2077236 - RNA, 17 nt, Staphylococcus aureus subsp. aureus Mu50
acacgcauuacuuuaga

SEQ ID NO: 2077237 - RNA, 19 nt, Staphylococcus aureus subsp. aureus Mu50
acacgcauuacuuuagaaa

SEQ ID NO: 2077238 - RNA, 14 nt, Staphylococcus aureus subsp. aureus Mu50
acacgauaauuaua

SEQ ID NO: 2077239 - RNA, 22 nt, Staphylococcus aureus subsp. aureus Mu50
acaccugguacauaaauaccug

SEQ ID NO: 2077240 - RNA, 20 nt, Staphylococcus aureus subsp. aureus Mu50
acaccuuaucacuuggaaua

SEQ ID NO: 2077241 - RNA, 13 nt, Staphylococcus aureus subsp. aureus Mu50
acaccuacaaaua

SEQ ID NO: 2077242 - RNA, 21 nt, Staphylococcus aureus subsp. aureus Mu50
acaaccucugauacuucacca

SEQ ID NO: 2077243 - RNA, 15 nt, Staphylococcus aureus subsp. aureus Mu50
acaagguuucaagag

SEQ ID NO: 2077244 - RNA, 18 nt, Staphylococcus aureus subsp. aureus Mu50
acaaguacaauaauaccu

SEQ ID NO: 2077245 - RNA, 15 nt, Staphylococcus aureus subsp. aureus Mu50
acaaguuguucaauu

SEQ ID NO: 2077246 - RNA, 21 nt, Staphylococcus aureus subsp. aureus Mu50
acaaguuuacagguugaauaa

SEQ ID NO: 2077247 - RNA, 15 nt, Staphylococcus aureus subsp. aureus Mu50
acaauaaaaaaccaa

SEQ ID NO: 2077248 - RNA, 16 nt, Staphylococcus aureus subsp. aureus Mu50
acaauaaugugcaagu

SEQ ID NO: 2077249 - RNA, 19 nt, Staphylococcus aureus subsp. aureus Mu50
acaaguugcugaauaaaau

SEQ ID NO: 2077250 - RNA, 20 nt, Staphylococcus aureus subsp. aureus Mu50
acaaguugcugaauaaaaua

SEQ ID NO: 2077251 - RNA, 14 nt, Staphylococcus aureus subsp. aureus Mu50
acaauauugacuuu

SEQ ID NO: 2077252 - RNA, 18 nt, Staphylococcus aureus subsp. aureus Mu50
acaauaccgcgauaaaua

SEQ ID NO: 2077253 - RNA, 15 nt, Staphylococcus aureus subsp. aureus Mu50
acaauacgaaaucaa

SEQ ID NO: 2077254 - RNA, 15 nt, Staphylococcus aureus subsp. aureus Mu50
acaauacaaaucgau

SEQ ID NO: 2077255 - RNA, 15 nt, Staphylococcus aureus subsp. aureus Mu50
acaauacauaauggu

SEQ ID NO: 2077256 - RNA, 18 nt, Staphylococcus aureus subsp. aureus Mu50
acaauuccccaaagccuu

SEQ ID NO: 2077257 - RNA, 15 nt, Staphylococcus aureus subsp. aureus Mu50
acaauugcuaaucca

SEQ ID NO: 2077258 - RNA, 22 nt, Staphylococcus aureus subsp. aureus Mu50
acaauuuuccuuccaauaauaa

SEQ ID NO: 2077259 - RNA, 22 nt, Staphylococcus aureus subsp. aureus Mu50
acaauuuguaacuauugaaaau

SEQ ID NO: 2077260 - RNA, 13 nt, Staphylococcus aureus subsp. aureus Mu50
acaaugcagcugu

SEQ ID NO: 2077261 - RNA, 14 nt, Staphylococcus aureus subsp. aureus Mu50
acaauucauuaaua

SEQ ID NO: 2077262 - RNA, 18 nt, Staphylococcus aureus subsp. aureus Mu50
acaaugaauuguuaguuu

SEQ ID NO: 2077263 - RNA, 23 nt, Staphylococcus aureus subsp. aureus Mu50
acaaugaauuucuaauuuaguau

SEQ ID NO: 2077264 - RNA, 19 nt, Staphylococcus aureus subsp. aureus Mu50
acaaucguuuuaaugccug

SEQ ID NO: 2077265 - RNA, 19 nt, Staphylococcus aureus subsp. aureus Mu50
acaaucagauaaguuacua

SEQ ID NO: 2077266 - RNA, 15 nt, Staphylococcus aureus subsp. aureus Mu50
acaaucagauaaguu

SEQ ID NO: 2077267 - RNA, 24 nt, Staphylococcus aureus subsp. aureus Mu50
acaaucagauaaguuacuagcauu

SEQ ID NO: 2077268 - RNA, 21 nt, Staphylococcus aureus subsp. aureus Mu50
acaaucauagauauaagaaau

SEQ ID NO: 2077269 - RNA, 14 nt, Staphylococcus aureus subsp. aureus Mu50
acaaucacgauuaa

SEQ ID NO: 2077270 - RNA, 18 nt, Staphylococcus aureus subsp. aureus Mu50
acaaucacagcaauaaua

SEQ ID NO: 2077271 - RNA, 24 nt, Staphylococcus aureus subsp. aureus Mu50
acaaucaaauuacaaauuaucuag

SEQ ID NO: 2077272 - RNA, 18 nt, Staphylococcus aureus subsp. aureus Mu50
acaaucaacuuagaauuu

SEQ ID NO: 2077273 - RNA, 23 nt, Staphylococcus aureus subsp. aureus Mu50
acaauauuuuuacauauuuauac

SEQ ID NO: 2077274 - RNA, 17 nt, Staphylococcus aureus subsp. aureus Mu50
acaaucggaagcauauu

SEQ ID NO: 2077275 - RNA, 19 nt, Staphylococcus aureus subsp. aureus Mu50
aauccaaagcugaauuuua

SEQ ID NO: 2077276 - RNA, 21 nt, Staphylococcus aureus subsp. aureus Mu50
aauccaaaaucuuuacuugua

SEQ ID NO: 2077277 - RNA, 15 nt, Staphylococcus aureus subsp. aureus Mu50
aaucaugacauaaaa

SEQ ID NO: 2077278 - RNA, 13 nt, Staphylococcus aureus subsp. aureus Mu50
aaucaugacauag

SEQ ID NO: 2077279 - RNA, 13 nt, Staphylococcus aureus subsp. aureus Mu50
aaucaugacauaa

SEQ ID NO: 2077280 - RNA, 17 nt, Staphylococcus aureus subsp. aureus Mu50
aaucaucuuuuugaaau

SEQ ID NO: 2077281 - RNA, 14 nt, Staphylococcus aureus subsp. aureus Mu50
aaucauuuguguau

SEQ ID NO: 2077282 - RNA, 23 nt, Staphylococcus aureus subsp. aureus Mu50
aaucauguaaugcuuaaaaacaa

SEQ ID NO: 2077283 - RNA, 20 nt, Staphylococcus aureus subsp. aureus Mu50
aaucauugguuucaucauau

SEQ ID NO: 2077284 - RNA, 22 nt, Staphylococcus aureus subsp. aureus Mu50
aaucauguaaugcuuaaaaaca

SEQ ID NO: 2077285 - RNA, 15 nt, Staphylococcus aureus subsp. aureus Mu50
aaucauguaaugcuu

SEQ ID NO: 2077286 - RNA, 18 nt, Staphylococcus aureus subsp. aureus Mu50
aaucauguaaugcuuaaa

SEQ ID NO: 2077287 - RNA, 18 nt, Staphylococcus aureus subsp. aureus Mu50
aaucagaugauuuaauuc

SEQ ID NO: 2077288 - RNA, 21 nt, Staphylococcus aureus subsp. aureus Mu50
aaucaucuuaacaacuuuaau

SEQ ID NO: 2077289 - RNA, 17 nt, Staphylococcus aureus subsp. aureus Mu50
aaucgagugauucagga

SEQ ID NO: 2077290 - RNA, 20 nt, Staphylococcus aureus subsp. aureus Mu50
aauccuuguucuauuugaua

SEQ ID NO: 2077291 - RNA, 21 nt, Staphylococcus aureus subsp. aureus Mu50
aauccuuguucuauuugauaa

SEQ ID NO: 2077292 - RNA, 21 nt, Staphylococcus aureus subsp. aureus Mu50
aaucgauuaagaaugcaccaa

SEQ ID NO: 2077293 - RNA, 15 nt, Staphylococcus aureus subsp. aureus Mu50
aaucgaguuugaaau

SEQ ID NO: 2077294 - RNA, 14 nt, Staphylococcus aureus subsp. aureus Mu50
aaucgauaacaguu

SEQ ID NO: 2077295 - RNA, 15 nt, Staphylococcus aureus subsp. aureus Mu50
aaucgauauaaugaa

SEQ ID NO: 2077296 - RNA, 14 nt, Staphylococcus aureus subsp. aureus Mu50
aauccuucaucaau

SEQ ID NO: 2077297 - RNA, 22 nt, Staphylococcus aureus subsp. aureus Mu50
aauccucacaaauuugaauaua

SEQ ID NO: 2077298 - RNA, 21 nt, Staphylococcus aureus subsp. aureus Mu50
aauccgauucacucuguaaua

SEQ ID NO: 2077299 - RNA, 20 nt, Staphylococcus aureus subsp. aureus Mu50
aaucccuucaaaauuuugac

SEQ ID NO: 2077300 - RNA, 23 nt, Staphylococcus aureus subsp. aureus Mu50
aaucccauaccuacaaauaugua

SEQ ID NO: 2077301 - RNA, 19 nt, Staphylococcus aureus subsp. aureus Mu50
aaucuaaggccauuuguag

SEQ ID NO: 2077302 - RNA, 14 nt, Staphylococcus aureus subsp. aureus Mu50
aaucuaauacauac

SEQ ID NO: 2077303 - RNA, 21 nt, Staphylococcus aureus subsp. aureus Mu50
aaucuaauacuuucaaacaaa

SEQ ID NO: 2077304 - RNA, 18 nt, Staphylococcus aureus subsp. aureus Mu50
aaucuaauccugguauaa

SEQ ID NO: 2077305 - RNA, 20 nt, Staphylococcus aureus subsp. aureus Mu50
aaucguuccaacaacuaaga

SEQ ID NO: 2077306 - RNA, 16 nt, Staphylococcus aureus subsp. aureus Mu50
aaucucauaauaauuc

SEQ ID NO: 2077307 - RNA, 13 nt, Staphylococcus aureus subsp. aureus Mu50
aaucucaucuaac

SEQ ID NO: 2077308 - RNA, 13 nt, Staphylococcus aureus subsp. aureus Mu50
aaucuauuuuaaa

SEQ ID NO: 2077309 - RNA, 16 nt, Staphylococcus aureus subsp. aureus Mu50
aaucuauugugauaua

SEQ ID NO: 2077310 - RNA, 19 nt, Staphylococcus aureus subsp. aureus Mu50
aaucuauuuucugccauaa

SEQ ID NO: 2077311 - RNA, 16 nt, Staphylococcus aureus subsp. aureus Mu50
aaucuauuuuaaacuc

SEQ ID NO: 2077312 - RNA, 13 nt, Staphylococcus aureus subsp. aureus Mu50
aaaaauuuauuca

SEQ ID NO: 2077313 - RNA, 18 nt, Staphylococcus aureus subsp. aureus Mu50
aaaaauuucaaaaauagc

SEQ ID NO: 2077314 - RNA, 22 nt, Staphylococcus aureus subsp. aureus Mu50
aaaaauugcuauauuaguauaa

SEQ ID NO: 2077315 - RNA, 12 nt, Staphylococcus aureus subsp. aureus Mu50
aaaaauuguaaa

SEQ ID NO: 2077316 - RNA, 16 nt, Staphylococcus aureus subsp. aureus Mu50
aaucugauucauuaaa

SEQ ID NO: 2077317 - RNA, 15 nt, Staphylococcus aureus subsp. aureus Mu50
aaucugauucauuaa

SEQ ID NO: 2077318 - RNA, 19 nt, Staphylococcus aureus subsp. aureus Mu50
aaucucuuuuugauuauau

SEQ ID NO: 2077319 - RNA, 19 nt, Staphylococcus aureus subsp. aureus Mu50
aaucucuuuagaugagauu

SEQ ID NO: 2077320 - RNA, 17 nt, Staphylococcus aureus subsp. aureus Mu50
aaucuuaguacaaaauu

SEQ ID NO: 2077321 - RNA, 18 nt, Staphylococcus aureus subsp. aureus Mu50
aaucuuaguacaaaauug

SEQ ID NO: 2077322 - RNA, 21 nt, Staphylococcus aureus subsp. aureus Mu50
aaucuuaugaugucauguauu

SEQ ID NO: 2077323 - RNA, 16 nt, Staphylococcus aureus subsp. aureus Mu50
aaucuuaguuaaaauu

SEQ ID NO: 2077324 - RNA, 23 nt, Staphylococcus aureus subsp. aureus Mu50
aaucuuauuuuguuuuaaaaaac

SEQ ID NO: 2077325 - RNA, 17 nt, Staphylococcus aureus subsp. aureus Mu50
aaucuucauuaauuaca

SEQ ID NO: 2077326 - RNA, 18 nt, Staphylococcus aureus subsp. aureus Mu50
aaucuucuaauuaagaau

SEQ ID NO: 2077327 - RNA, 17 nt, Staphylococcus aureus subsp. aureus Mu50
aaucuguuuaaauuuaa

SEQ ID NO: 2077328 - RNA, 18 nt, Staphylococcus aureus subsp. aureus Mu50
aaucuuaauauugauuaa

SEQ ID NO: 2077329 - RNA, 14 nt, Staphylococcus aureus subsp. aureus Mu50
aaucuguucauaau

SEQ ID NO: 2077330 - RNA, 20 nt, Staphylococcus aureus subsp. aureus Mu50
aauauuuuuacauauuuaua

SEQ ID NO: 2077331 - RNA, 22 nt, Staphylococcus aureus subsp. aureus Mu50
aauauuuucauguccaucuuuu

SEQ ID NO: 2077332 - RNA, 12 nt, Staphylococcus aureus subsp. aureus Mu50
aauauuugauaa

SEQ ID NO: 2077333 - RNA, 17 nt, Staphylococcus aureus subsp. aureus Mu50
aauauuuuacaaaauau

SEQ ID NO: 2077334 - RNA, 15 nt, Staphylococcus aureus subsp. aureus Mu50
aaucaaaaaagacau

SEQ ID NO: 2077335 - RNA, 23 nt, Staphylococcus aureus subsp. aureus Mu50
aauauuuuuguugcaauugccuu

SEQ ID NO: 2077336 - RNA, 19 nt, Staphylococcus aureus subsp. aureus Mu50
aauauuucccuaugaaaua

SEQ ID NO: 2077337 - RNA, 17 nt, Staphylococcus aureus subsp. aureus Mu50
aauauuuaaauuuuaag

SEQ ID NO: 2077338 - RNA, 17 nt, Staphylococcus aureus subsp. aureus Mu50
aauauuuaaacuaguaa

SEQ ID NO: 2077339 - RNA, 19 nt, Staphylococcus aureus subsp. aureus Mu50
aauauuuauuguuuuuaaa

SEQ ID NO: 2077340 - RNA, 15 nt, Staphylococcus aureus subsp. aureus Mu50
aauauuuauauuaaa

SEQ ID NO: 2077341 - RNA, 15 nt, Staphylococcus aureus subsp. aureus Mu50
aauauugaugaauaa

SEQ ID NO: 2077342 - RNA, 21 nt, Staphylococcus aureus subsp. aureus Mu50
aauauucuuuaauauagauuu

SEQ ID NO: 2077343 - RNA, 16 nt, Staphylococcus aureus subsp. aureus Mu50
aauauucuuucguuuu

SEQ ID NO: 2077344 - RNA, 13 nt, Staphylococcus aureus subsp. aureus Mu50
aauauugaacaau

SEQ ID NO: 2077345 - RNA, 15 nt, Staphylococcus aureus subsp. aureus Mu50
aauauugaacaauuu

SEQ ID NO: 2077346 - RNA, 20 nt, Staphylococcus aureus subsp. aureus Mu50
aauauugauucuagugaaau

SEQ ID NO: 2077347 - RNA, 16 nt, Staphylococcus aureus subsp. aureus Mu50
aauauugcguuuaauu

SEQ ID NO: 2077348 - RNA, 16 nt, Staphylococcus aureus subsp. aureus Mu50
aauauucaauaauuca

SEQ ID NO: 2077349 - RNA, 20 nt, Staphylococcus aureus subsp. aureus Mu50
aauauuauucauaauauauu

SEQ ID NO: 2077350 - RNA, 21 nt, Staphylococcus aureus subsp. aureus Mu50
aauauuauuuuuaagugauga

SEQ ID NO: 2077351 - RNA, 20 nt, Staphylococcus aureus subsp. aureus Mu50
aauauucgauacauaaaaca

SEQ ID NO: 2077352 - RNA, 17 nt, Staphylococcus aureus subsp. aureus Mu50
aauaugugcaugagacu

SEQ ID NO: 2077353 - RNA, 23 nt, Staphylococcus aureus subsp. aureus Mu50
aauauguggcgcucuuauaaaga

SEQ ID NO: 2077354 - RNA, 18 nt, Staphylococcus aureus subsp. aureus Mu50
aauauggaauuucauaua

SEQ ID NO: 2077355 - RNA, 15 nt, Staphylococcus aureus subsp. aureus Mu50
aauauuaagauguau

SEQ ID NO: 2077356 - RNA, 22 nt, Staphylococcus aureus subsp. aureus Mu50
aauauuaagauguauaugaauu

SEQ ID NO: 2077357 - RNA, 21 nt, Staphylococcus aureus subsp. aureus Mu50
aauauuaaauuucugaacaua

SEQ ID NO: 2077358 - RNA, 14 nt, Staphylococcus aureus subsp. aureus Mu50
aauauuaacaccag

SEQ ID NO: 2077359 - RNA, 16 nt, Staphylococcus aureus subsp. aureus Mu50
aauauuaaauucaucu

SEQ ID NO: 2077360 - RNA, 21 nt, Staphylococcus aureus subsp. aureus Mu50
aauauuaaauucaucuugcaa

SEQ ID NO: 2077361 - RNA, 17 nt, Staphylococcus aureus subsp. aureus Mu50
aauaugcuuuuaauagu

SEQ ID NO: 2077362 - RNA, 14 nt, Staphylococcus aureus subsp. aureus Mu50
aauaugauguuaaa

SEQ ID NO: 2077363 - RNA, 22 nt, Staphylococcus aureus subsp. aureus Mu50
aauaugauugcaaauuaucauu

SEQ ID NO: 2077364 - RNA, 17 nt, Staphylococcus aureus subsp. aureus Mu50
aauaugauuaauaaagu

SEQ ID NO: 2077365 - RNA, 19 nt, Staphylococcus aureus subsp. aureus Mu50
aauaugauugaaugaagcu

SEQ ID NO: 2077366 - RNA, 15 nt, Staphylococcus aureus subsp. aureus Mu50
aauagauaauauaua

SEQ ID NO: 2077367 - RNA, 16 nt, Staphylococcus aureus subsp. aureus Mu50
aauagauaaugcaccu

SEQ ID NO: 2077368 - RNA, 22 nt, Staphylococcus aureus subsp. aureus Mu50
aauagcaguuucugagaagaaa

SEQ ID NO: 2077369 - RNA, 13 nt, Staphylococcus aureus subsp. aureus Mu50
aauagcauuugua

SEQ ID NO: 2077370 - RNA, 17 nt, Staphylococcus aureus subsp. aureus Mu50
aaucacgauuuucaagu

SEQ ID NO: 2077371 - RNA, 23 nt, Staphylococcus aureus subsp. aureus Mu50
aaucacuaucuguuguuauauaa

SEQ ID NO: 2077372 - RNA, 22 nt, Staphylococcus aureus subsp. aureus Mu50
aaucacuccucuauuuuaugau

SEQ ID NO: 2077373 - RNA, 15 nt, Staphylococcus aureus subsp. aureus Mu50
aaucacugcuuucaa

SEQ ID NO: 2077374 - RNA, 21 nt, Staphylococcus aureus subsp. aureus Mu50
aaucacuuggcgacauuugua

SEQ ID NO: 2077375 - RNA, 23 nt, Staphylococcus aureus subsp. aureus Mu50
aaucacuuggcgacauuuguaaa

SEQ ID NO: 2077376 - RNA, 18 nt, Staphylococcus aureus subsp. aureus Mu50
aaucagaaggcuguucug

SEQ ID NO: 2077377 - RNA, 20 nt, Staphylococcus aureus subsp. aureus Mu50
aaucagaaggcuguucugga

SEQ ID NO: 2077378 - RNA, 14 nt, Staphylococcus aureus subsp. aureus Mu50
aaucacaguuauau

SEQ ID NO: 2077379 - RNA, 14 nt, Staphylococcus aureus subsp. aureus Mu50
aaucacaauacgaa

SEQ ID NO: 2077380 - RNA, 14 nt, Staphylococcus aureus subsp. aureus Mu50
aaucacauaugaua

SEQ ID NO: 2077381 - RNA, 18 nt, Staphylococcus aureus subsp. aureus Mu50
aaucaauugcauacguaa

SEQ ID NO: 2077382 - RNA, 23 nt, Staphylococcus aureus subsp. aureus Mu50
aaucaacuuuuuguuaauuuuuu

SEQ ID NO: 2077383 - RNA, 22 nt, Staphylococcus aureus subsp. aureus Mu50
aaucaacguauauaaguuaaaa

SEQ ID NO: 2077384 - RNA, 13 nt, Staphylococcus aureus subsp. aureus Mu50
aaucaagcaaugc

SEQ ID NO: 2077385 - RNA, 16 nt, Staphylococcus aureus subsp. aureus Mu50
aaucaagcuagcauca

SEQ ID NO: 2077386 - RNA, 22 nt, Staphylococcus aureus subsp. aureus Mu50
aaucaacuuagaauuuacaagu

SEQ ID NO: 2077387 - RNA, 12 nt, Staphylococcus aureus subsp. aureus Mu50
aaucaacaucau

SEQ ID NO: 2077388 - RNA, 16 nt, Staphylococcus aureus subsp. aureus Mu50
aaucaacaauuuaaac

SEQ ID NO: 2077389 - RNA, 16 nt, Staphylococcus aureus subsp. aureus Mu50
aaucaaaauuaugacu

SEQ ID NO: 2077390 - RNA, 13 nt, Staphylococcus aureus subsp. aureus Mu50
aaucaaaaauaau

SEQ ID NO: 2077391 - RNA, 21 nt, Staphylococcus aureus subsp. aureus Mu50
aaucaaagaggaacagcggaa

SEQ ID NO: 2077392 - RNA, 12 nt, Staphylococcus aureus subsp. aureus Mu50
aaucaaagagga

SEQ ID NO: 2077393 - RNA, 17 nt, Staphylococcus aureus subsp. aureus Mu50
aaucaaagcuauauaug

SEQ ID NO: 2077394 - RNA, 23 nt, Staphylococcus aureus subsp. aureus Mu50
aaucaaagggcuucgauucauaa

SEQ ID NO: 2077395 - RNA, 14 nt, Staphylococcus aureus subsp. aureus Mu50
aaucaaauacauca

SEQ ID NO: 2077396 - RNA, 17 nt, Staphylococcus aureus subsp. aureus Mu50
aaucaaauacaucaauu

SEQ ID NO: 2077397 - RNA, 13 nt, Staphylococcus aureus subsp. aureus Mu50
aauucuuuuguaa

SEQ ID NO: 2077398 - RNA, 18 nt, Staphylococcus aureus subsp. aureus Mu50
aauucuuuuucagcuaau

SEQ ID NO: 2077399 - RNA, 14 nt, Staphylococcus aureus subsp. aureus Mu50
aauucugguuuaau

SEQ ID NO: 2077400 - RNA, 13 nt, Staphylococcus aureus subsp. aureus Mu50
aauugaaaugaua

SEQ ID NO: 2077401 - RNA, 17 nt, Staphylococcus aureus subsp. aureus Mu50
aauugaaauagaaacua

SEQ ID NO: 2077402 - RNA, 18 nt, Staphylococcus aureus subsp. aureus Mu50
aauugcauuacuacaaac

SEQ ID NO: 2077403 - RNA, 14 nt, Staphylococcus aureus subsp. aureus Mu50
aauugauggcuucu

SEQ ID NO: 2077404 - RNA, 17 nt, Staphylococcus aureus subsp. aureus Mu50
aauugauggcuucucuu

SEQ ID NO: 2077405 - RNA, 14 nt, Staphylococcus aureus subsp. aureus Mu50
aauuggguuuaaua

SEQ ID NO: 2077406 - RNA, 16 nt, Staphylococcus aureus subsp. aureus Mu50
aauugggaaauauuug

SEQ ID NO: 2077407 - RNA, 14 nt, Staphylococcus aureus subsp. aureus Mu50
aauugggaaauauu

SEQ ID NO: 2077408 - RNA, 17 nt, Staphylococcus aureus subsp. aureus Mu50
aauugcuuuagaaaguc

SEQ ID NO: 2077409 - RNA, 17 nt, Staphylococcus aureus subsp. aureus Mu50
aauugcuuguucuuucu

SEQ ID NO: 2077410 - RNA, 22 nt, Staphylococcus aureus subsp. aureus Mu50
aauugcuuguuuuaaaugaccu

SEQ ID NO: 2077411 - RNA, 20 nt, Staphylococcus aureus subsp. aureus Mu50
aauuggauguaauagagaag

SEQ ID NO: 2077412 - RNA, 14 nt, Staphylococcus aureus subsp. aureus Mu50
aauuggauugagau

SEQ ID NO: 2077413 - RNA, 22 nt, Staphylococcus aureus subsp. aureus Mu50
aauuggaaucaucuuuuugaaa

SEQ ID NO: 2077414 - RNA, 17 nt, Staphylococcus aureus subsp. aureus Mu50
aauugcucuuuaacaau

SEQ ID NO: 2077415 - RNA, 18 nt, Staphylococcus aureus subsp. aureus Mu50
aauugcucuuuaacaaug

SEQ ID NO: 2077416 - RNA, 18 nt, Staphylococcus aureus subsp. aureus Mu50
aauuuaguacucaauguu

SEQ ID NO: 2077417 - RNA, 18 nt, Staphylococcus aureus subsp. aureus Mu50
aauuuagucauuacaaau

SEQ ID NO: 2077418 - RNA, 16 nt, Staphylococcus aureus subsp. aureus Mu50
aauuuaauauuauaag

SEQ ID NO: 2077419 - RNA, 16 nt, Staphylococcus aureus subsp. aureus Mu50
aauuuaauuaagaaaa

SEQ ID NO: 2077420 - RNA, 15 nt, Staphylococcus aureus subsp. aureus Mu50
aauuuaauugguucu

SEQ ID NO: 2077421 - RNA, 16 nt, Staphylococcus aureus subsp. aureus Mu50
aauuuaauauuguuaa

SEQ ID NO: 2077422 - RNA, 16 nt, Staphylococcus aureus subsp. aureus Mu50
aauuuaauaauuaaau

SEQ ID NO: 2077423 - RNA, 19 nt, Staphylococcus aureus subsp. aureus Mu50
aauuguuuaauaacaaaau

SEQ ID NO: 2077424 - RNA, 17 nt, Staphylococcus aureus subsp. aureus Mu50
aauuguuguacauguau

SEQ ID NO: 2077425 - RNA, 18 nt, Staphylococcus aureus subsp. aureus Mu50
aauuguuguacauguauu

SEQ ID NO: 2077426 - RNA, 13 nt, Staphylococcus aureus subsp. aureus Mu50
aauuuaaaauaau

SEQ ID NO: 2077427 - RNA, 15 nt, Staphylococcus aureus subsp. aureus Mu50
aauuuaaaagagaau

SEQ ID NO: 2077428 - RNA, 14 nt, Staphylococcus aureus subsp. aureus Mu50
aauuuaaaagaaaa

SEQ ID NO: 2077429 - RNA, 17 nt, Staphylococcus aureus subsp. aureus Mu50
aauuguuuuuucuuauu

SEQ ID NO: 2077430 - RNA, 12 nt, Staphylococcus aureus subsp. aureus Mu50
aauuuaaaacaa

SEQ ID NO: 2077431 - RNA, 16 nt, Staphylococcus aureus subsp. aureus Mu50
aauuuaaaacaaugau

SEQ ID NO: 2077432 - RNA, 20 nt, Staphylococcus aureus subsp. aureus Mu50
aauuuaaaacaaugauuaaa

SEQ ID NO: 2077433 - RNA, 20 nt, Staphylococcus aureus subsp. aureus Mu50
aauugucuagguuagaauua

SEQ ID NO: 2077434 - RNA, 16 nt, Staphylococcus aureus subsp. aureus Mu50
aauuguuacuaguucu

SEQ ID NO: 2077435 - RNA, 23 nt, Staphylococcus aureus subsp. aureus Mu50
aauuguucuaauacaccaaaucc

SEQ ID NO: 2077436 - RNA, 20 nt, Staphylococcus aureus subsp. aureus Mu50
aauuguggagaucuaacaau

SEQ ID NO: 2077437 - RNA, 21 nt, Staphylococcus aureus subsp. aureus Mu50
aauuguggcuacuaaucuuuu

SEQ ID NO: 2077438 - RNA, 16 nt, Staphylococcus aureus subsp. aureus Mu50
aauuguguugaaucaa

SEQ ID NO: 2077439 - RNA, 17 nt, Staphylococcus aureus subsp. aureus Mu50
aauuguuaaaucaccaa

SEQ ID NO: 2077440 - RNA, 20 nt, Staphylococcus aureus subsp. aureus Mu50
aauuguaaucuauuuucugc

SEQ ID NO: 2077441 - RNA, 17 nt, Staphylococcus aureus subsp. aureus Mu50
aauuguaaagcaugaau

SEQ ID NO: 2077442 - RNA, 22 nt, Staphylococcus aureus subsp. aureus Mu50
aauuguaaagcaugaauagcuu

SEQ ID NO: 2077443 - RNA, 20 nt, Staphylococcus aureus subsp. aureus Mu50
aauugguuuggauaaaauga

SEQ ID NO: 2077444 - RNA, 18 nt, Staphylococcus aureus subsp. aureus Mu50
aauuguagauccaauucc

SEQ ID NO: 2077445 - RNA, 16 nt, Staphylococcus aureus subsp. aureus Mu50
aauuguaguaaugaag

SEQ ID NO: 2077446 - RNA, 15 nt, Staphylococcus aureus subsp. aureus Mu50
aauuguauuucuuaa

SEQ ID NO: 2077447 - RNA, 16 nt, Staphylococcus aureus subsp. aureus Mu50
aauuauuuagaaacuu

SEQ ID NO: 2077448 - RNA, 19 nt, Staphylococcus aureus subsp. aureus Mu50
aauuauuuaauuuuucuaa

SEQ ID NO: 2077449 - RNA, 24 nt, Staphylococcus aureus subsp. aureus Mu50
aauuauuuauucauuauagucuua

SEQ ID NO: 2077450 - RNA, 15 nt, Staphylococcus aureus subsp. aureus Mu50
aauuauuauaauaaa

SEQ ID NO: 2077451 - RNA, 15 nt, Staphylococcus aureus subsp. aureus Mu50
aauucagaugaauaa

SEQ ID NO: 2077452 - RNA, 20 nt, Staphylococcus aureus subsp. aureus Mu50
aauuaacuagugccucuuuu

SEQ ID NO: 2077453 - RNA, 16 nt, Staphylococcus aureus subsp. aureus Mu50
aauuaacuaguguaau

SEQ ID NO: 2077454 - RNA, 12 nt, Staphylococcus aureus subsp. aureus Mu50
aauuaagaaaag

SEQ ID NO: 2077455 - RNA, 22 nt, Staphylococcus aureus subsp. aureus Mu50
aauuauaaguagugauuuuuua

SEQ ID NO: 2077456 - RNA, 17 nt, Staphylococcus aureus subsp. aureus Mu50
aauuauaaaugauuaaa

SEQ ID NO: 2077457 - RNA, 16 nt, Staphylococcus aureus subsp. aureus Mu50
aauuauaaaugauuaa

SEQ ID NO: 2077458 - RNA, 18 nt, Staphylococcus aureus subsp. aureus Mu50
aauuauccuacugcuguc

SEQ ID NO: 2077459 - RNA, 20 nt, Staphylococcus aureus subsp. aureus Mu50
aauuaucagaaucaaguaau

SEQ ID NO: 2077460 - RNA, 12 nt, Staphylococcus aureus subsp. aureus Mu50
aauuaucauuac

SEQ ID NO: 2077461 - RNA, 15 nt, Staphylococcus aureus subsp. aureus Mu50
aauuaucauaaagau

SEQ ID NO: 2077462 - RNA, 13 nt, Staphylococcus aureus subsp. aureus Mu50
aauuauauuaaug

SEQ ID NO: 2077463 - RNA, 22 nt, Staphylococcus aureus subsp. aureus Mu50
aauuauauagaaaacuagaacu

SEQ ID NO: 2077464 - RNA, 21 nt, Staphylococcus aureus subsp. aureus Mu50
aauuccccaaagccuucuauc

SEQ ID NO: 2077465 - RNA, 20 nt, Staphylococcus aureus subsp. aureus Mu50
aauucauuuuauaaaucaaa

SEQ ID NO: 2077466 - RNA, 16 nt, Staphylococcus aureus subsp. aureus Mu50
aauucauuuuauaaau

SEQ ID NO: 2077467 - RNA, 20 nt, Staphylococcus aureus subsp. aureus Mu50
aauucaucuuaucaagaaua

SEQ ID NO: 2077468 - RNA, 21 nt, Staphylococcus aureus subsp. aureus Mu50
aauucaucuuaucaagaauau

SEQ ID NO: 2077469 - RNA, 13 nt, Staphylococcus aureus subsp. aureus Mu50
aauucgaaaagaa

SEQ ID NO: 2077470 - RNA, 14 nt, Staphylococcus aureus subsp. aureus Mu50
aauucgaaaagaaa

SEQ ID NO: 2077471 - RNA, 19 nt, Staphylococcus aureus subsp. aureus Mu50
aauucuacagguaaugcaa

SEQ ID NO: 2077472 - RNA, 18 nt, Staphylococcus aureus subsp. aureus Mu50
aauucgacucaaacaaua

SEQ ID NO: 2077473 - RNA, 21 nt, Staphylococcus aureus subsp. aureus Mu50
aauucucuuuguuggggccca

SEQ ID NO: 2077474 - RNA, 20 nt, Staphylococcus aureus subsp. aureus Mu50
aauucucuuuuaaauucuua

SEQ ID NO: 2077475 - RNA, 18 nt, Staphylococcus aureus subsp. aureus Mu50
aauucucuaacuuuacca

SEQ ID NO: 2077476 - RNA, 19 nt, Staphylococcus aureus subsp. aureus Mu50
aauucucgauuuuuuuaua

SEQ ID NO: 2077477 - RNA, 14 nt, Staphylococcus aureus subsp. aureus Mu50
aauucuauuuuuga

SEQ ID NO: 2077478 - RNA, 17 nt, Staphylococcus aureus subsp. aureus Mu50
aauucuauuuuugauuu

SEQ ID NO: 2077479 - RNA, 20 nt, Staphylococcus aureus subsp. aureus Mu50
aauucuauuuuugauuuaau

SEQ ID NO: 2077480 - RNA, 21 nt, Staphylococcus aureus subsp. aureus Mu50
aauucuauuuuugauuuaaua

SEQ ID NO: 2077481 - RNA, 11 nt, Staphylococcus aureus subsp. aureus Mu50
aauucuauuuu

SEQ ID NO: 2077482 - RNA, 21 nt, Staphylococcus aureus subsp. aureus Mu50
aauguugucguuucuagcaac

SEQ ID NO: 2077483 - RNA, 23 nt, Staphylococcus aureus subsp. aureus Mu50
aauguuggaaaaggucaaaaaau

SEQ ID NO: 2077484 - RNA, 15 nt, Staphylococcus aureus subsp. aureus Mu50
aauguuuauaucuuu

SEQ ID NO: 2077485 - RNA, 20 nt, Staphylococcus aureus subsp. aureus Mu50
aauguuuaauuuucuaaaua

SEQ ID NO: 2077486 - RNA, 21 nt, Staphylococcus aureus subsp. aureus Mu50
aauguuugaguguuuaugaaa

SEQ ID NO: 2077487 - RNA, 13 nt, Staphylococcus aureus subsp. aureus Mu50
aauguuucuccua

SEQ ID NO: 2077488 - RNA, 18 nt, Staphylococcus aureus subsp. aureus Mu50
aauguuugcuuuuuguaa

SEQ ID NO: 2077489 - RNA, 12 nt, Staphylococcus aureus subsp. aureus Mu50
aauguuuuaugu

SEQ ID NO: 2077490 - RNA, 18 nt, Staphylococcus aureus subsp. aureus Mu50
aauguuuuauguauuuau

SEQ ID NO: 2077491 - RNA, 18 nt, Staphylococcus aureus subsp. aureus Mu50
aauguuuuugauaguaau

SEQ ID NO: 2077492 - RNA, 14 nt, Staphylococcus aureus subsp. aureus Mu50
aauuaaaaaacaaa

SEQ ID NO: 2077493 - RNA, 20 nt, Staphylococcus aureus subsp. aureus Mu50
aauuaaaaaacaauaaaauu

SEQ ID NO: 2077494 - RNA, 14 nt, Staphylococcus aureus subsp. aureus Mu50
aauuaaaaaacaau

SEQ ID NO: 2077495 - RNA, 18 nt, Staphylococcus aureus subsp. aureus Mu50
aauuaaaaaacaauaaaa

SEQ ID NO: 2077496 - RNA, 17 nt, Staphylococcus aureus subsp. aureus Mu50
aauuaaaacagcaaaua

SEQ ID NO: 2077497 - RNA, 20 nt, Staphylococcus aureus subsp. aureus Mu50
aauuaaaacagcaaauaaaa

SEQ ID NO: 2077498 - RNA, 14 nt, Staphylococcus aureus subsp. aureus Mu50
aauuaaaacuauaa

SEQ ID NO: 2077499 - RNA, 18 nt, Staphylococcus aureus subsp. aureus Mu50
aauuaaauuauauguuuu

SEQ ID NO: 2077500 - RNA, 13 nt, Staphylococcus aureus subsp. aureus Mu50
aauuaaagugaau

SEQ ID NO: 2077501 - RNA, 13 nt, Staphylococcus aureus subsp. aureus Mu50
aauuaaauguuua

SEQ ID NO: 2077502 - RNA, 19 nt, Staphylococcus aureus subsp. aureus Mu50
aauuaacaauauuaaauuu

SEQ ID NO: 2077503 - RNA, 16 nt, Staphylococcus aureus subsp. aureus Mu50
aauuaacaauauuaaa

SEQ ID NO: 2077504 - RNA, 23 nt, Staphylococcus aureus subsp. aureus Mu50
aauuaaacgcucaacuauauaua

SEQ ID NO: 2077505 - RNA, 23 nt, Staphylococcus aureus subsp. aureus Mu50
aauuaaacaagccuuaaaauauu

SEQ ID NO: 2077506 - RNA, 14 nt, Staphylococcus aureus subsp. aureus Mu50
aauuaaaauucucu

SEQ ID NO: 2077507 - RNA, 15 nt, Staphylococcus aureus subsp. aureus Mu50
aauuaaaauucucuu

SEQ ID NO: 2077508 - RNA, 13 nt, Staphylococcus aureus subsp. aureus Mu50
aauuaaaauguua

SEQ ID NO: 2077509 - RNA, 15 nt, Staphylococcus aureus subsp. aureus Mu50
aauuaaaauguuaau

SEQ ID NO: 2077510 - RNA, 12 nt, Staphylococcus aureus subsp. aureus Mu50
aauuaaaauaca

SEQ ID NO: 2077511 - RNA, 20 nt, Staphylococcus aureus subsp. aureus Mu50
aauuaaaacuuucagagaua

SEQ ID NO: 2077512 - RNA, 20 nt, Staphylococcus aureus subsp. aureus Mu50
aauuaaaauaagauauauaa

SEQ ID NO: 2077513 - RNA, 16 nt, Staphylococcus aureus subsp. aureus Mu50
aauuaaauaaaaauau

SEQ ID NO: 2077514 - RNA, 20 nt, Staphylococcus aureus subsp. aureus Mu50
aauuaaagucaauuuaaaua

SEQ ID NO: 2077515 - RNA, 20 nt, Staphylococcus aureus subsp. aureus Mu50
aauuaaacgcucaacuauau

SEQ ID NO: 2077516 - RNA, 17 nt, Staphylococcus aureus subsp. aureus Mu50
aauuaaacuuaagaaua

SEQ ID NO: 2077517 - RNA, 18 nt, Staphylococcus aureus subsp. aureus Mu50
aauuaaagauuaaaauau

SEQ ID NO: 2077518 - RNA, 15 nt, Staphylococcus aureus subsp. aureus Mu50
aaugucguauaugua

SEQ ID NO: 2077519 - RNA, 14 nt, Staphylococcus aureus subsp. aureus Mu50
aaugucuucauaau

SEQ ID NO: 2077520 - RNA, 22 nt, Staphylococcus aureus subsp. aureus Mu50
aaugugagauacguuauuucaa

SEQ ID NO: 2077521 - RNA, 15 nt, Staphylococcus aureus subsp. aureus Mu50
aaugucauagacuac

SEQ ID NO: 2077522 - RNA, 23 nt, Staphylococcus aureus subsp. aureus Mu50
aaugucauagccuauuuaaaaga

SEQ ID NO: 2077523 - RNA, 20 nt, Staphylococcus aureus subsp. aureus Mu50
aauguauuuuuacuuuuaua

SEQ ID NO: 2077524 - RNA, 21 nt, Staphylococcus aureus subsp. aureus Mu50
aauguauuuuuacuuuuauaa

SEQ ID NO: 2077525 - RNA, 14 nt, Staphylococcus aureus subsp. aureus Mu50
aauguguaugguuu

SEQ ID NO: 2077526 - RNA, 21 nt, Staphylococcus aureus subsp. aureus Mu50
aauguguggauuuaauuuuua

SEQ ID NO: 2077527 - RNA, 23 nt, Staphylococcus aureus subsp. aureus Mu50
aauguguuaaucaacguauauaa

SEQ ID NO: 2077528 - RNA, 22 nt, Staphylococcus aureus subsp. aureus Mu50
aauguguaugguuuuguacaua

SEQ ID NO: 2077529 - RNA, 14 nt, Staphylococcus aureus subsp. aureus Mu50
aauguguuaauacu

SEQ ID NO: 2077530 - RNA, 22 nt, Staphylococcus aureus subsp. aureus Mu50
aaugugcugugucuuuugauuu

SEQ ID NO: 2077531 - RNA, 21 nt, Staphylococcus aureus subsp. aureus Mu50
aauguggaacaugauucauga

SEQ ID NO: 2077532 - RNA, 20 nt, Staphylococcus aureus subsp. aureus Mu50
aaugugcaauuagaauauau

SEQ ID NO: 2077533 - RNA, 15 nt, Staphylococcus aureus subsp. aureus Mu50
aaugugcauuuaucu

SEQ ID NO: 2077534 - RNA, 15 nt, Staphylococcus aureus subsp. aureus Mu50
aaugugaugauuaau

SEQ ID NO: 2077535 - RNA, 23 nt, Staphylococcus aureus subsp. aureus Mu50
aauguuacacaucgaucuaaaua

SEQ ID NO: 2077536 - RNA, 14 nt, Staphylococcus aureus subsp. aureus Mu50
aauguuaauaauga

SEQ ID NO: 2077537 - RNA, 14 nt, Staphylococcus aureus subsp. aureus Mu50
aauguuaaagauua

SEQ ID NO: 2077538 - RNA, 16 nt, Staphylococcus aureus subsp. aureus Mu50
aauguuaaagauuauu

SEQ ID NO: 2077539 - RNA, 19 nt, Staphylococcus aureus subsp. aureus Mu50
aauguuaaacacucaaaau

SEQ ID NO: 2077540 - RNA, 14 nt, Staphylococcus aureus subsp. aureus Mu50
aauguucaaaaaau

SEQ ID NO: 2077541 - RNA, 17 nt, Staphylococcus aureus subsp. aureus Mu50
aauguuaucuugcuuau

SEQ ID NO: 2077542 - RNA, 15 nt, Staphylococcus aureus subsp. aureus Mu50
aauguucaauuuaua

SEQ ID NO: 2077543 - RNA, 16 nt, Staphylococcus aureus subsp. aureus Mu50
aaugauuuauucuaaa

SEQ ID NO: 2077544 - RNA, 23 nt, Staphylococcus aureus subsp. aureus Mu50
aaugauuuaauaaaaaccaauau

SEQ ID NO: 2077545 - RNA, 13 nt, Staphylococcus aureus subsp. aureus Mu50
aaugauuuugcuu

SEQ ID NO: 2077546 - RNA, 22 nt, Staphylococcus aureus subsp. aureus Mu50
aaugauuuuuauuauugucauc

SEQ ID NO: 2077547 - RNA, 14 nt, Staphylococcus aureus subsp. aureus Mu50
aaugauuuugcuuu

SEQ ID NO: 2077548 - RNA, 20 nt, Staphylococcus aureus subsp. aureus Mu50
aaucuugauuauauuuuucu

SEQ ID NO: 2077549 - RNA, 15 nt, Staphylococcus aureus subsp. aureus Mu50
aaucuucuauuuuca

SEQ ID NO: 2077550 - RNA, 20 nt, Staphylococcus aureus subsp. aureus Mu50
aaucuucuccaaucaucauu

SEQ ID NO: 2077551 - RNA, 20 nt, Staphylococcus aureus subsp. aureus Mu50
aaugcacgagcaacaucuuu

SEQ ID NO: 2077552 - RNA, 19 nt, Staphylococcus aureus subsp. aureus Mu50
aaugcagauucuucaccaa

SEQ ID NO: 2077553 - RNA, 20 nt, Staphylococcus aureus subsp. aureus Mu50
aaugcaaaucucgucacaua

SEQ ID NO: 2077554 - RNA, 21 nt, Staphylococcus aureus subsp. aureus Mu50
aaugcaaguuggcggggcccc

SEQ ID NO: 2077555 - RNA, 15 nt, Staphylococcus aureus subsp. aureus Mu50
aaugcaacuugauca

SEQ ID NO: 2077556 - RNA, 16 nt, Staphylococcus aureus subsp. aureus Mu50
aaugcaacuugaucau

SEQ ID NO: 2077557 - RNA, 21 nt, Staphylococcus aureus subsp. aureus Mu50
aaugccuuaucuauagguaau

SEQ ID NO: 2077558 - RNA, 18 nt, Staphylococcus aureus subsp. aureus Mu50
aaugcgaagauuuuuaac

SEQ ID NO: 2077559 - RNA, 21 nt, Staphylococcus aureus subsp. aureus Mu50
aaugccauuguuauccaaaac

SEQ ID NO: 2077560 - RNA, 16 nt, Staphylococcus aureus subsp. aureus Mu50
aaugcuuaaaaacaau

SEQ ID NO: 2077561 - RNA, 16 nt, Staphylococcus aureus subsp. aureus Mu50
aaugcgacguuguucu

SEQ ID NO: 2077562 - RNA, 15 nt, Staphylococcus aureus subsp. aureus Mu50
aauggaugaauauau

SEQ ID NO: 2077563 - RNA, 14 nt, Staphylococcus aureus subsp. aureus Mu50
aauggaguauauca

SEQ ID NO: 2077564 - RNA, 21 nt, Staphylococcus aureus subsp. aureus Mu50
aaugguucuauaauaaaucga

SEQ ID NO: 2077565 - RNA, 23 nt, Staphylococcus aureus subsp. aureus Mu50
aaugguugauuauauuucucaua

SEQ ID NO: 2077566 - RNA, 22 nt, Staphylococcus aureus subsp. aureus Mu50
aauguaagcgaauacaauagua

SEQ ID NO: 2077567 - RNA, 21 nt, Staphylococcus aureus subsp. aureus Mu50
aauguacauuguaaauauagu

SEQ ID NO: 2077568 - RNA, 21 nt, Staphylococcus aureus subsp. aureus Mu50
aauguaacauuaaaaauaaaa

SEQ ID NO: 2077569 - RNA, 19 nt, Staphylococcus aureus subsp. aureus Mu50
aacagaaccgaaaauaauc

SEQ ID NO: 2077570 - RNA, 22 nt, Staphylococcus aureus subsp. aureus Mu50
aacacucaaaauguuuaacaau

SEQ ID NO: 2077571 - RNA, 21 nt, Staphylococcus aureus subsp. aureus Mu50
aacacucaaaauguuuaacaa

SEQ ID NO: 2077572 - RNA, 18 nt, Staphylococcus aureus subsp. aureus Mu50
aacacugagaauuucuaa

SEQ ID NO: 2077573 - RNA, 19 nt, Staphylococcus aureus subsp. aureus Mu50
aacacugagaauuucuaau

SEQ ID NO: 2077574 - RNA, 19 nt, Staphylococcus aureus subsp. aureus Mu50
aacacgaugagcgcauaaa

SEQ ID NO: 2077575 - RNA, 20 nt, Staphylococcus aureus subsp. aureus Mu50
aacacgauuugguugaacug

SEQ ID NO: 2077576 - RNA, 22 nt, Staphylococcus aureus subsp. aureus Mu50
aacaccugguacauaaauaccu

SEQ ID NO: 2077577 - RNA, 16 nt, Staphylococcus aureus subsp. aureus Mu50
aacaccuaauauuuua

SEQ ID NO: 2077578 - RNA, 20 nt, Staphylococcus aureus subsp. aureus Mu50
aacacgaacugcauagguaa

SEQ ID NO: 2077579 - RNA, 14 nt, Staphylococcus aureus subsp. aureus Mu50
aacacgaacugcau

SEQ ID NO: 2077580 - RNA, 21 nt, Staphylococcus aureus subsp. aureus Mu50
aacaccacacagcauuuucaa

SEQ ID NO: 2077581 - RNA, 20 nt, Staphylococcus aureus subsp. aureus Mu50
aaaaaguaaaaucuuuaaca

SEQ ID NO: 2077582 - RNA, 19 nt, Staphylococcus aureus subsp. aureus Mu50
aacacauucuuauuugaaa

SEQ ID NO: 2077583 - RNA, 14 nt, Staphylococcus aureus subsp. aureus Mu50
aacacauucaaaua

SEQ ID NO: 2077584 - RNA, 18 nt, Staphylococcus aureus subsp. aureus Mu50
aaaaagugauaauuaaaa

SEQ ID NO: 2077585 - RNA, 20 nt, Staphylococcus aureus subsp. aureus Mu50
aaaaagugaaaguauuagau

SEQ ID NO: 2077586 - RNA, 12 nt, Staphylococcus aureus subsp. aureus Mu50
aacacaaagaau

SEQ ID NO: 2077587 - RNA, 18 nt, Staphylococcus aureus subsp. aureus Mu50
aacacaaaaaugaagaau

SEQ ID NO: 2077588 - RNA, 21 nt, Staphylococcus aureus subsp. aureus Mu50
aacaauuuuugggaagaauaa

SEQ ID NO: 2077589 - RNA, 22 nt, Staphylococcus aureus subsp. aureus Mu50
aacacacuuauaaucuauaaau

SEQ ID NO: 2077590 - RNA, 14 nt, Staphylococcus aureus subsp. aureus Mu50
aacacauaaauuaa

SEQ ID NO: 2077591 - RNA, 23 nt, Staphylococcus aureus subsp. aureus Mu50
aacacagagaauuucgaaaagaa

SEQ ID NO: 2077592 - RNA, 16 nt, Staphylococcus aureus subsp. aureus Mu50
aacacaguacaaauaa

SEQ ID NO: 2077593 - RNA, 11 nt, Staphylococcus aureus subsp. aureus Mu50
aacacaucuau

SEQ ID NO: 2077594 - RNA, 18 nt, Staphylococcus aureus subsp. aureus Mu50
aacaaucggaagcauauu

SEQ ID NO: 2077595 - RNA, 24 nt, Staphylococcus aureus subsp. aureus Mu50
aacaaucggaagcauauuucuaaa

SEQ ID NO: 2077596 - RNA, 18 nt, Staphylococcus aureus subsp. aureus Mu50
aacaaucaaagagccaga

SEQ ID NO: 2077597 - RNA, 19 nt, Staphylococcus aureus subsp. aureus Mu50
aacaaucagauaaguuacu

SEQ ID NO: 2077598 - RNA, 19 nt, Staphylococcus aureus subsp. aureus Mu50
aacaaugcgaagaaaucau

SEQ ID NO: 2077599 - RNA, 17 nt, Staphylococcus aureus subsp. aureus Mu50
aacaaugauuaaaauua

SEQ ID NO: 2077600 - RNA, 18 nt, Staphylococcus aureus subsp. aureus Mu50
aacaaugaggauugugua

SEQ ID NO: 2077601 - RNA, 13 nt, Staphylococcus aureus subsp. aureus Mu50
aacaaucuuuuuc

SEQ ID NO: 2077602 - RNA, 22 nt, Staphylococcus aureus subsp. aureus Mu50
aacaauuugaggauacauaaau

SEQ ID NO: 2077603 - RNA, 20 nt, Staphylococcus aureus subsp. aureus Mu50
aacaauuuuaaaucuuuuag

SEQ ID NO: 2077604 - RNA, 16 nt, Staphylococcus aureus subsp. aureus Mu50
aacaauugcuaaucca

SEQ ID NO: 2077605 - RNA, 19 nt, Staphylococcus aureus subsp. aureus Mu50
aacaauugcuaauccauac

SEQ ID NO: 2077606 - RNA, 15 nt, Staphylococcus aureus subsp. aureus Mu50
aacaauuuauuaaaa

SEQ ID NO: 2077607 - RNA, 13 nt, Staphylococcus aureus subsp. aureus Mu50
aaauucucuaauu

SEQ ID NO: 2077608 - RNA, 22 nt, Staphylococcus aureus subsp. aureus Mu50
aaauucucuaauuucucccguu

SEQ ID NO: 2077609 - RNA, 18 nt, Staphylococcus aureus subsp. aureus Mu50
aaauucuuauaaaauaaa

SEQ ID NO: 2077610 - RNA, 13 nt, Staphylococcus aureus subsp. aureus Mu50
aaauucuuuugua

SEQ ID NO: 2077611 - RNA, 14 nt, Staphylococcus aureus subsp. aureus Mu50
aacaauauaauaua

SEQ ID NO: 2077612 - RNA, 20 nt, Staphylococcus aureus subsp. aureus Mu50
aacaauauucguaaauccuu

SEQ ID NO: 2077613 - RNA, 21 nt, Staphylococcus aureus subsp. aureus Mu50
aacaauauuaaauuucugaac

SEQ ID NO: 2077614 - RNA, 20 nt, Staphylococcus aureus subsp. aureus Mu50
aacaauauuaaauuucugaa

SEQ ID NO: 2077615 - RNA, 13 nt, Staphylococcus aureus subsp. aureus Mu50
aacaauaauaugc

SEQ ID NO: 2077616 - RNA, 15 nt, Staphylococcus aureus subsp. aureus Mu50
aacaauaaaaaacca

SEQ ID NO: 2077617 - RNA, 16 nt, Staphylococcus aureus subsp. aureus Mu50
aacaauaaaaaaccaa

SEQ ID NO: 2077618 - RNA, 23 nt, Staphylococcus aureus subsp. aureus Mu50
aaccaucugugucagcauucaua

SEQ ID NO: 2077619 - RNA, 13 nt, Staphylococcus aureus subsp. aureus Mu50
aaccauucguaau

SEQ ID NO: 2077620 - RNA, 18 nt, Staphylococcus aureus subsp. aureus Mu50
aaccauucguaauaaaca

SEQ ID NO: 2077621 - RNA, 16 nt, Staphylococcus aureus subsp. aureus Mu50
aaccauuuuauuuuaa

SEQ ID NO: 2077622 - RNA, 17 nt, Staphylococcus aureus subsp. aureus Mu50
aaccauuuuauuuuaac

SEQ ID NO: 2077623 - RNA, 16 nt, Staphylococcus aureus subsp. aureus Mu50
aaccauuuaaaaauug

SEQ ID NO: 2077624 - RNA, 14 nt, Staphylococcus aureus subsp. aureus Mu50
aaccauuuaaaaau

SEQ ID NO: 2077625 - RNA, 16 nt, Staphylococcus aureus subsp. aureus Mu50
aaccgauauuucugaa

SEQ ID NO: 2077626 - RNA, 22 nt, Staphylococcus aureus subsp. aureus Mu50
aacccuaauguguggauuuaau

SEQ ID NO: 2077627 - RNA, 21 nt, Staphylococcus aureus subsp. aureus Mu50
aacauauuuuaacuaugaaug

SEQ ID NO: 2077628 - RNA, 12 nt, Staphylococcus aureus subsp. aureus Mu50
aacauauuuuaa

SEQ ID NO: 2077629 - RNA, 23 nt, Staphylococcus aureus subsp. aureus Mu50
aacauauucaguauauguauaga

SEQ ID NO: 2077630 - RNA, 16 nt, Staphylococcus aureus subsp. aureus Mu50
aacauauuauauauau

SEQ ID NO: 2077631 - RNA, 21 nt, Staphylococcus aureus subsp. aureus Mu50
aacauauuuaucucuuucuuc

SEQ ID NO: 2077632 - RNA, 14 nt, Staphylococcus aureus subsp. aureus Mu50
aacauauucauaau

SEQ ID NO: 2077633 - RNA, 14 nt, Staphylococcus aureus subsp. aureus Mu50
aacaucauuucuga

SEQ ID NO: 2077634 - RNA, 15 nt, Staphylococcus aureus subsp. aureus Mu50
aacaucauuucugaa

SEQ ID NO: 2077635 - RNA, 23 nt, Staphylococcus aureus subsp. aureus Mu50
aacaugaacaaucagauaaguua

SEQ ID NO: 2077636 - RNA, 13 nt, Staphylococcus aureus subsp. aureus Mu50
aacaucuucaaca

SEQ ID NO: 2077637 - RNA, 22 nt, Staphylococcus aureus subsp. aureus Mu50
aacauccuuugauguuuucuau

SEQ ID NO: 2077638 - RNA, 15 nt, Staphylococcus aureus subsp. aureus Mu50
aacaucugaaaaaau

SEQ ID NO: 2077639 - RNA, 14 nt, Staphylococcus aureus subsp. aureus Mu50
aacauaauuuuuau

SEQ ID NO: 2077640 - RNA, 18 nt, Staphylococcus aureus subsp. aureus Mu50
aacauacguuauuuuuug

SEQ ID NO: 2077641 - RNA, 15 nt, Staphylococcus aureus subsp. aureus Mu50
aacauacuauaaaaa

SEQ ID NO: 2077642 - RNA, 22 nt, Staphylococcus aureus subsp. aureus Mu50
aacauacuauaaaaauuuauuc

SEQ ID NO: 2077643 - RNA, 16 nt, Staphylococcus aureus subsp. aureus Mu50
aacauauuauaaaagu

SEQ ID NO: 2077644 - RNA, 20 nt, Staphylococcus aureus subsp. aureus Mu50
aacauuaaucuauauaaaaa

SEQ ID NO: 2077645 - RNA, 14 nt, Staphylococcus aureus subsp. aureus Mu50
aacauuaauaaaua

SEQ ID NO: 2077646 - RNA, 13 nt, Staphylococcus aureus subsp. aureus Mu50
aacauuaaauuau

SEQ ID NO: 2077647 - RNA, 14 nt, Staphylococcus aureus subsp. aureus Mu50
aacauuaaauuauu

SEQ ID NO: 2077648 - RNA, 15 nt, Staphylococcus aureus subsp. aureus Mu50
aacauuaaaaugaua

SEQ ID NO: 2077649 - RNA, 16 nt, Staphylococcus aureus subsp. aureus Mu50
aacaugauacugaaau

SEQ ID NO: 2077650 - RNA, 23 nt, Staphylococcus aureus subsp. aureus Mu50
aacaugguuuucuuuuuaucaug

SEQ ID NO: 2077651 - RNA, 13 nt, Staphylococcus aureus subsp. aureus Mu50
aacauguacaauu

SEQ ID NO: 2077652 - RNA, 18 nt, Staphylococcus aureus subsp. aureus Mu50
aacauguacaauuuuuaa

SEQ ID NO: 2077653 - RNA, 23 nt, Staphylococcus aureus subsp. aureus Mu50
aacauguacaauuuuuaaaaacc

SEQ ID NO: 2077654 - RNA, 21 nt, Staphylococcus aureus subsp. aureus Mu50
aacauguugauaaaaaggauc

SEQ ID NO: 2077655 - RNA, 16 nt, Staphylococcus aureus subsp. aureus Mu50
aacauguguaugauca

SEQ ID NO: 2077656 - RNA, 22 nt, Staphylococcus aureus subsp. aureus Mu50
aacauguuccgcuacaaaacau

SEQ ID NO: 2077657 - RNA, 20 nt, Staphylococcus aureus subsp. aureus Mu50
aacauucuucaaaaaauaau

SEQ ID NO: 2077658 - RNA, 17 nt, Staphylococcus aureus subsp. aureus Mu50
aacauucuucaaaaaau

SEQ ID NO: 2077659 - RNA, 19 nt, Staphylococcus aureus subsp. aureus Mu50
aacauucuucaaaaaauaa

SEQ ID NO: 2077660 - RNA, 17 nt, Staphylococcus aureus subsp. aureus Mu50
aacauuagcaugauaaa

SEQ ID NO: 2077661 - RNA, 19 nt, Staphylococcus aureus subsp. aureus Mu50
aacauuagcaugauaaagu

SEQ ID NO: 2077662 - RNA, 20 nt, Staphylococcus aureus subsp. aureus Mu50
aacauuacuaauugaucagc

SEQ ID NO: 2077663 - RNA, 19 nt, Staphylococcus aureus subsp. aureus Mu50
aacauucccuuaauaauaa

SEQ ID NO: 2077664 - RNA, 18 nt, Staphylococcus aureus subsp. aureus Mu50
aaccaaaucggaauaaaa

SEQ ID NO: 2077665 - RNA, 20 nt, Staphylococcus aureus subsp. aureus Mu50
aaccaaaucggaauaaaaua

SEQ ID NO: 2077666 - RNA, 15 nt, Staphylococcus aureus subsp. aureus Mu50
aacauugagauuauc

SEQ ID NO: 2077667 - RNA, 14 nt, Staphylococcus aureus subsp. aureus Mu50
aaccaauuaauugu

SEQ ID NO: 2077668 - RNA, 17 nt, Staphylococcus aureus subsp. aureus Mu50
aaccaauuaauuguaaa

SEQ ID NO: 2077669 - RNA, 16 nt, Staphylococcus aureus subsp. aureus Mu50
aagaauauaagugauu

SEQ ID NO: 2077670 - RNA, 15 nt, Staphylococcus aureus subsp. aureus Mu50
aagaauacaaauauu

SEQ ID NO: 2077671 - RNA, 21 nt, Staphylococcus aureus subsp. aureus Mu50
aagaaggaugaguuuaaaaau

SEQ ID NO: 2077672 - RNA, 16 nt, Staphylococcus aureus subsp. aureus Mu50
aagaaguaauguuaaa

SEQ ID NO: 2077673 - RNA, 17 nt, Staphylococcus aureus subsp. aureus Mu50
aagaacguguuugaaug

SEQ ID NO: 2077674 - RNA, 15 nt, Staphylococcus aureus subsp. aureus Mu50
aagaacuauuuuaaa

SEQ ID NO: 2077675 - RNA, 13 nt, Staphylococcus aureus subsp. aureus Mu50
aagaagaaauacu

SEQ ID NO: 2077676 - RNA, 22 nt, Staphylococcus aureus subsp. aureus Mu50
aagaagacauuggauuacuucc

SEQ ID NO: 2077677 - RNA, 11 nt, Staphylococcus aureus subsp. aureus Mu50
aagaagagcca

SEQ ID NO: 2077678 - RNA, 22 nt, Staphylococcus aureus subsp. aureus Mu50
aagaaaaagugauaauuaaaau

SEQ ID NO: 2077679 - RNA, 21 nt, Staphylococcus aureus subsp. aureus Mu50
aagaaaaauuuucuugguuug

SEQ ID NO: 2077680 - RNA, 21 nt, Staphylococcus aureus subsp. aureus Mu50
aagaaaaaccugggacauuaa

SEQ ID NO: 2077681 - RNA, 15 nt, Staphylococcus aureus subsp. aureus Mu50
aacuugcgauaaguu

SEQ ID NO: 2077682 - RNA, 20 nt, Staphylococcus aureus subsp. aureus Mu50
aacuugauuauguaauucua

SEQ ID NO: 2077683 - RNA, 21 nt, Staphylococcus aureus subsp. aureus Mu50
aacuugaucauuauaaaaugg

SEQ ID NO: 2077684 - RNA, 21 nt, Staphylococcus aureus subsp. aureus Mu50
aagaaccgauauuucugaauu

SEQ ID NO: 2077685 - RNA, 19 nt, Staphylococcus aureus subsp. aureus Mu50
aagaaauucuacagguaau

SEQ ID NO: 2077686 - RNA, 22 nt, Staphylococcus aureus subsp. aureus Mu50
aagaaauucuacagguaaugca

SEQ ID NO: 2077687 - RNA, 17 nt, Staphylococcus aureus subsp. aureus Mu50
aagaaauucgcaagccu

SEQ ID NO: 2077688 - RNA, 21 nt, Staphylococcus aureus subsp. aureus Mu50
aagaaauucgcuugauuaauu

SEQ ID NO: 2077689 - RNA, 19 nt, Staphylococcus aureus subsp. aureus Mu50
aagaaauucuacaggcaau

SEQ ID NO: 2077690 - RNA, 12 nt, Staphylococcus aureus subsp. aureus Mu50
aacuuauaauau

SEQ ID NO: 2077691 - RNA, 18 nt, Staphylococcus aureus subsp. aureus Mu50
aacuuauucaaacagucc

SEQ ID NO: 2077692 - RNA, 11 nt, Staphylococcus aureus subsp. aureus Mu50
aacuucuuuuu

SEQ ID NO: 2077693 - RNA, 16 nt, Staphylococcus aureus subsp. aureus Mu50
aacugguugauaaaua

SEQ ID NO: 2077694 - RNA, 13 nt, Staphylococcus aureus subsp. aureus Mu50
aacuuaaaacuau

SEQ ID NO: 2077695 - RNA, 14 nt, Staphylococcus aureus subsp. aureus Mu50
aacuuacuuuugua

SEQ ID NO: 2077696 - RNA, 15 nt, Staphylococcus aureus subsp. aureus Mu50
aacuuaaaauuuaaa

SEQ ID NO: 2077697 - RNA, 24 nt, Staphylococcus aureus subsp. aureus Mu50
aacuuaauuaaaaaaagauuagua

SEQ ID NO: 2077698 - RNA, 20 nt, Staphylococcus aureus subsp. aureus Mu50
aacuuaaugcuucaaaugua

SEQ ID NO: 2077699 - RNA, 22 nt, Staphylococcus aureus subsp. aureus Mu50
aacuuaccaugaugagauaaaa

SEQ ID NO: 2077700 - RNA, 18 nt, Staphylococcus aureus subsp. aureus Mu50
aacucuuuaauuuuacca

SEQ ID NO: 2077701 - RNA, 14 nt, Staphylococcus aureus subsp. aureus Mu50
aacuggaacuuaca

SEQ ID NO: 2077702 - RNA, 18 nt, Staphylococcus aureus subsp. aureus Mu50
aacugcugcuaaaauaaa

SEQ ID NO: 2077703 - RNA, 15 nt, Staphylococcus aureus subsp. aureus Mu50
aacgucaacagcaua

SEQ ID NO: 2077704 - RNA, 21 nt, Staphylococcus aureus subsp. aureus Mu50
aacguacuguguaauaccaau

SEQ ID NO: 2077705 - RNA, 15 nt, Staphylococcus aureus subsp. aureus Mu50
aacguacauuuuuau

SEQ ID NO: 2077706 - RNA, 17 nt, Staphylococcus aureus subsp. aureus Mu50
aacguacauuuuuauga

SEQ ID NO: 2077707 - RNA, 14 nt, Staphylococcus aureus subsp. aureus Mu50
aacgucauuuuuaa

SEQ ID NO: 2077708 - RNA, 13 nt, Staphylococcus aureus subsp. aureus Mu50
aacguccaaacac

SEQ ID NO: 2077709 - RNA, 12 nt, Staphylococcus aureus subsp. aureus Mu50
aacgucacuuua

SEQ ID NO: 2077710 - RNA, 20 nt, Staphylococcus aureus subsp. aureus Mu50
aacguucaaucguuucuucc

SEQ ID NO: 2077711 - RNA, 17 nt, Staphylococcus aureus subsp. aureus Mu50
aacguucauauaugaua

SEQ ID NO: 2077712 - RNA, 18 nt, Staphylococcus aureus subsp. aureus Mu50
aacguucauauaugauaa

SEQ ID NO: 2077713 - RNA, 12 nt, Staphylococcus aureus subsp. aureus Mu50
aacguuuucacu

SEQ ID NO: 2077714 - RNA, 15 nt, Staphylococcus aureus subsp. aureus Mu50
aacguuugaagaaug

SEQ ID NO: 2077715 - RNA, 13 nt, Staphylococcus aureus subsp. aureus Mu50
aacguuuucacuu

SEQ ID NO: 2077716 - RNA, 17 nt, Staphylococcus aureus subsp. aureus Mu50
aacuaaaaugucuuuga

SEQ ID NO: 2077717 - RNA, 19 nt, Staphylococcus aureus subsp. aureus Mu50
aacuaaaacgauaauaaua

SEQ ID NO: 2077718 - RNA, 20 nt, Staphylococcus aureus subsp. aureus Mu50
aacuaaaacgauaauaauaa

SEQ ID NO: 2077719 - RNA, 20 nt, Staphylococcus aureus subsp. aureus Mu50
aacuaaagguauucuauuuu

SEQ ID NO: 2077720 - RNA, 13 nt, Staphylococcus aureus subsp. aureus Mu50
aacuaaauuaaaa

SEQ ID NO: 2077721 - RNA, 15 nt, Staphylococcus aureus subsp. aureus Mu50
aacuaaaccauugaa

SEQ ID NO: 2077722 - RNA, 22 nt, Staphylococcus aureus subsp. aureus Mu50
aacuaaauacgagcguugguaa

SEQ ID NO: 2077723 - RNA, 13 nt, Staphylococcus aureus subsp. aureus Mu50
aacuaauuuaaag

SEQ ID NO: 2077724 - RNA, 21 nt, Staphylococcus aureus subsp. aureus Mu50
aacuaauuuaaagcaucauau

SEQ ID NO: 2077725 - RNA, 13 nt, Staphylococcus aureus subsp. aureus Mu50
aacuaauuuagac

SEQ ID NO: 2077726 - RNA, 14 nt, Staphylococcus aureus subsp. aureus Mu50
aacuaaugucgcac

SEQ ID NO: 2077727 - RNA, 14 nt, Staphylococcus aureus subsp. aureus Mu50
aacuaauaauuugu

SEQ ID NO: 2077728 - RNA, 20 nt, Staphylococcus aureus subsp. aureus Mu50
aacuaaucguguauuauuga

SEQ ID NO: 2077729 - RNA, 15 nt, Staphylococcus aureus subsp. aureus Mu50
aacuaauaauuugua

SEQ ID NO: 2077730 - RNA, 17 nt, Staphylococcus aureus subsp. aureus Mu50
aacuagaaaacauaaau

SEQ ID NO: 2077731 - RNA, 18 nt, Staphylococcus aureus subsp. aureus Mu50
aacuagaaaacauaaaua

SEQ ID NO: 2077732 - RNA, 15 nt, Staphylococcus aureus subsp. aureus Mu50
aacuauugaaaauag

SEQ ID NO: 2077733 - RNA, 22 nt, Staphylococcus aureus subsp. aureus Mu50
aacuaguguaaugucucuuuuc

SEQ ID NO: 2077734 - RNA, 14 nt, Staphylococcus aureus subsp. aureus Mu50
aacuauaaucauua

SEQ ID NO: 2077735 - RNA, 14 nt, Staphylococcus aureus subsp. aureus Mu50
aacuauaacaauag

SEQ ID NO: 2077736 - RNA, 16 nt, Staphylococcus aureus subsp. aureus Mu50
aacuacgcauuuuaaa

SEQ ID NO: 2077737 - RNA, 23 nt, Staphylococcus aureus subsp. aureus Mu50
aacuacgcauuuuaaauaaaaug

SEQ ID NO: 2077738 - RNA, 16 nt, Staphylococcus aureus subsp. aureus Mu50
aacuacugcaacacca

SEQ ID NO: 2077739 - RNA, 22 nt, Staphylococcus aureus subsp. aureus Mu50
aacuacacacguagaaagaugu

SEQ ID NO: 2077740 - RNA, 20 nt, Staphylococcus aureus subsp. aureus Mu50
aacgguacagauaagaauau

SEQ ID NO: 2077741 - RNA, 18 nt, Staphylococcus aureus subsp. aureus Mu50
aacgguaaauaaccacuu

SEQ ID NO: 2077742 - RNA, 16 nt, Staphylococcus aureus subsp. aureus Mu50
aacgguuguauuucau

SEQ ID NO: 2077743 - RNA, 14 nt, Staphylococcus aureus subsp. aureus Mu50
aacgguagaauaaa

SEQ ID NO: 2077744 - RNA, 16 nt, Staphylococcus aureus subsp. aureus Mu50
aacgguagaauaaaag

SEQ ID NO: 2077745 - RNA, 19 nt, Staphylococcus aureus subsp. aureus Mu50
aacgguaucaacauauuua

SEQ ID NO: 2077746 - RNA, 17 nt, Staphylococcus aureus subsp. aureus Mu50
aacgcuuuauuacuuua

SEQ ID NO: 2077747 - RNA, 20 nt, Staphylococcus aureus subsp. aureus Mu50
aacgcuugaaaaauuuuacu

SEQ ID NO: 2077748 - RNA, 14 nt, Staphylococcus aureus subsp. aureus Mu50
aacggaaauaacca

SEQ ID NO: 2077749 - RNA, 16 nt, Staphylococcus aureus subsp. aureus Mu50
aacgccucaacacuuu

SEQ ID NO: 2077750 - RNA, 17 nt, Staphylococcus aureus subsp. aureus Mu50
aacgaugcuacuuaaag

SEQ ID NO: 2077751 - RNA, 13 nt, Staphylococcus aureus subsp. aureus Mu50
aacgauauuuuaa

SEQ ID NO: 2077752 - RNA, 24 nt, Staphylococcus aureus subsp. aureus Mu50
aagcuucauauuuagguaauacau

SEQ ID NO: 2077753 - RNA, 13 nt, Staphylococcus aureus subsp. aureus Mu50
aaggaaagcuuca

SEQ ID NO: 2077754 - RNA, 18 nt, Staphylococcus aureus subsp. aureus Mu50
aagcugauuuuucauuga

SEQ ID NO: 2077755 - RNA, 23 nt, Staphylococcus aureus subsp. aureus Mu50
aagcugauuucuaucaaauaaug

SEQ ID NO: 2077756 - RNA, 14 nt, Staphylococcus aureus subsp. aureus Mu50
aagcugauuucuau

SEQ ID NO: 2077757 - RNA, 17 nt, Staphylococcus aureus subsp. aureus Mu50
aagcugaugugacaaag

SEQ ID NO: 2077758 - RNA, 14 nt, Staphylococcus aureus subsp. aureus Mu50
aagcugauuaaaau

SEQ ID NO: 2077759 - RNA, 19 nt, Staphylococcus aureus subsp. aureus Mu50
aagcugacgaaaagucagc

SEQ ID NO: 2077760 - RNA, 15 nt, Staphylococcus aureus subsp. aureus Mu50
aagcugagcuuuaau

SEQ ID NO: 2077761 - RNA, 23 nt, Staphylococcus aureus subsp. aureus Mu50
aagcugugcugucauuuucugcu

SEQ ID NO: 2077762 - RNA, 13 nt, Staphylococcus aureus subsp. aureus Mu50
aagcuuauuaaau

SEQ ID NO: 2077763 - RNA, 20 nt, Staphylococcus aureus subsp. aureus Mu50
aagcugcgauauaacuaaaa

SEQ ID NO: 2077764 - RNA, 13 nt, Staphylococcus aureus subsp. aureus Mu50
aagcuaaugcaag

SEQ ID NO: 2077765 - RNA, 15 nt, Staphylococcus aureus subsp. aureus Mu50
aagcguucaauuuuu

SEQ ID NO: 2077766 - RNA, 21 nt, Staphylococcus aureus subsp. aureus Mu50
aagcguucgugauagaaguuu

SEQ ID NO: 2077767 - RNA, 15 nt, Staphylococcus aureus subsp. aureus Mu50
aagcuaaauguuaau

SEQ ID NO: 2077768 - RNA, 20 nt, Staphylococcus aureus subsp. aureus Mu50
aagcuaaauguuaaugcuuc

SEQ ID NO: 2077769 - RNA, 14 nt, Staphylococcus aureus subsp. aureus Mu50
aagcuaaguuugaa

SEQ ID NO: 2077770 - RNA, 16 nt, Staphylococcus aureus subsp. aureus Mu50
aagcguaugauguugu

SEQ ID NO: 2077771 - RNA, 17 nt, Staphylococcus aureus subsp. aureus Mu50
aagcgcuuggauuuuuu

SEQ ID NO: 2077772 - RNA, 22 nt, Staphylococcus aureus subsp. aureus Mu50
aaggguguuuagauagcucuau

SEQ ID NO: 2077773 - RNA, 15 nt, Staphylococcus aureus subsp. aureus Mu50
aagggagguauauac

SEQ ID NO: 2077774 - RNA, 21 nt, Staphylococcus aureus subsp. aureus Mu50
aagggaucggucuugaaaacc

SEQ ID NO: 2077775 - RNA, 14 nt, Staphylococcus aureus subsp. aureus Mu50
aaggccugcaucac

SEQ ID NO: 2077776 - RNA, 15 nt, Staphylococcus aureus subsp. aureus Mu50
aagguauucuauuuu

SEQ ID NO: 2077777 - RNA, 19 nt, Staphylococcus aureus subsp. aureus Mu50
aagguguucgggaauuuuu

SEQ ID NO: 2077778 - RNA, 15 nt, Staphylococcus aureus subsp. aureus Mu50
aaggugauugaacaa

SEQ ID NO: 2077779 - RNA, 22 nt, Staphylococcus aureus subsp. aureus Mu50
aaguaaagggagguauauacaa

SEQ ID NO: 2077780 - RNA, 22 nt, Staphylococcus aureus subsp. aureus Mu50
aagguuguuuuucaucauuaaa

SEQ ID NO: 2077781 - RNA, 23 nt, Staphylococcus aureus subsp. aureus Mu50
aagguucuuuuuuuaccuaauug

SEQ ID NO: 2077782 - RNA, 14 nt, Staphylococcus aureus subsp. aureus Mu50
aagccaucuuucuu

SEQ ID NO: 2077783 - RNA, 19 nt, Staphylococcus aureus subsp. aureus Mu50
aagcaucguaaaaaacaaa

SEQ ID NO: 2077784 - RNA, 20 nt, Staphylococcus aureus subsp. aureus Mu50
aagcaugauacucaauaaaa

SEQ ID NO: 2077785 - RNA, 15 nt, Staphylococcus aureus subsp. aureus Mu50
aagcauaccuacaga

SEQ ID NO: 2077786 - RNA, 14 nt, Staphylococcus aureus subsp. aureus Mu50
aagcaucauauaca

SEQ ID NO: 2077787 - RNA, 17 nt, Staphylococcus aureus subsp. aureus Mu50
aagcaucauauacauac

SEQ ID NO: 2077788 - RNA, 16 nt, Staphylococcus aureus subsp. aureus Mu50
aagcaguuguugguuu

SEQ ID NO: 2077789 - RNA, 23 nt, Staphylococcus aureus subsp. aureus Mu50
aagauuuguagcuugaauaauau

SEQ ID NO: 2077790 - RNA, 20 nt, Staphylococcus aureus subsp. aureus Mu50
aagauuuguagcuugaauaa

SEQ ID NO: 2077791 - RNA, 17 nt, Staphylococcus aureus subsp. aureus Mu50
aagauuuaauaaagugu

SEQ ID NO: 2077792 - RNA, 20 nt, Staphylococcus aureus subsp. aureus Mu50
aagcaauuauggagcggaag

SEQ ID NO: 2077793 - RNA, 18 nt, Staphylococcus aureus subsp. aureus Mu50
aagauuauuauuacaaug

SEQ ID NO: 2077794 - RNA, 22 nt, Staphylococcus aureus subsp. aureus Mu50
aagauuagaugauauuuaacaa

SEQ ID NO: 2077795 - RNA, 17 nt, Staphylococcus aureus subsp. aureus Mu50
aagauuaguagucaaaa

SEQ ID NO: 2077796 - RNA, 15 nt, Staphylococcus aureus subsp. aureus Mu50
aagaugcuuuaauua

SEQ ID NO: 2077797 - RNA, 18 nt, Staphylococcus aureus subsp. aureus Mu50
aagaugcuuuaauuaaag

SEQ ID NO: 2077798 - RNA, 22 nt, Staphylococcus aureus subsp. aureus Mu50
aagaugguuugaguaaauuaau

SEQ ID NO: 2077799 - RNA, 22 nt, Staphylococcus aureus subsp. aureus Mu50
aagaugugcaucccgaaaguua

SEQ ID NO: 2077800 - RNA, 18 nt, Staphylococcus aureus subsp. aureus Mu50
aagaauguuucauaugca

SEQ ID NO: 2077801 - RNA, 21 nt, Staphylococcus aureus subsp. aureus Mu50
aagaauccuaugccaaauaac

SEQ ID NO: 2077802 - RNA, 13 nt, Staphylococcus aureus subsp. aureus Mu50
aagaauuauucaa

SEQ ID NO: 2077803 - RNA, 22 nt, Staphylococcus aureus subsp. aureus Mu50
aagaauuaacaacaaauauaau

SEQ ID NO: 2077804 - RNA, 21 nt, Staphylococcus aureus subsp. aureus Mu50
aagaauuaauucgccuaaaug

SEQ ID NO: 2077805 - RNA, 23 nt, Staphylococcus aureus subsp. aureus Mu50
aagaauuaauucgccuaaauggu

SEQ ID NO: 2077806 - RNA, 19 nt, Staphylococcus aureus subsp. aureus Mu50
aagaugauuauucucuuua

SEQ ID NO: 2077807 - RNA, 21 nt, Staphylococcus aureus subsp. aureus Mu50
aagaugaaauauucuuuaaua

SEQ ID NO: 2077808 - RNA, 20 nt, Staphylococcus aureus subsp. aureus Mu50
aagaugaaaaagucuuucuc

SEQ ID NO: 2077809 - RNA, 16 nt, Staphylococcus aureus subsp. aureus Mu50
aauacuucauauccuu

SEQ ID NO: 2077810 - RNA, 15 nt, Staphylococcus aureus subsp. aureus Mu50
aauacuucguuauau

SEQ ID NO: 2077811 - RNA, 16 nt, Staphylococcus aureus subsp. aureus Mu50
aauacuguauuuuaac

SEQ ID NO: 2077812 - RNA, 13 nt, Staphylococcus aureus subsp. aureus Mu50
aauacucuucaau

SEQ ID NO: 2077813 - RNA, 16 nt, Staphylococcus aureus subsp. aureus Mu50
aauacucccuucaaca

SEQ ID NO: 2077814 - RNA, 18 nt, Staphylococcus aureus subsp. aureus Mu50
aauacucccgcauuauua

SEQ ID NO: 2077815 - RNA, 12 nt, Staphylococcus aureus subsp. aureus Mu50
aauacucacauu

SEQ ID NO: 2077816 - RNA, 18 nt, Staphylococcus aureus subsp. aureus Mu50
aauacuauacugaugaaa

SEQ ID NO: 2077817 - RNA, 14 nt, Staphylococcus aureus subsp. aureus Mu50
aauacuauauauaa

SEQ ID NO: 2077818 - RNA, 21 nt, Staphylococcus aureus subsp. aureus Mu50
aauacucaacacgauagucau

SEQ ID NO: 2077819 - RNA, 24 nt, Staphylococcus aureus subsp. aureus Mu50
aauacuacuuaaugacuucuuuau

SEQ ID NO: 2077820 - RNA, 20 nt, Staphylococcus aureus subsp. aureus Mu50
aauacuaccguuuuuauaua

SEQ ID NO: 2077821 - RNA, 22 nt, Staphylococcus aureus subsp. aureus Mu50
aauacuaccguuuuuauauacu

SEQ ID NO: 2077822 - RNA, 14 nt, Staphylococcus aureus subsp. aureus Mu50
aauacuauacugau

SEQ ID NO: 2077823 - RNA, 14 nt, Staphylococcus aureus subsp. aureus Mu50
aauacuaaucaaag

SEQ ID NO: 2077824 - RNA, 20 nt, Staphylococcus aureus subsp. aureus Mu50
aauacuaauuucuauagaaa

SEQ ID NO: 2077825 - RNA, 18 nt, Staphylococcus aureus subsp. aureus Mu50
aauacuaaucaaagaaaa

SEQ ID NO: 2077826 - RNA, 21 nt, Staphylococcus aureus subsp. aureus Mu50
aauacuacacuccccuuauca

SEQ ID NO: 2077827 - RNA, 22 nt, Staphylococcus aureus subsp. aureus Mu50
aauacuacacuccccuuaucaa

SEQ ID NO: 2077828 - RNA, 14 nt, Staphylococcus aureus subsp. aureus Mu50
aauacuacauauaa

SEQ ID NO: 2077829 - RNA, 16 nt, Staphylococcus aureus subsp. aureus Mu50
aauagagaacuugcuu

SEQ ID NO: 2077830 - RNA, 14 nt, Staphylococcus aureus subsp. aureus Mu50
aauagaaauaauca

SEQ ID NO: 2077831 - RNA, 12 nt, Staphylococcus aureus subsp. aureus Mu50
aauagaaauaau

SEQ ID NO: 2077832 - RNA, 14 nt, Staphylococcus aureus subsp. aureus Mu50
aauagagaaagaau

SEQ ID NO: 2077833 - RNA, 16 nt, Staphylococcus aureus subsp. aureus Mu50
aauagagaaagaauaa

SEQ ID NO: 2077834 - RNA, 18 nt, Staphylococcus aureus subsp. aureus Mu50
aauacuuucacuuuuuau

SEQ ID NO: 2077835 - RNA, 22 nt, Staphylococcus aureus subsp. aureus Mu50
aauacuuucaaacaaaucuuuu

SEQ ID NO: 2077836 - RNA, 17 nt, Staphylococcus aureus subsp. aureus Mu50
aauacuuucacuuuuua

SEQ ID NO: 2077837 - RNA, 16 nt, Staphylococcus aureus subsp. aureus Mu50
aauacuuuauuugaua

SEQ ID NO: 2077838 - RNA, 17 nt, Staphylococcus aureus subsp. aureus Mu50
aauacuuuauuugauaa

SEQ ID NO: 2077839 - RNA, 13 nt, Staphylococcus aureus subsp. aureus Mu50
aauacuugaaaga

SEQ ID NO: 2077840 - RNA, 17 nt, Staphylococcus aureus subsp. aureus Mu50
aauagaaaaauuucaaa

SEQ ID NO: 2077841 - RNA, 12 nt, Staphylococcus aureus subsp. aureus Mu50
aauacuuuuuga

SEQ ID NO: 2077842 - RNA, 14 nt, Staphylococcus aureus subsp. aureus Mu50
aauacuuuuuaacu

SEQ ID NO: 2077843 - RNA, 13 nt, Staphylococcus aureus subsp. aureus Mu50
aauacuuuuuaac

SEQ ID NO: 2077844 - RNA, 18 nt, Staphylococcus aureus subsp. aureus Mu50
aauaccgccuacuguuuc

SEQ ID NO: 2077845 - RNA, 22 nt, Staphylococcus aureus subsp. aureus Mu50
aauacgacaccaacauauuuua

SEQ ID NO: 2077846 - RNA, 16 nt, Staphylococcus aureus subsp. aureus Mu50
aauacgaauuucauag

SEQ ID NO: 2077847 - RNA, 17 nt, Staphylococcus aureus subsp. aureus Mu50
aauacauacugauuaaa

SEQ ID NO: 2077848 - RNA, 15 nt, Staphylococcus aureus subsp. aureus Mu50
aauacauaaugguuc

SEQ ID NO: 2077849 - RNA, 11 nt, Staphylococcus aureus subsp. aureus Mu50
aauacaucuaa

SEQ ID NO: 2077850 - RNA, 16 nt, Staphylococcus aureus subsp. aureus Mu50
aauacauccauacuuc

SEQ ID NO: 2077851 - RNA, 15 nt, Staphylococcus aureus subsp. aureus Mu50
aauacaugaguaaaa

SEQ ID NO: 2077852 - RNA, 22 nt, Staphylococcus aureus subsp. aureus Mu50
aauacaugaguaaaacucaugc

SEQ ID NO: 2077853 - RNA, 17 nt, Staphylococcus aureus subsp. aureus Mu50
aauacaucuaauaaaua

SEQ ID NO: 2077854 - RNA, 19 nt, Staphylococcus aureus subsp. aureus Mu50
aauacaucuaauaaauaua

SEQ ID NO: 2077855 - RNA, 16 nt, Staphylococcus aureus subsp. aureus Mu50
aauacgauaauaacua

SEQ ID NO: 2077856 - RNA, 16 nt, Staphylococcus aureus subsp. aureus Mu50
aauacguuuaauguau

SEQ ID NO: 2077857 - RNA, 20 nt, Staphylococcus aureus subsp. aureus Mu50
aauacguuuaauaaugguuc

SEQ ID NO: 2077858 - RNA, 20 nt, Staphylococcus aureus subsp. aureus Mu50
aauacguguguuuucuuuuc

SEQ ID NO: 2077859 - RNA, 15 nt, Staphylococcus aureus subsp. aureus Mu50
aauacgucaucuuua

SEQ ID NO: 2077860 - RNA, 14 nt, Staphylococcus aureus subsp. aureus Mu50
aauaauauauuuag

SEQ ID NO: 2077861 - RNA, 13 nt, Staphylococcus aureus subsp. aureus Mu50
aauaauauaaaaa

SEQ ID NO: 2077862 - RNA, 16 nt, Staphylococcus aureus subsp. aureus Mu50
aauaauauaaaacgau

SEQ ID NO: 2077863 - RNA, 19 nt, Staphylococcus aureus subsp. aureus Mu50
aauaauaugccauaguaau

SEQ ID NO: 2077864 - RNA, 12 nt, Staphylococcus aureus subsp. aureus Mu50
aauaaucaaacc

SEQ ID NO: 2077865 - RNA, 15 nt, Staphylococcus aureus subsp. aureus Mu50
aaaaaucaaagaggc

SEQ ID NO: 2077866 - RNA, 10 nt, Staphylococcus aureus subsp. aureus Mu50
aaaaaucaaa

SEQ ID NO: 2077867 - RNA, 14 nt, Staphylococcus aureus subsp. aureus Mu50
aaaaauauugaaua

SEQ ID NO: 2077868 - RNA, 20 nt, Staphylococcus aureus subsp. aureus Mu50
aaaaauauugcguuuaauuu

SEQ ID NO: 2077869 - RNA, 12 nt, Staphylococcus aureus subsp. aureus Mu50
aaaaauauccug

SEQ ID NO: 2077870 - RNA, 18 nt, Staphylococcus aureus subsp. aureus Mu50
aauaauacgcuugauaaa

SEQ ID NO: 2077871 - RNA, 17 nt, Staphylococcus aureus subsp. aureus Mu50
aauaauaccuucaauug

SEQ ID NO: 2077872 - RNA, 23 nt, Staphylococcus aureus subsp. aureus Mu50
aaaaauaaucccggaacuaauuu

SEQ ID NO: 2077873 - RNA, 17 nt, Staphylococcus aureus subsp. aureus Mu50
aaaaauaauagcaaaau

SEQ ID NO: 2077874 - RNA, 13 nt, Staphylococcus aureus subsp. aureus Mu50
aaaaauacauaau

SEQ ID NO: 2077875 - RNA, 15 nt, Staphylococcus aureus subsp. aureus Mu50
aaaaauaauuaugaa

SEQ ID NO: 2077876 - RNA, 19 nt, Staphylococcus aureus subsp. aureus Mu50
aaaaauaauuaugaaaagu

SEQ ID NO: 2077877 - RNA, 23 nt, Staphylococcus aureus subsp. aureus Mu50
aauaaccuuuaaaacaucauuca

SEQ ID NO: 2077878 - RNA, 22 nt, Staphylococcus aureus subsp. aureus Mu50
aauaacuagauguucacauucu

SEQ ID NO: 2077879 - RNA, 16 nt, Staphylococcus aureus subsp. aureus Mu50
aauacaaauauuaagu

SEQ ID NO: 2077880 - RNA, 12 nt, Staphylococcus aureus subsp. aureus Mu50
aauacaaacccu

SEQ ID NO: 2077881 - RNA, 21 nt, Staphylococcus aureus subsp. aureus Mu50
aauacaaacccuuuaaacaua

SEQ ID NO: 2077882 - RNA, 16 nt, Staphylococcus aureus subsp. aureus Mu50
aauaauuuacauuaau

SEQ ID NO: 2077883 - RNA, 16 nt, Staphylococcus aureus subsp. aureus Mu50
aauaauuuaauauuua

SEQ ID NO: 2077884 - RNA, 20 nt, Staphylococcus aureus subsp. aureus Mu50
aauaauuggaaucaucuuuu

SEQ ID NO: 2077885 - RNA, 17 nt, Staphylococcus aureus subsp. aureus Mu50
aauaauuggcugaugaa

SEQ ID NO: 2077886 - RNA, 14 nt, Staphylococcus aureus subsp. aureus Mu50
aauaauugaugaaa

SEQ ID NO: 2077887 - RNA, 19 nt, Staphylococcus aureus subsp. aureus Mu50
aauaauugcuuuagaaagu

SEQ ID NO: 2077888 - RNA, 16 nt, Staphylococcus aureus subsp. aureus Mu50
aauaauuggaaucauc

SEQ ID NO: 2077889 - RNA, 19 nt, Staphylococcus aureus subsp. aureus Mu50
aauacagcuagcaagaaua

SEQ ID NO: 2077890 - RNA, 16 nt, Staphylococcus aureus subsp. aureus Mu50
aauacaagucuuuacu

SEQ ID NO: 2077891 - RNA, 19 nt, Staphylococcus aureus subsp. aureus Mu50
aauaaucggacugauggaa

SEQ ID NO: 2077892 - RNA, 21 nt, Staphylococcus aureus subsp. aureus Mu50
aauaaucguaaacacuauaaa

SEQ ID NO: 2077893 - RNA, 21 nt, Staphylococcus aureus subsp. aureus Mu50
aauaaucgguaauuacuugua

SEQ ID NO: 2077894 - RNA, 23 nt, Staphylococcus aureus subsp. aureus Mu50
aauaaucccaaccauucuaccag

SEQ ID NO: 2077895 - RNA, 16 nt, Staphylococcus aureus subsp. aureus Mu50
aauaaucauccauaua

SEQ ID NO: 2077896 - RNA, 18 nt, Staphylococcus aureus subsp. aureus Mu50
aauaauucauaaaugcuu

SEQ ID NO: 2077897 - RNA, 19 nt, Staphylococcus aureus subsp. aureus Mu50
aauaauucauaaaugcuuc

SEQ ID NO: 2077898 - RNA, 23 nt, Staphylococcus aureus subsp. aureus Mu50
aauaauguuuccugauauuucaa

SEQ ID NO: 2077899 - RNA, 15 nt, Staphylococcus aureus subsp. aureus Mu50
aauaauuacuaaccu

SEQ ID NO: 2077900 - RNA, 12 nt, Staphylococcus aureus subsp. aureus Mu50
aauaauuaaaaa

SEQ ID NO: 2077901 - RNA, 12 nt, Staphylococcus aureus subsp. aureus Mu50
aauaauuaaaua

SEQ ID NO: 2077902 - RNA, 16 nt, Staphylococcus aureus subsp. aureus Mu50
aauaauuaaauaaaaa

SEQ ID NO: 2077903 - RNA, 17 nt, Staphylococcus aureus subsp. aureus Mu50
aauaauuaaauaaaaau

SEQ ID NO: 2077904 - RNA, 14 nt, Staphylococcus aureus subsp. aureus Mu50
aaguguaaaugaaa

SEQ ID NO: 2077905 - RNA, 19 nt, Staphylococcus aureus subsp. aureus Mu50
aaguuagacuaaaaaacua

SEQ ID NO: 2077906 - RNA, 15 nt, Staphylococcus aureus subsp. aureus Mu50
aaguuacuuacgcca

SEQ ID NO: 2077907 - RNA, 22 nt, Staphylococcus aureus subsp. aureus Mu50
aaguuauaucaucaacaaucuu

SEQ ID NO: 2077908 - RNA, 15 nt, Staphylococcus aureus subsp. aureus Mu50
aaguuauaaauuaua

SEQ ID NO: 2077909 - RNA, 17 nt, Staphylococcus aureus subsp. aureus Mu50
aaguuauaaauuauauu

SEQ ID NO: 2077910 - RNA, 13 nt, Staphylococcus aureus subsp. aureus Mu50
aaguucuagauua

SEQ ID NO: 2077911 - RNA, 13 nt, Staphylococcus aureus subsp. aureus Mu50
aaguuuccuaucu

SEQ ID NO: 2077912 - RNA, 23 nt, Staphylococcus aureus subsp. aureus Mu50
aaguuuguauauucuuuuuaacu

SEQ ID NO: 2077913 - RNA, 22 nt, Staphylococcus aureus subsp. aureus Mu50
aaguuucgcagcuuuauaaugu

SEQ ID NO: 2077914 - RNA, 18 nt, Staphylococcus aureus subsp. aureus Mu50
aaguugcugaauaaaaua

SEQ ID NO: 2077915 - RNA, 18 nt, Staphylococcus aureus subsp. aureus Mu50
aaguuggcuggcccccaa

SEQ ID NO: 2077916 - RNA, 19 nt, Staphylococcus aureus subsp. aureus Mu50
aaguuggcggggccccaac

SEQ ID NO: 2077917 - RNA, 23 nt, Staphylococcus aureus subsp. aureus Mu50
aaguuggcggggccccaacacag

SEQ ID NO: 2077918 - RNA, 15 nt, Staphylococcus aureus subsp. aureus Mu50
aaguugcauauaaaa

SEQ ID NO: 2077919 - RNA, 17 nt, Staphylococcus aureus subsp. aureus Mu50
aaguugcacauuauaaa

SEQ ID NO: 2077920 - RNA, 14 nt, Staphylococcus aureus subsp. aureus Mu50
aaguucuuuuguaa

SEQ ID NO: 2077921 - RNA, 14 nt, Staphylococcus aureus subsp. aureus Mu50
aaguugaaaaccuc

SEQ ID NO: 2077922 - RNA, 15 nt, Staphylococcus aureus subsp. aureus Mu50
aaguaauauauaaaa

SEQ ID NO: 2077923 - RNA, 21 nt, Staphylococcus aureus subsp. aureus Mu50
aaguaauaugagugaaaguuu

SEQ ID NO: 2077924 - RNA, 20 nt, Staphylococcus aureus subsp. aureus Mu50
aaguaauaauauaaauaaaa

SEQ ID NO: 2077925 - RNA, 18 nt, Staphylococcus aureus subsp. aureus Mu50
aaguaauaaguaauaauu

SEQ ID NO: 2077926 - RNA, 22 nt, Staphylococcus aureus subsp. aureus Mu50
aaguaauccccgaagcacagaa

SEQ ID NO: 2077927 - RNA, 21 nt, Staphylococcus aureus subsp. aureus Mu50
aagucuguugguuuaucagcu

SEQ ID NO: 2077928 - RNA, 23 nt, Staphylococcus aureus subsp. aureus Mu50
aagucuguugguuuaucagcuuu

SEQ ID NO: 2077929 - RNA, 17 nt, Staphylococcus aureus subsp. aureus Mu50
aagucugaugucgaaaa

SEQ ID NO: 2077930 - RNA, 20 nt, Staphylococcus aureus subsp. aureus Mu50
aagucugaugucgaaaauag

SEQ ID NO: 2077931 - RNA, 13 nt, Staphylococcus aureus subsp. aureus Mu50
aaguaacucaagu

SEQ ID NO: 2077932 - RNA, 20 nt, Staphylococcus aureus subsp. aureus Mu50
aaguaacauacuauaaaaau

SEQ ID NO: 2077933 - RNA, 16 nt, Staphylococcus aureus subsp. aureus Mu50
aaguaagcaccuguua

SEQ ID NO: 2077934 - RNA, 14 nt, Staphylococcus aureus subsp. aureus Mu50
aaguaauaaaauaa

SEQ ID NO: 2077935 - RNA, 12 nt, Staphylococcus aureus subsp. aureus Mu50
aaguaaguaaaa

SEQ ID NO: 2077936 - RNA, 13 nt, Staphylococcus aureus subsp. aureus Mu50
aaguaaguaaaau

SEQ ID NO: 2077937 - RNA, 21 nt, Staphylococcus aureus subsp. aureus Mu50
aagugauuuaaaaaauuuaau

SEQ ID NO: 2077938 - RNA, 19 nt, Staphylococcus aureus subsp. aureus Mu50
aagugcagauguugguuca

SEQ ID NO: 2077939 - RNA, 19 nt, Staphylococcus aureus subsp. aureus Mu50
aagugaugaccaauauucu

SEQ ID NO: 2077940 - RNA, 15 nt, Staphylococcus aureus subsp. aureus Mu50
aagugaugaccaaua

SEQ ID NO: 2077941 - RNA, 14 nt, Staphylococcus aureus subsp. aureus Mu50
aagugauaauuaaa

SEQ ID NO: 2077942 - RNA, 19 nt, Staphylococcus aureus subsp. aureus Mu50
aagucuuuacucuacacuc

SEQ ID NO: 2077943 - RNA, 20 nt, Staphylococcus aureus subsp. aureus Mu50
aagugcuugauuaacauuuu

SEQ ID NO: 2077944 - RNA, 15 nt, Staphylococcus aureus subsp. aureus Mu50
aagugcucaaauuuu

SEQ ID NO: 2077945 - RNA, 23 nt, Staphylococcus aureus subsp. aureus Mu50
aagugcuaagagguauacaguua

SEQ ID NO: 2077946 - RNA, 17 nt, Staphylococcus aureus subsp. aureus Mu50
aagugcuugguuaaagu

SEQ ID NO: 2077947 - RNA, 18 nt, Staphylococcus aureus subsp. aureus Mu50
aauaacaaaauuaaauau

SEQ ID NO: 2077948 - RNA, 13 nt, Staphylococcus aureus subsp. aureus Mu50
aauaaauuuuaua

SEQ ID NO: 2077949 - RNA, 21 nt, Staphylococcus aureus subsp. aureus Mu50
aauaaauuuagauauuauaaa

SEQ ID NO: 2077950 - RNA, 18 nt, Staphylococcus aureus subsp. aureus Mu50
aauaaauugacucaaaga

SEQ ID NO: 2077951 - RNA, 18 nt, Staphylococcus aureus subsp. aureus Mu50
aauaaauuguaugaauaa

SEQ ID NO: 2077952 - RNA, 19 nt, Staphylococcus aureus subsp. aureus Mu50
aauaaauuguaugaauaau

SEQ ID NO: 2077953 - RNA, 17 nt, Staphylococcus aureus subsp. aureus Mu50
aauaaauuguauuucuu

SEQ ID NO: 2077954 - RNA, 17 nt, Staphylococcus aureus subsp. aureus Mu50
aauaaauagauaauaua

SEQ ID NO: 2077955 - RNA, 14 nt, Staphylococcus aureus subsp. aureus Mu50
aauaaauuaaauuu

SEQ ID NO: 2077956 - RNA, 21 nt, Staphylococcus aureus subsp. aureus Mu50
aauaacaaucaaagagccaga

SEQ ID NO: 2077957 - RNA, 16 nt, Staphylococcus aureus subsp. aureus Mu50
aauaacaccaauugaa

SEQ ID NO: 2077958 - RNA, 15 nt, Staphylococcus aureus subsp. aureus Mu50
aauaacaccaauuga

SEQ ID NO: 2077959 - RNA, 22 nt, Staphylococcus aureus subsp. aureus Mu50
aauaacacgauuugguugaacu

SEQ ID NO: 2077960 - RNA, 19 nt, Staphylococcus aureus subsp. aureus Mu50
aauaacauccccaaaaaua

SEQ ID NO: 2077961 - RNA, 19 nt, Staphylococcus aureus subsp. aureus Mu50
aauaacaggugcuuacuuu

SEQ ID NO: 2077962 - RNA, 22 nt, Staphylococcus aureus subsp. aureus Mu50
aauaaagcugauuuuucauuga

SEQ ID NO: 2077963 - RNA, 17 nt, Staphylococcus aureus subsp. aureus Mu50
aauaaaggcaacaaaua

SEQ ID NO: 2077964 - RNA, 14 nt, Staphylococcus aureus subsp. aureus Mu50
aauaaauacaaugu

SEQ ID NO: 2077965 - RNA, 21 nt, Staphylococcus aureus subsp. aureus Mu50
aauaaauaggaugaaaaagau

SEQ ID NO: 2077966 - RNA, 22 nt, Staphylococcus aureus subsp. aureus Mu50
aauaaauagacugccaauaaaa

SEQ ID NO: 2077967 - RNA, 19 nt, Staphylococcus aureus subsp. aureus Mu50
aauaaauaagcaaucauaa

SEQ ID NO: 2077968 - RNA, 21 nt, Staphylococcus aureus subsp. aureus Mu50
aauaaaccuacaauauagaaa

SEQ ID NO: 2077969 - RNA, 22 nt, Staphylococcus aureus subsp. aureus Mu50
aauaaaccgauuguuucaccag

SEQ ID NO: 2077970 - RNA, 18 nt, Staphylococcus aureus subsp. aureus Mu50
aauaaacuuuaugaaauu

SEQ ID NO: 2077971 - RNA, 14 nt, Staphylococcus aureus subsp. aureus Mu50
aauaaaaucaaagc

SEQ ID NO: 2077972 - RNA, 13 nt, Staphylococcus aureus subsp. aureus Mu50
aauaaaauauauc

SEQ ID NO: 2077973 - RNA, 15 nt, Staphylococcus aureus subsp. aureus Mu50
aauaaaauauaucuu

SEQ ID NO: 2077974 - RNA, 19 nt, Staphylococcus aureus subsp. aureus Mu50
aauaaaaggcuuuguuaaa

SEQ ID NO: 2077975 - RNA, 18 nt, Staphylococcus aureus subsp. aureus Mu50
aauaaaaggcuuuguuaa

SEQ ID NO: 2077976 - RNA, 15 nt, Staphylococcus aureus subsp. aureus Mu50
aauaaaauucuauaa

SEQ ID NO: 2077977 - RNA, 13 nt, Staphylococcus aureus subsp. aureus Mu50
aauaaaauuaaaa

SEQ ID NO: 2077978 - RNA, 16 nt, Staphylococcus aureus subsp. aureus Mu50
aauaaacaacuaaagg

SEQ ID NO: 2077979 - RNA, 15 nt, Staphylococcus aureus subsp. aureus Mu50
aauaaacaacugcaa

SEQ ID NO: 2077980 - RNA, 13 nt, Staphylococcus aureus subsp. aureus Mu50
aaguuuucauuua

SEQ ID NO: 2077981 - RNA, 20 nt, Staphylococcus aureus subsp. aureus Mu50
aaguuugucuuugaacauau

SEQ ID NO: 2077982 - RNA, 13 nt, Staphylococcus aureus subsp. aureus Mu50
aaguuuuucaggg

SEQ ID NO: 2077983 - RNA, 13 nt, Staphylococcus aureus subsp. aureus Mu50
aaguuuuugaaua

SEQ ID NO: 2077984 - RNA, 21 nt, Staphylococcus aureus subsp. aureus Mu50
aauaaaaaaaucacgcuaaca

SEQ ID NO: 2077985 - RNA, 17 nt, Staphylococcus aureus subsp. aureus Mu50
aauaaaaauacauaauu

SEQ ID NO: 2077986 - RNA, 13 nt, Staphylococcus aureus subsp. aureus Mu50
aauaaaacaaauu

SEQ ID NO: 2077987 - RNA, 15 nt, Staphylococcus aureus subsp. aureus Mu50
aauaaaaauuauaua

SEQ ID NO: 2077988 - RNA, 12 nt, Staphylococcus aureus subsp. aureus Mu50
aauaaaaaugcc

SEQ ID NO: 2077989 - RNA, 19 nt, Staphylococcus aureus subsp. aureus Mu50
aauaaaaauuauauaaauu

SEQ ID NO: 2077990 - RNA, 16 nt, Staphylococcus aureus subsp. aureus Mu50
cggcacauucauaccg

SEQ ID NO: 2077991 - RNA, 22 nt, Staphylococcus aureus subsp. aureus Mu50
cggcacauucauaccgaagaaa

SEQ ID NO: 2077992 - RNA, 22 nt, Staphylococcus aureus subsp. aureus Mu50
cggaauugguuuuuagugaaaa

SEQ ID NO: 2077993 - RNA, 15 nt, Staphylococcus aureus subsp. aureus Mu50
cggaagauaggauuu

SEQ ID NO: 2077994 - RNA, 14 nt, Staphylococcus aureus subsp. aureus Mu50
cggaacuaauuuag

SEQ ID NO: 2077995 - RNA, 21 nt, Staphylococcus aureus subsp. aureus Mu50
cggaagcauauuucuaaauua

SEQ ID NO: 2077996 - RNA, 14 nt, Staphylococcus aureus subsp. aureus Mu50
cggaauaaaauaaa

SEQ ID NO: 2077997 - RNA, 14 nt, Staphylococcus aureus subsp. aureus Mu50
cgcuacaaaacaua

SEQ ID NO: 2077998 - RNA, 17 nt, Staphylococcus aureus subsp. aureus Mu50
cggaaaaagaugaaaaa

SEQ ID NO: 2077999 - RNA, 23 nt, Staphylococcus aureus subsp. aureus Mu50
cgcuuuuuuuauuuuucuuuuug

SEQ ID NO: 2078000 - RNA, 14 nt, Staphylococcus aureus subsp. aureus Mu50
cggcauuuuuauau

SEQ ID NO: 2078001 - RNA, 17 nt, Staphylococcus aureus subsp. aureus Mu50
cgauaaaaguuguauuc

SEQ ID NO: 2078002 - RNA, 17 nt, Staphylococcus aureus subsp. aureus Mu50
cgauaaauguauuaaac

SEQ ID NO: 2078003 - RNA, 11 nt, Staphylococcus aureus subsp. aureus Mu50
cgauaaauaau

SEQ ID NO: 2078004 - RNA, 11 nt, Staphylococcus aureus subsp. aureus Mu50
cgauaaaugua

SEQ ID NO: 2078005 - RNA, 12 nt, Staphylococcus aureus subsp. aureus Mu50
cgauaaaagaac

SEQ ID NO: 2078006 - RNA, 23 nt, Staphylococcus aureus subsp. aureus Mu50
cgaguuuguuucuaaauucuuuu

SEQ ID NO: 2078007 - RNA, 17 nt, Staphylococcus aureus subsp. aureus Mu50
cgauaccaaauauauuu

SEQ ID NO: 2078008 - RNA, 13 nt, Staphylococcus aureus subsp. aureus Mu50
cgauagauaucau

SEQ ID NO: 2078009 - RNA, 21 nt, Staphylococcus aureus subsp. aureus Mu50
cgauagauuuaucaccuuuag

SEQ ID NO: 2078010 - RNA, 20 nt, Staphylococcus aureus subsp. aureus Mu50
cgagcuuugcucauagauga

SEQ ID NO: 2078011 - RNA, 23 nt, Staphylococcus aureus subsp. aureus Mu50
cgagcuuagggcuuuguuuucug

SEQ ID NO: 2078012 - RNA, 16 nt, Staphylococcus aureus subsp. aureus Mu50
cgagcguaauggauua

SEQ ID NO: 2078013 - RNA, 12 nt, Staphylococcus aureus subsp. aureus Mu50
aaacggagcaac

SEQ ID NO: 2078014 - RNA, 13 nt, Staphylococcus aureus subsp. aureus Mu50
aaacggaaauaac

SEQ ID NO: 2078015 - RNA, 14 nt, Staphylococcus aureus subsp. aureus Mu50
aaacgcugauuuaa

SEQ ID NO: 2078016 - RNA, 17 nt, Staphylococcus aureus subsp. aureus Mu50
aaacgcugauuuuauaa

SEQ ID NO: 2078017 - RNA, 16 nt, Staphylococcus aureus subsp. aureus Mu50
cgacguuuaaaugccc

SEQ ID NO: 2078018 - RNA, 18 nt, Staphylococcus aureus subsp. aureus Mu50
cgagaaauuagaaccauc

SEQ ID NO: 2078019 - RNA, 15 nt, Staphylococcus aureus subsp. aureus Mu50
cgacuucgauaucaa

SEQ ID NO: 2078020 - RNA, 14 nt, Staphylococcus aureus subsp. aureus Mu50
cgacuuaacuuaag

SEQ ID NO: 2078021 - RNA, 11 nt, Staphylococcus aureus subsp. aureus Mu50
cgagaaucucc

SEQ ID NO: 2078022 - RNA, 13 nt, Staphylococcus aureus subsp. aureus Mu50
cgagcaauucuuc

SEQ ID NO: 2078023 - RNA, 23 nt, Staphylococcus aureus subsp. aureus Mu50
cgccaauacagaacuuuaauaau

SEQ ID NO: 2078024 - RNA, 16 nt, Staphylococcus aureus subsp. aureus Mu50
cgccaacuaauguuaa

SEQ ID NO: 2078025 - RNA, 15 nt, Staphylococcus aureus subsp. aureus Mu50
cgcaucaaaaaugag

SEQ ID NO: 2078026 - RNA, 13 nt, Staphylococcus aureus subsp. aureus Mu50
cgcaucauguaua

SEQ ID NO: 2078027 - RNA, 18 nt, Staphylococcus aureus subsp. aureus Mu50
cgcaucuccaaaggccau

SEQ ID NO: 2078028 - RNA, 20 nt, Staphylococcus aureus subsp. aureus Mu50
cgcaucuuuugguuuaucug

SEQ ID NO: 2078029 - RNA, 22 nt, Staphylococcus aureus subsp. aureus Mu50
cgcaauuuggugaaguaugaua

SEQ ID NO: 2078030 - RNA, 14 nt, Staphylococcus aureus subsp. aureus Mu50
cgcaauuuaauauu

SEQ ID NO: 2078031 - RNA, 16 nt, Staphylococcus aureus subsp. aureus Mu50
cgcaauuuuuaacaaa

SEQ ID NO: 2078032 - RNA, 13 nt, Staphylococcus aureus subsp. aureus Mu50
cgcaagagauaag

SEQ ID NO: 2078033 - RNA, 21 nt, Staphylococcus aureus subsp. aureus Mu50
cgauauguuuggauaucuuug

SEQ ID NO: 2078034 - RNA, 21 nt, Staphylococcus aureus subsp. aureus Mu50
cgaugaugauuuauaaaaacu

SEQ ID NO: 2078035 - RNA, 13 nt, Staphylococcus aureus subsp. aureus Mu50
cgauuuucaagua

SEQ ID NO: 2078036 - RNA, 20 nt, Staphylococcus aureus subsp. aureus Mu50
cgauuuuaaaagauaaauaa

SEQ ID NO: 2078037 - RNA, 12 nt, Staphylococcus aureus subsp. aureus Mu50
cgauuuuaaaga

SEQ ID NO: 2078038 - RNA, 15 nt, Staphylococcus aureus subsp. aureus Mu50
cgauuuguucaauga

SEQ ID NO: 2078039 - RNA, 22 nt, Staphylococcus aureus subsp. aureus Mu50
cgauuucuuuaugauaauaaga

SEQ ID NO: 2078040 - RNA, 12 nt, Staphylococcus aureus subsp. aureus Mu50
cgauugcaauug

SEQ ID NO: 2078041 - RNA, 13 nt, Staphylococcus aureus subsp. aureus Mu50
aaacguauguaca

SEQ ID NO: 2078042 - RNA, 22 nt, Staphylococcus aureus subsp. aureus Mu50
aaacgugcaaauaaaaaaguua

SEQ ID NO: 2078043 - RNA, 13 nt, Staphylococcus aureus subsp. aureus Mu50
aaacgugauuuua

SEQ ID NO: 2078044 - RNA, 21 nt, Staphylococcus aureus subsp. aureus Mu50
aaacgugcaaauaaaaaaguu

SEQ ID NO: 2078045 - RNA, 22 nt, Staphylococcus aureus subsp. aureus Mu50
aaacgucacuuuauuaaauaac

SEQ ID NO: 2078046 - RNA, 22 nt, Staphylococcus aureus subsp. aureus Mu50
aaacguccaaacacaaauaaag

SEQ ID NO: 2078047 - RNA, 18 nt, Staphylococcus aureus subsp. aureus Mu50
aaacguugaguauuacuu

SEQ ID NO: 2078048 - RNA, 22 nt, Staphylococcus aureus subsp. aureus Mu50
aaacguugaguauuacuugaaa

SEQ ID NO: 2078049 - RNA, 17 nt, Staphylococcus aureus subsp. aureus Mu50
aaaccuuacccaaaaaa

SEQ ID NO: 2078050 - RNA, 14 nt, Staphylococcus aureus subsp. aureus Mu50
aaaccuuacccaaa

SEQ ID NO: 2078051 - RNA, 21 nt, Staphylococcus aureus subsp. aureus Mu50
aaaccuuggcuucauguucua

SEQ ID NO: 2078052 - RNA, 16 nt, Staphylococcus aureus subsp. aureus Mu50
aaacgauucauuauau

SEQ ID NO: 2078053 - RNA, 22 nt, Staphylococcus aureus subsp. aureus Mu50
aaacgauugauuaucauaugaa

SEQ ID NO: 2078054 - RNA, 20 nt, Staphylococcus aureus subsp. aureus Mu50
aaaccucuaaauaaaauuaa

SEQ ID NO: 2078055 - RNA, 17 nt, Staphylococcus aureus subsp. aureus Mu50
aaaccucuaaauaaaau

SEQ ID NO: 2078056 - RNA, 16 nt, Staphylococcus aureus subsp. aureus Mu50
aaaccuagggauaauu

SEQ ID NO: 2078057 - RNA, 16 nt, Staphylococcus aureus subsp. aureus Mu50
ccggaacauuaaaagg

SEQ ID NO: 2078058 - RNA, 13 nt, Staphylococcus aureus subsp. aureus Mu50
ccggaaauuaaau

SEQ ID NO: 2078059 - RNA, 12 nt, Staphylococcus aureus subsp. aureus Mu50
ccgcuauaaaau

SEQ ID NO: 2078060 - RNA, 18 nt, Staphylococcus aureus subsp. aureus Mu50
aaaccgagaaucuccauu

SEQ ID NO: 2078061 - RNA, 23 nt, Staphylococcus aureus subsp. aureus Mu50
aaaccgcacuucuauauuaauag

SEQ ID NO: 2078062 - RNA, 12 nt, Staphylococcus aureus subsp. aureus Mu50
aaaccgauuaau

SEQ ID NO: 2078063 - RNA, 22 nt, Staphylococcus aureus subsp. aureus Mu50
aaaccgccaacuaauguuaaaa

SEQ ID NO: 2078064 - RNA, 20 nt, Staphylococcus aureus subsp. aureus Mu50
aaacccuuuaaacauauuua

SEQ ID NO: 2078065 - RNA, 18 nt, Staphylococcus aureus subsp. aureus Mu50
ccucucguaaauuguugu

SEQ ID NO: 2078066 - RNA, 15 nt, Staphylococcus aureus subsp. aureus Mu50
ccucugauaaaugaa

SEQ ID NO: 2078067 - RNA, 22 nt, Staphylococcus aureus subsp. aureus Mu50
ccucugauacuucaccaucuuu

SEQ ID NO: 2078068 - RNA, 19 nt, Staphylococcus aureus subsp. aureus Mu50
ccucguaggcauaggcuua

SEQ ID NO: 2078069 - RNA, 14 nt, Staphylococcus aureus subsp. aureus Mu50
ccucauaauuauca

SEQ ID NO: 2078070 - RNA, 11 nt, Staphylococcus aureus subsp. aureus Mu50
ccucauucaca

SEQ ID NO: 2078071 - RNA, 17 nt, Staphylococcus aureus subsp. aureus Mu50
aaacgccucaacacuuu

SEQ ID NO: 2078072 - RNA, 18 nt, Staphylococcus aureus subsp. aureus Mu50
ccuaugauauaugcugca

SEQ ID NO: 2078073 - RNA, 16 nt, Staphylococcus aureus subsp. aureus Mu50
ccuaugccaaauaacg

SEQ ID NO: 2078074 - RNA, 18 nt, Staphylococcus aureus subsp. aureus Mu50
ccuauuacacuaaaaccu

SEQ ID NO: 2078075 - RNA, 17 nt, Staphylococcus aureus subsp. aureus Mu50
ccuauucccaaaaugau

SEQ ID NO: 2078076 - RNA, 22 nt, Staphylococcus aureus subsp. aureus Mu50
ccuauuccuaauaaauaucuua

SEQ ID NO: 2078077 - RNA, 19 nt, Staphylococcus aureus subsp. aureus Mu50
ccuauuaaaucugcuugug

SEQ ID NO: 2078078 - RNA, 20 nt, Staphylococcus aureus subsp. aureus Mu50
ccuauggcgcaauuuuuaac

SEQ ID NO: 2078079 - RNA, 19 nt, Staphylococcus aureus subsp. aureus Mu50
ccucacuagauaguuuaua

SEQ ID NO: 2078080 - RNA, 18 nt, Staphylococcus aureus subsp. aureus Mu50
ccucaacauuaaaaugug

SEQ ID NO: 2078081 - RNA, 18 nt, Staphylococcus aureus subsp. aureus Mu50
ccugcauauucacgauau

SEQ ID NO: 2078082 - RNA, 20 nt, Staphylococcus aureus subsp. aureus Mu50
ccugcaaaauguuacacaaa

SEQ ID NO: 2078083 - RNA, 21 nt, Staphylococcus aureus subsp. aureus Mu50
ccugauauuucaacuuuuuaa

SEQ ID NO: 2078084 - RNA, 21 nt, Staphylococcus aureus subsp. aureus Mu50
ccugaaauuaacgucaacagc

SEQ ID NO: 2078085 - RNA, 21 nt, Staphylococcus aureus subsp. aureus Mu50
cgaagucagucaauucaaacu

SEQ ID NO: 2078086 - RNA, 22 nt, Staphylococcus aureus subsp. aureus Mu50
cgaauaacuguuuaucaugaug

SEQ ID NO: 2078087 - RNA, 13 nt, Staphylococcus aureus subsp. aureus Mu50
cgaacaaaugaaa

SEQ ID NO: 2078088 - RNA, 16 nt, Staphylococcus aureus subsp. aureus Mu50
cgaacaucugaaaaaa

SEQ ID NO: 2078089 - RNA, 22 nt, Staphylococcus aureus subsp. aureus Mu50
cgaacaucugaaaaaauuaaua

SEQ ID NO: 2078090 - RNA, 17 nt, Staphylococcus aureus subsp. aureus Mu50
cgaaagaugauauauuc

SEQ ID NO: 2078091 - RNA, 17 nt, Staphylococcus aureus subsp. aureus Mu50
cgaaaguagaauuauuu

SEQ ID NO: 2078092 - RNA, 21 nt, Staphylococcus aureus subsp. aureus Mu50
cgaaaugcaaugagcaucuug

SEQ ID NO: 2078093 - RNA, 15 nt, Staphylococcus aureus subsp. aureus Mu50
cgaaaugaaugagug

SEQ ID NO: 2078094 - RNA, 15 nt, Staphylococcus aureus subsp. aureus Mu50
cgaaacauuaaaaua

SEQ ID NO: 2078095 - RNA, 23 nt, Staphylococcus aureus subsp. aureus Mu50
cgaaaauuucaggcguuaauaca

SEQ ID NO: 2078096 - RNA, 20 nt, Staphylococcus aureus subsp. aureus Mu50
cgaaaauagcuauuaaaaua

SEQ ID NO: 2078097 - RNA, 20 nt, Staphylococcus aureus subsp. aureus Mu50
cgaaaauugcuaaaaaaauu

SEQ ID NO: 2078098 - RNA, 23 nt, Staphylococcus aureus subsp. aureus Mu50
cgaaaauucgcuuguaacaagcu

SEQ ID NO: 2078099 - RNA, 23 nt, Staphylococcus aureus subsp. aureus Mu50
cgaaaaccucuguuuuguuggug

SEQ ID NO: 2078100 - RNA, 23 nt, Staphylococcus aureus subsp. aureus Mu50
cgaaaagaaauucuacagguaau

SEQ ID NO: 2078101 - RNA, 23 nt, Staphylococcus aureus subsp. aureus Mu50
cgaaaagaaauucuacaggcaau

SEQ ID NO: 2078102 - RNA, 17 nt, Staphylococcus aureus subsp. aureus Mu50
ccuuuuugacucagaau

SEQ ID NO: 2078103 - RNA, 13 nt, Staphylococcus aureus subsp. aureus Mu50
ccuuuuuguaauu

SEQ ID NO: 2078104 - RNA, 17 nt, Staphylococcus aureus subsp. aureus Mu50
ccuuuuuguaauuguaa

SEQ ID NO: 2078105 - RNA, 11 nt, Staphylococcus aureus subsp. aureus Mu50
ccuuuuuucuc

SEQ ID NO: 2078106 - RNA, 20 nt, Staphylococcus aureus subsp. aureus Mu50
ccuuuuauaagcuuguaauc

SEQ ID NO: 2078107 - RNA, 18 nt, Staphylococcus aureus subsp. aureus Mu50
ccuuuuaauuuaguuaua

SEQ ID NO: 2078108 - RNA, 18 nt, Staphylococcus aureus subsp. aureus Mu50
ccuuaacuucauaauaua

SEQ ID NO: 2078109 - RNA, 13 nt, Staphylococcus aureus subsp. aureus Mu50
ccuucaucacuau

SEQ ID NO: 2078110 - RNA, 21 nt, Staphylococcus aureus subsp. aureus Mu50
ccuucauuagccaaaucuuua

SEQ ID NO: 2078111 - RNA, 15 nt, Staphylococcus aureus subsp. aureus Mu50
ccuuccaauaauaaa

SEQ ID NO: 2078112 - RNA, 18 nt, Staphylococcus aureus subsp. aureus Mu50
ccuugauuuaauuuuuaa

SEQ ID NO: 2078113 - RNA, 15 nt, Staphylococcus aureus subsp. aureus Mu50
ccuguugaauauacu

SEQ ID NO: 2078114 - RNA, 15 nt, Staphylococcus aureus subsp. aureus Mu50
ccuuaaaauauuuaa

SEQ ID NO: 2078115 - RNA, 22 nt, Staphylococcus aureus subsp. aureus Mu50
ccuguuauugcaauaaaauuag

SEQ ID NO: 2078116 - RNA, 13 nt, Staphylococcus aureus subsp. aureus Mu50
ccugugauaaaaa

SEQ ID NO: 2078117 - RNA, 17 nt, Staphylococcus aureus subsp. aureus Mu50
ccugcuacaacuucuuc

SEQ ID NO: 2078118 - RNA, 22 nt, Staphylococcus aureus subsp. aureus Mu50
aaacauuucgguaugauauuuc

SEQ ID NO: 2078119 - RNA, 16 nt, Staphylococcus aureus subsp. aureus Mu50
aaacauuuuuagaauc

SEQ ID NO: 2078120 - RNA, 15 nt, Staphylococcus aureus subsp. aureus Mu50
aaaccaauuuuaacu

SEQ ID NO: 2078121 - RNA, 13 nt, Staphylococcus aureus subsp. aureus Mu50
aaaccaauuuuaa

SEQ ID NO: 2078122 - RNA, 20 nt, Staphylococcus aureus subsp. aureus Mu50
aaacauaaauacaaaaauau

SEQ ID NO: 2078123 - RNA, 16 nt, Staphylococcus aureus subsp. aureus Mu50
aaacaugaacaaucag

SEQ ID NO: 2078124 - RNA, 21 nt, Staphylococcus aureus subsp. aureus Mu50
aaacaugcuuggacauauacu

SEQ ID NO: 2078125 - RNA, 19 nt, Staphylococcus aureus subsp. aureus Mu50
ccgaacaucugaaaaaauu

SEQ ID NO: 2078126 - RNA, 18 nt, Staphylococcus aureus subsp. aureus Mu50
ccgaacacaaaaaugaag

SEQ ID NO: 2078127 - RNA, 14 nt, Staphylococcus aureus subsp. aureus Mu50
cccuuuagucaugu

SEQ ID NO: 2078128 - RNA, 15 nt, Staphylococcus aureus subsp. aureus Mu50
cccugcuguuuuauu

SEQ ID NO: 2078129 - RNA, 19 nt, Staphylococcus aureus subsp. aureus Mu50
aaacacuuuuaguuguaac

SEQ ID NO: 2078130 - RNA, 16 nt, Staphylococcus aureus subsp. aureus Mu50
ccgaggcuaauuuuaa

SEQ ID NO: 2078131 - RNA, 21 nt, Staphylococcus aureus subsp. aureus Mu50
ccccauuuauguguuggcuuu

SEQ ID NO: 2078132 - RNA, 11 nt, Staphylococcus aureus subsp. aureus Mu50
cccccaacaca

SEQ ID NO: 2078133 - RNA, 15 nt, Staphylococcus aureus subsp. aureus Mu50
ccccaacucgcauug

SEQ ID NO: 2078134 - RNA, 19 nt, Staphylococcus aureus subsp. aureus Mu50
cccauugcuuguccucuaa

SEQ ID NO: 2078135 - RNA, 17 nt, Staphylococcus aureus subsp. aureus Mu50
cccauucacuacuuuuu

SEQ ID NO: 2078136 - RNA, 17 nt, Staphylococcus aureus subsp. aureus Mu50
ccccucauucacaauga

SEQ ID NO: 2078137 - RNA, 14 nt, Staphylococcus aureus subsp. aureus Mu50
ccccuagcaaaaau

SEQ ID NO: 2078138 - RNA, 16 nt, Staphylococcus aureus subsp. aureus Mu50
ccauucaauguuuaau

SEQ ID NO: 2078139 - RNA, 21 nt, Staphylococcus aureus subsp. aureus Mu50
ccauucaauguuuaauuuucu

SEQ ID NO: 2078140 - RNA, 18 nt, Staphylococcus aureus subsp. aureus Mu50
ccauugaucuuuuauaau

SEQ ID NO: 2078141 - RNA, 17 nt, Staphylococcus aureus subsp. aureus Mu50
ccauugcacuaugcaua

SEQ ID NO: 2078142 - RNA, 15 nt, Staphylococcus aureus subsp. aureus Mu50
ccauuguuauccaaa

SEQ ID NO: 2078143 - RNA, 17 nt, Staphylococcus aureus subsp. aureus Mu50
ccauuguugauaaaugg

SEQ ID NO: 2078144 - RNA, 22 nt, Staphylococcus aureus subsp. aureus Mu50
ccauuguccaacugcuuuuuau

SEQ ID NO: 2078145 - RNA, 17 nt, Staphylococcus aureus subsp. aureus Mu50
ccauuuaaggauuuccu

SEQ ID NO: 2078146 - RNA, 20 nt, Staphylococcus aureus subsp. aureus Mu50
cccaaucgauuuuauaucuu

SEQ ID NO: 2078147 - RNA, 22 nt, Staphylococcus aureus subsp. aureus Mu50
cccaacacugagaauuucuaau

SEQ ID NO: 2078148 - RNA, 19 nt, Staphylococcus aureus subsp. aureus Mu50
cccaaccacgauaucuagc

SEQ ID NO: 2078149 - RNA, 20 nt, Staphylococcus aureus subsp. aureus Mu50
cccaauucggauuauauuua

SEQ ID NO: 2078150 - RNA, 19 nt, Staphylococcus aureus subsp. aureus Mu50
cccaaugcuugaauuuuau

SEQ ID NO: 2078151 - RNA, 18 nt, Staphylococcus aureus subsp. aureus Mu50
cccaaauguaagaacgaa

SEQ ID NO: 2078152 - RNA, 12 nt, Staphylococcus aureus subsp. aureus Mu50
cccaacacagag

SEQ ID NO: 2078153 - RNA, 15 nt, Staphylococcus aureus subsp. aureus Mu50
cccaacacagagaaa

SEQ ID NO: 2078154 - RNA, 13 nt, Staphylococcus aureus subsp. aureus Mu50
ccauuuaucuuua

SEQ ID NO: 2078155 - RNA, 14 nt, Staphylococcus aureus subsp. aureus Mu50
cccaaaaaauugua

SEQ ID NO: 2078156 - RNA, 11 nt, Staphylococcus aureus subsp. aureus Mu50
cccacacccca

SEQ ID NO: 2078157 - RNA, 12 nt, Staphylococcus aureus subsp. aureus Mu50
cccacaccccaa

SEQ ID NO: 2078158 - RNA, 13 nt, Staphylococcus aureus subsp. aureus Mu50
cccacaccccaac

SEQ ID NO: 2078159 - RNA, 14 nt, Staphylococcus aureus subsp. aureus Mu50
cccacaccccaacu

SEQ ID NO: 2078160 - RNA, 13 nt, Staphylococcus aureus subsp. aureus Mu50
aaacaauaaaaaa

SEQ ID NO: 2078161 - RNA, 20 nt, Staphylococcus aureus subsp. aureus Mu50
aaacaauaaaaaaccaagug

SEQ ID NO: 2078162 - RNA, 21 nt, Staphylococcus aureus subsp. aureus Mu50
ccaucccaacuuaauaaccau

SEQ ID NO: 2078163 - RNA, 17 nt, Staphylococcus aureus subsp. aureus Mu50
ccaugauuagcgcacca

SEQ ID NO: 2078164 - RNA, 19 nt, Staphylococcus aureus subsp. aureus Mu50
ccaugauuagcgcaccaau

SEQ ID NO: 2078165 - RNA, 15 nt, Staphylococcus aureus subsp. aureus Mu50
ccaguggaaaugaua

SEQ ID NO: 2078166 - RNA, 15 nt, Staphylococcus aureus subsp. aureus Mu50
ccauaaauauuaaau

SEQ ID NO: 2078167 - RNA, 16 nt, Staphylococcus aureus subsp. aureus Mu50
ccauaacaaucauuuc

SEQ ID NO: 2078168 - RNA, 13 nt, Staphylococcus aureus subsp. aureus Mu50
ccauaacaauuuu

SEQ ID NO: 2078169 - RNA, 11 nt, Staphylococcus aureus subsp. aureus Mu50
ccauagauuau

SEQ ID NO: 2078170 - RNA, 23 nt, Staphylococcus aureus subsp. aureus Mu50
ccauauaaagcugcgauauaacu

SEQ ID NO: 2078171 - RNA, 22 nt, Staphylococcus aureus subsp. aureus Mu50
ccauacuucuauuuuauaauaa

SEQ ID NO: 2078172 - RNA, 20 nt, Staphylococcus aureus subsp. aureus Mu50
ccauacucugggcauuuuga

SEQ ID NO: 2078173 - RNA, 14 nt, Staphylococcus aureus subsp. aureus Mu50
ccauacuucuauuu

SEQ ID NO: 2078174 - RNA, 14 nt, Staphylococcus aureus subsp. aureus Mu50
ccauacucugggca

SEQ ID NO: 2078175 - RNA, 21 nt, Staphylococcus aureus subsp. aureus Mu50
ccauacuaaauaaguaguuca

SEQ ID NO: 2078176 - RNA, 20 nt, Staphylococcus aureus subsp. aureus Mu50
ccauacuaaucguuccaaca

SEQ ID NO: 2078177 - RNA, 20 nt, Staphylococcus aureus subsp. aureus Mu50
ccauaauaaugccgcugcac

SEQ ID NO: 2078178 - RNA, 13 nt, Staphylococcus aureus subsp. aureus Mu50
ccauaaguaaaac

SEQ ID NO: 2078179 - RNA, 23 nt, Staphylococcus aureus subsp. aureus Mu50
ccaucaauccaacuacugcaaca

SEQ ID NO: 2078180 - RNA, 16 nt, Staphylococcus aureus subsp. aureus Mu50
ccagcuaaaccaucug

SEQ ID NO: 2078181 - RNA, 23 nt, Staphylococcus aureus subsp. aureus Mu50
ccacuccuuaaacaaauaaaugu

SEQ ID NO: 2078182 - RNA, 12 nt, Staphylococcus aureus subsp. aureus Mu50
ccagguccuggg

SEQ ID NO: 2078183 - RNA, 20 nt, Staphylococcus aureus subsp. aureus Mu50
ccagcuugaccgccuaugau

SEQ ID NO: 2078184 - RNA, 16 nt, Staphylococcus aureus subsp. aureus Mu50
cauuuccuaugugcug

SEQ ID NO: 2078185 - RNA, 21 nt, Staphylococcus aureus subsp. aureus Mu50
cauuucgauaccuaaaauacc

SEQ ID NO: 2078186 - RNA, 11 nt, Staphylococcus aureus subsp. aureus Mu50
cauuucaucau

SEQ ID NO: 2078187 - RNA, 15 nt, Staphylococcus aureus subsp. aureus Mu50
cauuucaucauaauu

SEQ ID NO: 2078188 - RNA, 21 nt, Staphylococcus aureus subsp. aureus Mu50
cauuucaucaauaauuucuug

SEQ ID NO: 2078189 - RNA, 14 nt, Staphylococcus aureus subsp. aureus Mu50
cauuucauguguca

SEQ ID NO: 2078190 - RNA, 17 nt, Staphylococcus aureus subsp. aureus Mu50
cauuucaugugucacaa

SEQ ID NO: 2078191 - RNA, 21 nt, Staphylococcus aureus subsp. aureus Mu50
cauuuauguguuggcuuuuau

SEQ ID NO: 2078192 - RNA, 18 nt, Staphylococcus aureus subsp. aureus Mu50
cauuuacuugauuagauu

SEQ ID NO: 2078193 - RNA, 23 nt, Staphylococcus aureus subsp. aureus Mu50
cauuuacuugauuagauuugugu

SEQ ID NO: 2078194 - RNA, 15 nt, Staphylococcus aureus subsp. aureus Mu50
cauuucaauauuaaa

SEQ ID NO: 2078195 - RNA, 17 nt, Staphylococcus aureus subsp. aureus Mu50
cauuuguucugcagagu

SEQ ID NO: 2078196 - RNA, 13 nt, Staphylococcus aureus subsp. aureus Mu50
cauuuguguaaau

SEQ ID NO: 2078197 - RNA, 23 nt, Staphylococcus aureus subsp. aureus Mu50
cauuuguuaaauucaucuuauca

SEQ ID NO: 2078198 - RNA, 15 nt, Staphylococcus aureus subsp. aureus Mu50
cauuugguucuucua

SEQ ID NO: 2078199 - RNA, 18 nt, Staphylococcus aureus subsp. aureus Mu50
cauuugguuuaacuuuau

SEQ ID NO: 2078200 - RNA, 16 nt, Staphylococcus aureus subsp. aureus Mu50
cauuuuaauaaaauca

SEQ ID NO: 2078201 - RNA, 16 nt, Staphylococcus aureus subsp. aureus Mu50
cauuuuauaaaucaaa

SEQ ID NO: 2078202 - RNA, 15 nt, Staphylococcus aureus subsp. aureus Mu50
cauuuuauauuuuag

SEQ ID NO: 2078203 - RNA, 16 nt, Staphylococcus aureus subsp. aureus Mu50
cauuuuauauuuuagu

SEQ ID NO: 2078204 - RNA, 14 nt, Staphylococcus aureus subsp. aureus Mu50
cauuuuaaauaaaa

SEQ ID NO: 2078205 - RNA, 17 nt, Staphylococcus aureus subsp. aureus Mu50
cauuuuaaaucuaauua

SEQ ID NO: 2078206 - RNA, 10 nt, Staphylococcus aureus subsp. aureus Mu50
cauuuuaaag

SEQ ID NO: 2078207 - RNA, 22 nt, Staphylococcus aureus subsp. aureus Mu50
cauuggcaauauacuuuuuaaa

SEQ ID NO: 2078208 - RNA, 22 nt, Staphylococcus aureus subsp. aureus Mu50
cauugucaugccuucauuagcc

SEQ ID NO: 2078209 - RNA, 16 nt, Staphylococcus aureus subsp. aureus Mu50
cauuguaaaacaaauu

SEQ ID NO: 2078210 - RNA, 15 nt, Staphylococcus aureus subsp. aureus Mu50
cauuguaaaaugcuc

SEQ ID NO: 2078211 - RNA, 17 nt, Staphylococcus aureus subsp. aureus Mu50
cauugguaccuuuuuau

SEQ ID NO: 2078212 - RNA, 23 nt, Staphylococcus aureus subsp. aureus Mu50
cauugguaccuuuuuauuaucuu

SEQ ID NO: 2078213 - RNA, 17 nt, Staphylococcus aureus subsp. aureus Mu50
cauuguuuuacagucaa

SEQ ID NO: 2078214 - RNA, 14 nt, Staphylococcus aureus subsp. aureus Mu50
cauuuaaaauauuu

SEQ ID NO: 2078215 - RNA, 17 nt, Staphylococcus aureus subsp. aureus Mu50
cauuuacgauacaucau

SEQ ID NO: 2078216 - RNA, 11 nt, Staphylococcus aureus subsp. aureus Mu50
cauuuaagccu

SEQ ID NO: 2078217 - RNA, 16 nt, Staphylococcus aureus subsp. aureus Mu50
cauuuaauacuuuucu

SEQ ID NO: 2078218 - RNA, 23 nt, Staphylococcus aureus subsp. aureus Mu50
cauuuaauacuuuucucgauuaa

SEQ ID NO: 2078219 - RNA, 15 nt, Staphylococcus aureus subsp. aureus Mu50
cauuguuauccaaaa

SEQ ID NO: 2078220 - RNA, 22 nt, Staphylococcus aureus subsp. aureus Mu50
cauuguguccauaaauauuaaa

SEQ ID NO: 2078221 - RNA, 22 nt, Staphylococcus aureus subsp. aureus Mu50
cauuguggcuuuuuuuauggug

SEQ ID NO: 2078222 - RNA, 14 nt, Staphylococcus aureus subsp. aureus Mu50
cauucggauaaaua

SEQ ID NO: 2078223 - RNA, 12 nt, Staphylococcus aureus subsp. aureus Mu50
cauucguuuaau

SEQ ID NO: 2078224 - RNA, 22 nt, Staphylococcus aureus subsp. aureus Mu50
cauugcuuaacuuccuuuuuau

SEQ ID NO: 2078225 - RNA, 23 nt, Staphylococcus aureus subsp. aureus Mu50
cauugcuagugcucuugcaauag

SEQ ID NO: 2078226 - RNA, 19 nt, Staphylococcus aureus subsp. aureus Mu50
cauuccucuauuguaucuu

SEQ ID NO: 2078227 - RNA, 23 nt, Staphylococcus aureus subsp. aureus Mu50
cauucgaugcuaaaaauauugaa

SEQ ID NO: 2078228 - RNA, 16 nt, Staphylococcus aureus subsp. aureus Mu50
cauuccuaauuauauu

SEQ ID NO: 2078229 - RNA, 18 nt, Staphylococcus aureus subsp. aureus Mu50
cauucauauggaauacua

SEQ ID NO: 2078230 - RNA, 15 nt, Staphylococcus aureus subsp. aureus Mu50
cauucauaaaugacu

SEQ ID NO: 2078231 - RNA, 14 nt, Staphylococcus aureus subsp. aureus Mu50
cauuaguacuaaac

SEQ ID NO: 2078232 - RNA, 17 nt, Staphylococcus aureus subsp. aureus Mu50
cauuaguuaugugcuaa

SEQ ID NO: 2078233 - RNA, 15 nt, Staphylococcus aureus subsp. aureus Mu50
cauuaguugcauaau

SEQ ID NO: 2078234 - RNA, 22 nt, Staphylococcus aureus subsp. aureus Mu50
cauuaguugcauaaucaauuuc

SEQ ID NO: 2078235 - RNA, 20 nt, Staphylococcus aureus subsp. aureus Mu50
cauuaguuguaucagugaca

SEQ ID NO: 2078236 - RNA, 17 nt, Staphylococcus aureus subsp. aureus Mu50
cauuaguuuuuaaaauu

SEQ ID NO: 2078237 - RNA, 18 nt, Staphylococcus aureus subsp. aureus Mu50
cauuaguuuuuaaaauua

SEQ ID NO: 2078238 - RNA, 17 nt, Staphylococcus aureus subsp. aureus Mu50
cauuauaaugauuuuua

SEQ ID NO: 2078239 - RNA, 20 nt, Staphylococcus aureus subsp. aureus Mu50
cauuauuugcugcuaauuga

SEQ ID NO: 2078240 - RNA, 16 nt, Staphylococcus aureus subsp. aureus Mu50
cauuauugccuaaccu

SEQ ID NO: 2078241 - RNA, 18 nt, Staphylococcus aureus subsp. aureus Mu50
cauuauauaauucuucaa

SEQ ID NO: 2078242 - RNA, 23 nt, Staphylococcus aureus subsp. aureus Mu50
cauguggcuggacaaucuuauca

SEQ ID NO: 2078243 - RNA, 18 nt, Staphylococcus aureus subsp. aureus Mu50
caugucuagauuuuaaau

SEQ ID NO: 2078244 - RNA, 19 nt, Staphylococcus aureus subsp. aureus Mu50
cauuaagcuaugcuuuuuu

SEQ ID NO: 2078245 - RNA, 14 nt, Staphylococcus aureus subsp. aureus Mu50
cauuaaguacuuuu

SEQ ID NO: 2078246 - RNA, 17 nt, Staphylococcus aureus subsp. aureus Mu50
cauuaauaaauaauaac

SEQ ID NO: 2078247 - RNA, 18 nt, Staphylococcus aureus subsp. aureus Mu50
cauuaauaauuaaacaag

SEQ ID NO: 2078248 - RNA, 13 nt, Staphylococcus aureus subsp. aureus Mu50
cauuaauaauuaa

SEQ ID NO: 2078249 - RNA, 18 nt, Staphylococcus aureus subsp. aureus Mu50
cauuacuaauugaucagc

SEQ ID NO: 2078250 - RNA, 19 nt, Staphylococcus aureus subsp. aureus Mu50
cauuacuaaaacaaauuca

SEQ ID NO: 2078251 - RNA, 20 nt, Staphylococcus aureus subsp. aureus Mu50
cauuacuacuuuauaaauau

SEQ ID NO: 2078252 - RNA, 17 nt, Staphylococcus aureus subsp. aureus Mu50
cauuacuaucuucauca

SEQ ID NO: 2078253 - RNA, 22 nt, Staphylococcus aureus subsp. aureus Mu50
cauuagccacagcuaaugugua

SEQ ID NO: 2078254 - RNA, 23 nt, Staphylococcus aureus subsp. aureus Mu50
cauuagccaaaucuuuaauaacc

SEQ ID NO: 2078255 - RNA, 15 nt, Staphylococcus aureus subsp. aureus Mu50
cauuagcauuaaauu

SEQ ID NO: 2078256 - RNA, 15 nt, Staphylococcus aureus subsp. aureus Mu50
cauuagcaugauaaa

SEQ ID NO: 2078257 - RNA, 15 nt, Staphylococcus aureus subsp. aureus Mu50
cauuagcaauuucau

SEQ ID NO: 2078258 - RNA, 14 nt, Staphylococcus aureus subsp. aureus Mu50
cauuacccuuuaaa

SEQ ID NO: 2078259 - RNA, 16 nt, Staphylococcus aureus subsp. aureus Mu50
cauuacccuuuaaacu

SEQ ID NO: 2078260 - RNA, 14 nt, Staphylococcus aureus subsp. aureus Mu50
cauuaccagcaauu

SEQ ID NO: 2078261 - RNA, 19 nt, Staphylococcus aureus subsp. aureus Mu50
cauuacgcucaucaccuuu

SEQ ID NO: 2078262 - RNA, 22 nt, Staphylococcus aureus subsp. aureus Mu50
caucuucaauauuuaaauuuua

SEQ ID NO: 2078263 - RNA, 17 nt, Staphylococcus aureus subsp. aureus Mu50
cauguaaugcuuaaaaa

SEQ ID NO: 2078264 - RNA, 19 nt, Staphylococcus aureus subsp. aureus Mu50
cauguacauugguuuuuac

SEQ ID NO: 2078265 - RNA, 15 nt, Staphylococcus aureus subsp. aureus Mu50
cauguacaguuacuu

SEQ ID NO: 2078266 - RNA, 20 nt, Staphylococcus aureus subsp. aureus Mu50
cauguacguuuuuuuaaaua

SEQ ID NO: 2078267 - RNA, 12 nt, Staphylococcus aureus subsp. aureus Mu50
ccacucaauucu

SEQ ID NO: 2078268 - RNA, 15 nt, Staphylococcus aureus subsp. aureus Mu50
ccacuauauccuuuu

SEQ ID NO: 2078269 - RNA, 13 nt, Staphylococcus aureus subsp. aureus Mu50
ccacgguuuacca

SEQ ID NO: 2078270 - RNA, 14 nt, Staphylococcus aureus subsp. aureus Mu50
ccacgguuuaccac

SEQ ID NO: 2078271 - RNA, 22 nt, Staphylococcus aureus subsp. aureus Mu50
ccacagcuaauguguacuuaaa

SEQ ID NO: 2078272 - RNA, 23 nt, Staphylococcus aureus subsp. aureus Mu50
ccaaugcguggauguguuuuaau

SEQ ID NO: 2078273 - RNA, 18 nt, Staphylococcus aureus subsp. aureus Mu50
ccaaugcugaauaaauaa

SEQ ID NO: 2078274 - RNA, 16 nt, Staphylococcus aureus subsp. aureus Mu50
ccaauguauaaaaccu

SEQ ID NO: 2078275 - RNA, 19 nt, Staphylococcus aureus subsp. aureus Mu50
ccaauggaaguuuuuuagu

SEQ ID NO: 2078276 - RNA, 20 nt, Staphylococcus aureus subsp. aureus Mu50
ccaauuuaauagcuuguaca

SEQ ID NO: 2078277 - RNA, 17 nt, Staphylococcus aureus subsp. aureus Mu50
ccaauuugauuaguaau

SEQ ID NO: 2078278 - RNA, 14 nt, Staphylococcus aureus subsp. aureus Mu50
ccaauguguuuaac

SEQ ID NO: 2078279 - RNA, 13 nt, Staphylococcus aureus subsp. aureus Mu50
ccaaucaauaguu

SEQ ID NO: 2078280 - RNA, 18 nt, Staphylococcus aureus subsp. aureus Mu50
ccaauagguucauuauuu

SEQ ID NO: 2078281 - RNA, 13 nt, Staphylococcus aureus subsp. aureus Mu50
ccaaguauuuucu

SEQ ID NO: 2078282 - RNA, 18 nt, Staphylococcus aureus subsp. aureus Mu50
ccaaguccaauuccaaua

SEQ ID NO: 2078283 - RNA, 15 nt, Staphylococcus aureus subsp. aureus Mu50
ccaagauauauaacu

SEQ ID NO: 2078284 - RNA, 19 nt, Staphylococcus aureus subsp. aureus Mu50
ccaagauaaaucaucauuc

SEQ ID NO: 2078285 - RNA, 16 nt, Staphylococcus aureus subsp. aureus Mu50
ccaagaugguauugcu

SEQ ID NO: 2078286 - RNA, 17 nt, Staphylococcus aureus subsp. aureus Mu50
ccaagcucguuaaauca

SEQ ID NO: 2078287 - RNA, 22 nt, Staphylococcus aureus subsp. aureus Mu50
ccaaggauguuauaaaaugaau

SEQ ID NO: 2078288 - RNA, 15 nt, Staphylococcus aureus subsp. aureus Mu50
ccaacaucuucaaca

SEQ ID NO: 2078289 - RNA, 23 nt, Staphylococcus aureus subsp. aureus Mu50
cauuuucaauacuugaaagauuu

SEQ ID NO: 2078290 - RNA, 19 nt, Staphylococcus aureus subsp. aureus Mu50
cauuuucaaguuuaaaaua

SEQ ID NO: 2078291 - RNA, 23 nt, Staphylococcus aureus subsp. aureus Mu50
cauuuucaaguuuaaaauacgac

SEQ ID NO: 2078292 - RNA, 14 nt, Staphylococcus aureus subsp. aureus Mu50
cauuuucaagagga

SEQ ID NO: 2078293 - RNA, 16 nt, Staphylococcus aureus subsp. aureus Mu50
ccaaauauuaaaaaca

SEQ ID NO: 2078294 - RNA, 22 nt, Staphylococcus aureus subsp. aureus Mu50
ccaaaguaccaucucuauuuuu

SEQ ID NO: 2078295 - RNA, 23 nt, Staphylococcus aureus subsp. aureus Mu50
ccaacauauuuuaacuaugaaug

SEQ ID NO: 2078296 - RNA, 20 nt, Staphylococcus aureus subsp. aureus Mu50
ccaacaagguucuaaaucuu

SEQ ID NO: 2078297 - RNA, 12 nt, Staphylococcus aureus subsp. aureus Mu50
ccaacaacuaag

SEQ ID NO: 2078298 - RNA, 14 nt, Staphylococcus aureus subsp. aureus Mu50
ccaaauuuuauacu

SEQ ID NO: 2078299 - RNA, 14 nt, Staphylococcus aureus subsp. aureus Mu50
ccaacaaaaagaau

SEQ ID NO: 2078300 - RNA, 21 nt, Staphylococcus aureus subsp. aureus Mu50
ccaaaucggaauaaaauaaau

SEQ ID NO: 2078301 - RNA, 16 nt, Staphylococcus aureus subsp. aureus Mu50
ccaaauccaucuaauu

SEQ ID NO: 2078302 - RNA, 18 nt, Staphylococcus aureus subsp. aureus Mu50
caucuguaacuaauauga

SEQ ID NO: 2078303 - RNA, 12 nt, Staphylococcus aureus subsp. aureus Mu50
caucuucaacau

SEQ ID NO: 2078304 - RNA, 22 nt, Staphylococcus aureus subsp. aureus Mu50
caucuucaagacgcauuguugu

SEQ ID NO: 2078305 - RNA, 23 nt, Staphylococcus aureus subsp. aureus Mu50
caucuucaagacgcauuguugua

SEQ ID NO: 2078306 - RNA, 19 nt, Staphylococcus aureus subsp. aureus Mu50
caucuuaucggcucuuuuu

SEQ ID NO: 2078307 - RNA, 21 nt, Staphylococcus aureus subsp. aureus Mu50
caucuuaugacugcuuuuuau

SEQ ID NO: 2078308 - RNA, 19 nt, Staphylococcus aureus subsp. aureus Mu50
caucuuaucaagaauauaa

SEQ ID NO: 2078309 - RNA, 18 nt, Staphylococcus aureus subsp. aureus Mu50
caucuuaacaacuuuaau

SEQ ID NO: 2078310 - RNA, 21 nt, Staphylococcus aureus subsp. aureus Mu50
caucucugcuuuaauauaauu

SEQ ID NO: 2078311 - RNA, 16 nt, Staphylococcus aureus subsp. aureus Mu50
caucugaaaaaauuaa

SEQ ID NO: 2078312 - RNA, 22 nt, Staphylococcus aureus subsp. aureus Mu50
caucugaaaaaauuaauaauuu

SEQ ID NO: 2078313 - RNA, 12 nt, Staphylococcus aureus subsp. aureus Mu50
caucucuucugg

SEQ ID NO: 2078314 - RNA, 15 nt, Staphylococcus aureus subsp. aureus Mu50
caucugcaagggauc

SEQ ID NO: 2078315 - RNA, 18 nt, Staphylococcus aureus subsp. aureus Mu50
caucguaaagaucauuuu

SEQ ID NO: 2078316 - RNA, 14 nt, Staphylococcus aureus subsp. aureus Mu50
caucguauagaugu

SEQ ID NO: 2078317 - RNA, 13 nt, Staphylococcus aureus subsp. aureus Mu50
caucuaaaaugag

SEQ ID NO: 2078318 - RNA, 19 nt, Staphylococcus aureus subsp. aureus Mu50
caucuaaaugcacgagcaa

SEQ ID NO: 2078319 - RNA, 14 nt, Staphylococcus aureus subsp. aureus Mu50
caucguauucuuuu

SEQ ID NO: 2078320 - RNA, 22 nt, Staphylococcus aureus subsp. aureus Mu50
caucgucaucacuuuuuaaacg

SEQ ID NO: 2078321 - RNA, 21 nt, Staphylococcus aureus subsp. aureus Mu50
caucgucaucacuuuuuaaac

SEQ ID NO: 2078322 - RNA, 21 nt, Staphylococcus aureus subsp. aureus Mu50
caucuacaauauucaauaauu

SEQ ID NO: 2078323 - RNA, 14 nt, Staphylococcus aureus subsp. aureus Mu50
caucuauauuuaau

SEQ ID NO: 2078324 - RNA, 14 nt, Staphylococcus aureus subsp. aureus Mu50
caucuauuucuugu

SEQ ID NO: 2078325 - RNA, 17 nt, Staphylococcus aureus subsp. aureus Mu50
caucucagcaauacuaa

SEQ ID NO: 2078326 - RNA, 18 nt, Staphylococcus aureus subsp. aureus Mu50
caucuccaccauuaauag

SEQ ID NO: 2078327 - RNA, 23 nt, Staphylococcus aureus subsp. aureus Mu50
caucauuauacgugcuuuaaagu

SEQ ID NO: 2078328 - RNA, 16 nt, Staphylococcus aureus subsp. aureus Mu50
caucauucaaacuccu

SEQ ID NO: 2078329 - RNA, 21 nt, Staphylococcus aureus subsp. aureus Mu50
caucauucauauggaauacua

SEQ ID NO: 2078330 - RNA, 16 nt, Staphylococcus aureus subsp. aureus Mu50
caucauuguaaaacaa

SEQ ID NO: 2078331 - RNA, 13 nt, Staphylococcus aureus subsp. aureus Mu50
caucauuguaaaa

SEQ ID NO: 2078332 - RNA, 19 nt, Staphylococcus aureus subsp. aureus Mu50
caucgcaaauacauaauca

SEQ ID NO: 2078333 - RNA, 23 nt, Staphylococcus aureus subsp. aureus Mu50
caucauaaucuuuuccuaaaccu

SEQ ID NO: 2078334 - RNA, 15 nt, Staphylococcus aureus subsp. aureus Mu50
caucauaauaaaucu

SEQ ID NO: 2078335 - RNA, 23 nt, Staphylococcus aureus subsp. aureus Mu50
caucauaucauaccaaaaaguau

SEQ ID NO: 2078336 - RNA, 14 nt, Staphylococcus aureus subsp. aureus Mu50
caucaguuaauaau

SEQ ID NO: 2078337 - RNA, 21 nt, Staphylococcus aureus subsp. aureus Mu50
caucaguaccaaagaaaucac

SEQ ID NO: 2078338 - RNA, 19 nt, Staphylococcus aureus subsp. aureus Mu50
caucaucacuguagauuca

SEQ ID NO: 2078339 - RNA, 16 nt, Staphylococcus aureus subsp. aureus Mu50
caucaucaaguucacc

SEQ ID NO: 2078340 - RNA, 22 nt, Staphylococcus aureus subsp. aureus Mu50
caucaugaacuuuuauugccau

SEQ ID NO: 2078341 - RNA, 21 nt, Staphylococcus aureus subsp. aureus Mu50
caucaaucgcuuuagcaauug

SEQ ID NO: 2078342 - RNA, 20 nt, Staphylococcus aureus subsp. aureus Mu50
cauacuaucuacaauaacca

SEQ ID NO: 2078343 - RNA, 19 nt, Staphylococcus aureus subsp. aureus Mu50
cauacguuccuaaagucgu

SEQ ID NO: 2078344 - RNA, 19 nt, Staphylococcus aureus subsp. aureus Mu50
cauacuauaagcaauuucu

SEQ ID NO: 2078345 - RNA, 13 nt, Staphylococcus aureus subsp. aureus Mu50
cauacuauaaaaa

SEQ ID NO: 2078346 - RNA, 15 nt, Staphylococcus aureus subsp. aureus Mu50
cauacuauaaaaauu

SEQ ID NO: 2078347 - RNA, 18 nt, Staphylococcus aureus subsp. aureus Mu50
cauacuauaaaaauuuau

SEQ ID NO: 2078348 - RNA, 16 nt, Staphylococcus aureus subsp. aureus Mu50
cauauacgacauuuuu

SEQ ID NO: 2078349 - RNA, 18 nt, Staphylococcus aureus subsp. aureus Mu50
cauauacgacauuuuuag

SEQ ID NO: 2078350 - RNA, 15 nt, Staphylococcus aureus subsp. aureus Mu50
cauauacgacauuuu

SEQ ID NO: 2078351 - RNA, 13 nt, Staphylococcus aureus subsp. aureus Mu50
cauaucuauuuuu

SEQ ID NO: 2078352 - RNA, 16 nt, Staphylococcus aureus subsp. aureus Mu50
cauaucuuuaucauua

SEQ ID NO: 2078353 - RNA, 13 nt, Staphylococcus aureus subsp. aureus Mu50
cauaucuuucaau

SEQ ID NO: 2078354 - RNA, 15 nt, Staphylococcus aureus subsp. aureus Mu50
cauaucuuuugcugu

SEQ ID NO: 2078355 - RNA, 17 nt, Staphylococcus aureus subsp. aureus Mu50
cauaucagcuuuuucau

SEQ ID NO: 2078356 - RNA, 14 nt, Staphylococcus aureus subsp. aureus Mu50
cauaucaugaaugu

SEQ ID NO: 2078357 - RNA, 21 nt, Staphylococcus aureus subsp. aureus Mu50
cauaucaugaaugucagucgu

SEQ ID NO: 2078358 - RNA, 23 nt, Staphylococcus aureus subsp. aureus Mu50
cauauggugaacuguuaaacuca

SEQ ID NO: 2078359 - RNA, 15 nt, Staphylococcus aureus subsp. aureus Mu50
cauauguacuauuau

SEQ ID NO: 2078360 - RNA, 14 nt, Staphylococcus aureus subsp. aureus Mu50
cauauuaacuguua

SEQ ID NO: 2078361 - RNA, 18 nt, Staphylococcus aureus subsp. aureus Mu50
cauauguaauacaaaaga

SEQ ID NO: 2078362 - RNA, 17 nt, Staphylococcus aureus subsp. aureus Mu50
cauauugugccgcuucu

SEQ ID NO: 2078363 - RNA, 20 nt, Staphylococcus aureus subsp. aureus Mu50
cauauugugccgcuucuaca

SEQ ID NO: 2078364 - RNA, 22 nt, Staphylococcus aureus subsp. aureus Mu50
cauauuuagguaauacaucauc

SEQ ID NO: 2078365 - RNA, 11 nt, Staphylococcus aureus subsp. aureus Mu50
cauauucacau

SEQ ID NO: 2078366 - RNA, 15 nt, Staphylococcus aureus subsp. aureus Mu50
cauauucaguauaug

SEQ ID NO: 2078367 - RNA, 13 nt, Staphylococcus aureus subsp. aureus Mu50
caucaaacaacau

SEQ ID NO: 2078368 - RNA, 14 nt, Staphylococcus aureus subsp. aureus Mu50
caucaaacaacauc

SEQ ID NO: 2078369 - RNA, 16 nt, Staphylococcus aureus subsp. aureus Mu50
cauauuucuaaauuau

SEQ ID NO: 2078370 - RNA, 19 nt, Staphylococcus aureus subsp. aureus Mu50
cauauuucuaaauuauuua

SEQ ID NO: 2078371 - RNA, 14 nt, Staphylococcus aureus subsp. aureus Mu50
caucaaaaauaaaa

SEQ ID NO: 2078372 - RNA, 13 nt, Staphylococcus aureus subsp. aureus Mu50
caucaaaaaugag

SEQ ID NO: 2078373 - RNA, 23 nt, Staphylococcus aureus subsp. aureus Mu50
cauauuuaucgcgauuauuacca

SEQ ID NO: 2078374 - RNA, 13 nt, Staphylococcus aureus subsp. aureus Mu50
cauauuuauauuu

SEQ ID NO: 2078375 - RNA, 17 nt, Staphylococcus aureus subsp. aureus Mu50
cauauuuauauuuacac

SEQ ID NO: 2078376 - RNA, 20 nt, Staphylococcus aureus subsp. aureus Mu50
cauauuuaucgcgauuauua

SEQ ID NO: 2078377 - RNA, 13 nt, Staphylococcus aureus subsp. aureus Mu50
cauauuucuaaau

SEQ ID NO: 2078378 - RNA, 19 nt, Staphylococcus aureus subsp. aureus Mu50
caucaauaucuucuucuaa

SEQ ID NO: 2078379 - RNA, 23 nt, Staphylococcus aureus subsp. aureus Mu50
cauaacgacaacuugaacuaaaa

SEQ ID NO: 2078380 - RNA, 22 nt, Staphylococcus aureus subsp. aureus Mu50
cauaacgagcaguauauaucaa

SEQ ID NO: 2078381 - RNA, 13 nt, Staphylococcus aureus subsp. aureus Mu50
cauaacaccuacu

SEQ ID NO: 2078382 - RNA, 14 nt, Staphylococcus aureus subsp. aureus Mu50
cauaacaaagaacc

SEQ ID NO: 2078383 - RNA, 18 nt, Staphylococcus aureus subsp. aureus Mu50
cauaacuuuauauauaaa

SEQ ID NO: 2078384 - RNA, 22 nt, Staphylococcus aureus subsp. aureus Mu50
cauaacuguaguuucuuaauua

SEQ ID NO: 2078385 - RNA, 14 nt, Staphylococcus aureus subsp. aureus Mu50
cauaagaaaauacu

SEQ ID NO: 2078386 - RNA, 16 nt, Staphylococcus aureus subsp. aureus Mu50
cauaagaaaauacuaa

SEQ ID NO: 2078387 - RNA, 16 nt, Staphylococcus aureus subsp. aureus Mu50
cauaacugaauaaacc

SEQ ID NO: 2078388 - RNA, 22 nt, Staphylococcus aureus subsp. aureus Mu50
cauaaggucuuggacuaauaau

SEQ ID NO: 2078389 - RNA, 16 nt, Staphylococcus aureus subsp. aureus Mu50
cauaagccauaugcuu

SEQ ID NO: 2078390 - RNA, 20 nt, Staphylococcus aureus subsp. aureus Mu50
cauaaauaaacuuuaugaaa

SEQ ID NO: 2078391 - RNA, 16 nt, Staphylococcus aureus subsp. aureus Mu50
cauaaauacaaaaaua

SEQ ID NO: 2078392 - RNA, 17 nt, Staphylococcus aureus subsp. aureus Mu50
cauaaauacaaaaauau

SEQ ID NO: 2078393 - RNA, 20 nt, Staphylococcus aureus subsp. aureus Mu50
cauaaauacaaaaauauagc

SEQ ID NO: 2078394 - RNA, 15 nt, Staphylococcus aureus subsp. aureus Mu50
cauaaauacaaaaau

SEQ ID NO: 2078395 - RNA, 18 nt, Staphylococcus aureus subsp. aureus Mu50
cauaaauuaauauaguag

SEQ ID NO: 2078396 - RNA, 20 nt, Staphylococcus aureus subsp. aureus Mu50
cauaaaugcuaaaaguauaa

SEQ ID NO: 2078397 - RNA, 14 nt, Staphylococcus aureus subsp. aureus Mu50
cauaaauauaaaau

SEQ ID NO: 2078398 - RNA, 16 nt, Staphylococcus aureus subsp. aureus Mu50
cauaaauauaaaauau

SEQ ID NO: 2078399 - RNA, 19 nt, Staphylococcus aureus subsp. aureus Mu50
cauaaauauuggaauacuc

SEQ ID NO: 2078400 - RNA, 14 nt, Staphylococcus aureus subsp. aureus Mu50
cauaaaugacugaa

SEQ ID NO: 2078401 - RNA, 12 nt, Staphylococcus aureus subsp. aureus Mu50
cauaaaucaaug

SEQ ID NO: 2078402 - RNA, 20 nt, Staphylococcus aureus subsp. aureus Mu50
cauaaaaaucauaaauaaca

SEQ ID NO: 2078403 - RNA, 17 nt, Staphylococcus aureus subsp. aureus Mu50
cauaaaaaugcucaagu

SEQ ID NO: 2078404 - RNA, 18 nt, Staphylococcus aureus subsp. aureus Mu50
cauaaaacuuacauuaca

SEQ ID NO: 2078405 - RNA, 20 nt, Staphylococcus aureus subsp. aureus Mu50
cauaaaagacagaaauuacu

SEQ ID NO: 2078406 - RNA, 19 nt, Staphylococcus aureus subsp. aureus Mu50
cauaaaacuuacauuacau

SEQ ID NO: 2078407 - RNA, 23 nt, Staphylococcus aureus subsp. aureus Mu50
cauaaaacuuacauuacauauau

SEQ ID NO: 2078408 - RNA, 13 nt, Staphylococcus aureus subsp. aureus Mu50
cauaaaaaaagag

SEQ ID NO: 2078409 - RNA, 15 nt, Staphylococcus aureus subsp. aureus Mu50
cauaaaaaaagaacu

SEQ ID NO: 2078410 - RNA, 12 nt, Staphylococcus aureus subsp. aureus Mu50
cauaaaaauaau

SEQ ID NO: 2078411 - RNA, 20 nt, Staphylococcus aureus subsp. aureus Mu50
cauaaacaauaacuguucuu

SEQ ID NO: 2078412 - RNA, 11 nt, Staphylococcus aureus subsp. aureus Mu50
cauaaaaugag

SEQ ID NO: 2078413 - RNA, 12 nt, Staphylococcus aureus subsp. aureus Mu50
cauaaaauuuaa

SEQ ID NO: 2078414 - RNA, 14 nt, Staphylococcus aureus subsp. aureus Mu50
cauaaaauuucugc

SEQ ID NO: 2078415 - RNA, 17 nt, Staphylococcus aureus subsp. aureus Mu50
cauaauaaucguaaaca

SEQ ID NO: 2078416 - RNA, 18 nt, Staphylococcus aureus subsp. aureus Mu50
cauaauagacuuauauua

SEQ ID NO: 2078417 - RNA, 20 nt, Staphylococcus aureus subsp. aureus Mu50
cauaauagacuuauauuaau

SEQ ID NO: 2078418 - RNA, 22 nt, Staphylococcus aureus subsp. aureus Mu50
cauaauauauuaacaacuuuau

SEQ ID NO: 2078419 - RNA, 16 nt, Staphylococcus aureus subsp. aureus Mu50
cauaaucaagucugca

SEQ ID NO: 2078420 - RNA, 17 nt, Staphylococcus aureus subsp. aureus Mu50
cauaauccauucuucuu

SEQ ID NO: 2078421 - RNA, 19 nt, Staphylococcus aureus subsp. aureus Mu50
cauaauccauucuucuugu

SEQ ID NO: 2078422 - RNA, 18 nt, Staphylococcus aureus subsp. aureus Mu50
cauaauuaccuuuccauu

SEQ ID NO: 2078423 - RNA, 19 nt, Staphylococcus aureus subsp. aureus Mu50
cauaauuaccuuuccauuc

SEQ ID NO: 2078424 - RNA, 22 nt, Staphylococcus aureus subsp. aureus Mu50
cauaauuugauguucuugaaaa

SEQ ID NO: 2078425 - RNA, 17 nt, Staphylococcus aureus subsp. aureus Mu50
cauaauuuaaaagauua

SEQ ID NO: 2078426 - RNA, 11 nt, Staphylococcus aureus subsp. aureus Mu50
cauaauuuaaa

SEQ ID NO: 2078427 - RNA, 15 nt, Staphylococcus aureus subsp. aureus Mu50
cauaauuuguugaua

SEQ ID NO: 2078428 - RNA, 15 nt, Staphylococcus aureus subsp. aureus Mu50
cauaauuuuguuuug

SEQ ID NO: 2078429 - RNA, 11 nt, Staphylococcus aureus subsp. aureus Mu50
cauaaugguuc

SEQ ID NO: 2078430 - RNA, 20 nt, Staphylococcus aureus subsp. aureus Mu50
cauaaugacuauaacaccaa

SEQ ID NO: 2078431 - RNA, 15 nt, Staphylococcus aureus subsp. aureus Mu50
cauaaugaucaagua

SEQ ID NO: 2078432 - RNA, 23 nt, Staphylococcus aureus subsp. aureus Mu50
cauaaucuuuauuaauaaauucu

SEQ ID NO: 2078433 - RNA, 17 nt, Staphylococcus aureus subsp. aureus Mu50
cauaaugaauucauuca

SEQ ID NO: 2078434 - RNA, 20 nt, Staphylococcus aureus subsp. aureus Mu50
cauaaugaauucauucaaua

SEQ ID NO: 2078435 - RNA, 15 nt, Staphylococcus aureus subsp. aureus Mu50
cauacauaacacaag

SEQ ID NO: 2078436 - RNA, 15 nt, Staphylococcus aureus subsp. aureus Mu50
cauacauaucuuuug

SEQ ID NO: 2078437 - RNA, 23 nt, Staphylococcus aureus subsp. aureus Mu50
cauaccacuugaauacuuuuuaa

SEQ ID NO: 2078438 - RNA, 23 nt, Staphylococcus aureus subsp. aureus Mu50
cauacacuaucauuaucaaauaa

SEQ ID NO: 2078439 - RNA, 18 nt, Staphylococcus aureus subsp. aureus Mu50
cauacgaauuaaaauaac

SEQ ID NO: 2078440 - RNA, 15 nt, Staphylococcus aureus subsp. aureus Mu50
cauacccauauuaaa

SEQ ID NO: 2078441 - RNA, 16 nt, Staphylococcus aureus subsp. aureus Mu50
cauaccggcaaauaac

SEQ ID NO: 2078442 - RNA, 14 nt, Staphylococcus aureus subsp. aureus Mu50
caguuuuaaagacu

SEQ ID NO: 2078443 - RNA, 18 nt, Staphylococcus aureus subsp. aureus Mu50
caguuuuauuaucuuugu

SEQ ID NO: 2078444 - RNA, 12 nt, Staphylococcus aureus subsp. aureus Mu50
cauaaaaaaacg

SEQ ID NO: 2078445 - RNA, 19 nt, Staphylococcus aureus subsp. aureus Mu50
caguuuugaagaauaaaaa

SEQ ID NO: 2078446 - RNA, 12 nt, Staphylococcus aureus subsp. aureus Mu50
caguuuuuaaau

SEQ ID NO: 2078447 - RNA, 15 nt, Staphylococcus aureus subsp. aureus Mu50
caguuucaagugcuu

SEQ ID NO: 2078448 - RNA, 21 nt, Staphylococcus aureus subsp. aureus Mu50
caguuucaagugcuugguuaa

SEQ ID NO: 2078449 - RNA, 15 nt, Staphylococcus aureus subsp. aureus Mu50
caguuuauugaggau

SEQ ID NO: 2078450 - RNA, 18 nt, Staphylococcus aureus subsp. aureus Mu50
caguuguuuuuuugucag

SEQ ID NO: 2078451 - RNA, 18 nt, Staphylococcus aureus subsp. aureus Mu50
caguuguuauuuuugcua

SEQ ID NO: 2078452 - RNA, 22 nt, Staphylococcus aureus subsp. aureus Mu50
caguugguauaucgaaagguaa

SEQ ID NO: 2078453 - RNA, 22 nt, Staphylococcus aureus subsp. aureus Mu50
caguucuauagguuuauaaaaa

SEQ ID NO: 2078454 - RNA, 15 nt, Staphylococcus aureus subsp. aureus Mu50
caguugagucaauuu

SEQ ID NO: 2078455 - RNA, 21 nt, Staphylococcus aureus subsp. aureus Mu50
caguugcacaaauugcaaugg

SEQ ID NO: 2078456 - RNA, 23 nt, Staphylococcus aureus subsp. aureus Mu50
caguuagugcuuguuacacauga

SEQ ID NO: 2078457 - RNA, 17 nt, Staphylococcus aureus subsp. aureus Mu50
caguuaugccugaagcg

SEQ ID NO: 2078458 - RNA, 20 nt, Staphylococcus aureus subsp. aureus Mu50
caguguugggggccagccaa

SEQ ID NO: 2078459 - RNA, 19 nt, Staphylococcus aureus subsp. aureus Mu50
caguguuauaauggcgggc

SEQ ID NO: 2078460 - RNA, 18 nt, Staphylococcus aureus subsp. aureus Mu50
caguguuugacugaauga

SEQ ID NO: 2078461 - RNA, 12 nt, Staphylococcus aureus subsp. aureus Mu50
caguuaauaauu

SEQ ID NO: 2078462 - RNA, 13 nt, Staphylococcus aureus subsp. aureus Mu50
caguuaauaugaa

SEQ ID NO: 2078463 - RNA, 21 nt, Staphylococcus aureus subsp. aureus Mu50
caguuacuuucgcuugcaaag

SEQ ID NO: 2078464 - RNA, 13 nt, Staphylococcus aureus subsp. aureus Mu50
caguguaugauga

SEQ ID NO: 2078465 - RNA, 16 nt, Staphylococcus aureus subsp. aureus Mu50
cagugcuauguauuuu

SEQ ID NO: 2078466 - RNA, 17 nt, Staphylococcus aureus subsp. aureus Mu50
caguggauuacagauga

SEQ ID NO: 2078467 - RNA, 19 nt, Staphylococcus aureus subsp. aureus Mu50
caguggauuacagaugaug

SEQ ID NO: 2078468 - RNA, 21 nt, Staphylococcus aureus subsp. aureus Mu50
aaaaugcgcuuccaauuuaaa

SEQ ID NO: 2078469 - RNA, 13 nt, Staphylococcus aureus subsp. aureus Mu50
aaaaugccaacua

SEQ ID NO: 2078470 - RNA, 12 nt, Staphylococcus aureus subsp. aureus Mu50
cagcaaauaaaa

SEQ ID NO: 2078471 - RNA, 21 nt, Staphylococcus aureus subsp. aureus Mu50
aaaaugauagcuaaacauuuu

SEQ ID NO: 2078472 - RNA, 23 nt, Staphylococcus aureus subsp. aureus Mu50
aaaaugauguaacguuucuuugu

SEQ ID NO: 2078473 - RNA, 15 nt, Staphylococcus aureus subsp. aureus Mu50
aaaaugcauagcucu

SEQ ID NO: 2078474 - RNA, 15 nt, Staphylococcus aureus subsp. aureus Mu50
cagauccauaaggau

SEQ ID NO: 2078475 - RNA, 18 nt, Staphylococcus aureus subsp. aureus Mu50
aaaaucggcuuucuaagu

SEQ ID NO: 2078476 - RNA, 19 nt, Staphylococcus aureus subsp. aureus Mu50
aaaaucggauuaacauuau

SEQ ID NO: 2078477 - RNA, 17 nt, Staphylococcus aureus subsp. aureus Mu50
aaaaugucuuugaaaaa

SEQ ID NO: 2078478 - RNA, 16 nt, Staphylococcus aureus subsp. aureus Mu50
aaaauguuaauaauga

SEQ ID NO: 2078479 - RNA, 17 nt, Staphylococcus aureus subsp. aureus Mu50
aaaauguuacacaaauu

SEQ ID NO: 2078480 - RNA, 18 nt, Staphylococcus aureus subsp. aureus Mu50
aaaauggcgaaaaagcua

SEQ ID NO: 2078481 - RNA, 20 nt, Staphylococcus aureus subsp. aureus Mu50
aaaaugucauuugaauccaa

SEQ ID NO: 2078482 - RNA, 22 nt, Staphylococcus aureus subsp. aureus Mu50
aaaauguaggcgccauaaucau

SEQ ID NO: 2078483 - RNA, 21 nt, Staphylococcus aureus subsp. aureus Mu50
aaaauccucacaaauuugaau

SEQ ID NO: 2078484 - RNA, 22 nt, Staphylococcus aureus subsp. aureus Mu50
aaaaucgaacaaaugaaaaagu

SEQ ID NO: 2078485 - RNA, 18 nt, Staphylococcus aureus subsp. aureus Mu50
aaaaucgcgucugauucu

SEQ ID NO: 2078486 - RNA, 21 nt, Staphylococcus aureus subsp. aureus Mu50
aaaaucgcgucugauucucua

SEQ ID NO: 2078487 - RNA, 16 nt, Staphylococcus aureus subsp. aureus Mu50
cagauaauuauuucua

SEQ ID NO: 2078488 - RNA, 17 nt, Staphylococcus aureus subsp. aureus Mu50
aaaaucacgcuaacauu

SEQ ID NO: 2078489 - RNA, 18 nt, Staphylococcus aureus subsp. aureus Mu50
aaaaucacgcuaacauuc

SEQ ID NO: 2078490 - RNA, 20 nt, Staphylococcus aureus subsp. aureus Mu50
cagaaugaacuucucuuagu

SEQ ID NO: 2078491 - RNA, 23 nt, Staphylococcus aureus subsp. aureus Mu50
cagacgaaacacacuaaaagcug

SEQ ID NO: 2078492 - RNA, 12 nt, Staphylococcus aureus subsp. aureus Mu50
cagaaaguugca

SEQ ID NO: 2078493 - RNA, 13 nt, Staphylococcus aureus subsp. aureus Mu50
cagaacuaaugua

SEQ ID NO: 2078494 - RNA, 17 nt, Staphylococcus aureus subsp. aureus Mu50
cagaaaagggcaaaaaa

SEQ ID NO: 2078495 - RNA, 18 nt, Staphylococcus aureus subsp. aureus Mu50
cagaaaagggcaaaaaag

SEQ ID NO: 2078496 - RNA, 22 nt, Staphylococcus aureus subsp. aureus Mu50
cagaaaagcagucgaacaauga

SEQ ID NO: 2078497 - RNA, 12 nt, Staphylococcus aureus subsp. aureus Mu50
aaaauaucauuu

SEQ ID NO: 2078498 - RNA, 16 nt, Staphylococcus aureus subsp. aureus Mu50
cacuuuaggguucauu

SEQ ID NO: 2078499 - RNA, 23 nt, Staphylococcus aureus subsp. aureus Mu50
cacuuuaaacaagcaucaugaaa

SEQ ID NO: 2078500 - RNA, 22 nt, Staphylococcus aureus subsp. aureus Mu50
cacuugguacaccuacaaauau

SEQ ID NO: 2078501 - RNA, 19 nt, Staphylococcus aureus subsp. aureus Mu50
aaaauaucugaaaaaccaa

SEQ ID NO: 2078502 - RNA, 20 nt, Staphylococcus aureus subsp. aureus Mu50
aaaauaugauugcaaauuau

SEQ ID NO: 2078503 - RNA, 13 nt, Staphylococcus aureus subsp. aureus Mu50
cacuuuauaauuu

SEQ ID NO: 2078504 - RNA, 19 nt, Staphylococcus aureus subsp. aureus Mu50
aaaauauugcguuuaauuu

SEQ ID NO: 2078505 - RNA, 14 nt, Staphylococcus aureus subsp. aureus Mu50
cacuucgccaagcc

SEQ ID NO: 2078506 - RNA, 20 nt, Staphylococcus aureus subsp. aureus Mu50
cacuucgccaagccaucuuu

SEQ ID NO: 2078507 - RNA, 17 nt, Staphylococcus aureus subsp. aureus Mu50
cacuuccaucaauccaa

SEQ ID NO: 2078508 - RNA, 18 nt, Staphylococcus aureus subsp. aureus Mu50
cacuucaucuaaaugaug

SEQ ID NO: 2078509 - RNA, 17 nt, Staphylococcus aureus subsp. aureus Mu50
cacuugaccacuuuugu

SEQ ID NO: 2078510 - RNA, 20 nt, Staphylococcus aureus subsp. aureus Mu50
cacuugaauacuuuuuaacu

SEQ ID NO: 2078511 - RNA, 12 nt, Staphylococcus aureus subsp. aureus Mu50
cacuucuucacc

SEQ ID NO: 2078512 - RNA, 16 nt, Staphylococcus aureus subsp. aureus Mu50
cacuuguaauauuaua

SEQ ID NO: 2078513 - RNA, 23 nt, Staphylococcus aureus subsp. aureus Mu50
cacuuggcuuaggaugaaaauau

SEQ ID NO: 2078514 - RNA, 13 nt, Staphylococcus aureus subsp. aureus Mu50
cacuugguacacc

SEQ ID NO: 2078515 - RNA, 18 nt, Staphylococcus aureus subsp. aureus Mu50
cacuuggauucaaaugac

SEQ ID NO: 2078516 - RNA, 14 nt, Staphylococcus aureus subsp. aureus Mu50
cacuguauuuacua

SEQ ID NO: 2078517 - RNA, 21 nt, Staphylococcus aureus subsp. aureus Mu50
cacuguauggucuggaauaaa

SEQ ID NO: 2078518 - RNA, 22 nt, Staphylococcus aureus subsp. aureus Mu50
cacuguaacgaguccauuuucu

SEQ ID NO: 2078519 - RNA, 23 nt, Staphylococcus aureus subsp. aureus Mu50
cacuuagauuccccuuuuugucu

SEQ ID NO: 2078520 - RNA, 13 nt, Staphylococcus aureus subsp. aureus Mu50
cacuuacaaauau

SEQ ID NO: 2078521 - RNA, 21 nt, Staphylococcus aureus subsp. aureus Mu50
cacuuaaucguucccauucuu

SEQ ID NO: 2078522 - RNA, 17 nt, Staphylococcus aureus subsp. aureus Mu50
cacuuaauaaauaauuu

SEQ ID NO: 2078523 - RNA, 18 nt, Staphylococcus aureus subsp. aureus Mu50
cacuuaugauacugauau

SEQ ID NO: 2078524 - RNA, 13 nt, Staphylococcus aureus subsp. aureus Mu50
cacuucaaacaaa

SEQ ID NO: 2078525 - RNA, 17 nt, Staphylococcus aureus subsp. aureus Mu50
cacuucaaacaaagggg

SEQ ID NO: 2078526 - RNA, 14 nt, Staphylococcus aureus subsp. aureus Mu50
cacuucaaaagaaa

SEQ ID NO: 2078527 - RNA, 13 nt, Staphylococcus aureus subsp. aureus Mu50
cacuuaacucaaa

SEQ ID NO: 2078528 - RNA, 18 nt, Staphylococcus aureus subsp. aureus Mu50
cacuguuuuauaaaugaa

SEQ ID NO: 2078529 - RNA, 12 nt, Staphylococcus aureus subsp. aureus Mu50
cacucauaaccg

SEQ ID NO: 2078530 - RNA, 18 nt, Staphylococcus aureus subsp. aureus Mu50
cacucauaaccgcuucuu

SEQ ID NO: 2078531 - RNA, 19 nt, Staphylococcus aureus subsp. aureus Mu50
cacucauaaucaagucugc

SEQ ID NO: 2078532 - RNA, 12 nt, Staphylococcus aureus subsp. aureus Mu50
cacuauuuuuau

SEQ ID NO: 2078533 - RNA, 17 nt, Staphylococcus aureus subsp. aureus Mu50
cacucaauucucuaacu

SEQ ID NO: 2078534 - RNA, 15 nt, Staphylococcus aureus subsp. aureus Mu50
cacuaggaucuuuuc

SEQ ID NO: 2078535 - RNA, 15 nt, Staphylococcus aureus subsp. aureus Mu50
cacuauaaaauucac

SEQ ID NO: 2078536 - RNA, 11 nt, Staphylococcus aureus subsp. aureus Mu50
cacuauaaaag

SEQ ID NO: 2078537 - RNA, 13 nt, Staphylococcus aureus subsp. aureus Mu50
cacuauaauuucu

SEQ ID NO: 2078538 - RNA, 11 nt, Staphylococcus aureus subsp. aureus Mu50
cacuaucuuuu

SEQ ID NO: 2078539 - RNA, 15 nt, Staphylococcus aureus subsp. aureus Mu50
cacuaucuuuugcuu

SEQ ID NO: 2078540 - RNA, 18 nt, Staphylococcus aureus subsp. aureus Mu50
cacguguauuguauuuua

SEQ ID NO: 2078541 - RNA, 22 nt, Staphylococcus aureus subsp. aureus Mu50
aaaauaguucuuuaaauuauau

SEQ ID NO: 2078542 - RNA, 24 nt, Staphylococcus aureus subsp. aureus Mu50
aaaauaguucuuuaaauuauauac

SEQ ID NO: 2078543 - RNA, 16 nt, Staphylococcus aureus subsp. aureus Mu50
cacuaaaaauauauuu

SEQ ID NO: 2078544 - RNA, 19 nt, Staphylococcus aureus subsp. aureus Mu50
cacguucuugguauuuuuu

SEQ ID NO: 2078545 - RNA, 16 nt, Staphylococcus aureus subsp. aureus Mu50
cacuaaugcauaauua

SEQ ID NO: 2078546 - RNA, 24 nt, Staphylococcus aureus subsp. aureus Mu50
cacuacgcugaugaaugauugcau

SEQ ID NO: 2078547 - RNA, 19 nt, Staphylococcus aureus subsp. aureus Mu50
cacuaaaugugacuuuaaa

SEQ ID NO: 2078548 - RNA, 15 nt, Staphylococcus aureus subsp. aureus Mu50
cacuccuauuguuuu

SEQ ID NO: 2078549 - RNA, 22 nt, Staphylococcus aureus subsp. aureus Mu50
cacuccucuauuuuaugauuug

SEQ ID NO: 2078550 - RNA, 18 nt, Staphylococcus aureus subsp. aureus Mu50
cacuccuuaaacaaauaa

SEQ ID NO: 2078551 - RNA, 20 nt, Staphylococcus aureus subsp. aureus Mu50
cacuccuuaaacaaauaaau

SEQ ID NO: 2078552 - RNA, 23 nt, Staphylococcus aureus subsp. aureus Mu50
cacucuagagguaaaucuaucua

SEQ ID NO: 2078553 - RNA, 14 nt, Staphylococcus aureus subsp. aureus Mu50
cacugaaaucuaga

SEQ ID NO: 2078554 - RNA, 17 nt, Staphylococcus aureus subsp. aureus Mu50
cacugacaugauaaauu

SEQ ID NO: 2078555 - RNA, 15 nt, Staphylococcus aureus subsp. aureus Mu50
cacugacaugauaaa

SEQ ID NO: 2078556 - RNA, 17 nt, Staphylococcus aureus subsp. aureus Mu50
cacugagcaacaaaaga

SEQ ID NO: 2078557 - RNA, 17 nt, Staphylococcus aureus subsp. aureus Mu50
cacugagaauuucuaau

SEQ ID NO: 2078558 - RNA, 14 nt, Staphylococcus aureus subsp. aureus Mu50
cacugcaacauuug

SEQ ID NO: 2078559 - RNA, 14 nt, Staphylococcus aureus subsp. aureus Mu50
cacugccuuuuugu

SEQ ID NO: 2078560 - RNA, 21 nt, Staphylococcus aureus subsp. aureus Mu50
aaaauuccuagcuuuuauguc

SEQ ID NO: 2078561 - RNA, 13 nt, Staphylococcus aureus subsp. aureus Mu50
aaaauucucuuuu

SEQ ID NO: 2078562 - RNA, 15 nt, Staphylococcus aureus subsp. aureus Mu50
aaaauuauguaaaaa

SEQ ID NO: 2078563 - RNA, 11 nt, Staphylococcus aureus subsp. aureus Mu50
aaaauuauaug

SEQ ID NO: 2078564 - RNA, 18 nt, Staphylococcus aureus subsp. aureus Mu50
aaaauuauauaaauuacc

SEQ ID NO: 2078565 - RNA, 14 nt, Staphylococcus aureus subsp. aureus Mu50
aaaauucaccaacu

SEQ ID NO: 2078566 - RNA, 18 nt, Staphylococcus aureus subsp. aureus Mu50
aaaauuauugaauuugaa

SEQ ID NO: 2078567 - RNA, 15 nt, Staphylococcus aureus subsp. aureus Mu50
aaaauuauuaaaaaa

SEQ ID NO: 2078568 - RNA, 12 nt, Staphylococcus aureus subsp. aureus Mu50
aaaauuauuaaa

SEQ ID NO: 2078569 - RNA, 22 nt, Staphylococcus aureus subsp. aureus Mu50
aaaauuaaauaaugauaaauua

SEQ ID NO: 2078570 - RNA, 16 nt, Staphylococcus aureus subsp. aureus Mu50
aaaauguuuaacaaua

SEQ ID NO: 2078571 - RNA, 13 nt, Staphylococcus aureus subsp. aureus Mu50
aaaauuaaaaaac

SEQ ID NO: 2078572 - RNA, 17 nt, Staphylococcus aureus subsp. aureus Mu50
aaaauguuuaacaauaa

SEQ ID NO: 2078573 - RNA, 17 nt, Staphylococcus aureus subsp. aureus Mu50
aaaauuaaaaaacaaaa

SEQ ID NO: 2078574 - RNA, 14 nt, Staphylococcus aureus subsp. aureus Mu50
cagcgacauuuuua

SEQ ID NO: 2078575 - RNA, 14 nt, Staphylococcus aureus subsp. aureus Mu50
cagguaaugcaagu

SEQ ID NO: 2078576 - RNA, 18 nt, Staphylococcus aureus subsp. aureus Mu50
cagguaaugcaaguuggg

SEQ ID NO: 2078577 - RNA, 14 nt, Staphylococcus aureus subsp. aureus Mu50
aaacaaaagaaagu

SEQ ID NO: 2078578 - RNA, 15 nt, Staphylococcus aureus subsp. aureus Mu50
aaacaaaaaacuucc

SEQ ID NO: 2078579 - RNA, 17 nt, Staphylococcus aureus subsp. aureus Mu50
aaacaaaaaauaucuuu

SEQ ID NO: 2078580 - RNA, 21 nt, Staphylococcus aureus subsp. aureus Mu50
aaacaaaaaauaucuuuuugu

SEQ ID NO: 2078581 - RNA, 14 nt, Staphylococcus aureus subsp. aureus Mu50
cagggaaaucaucu

SEQ ID NO: 2078582 - RNA, 20 nt, Staphylococcus aureus subsp. aureus Mu50
caggcgaaccgaagcgcagu

SEQ ID NO: 2078583 - RNA, 17 nt, Staphylococcus aureus subsp. aureus Mu50
caggcgaaccgaagcgc

SEQ ID NO: 2078584 - RNA, 19 nt, Staphylococcus aureus subsp. aureus Mu50
aaaauuucaccgcuuucaa

SEQ ID NO: 2078585 - RNA, 19 nt, Staphylococcus aureus subsp. aureus Mu50
cagcuggcaaauacaacuc

SEQ ID NO: 2078586 - RNA, 23 nt, Staphylococcus aureus subsp. aureus Mu50
aaaauugaaggaaaauaaaaacc

SEQ ID NO: 2078587 - RNA, 19 nt, Staphylococcus aureus subsp. aureus Mu50
cagcuaaaaguuucccaag

SEQ ID NO: 2078588 - RNA, 16 nt, Human
uuaaaguaaaggcaaa

SEQ ID NO: 2078589 - RNA, 16 nt, Human
gcuauuugcuguuauu

SEQ ID NO: 2078590 - RNA, 15 nt, Human
uacuguaagaaaaua

SEQ ID NO: 2078591 - RNA, 19 nt, Human
ucaaucagccuaguugauc

SEQ ID NO: 2078592 - RNA, 14 nt, Human
ugcagaagacagua

SEQ ID NO: 2078593 - RNA, 17 nt, Human
ugcuggagacauugagg

SEQ ID NO: 2078594 - RNA, 22 nt, Human
ucauuuuagggguagcauuugu

SEQ ID NO: 2078595 - RNA, 17 nt, Human
uccaccuacaugaggua

SEQ ID NO: 2078596 - RNA, 21 nt, Human
ugaaguccaagcauuuagaug

SEQ ID NO: 2078597 - RNA, 15 nt, Human
ugauuuuauaugcua

SEQ ID NO: 2078598 - RNA, 22 nt, Human
gauguuuagaaacacaacuaua

SEQ ID NO: 2078599 - RNA, 19 nt, Human
cuugaugaagaaguugaua

SEQ ID NO: 2078600 - RNA, 18 nt, Human
gaauucuguugauggaaa

SEQ ID NO: 2078601 - RNA, 20 nt, Human
gaacuuccagauccuggaaa

SEQ ID NO: 2078602 - RNA, 18 nt, Human
gacauuugcucauggaau

SEQ ID NO: 2078603 - RNA, 14 nt, Human
uuagggguagcauu

SEQ ID NO: 2078604 - RNA, 18 nt, Human
cgcauccuagucucuauc

SEQ ID NO: 2078605 - RNA, 20 nt, Human
aaaacuuauccuccaugaau

SEQ ID NO: 2078606 - RNA, 17 nt, Human
aagcaccaaucaugaau

SEQ ID NO: 2078607 - RNA, 20 nt, Human
aaaaacguauugcauuuaau

SEQ ID NO: 2078608 - RNA, 12 nt, Human
aaguucuaguga

SEQ ID NO: 2078609 - RNA, 14 nt, Human
aagguacuucaaau

SEQ ID NO: 2078610 - RNA, 11 nt, Human
acacuguuauc

SEQ ID NO: 2078611 - RNA, 21 nt, Human
acuauuuaauuauuucacuuu

SEQ ID NO: 2078612 - RNA, 23 nt, Human
aauuugguuuucacauuggaaac

SEQ ID NO: 2078613 - RNA, 19 nt, Human
aagaagagccggagccucc

SEQ ID NO: 2078614 - RNA, 14 nt, Human
aucaggcuggccaa

SEQ ID NO: 2078615 - RNA, 21 nt, Human
augcuagaacucccuuucaac

SEQ ID NO: 2078616 - RNA, 13 nt, Human
agucauucagaua

SEQ ID NO: 2078617 - RNA, 18 nt, Human
agaauuucuaaaaguuua

SEQ ID NO: 2078618 - RNA, 14 nt, Human
agauuuaccacuug

SEQ ID NO: 2078619 - RNA, 11 nt, Human
cgacggagccg

SEQ ID NO: 2078620 - RNA, 21 nt, Human
ccucagucucccucccuuggg

SEQ ID NO: 2078621 - RNA, 14 nt, Human
ccuccauccugagg

SEQ ID NO: 2078622 - RNA, 23 nt, Human
ccugcuagaacagucucuugagg

SEQ ID NO: 2078623 - RNA, 22 nt, Human
ccagucugacuguuuccaucaa

SEQ ID NO: 2078624 - RNA, 18 nt, Human
ccauccugaggcuccacu

SEQ ID NO: 2078625 - RNA, 16 nt, Human
cccagagcuacaggcc

SEQ ID NO: 2078626 - RNA, 22 nt, Human
auguauuacaguggggaaugaa

SEQ ID NO: 2078627 - RNA, 18 nt, Human
auguauguacuucaugcu

SEQ ID NO: 2078628 - RNA, 17 nt, Human
auguuucaaacauauau

SEQ ID NO: 2078629 - RNA, 15 nt, Human
auguuuagaaacaca

SEQ ID NO: 2078630 - RNA, 15 nt, Human
cagcccuuagcccuu

SEQ ID NO: 2078631 - RNA, 18 nt, Human
cauccuagucucuaucau

SEQ ID NO: 2078632 - RNA, 19 nt, Human
cauccuagucucuaucauu

SEQ ID NO: 2078633 - RNA, 17 nt, Human
caugaauuaguuuuaua

SEQ ID NO: 2078634 - RNA, 17 nt, Human
gccgguccuugcugcac

SEQ ID NO: 2078635 - RNA, 14 nt, Human
gcuugaaaccuuca

SEQ ID NO: 2078636 - RNA, 19 nt, Human
gacagucaccucauggaau

SEQ ID NO: 2078637 - RNA, 11 nt, Human
gauacagaaaa

SEQ ID NO: 2078638 - RNA, 23 nt, Human
cgcuuccgcauccuagucucuau

SEQ ID NO: 2078639 - RNA, 16 nt, Human
cuagaaaacaggcaaa

SEQ ID NO: 2078640 - RNA, 20 nt, Human
cuugccuaggcauagcccug

SEQ ID NO: 2078641 - RNA, 23 nt, Human
cuucagccugaaagaggaaugaa

SEQ ID NO: 2078642 - RNA, 17 nt, Human
uauguacuucaugcugu

SEQ ID NO: 2078643 - RNA, 15 nt, Human
uaugcuucuguuuua

SEQ ID NO: 2078644 - RNA, 12 nt, Human
uauuuuguuuca

SEQ ID NO: 2078645 - RNA, 19 nt, Human
guagaggagaaacuggaac

SEQ ID NO: 2078646 - RNA, 16 nt, Human
uccuagucucuaucau

SEQ ID NO: 2078647 - RNA, 20 nt, Human
uccucaaaacuucagacaua

SEQ ID NO: 2078648 - RNA, 18 nt, Human
ugaacuagaguuuagcug

SEQ ID NO: 2078649 - RNA, 14 nt, Human
ugaagaaguugaua

SEQ ID NO: 2078650 - RNA, 20 nt, Human
ugcugagccccaaguggaac

SEQ ID NO: 2078651 - RNA, 21 nt, Human
uggggaauauguuagagaauu

SEQ ID NO: 2078652 - RNA, 13 nt, Human
ucuauguagaaua

SEQ ID NO: 2078653 - RNA, 19 nt, Human
ucucagcuucacccugagg

SEQ ID NO: 2078654 - RNA, 12 nt, Human
ucggacggcucc

SEQ ID NO: 2078655 - RNA, 13 nt, Human
ucugagccuuggg

SEQ ID NO: 2078656 - RNA, 16 nt, Human
ucucuaucauuaaagu

SEQ ID NO: 2078657 - RNA, 16 nt, Human
ugggucgccggcaucu

SEQ ID NO: 2078658 - RNA, 21 nt, Human
ugaacaguuguguuugaagca

SEQ ID NO: 2078659 - RNA, 19 nt, Human
ugggagcuuuuguagaagu

SEQ ID NO: 2078660 - RNA, 14 nt, Human
uucaggggccacac

SEQ ID NO: 2078661 - RNA, 13 nt, Human
uuguaaaauggug

SEQ ID NO: 2078662 - RNA, 13 nt, Human
uuguuaaaugauu

SEQ ID NO: 2078663 - RNA, 15 nt, Human
uucuuccucccauuc

SEQ ID NO: 2078664 - RNA, 14 nt, Human
uaauuugguuuuca

SEQ ID NO: 2078665 - RNA, 14 nt, Human
uaauaauguuucaa

SEQ ID NO: 2078666 - RNA, 11 nt, Human
uaauuggaaag

SEQ ID NO: 2078667 - RNA, 18 nt, Human
uaauuagcauggccacau

SEQ ID NO: 2078668 - RNA, 15 nt, Human
gugaggagcuggaaa

SEQ ID NO: 2078669 - RNA, 22 nt, Human
uacgugggcauucaaauguauu

SEQ ID NO: 2078670 - RNA, 22 nt, Human
uauuuacggaacucaaauacgu

SEQ ID NO: 2078671 - RNA, 18 nt, Human
uauuuuaauaauguuuca

SEQ ID NO: 2078672 - RNA, 17 nt, Human
uauuuucaugcuguuca

SEQ ID NO: 2078673 - RNA, 15 nt, Human
uaugccuuuucccaa

SEQ ID NO: 2078674 - RNA, 22 nt, Human
ucaauaaaauccauacauuugu

SEQ ID NO: 2078675 - RNA, 23 nt, Human
aaacuuugauuuuauaugcuauu

SEQ ID NO: 2078676 - RNA, 13 nt, Human
aauauuucagaua

SEQ ID NO: 2078677 - RNA, 17 nt, Human
aauauuauguuaaaacu

SEQ ID NO: 2078678 - RNA, 20 nt, Human
aaguaaacggucucucacuu

SEQ ID NO: 2078679 - RNA, 13 nt, Human
aaagaagagccgg

SEQ ID NO: 2078680 - RNA, 21 nt, Human
aaaggacaccauuuuggcaag

SEQ ID NO: 2078681 - RNA, 14 nt, Human
aaaccgaacugaug

SEQ ID NO: 2078682 - RNA, 13 nt, Human
aaacuuuuggaag

SEQ ID NO: 2078683 - RNA, 19 nt, Human
aaaaucucaauauuucaga

SEQ ID NO: 2078684 - RNA, 15 nt, Human
aaaaugugauaugua

SEQ ID NO: 2078685 - RNA, 22 nt, Human
aaugauaacuggaaacuucagc

SEQ ID NO: 2078686 - RNA, 22 nt, Human
acauauauaacaaugcuguauu

SEQ ID NO: 2078687 - RNA, 17 nt, Human
acuguuaucuucacuuu

SEQ ID NO: 2078688 - RNA, 21 nt, Human
accugggaaagggcuguuaua

SEQ ID NO: 2078689 - RNA, 13 nt, Human
aauguuucaaaca

SEQ ID NO: 2078690 - RNA, 19 nt, Human
aauaucuccgucaacucau

SEQ ID NO: 2078691 - RNA, 13 nt, Human
augaaugaaugaa

SEQ ID NO: 2078692 - RNA, 23 nt, Human
augacuuguacucugaaaguuuu

SEQ ID NO: 2078693 - RNA, 23 nt, Human
augagcacgcauggaaaaguuuc

SEQ ID NO: 2078694 - RNA, 17 nt, Human
auugaggcuuuaaaacu

SEQ ID NO: 2078695 - RNA, 17 nt, Human
agcuacuuauuguagca

SEQ ID NO: 2078696 - RNA, 13 nt, Human
agccuccagcugc

SEQ ID NO: 2078697 - RNA, 16 nt, Human
agcauuccaacuaucu

SEQ ID NO: 2078698 - RNA, 18 nt, Human
acauuccugaacaggaua

SEQ ID NO: 2078699 - RNA, 22 nt, Human
acaucuagugagcagucaggaa

SEQ ID NO: 2078700 - RNA, 16 nt, Human
aauuacauuuguauaa

SEQ ID NO: 2078701 - RNA, 13 nt, Human
aguuuuauaugcu

SEQ ID NO: 2078702 - RNA, 14 nt, Human
aggacugaauuaug

SEQ ID NO: 2078703 - RNA, 15 nt, Human
cacuuaaaaaugguu

SEQ ID NO: 2078704 - RNA, 24 nt, Human
cacuugucaauaaaauccauacau

SEQ ID NO: 2078705 - RNA, 16 nt, Human
auucaacaucuaguga

SEQ ID NO: 2078706 - RNA, 14 nt, Human
caucaaugaaugaa

SEQ ID NO: 2078707 - RNA, 12 nt, Human
ccauucaggaug

SEQ ID NO: 2078708 - RNA, 12 nt, Human
auccugaggcuc

SEQ ID NO: 2078709 - RNA, 21 nt, Human
auccugaggcuccacuugguc

SEQ ID NO: 2078710 - RNA, 18 nt, Human
augccccauucaacaucu

SEQ ID NO: 2078711 - RNA, 19 nt, Human
auagugaggcaucgcaaug

SEQ ID NO: 2078712 - RNA, 21 nt, Human
aguuuuauaugcuucuguuuu

SEQ ID NO: 2078713 - RNA, 20 nt, Human
auaucuccgucaacucauau

SEQ ID NO: 2078714 - RNA, 18 nt, Human
aucaguuauuuuuaaacu

SEQ ID NO: 2078715 - RNA, 16 nt, Human
uuuccugggagcuuuu

SEQ ID NO: 2078716 - RNA, 18 nt, Human
uuuuaaaaaagaaacauu

SEQ ID NO: 2078717 - RNA, 14 nt, Human
uuuaaauagcuuuu

SEQ ID NO: 2078718 - RNA, 16 nt, Human
agucauucagauauga

SEQ ID NO: 2078719 - RNA, 17 nt, Human
agcuuauugucuaguga

SEQ ID NO: 2078720 - RNA, 21 nt, Human
uaauuuguaguguuggagaag

SEQ ID NO: 2078721 - RNA, 14 nt, Human
uacauaaauuuagu

SEQ ID NO: 2078722 - RNA, 21 nt, Human
uacaucccuuaccugggaaag

SEQ ID NO: 2078723 - RNA, 13 nt, Human
uaaucuuucacag

SEQ ID NO: 2078724 - RNA, 16 nt, Human
uaauguuucaaacaua

SEQ ID NO: 2078725 - RNA, 23 nt, Human
guucuaugagggcuaauaucuua

SEQ ID NO: 2078726 - RNA, 16 nt, Human
ucaaauguauuacagu

SEQ ID NO: 2078727 - RNA, 12 nt, Human
ucacuuguuuua

SEQ ID NO: 2078728 - RNA, 14 nt, Human
ucaccccuugccau

SEQ ID NO: 2078729 - RNA, 17 nt, Human
ucauauuuucaugcugu

SEQ ID NO: 2078730 - RNA, 12 nt, Human
ugauucaaaugu

SEQ ID NO: 2078731 - RNA, 20 nt, Human
ugauuaugaauuacauuugu

SEQ ID NO: 2078732 - RNA, 17 nt, Human
ucugugagaugcuagaa

SEQ ID NO: 2078733 - RNA, 11 nt, Human
gcuaugcuauu

SEQ ID NO: 2078734 - RNA, 20 nt, Human
gggaaugaagauacugaaau

SEQ ID NO: 2078735 - RNA, 21 nt, Human
ggcuuuaacuccugcuagaac

SEQ ID NO: 2078736 - RNA, 23 nt, Human
guguugcagugucugcuggagac

SEQ ID NO: 2078737 - RNA, 14 nt, Human
gcauuccaacuauc

SEQ ID NO: 2078738 - RNA, 15 nt, Human
gccaaacauccuaca

SEQ ID NO: 2078739 - RNA, 19 nt, Human
gcacagugaucaaguuauu

SEQ ID NO: 2078740 - RNA, 15 nt, Human
gagaaucacuugaac

SEQ ID NO: 2078741 - RNA, 20 nt, Human
gaaaugagcacgcauggaaa

SEQ ID NO: 2078742 - RNA, 18 nt, Human
cugauaugggucuugaua

SEQ ID NO: 2078743 - RNA, 21 nt, Human
agauuuuccugaaaacccuug

SEQ ID NO: 2078744 - RNA, 20 nt, Human
agauacugaaauaaacgucu

SEQ ID NO: 2078745 - RNA, 15 nt, Human
agcagggacuugaac

SEQ ID NO: 2078746 - RNA, 21 nt, Human
agagcuacaggccccaucugg

SEQ ID NO: 2078747 - RNA, 20 nt, Human
ucucacuuguuuuauuuaac

SEQ ID NO: 2078748 - RNA, 20 nt, Human
accucauggaauuggagcuc

SEQ ID NO: 2078749 - RNA, 16 nt, Human
gcagugucugcuggag

SEQ ID NO: 2078750 - RNA, 13 nt, Human
uaugaaauauuau

SEQ ID NO: 2078751 - RNA, 15 nt, Human
aagccaugugcagcc

SEQ ID NO: 2078752 - RNA, 19 nt, Human
uggccacaucugagccccg

SEQ ID NO: 2078753 - RNA, 17 nt, Human
ucauacuucuuaggguu

SEQ ID NO: 2078754 - RNA, 12 nt, Human
aagagcuuaaca

SEQ ID NO: 2078755 - RNA, 22 nt, Human
accuuaucuauguagaauauau

SEQ ID NO: 2078756 - RNA, 12 nt, Human
caagaaggaaag

SEQ ID NO: 2078757 - RNA, 22 nt, Human
caaacaauuugaauauaaauuu

SEQ ID NO: 2078758 - RNA, 19 nt, Human
gcuguuccucgccacgcuc

SEQ ID NO: 2078759 - RNA, 14 nt, Human
uuauaucuauauuu

SEQ ID NO: 2078760 - RNA, 22 nt, Human
aaaucaggguuaguauugucca

SEQ ID NO: 2078761 - RNA, 20 nt, Human
aauuaaguuuuuuuuuaaaa

SEQ ID NO: 2078762 - RNA, 22 nt, Human
agagccggagccuccagcugcc

SEQ ID NO: 2078763 - RNA, 19 nt, Human
ucuguuuucccuccuugga

SEQ ID NO: 2078764 - RNA, 16 nt, Human
uguucuaagaagugaa

SEQ ID NO: 2078765 - RNA, 19 nt, Human
uaaccucuaaauucuuuca

SEQ ID NO: 2078766 - RNA, 19 nt, Human
uuccucccuucucuucaca

SEQ ID NO: 2078767 - RNA, 12 nt, Human
uauuuuuuucug

SEQ ID NO: 2078768 - RNA, 17 nt, Human
gccgggaaagaagagcc

SEQ ID NO: 2078769 - RNA, 13 nt, Human
acuauuauauuuc

SEQ ID NO: 2078770 - RNA, 20 nt, Human
gaaacaagucagucauucag

SEQ ID NO: 2078771 - RNA, 23 nt, Human
ggacggcuccggacgcugcugcc

SEQ ID NO: 2078772 - RNA, 12 nt, Human
ucaccccuugcc

SEQ ID NO: 2078773 - RNA, 15 nt, Human
cuucaacucccugcc

SEQ ID NO: 2078774 - RNA, 16 nt, Human
guuggcuguuccugca

SEQ ID NO: 2078775 - RNA, 15 nt, Human
uaaaguaaaggcaaa

SEQ ID NO: 2078776 - RNA, 18 nt, Human
gagccgggaaagaagagc

SEQ ID NO: 2078777 - RNA, 17 nt, Human
ccacuggacucaccucc

SEQ ID NO: 2078778 - RNA, 15 nt, Human
uaagucccugcugcc

SEQ ID NO: 2078779 - RNA, 16 nt, Human
gagcaucaucuucugg

SEQ ID NO: 2078780 - RNA, 17 nt, Human
ugaauauaaauuuauca

SEQ ID NO: 2078781 - RNA, 12 nt, Human
uuauuucacuuu

SEQ ID NO: 2078782 - RNA, 13 nt, Human
cugugcggccugg

SEQ ID NO: 2078783 - RNA, 18 nt, Human
ugcccauaccccuggcca

SEQ ID NO: 2078784 - RNA, 18 nt, Human
augauguuucauaagaau

SEQ ID NO: 2078785 - RNA, 16 nt, Human
ugcuguauuuuaaaag

SEQ ID NO: 2078786 - RNA, 22 nt, Human
gucucuacuaaaaauacaaaaa

SEQ ID NO: 2078787 - RNA, 19 nt, Human
auuguaggugacuauuaua

SEQ ID NO: 2078788 - RNA, 16 nt, Human
ugaauuaguuuuauau

SEQ ID NO: 2078789 - RNA, 19 nt, Human
gagcucaccagucccuccc

SEQ ID NO: 2078790 - RNA, 16 nt, Human
gccaaggaugccccgu

SEQ ID NO: 2078791 - RNA, 19 nt, Human
caguccauugggcaggcag

SEQ ID NO: 2078792 - RNA, 22 nt, Human
cauuuaguuauaaaaauauaua

SEQ ID NO: 2078793 - RNA, 15 nt, Human
uggaaacgaagcacc

SEQ ID NO: 2078794 - RNA, 22 nt, Human
ugugagcucaccagucccuccc

SEQ ID NO: 2078795 - RNA, 21 nt, Human
gaaauguuuacagauccccaa

SEQ ID NO: 2078796 - RNA, 23 nt, Human
uccagguagaggguguguaagua

SEQ ID NO: 2078797 - RNA, 21 nt, Human
uacuucccgcuguuccucgcc

SEQ ID NO: 2078798 - RNA, 19 nt, Human
cucugcauacucauuagga

SEQ ID NO: 2078799 - RNA, 23 nt, Human
auuuuagauagaugaagaagcua

SEQ ID NO: 2078800 - RNA, 17 nt, Human
agcuacaggccccaucu

SEQ ID NO: 2078801 - RNA, 13 nt, Human
gcucucuggccuu

SEQ ID NO: 2078802 - RNA, 16 nt, Human
aauuacauuuguauaa

SEQ ID NO: 2078803 - RNA, 20 nt, Human
auguuucuuggggaauaugu

SEQ ID NO: 2078804 - RNA, 16 nt, Human
cauuuaguuauaaaaa

SEQ ID NO: 2078805 - RNA, 12 nt, Human
aauaaaguacaa

SEQ ID NO: 2078806 - RNA, 18 nt, Human
gagcgacagugagacucu

SEQ ID NO: 2078807 - RNA, 22 nt, Human
cccuauccuacuuccccuuccu

SEQ ID NO: 2078808 - RNA, 21 nt, Human
auauauuuuuuuuuuuaaaaa

SEQ ID NO: 2078809 - RNA, 21 nt, Human
ggaagacaagaaggaaagauu

SEQ ID NO: 2078810 - RNA, 12 nt, Human
cccccagcccuc

SEQ ID NO: 2078811 - RNA, 14 nt, Human
uugcuggagcucug

SEQ ID NO: 2078812 - RNA, 17 nt, Human
ccaguaguuagcuuucu

SEQ ID NO: 2078813 - RNA, 21 nt, Human
agucuguuuucccuccuugga

SEQ ID NO: 2078814 - RNA, 19 nt, Human
acuggacucaccuccccca

SEQ ID NO: 2078815 - RNA, 22 nt, Human
uguuucagugcacuaaugugua

SEQ ID NO: 2078816 - RNA, 21 nt, Human
uuccuaauuccacagcugcuc

SEQ ID NO: 2078817 - RNA, 18 nt, Human
ggcacagaaacuccuguu

SEQ ID NO: 2078818 - RNA, 15 nt, Human
uccgcuacuuccagg

SEQ ID NO: 2078819 - RNA, 20 nt, Human
cuaauguguaagacaaaaag

SEQ ID NO: 2078820 - RNA, 19 nt, Human
agccugaucaccugcccug

SEQ ID NO: 2078821 - RNA, 19 nt, Human
uugugggauacuauuuaau

SEQ ID NO: 2078822 - RNA, 16 nt, Human
ugagccccgaaucuga

SEQ ID NO: 2078823 - RNA, 12 nt, Human
cuacaagacaca

SEQ ID NO: 2078824 - RNA, 19 nt, Human
cucucacuuguuuuauuua

SEQ ID NO: 2078825 - RNA, 21 nt, Human
uuuucaggcuagauguaugua

SEQ ID NO: 2078826 - RNA, 23 nt, Human
aucacagcuacuugggaggcuga

SEQ ID NO: 2078827 - RNA, 13 nt, Human
cucugagccuugg

SEQ ID NO: 2078828 - RNA, 18 nt, Human
ugaagcuguguccucaug

SEQ ID NO: 2078829 - RNA, 14 nt, Human
cuucucuucacagu

SEQ ID NO: 2078830 - RNA, 16 nt, Human
acauuugcucauggaa

SEQ ID NO: 2078831 - RNA, 15 nt, Human
agagugugaggaaaa

SEQ ID NO: 2078832 - RNA, 20 nt, Human
cagcuuccaggcuggcgugc

SEQ ID NO: 2078833 - RNA, 20 nt, Human
agccuuggggcugaugcagu

SEQ ID NO: 2078834 - RNA, 23 nt, Human
uagaagucacauuccugaacagg

SEQ ID NO: 2078835 - RNA, 17 nt, Human
aacaguuaccucugccu

SEQ ID NO: 2078836 - RNA, 18 nt, Human
cuccgcgcagcucaggcu

SEQ ID NO: 2078837 - RNA, 23 nt, Human
auauaacaaugcuguauuuuaaa

SEQ ID NO: 2078838 - RNA, 19 nt, Human
ugcagcgaguacuucccgc

SEQ ID NO: 2078839 - RNA, 19 nt, Human
ccuccauccugaggcucca

SEQ ID NO: 2078840 - RNA, 22 nt, Human
agcccuccuuaucaaaggacac

SEQ ID NO: 2078841 - RNA, 18 nt, Human
uaauaauguuucaaacau

SEQ ID NO: 2078842 - RNA, 18 nt, Human
cagucucccucccuuggg

SEQ ID NO: 2078843 - RNA, 17 nt, Human
cuauccuacuuccccuu

SEQ ID NO: 2078844 - RNA, 20 nt, Human
gagcaucaucuucuggguua

SEQ ID NO: 2078845 - RNA, 19 nt, Human
gcauggccacaucugagcc

SEQ ID NO: 2078846 - RNA, 14 nt, Human
gcuggagcucugcc

SEQ ID NO: 2078847 - RNA, 22 nt, Human
aagacccaaaaggcagaagcaa

SEQ ID NO: 2078848 - RNA, 17 nt, Human
uggacaaaauggaauac

SEQ ID NO: 2078849 - RNA, 14 nt, Human
uaguuucccuugca

SEQ ID NO: 2078850 - RNA, 21 nt, Human
acucuuauaucuauauuuuac

SEQ ID NO: 2078851 - RNA, 13 nt, Human
uaaaaguuuaagu

SEQ ID NO: 2078852 - RNA, 15 nt, Human
gcaacccaaauguuc

SEQ ID NO: 2078853 - RNA, 16 nt, Human
ccugagaccaaggccc

SEQ ID NO: 2078854 - RNA, 13 nt, Human
caauaaagaguuc

SEQ ID NO: 2078855 - RNA, 16 nt, Human
auccuacaagacacag

SEQ ID NO: 2078856 - RNA, 13 nt, Human
uuauucacaagac

SEQ ID NO: 2078857 - RNA, 12 nt, Human
ucugcacacagc

SEQ ID NO: 2078858 - RNA, 23 nt, Human
gauauuaaccaggggccaugaau

SEQ ID NO: 2078859 - RNA, 14 nt, Human
cggagccuccagcu

SEQ ID NO: 2078860 - RNA, 18 nt, Human
uggccaccugcugagccc

SEQ ID NO: 2078861 - RNA, 18 nt, Human
acuguaaagcuuugugca

SEQ ID NO: 2078862 - RNA, 17 nt, Human
uguuggcuguuccugca

SEQ ID NO: 2078863 - RNA, 22 nt, Human
cgugcuugucccuguggaagua

SEQ ID NO: 2078864 - RNA, 14 nt, Human
cgcucgcuuccgca

SEQ ID NO: 2078865 - RNA, 11 nt, Human
caacucccugc

SEQ ID NO: 2078866 - RNA, 17 nt, Human
ucucacuuguuuuauuu

SEQ ID NO: 2078867 - RNA, 13 nt, Human
cggccgcgcugcg

SEQ ID NO: 2078868 - RNA, 14 nt, Human
ugagacucugucuc

SEQ ID NO: 2078869 - RNA, 14 nt, Human
uucuaugaaauauu

SEQ ID NO: 2078870 - RNA, 15 nt, Human
cuaagugcagccccg

SEQ ID NO: 2078871 - RNA, 15 nt, Human
accaaggcugauuaa

SEQ ID NO: 2078872 - RNA, 21 nt, Human
uuguaauuuuuuugugggaaa

SEQ ID NO: 2078873 - RNA, 18 nt, Human
aucuauguagaauauauu

SEQ ID NO: 2078874 - RNA, 20 nt, Human
gccuaauuuguuuucccuuc

SEQ ID NO: 2078875 - RNA, 15 nt, Human
gacucaccuccccca

SEQ ID NO: 2078876 - RNA, 18 nt, Human
caugaauuaguuuuauau

SEQ ID NO: 2078877 - RNA, 16 nt, Human
auaugauucaaauguc

SEQ ID NO: 2078878 - RNA, 15 nt, Human
aaaauacaaaaaaaa

SEQ ID NO: 2078879 - RNA, 19 nt, Human
cugguccuaagucccugcu

SEQ ID NO: 2078880 - RNA, 18 nt, Human
cagggaggacgcucucug

SEQ ID NO: 2078881 - RNA, 14 nt, Human
ggaaguagaggagg

SEQ ID NO: 2078882 - RNA, 22 nt, Human
cuucagccugaaagaggaauga

SEQ ID NO: 2078883 - RNA, 13 nt, Human
cgcuuccgcaucc

SEQ ID NO: 2078884 - RNA, 23 nt, Human
cuagaauuugauaugugaacagu

SEQ ID NO: 2078885 - RNA, 22 nt, Human
uauuccuuuuucucuccucucc

SEQ ID NO: 2078886 - RNA, 19 nt, Human
cucuaaauucuuucauuuu

SEQ ID NO: 2078887 - RNA, 16 nt, Human
gcuucuguuccgugcu

SEQ ID NO: 2078888 - RNA, 11 nt, Human
gggaaagaaga

SEQ ID NO: 2078889 - RNA, 12 nt, Human
cuccagcugccc

SEQ ID NO: 2078890 - RNA, 22 nt, Human
agcuaaugaaguguuuagcaua

SEQ ID NO: 2078891 - RNA, 17 nt, Human
ggagggcgcggggcggg

SEQ ID NO: 2078892 - RNA, 17 nt, Human
ccugcucgcccacuucc

SEQ ID NO: 2078893 - RNA, 14 nt, Human
agcgcgcgcgcccu

SEQ ID NO: 2078894 - RNA, 15 nt, Human
aaugaauggcuaagc

SEQ ID NO: 2078895 - RNA, 14 nt, Human
gaaggugaucuggc

SEQ ID NO: 2078896 - RNA, 14 nt, Human
uucagccugaaaga

SEQ ID NO: 2078897 - RNA, 12 nt, Human
auuuuaaaagaa

SEQ ID NO: 2078898 - RNA, 15 nt, Human
auguuagagaauuuc

SEQ ID NO: 2078899 - RNA, 23 nt, Human
ggagcaucuccucaacucugagu

SEQ ID NO: 2078900 - RNA, 15 nt, Human
gagccuccagcugcc

SEQ ID NO: 2078901 - RNA, 15 nt, Human
uagagaauuuccuua

SEQ ID NO: 2078902 - RNA, 22 nt, Human
accccugagcuugcagagauga

SEQ ID NO: 2078903 - RNA, 19 nt, Human
cuagucuguuuucccuccu

SEQ ID NO: 2078904 - RNA, 16 nt, Human
ugugagaugcuagaac

SEQ ID NO: 2078905 - RNA, 15 nt, Human
uccuaagucccugcu

SEQ ID NO: 2078906 - RNA, 21 nt, Human
aauuaaguuuuuuuuuaaaaa

SEQ ID NO: 2078907 - RNA, 21 nt, Human
ucuuauaucuauauuuuacau

SEQ ID NO: 2078908 - RNA, 23 nt, Human
uauuuuauuaggaguaccauaau

SEQ ID NO: 2078909 - RNA, 16 nt, Human
gcauccuagucucuau

SEQ ID NO: 2078910 - RNA, 17 nt, Human
ucuaaauucuuucauuu

SEQ ID NO: 2078911 - RNA, 23 nt, Human
agccuugggaccccugagcuugc

SEQ ID NO: 2078912 - RNA, 13 nt, Human
uuauaaaaauaua

SEQ ID NO: 2078913 - RNA, 13 nt, Human
caccaaggagcca

SEQ ID NO: 2078914 - RNA, 23 nt, Human
cgagccccaggcggguccggguc

SEQ ID NO: 2078915 - RNA, 21 nt, Human
caucccacccgcccaccgcag

SEQ ID NO: 2078916 - RNA, 18 nt, Human
ggaacuggugucuucagg

SEQ ID NO: 2078917 - RNA, 20 nt, Human
cagucccuccccaaaugcuu

SEQ ID NO: 2078918 - RNA, 22 nt, Human
uuuguagaagucacauuccuga

SEQ ID NO: 2078919 - RNA, 15 nt, Human
agaauaccacaggaa

SEQ ID NO: 2078920 - RNA, 18 nt, Human
ccuuccuaauuccacagc

SEQ ID NO: 2078921 - RNA, 23 nt, Human
aauacacuguuaucuucacuuuu

SEQ ID NO: 2078922 - RNA, 16 nt, Human
uuuucucuaggaaaua

SEQ ID NO: 2078923 - RNA, 16 nt, Human
auuuaguuauaaaaau

SEQ ID NO: 2078924 - RNA, 14 nt, Human
cggccggcgcgcuc

SEQ ID NO: 2078925 - RNA, 14 nt, Human
uuccccucugcagc

SEQ ID NO: 2078926 - RNA, 18 nt, Human
cucccuuggggccuaugc

SEQ ID NO: 2078927 - RNA, 17 nt, Human
gcgccuccgcuacuucc

SEQ ID NO: 2078928 - RNA, 14 nt, Human
acccgggaggcaga

SEQ ID NO: 2078929 - RNA, 19 nt, Human
cccugccccccagcccucc

SEQ ID NO: 2078930 - RNA, 13 nt, Human
aacgucacaucuu

SEQ ID NO: 2078931 - RNA, 15 nt, Human
cccugcaaagcccag

SEQ ID NO: 2078932 - RNA, 15 nt, Human
cuggacucaccuccc

SEQ ID NO: 2078933 - RNA, 13 nt, Human
ugccuaauuuguu

SEQ ID NO: 2078934 - RNA, 23 nt, Human
gcauuguuggcuguuccugcagu

SEQ ID NO: 2078935 - RNA, 14 nt, Human
gucccaggcugagc

SEQ ID NO: 2078936 - RNA, 22 nt, Human
acauccuacaagacacagugac

SEQ ID NO: 2078937 - RNA, 20 nt, Human
ucuaugagggcuaauaucuu

SEQ ID NO: 2078938 - RNA, 20 nt, Human
aauuuugugaagcaaaauuu

SEQ ID NO: 2078939 - RNA, 18 nt, Human
aacugccaucauuuacuu

SEQ ID NO: 2078940 - RNA, 16 nt, Human
uuagagaauuuccuua

SEQ ID NO: 2078941 - RNA, 21 nt, Human
agcccuucuuuccacagaagc

SEQ ID NO: 2078942 - RNA, 18 nt, Human
uuuauggcacuaguauuu

SEQ ID NO: 2078943 - RNA, 18 nt, Human
uguggucacaggaaguag

SEQ ID NO: 2078944 - RNA, 23 nt, Human
auucugagguaaccucauuauca

SEQ ID NO: 2078945 - RNA, 14 nt, Human
ugcuagaacucccu

SEQ ID NO: 2078946 - RNA, 11 nt, Human
uucacagggga

SEQ ID NO: 2078947 - RNA, 20 nt, Human
auuacuguaagaaaauauca

SEQ ID NO: 2078948 - RNA, 13 nt, Human
guuuucccaucuc

SEQ ID NO: 2078949 - RNA, 14 nt, Human
gcgagcgcgcgcgc

SEQ ID NO: 2078950 - RNA, 13 nt, Human
auugucuagugaa

SEQ ID NO: 2078951 - RNA, 13 nt, Human
uuaaaaaagaaac

SEQ ID NO: 2078952 - RNA, 14 nt, Human
cucaacucugagug

SEQ ID NO: 2078953 - RNA, 17 nt, Human
ucugugagaugcuagaa

SEQ ID NO: 2078954 - RNA, 21 nt, Human
ccucuguucugcacacagcac

SEQ ID NO: 2078955 - RNA, 20 nt, Human
agcccuggugggcagagagg

SEQ ID NO: 2078956 - RNA, 16 nt, Human
ccacuuccucccggcc

SEQ ID NO: 2078957 - RNA, 16 nt, Human
uguguaagacaaaaag

SEQ ID NO: 2078958 - RNA, 22 nt, Human
cuaccuguucgcgcgccuccgc

SEQ ID NO: 2078959 - RNA, 21 nt, Human
ucccugcugcccuuccccuuc

SEQ ID NO: 2078960 - RNA, 20 nt, Human
uuucuucaacucccugcccc

SEQ ID NO: 2078961 - RNA, 18 nt, Human
cagaaagcagaacaguga

SEQ ID NO: 2078962 - RNA, 22 nt, Human
ccacacuguccauucuuccucc

SEQ ID NO: 2078963 - RNA, 14 nt, Human
caaggcuagaacca

SEQ ID NO: 2078964 - RNA, 15 nt, Human
augaauuaaguuuuu

SEQ ID NO: 2078965 - RNA, 22 nt, Human
cagcacgggggccaaggaugcc

SEQ ID NO: 2078966 - RNA, 17 nt, Human
agugauuaccagggacu

SEQ ID NO: 2078967 - RNA, 14 nt, Human
guagcuaaauauau

SEQ ID NO: 2078968 - RNA, 10 nt, Human
accugagccc

SEQ ID NO: 2078969 - RNA, 19 nt, Human
cuccucggacggcuccgga

SEQ ID NO: 2078970 - RNA, 22 nt, Human
ccugcugcccuuccccuuccca

SEQ ID NO: 2078971 - RNA, 16 nt, Human
ugacuauuauauuucc

SEQ ID NO: 2078972 - RNA, 13 nt, Human
aguuaccucugcc

SEQ ID NO: 2078973 - RNA, 15 nt, Human
aguuuauauagaaau

SEQ ID NO: 2078974 - RNA, 18 nt, Human
ggcucuggacaggcacua

SEQ ID NO: 2078975 - RNA, 14 nt, Human
aauaguuuaugauu

SEQ ID NO: 2078976 - RNA, 21 nt, Human
gagcaucuccucaacucugag

SEQ ID NO: 2078977 - RNA, 20 nt, Human
uuaacacaugauccugcaau

SEQ ID NO: 2078978 - RNA, 15 nt, Human
aucaauuuaaaaaaa

SEQ ID NO: 2078979 - RNA, 12 nt, Human
gccccugagccc

SEQ ID NO: 2078980 - RNA, 13 nt, Human
ggcaggcacugcc

SEQ ID NO: 2078981 - RNA, 20 nt, Human
gcuuccaggcuggcgugcag

SEQ ID NO: 2078982 - RNA, 16 nt, Human
uaggauguugaaaaag

SEQ ID NO: 2078983 - RNA, 14 nt, Human
aucuaugccacaag

SEQ ID NO: 2078984 - RNA, 19 nt, Human
ugcacacagcacgggggcc

SEQ ID NO: 2078985 - RNA, 14 nt, Human
auugucuagugaaa

SEQ ID NO: 2078986 - RNA, 17 nt, Human
uuauaucaauuuaaaaa

SEQ ID NO: 2078987 - RNA, 22 nt, Human
gugccucaccccuugccauaau

SEQ ID NO: 2078988 - RNA, 14 nt, Human
ccucuccucucuuc

SEQ ID NO: 2078989 - RNA, 16 nt, Human
guuuuuuuuuaaaaaa

SEQ ID NO: 2078990 - RNA, 21 nt, Human
cagugagacagcucugcauac

SEQ ID NO: 2078991 - RNA, 14 nt, Human
ccggggaggggcgc

SEQ ID NO: 2078992 - RNA, 19 nt, Human
ccuuagcccuuccccucug

SEQ ID NO: 2078993 - RNA, 16 nt, Human
aagaaauauuccuuaa

SEQ ID NO: 2078994 - RNA, 15 nt, Human
ccucauguccacugg

SEQ ID NO: 2078995 - RNA, 13 nt, Human
caucugagccccg

SEQ ID NO: 2078996 - RNA, 20 nt, Human
cucgcuuccgcauccuaguc

SEQ ID NO: 2078997 - RNA, 15 nt, Human
ccacaagaaaugaaa

SEQ ID NO: 2078998 - RNA, 13 nt, Human
caacaucuaguga

SEQ ID NO: 2078999 - RNA, 16 nt, Human
cuagaaccaccugccu

SEQ ID NO: 2079000 - RNA, 16 nt, Human
acagagacagaaagca

SEQ ID NO: 2079001 - RNA, 11 nt, Human
uuauauuuauu

SEQ ID NO: 2079002 - RNA, 23 nt, Human
aggugaucuggcucuggacaggc

SEQ ID NO: 2079003 - RNA, 16 nt, Human
aucaguuauuuuuaaa

SEQ ID NO: 2079004 - RNA, 15 nt, Human
ugccgugggccugag

SEQ ID NO: 2079005 - RNA, 21 nt, Human
uagaagucacauuccugaaca

SEQ ID NO: 2079006 - RNA, 21 nt, Human
aauuuuuauauuugaaauauu

SEQ ID NO: 2079007 - RNA, 19 nt, Human
uguugaagagguuuuaaag

SEQ ID NO: 2079008 - RNA, 13 nt, Human
auugggcaggcag

SEQ ID NO: 2079009 - RNA, 23 nt, Human
caugcugucuacacuaagagaga

SEQ ID NO: 2079010 - RNA, 17 nt, Human
ccagggcuacgcgcgcu

SEQ ID NO: 2079011 - RNA, 16 nt, Human
cuguggauuuaaugug

SEQ ID NO: 2079012 - RNA, 13 nt, Human
ucucccucccuug

SEQ ID NO: 2079013 - RNA, 18 nt, Human
ugccuaggcauagcccug

SEQ ID NO: 2079014 - RNA, 20 nt, Human
uuaaugccacuaaauugaca

SEQ ID NO: 2079015 - RNA, 11 nt, Human
ggggaggggcg

SEQ ID NO: 2079016 - RNA, 22 nt, Human
auaucuuuuuuuuaauaaacca

SEQ ID NO: 2079017 - RNA, 20 nt, Human
aauaagccagacaucaacag

SEQ ID NO: 2079018 - RNA, 17 nt, Human
cuggacucaccuccccc

SEQ ID NO: 2079019 - RNA, 17 nt, Human
cugccucucucauccac

SEQ ID NO: 2079020 - RNA, 15 nt, Human
gccuugggaccccug

SEQ ID NO: 2079021 - RNA, 22 nt, Human
cccaugauguuuagaaacacaa

SEQ ID NO: 2079022 - RNA, 14 nt, Human
cucaccagucccuc

SEQ ID NO: 2079023 - RNA, 20 nt, Human
uuauucacuguauguccuug

SEQ ID NO: 2079024 - RNA, 16 nt, Human
cugugccguccccaga

SEQ ID NO: 2079025 - RNA, 18 nt, Human
uccagcuggccgggagcc

SEQ ID NO: 2079026 - RNA, 16 nt, Human
ccuacaugagguacug

SEQ ID NO: 2079027 - RNA, 17 nt, Human
gacucaccucccccauc

SEQ ID NO: 2079028 - RNA, 20 nt, Human
ccgcagggugaacugcagcg

SEQ ID NO: 2079029 - RNA, 21 nt, Human
auacuauuuaauuauuucacu

SEQ ID NO: 2079030 - RNA, 17 nt, Human
gcaugguuuagaaagcu

SEQ ID NO: 2079031 - RNA, 14 nt, Human
aagucagucauuca

SEQ ID NO: 2079032 - RNA, 14 nt, Human
gcaaagcccagcuu

SEQ ID NO: 2079033 - RNA, 19 nt, Human
aguauuucuaugaaauauu

SEQ ID NO: 2079034 - RNA, 23 nt, Human
aguacucauacauguuacaacac

SEQ ID NO: 2079035 - RNA, 19 nt, Human
ggaauuucuucaacucccu

SEQ ID NO: 2079036 - RNA, 18 nt, Human
ugugcauauuuuauuaua

SEQ ID NO: 2079037 - RNA, 20 nt, Human
gauuauauauauuuuuuucu

SEQ ID NO: 2079038 - RNA, 17 nt, Human
cucccuggaaucuugua

SEQ ID NO: 2079039 - RNA, 23 nt, Human
aucauuaaaguucuagugaccga

SEQ ID NO: 2079040 - RNA, 14 nt, Human
ggcuccagcuggcc

SEQ ID NO: 2079041 - RNA, 22 nt, Human
ggcagcuuuccucaaaacuuca

SEQ ID NO: 2079042 - RNA, 22 nt, Human
agcuguguccucaugagggcug

SEQ ID NO: 2079043 - RNA, 22 nt, Human
auucaaugccccugaauuuaaa

SEQ ID NO: 2079044 - RNA, 23 nt, Human
accuccauggaaacgaagcacca

SEQ ID NO: 2079045 - RNA, 22 nt, Human
agcagcauaaauguugacaugg

SEQ ID NO: 2079046 - RNA, 16 nt, Human
auugucuagugaaacu

SEQ ID NO: 2079047 - RNA, 18 nt, Human
ccucaagcuaugugagcu

SEQ ID NO: 2079048 - RNA, 12 nt, Human
uaaaugcucaau

SEQ ID NO: 2079049 - RNA, 16 nt, Human
gaagccagaucuaugc

SEQ ID NO: 2079050 - RNA, 22 nt, Human
gagccucagucucccucccuug

SEQ ID NO: 2079051 - RNA, 22 nt, Human
gaaauaagccagacaucaacag

SEQ ID NO: 2079052 - RNA, 14 nt, Human
ggaccaucccggcc

SEQ ID NO: 2079053 - RNA, 15 nt, Human
cgcauccuagucucu

SEQ ID NO: 2079054 - RNA, 18 nt, Human
ccugccuaagugcagccc

SEQ ID NO: 2079055 - RNA, 18 nt, Human
cugagccuugggaccccu

SEQ ID NO: 2079056 - RNA, 11 nt, Human
agugucugcug

SEQ ID NO: 2079057 - RNA, 13 nt, Human
gagacagcucugc

SEQ ID NO: 2079058 - RNA, 13 nt, Human
agcuucuguuccg

SEQ ID NO: 2079059 - RNA, 18 nt, Human
uuuugugaagcaaaauuu

SEQ ID NO: 2079060 - RNA, 19 nt, Human
uguaguguuggagaagaac

SEQ ID NO: 2079061 - RNA, 15 nt, Human
agucccugcugcccu

SEQ ID NO: 2079062 - RNA, 19 nt, Human
agucaaauugugugaaagg

SEQ ID NO: 2079063 - RNA, 13 nt, Human
ugggaggcugaga

SEQ ID NO: 2079064 - RNA, 23 nt, Human
ggccugagaccaaggcccccggg

SEQ ID NO: 2079065 - RNA, 18 nt, Human
cagagacagaaagcagaa

SEQ ID NO: 2079066 - RNA, 13 nt, Human
cggccggcgcgcu

SEQ ID NO: 2079067 - RNA, 14 nt, Human
cugcaaagcccagc

SEQ ID NO: 2079068 - RNA, 21 nt, Human
gauuauauauauuuuuuucug

SEQ ID NO: 2079069 - RNA, 13 nt, Human
ugaauauaaauuu

SEQ ID NO: 2079070 - RNA, 14 nt, Human
agagguccacaaca

SEQ ID NO: 2079071 - RNA, 14 nt, Human
auuuauuuuaauaa

SEQ ID NO: 2079072 - RNA, 23 nt, Human
aggaugguucccuugaugaagaa

SEQ ID NO: 2079073 - RNA, 20 nt, Human
uuauugaggcuuuaaaacuu

SEQ ID NO: 2079074 - RNA, 17 nt, Human
gcuguacgcgagcgcgc

SEQ ID NO: 2079075 - RNA, 21 nt, Human
agcauuuguguugaagagguu

SEQ ID NO: 2079076 - RNA, 13 nt, Human
ccucccccaucuc

SEQ ID NO: 2079077 - RNA, 19 nt, Human
agguaaccucauuaucagu

SEQ ID NO: 2079078 - RNA, 13 nt, Human
augaguugcaguu

SEQ ID NO: 2079079 - RNA, 13 nt, Human
agccgggaaagaa

SEQ ID NO: 2079080 - RNA, 21 nt, Human
gcaaaauuuuuucucuaggaa

SEQ ID NO: 2079081 - RNA, 16 nt, Human
cugagcuugcagagau

SEQ ID NO: 2079082 - RNA, 11 nt, Human
gccaugggaca

SEQ ID NO: 2079083 - RNA, 21 nt, Human
gaauuuaaauagcuuuuuucu

SEQ ID NO: 2079084 - RNA, 18 nt, Human
ccugaaagaggaaugaag

SEQ ID NO: 2079085 - RNA, 23 nt, Human
cuagucuguuuucccuccuugga

SEQ ID NO: 2079086 - RNA, 19 nt, Human
uacuucuuaggguuaugau

SEQ ID NO: 2079087 - RNA, 18 nt, Human
gaaaauaucacuugucaa

SEQ ID NO: 2079088 - RNA, 19 nt, Human
ugcuauuugcuguuauuuu

SEQ ID NO: 2079089 - RNA, 22 nt, Human
cuaagucccugcugcccuuccc

SEQ ID NO: 2079090 - RNA, 20 nt, Human
cuaaaugucaaucagccuag

SEQ ID NO: 2079091 - RNA, 15 nt, Human
ugccccccagcccuc

SEQ ID NO: 2079092 - RNA, 19 nt, Human
acugccaucauuuacuuuu

SEQ ID NO: 2079093 - RNA, 16 nt, Human
cacuggacucaccucc

SEQ ID NO: 2079094 - RNA, 21 nt, Human
auuuguauaaaauaauuuuua

SEQ ID NO: 2079095 - RNA, 17 nt, Human
uuugauaugugaacagu

SEQ ID NO: 2079096 - RNA, 21 nt, Human
uaggugacuauuauauuucca

SEQ ID NO: 2079097 - RNA, 18 nt, Human
ugcagugucugcuggaga

SEQ ID NO: 2079098 - RNA, 22 nt, Human
acuuugauuuuauaugcuauuu

SEQ ID NO: 2079099 - RNA, 21 nt, Human
ucuuaggguuaugauuaagua

SEQ ID NO: 2079100 - RNA, 21 nt, Human
cuaaauugacacuuaaaaaug

SEQ ID NO: 2079101 - RNA, 17 nt, Human
cuggcugcgcucggccu

SEQ ID NO: 2079102 - RNA, 22 nt, Human
aaacguauucaaacaauuugaa

SEQ ID NO: 2079103 - RNA, 19 nt, Human
aggucuaccaaaaaucuca

SEQ ID NO: 2079104 - RNA, 14 nt, Human
agcugccucucuca

SEQ ID NO: 2079105 - RNA, 16 nt, Human
gaagauguagaggaga

SEQ ID NO: 2079106 - RNA, 18 nt, Human
uaggaaauauuuuaaugu

SEQ ID NO: 2079107 - RNA, 18 nt, Human
cuuugagcgcccacuaga

SEQ ID NO: 2079108 - RNA, 22 nt, Human
ccauacuaauuauacccccugc

SEQ ID NO: 2079109 - RNA, 15 nt, Human
aaugauuaugaauua

SEQ ID NO: 2079110 - RNA, 21 nt, Human
gcgccgcgcuccucggacggc

SEQ ID NO: 2079111 - RNA, 15 nt, Human
ugcagccaccagucc

SEQ ID NO: 2079112 - RNA, 19 nt, Human
cuccgcuacuuccagggcu

SEQ ID NO: 2079113 - RNA, 20 nt, Human
ugaggcuccacuuggucugu

SEQ ID NO: 2079114 - RNA, 18 nt, Human
cagcugcucaauaaagua

SEQ ID NO: 2079115 - RNA, 12 nt, Human
ccaggcugagcc

SEQ ID NO: 2079116 - RNA, 16 nt, Human
guugagguaccuccaa

SEQ ID NO: 2079117 - RNA, 13 nt, Human
agccucagucucc

SEQ ID NO: 2079118 - RNA, 19 nt, Human
ugcucgcccacuuccuccc

SEQ ID NO: 2079119 - RNA, 21 nt, Human
acagugauuaccagggacuga

SEQ ID NO: 2079120 - RNA, 15 nt, Human
uccauccugaggcuc

SEQ ID NO: 2079121 - RNA, 16 nt, Human
aucaaaagaaagaaaa

SEQ ID NO: 2079122 - RNA, 23 nt, Human
uguugcccacagcuguaugauuc

SEQ ID NO: 2079123 - RNA, 15 nt, Human
uccagauccuggaaa

SEQ ID NO: 2079124 - RNA, 19 nt, Human
ggagccugaucaccugccc

SEQ ID NO: 2079125 - RNA, 17 nt, Human
uaagaaauaggaaauau

SEQ ID NO: 2079126 - RNA, 19 nt, Human
cauggaauuggagcucgug

SEQ ID NO: 2079127 - RNA, 15 nt, Human
aggaacuggugucuu

SEQ ID NO: 2079128 - RNA, 21 nt, Human
uauaagaaauaggaaauauuu

SEQ ID NO: 2079129 - RNA, 19 nt, Human
aaucuacacuccagugaga

SEQ ID NO: 2079130 - RNA, 18 nt, Human
aauccacacugagcugag

SEQ ID NO: 2079131 - RNA, 20 nt, Human
uccuccaugaauaucaguua

SEQ ID NO: 2079132 - RNA, 17 nt, Human
ccugcugcccuuccccu

SEQ ID NO: 2079133 - RNA, 22 nt, Human
ugguagcuaaauauauauuuua

SEQ ID NO: 2079134 - RNA, 18 nt, Human
acugacucuuaagaagac

SEQ ID NO: 2079135 - RNA, 14 nt, Human
cugguggcucugug

SEQ ID NO: 2079136 - RNA, 15 nt, Human
uucggccuccauccu

SEQ ID NO: 2079137 - RNA, 23 nt, Human
caaaauggaauacucuuauaucu

SEQ ID NO: 2079138 - RNA, 15 nt, Human
aaaugauguuucaua

SEQ ID NO: 2079139 - RNA, 21 nt, Human
uuuuagggguagcauuugugu

SEQ ID NO: 2079140 - RNA, 13 nt, Human
cgcgagcgcgcgc

SEQ ID NO: 2079141 - RNA, 21 nt, Human
cuguguccucaugagggcugg

SEQ ID NO: 2079142 - RNA, 22 nt, Human
ccggcgcgcucaucccacccgc

SEQ ID NO: 2079143 - RNA, 19 nt, Human
auuucuucaacucccugcc

SEQ ID NO: 2079144 - RNA, 20 nt, Human
acuucuuaggguuaugauua

SEQ ID NO: 2079145 - RNA, 20 nt, Human
agaauucuguugauggaaau

SEQ ID NO: 2079146 - RNA, 21 nt, Human
ccggccuuugcaccuccaugg

SEQ ID NO: 2079147 - RNA, 20 nt, Human
cugguggcgcuggcugcgcu

SEQ ID NO: 2079148 - RNA, 17 nt, Human
cuccuuaucaaaggaca

SEQ ID NO: 2079149 - RNA, 12 nt, Human
ccuucagccuga

SEQ ID NO: 2079150 - RNA, 23 nt, Human
gggagccugaucaccugcccugc

SEQ ID NO: 2079151 - RNA, 17 nt, Human
auaucaauuuaaaaaaa

SEQ ID NO: 2079152 - RNA, 18 nt, Human
aguccauugggcaggcag

SEQ ID NO: 2079153 - RNA, 19 nt, Human
gcggcccugugcggccugg

SEQ ID NO: 2079154 - RNA, 24 nt, Human
ucucuaucauuaaaguucuaguga

SEQ ID NO: 2079155 - RNA, 18 nt, Human
caugaagauguagaggag

SEQ ID NO: 2079156 - RNA, 16 nt, Human
gaauggcuaagcaaaa

SEQ ID NO: 2079157 - RNA, 15 nt, Human
cgggagccugaucac

SEQ ID NO: 2079158 - RNA, 18 nt, Human
agucuguuuucccuccuu

SEQ ID NO: 2079159 - RNA, 16 nt, Human
agugagacagcucugc

SEQ ID NO: 2079160 - RNA, 22 nt, Human
aaacuuuuggaagguauuuaau

SEQ ID NO: 2079161 - RNA, 22 nt, Human
caucaucuucuggguuaggccu

SEQ ID NO: 2079162 - RNA, 14 nt, Human
cucaccccuugcca

SEQ ID NO: 2079163 - RNA, 14 nt, Human
cuaggacugaauua

SEQ ID NO: 2079164 - RNA, 17 nt, Human
ucuuuaucuuuuuagua

SEQ ID NO: 2079165 - RNA, 14 nt, Human
caucucaggugugu

SEQ ID NO: 2079166 - RNA, 13 nt, Human
auuccucacuuug

SEQ ID NO: 2079167 - RNA, 19 nt, Human
uaccuccaaggaccggccu

SEQ ID NO: 2079168 - RNA, 22 nt, Human
auaaaguaugugcauauuuuau

SEQ ID NO: 2079169 - RNA, 22 nt, Human
uauaagaaauaggaaauauuuu

SEQ ID NO: 2079170 - RNA, 19 nt, Human
cgcucugggucgccggcau

SEQ ID NO: 2079171 - RNA, 16 nt, Human
uauguucuaagaagug

SEQ ID NO: 2079172 - RNA, 21 nt, Human
cuauuuaauuauuucacuuua

SEQ ID NO: 2079173 - RNA, 14 nt, Human
ugcaccuccaugga

SEQ ID NO: 2079174 - RNA, 16 nt, Human
caaguaaaaggaaaug

SEQ ID NO: 2079175 - RNA, 14 nt, Human
ugaagauguagagg

SEQ ID NO: 2079176 - RNA, 23 nt, Human
cacauuggaaacaagucagucau

SEQ ID NO: 2079177 - RNA, 17 nt, Human
ccagggaagacaagaag

SEQ ID NO: 2079178 - RNA, 14 nt, Human
ccucagucucccuc

SEQ ID NO: 2079179 - RNA, 15 nt, Human
cugcagauaaacagu

SEQ ID NO: 2079180 - RNA, 16 nt, Human
caggaaguagaggagg

SEQ ID NO: 2079181 - RNA, 20 nt, Human
gaacguaaucguguccccua

SEQ ID NO: 2079182 - RNA, 19 nt, Human
cuggacucaccucccccau

SEQ ID NO: 2079183 - RNA, 17 nt, Human
ggagcucguggaacagu

SEQ ID NO: 2079184 - RNA, 18 nt, Human
ggccuugugaggagcugg

SEQ ID NO: 2079185 - RNA, 21 nt, Human
gacagaaagcagaacagugau

SEQ ID NO: 2079186 - RNA, 15 nt, Human
guucugcagauaaac

SEQ ID NO: 2079187 - RNA, 20 nt, Human
gucauucagauaugauucaa

SEQ ID NO: 2079188 - RNA, 16 nt, Human
cagaagcaacccaaau

SEQ ID NO: 2079189 - RNA, 23 nt, Human
agggcgcggggcggggagcgagc

SEQ ID NO: 2079190 - RNA, 21 nt, Human
augucauuugcuggagcucug

SEQ ID NO: 2079191 - RNA, 16 nt, Human
agcuugaaaccuucac

SEQ ID NO: 2079192 - RNA, 13 nt, Human
ccccucugcagcu

SEQ ID NO: 2079193 - RNA, 17 nt, Human
guguccccuauccuacu

SEQ ID NO: 2079194 - RNA, 17 nt, Human
cuggcugcugguggcgc

SEQ ID NO: 2079195 - RNA, 15 nt, Human
uccauugggcaggca

SEQ ID NO: 2079196 - RNA, 19 nt, Human
caagcagcccuuagcccuu

SEQ ID NO: 2079197 - RNA, 23 nt, Human
cuuauuguagcauccuggaauau

SEQ ID NO: 2079198 - RNA, 21 nt, Human
ggaaagaauaaccaacacccu

SEQ ID NO: 2079199 - RNA, 15 nt, Human
gcugcgcucggccug

SEQ ID NO: 2079200 - RNA, 23 nt, Human
agcagcccuuagcccuuccccuc

SEQ ID NO: 2079201 - RNA, 12 nt, Human
gaauuggagcuc

SEQ ID NO: 2079202 - RNA, 19 nt, Human
cggccugcucgcccacuuc

SEQ ID NO: 2079203 - RNA, 22 nt, Human
caucucuucuggguuccuuccu

SEQ ID NO: 2079204 - RNA, 18 nt, Human
acauuugcucauggaauu

SEQ ID NO: 2079205 - RNA, 18 nt, Human
uaauuauuucacuuuaga

SEQ ID NO: 2079206 - RNA, 18 nt, Human
cccacuggacucaccucc

SEQ ID NO: 2079207 - RNA, 17 nt, Human
uccugccccugagccca

SEQ ID NO: 2079208 - RNA, 22 nt, Human
aauaugccccauucaacaucua

SEQ ID NO: 2079209 - RNA, 23 nt, Human
auaucuuuuuuuuaauaaaccau

SEQ ID NO: 2079210 - RNA, 20 nt, Human
cacagcacgggggccaagga

SEQ ID NO: 2079211 - RNA, 12 nt, Human
auucuuccuccc

SEQ ID NO: 2079212 - RNA, 19 nt, Human
ucagguguguugcaguguc

SEQ ID NO: 2079213 - RNA, 15 nt, Human
uagggugauauuaac

SEQ ID NO: 2079214 - RNA, 21 nt, Human
ugaauuguaggugacuauuau

SEQ ID NO: 2079215 - RNA, 14 nt, Human
ugagcuugcagaga

SEQ ID NO: 2079216 - RNA, 22 nt, Human
ugggcacuguggguagacacac

SEQ ID NO: 2079217 - RNA, 19 nt, Human
gcuggccuugugaggagcu

SEQ ID NO: 2079218 - RNA, 22 nt, Human
uaccucugcuauuugcuguuau

SEQ ID NO: 2079219 - RNA, 19 nt, Human
cuguccauucuuccuccca

SEQ ID NO: 2079220 - RNA, 21 nt, Human
ugaaauaaacgucuuaaauau

SEQ ID NO: 2079221 - RNA, 14 nt, Human
auacaaaaaaaaaa

SEQ ID NO: 2079222 - RNA, 19 nt, Human
aaaacguauugcauuuaau

SEQ ID NO: 2079223 - RNA, 18 nt, Human
uggucaauuuuguuaugu

SEQ ID NO: 2079224 - RNA, 17 nt, Human
guucgcgcgccuccgcu

SEQ ID NO: 2079225 - RNA, 15 nt, Human
agccugaaagaggaa

SEQ ID NO: 2079226 - RNA, 20 nt, Human
ucugguagcuaaauauauau

SEQ ID NO: 2079227 - RNA, 13 nt, Human
uauuuauuuuaau

SEQ ID NO: 2079228 - RNA, 15 nt, Human
cagucucccucccuu

SEQ ID NO: 2079229 - RNA, 16 nt, Human
uaggaaauauuuuaau

SEQ ID NO: 2079230 - RNA, 23 nt, Human
aagagccggagccuccagcugcc

SEQ ID NO: 2079231 - RNA, 21 nt, Human
ccuagucucuaucauuaaagu

SEQ ID NO: 2079232 - RNA, 13 nt, Human
cccuuccccuucc

SEQ ID NO: 2079233 - RNA, 13 nt, Human
aauaucucuucuc

SEQ ID NO: 2079234 - RNA, 22 nt, Human
ugagacucugucucaguccaug

SEQ ID NO: 2079235 - RNA, 13 nt, Human
uacagagacagaa

SEQ ID NO: 2079236 - RNA, 22 nt, Human
uaaaauaauuuuuauauuugaa

SEQ ID NO: 2079237 - RNA, 13 nt, Human
auauuuuauuaua

SEQ ID NO: 2079238 - RNA, 17 nt, Human
uaucaauuuaaaaaaaa

SEQ ID NO: 2079239 - RNA, 16 nt, Human
aauuccacagcugcuc

SEQ ID NO: 2079240 - RNA, 21 nt, Human
gcuggccaccugcugagcccc

SEQ ID NO: 2079241 - RNA, 19 nt, Human
gcuguacgcgagcgcgcgc

SEQ ID NO: 2079242 - RNA, 20 nt, Human
cgcgcucaucccacccgccc

SEQ ID NO: 2079243 - RNA, 20 nt, Human
cuugccauaauuacuauguc

SEQ ID NO: 2079244 - RNA, 14 nt, Human
acccugaggugagc

SEQ ID NO: 2079245 - RNA, 18 nt, Human
cuggaaacuucagcgguu

SEQ ID NO: 2079246 - RNA, 12 nt, Human
gguauuuuaauc

SEQ ID NO: 2079247 - RNA, 15 nt, Human
cagcuggccuuguga

SEQ ID NO: 2079248 - RNA, 17 nt, Human
uccagcuggccgggagc

SEQ ID NO: 2079249 - RNA, 20 nt, Human
agaagagccggagccuccag

SEQ ID NO: 2079250 - RNA, 16 nt, Human
agggcaguguucccug

SEQ ID NO: 2079251 - RNA, 22 nt, Human
cuggugucuucaggggccacac

SEQ ID NO: 2079252 - RNA, 13 nt, Human
acggggugaaacc

SEQ ID NO: 2079253 - RNA, 14 nt, Human
cucuugaggcacag

SEQ ID NO: 2079254 - RNA, 13 nt, Human
cccggccgcgcug

SEQ ID NO: 2079255 - RNA, 23 nt, Human
uaagaauucuguugauggaaaua

SEQ ID NO: 2079256 - RNA, 12 nt, Human
uauucacaagac

SEQ ID NO: 2079257 - RNA, 15 nt, Human
uaaaaggaaaugcuc

SEQ ID NO: 2079258 - RNA, 23 nt, Human
aggagcuguugagguaccuccaa

SEQ ID NO: 2079259 - RNA, 18 nt, Human
ggcccugugcggccuggu

SEQ ID NO: 2079260 - RNA, 14 nt, Human
uauaucuauauuuu

SEQ ID NO: 2079261 - RNA, 16 nt, Human
cuaggcauagcccugc

SEQ ID NO: 2079262 - RNA, 20 nt, Human
ucaaaacuucagacauagaa

SEQ ID NO: 2079263 - RNA, 19 nt, Human
cauggccacaucugagccc

SEQ ID NO: 2079264 - RNA, 14 nt, Human
uaaauuuaucauuu

SEQ ID NO: 2079265 - RNA, 14 nt, Human
uaaccucuaaauuc

SEQ ID NO: 2079266 - RNA, 18 nt, Human
gcugcugccgugggccug

SEQ ID NO: 2079267 - RNA, 23 nt, Human
gaaugagagacacacugaagaag

SEQ ID NO: 2079268 - RNA, 18 nt, Human
cuuuccacagaagcucca

SEQ ID NO: 2079269 - RNA, 13 nt, Human
aacucccugcccc

SEQ ID NO: 2079270 - RNA, 22 nt, Human
ccuuccccucugcagcuuccag

SEQ ID NO: 2079271 - RNA, 23 nt, Human
cauccucgaggcccuagcauuuc

SEQ ID NO: 2079272 - RNA, 17 nt, Human
caaccuucugaggagcu

SEQ ID NO: 2079273 - RNA, 24 nt, Human
uuugugggaaauccacacugagcu

SEQ ID NO: 2079274 - RNA, 23 nt, Human
auucaauaucuuuuuuuuaauaa

SEQ ID NO: 2079275 - RNA, 22 nt, Human
auucugagguaaccucauuauc

SEQ ID NO: 2079276 - RNA, 20 nt, Human
uauguccuuggugccuggag

SEQ ID NO: 2079277 - RNA, 21 nt, Human
augugcauauuuuauuauagu

SEQ ID NO: 2079278 - RNA, 19 nt, Human
uuuccugaaaacccuugcc

SEQ ID NO: 2079279 - RNA, 14 nt, Human
uuaaacuuugauuu

SEQ ID NO: 2079280 - RNA, 23 nt, Human
aauauuuauuuuaauaauguuuc

SEQ ID NO: 2079281 - RNA, 23 nt, Human
agaaugauuaugaauuacauuug

SEQ ID NO: 2079282 - RNA, 21 nt, Human
auggcagcuuuccucaaaacu

SEQ ID NO: 2079283 - RNA, 13 nt, Human
aauuuuuauauuu

SEQ ID NO: 2079284 - RNA, 15 nt, Human
ccccugagcuugcag

SEQ ID NO: 2079285 - RNA, 15 nt, Human
aaggguacacugccu

SEQ ID NO: 2079286 - RNA, 13 nt, Human
aggcauagcccug

SEQ ID NO: 2079287 - RNA, 21 nt, Human
cucagugucaaugcagccccc

SEQ ID NO: 2079288 - RNA, 21 nt, Human
uacauaaauuuaguauuuugu

SEQ ID NO: 2079289 - RNA, 13 nt, Human
gcggccuggucua

SEQ ID NO: 2079290 - RNA, 17 nt, Human
uaugcuaagugaaauaa

SEQ ID NO: 2079291 - RNA, 17 nt, Human
augccccgucccccucu

SEQ ID NO: 2079292 - RNA, 17 nt, Human
uccauucuuccucccau

SEQ ID NO: 2079293 - RNA, 21 nt, Human
auggaaauacacuguuaucuu

SEQ ID NO: 2079294 - RNA, 18 nt, Human
gcgcgcccucuggcugcu

SEQ ID NO: 2079295 - RNA, 20 nt, Human
augguuuagaaagcuugccc

SEQ ID NO: 2079296 - RNA, 18 nt, Human
uaucaaaagaaagaaaau

SEQ ID NO: 2079297 - RNA, 23 nt, Human
gcccuggugccucaccccuugcc

SEQ ID NO: 2079298 - RNA, 15 nt, Human
ccucccggccgcgcu

SEQ ID NO: 2079299 - RNA, 16 nt, Human
gccaaggaagaucccu

SEQ ID NO: 2079300 - RNA, 14 nt, Human
uuaauuauuucacu

SEQ ID NO: 2079301 - RNA, 17 nt, Human
cagucauucagauauga

SEQ ID NO: 2079302 - RNA, 15 nt, Human
ccggggaggggcgcu

SEQ ID NO: 2079303 - RNA, 22 nt, Human
uuuaauaauguuucaaacauau

SEQ ID NO: 2079304 - RNA, 23 nt, Human
ggcugcgcucggccugcucgccc

SEQ ID NO: 2079305 - RNA, 13 nt, Human
aaaugaaagcagg

SEQ ID NO: 2079306 - RNA, 20 nt, Human
accggccuuugcaccuccau

SEQ ID NO: 2079307 - RNA, 18 nt, Human
ucaaggguacacugccuu

SEQ ID NO: 2079308 - RNA, 23 nt, Human
uaaguuuuuuuuuaaaaaagaaa

SEQ ID NO: 2079309 - RNA, 12 nt, Human
uucagccugaaa

SEQ ID NO: 2079310 - RNA, 16 nt, Human
gcugcgcgccgcgcuc

SEQ ID NO: 2079311 - RNA, 18 nt, Human
ggcgcuggcugcgcucgg

SEQ ID NO: 2079312 - RNA, 14 nt, Human
ccugagaccaaggc

SEQ ID NO: 2079313 - RNA, 19 nt, Human
agauuugagcucagcccug

SEQ ID NO: 2079314 - RNA, 20 nt, Human
cgcaggaccaucccggccgg

SEQ ID NO: 2079315 - RNA, 16 nt, Human
ugugcagccaccaguc

SEQ ID NO: 2079316 - RNA, 23 nt, Human
cucaggggggugguuuucccauc

SEQ ID NO: 2079317 - RNA, 20 nt, Human
cuggccuucggccuccaucc

SEQ ID NO: 2079318 - RNA, 19 nt, Human
ccccugcaaagcccagcuu

SEQ ID NO: 2079319 - RNA, 16 nt, Human
ccugaucaccugcccu

SEQ ID NO: 2079320 - RNA, 22 nt, Human
auguccuuggugccuggagccu

SEQ ID NO: 2079321 - RNA, 17 nt, Human
uagaagucacauuccug

SEQ ID NO: 2079322 - RNA, 16 nt, Human
aagguccuggcaaaga

SEQ ID NO: 2079323 - RNA, 20 nt, Human
aucaaccugccagcuggccu

SEQ ID NO: 2079324 - RNA, 17 nt, Human
cggccgcgcugcgcgcc

SEQ ID NO: 2079325 - RNA, 12 nt, Human
agaauauauuuc

SEQ ID NO: 2079326 - RNA, 20 nt, Human
uuuagacauucuuuaucuuu

SEQ ID NO: 2079327 - RNA, 15 nt, Human
agcuaaauauauauu

SEQ ID NO: 2079328 - RNA, 21 nt, Human
ccauaccccuggccaaggaag

SEQ ID NO: 2079329 - RNA, 16 nt, Human
ccuaugcagaggucca

SEQ ID NO: 2079330 - RNA, 15 nt, Human
gaaaugaaagcaggg

SEQ ID NO: 2079331 - RNA, 19 nt, Human
uaccccuggccaaggaaga

SEQ ID NO: 2079332 - RNA, 19 nt, Human
aacaguuguguuugaagca

SEQ ID NO: 2079333 - RNA, 11 nt, Human
aauuuaaauag

SEQ ID NO: 2079334 - RNA, 22 nt, Human
cucagcuucacccugaggugag

SEQ ID NO: 2079335 - RNA, 20 nt, Human
ccaggcggguccgggucgca

SEQ ID NO: 2079336 - RNA, 20 nt, Human
acuccagugagacagcucug

SEQ ID NO: 2079337 - RNA, 18 nt, Human
ggaaagaauaaccaacac

SEQ ID NO: 2079338 - RNA, 13 nt, Human
cugcacuccagcc

SEQ ID NO: 2079339 - RNA, 13 nt, Human
gcccccgggccga

SEQ ID NO: 2079340 - RNA, 12 nt, Human
cuuuaucuuuuu

SEQ ID NO: 2079341 - RNA, 15 nt, Human
auuuuacauggcugg

SEQ ID NO: 2079342 - RNA, 18 nt, Human
gaaaugaaagcagggacu

SEQ ID NO: 2079343 - RNA, 20 nt, Human
auauuuuauaucaauuuaaa

SEQ ID NO: 2079344 - RNA, 17 nt, Human
ugaaauaagccagacau

SEQ ID NO: 2079345 - RNA, 19 nt, Human
agaguuuagcuggaaaagu

SEQ ID NO: 2079346 - RNA, 15 nt, Human
aguaaauguuguuuu

SEQ ID NO: 2079347 - RNA, 17 nt, Human
cuccuaagaaggcaccu

SEQ ID NO: 2079348 - RNA, 15 nt, Human
uuucccagucuucag

SEQ ID NO: 2079349 - RNA, 17 nt, Human
caccugcugagccccaa

SEQ ID NO: 2079350 - RNA, 21 nt, Human
ccaugugcagccaccagucca

SEQ ID NO: 2079351 - RNA, 21 nt, Human
cucaaaacuucagacauagaa

SEQ ID NO: 2079352 - RNA, 13 nt, Human
ccagcacagccuc

SEQ ID NO: 2079353 - RNA, 21 nt, Human
aucuuguaaagguccuggcaa

SEQ ID NO: 2079354 - RNA, 17 nt, Human
cuaucucauuuccaagc

SEQ ID NO: 2079355 - RNA, 15 nt, Human
cgcgcugcgcgccgc

SEQ ID NO: 2079356 - RNA, 22 nt, Human
ucuuccuggauuccucacuuug

SEQ ID NO: 2079357 - RNA, 15 nt, Human
ccacaggaaccacaa

SEQ ID NO: 2079358 - RNA, 15 nt, Human
guugaagagguuuua

SEQ ID NO: 2079359 - RNA, 17 nt, Human
aguuauuuuuaaacugu

SEQ ID NO: 2079360 - RNA, 23 nt, Human
augaaacuuuuggaagguauuua

SEQ ID NO: 2079361 - RNA, 15 nt, Human
agcaccaucauuccc

SEQ ID NO: 2079362 - RNA, 17 nt, Human
acuccugcuagaacagu

SEQ ID NO: 2079363 - RNA, 23 nt, Human
cuuauaucuauauuuuacauaaa

SEQ ID NO: 2079364 - RNA, 16 nt, Human
aaauauuuauuuuaau

SEQ ID NO: 2079365 - RNA, 23 nt, Human
aguaauuggaaaggcagcucuaa

SEQ ID NO: 2079366 - RNA, 21 nt, Human
accaaggagccaaacauccua

SEQ ID NO: 2079367 - RNA, 17 nt, Human
uuccaagccucaugucc

SEQ ID NO: 2079368 - RNA, 15 nt, Human
ucucagaaggaaaga

SEQ ID NO: 2079369 - RNA, 15 nt, Human
agucaccucauggaa

SEQ ID NO: 2079370 - RNA, 16 nt, Human
uucaugcuguucauga

SEQ ID NO: 2079371 - RNA, 22 nt, Human
uggagacauugaggcaggcacu

SEQ ID NO: 2079372 - RNA, 14 nt, Human
ugaucaccugcccu

SEQ ID NO: 2079373 - RNA, 13 nt, Human
gaagaacugaaau

SEQ ID NO: 2079374 - RNA, 22 nt, Human
aaugauguuucauaagaauucu

SEQ ID NO: 2079375 - RNA, 13 nt, Human
ggugugugcagca

SEQ ID NO: 2079376 - RNA, 19 nt, Human
uuguagaagucacauuccu

SEQ ID NO: 2079377 - RNA, 17 nt, Human
agcuggaaacacauguu

SEQ ID NO: 2079378 - RNA, 19 nt, Human
auuuaguuauaaaaauaua

SEQ ID NO: 2079379 - RNA, 18 nt, Human
uauuuuguuucagugcac

SEQ ID NO: 2079380 - RNA, 23 nt, Human
aaaauaucacuugucaauaaaau

SEQ ID NO: 2079381 - RNA, 17 nt, Human
ucucuggccuucggccu

SEQ ID NO: 2079382 - RNA, 12 nt, Human
gucccaggcuga

SEQ ID NO: 2079383 - RNA, 15 nt, Human
acuuuuauaagaaau

SEQ ID NO: 2079384 - RNA, 12 nt, Human
gcgagcgcgcgc

SEQ ID NO: 2079385 - RNA, 20 nt, Human
caaauguucaucaaugaaug

SEQ ID NO: 2079386 - RNA, 23 nt, Human
ggaggcagagguugcagugagcc

SEQ ID NO: 2079387 - RNA, 15 nt, Human
ccucagucucccucc

SEQ ID NO: 2079388 - RNA, 19 nt, Human
ugaucaccugcccugcuga

SEQ ID NO: 2079389 - RNA, 13 nt, Human
gccuccagcugcc

SEQ ID NO: 2079390 - RNA, 18 nt, Human
cuaauguguaagacaaaa

SEQ ID NO: 2079391 - RNA, 16 nt, Human
gacauagaauuaacac

SEQ ID NO: 2079392 - RNA, 11 nt, Human
cuguuuuauaa

SEQ ID NO: 2079393 - RNA, 14 nt, Human
ccugcugagcccca

SEQ ID NO: 2079394 - RNA, 22 nt, Human
cauaaauguugacaugggacau

SEQ ID NO: 2079395 - RNA, 22 nt, Human
uuuacauggcuggagcuagaau

SEQ ID NO: 2079396 - RNA, 14 nt, Human
cccauucaggaugc

SEQ ID NO: 2079397 - RNA, 22 nt, Human
aauuuuagacauucuuuaucuu

SEQ ID NO: 2079398 - RNA, 22 nt, Human
agcacagccucuuagaugcagu

SEQ ID NO: 2079399 - RNA, 15 nt, Human
cccggccggcgcgcu

SEQ ID NO: 2079400 - RNA, 18 nt, Human
uauguuagagaauuuccu

SEQ ID NO: 2079401 - RNA, 19 nt, Human
acggagccgggaaagaaga

SEQ ID NO: 2079402 - RNA, 22 nt, Human
cgggucgcaggaccaucccggc

SEQ ID NO: 2079403 - RNA, 18 nt, Human
cauggaauuggagcucgu

SEQ ID NO: 2079404 - RNA, 17 nt, Human
cugccucagaaaacaag

SEQ ID NO: 2079405 - RNA, 22 nt, Human
gugaacaaauuuacagagacag

SEQ ID NO: 2079406 - RNA, 14 nt, Human
gcgcugcgcgccgc

SEQ ID NO: 2079407 - RNA, 13 nt, Human
cugaagcuguguc

SEQ ID NO: 2079408 - RNA, 16 nt, Human
ugaagauacugaaaua

SEQ ID NO: 2079409 - RNA, 19 nt, Human
uguuaucuucacuuuuaua

SEQ ID NO: 2079410 - RNA, 17 nt, Human
caaagagaaagaggguu

SEQ ID NO: 2079411 - RNA, 18 nt, Human
cuccgucaacucauauuu

SEQ ID NO: 2079412 - RNA, 15 nt, Human
guaaggggaauugag

SEQ ID NO: 2079413 - RNA, 16 nt, Human
gccgcgcugcgcgccg

SEQ ID NO: 2079414 - RNA, 14 nt, Human
gcuccgcgcagcuc

SEQ ID NO: 2079415 - RNA, 17 nt, Human
agggagucucagcuuca

SEQ ID NO: 2079416 - RNA, 21 nt, Human
ccuccccaaaugcuuuccaug

SEQ ID NO: 2079417 - RNA, 16 nt, Human
auccuugaagauuuac

SEQ ID NO: 2079418 - RNA, 21 nt, Human
gguccuugcugcaccugugcc

SEQ ID NO: 2079419 - RNA, 17 nt, Human
accugcugagccccaag

SEQ ID NO: 2079420 - RNA, 22 nt, Human
ccgggaggcagagguugcagug

SEQ ID NO: 2079421 - RNA, 17 nt, Human
ugaucaccugcccugcu

SEQ ID NO: 2079422 - RNA, 16 nt, Human
gcagcucaggcuggca

SEQ ID NO: 2079423 - RNA, 13 nt, Human
agacacagugacc

SEQ ID NO: 2079424 - RNA, 18 nt, Human
uaaauguuguuuuaggaa

SEQ ID NO: 2079425 - RNA, 14 nt, Human
uucccgcuguuccu

SEQ ID NO: 2079426 - RNA, 13 nt, Human
aagcauuccaacu

SEQ ID NO: 2079427 - RNA, 17 nt, Human
auauuuuuuuuuuuaaa

SEQ ID NO: 2079428 - RNA, 14 nt, Human
gcguugagccacca

SEQ ID NO: 2079429 - RNA, 13 nt, Human
aucuacacuccag

SEQ ID NO: 2079430 - RNA, 17 nt, Human
gcaaauugucacaggac

SEQ ID NO: 2079431 - RNA, 14 nt, Human
uccacaacacacag

SEQ ID NO: 2079432 - RNA, 14 nt, Human
cuccagugagacag

SEQ ID NO: 2079433 - RNA, 13 nt, Human
aaagaagagccgg

SEQ ID NO: 2079434 - RNA, 12 nt, Human
gccggcgcgcuc

SEQ ID NO: 2079435 - RNA, 20 nt, Human
agaugcaguucugaagaaga

SEQ ID NO: 2079436 - RNA, 18 nt, Human
auucugguagcuaaauau

SEQ ID NO: 2079437 - RNA, 17 nt, Human
auaaaguacaagagcuu

SEQ ID NO: 2079438 - RNA, 18 nt, Human
acagagacagaaagcaga

SEQ ID NO: 2079439 - RNA, 14 nt, Human
aagaagugaaaauc

SEQ ID NO: 2079440 - RNA, 23 nt, Human
aauguauucuuuuaguuuuuaaa

SEQ ID NO: 2079441 - RNA, 13 nt, Human
uuuaaaaaagaaa

SEQ ID NO: 2079442 - RNA, 19 nt, Human
acuucagcgguuuauauaa

SEQ ID NO: 2079443 - RNA, 17 nt, Human
uccuuggugccuggagc

SEQ ID NO: 2079444 - RNA, 18 nt, Human
uggcuguuaaucuuucaa

SEQ ID NO: 2079445 - RNA, 15 nt, Human
gagcgcgcgcgcccu

SEQ ID NO: 2079446 - RNA, 16 nt, Human
aagcauuuagauguau

SEQ ID NO: 2079447 - RNA, 16 nt, Human
aauauuuuaauguuuc

SEQ ID NO: 2079448 - RNA, 13 nt, Human
gaugcccacggcu

SEQ ID NO: 2079449 - RNA, 14 nt, Human
cugaacccagggaa

SEQ ID NO: 2079450 - RNA, 19 nt, Human
accuccuaagaaggcaccu

SEQ ID NO: 2079451 - RNA, 20 nt, Human
ccaaauguucaucaaugaau

SEQ ID NO: 2079452 - RNA, 20 nt, Human
gcuggagacauugaggcagg

SEQ ID NO: 2079453 - RNA, 13 nt, Human
auuauauauauuu

SEQ ID NO: 2079454 - RNA, 15 nt, Human
uaucuucacuuuuau

SEQ ID NO: 2079455 - RNA, 20 nt, Human
ucuguuuucccuccuuggag

SEQ ID NO: 2079456 - RNA, 16 nt, Human
ucaucaaugaaugaau

SEQ ID NO: 2079457 - RNA, 20 nt, Human
aggauauucucacagcucca

SEQ ID NO: 2079458 - RNA, 18 nt, Human
aaguugauaugccuuuuc

SEQ ID NO: 2079459 - RNA, 20 nt, Human
aaaugauguuucauaagaau

SEQ ID NO: 2079460 - RNA, 19 nt, Human
cuucccgcuguuccucgcc

SEQ ID NO: 2079461 - RNA, 15 nt, Human
ugauaugugaacagu

SEQ ID NO: 2079462 - RNA, 12 nt, Human
uuuugaaaccaa

SEQ ID NO: 2079463 - RNA, 14 nt, Human
aagcugaguguuuc

SEQ ID NO: 2079464 - RNA, 18 nt, Human
acucuuaagaagacugca

SEQ ID NO: 2079465 - RNA, 21 nt, Human
gcugagucccaggcugagccu

SEQ ID NO: 2079466 - RNA, 23 nt, Human
acuaguuguaauuuuuuuguggg

SEQ ID NO: 2079467 - RNA, 15 nt, Human
auccuagucucuauc

SEQ ID NO: 2079468 - RNA, 17 nt, Human
cacuuuccaauaaagag

SEQ ID NO: 2079469 - RNA, 19 nt, Human
ucagugucaaugcagcccc

SEQ ID NO: 2079470 - RNA, 22 nt, Human
agucccugcugcccuuccccuu

SEQ ID NO: 2079471 - RNA, 13 nt, Human
auugaggcaggca

SEQ ID NO: 2079472 - RNA, 13 nt, Human
guuauuuuuaaac

SEQ ID NO: 2079473 - RNA, 12 nt, Human
agugcagccccg

SEQ ID NO: 2079474 - RNA, 22 nt, Human
augcagagguccacaacacaca

SEQ ID NO: 2079475 - RNA, 23 nt, Human
cccuagaaagccaugugcagcca

SEQ ID NO: 2079476 - RNA, 22 nt, Human
cuccuccagggagucucagcuu

SEQ ID NO: 2079477 - RNA, 16 nt, Human
cacuaguauuucuaug

SEQ ID NO: 2079478 - RNA, 22 nt, Human
gcugccucucucauccacuuuc

SEQ ID NO: 2079479 - RNA, 20 nt, Human
acuagaguuuagcuggaaaa

SEQ ID NO: 2079480 - RNA, 19 nt, Human
cucauggaauuggagcucg

SEQ ID NO: 2079481 - RNA, 18 nt, Human
uccuaauuccacagcugc

SEQ ID NO: 2079482 - RNA, 20 nt, Human
uuagcauaguaccucugcua

SEQ ID NO: 2079483 - RNA, 19 nt, Human
uuauauauauauauuuuuu

SEQ ID NO: 2079484 - RNA, 15 nt, Human
uggacucaccucccc

SEQ ID NO: 2079485 - RNA, 15 nt, Human
ugagcucaccagucc

SEQ ID NO: 2079486 - RNA, 12 nt, Human
gcugaugcaguu

SEQ ID NO: 2079487 - RNA, 13 nt, Human
ugagcgacaguga

SEQ ID NO: 2079488 - RNA, 18 nt, Human
uuucucugauacagaaaa

SEQ ID NO: 2079489 - RNA, 17 nt, Human
gcugcccuuccccuucc

SEQ ID NO: 2079490 - RNA, 17 nt, Human
acuauuuaauuauuuca

SEQ ID NO: 2079491 - RNA, 14 nt, Human
accauuuuuacuug

SEQ ID NO: 2079492 - RNA, 18 nt, Human
gaauuuccuuacucuuga

SEQ ID NO: 2079493 - RNA, 17 nt, Human
auauuugaaauauugac

SEQ ID NO: 2079494 - RNA, 14 nt, Human
ggaaagaagagccg

SEQ ID NO: 2079495 - RNA, 11 nt, Human
aauuccacagc

SEQ ID NO: 2079496 - RNA, 17 nt, Human
uuuccugggagcuuuug

SEQ ID NO: 2079497 - RNA, 13 nt, Human
cccugcacuccag

SEQ ID NO: 2079498 - RNA, 19 nt, Human
gccgcgcugcgcgccgcgc

SEQ ID NO: 2079499 - RNA, 20 nt, Human
cuuccucccauucaggaugc

SEQ ID NO: 2079500 - RNA, 17 nt, Human
gaagauacugaaauaaa

SEQ ID NO: 2079501 - RNA, 12 nt, Human
uaauuccacagc

SEQ ID NO: 2079502 - RNA, 15 nt, Human
uaucaauuuaaaaaa

SEQ ID NO: 2079503 - RNA, 16 nt, Human
ucuuuuaguuuuuaaa

SEQ ID NO: 2079504 - RNA, 18 nt, Human
uuuuaucugcuaugcuau

SEQ ID NO: 2079505 - RNA, 21 nt, Human
gcucggccugcucgcccacuu

SEQ ID NO: 2079506 - RNA, 14 nt, Human
ucuaggaaauauuu

SEQ ID NO: 2079507 - RNA, 17 nt, Human
gcaucuccucaacucug

SEQ ID NO: 2079508 - RNA, 14 nt, Human
gagagugaacaaau

SEQ ID NO: 2079509 - RNA, 12 nt, Human
acagagacagaa

SEQ ID NO: 2079510 - RNA, 13 nt, Human
acaagaaggaaag

SEQ ID NO: 2079511 - RNA, 13 nt, Human
aguuguaauuuuu

SEQ ID NO: 2079512 - RNA, 17 nt, Human
uauauuuccaagaaaua

SEQ ID NO: 2079513 - RNA, 21 nt, Human
agccgguccuugcugcaccug

SEQ ID NO: 2079514 - RNA, 20 nt, Human
aauucugguagcuaaauaua

SEQ ID NO: 2079515 - RNA, 16 nt, Human
ccucagucucccuccc

SEQ ID NO: 2079516 - RNA, 14 nt, Human
agauguagaggaga

SEQ ID NO: 2079517 - RNA, 15 nt, Human
cucgcccacuuccuc

SEQ ID NO: 2079518 - RNA, 13 nt, Human
ucugaaauuuccu

SEQ ID NO: 2079519 - RNA, 16 nt, Human
gcagcaucagcauccc

SEQ ID NO: 2079520 - RNA, 12 nt, Human
uacuauuuaauu

SEQ ID NO: 2079521 - RNA, 13 nt, Human
caacucccugccc

SEQ ID NO: 2079522 - RNA, 12 nt, Human
acugaaaucaua

SEQ ID NO: 2079523 - RNA, 19 nt, Human
acuaucucauuuccaagca

SEQ ID NO: 2079524 - RNA, 14 nt, Human
gcuuuaacuccugc

SEQ ID NO: 2079525 - RNA, 17 nt, Human
ggcuggagcugccucuc

SEQ ID NO: 2079526 - RNA, 18 nt, Human
ccuucggccuccauccug

SEQ ID NO: 2079527 - RNA, 18 nt, Human
auuuaguauuuuguuuca

SEQ ID NO: 2079528 - RNA, 22 nt, Human
cuuaucuauguagaauauauuu

SEQ ID NO: 2079529 - RNA, 22 nt, Human
gcauccuagucucuaucauuaa

SEQ ID NO: 2079530 - RNA, 22 nt, Human
cuuguacucugaaaguuuugga

SEQ ID NO: 2079531 - RNA, 18 nt, Human
uaauuuuagacauucuuu

SEQ ID NO: 2079532 - RNA, 21 nt, Human
uauaaaauaauuuuuauauuu

SEQ ID NO: 2079533 - RNA, 18 nt, Human
uuccuaauaaagcuucug

SEQ ID NO: 2079534 - RNA, 16 nt, Human
aaaguugaauuuuaca

SEQ ID NO: 2079535 - RNA, 16 nt, Human
aucuauauuuuacaua

SEQ ID NO: 2079536 - RNA, 18 nt, Human
gaccccugagcuugcaga

SEQ ID NO: 2079537 - RNA, 18 nt, Human
ugcaccugugccgucccc

SEQ ID NO: 2079538 - RNA, 11 nt, Human
ccacaucugag

SEQ ID NO: 2079539 - RNA, 22 nt, Human
auauauaacaaugcuguauuuu

SEQ ID NO: 2079540 - RNA, 17 nt, Human
ggccaugggacagggag

SEQ ID NO: 2079541 - RNA, 13 nt, Human
augauuccaccua

SEQ ID NO: 2079542 - RNA, 16 nt, Human
ugaauuuaaauagcuu

SEQ ID NO: 2079543 - RNA, 13 nt, Human
ugugcuggccacc

SEQ ID NO: 2079544 - RNA, 20 nt, Human
uaugcuucuguuuuauaauu

SEQ ID NO: 2079545 - RNA, 14 nt, Human
auuauuucacuuua

SEQ ID NO: 2079546 - RNA, 18 nt, Human
guuucaaacauauauaac

SEQ ID NO: 2079547 - RNA, 16 nt, Human
gaaucacuugaacccg

SEQ ID NO: 2079548 - RNA, 21 nt, Human
uggaaacguauucaaacaauu

SEQ ID NO: 2079549 - RNA, 13 nt, Human
ccacaacacacag

SEQ ID NO: 2079550 - RNA, 16 nt, Human
augccccgucccccuc

SEQ ID NO: 2079551 - RNA, 14 nt, Human
agaauauauuuccu

SEQ ID NO: 2079552 - RNA, 15 nt, Human
aggcaccucucuggg

SEQ ID NO: 2079553 - RNA, 15 nt, Human
guccuugcugcaccu

SEQ ID NO: 2079554 - RNA, 17 nt, Human
ggaaauauuuauuuuaa

SEQ ID NO: 2079555 - RNA, 13 nt, Human
gccguccccagag

SEQ ID NO: 2079556 - RNA, 18 nt, Human
auguuccuaauaaagcuu

SEQ ID NO: 2079557 - RNA, 20 nt, Human
agagacacacugaagaagca

SEQ ID NO: 2079558 - RNA, 12 nt, Human
caccuccuaaga

SEQ ID NO: 2079559 - RNA, 14 nt, Human
cagcaucagcaucc

SEQ ID NO: 2079560 - RNA, 17 nt, Human
aggcuagaaccaccugc

SEQ ID NO: 2079561 - RNA, 19 nt, Human
cacggcuggagcugccucu

SEQ ID NO: 2079562 - RNA, 17 nt, Human
ggcucuggacaggcacu

SEQ ID NO: 2079563 - RNA, 14 nt, Human
cacuguccauucuu

SEQ ID NO: 2079564 - RNA, 13 nt, Human
uaaauauauauuu

SEQ ID NO: 2079565 - RNA, 16 nt, Human
gccaugugcuaguaau

SEQ ID NO: 2079566 - RNA, 21 nt, Human
uuuguauaaaauaauuuuuau

SEQ ID NO: 2079567 - RNA, 20 nt, Human
cuggcuaauuagcauggcca

SEQ ID NO: 2079568 - RNA, 14 nt, Human
cucccugcccccca

SEQ ID NO: 2079569 - RNA, 18 nt, Human
ucaccagucccuccccaa

SEQ ID NO: 2079570 - RNA, 16 nt, Human
cugcugagccccaagu

SEQ ID NO: 2079571 - RNA, 14 nt, Human
cgugcuugucccug

SEQ ID NO: 2079572 - RNA, 14 nt, Human
acuuggucugugag

SEQ ID NO: 2079573 - RNA, 22 nt, Human
uauuucagauaaucacaauaca

SEQ ID NO: 2079574 - RNA, 10 nt, Human
caacucccug

SEQ ID NO: 2079575 - RNA, 15 nt, Human
ccugccccccagccc

SEQ ID NO: 2079576 - RNA, 18 nt, Human
agccugaucaccugcccu

SEQ ID NO: 2079577 - RNA, 22 nt, Human
uucaauaucuuuuuuuuaauaa

SEQ ID NO: 2079578 - RNA, 17 nt, Human
cccaggcugagccucag

SEQ ID NO: 2079579 - RNA, 20 nt, Human
cagcugccccggggaggggc

SEQ ID NO: 2079580 - RNA, 23 nt, Human
ucccuagaaagccaugugcagcc

SEQ ID NO: 2079581 - RNA, 15 nt, Human
gagaugcuagaacuc

SEQ ID NO: 2079582 - RNA, 22 nt, Human
accaaucaugaauuaguuuuau

SEQ ID NO: 2079583 - RNA, 13 nt, Human
cagaaaaguugaa

SEQ ID NO: 2079584 - RNA, 22 nt, Human
auauuuuagauagaugaagaag

SEQ ID NO: 2079585 - RNA, 20 nt, Human
cuuccaggcuggcgugcagc

SEQ ID NO: 2079586 - RNA, 21 nt, Human
acgcucucuggccuucggccu

SEQ ID NO: 2079587 - RNA, 17 nt, Human
ccuuggugccuggagcc

SEQ ID NO: 2079588 - RNA, 16 nt, Human
uggcaagcucuaucac

SEQ ID NO: 2079589 - RNA, 16 nt, Human
aaauauuauguuaaaa

SEQ ID NO: 2079590 - RNA, 16 nt, Human
ggggagcgagccccag

SEQ ID NO: 2079591 - RNA, 22 nt, Human
ggggugguuuucccaucucagg

SEQ ID NO: 2079592 - RNA, 22 nt, Human
ccaaacauccuacaagacacag

SEQ ID NO: 2079593 - RNA, 18 nt, Human
ucuucaacucccugcccc

SEQ ID NO: 2079594 - RNA, 15 nt, Human
uccucaacucugagu

SEQ ID NO: 2079595 - RNA, 21 nt, Human
auuuuccugaaaacccuugcc

SEQ ID NO: 2079596 - RNA, 13 nt, Human
uccuacuuccccu

SEQ ID NO: 2079597 - RNA, 16 nt, Human
cgcgcgcuccgcgcag

SEQ ID NO: 2079598 - RNA, 13 nt, Human
cuaggcauagccc

SEQ ID NO: 2079599 - RNA, 14 nt, Human
ugacuauuauauuu

SEQ ID NO: 2079600 - RNA, 20 nt, Human
gauugugccccugcacucca

SEQ ID NO: 2079601 - RNA, 14 nt, Human
aauauuuauuuuaa

SEQ ID NO: 2079602 - RNA, 13 nt, Human
gcgcucggccugc

SEQ ID NO: 2079603 - RNA, 21 nt, Human
aauuuacagagacagaaagca

SEQ ID NO: 2079604 - RNA, 13 nt, Human
cgggaggcagagg

SEQ ID NO: 2079605 - RNA, 13 nt, Human
uuuuaaaaaagaa

SEQ ID NO: 2079606 - RNA, 13 nt, Human
ccugccccccagc

SEQ ID NO: 2079607 - RNA, 14 nt, Human
aaagaggaaugaag

SEQ ID NO: 2079608 - RNA, 13 nt, Human
uguauauuuuaua

SEQ ID NO: 2079609 - RNA, 21 nt, Human
ucgcccacuuccucccggccg

SEQ ID NO: 2079610 - RNA, 19 nt, Human
uuggcaagcucuaucacca

SEQ ID NO: 2079611 - RNA, 19 nt, Human
uggaaauguuuacagaucc

SEQ ID NO: 2079612 - RNA, 14 nt, Human
auugaggcaggcac

SEQ ID NO: 2079613 - RNA, 21 nt, Human
gaacagucucuugaggcacag

SEQ ID NO: 2079614 - RNA, 14 nt, Human
ugcuggagcucugc

SEQ ID NO: 2079615 - RNA, 12 nt, Human
uuuuuucugaaa

SEQ ID NO: 2079616 - RNA, 13 nt, Human
gggaaagaagagc

SEQ ID NO: 2079617 - RNA, 14 nt, Human
ucccacccgcccac

SEQ ID NO: 2079618 - RNA, 15 nt, Human
uuggggaauauguua

SEQ ID NO: 2079619 - RNA, 11 nt, Human
uuauauuucca

SEQ ID NO: 2079620 - RNA, 15 nt, Human
uguauuuuaaaagaa

SEQ ID NO: 2079621 - RNA, 18 nt, Human
ucaagggugugugcagca

SEQ ID NO: 2079622 - RNA, 17 nt, Human
agcugccccggggaggg

SEQ ID NO: 2079623 - RNA, 17 nt, Human
uaauuugguuuucacau

SEQ ID NO: 2079624 - RNA, 19 nt, Human
auuaaguuuuuuuuuaaaa

SEQ ID NO: 2079625 - RNA, 14 nt, Human
agagacagaaagca

SEQ ID NO: 2079626 - RNA, 23 nt, Human
caccucauggaauuggagcucgu

SEQ ID NO: 2079627 - RNA, 22 nt, Human
uaagaauucuguugauggaaau

SEQ ID NO: 2079628 - RNA, 14 nt, Human
caauugacuauagu

SEQ ID NO: 2079629 - RNA, 19 nt, Human
uccuauaauuuuagacauu

SEQ ID NO: 2079630 - RNA, 18 nt, Human
ccacaucugagccccgaa

SEQ ID NO: 2079631 - RNA, 19 nt, Human
acuauuuaauuauuucacu

SEQ ID NO: 2079632 - RNA, 20 nt, Human
uaucuucacuuuuauaagaa

SEQ ID NO: 2079633 - RNA, 22 nt, Human
cagaucuaugccacaagaaccc

SEQ ID NO: 2079634 - RNA, 20 nt, Human
auuacauuuguauaaaauaa

SEQ ID NO: 2079635 - RNA, 15 nt, Human
uggcuaauuagcaug

SEQ ID NO: 2079636 - RNA, 15 nt, Human
aauuuaucauuuagu

SEQ ID NO: 2079637 - RNA, 22 nt, Human
cugcuggagacauugaggcagg

SEQ ID NO: 2079638 - RNA, 22 nt, Human
gcggggagcgagccccaggcgg

SEQ ID NO: 2079639 - RNA, 18 nt, Human
auaggaaauauuuuaaug

SEQ ID NO: 2079640 - RNA, 22 nt, Human
guggcgcuggcugcgcucggcc

SEQ ID NO: 2079641 - RNA, 13 nt, Human
uuuaacuccugcu

SEQ ID NO: 2079642 - RNA, 12 nt, Human
uaaauauauauu

SEQ ID NO: 2079643 - RNA, 16 nt, Human
acuaguuucccuugca

SEQ ID NO: 2079644 - RNA, 16 nt, Human
agcuaaauauauauuu

SEQ ID NO: 2079645 - RNA, 13 nt, Human
ucuacuaaaaaua

SEQ ID NO: 2079646 - RNA, 14 nt, Human
cucccuuggggccu

SEQ ID NO: 2079647 - RNA, 16 nt, Human
cgcauggaaaaguuuc

SEQ ID NO: 2079648 - RNA, 15 nt, Human
auccugccccugagc

SEQ ID NO: 2079649 - RNA, 14 nt, Human
cacuuauaggaauu

SEQ ID NO: 2079650 - RNA, 19 nt, Human
uaggugacuauuauauuuc

SEQ ID NO: 2079651 - RNA, 21 nt, Human
cauucaaauguauuacagugg

SEQ ID NO: 2079652 - RNA, 19 nt, Human
gagguacugagagugaaca

SEQ ID NO: 2079653 - RNA, 21 nt, Human
aagauacugaaauaaacgucu

SEQ ID NO: 2079654 - RNA, 20 nt, Human
aaggaugccccgucccccuc

SEQ ID NO: 2079655 - RNA, 23 nt, Human
caucucuucuggguuccuuccuc

SEQ ID NO: 2079656 - RNA, 21 nt, Human
uuacaaugcauucugagguaa

SEQ ID NO: 2079657 - RNA, 20 nt, Human
cuucaacucccugcccccca

SEQ ID NO: 2079658 - RNA, 22 nt, Human
ucugguagcuaaauauauauuu

SEQ ID NO: 2079659 - RNA, 16 nt, Human
ucucuaggaaauauuu

SEQ ID NO: 2079660 - RNA, 19 nt, Human
gcacacagcacgggggcca

SEQ ID NO: 2079661 - RNA, 22 nt, Human
uaaacuguaaagcuuugugcag

SEQ ID NO: 2079662 - RNA, 21 nt, Human
agaauucuguugauggaaaua

SEQ ID NO: 2079663 - RNA, 19 nt, Human
uucuuuaucuuuuuaguau

SEQ ID NO: 2079664 - RNA, 22 nt, Human
auauauauuuuuuuuuuuaaaa

SEQ ID NO: 2079665 - RNA, 21 nt, Human
ugcucaauaaaguacaagagc

SEQ ID NO: 2079666 - RNA, 18 nt, Human
cagccucuuagaugcagu

SEQ ID NO: 2079667 - RNA, 18 nt, Human
auuuguauaaaauaauuu

SEQ ID NO: 2079668 - RNA, 19 nt, Human
cagaaagcagaacagugau

SEQ ID NO: 2079669 - RNA, 15 nt, Human
aucaguaugaaaaug

SEQ ID NO: 2079670 - RNA, 19 nt, Human
aagucagucauucagauau

SEQ ID NO: 2079671 - RNA, 16 nt, Human
guuaucuucacuuuua

SEQ ID NO: 2079672 - RNA, 13 nt, Human
uaggacugaauua

SEQ ID NO: 2079673 - RNA, 15 nt, Human
ggcaagcucuaucac

SEQ ID NO: 2079674 - RNA, 12 nt, Human
aauauauuuccu

SEQ ID NO: 2079675 - RNA, 13 nt, Human
gcuggagcucugc

SEQ ID NO: 2079676 - RNA, 14 nt, Human
auuucuaugaaaua

SEQ ID NO: 2079677 - RNA, 20 nt, Human
acaugagguacugagaguga

SEQ ID NO: 2079678 - RNA, 18 nt, Human
cggagccuccagcugccc

SEQ ID NO: 2079679 - RNA, 23 nt, Human
uccaacuaucucauuuccaagca

SEQ ID NO: 2079680 - RNA, 15 nt, Human
uugaagcacagugau

SEQ ID NO: 2079681 - RNA, 14 nt, Human
cccugccccccagc

SEQ ID NO: 2079682 - RNA, 15 nt, Human
uccacaaguaaaagg

SEQ ID NO: 2079683 - RNA, 19 nt, Human
ggagcuggaaacacauguu

SEQ ID NO: 2079684 - RNA, 20 nt, Human
cccugccccccagcccuccu

SEQ ID NO: 2079685 - RNA, 23 nt, Human
cugaaaucauacuucuuaggguu

SEQ ID NO: 2079686 - RNA, 12 nt, Human
caugggaaguga

SEQ ID NO: 2079687 - RNA, 17 nt, Human
ucuggaggucucugaac

SEQ ID NO: 2079688 - RNA, 22 nt, Human
uacaugagguacugagagugaa

SEQ ID NO: 2079689 - RNA, 18 nt, Human
cccucuggcuccagcugg

SEQ ID NO: 2079690 - RNA, 19 nt, Human
aauuuuuauauuugaaaua

SEQ ID NO: 2079691 - RNA, 16 nt, Human
gaucaaguuauuuuua

SEQ ID NO: 2079692 - RNA, 15 nt, Human
guccauucuuccucc

SEQ ID NO: 2079693 - RNA, 23 nt, Human
gcccacggcuggagcugccucuc

SEQ ID NO: 2079694 - RNA, 18 nt, Human
cuguuuucccuccuugga

SEQ ID NO: 2079695 - RNA, 14 nt, Human
aaaauacaaaaaaa

SEQ ID NO: 2079696 - RNA, 15 nt, Human
acuauuauauuucca

SEQ ID NO: 2079697 - RNA, 23 nt, Human
uaucuauguagaauauauuuccu

SEQ ID NO: 2079698 - RNA, 22 nt, Human
agaagagccggagccuccagcu

SEQ ID NO: 2079699 - RNA, 16 nt, Human
guuccuuccucugagc

SEQ ID NO: 2079700 - RNA, 12 nt, Human
acaagacacagu

SEQ ID NO: 2079701 - RNA, 14 nt, Human
augcuccuccaggg

SEQ ID NO: 2079702 - RNA, 16 nt, Human
augagcacgcauggaa

SEQ ID NO: 2079703 - RNA, 19 nt, Human
uuauggcacuaguauuucu

SEQ ID NO: 2079704 - RNA, 12 nt, Human
uuccugaacagg

SEQ ID NO: 2079705 - RNA, 16 nt, Human
cacgggggccaaggau

SEQ ID NO: 2079706 - RNA, 23 nt, Human
gcugccccggggaggggcgcucg

SEQ ID NO: 2079707 - RNA, 15 nt, Human
agcucuaucaccaag

SEQ ID NO: 2079708 - RNA, 18 nt, Human
uaggugacuauuauauuu

SEQ ID NO: 2079709 - RNA, 19 nt, Human
cuggcucuggacaggcacu

SEQ ID NO: 2079710 - RNA, 21 nt, Human
uuacauuuguauaaaauaauu

SEQ ID NO: 2079711 - RNA, 21 nt, Human
auacauaaaguaugugcauau

SEQ ID NO: 2079712 - RNA, 16 nt, Human
ugacaagcucacagac

SEQ ID NO: 2079713 - RNA, 17 nt, Human
ccaccugcugagcccca

SEQ ID NO: 2079714 - RNA, 17 nt, Human
cggcccugugcggccug

SEQ ID NO: 2079715 - RNA, 16 nt, Human
agauagaugaagaagc

SEQ ID NO: 2079716 - RNA, 22 nt, Human
aggcccccgggccgacggagcc

SEQ ID NO: 2079717 - RNA, 15 nt, Human
agucucuaucauuaa

SEQ ID NO: 2079718 - RNA, 17 nt, Human
cgcgccuccgcuacuuc

SEQ ID NO: 2079719 - RNA, 22 nt, Human
cugggacaggggagaaccuagg

SEQ ID NO: 2079720 - RNA, 19 nt, Human
cucuugaggcacagaaacu

SEQ ID NO: 2079721 - RNA, 13 nt, Human
cuugcugcaccug

SEQ ID NO: 2079722 - RNA, 18 nt, Human
cacaaguaaaaggaaaug

SEQ ID NO: 2079723 - RNA, 22 nt, Human
gcccacggcuggagcugccucu

SEQ ID NO: 2079724 - RNA, 20 nt, Human
cuguccauucuuccucccau

SEQ ID NO: 2079725 - RNA, 17 nt, Human
ggcuccggacgcugcug

SEQ ID NO: 2079726 - RNA, 14 nt, Human
aacuuugauuuuau

SEQ ID NO: 2079727 - RNA, 13 nt, Human
cccuccuuaucaa

SEQ ID NO: 2079728 - RNA, 13 nt, Human
gauuguaaaaugg

SEQ ID NO: 2079729 - RNA, 14 nt, Human
cugccccccagccc

SEQ ID NO: 2079730 - RNA, 16 nt, Human
aauugacccacaagaa

SEQ ID NO: 2079731 - RNA, 16 nt, Human
ugcuauugaaguuuug

SEQ ID NO: 2079732 - RNA, 17 nt, Human
aucauuuacuuuuaaac

SEQ ID NO: 2079733 - RNA, 18 nt, Human
uuaucauuuaguuauaaa

SEQ ID NO: 2079734 - RNA, 22 nt, Human
agaaauaggaaauauuuuaaug

SEQ ID NO: 2079735 - RNA, 22 nt, Human
agcuuguauuccuuuuucucuc

SEQ ID NO: 2079736 - RNA, 20 nt, Human
uuugccgcuuaagcuuucag

SEQ ID NO: 2079737 - RNA, 19 nt, Human
ccugccuaagugcagcccc

SEQ ID NO: 2079738 - RNA, 22 nt, Human
ugauugugggauacuauuuaau

SEQ ID NO: 2079739 - RNA, 22 nt, Human
aacucccugccccccagcccuc

SEQ ID NO: 2079740 - RNA, 21 nt, Human
gcccauccugccccugagccc

SEQ ID NO: 2079741 - RNA, 20 nt, Human
uaugcuauuuauuaaguauu

SEQ ID NO: 2079742 - RNA, 19 nt, Human
uuuauaucaauuuaaaaaa

SEQ ID NO: 2079743 - RNA, 18 nt, Human
uccucgccacgcucuggg

SEQ ID NO: 2079744 - RNA, 22 nt, Human
cuagucucuaucauuaaaguuc

SEQ ID NO: 2079745 - RNA, 15 nt, Human
aaucucaauauuuca

SEQ ID NO: 2079746 - RNA, 15 nt, Human
cucgugggacaguca

SEQ ID NO: 2079747 - RNA, 18 nt, Human
uuccaagaaauauuccuu

SEQ ID NO: 2079748 - RNA, 22 nt, Human
acccugaggugagcaucaucuu

SEQ ID NO: 2079749 - RNA, 16 nt, Human
cuucuggguuccuucc

SEQ ID NO: 2079750 - RNA, 16 nt, Human
auuauacccccugcaa

SEQ ID NO: 2079751 - RNA, 14 nt, Human
auaaaauaauuuuu

SEQ ID NO: 2079752 - RNA, 21 nt, Human
ucuucaacucccugcccccca

SEQ ID NO: 2079753 - RNA, 16 nt, Human
cuucccacacugucca

SEQ ID NO: 2079754 - RNA, 15 nt, Human
gugggccugagacca

SEQ ID NO: 2079755 - RNA, 20 nt, Human
ucacuguauguccuuggugc

SEQ ID NO: 2079756 - RNA, 13 nt, Human
cguugagccacca

SEQ ID NO: 2079757 - RNA, 21 nt, Human
cuggcugcgcucggccugcuc

SEQ ID NO: 2079758 - RNA, 18 nt, Human
gccguccccagagcuaca

SEQ ID NO: 2079759 - RNA, 13 nt, Human
uguccacaaguaa

SEQ ID NO: 2079760 - RNA, 15 nt, Human
ucuggcuccagcugg

SEQ ID NO: 2079761 - RNA, 19 nt, Human
ccccucuggcuccagcugg

SEQ ID NO: 2079762 - RNA, 17 nt, Human
cccacggcuggagcugc

SEQ ID NO: 2079763 - RNA, 11 nt, Human
uaguuagcuuu

SEQ ID NO: 2079764 - RNA, 16 nt, Human
uggucugugagaugcu

SEQ ID NO: 2079765 - RNA, 10 nt, Human
ccugagcccc

SEQ ID NO: 2079766 - RNA, 19 nt, Human
cccugcaaagcccagcuug

SEQ ID NO: 2079767 - RNA, 15 nt, Human
gcccugugcggccug

SEQ ID NO: 2079768 - RNA, 14 nt, Human
cgucccccucuggc

SEQ ID NO: 2079769 - RNA, 18 nt, Human
uaaaauccauacauuugu

SEQ ID NO: 2079770 - RNA, 22 nt, Human
ucccuagaaagccaugugcagc

SEQ ID NO: 2079771 - RNA, 17 nt, Human
agccuccagcugccccg

SEQ ID NO: 2079772 - RNA, 15 nt, Human
cucauccacuuucca

SEQ ID NO: 2079773 - RNA, 16 nt, Human
aggccaugggacaggg

SEQ ID NO: 2079774 - RNA, 23 nt, Human
ggauguggggaaguuaggaacug

SEQ ID NO: 2079775 - RNA, 15 nt, Human
uugacacuuaaaaau

SEQ ID NO: 2079776 - RNA, 22 nt, Human
cggccugcucgcccacuuccuc

SEQ ID NO: 2079777 - RNA, 14 nt, Human
uuccgcauccuagu

SEQ ID NO: 2079778 - RNA, 15 nt, Human
ugagguaaccucauu

SEQ ID NO: 2079779 - RNA, 17 nt, Human
uaaauuuaucauuuagu

SEQ ID NO: 2079780 - RNA, 12 nt, Human
acaugagguacu

SEQ ID NO: 2079781 - RNA, 12 nt, Human
uuauucacugua

SEQ ID NO: 2079782 - RNA, 21 nt, Human
aaucaccaaggcugauuaaac

SEQ ID NO: 2079783 - RNA, 17 nt, Human
uuauuacuguaagaaaa

SEQ ID NO: 2079784 - RNA, 19 nt, Human
uggggcuuuaacuccugcu

SEQ ID NO: 2079785 - RNA, 22 nt, Human
gggccugagaccaaggcccccg

SEQ ID NO: 2079786 - RNA, 18 nt, Human
cagauuugagcucagccc

SEQ ID NO: 2079787 - RNA, 23 nt, Human
ccccggggaggggcgcucgcuuc

SEQ ID NO: 2079788 - RNA, 14 nt, Human
agaauuugauaugu

SEQ ID NO: 2079789 - RNA, 19 nt, Human
gaauaucuccgucaacuca

SEQ ID NO: 2079790 - RNA, 18 nt, Human
auuugcuggagcucugcc

SEQ ID NO: 2079791 - RNA, 17 nt, Human
uccuacaagacacagug

SEQ ID NO: 2079792 - RNA, 13 nt, Human
aggggcgcucgcu

SEQ ID NO: 2079793 - RNA, 13 nt, Human
agagguccacaac

SEQ ID NO: 2079794 - RNA, 18 nt, Human
auguuucauaagaauucu

SEQ ID NO: 2079795 - RNA, 21 nt, Human
aaaagguauuuuaaucaccaa

SEQ ID NO: 2079796 - RNA, 22 nt, Human
ccccuuccuaauuccacagcug

SEQ ID NO: 2079797 - RNA, 18 nt, Human
cucuggccuucggccucc

SEQ ID NO: 2079798 - RNA, 23 nt, Human
aaagaugaucaguaugaaaaugu

SEQ ID NO: 2079799 - RNA, 15 nt, Human
ucuauauuuuacaua

SEQ ID NO: 2079800 - RNA, 21 nt, Human
aguuguugcccacagcuguau

SEQ ID NO: 2079801 - RNA, 21 nt, Human
accaccugccuauauuuuuug

SEQ ID NO: 2079802 - RNA, 22 nt, Human
aaauguugacaugggacauuug

SEQ ID NO: 2079803 - RNA, 16 nt, Human
gggccgacggagccgg

SEQ ID NO: 2079804 - RNA, 16 nt, Human
cugaucaccugcccug

SEQ ID NO: 2079805 - RNA, 21 nt, Human
cugaaauaaacgucuuaaaua

SEQ ID NO: 2079806 - RNA, 11 nt, Human
gcgcuggcugc

SEQ ID NO: 2079807 - RNA, 17 nt, Human
agcucugcccauccugc

SEQ ID NO: 2079808 - RNA, 19 nt, Human
cucugccucagaaaacaag

SEQ ID NO: 2079809 - RNA, 19 nt, Human
cuccuuggagacagggccc

SEQ ID NO: 2079810 - RNA, 13 nt, Human
gcgcgccuccgcu

SEQ ID NO: 2079811 - RNA, 15 nt, Human
acaggguuuauguuu

SEQ ID NO: 2079812 - RNA, 15 nt, Human
gaaaacaaggaugaa

SEQ ID NO: 2079813 - RNA, 20 nt, Human
uaguuauaaaaauauauagc

SEQ ID NO: 2079814 - RNA, 16 nt, Human
ucuucucagaaggaaa

SEQ ID NO: 2079815 - RNA, 20 nt, Human
gggagccccaauucgauccc

SEQ ID NO: 2079816 - RNA, 17 nt, Human
aaccuagggugauauua

SEQ ID NO: 2079817 - RNA, 16 nt, Human
uaucuuccuauaauuu

SEQ ID NO: 2079818 - RNA, 22 nt, Human
uuuccuuauucagaauuucuaa

SEQ ID NO: 2079819 - RNA, 16 nt, Human
ugcaugguuuagaaag

SEQ ID NO: 2079820 - RNA, 14 nt, Human
agcaaguauuagaa

SEQ ID NO: 2079821 - RNA, 22 nt, Human
uuguucuugugaacccaaagug

SEQ ID NO: 2079822 - RNA, 17 nt, Human
ugcccacggcuggagcu

SEQ ID NO: 2079823 - RNA, 13 nt, Human
cugagagugaaca

SEQ ID NO: 2079824 - RNA, 23 nt, Human
accucucuggguugaagggcagu

SEQ ID NO: 2079825 - RNA, 23 nt, Human
uugaaguuuuggcaauugacuau

SEQ ID NO: 2079826 - RNA, 21 nt, Human
ccucccuuggggccuaugcag

SEQ ID NO: 2079827 - RNA, 15 nt, Human
cagccagcacagccu

SEQ ID NO: 2079828 - RNA, 17 nt, Human
ccugagcuugcagagau

SEQ ID NO: 2079829 - RNA, 22 nt, Human
ccagcuggccuugugaggagcu

SEQ ID NO: 2079830 - RNA, 19 nt, Human
ucuuaucuuccuauaauuu

SEQ ID NO: 2079831 - RNA, 15 nt, Human
cugaaagaggaauga

SEQ ID NO: 2079832 - RNA, 22 nt, Human
ccucccuuggggccuaugcaga

SEQ ID NO: 2079833 - RNA, 21 nt, Human
ccugaucaccugcccugcuga

SEQ ID NO: 2079834 - RNA, 14 nt, Human
aucuauguagaaua

SEQ ID NO: 2079835 - RNA, 22 nt, Human
acggcuggagcugccucucuca

SEQ ID NO: 2079836 - RNA, 22 nt, Human
uuuauaagaaauaggaaauauu

SEQ ID NO: 2079837 - RNA, 12 nt, Human
cagaacagugau

SEQ ID NO: 2079838 - RNA, 18 nt, Human
ugaaaaaguucugcagau

SEQ ID NO: 2079839 - RNA, 14 nt, Human
cccugccucaagcu

SEQ ID NO: 2079840 - RNA, 12 nt, Human
cauuauauuuau

SEQ ID NO: 2079841 - RNA, 22 nt, Human
caguauggcagcuuuccucaaa

SEQ ID NO: 2079842 - RNA, 12 nt, Human
ucuuucaugaag

SEQ ID NO: 2079843 - RNA, 18 nt, Human
accaagcugguggcucug

SEQ ID NO: 2079844 - RNA, 21 nt, Human
aauuccugacugcuaguuuau

SEQ ID NO: 2079845 - RNA, 19 nt, Human
agagccggagccuccagcu

SEQ ID NO: 2079846 - RNA, 22 nt, Human
uaauaucuuaucuuccuauaau

SEQ ID NO: 2079847 - RNA, 20 nt, Human
cccggccgcgcugcgcgccg

SEQ ID NO: 2079848 - RNA, 16 nt, Human
auccuccaugaauauc

SEQ ID NO: 2079849 - RNA, 20 nt, Human
ccagcuggccgggagccuga

SEQ ID NO: 2079850 - RNA, 21 nt, Human
cuggguuuuggggggacgcua

SEQ ID NO: 2079851 - RNA, 23 nt, Human
cuggggcuuuaacuccugcuaga

SEQ ID NO: 2079852 - RNA, 12 nt, Human
uuuuuuuuaaaa

SEQ ID NO: 2079853 - RNA, 12 nt, Human
cuaagaagugaa

SEQ ID NO: 2079854 - RNA, 16 nt, Human
uuugcuguuauuuuau

SEQ ID NO: 2079855 - RNA, 15 nt, Human
guuauaaaaauauau

SEQ ID NO: 2079856 - RNA, 17 nt, Human
agagacagaaagcagaa

SEQ ID NO: 2079857 - RNA, 24 nt, Human
aucugguccuaagucccugcugcc

SEQ ID NO: 2079858 - RNA, 19 nt, Human
gagacauugaggcaggcac

SEQ ID NO: 2079859 - RNA, 17 nt, Human
gccggagccuccagcug

SEQ ID NO: 2079860 - RNA, 12 nt, Human
cuucaacucccu

SEQ ID NO: 2079861 - RNA, 19 nt, Human
cagcacgggggccaaggau

SEQ ID NO: 2079862 - RNA, 22 nt, Human
cccccugcaaagcccagcuuga

SEQ ID NO: 2079863 - RNA, 21 nt, Human
cuccagcuggccgggagccug

SEQ ID NO: 2079864 - RNA, 22 nt, Human
cgcccacuuccucccggccgcg

SEQ ID NO: 2079865 - RNA, 15 nt, Human
auaauuuugugaagc

SEQ ID NO: 2079866 - RNA, 13 nt, Human
ugccagcuggccu

SEQ ID NO: 2079867 - RNA, 20 nt, Human
uacaucccuuaccugggaaa

SEQ ID NO: 2079868 - RNA, 21 nt, Human
uguaaaauggugugaccacug

SEQ ID NO: 2079869 - RNA, 21 nt, Human
cuggaaacacauguuccccuu

SEQ ID NO: 2079870 - RNA, 18 nt, Human
aucuacacuccagugaga

SEQ ID NO: 2079871 - RNA, 14 nt, Human
cguguccccuaucc

SEQ ID NO: 2079872 - RNA, 20 nt, Human
agccgguccuugcugcaccu

SEQ ID NO: 2079873 - RNA, 17 nt, Human
cacaccaaccuucugag

SEQ ID NO: 2079874 - RNA, 12 nt, Human
uaagaaggcacc

SEQ ID NO: 2079875 - RNA, 18 nt, Human
auuuaggccaugggacag

SEQ ID NO: 2079876 - RNA, 19 nt, Human
gagccucagucucccuccc

SEQ ID NO: 2079877 - RNA, 13 nt, Human
ggaaguagaggag

SEQ ID NO: 2079878 - RNA, 16 nt, Human
cacgugugggcaaugu

SEQ ID NO: 2079879 - RNA, 15 nt, Human
ucagucucccucccu

SEQ ID NO: 2079880 - RNA, 18 nt, Human
ccgcuacuuccagggcua

SEQ ID NO: 2079881 - RNA, 21 nt, Human
gccugagaccaaggcccccgg

SEQ ID NO: 2079882 - RNA, 22 nt, Human
gaauuucuucaacucccugccc

SEQ ID NO: 2079883 - RNA, 23 nt, Human
uuguaaagguccuggcaaagaug

SEQ ID NO: 2079884 - RNA, 12 nt, Human
cagauuuuccug

SEQ ID NO: 2079885 - RNA, 21 nt, Human
aauauauuuccuuauucagaa

SEQ ID NO: 2079886 - RNA, 19 nt, Human
ugagucccaggcugagccu

SEQ ID NO: 2079887 - RNA, 21 nt, Human
aagacucgggauuaguacaca

SEQ ID NO: 2079888 - RNA, 12 nt, Human
agggauggggcu

SEQ ID NO: 2079889 - RNA, 22 nt, Human
cuccagccugagcgacagugag

SEQ ID NO: 2079890 - RNA, 14 nt, Human
ugcucauggaauug

SEQ ID NO: 2079891 - RNA, 15 nt, Human
ugcuugucccugugg

SEQ ID NO: 2079892 - RNA, 13 nt, Human
aucucaauauuuc

SEQ ID NO: 2079893 - RNA, 18 nt, Human
ugugaccacugcagaaga

SEQ ID NO: 2079894 - RNA, 15 nt, Human
ugagcgcccacuaga

SEQ ID NO: 2079895 - RNA, 14 nt, Human
guugaauuuuacau

SEQ ID NO: 2079896 - RNA, 20 nt, Human
uggggcuuuaacuccugcua

SEQ ID NO: 2079897 - RNA, 15 nt, Human
cuuccucccggccgc

SEQ ID NO: 2079898 - RNA, 17 nt, Human
aaacauccuacaagaca

SEQ ID NO: 2079899 - RNA, 16 nt, Human
gucucucacuuguuuu

SEQ ID NO: 2079900 - RNA, 19 nt, Human
uguucaugcccauaccccu

SEQ ID NO: 2079901 - RNA, 22 nt, Human
aggauggcuaguaucaaaagaa

SEQ ID NO: 2079902 - RNA, 18 nt, Human
ccugcucgcccacuuccu

SEQ ID NO: 2079903 - RNA, 19 nt, Human
gcagggugaacugcagcga

SEQ ID NO: 2079904 - RNA, 12 nt, Human
agcuuggaaugu

SEQ ID NO: 2079905 - RNA, 17 nt, Human
cuacacuccagugagac

SEQ ID NO: 2079906 - RNA, 18 nt, Human
cccaggcugagccucagu

SEQ ID NO: 2079907 - RNA, 13 nt, Human
ccagcccuccuua

SEQ ID NO: 2079908 - RNA, 18 nt, Human
uuauuauagucacuaguu

SEQ ID NO: 2079909 - RNA, 22 nt, Human
uggcgcuggcugcgcucggccu

SEQ ID NO: 2079910 - RNA, 16 nt, Human
ggaugccccguccccc

SEQ ID NO: 2079911 - RNA, 17 nt, Human
ccaaaaaucucaauauu

SEQ ID NO: 2079912 - RNA, 18 nt, Human
aaauauuuauuuuaauaa

SEQ ID NO: 2079913 - RNA, 22 nt, Human
acauuggaaacaagucagucau

SEQ ID NO: 2079914 - RNA, 20 nt, Human
cucccugccccccagcccuc

SEQ ID NO: 2079915 - RNA, 23 nt, Human
cuugauaaauggcuuccuggcaa

SEQ ID NO: 2079916 - RNA, 17 nt, Human
gggagcgagccccaggc

SEQ ID NO: 2079917 - RNA, 15 nt, Human
ggaaauauuuuaaug

SEQ ID NO: 2079918 - RNA, 17 nt, Human
caaggcccccgggccga

SEQ ID NO: 2079919 - RNA, 12 nt, Human
acacuuaaaaau

SEQ ID NO: 2079920 - RNA, 21 nt, Human
accaacacccugagguugugu

SEQ ID NO: 2079921 - RNA, 17 nt, Human
uuucccuccuuggagac

SEQ ID NO: 2079922 - RNA, 21 nt, Human
gcccugcugagucccaggcug

SEQ ID NO: 2079923 - RNA, 18 nt, Human
uaguaucaaaagaaagaa

SEQ ID NO: 2079924 - RNA, 23 nt, Human
aaccugccagcuggccuugugag

SEQ ID NO: 2079925 - RNA, 19 nt, Human
aaaguucuagugaccgaga

SEQ ID NO: 2079926 - RNA, 18 nt, Human
uagaauauauuuccuuau

SEQ ID NO: 2079927 - RNA, 21 nt, Human
gccuuuucccaacuccagaaa

SEQ ID NO: 2079928 - RNA, 16 nt, Human
uggcgcuggcugcgcu

SEQ ID NO: 2079929 - RNA, 15 nt, Human
acaugugcuggccac

SEQ ID NO: 2079930 - RNA, 19 nt, Human
cagauccccaagccuggca

SEQ ID NO: 2079931 - RNA, 15 nt, Human
ugcaauuccacuuau

SEQ ID NO: 2079932 - RNA, 15 nt, Human
ccagauccuggaaau

SEQ ID NO: 2079933 - RNA, 19 nt, Human
uggaaguaaauguuguuuu

SEQ ID NO: 2079934 - RNA, 15 nt, Human
gaucuggcucuggac

SEQ ID NO: 2079935 - RNA, 18 nt, Human
caaugccccugaauuuaa

SEQ ID NO: 2079936 - RNA, 11 nt, Human
ugcagugagcc

SEQ ID NO: 2079937 - RNA, 14 nt, Human
uauauauauauuuu

SEQ ID NO: 2079938 - RNA, 20 nt, Human
acagcccuucuuuccacaga

SEQ ID NO: 2079939 - RNA, 21 nt, Human
uugaagcacagugaucaaguu

SEQ ID NO: 2079940 - RNA, 20 nt, Human
acuauagugugagccaggaa

SEQ ID NO: 2079941 - RNA, 14 nt, Human
aaugauuaugaauu

SEQ ID NO: 2079942 - RNA, 18 nt, Human
ccugucacgugugggcaa

SEQ ID NO: 2079943 - RNA, 19 nt, Human
uucacauuggaaacaaguc

SEQ ID NO: 2079944 - RNA, 19 nt, Human
cuuggggccuaugcagagg

SEQ ID NO: 2079945 - RNA, 18 nt, Human
uuuuaaaaaagaaacauu

SEQ ID NO: 2079946 - RNA, 16 nt, Human
accuguucgcgcgccu

SEQ ID NO: 2079947 - RNA, 19 nt, Human
auuuucaugcuguucauga

SEQ ID NO: 2079948 - RNA, 14 nt, Human
gauaugugaacagu

SEQ ID NO: 2079949 - RNA, 16 nt, Human
accuccuaagaaggca

SEQ ID NO: 2079950 - RNA, 20 nt, Human
agagccggagccuccagcug

SEQ ID NO: 2079951 - RNA, 21 nt, Human
auauuuuuuuuuuuaaaaaaa

SEQ ID NO: 2079952 - RNA, 21 nt, Human
ccccugcaaagcccagcuuga

SEQ ID NO: 2079953 - RNA, 20 nt, Human
gggaggcagagguugcagug

SEQ ID NO: 2079954 - RNA, 22 nt, Human
gcuugcagagaugaggccgcca

SEQ ID NO: 2079955 - RNA, 16 nt, Human
agucucuaucauuaaa

SEQ ID NO: 2079956 - RNA, 16 nt, Human
guuucacaccuuaucu

SEQ ID NO: 2079957 - RNA, 11 nt, Human
ucaccugcccu

SEQ ID NO: 2079958 - RNA, 23 nt, Human
ggccuccauccugaggcuccacu

SEQ ID NO: 2079959 - RNA, 22 nt, Human
gaauaaccaacacccugagguu

SEQ ID NO: 2079960 - RNA, 16 nt, Human
ucagcagagaaguuuu

SEQ ID NO: 2079961 - RNA, 17 nt, Human
auggcuaguaucaaaag

SEQ ID NO: 2079962 - RNA, 21 nt, Human
uguccucaugagggcuggaug

SEQ ID NO: 2079963 - RNA, 15 nt, Human
ucaaaggacaccauu

SEQ ID NO: 2079964 - RNA, 20 nt, Human
uuucuuccuggauuccucac

SEQ ID NO: 2079965 - RNA, 19 nt, Human
cuuccuaauuccacagcug

SEQ ID NO: 2079966 - RNA, 16 nt, Human
ucuuggucucaguguc

SEQ ID NO: 2079967 - RNA, 16 nt, Human
ggcuaauaucuuaucu

SEQ ID NO: 2079968 - RNA, 20 nt, Human
uaucuccgucaacucauauu

SEQ ID NO: 2079969 - RNA, 18 nt, Human
ccugaggugagcaucauc

SEQ ID NO: 2079970 - RNA, 17 nt, Human
aaaguacaagagcuuaa

SEQ ID NO: 2079971 - RNA, 18 nt, Human
ggccacaucugagccccg

SEQ ID NO: 2079972 - RNA, 21 nt, Human
gcacuguggguagacacacau

SEQ ID NO: 2079973 - RNA, 18 nt, Human
uauaggauguggggaagu

SEQ ID NO: 2079974 - RNA, 18 nt, Human
ugaagaagcuagaaaaca

SEQ ID NO: 2079975 - RNA, 19 nt, Human
aauauuauguuaaaacugg

SEQ ID NO: 2079976 - RNA, 15 nt, Human
ucaccagucccuccc

SEQ ID NO: 2079977 - RNA, 16 nt, Human
ugauacagaaaaguug

SEQ ID NO: 2079978 - RNA, 16 nt, Human
auaucaguuauuuuua

SEQ ID NO: 2079979 - RNA, 21 nt, Human
cuuucaugaaggggcggcggc

SEQ ID NO: 2079980 - RNA, 13 nt, Human
uagcuuuuuucuc

SEQ ID NO: 2079981 - RNA, 15 nt, Human
gucucuugaggcaca

SEQ ID NO: 2079982 - RNA, 23 nt, Human
uagauguauagguugaugguggu

SEQ ID NO: 2079983 - RNA, 21 nt, Human
gcuacaggccccaucuggucc

SEQ ID NO: 2079984 - RNA, 19 nt, Human
aagcauuccaacuaucuca

SEQ ID NO: 2079985 - RNA, 18 nt, Human
acacuguuaucuucacuu

SEQ ID NO: 2079986 - RNA, 22 nt, Human
ucauucccguugaacgucacau

SEQ ID NO: 2079987 - RNA, 20 nt, Human
gacaggcacuaucuggguuu

SEQ ID NO: 2079988 - RNA, 18 nt, Human
ugccuaauuuguuuuccc

SEQ ID NO: 2079989 - RNA, 21 nt, Human
gaagugaaaaucuacacucca

SEQ ID NO: 2079990 - RNA, 17 nt, Human
aaagcagggacuugaac

SEQ ID NO: 2079991 - RNA, 18 nt, Human
gaaguaaauguuguuuua

SEQ ID NO: 2079992 - RNA, 22 nt, Human
cucuggccuucggccuccaucc

SEQ ID NO: 2079993 - RNA, 18 nt, Human
cuaauaucuuaucuuccu

SEQ ID NO: 2079994 - RNA, 20 nt, Human
caggcugagccucagucucc

SEQ ID NO: 2079995 - RNA, 16 nt, Human
aaugaaagcagggacu

SEQ ID NO: 2079996 - RNA, 23 nt, Human
cagcaccuccuaagaaggcaccu

SEQ ID NO: 2079997 - RNA, 17 nt, Human
uccauccugaggcucca

SEQ ID NO: 2079998 - RNA, 18 nt, Human
aacaaugcuguauuuuaa

SEQ ID NO: 2079999 - RNA, 17 nt, Human
cccccugcaaagcccag

SEQ ID NO: 2080000 - RNA, 20 nt, Human
ucuucagcagagaaguuuuc

SEQ ID NO: 2080001 - RNA, 22 nt, Human
auggaaauguuuacagaucccc

SEQ ID NO: 2080002 - RNA, 21 nt, Human
acuauuauauuuccaagaaau

SEQ ID NO: 2080003 - RNA, 15 nt, Human
gcaagcucuaucacc

SEQ ID NO: 2080004 - RNA, 20 nt, Human
aaaaaccugagccccaaaag

SEQ ID NO: 2080005 - RNA, 15 nt, Human
uuaguuuuuaaagua

SEQ ID NO: 2080006 - RNA, 23 nt, Human
gccugaguguugccuaauuuguu

SEQ ID NO: 2080007 - RNA, 21 nt, Human
ucuggguugaagggcaguguu

SEQ ID NO: 2080008 - RNA, 20 nt, Human
ccuccugccuaagugcagcc

SEQ ID NO: 2080009 - RNA, 23 nt, Human
agcuggaaacacauguuccccuu

SEQ ID NO: 2080010 - RNA, 15 nt, Human
auuugguaaggggaa

SEQ ID NO: 2080011 - RNA, 21 nt, Human
cugguagcuaaauauauauuu

SEQ ID NO: 2080012 - RNA, 22 nt, Human
guguccccuauccuacuucccc

SEQ ID NO: 2080013 - RNA, 14 nt, Human
ccucugcagcuucc

SEQ ID NO: 2080014 - RNA, 16 nt, Human
cggagccuccagcugc

SEQ ID NO: 2080015 - RNA, 15 nt, Human
cugcacuccagccug

SEQ ID NO: 2080016 - RNA, 17 nt, Human
aaccucuaaauucuuuc

SEQ ID NO: 2080017 - RNA, 16 nt, Human
aaaaugugauauguac

SEQ ID NO: 2080018 - RNA, 16 nt, Human
uugccauaauuacuau

SEQ ID NO: 2080019 - RNA, 17 nt, Human
caaacauauauaacaau

SEQ ID NO: 2080020 - RNA, 13 nt, Human
caagaaggaaaga

SEQ ID NO: 2080021 - RNA, 22 nt, Human
cccaggcggguccgggucgcag

SEQ ID NO: 2080022 - RNA, 23 nt, Human
ugucacgugugggcaauguuccc

SEQ ID NO: 2080023 - RNA, 17 nt, Human
caagacccaaaaggcag

SEQ ID NO: 2080024 - RNA, 19 nt, Human
auucuuuacccccugggag

SEQ ID NO: 2080025 - RNA, 20 nt, Human
ccauuguggucacaggaagu

SEQ ID NO: 2080026 - RNA, 16 nt, Human
ugacuuaaugccacua

SEQ ID NO: 2080027 - RNA, 18 nt, Human
cuuccucugagccuuggg

SEQ ID NO: 2080028 - RNA, 19 nt, Human
augaauuacauuuguauaa

SEQ ID NO: 2080029 - RNA, 15 nt, Human
ccaugugcagccacc

SEQ ID NO: 2080030 - RNA, 21 nt, Human
ggcaccgcuguacgcgagcgc

SEQ ID NO: 2080031 - RNA, 20 nt, Human
gcggggcggggagcgagccc

SEQ ID NO: 2080032 - RNA, 12 nt, Human
auuuaucauuua

SEQ ID NO: 2080033 - RNA, 10 nt, Human
acuuccuccc

SEQ ID NO: 2080034 - RNA, 21 nt, Human
cuaccaaaaaucucaauauuu

SEQ ID NO: 2080035 - RNA, 17 nt, Human
uccacaacacacagauu

SEQ ID NO: 2080036 - RNA, 16 nt, Human
ccccuucccacacugu

SEQ ID NO: 2080037 - RNA, 21 nt, Human
caauuuuguuauguauauuuu

SEQ ID NO: 2080038 - RNA, 14 nt, Human
caucaucuucuggg

SEQ ID NO: 2080039 - RNA, 13 nt, Human
auccuagucucua

SEQ ID NO: 2080040 - RNA, 18 nt, Human
auguuaaaacugggacag

SEQ ID NO: 2080041 - RNA, 20 nt, Human
caaacauccuacaagacaca

SEQ ID NO: 2080042 - RNA, 17 nt, Human
aggguguguaaguagau

SEQ ID NO: 2080043 - RNA, 18 nt, Human
auccuucagccugaaaga

SEQ ID NO: 2080044 - RNA, 23 nt, Human
aucuuccuauaauuuuagacauu

SEQ ID NO: 2080045 - RNA, 21 nt, Human
agagccggagccuccagcugc

SEQ ID NO: 2080046 - RNA, 10 nt, Human
aaacacaugu

SEQ ID NO: 2080047 - RNA, 17 nt, Human
gugggauacuauuuaau

SEQ ID NO: 2080048 - RNA, 14 nt, Human
gcgcccucuggcug

SEQ ID NO: 2080049 - RNA, 18 nt, Human
ugaggcaggcacugccaa

SEQ ID NO: 2080050 - RNA, 15 nt, Human
uguuaaaugauuuca

SEQ ID NO: 2080051 - RNA, 15 nt, Human
aauauauuuccuuau

SEQ ID NO: 2080052 - RNA, 17 nt, Human
gcaccugugccgucccc

SEQ ID NO: 2080053 - RNA, 14 nt, Human
ccggagccuccagc

SEQ ID NO: 2080054 - RNA, 20 nt, Human
cugcacacagcacgggggcc

SEQ ID NO: 2080055 - RNA, 23 nt, Human
cccagcccuccuuaucaaaggac

SEQ ID NO: 2080056 - RNA, 16 nt, Human
cuggaugcucucguug

SEQ ID NO: 2080057 - RNA, 22 nt, Human
gaugcaguucugaagaagaugg

SEQ ID NO: 2080058 - RNA, 14 nt, Human
cucccggccgcgcu

SEQ ID NO: 2080059 - RNA, 19 nt, Human
uauauuuccaagaaauauu

SEQ ID NO: 2080060 - RNA, 13 nt, Human
cuaugaaauauua

SEQ ID NO: 2080061 - RNA, 16 nt, Human
ccaccugcugagcccc

SEQ ID NO: 2080062 - RNA, 16 nt, Human
cccccagcccuccuua

SEQ ID NO: 2080063 - RNA, 18 nt, Human
cugagucccaggcugagc

SEQ ID NO: 2080064 - RNA, 21 nt, Human
uggggcuuuaacuccugcuag

SEQ ID NO: 2080065 - RNA, 19 nt, Human
uuucaugcuguucaugaaa

SEQ ID NO: 2080066 - RNA, 14 nt, Human
aacucauauuuuca

SEQ ID NO: 2080067 - RNA, 18 nt, Human
agccgggaaagaagagcc

SEQ ID NO: 2080068 - RNA, 22 nt, Human
agaauuugauaugugaacaguu

SEQ ID NO: 2080069 - RNA, 14 nt, Human
cuuguacucugaaa

SEQ ID NO: 2080070 - RNA, 19 nt, Human
cugccaaaacaucaaccug

SEQ ID NO: 2080071 - RNA, 16 nt, Human
agccuacuaaaugcuc

SEQ ID NO: 2080072 - RNA, 20 nt, Human
auaagccagacaucaacaga

SEQ ID NO: 2080073 - RNA, 11 nt, Human
uuuuuuuaaaa

SEQ ID NO: 2080074 - RNA, 13 nt, Human
cuucuuucaugaa

SEQ ID NO: 2080075 - RNA, 22 nt, Human
cuuccccucugcagcuuccagg

SEQ ID NO: 2080076 - RNA, 21 nt, Human
aggaagaucccuuuguccaca

SEQ ID NO: 2080077 - RNA, 17 nt, Human
guuuuaggaauacauaa

SEQ ID NO: 2080078 - RNA, 14 nt, Human
agcuggaaacacau

SEQ ID NO: 2080079 - RNA, 19 nt, Human
cgcccacuagacccacugg

SEQ ID NO: 2080080 - RNA, 16 nt, Human
uagaauauauuuccuu

SEQ ID NO: 2080081 - RNA, 13 nt, Human
aucuggcucugga

SEQ ID NO: 2080082 - RNA, 19 nt, Human
aagguccuggcaaagauga

SEQ ID NO: 2080083 - RNA, 20 nt, Human
aaucuuucacaggggacagg

SEQ ID NO: 2080084 - RNA, 12 nt, Human
uucucuaggaaa

SEQ ID NO: 2080085 - RNA, 15 nt, Human
aauugacccacaaga

SEQ ID NO: 2080086 - RNA, 16 nt, Human
uauccuacuuccccuu

SEQ ID NO: 2080087 - RNA, 19 nt, Human
ggacucaccucccccaucu

SEQ ID NO: 2080088 - RNA, 23 nt, Human
aucgcagacacaugugcuggcca

SEQ ID NO: 2080089 - RNA, 12 nt, Human
uuaauaaaccau

SEQ ID NO: 2080090 - RNA, 23 nt, Human
gggaaagaagagccggagccucc

SEQ ID NO: 2080091 - RNA, 16 nt, Human
ccacaagaacccccuu

SEQ ID NO: 2080092 - RNA, 22 nt, Human
ucugcuggagacauugaggcag

SEQ ID NO: 2080093 - RNA, 19 nt, Human
uaguuuaugauuccaccua

SEQ ID NO: 2080094 - RNA, 16 nt, Human
ugcaaauugucacagg

SEQ ID NO: 2080095 - RNA, 20 nt, Human
aguuuuuuuuuaaaaaagaa

SEQ ID NO: 2080096 - RNA, 16 nt, Human
aggacugaauuaugaa

SEQ ID NO: 2080097 - RNA, 21 nt, Human
agcccuuccccucugcagcuu

SEQ ID NO: 2080098 - RNA, 16 nt, Human
agacauugaggcaggc

SEQ ID NO: 2080099 - RNA, 20 nt, Human
uaagugaaauaagccagaca

SEQ ID NO: 2080100 - RNA, 19 nt, Human
cuggggcuuuaacuccugc

SEQ ID NO: 2080101 - RNA, 23 nt, Human
aaauuuacagagacagaaagcag

SEQ ID NO: 2080102 - RNA, 18 nt, Human
acugccuucucaacucca

SEQ ID NO: 2080103 - RNA, 22 nt, Human
aucaccaaggcugauuaaacca

SEQ ID NO: 2080104 - RNA, 18 nt, Human
uuuucucuccucucccca

SEQ ID NO: 2080105 - RNA, 17 nt, Human
caggaaucacuggcugu

SEQ ID NO: 2080106 - RNA, 13 nt, Human
ugggcauucaaau

SEQ ID NO: 2080107 - RNA, 14 nt, Human
acuuuuauaagaaa

SEQ ID NO: 2080108 - RNA, 22 nt, Human
gcacagccucuuagaugcaguu

SEQ ID NO: 2080109 - RNA, 18 nt, Human
agcuuugugcagauucuu

SEQ ID NO: 2080110 - RNA, 15 nt, Human
cugacucuuaagaag

SEQ ID NO: 2080111 - RNA, 21 nt, Human
ugccagcuggccuugugagga

SEQ ID NO: 2080112 - RNA, 13 nt, Human
cuucucaacucca

SEQ ID NO: 2080113 - RNA, 16 nt, Human
ugcucgcccacuuccu

SEQ ID NO: 2080114 - RNA, 23 nt, Human
aaguauccuucagccugaaagag

SEQ ID NO: 2080115 - RNA, 21 nt, Human
ugcccauccugccccugagcc

SEQ ID NO: 2080116 - RNA, 16 nt, Human
uuagauagaugaagaa

SEQ ID NO: 2080117 - RNA, 14 nt, Human
agugucuugaauug

SEQ ID NO: 2080118 - RNA, 20 nt, Human
uaauaucuuaucuuccuaua

SEQ ID NO: 2080119 - RNA, 24 nt, Human
gucgcaggaccaucccggccggcg

SEQ ID NO: 2080120 - RNA, 19 nt, Human
gcccacuuccucccggccg

SEQ ID NO: 2080121 - RNA, 11 nt, Human
ugugugcagca

SEQ ID NO: 2080122 - RNA, 14 nt, Human
uugccaugugcuag

SEQ ID NO: 2080123 - RNA, 15 nt, Human
cuaucuuugagcgcc

SEQ ID NO: 2080124 - RNA, 19 nt, Human
cuaguaucaaaagaaagaa

SEQ ID NO: 2080125 - RNA, 17 nt, Human
agaugggagaaucacuu

SEQ ID NO: 2080126 - RNA, 12 nt, Human
uugggcaggcag

SEQ ID NO: 2080127 - RNA, 16 nt, Human
guccauugggcaggca

SEQ ID NO: 2080128 - RNA, 15 nt, Human
cgcgcuccgcgcagc

SEQ ID NO: 2080129 - RNA, 21 nt, Human
aaugugacuuaaugccacuaa

SEQ ID NO: 2080130 - RNA, 15 nt, Human
acaucaacagauaaa

SEQ ID NO: 2080131 - RNA, 19 nt, Human
auuuacagagacagaaagc

SEQ ID NO: 2080132 - RNA, 18 nt, Human
cuggguuaggccuugccu

SEQ ID NO: 2080133 - RNA, 16 nt, Human
ugcacaucaaaauaug

SEQ ID NO: 2080134 - RNA, 14 nt, Human
ccgcuuaagcuuuc

SEQ ID NO: 2080135 - RNA, 12 nt, Human
cuuccucugagc

SEQ ID NO: 2080136 - RNA, 22 nt, Human
ucuggguuccuuccucugagcc

SEQ ID NO: 2080137 - RNA, 18 nt, Human
accauuuuugaaaccaaa

SEQ ID NO: 2080138 - RNA, 22 nt, Human
agaaugagagacacacugaaga

SEQ ID NO: 2080139 - RNA, 19 nt, Human
auuuccuuauucagaauuu

SEQ ID NO: 2080140 - RNA, 17 nt, Human
cucacaggagcaucucc

SEQ ID NO: 2080141 - RNA, 13 nt, Human
agcuaaauauaua

SEQ ID NO: 2080142 - RNA, 19 nt, Human
ugaucaguaugaaaauguc

SEQ ID NO: 2080143 - RNA, 20 nt, Human
uaucauuuaguuauaaaaau

SEQ ID NO: 2080144 - RNA, 23 nt, Human
acugcuaguuuauauagaaaugu

SEQ ID NO: 2080145 - RNA, 16 nt, Human
agagguccacaacaca

SEQ ID NO: 2080146 - RNA, 21 nt, Human
gcagcauuguuggcuguuccu

SEQ ID NO: 2080147 - RNA, 16 nt, Human
uuccuuacucuugauu

SEQ ID NO: 2080148 - RNA, 21 nt, Human
aguuagcuuucuuccuggauu

SEQ ID NO: 2080149 - RNA, 20 nt, Human
agcucaggcuggcaccgcug

SEQ ID NO: 2080150 - RNA, 20 nt, Human
caaacugccaucauuuacuu

SEQ ID NO: 2080151 - RNA, 16 nt, Human
ugagaugcuagaacuc

SEQ ID NO: 2080152 - RNA, 17 nt, Human
ugcacaucaaaauaugc

SEQ ID NO: 2080153 - RNA, 19 nt, Human
uagugagcagucaggaaag

SEQ ID NO: 2080154 - RNA, 23 nt, Human
ucuaccaaaaaucucaauauuuc

SEQ ID NO: 2080155 - RNA, 14 nt, Human
agucugacuguuuc

SEQ ID NO: 2080156 - RNA, 17 nt, Human
cugugcggccuggucua

SEQ ID NO: 2080157 - RNA, 19 nt, Human
uguaaagguccuggcaaag

SEQ ID NO: 2080158 - RNA, 13 nt, Human
auaacuggaaacu

SEQ ID NO: 2080159 - RNA, 14 nt, Human
aagcucuaucacca

SEQ ID NO: 2080160 - RNA, 22 nt, Human
uugacccacaagaaaugaaagc

SEQ ID NO: 2080161 - RNA, 20 nt, Human
ucucguugacccucacagga

SEQ ID NO: 2080162 - RNA, 22 nt, Human
gcugguggcgcuggcugcgcuc

SEQ ID NO: 2080163 - RNA, 19 nt, Human
uggugagugccuguaauca

SEQ ID NO: 2080164 - RNA, 14 nt, Human
cauggccacaucug

SEQ ID NO: 2080165 - RNA, 15 nt, Human
gaauuuaaauagcuu

SEQ ID NO: 2080166 - RNA, 16 nt, Human
agaguuccuucugcuc

SEQ ID NO: 2080167 - RNA, 14 nt, Human
cgagcgcgcgcgcc

SEQ ID NO: 2080168 - RNA, 17 nt, Human
guagaaugggggcagca

SEQ ID NO: 2080169 - RNA, 15 nt, Human
gccucagucucccuc

SEQ ID NO: 2080170 - RNA, 22 nt, Human
gcuaauuagcauggccacaucu

SEQ ID NO: 2080171 - RNA, 14 nt, Human
ccaugaccaacauc

SEQ ID NO: 2080172 - RNA, 15 nt, Human
ucauaagaauucugu

SEQ ID NO: 2080173 - RNA, 22 nt, Human
uguugcccacagcuguaugauu

SEQ ID NO: 2080174 - RNA, 21 nt, Human
ugagcucagcccuggugggca

SEQ ID NO: 2080175 - RNA, 19 nt, Human
auacuaauuauacccccug

SEQ ID NO: 2080176 - RNA, 20 nt, Human
cggagccuccagcugccccg

SEQ ID NO: 2080177 - RNA, 13 nt, Human
cugaauuuaaaua

SEQ ID NO: 2080178 - RNA, 18 nt, Human
gagccucagucucccucc

SEQ ID NO: 2080179 - RNA, 12 nt, Human
aaggaugccccg

SEQ ID NO: 2080180 - RNA, 12 nt, Human
gaaucuuguaaa

SEQ ID NO: 2080181 - RNA, 22 nt, Human
gacacaugugcuggccaccugc

SEQ ID NO: 2080182 - RNA, 14 nt, Human
cugagucccaggcu

SEQ ID NO: 2080183 - RNA, 13 nt, Human
gcuacgcgcgcuc

SEQ ID NO: 2080184 - RNA, 23 nt, Human
auguuaaaacugggacaggggag

SEQ ID NO: 2080185 - RNA, 13 nt, Human
uuccucugagccu

SEQ ID NO: 2080186 - RNA, 20 nt, Human
uggauuuaauguggaaauga

SEQ ID NO: 2080187 - RNA, 14 nt, Human
cuggagcucugccc

SEQ ID NO: 2080188 - RNA, 17 nt, Human
guugcugggggggauug

SEQ ID NO: 2080189 - RNA, 22 nt, Human
gcggguccgggucgcaggacca

SEQ ID NO: 2080190 - RNA, 14 nt, Human
gcgcgcuccgcgca

SEQ ID NO: 2080191 - RNA, 17 nt, Human
aauguuguuuuaggaau

SEQ ID NO: 2080192 - RNA, 23 nt, Human
ggccugcucgcccacuuccuccc

SEQ ID NO: 2080193 - RNA, 13 nt, Human
ucuaagaagugaa

SEQ ID NO: 2080194 - RNA, 17 nt, Human
gcgcgcuccgcgcagcu

SEQ ID NO: 2080195 - RNA, 21 nt, Human
acugccaaaacaucaaccugc

SEQ ID NO: 2080196 - RNA, 15 nt, Human
uccgcauccuagucu

SEQ ID NO: 2080197 - RNA, 21 nt, Human
cacuugaacccgggaggcaga

SEQ ID NO: 2080198 - RNA, 21 nt, Human
gacagucaccucauggaauug

SEQ ID NO: 2080199 - RNA, 15 nt, Human
ccaaggagccaaaca

SEQ ID NO: 2080200 - RNA, 15 nt, Human
acugaagaagcacca

SEQ ID NO: 2080201 - RNA, 22 nt, Human
cggagccuccagcugccccggg

SEQ ID NO: 2080202 - RNA, 14 nt, Human
uaaagcuuccauug

SEQ ID NO: 2080203 - RNA, 16 nt, Human
cuucaacucccugccc

SEQ ID NO: 2080204 - RNA, 21 nt, Human
auguuuacagauccccaagcc

SEQ ID NO: 2080205 - RNA, 15 nt, Human
auuuaauuauuucac

SEQ ID NO: 2080206 - RNA, 14 nt, Human
uauauuuuacauaa

SEQ ID NO: 2080207 - RNA, 18 nt, Human
cggcuggagcugccucuc

SEQ ID NO: 2080208 - RNA, 20 nt, Human
ccugccuaagugcagccccg

SEQ ID NO: 2080209 - RNA, 14 nt, Human
uauuugcuguuauu

SEQ ID NO: 2080210 - RNA, 20 nt, Human
agggcaguguucccuggggc

SEQ ID NO: 2080211 - RNA, 19 nt, Human
aauguuuacagauccccaa

SEQ ID NO: 2080212 - RNA, 20 nt, Human
cagagaaguuuucuggaggu

SEQ ID NO: 2080213 - RNA, 17 nt, Human
cugaacaggauauucuc

SEQ ID NO: 2080214 - RNA, 19 nt, Human
acaaauuuacagagacaga

SEQ ID NO: 2080215 - RNA, 19 nt, Human
uaucucauuuccaagcaag

SEQ ID NO: 2080216 - RNA, 18 nt, Human
ccggggaggggcgcucgc

SEQ ID NO: 2080217 - RNA, 23 nt, Human
caccaaggagccaaacauccuac

SEQ ID NO: 2080218 - RNA, 15 nt, Human
gaagauguagaggag

SEQ ID NO: 2080219 - RNA, 19 nt, Human
uggcaagcucuaucaccaa

SEQ ID NO: 2080220 - RNA, 15 nt, Human
uggagcuagaauuug

SEQ ID NO: 2080221 - RNA, 17 nt, Human
uccucugagccuuggga

SEQ ID NO: 2080222 - RNA, 17 nt, Human
gcucggccugcucgccc

SEQ ID NO: 2080223 - RNA, 19 nt, Human
gaccggccuuugcaccucc

SEQ ID NO: 2080224 - RNA, 14 nt, Human
ggaaucuuguaaag

SEQ ID NO: 2080225 - RNA, 17 nt, Human
uuucauaagaauucugu

SEQ ID NO: 2080226 - RNA, 18 nt, Human
auuauuucacuuuagaaa

SEQ ID NO: 2080227 - RNA, 17 nt, Human
auuagcauggccacauc

SEQ ID NO: 2080228 - RNA, 21 nt, Human
uauuguagcauccuggaauau

SEQ ID NO: 2080229 - RNA, 16 nt, Human
uguccccuauccuacu

SEQ ID NO: 2080230 - RNA, 22 nt, Human
gagucccaggcugagccucagu

SEQ ID NO: 2080231 - RNA, 18 nt, Human
gagccgguccuugcugca

SEQ ID NO: 2080232 - RNA, 14 nt, Human
ggccacaucugagc

SEQ ID NO: 2080233 - RNA, 17 nt, Human
gcccuuccccucugcag

SEQ ID NO: 2080234 - RNA, 13 nt, Human
auaauuuuagaca

SEQ ID NO: 2080235 - RNA, 17 nt, Human
gcagcaucagcaucccu

SEQ ID NO: 2080236 - RNA, 21 nt, Human
auuauauuuccaagaaauauu

SEQ ID NO: 2080237 - RNA, 19 nt, Human
aaccgaacugauguaagua

SEQ ID NO: 2080238 - RNA, 16 nt, Human
uaaacuuugauuuuau

SEQ ID NO: 2080239 - RNA, 20 nt, Human
uagucucuaucauuaaaguu

SEQ ID NO: 2080240 - RNA, 22 nt, Human
auauuuccuuauucagaauuuc

SEQ ID NO: 2080241 - RNA, 20 nt, Human
ccuaagucccugcugcccuu

SEQ ID NO: 2080242 - RNA, 15 nt, Human
uuuaguauuuuguuu

SEQ ID NO: 2080243 - RNA, 13 nt, Human
gagccggagccuc

SEQ ID NO: 2080244 - RNA, 17 nt, Human
aguaaaaggaaaugcuc

SEQ ID NO: 2080245 - RNA, 18 nt, Human
gcagugucugcuggagac

SEQ ID NO: 2080246 - RNA, 21 nt, Human
uugaggcacagaaacuccugu

SEQ ID NO: 2080247 - RNA, 22 nt, Human
uagaaauguauucuuuuaguuu

SEQ ID NO: 2080248 - RNA, 23 nt, Human
cgcaggaccaucccggccggcgc

SEQ ID NO: 2080249 - RNA, 10 nt, Human
auguuuucag

SEQ ID NO: 2080250 - RNA, 13 nt, Human
aaguaaaggcaaa

SEQ ID NO: 2080251 - RNA, 22 nt, Human
uacugagagugaacaaauuuac

SEQ ID NO: 2080252 - RNA, 17 nt, Human
cauuguuggcuguuccu

SEQ ID NO: 2080253 - RNA, 15 nt, Human
cacuuggucugugag

SEQ ID NO: 2080254 - RNA, 22 nt, Human
aggaugccccgucccccucugg

SEQ ID NO: 2080255 - RNA, 18 nt, Human
auagaauuaacacaugau

SEQ ID NO: 2080256 - RNA, 18 nt, Human
uauauuuuuuuuuuuaaa

SEQ ID NO: 2080257 - RNA, 13 nt, Human
cgcccucuggcug

SEQ ID NO: 2080258 - RNA, 13 nt, Human
aagugcagccccg

SEQ ID NO: 2080259 - RNA, 18 nt, Human
uaauagguuuggacaaaa

SEQ ID NO: 2080260 - RNA, 18 nt, Human
gcccuggugggcagagag

SEQ ID NO: 2080261 - RNA, 12 nt, Human
cgcgccuccgcu

SEQ ID NO: 2080262 - RNA, 12 nt, Human
ugacauuagaug

SEQ ID NO: 2080263 - RNA, 21 nt, Human
aggguuaugauuaaguaauga

SEQ ID NO: 2080264 - RNA, 15 nt, Human
agccucagucucccu

SEQ ID NO: 2080265 - RNA, 19 nt, Human
ccaaggcccccgggccgac

SEQ ID NO: 2080266 - RNA, 23 nt, Human
gcuuuggucuaucuuugagcgcc

SEQ ID NO: 2080267 - RNA, 17 nt, Human
auguuucauaagaauuc

SEQ ID NO: 2080268 - RNA, 15 nt, Human
auuuauuaaguauuu

SEQ ID NO: 2080269 - RNA, 11 nt, Human
auacugaaaua

SEQ ID NO: 2080270 - RNA, 19 nt, Human
uccuagucucuaucauuaa

SEQ ID NO: 2080271 - RNA, 23 nt, Human
cugccucucucauccacuuucca

SEQ ID NO: 2080272 - RNA, 23 nt, Human
ugaauuacauuuguauaaaauaa

SEQ ID NO: 2080273 - RNA, 20 nt, Human
uuucauaagaauucuguuga

SEQ ID NO: 2080274 - RNA, 18 nt, Human
agccggagccuccagcug

SEQ ID NO: 2080275 - RNA, 14 nt, Human
aauauuauguuaaa

SEQ ID NO: 2080276 - RNA, 22 nt, Human
gacucaccucccccaucucuuc

SEQ ID NO: 2080277 - RNA, 18 nt, Human
ugggcacaggguuuaugu

SEQ ID NO: 2080278 - RNA, 16 nt, Human
ccagggcuacgcgcgc

SEQ ID NO: 2080279 - RNA, 19 nt, Human
gacagucaccucauggaau

SEQ ID NO: 2080280 - RNA, 21 nt, Human
acagcccuucuuuccacagaa

SEQ ID NO: 2080281 - RNA, 13 nt, Human
gugagcaucaucu

SEQ ID NO: 2080282 - RNA, 13 nt, Human
cgcgcugcgcgcc

SEQ ID NO: 2080283 - RNA, 20 nt, Human
guucugcagauaaacaguag

SEQ ID NO: 2080284 - RNA, 15 nt, Human
caagcucacagaccu

SEQ ID NO: 2080285 - RNA, 17 nt, Human
augaauaucaguuauuu

SEQ ID NO: 2080286 - RNA, 20 nt, Human
accucugccucagaaaacaa

SEQ ID NO: 2080287 - RNA, 13 nt, Human
acaagaaaugaaa

SEQ ID NO: 2080288 - RNA, 18 nt, Human
gcaaagcccagcuugaaa

SEQ ID NO: 2080289 - RNA, 20 nt, Human
gccgggcgugguggugagug

SEQ ID NO: 2080290 - RNA, 21 nt, Human
cuauguucuaagaagugaaaa

SEQ ID NO: 2080291 - RNA, 12 nt, Human
caaccugccagc

SEQ ID NO: 2080292 - RNA, 15 nt, Human
uuauuuuuaaacugu

SEQ ID NO: 2080293 - RNA, 16 nt, Human
aaauauuccuuaagau

SEQ ID NO: 2080294 - RNA, 18 nt, Human
caagccucauguccacug

SEQ ID NO: 2080295 - RNA, 17 nt, Human
auuucuaaaaguuuaag

SEQ ID NO: 2080296 - RNA, 14 nt, Human
ugcagcuuccaggc

SEQ ID NO: 2080297 - RNA, 15 nt, Human
aauauauauuuuaga

SEQ ID NO: 2080298 - RNA, 17 nt, Human
agccgggaaagaagagc

SEQ ID NO: 2080299 - RNA, 19 nt, Human
gagccugaucaccugcccu

SEQ ID NO: 2080300 - RNA, 16 nt, Human
cuucggccuccauccu

SEQ ID NO: 2080301 - RNA, 14 nt, Human
acauauauaacaau

SEQ ID NO: 2080302 - RNA, 12 nt, Human
gguuuauauaag

SEQ ID NO: 2080303 - RNA, 12 nt, Human
acaagaaaugaa

SEQ ID NO: 2080304 - RNA, 18 nt, Human
acauguuacaacacggac

SEQ ID NO: 2080305 - RNA, 13 nt, Human
ccucauggaauug

SEQ ID NO: 2080306 - RNA, 22 nt, Human
cugcucaauaaaguacaagagc

SEQ ID NO: 2080307 - RNA, 18 nt, Human
acuggacucaccuccccc

SEQ ID NO: 2080308 - RNA, 13 nt, Human
uccccaaaugcuu

SEQ ID NO: 2080309 - RNA, 19 nt, Human
ccucucuuccucccuggaa

SEQ ID NO: 2080310 - RNA, 16 nt, Human
acaccaaccuucugag

SEQ ID NO: 2080311 - RNA, 12 nt, Human
uaguacacacuu

SEQ ID NO: 2080312 - RNA, 18 nt, Human
auuuuagacauucuuuau

SEQ ID NO: 2080313 - RNA, 13 nt, Human
cgagccccaggcg

SEQ ID NO: 2080314 - RNA, 14 nt, Human
agagaauuuccuua

SEQ ID NO: 2080315 - RNA, 18 nt, Human
gccggagccuccagcugc

SEQ ID NO: 2080316 - RNA, 20 nt, Human
uuugcaagccagauuuuccu

SEQ ID NO: 2080317 - RNA, 17 nt, Human
uuauaaucuuucacagg

SEQ ID NO: 2080318 - RNA, 15 nt, Human
caguuauuuuuaaac

SEQ ID NO: 2080319 - RNA, 14 nt, Human
aaauuuaucauuua

SEQ ID NO: 2080320 - RNA, 22 nt, Human
aggcuccacuuggucugugaga

SEQ ID NO: 2080321 - RNA, 14 nt, Human
gcugcccuuccccu

SEQ ID NO: 2080322 - RNA, 20 nt, Human
uguaagaaaauaucacuugu

SEQ ID NO: 2080323 - RNA, 19 nt, Human
guccauucuuccucccauu

SEQ ID NO: 2080324 - RNA, 17 nt, Human
acacuguuaucuucacu

SEQ ID NO: 2080325 - RNA, 18 nt, Human
augggggcagcaccuccu

SEQ ID NO: 2080326 - RNA, 19 nt, Human
aagcuuguauuccuuuuuc

SEQ ID NO: 2080327 - RNA, 14 nt, Human
uccacuuggucugu

SEQ ID NO: 2080328 - RNA, 15 nt, Human
cagcgaguacuuccc

SEQ ID NO: 2080329 - RNA, 16 nt, Human
cuuggagacagggccc

SEQ ID NO: 2080330 - RNA, 20 nt, Human
uggaaacacauguuccccuu

SEQ ID NO: 2080331 - RNA, 16 nt, Human
gcuccggacgcugcug

SEQ ID NO: 2080332 - RNA, 14 nt, Human
ggcaauagucaaau

SEQ ID NO: 2080333 - RNA, 16 nt, Human
acggcuggagcugccu

SEQ ID NO: 2080334 - RNA, 17 nt, Human
guuagagaauuuccuua

SEQ ID NO: 2080335 - RNA, 13 nt, Human
gagccuccagcug

SEQ ID NO: 2080336 - RNA, 17 nt, Human
agucccaggcugagccu

SEQ ID NO: 2080337 - RNA, 16 nt, Human
ggcagagagguaggga

SEQ ID NO: 2080338 - RNA, 11 nt, Human
gccuccagcug

SEQ ID NO: 2080339 - RNA, 15 nt, Human
cgcccacuuccuccc

SEQ ID NO: 2080340 - RNA, 17 nt, Human
ucaaguuauuuuuaauu

SEQ ID NO: 2080341 - RNA, 22 nt, Human
uggguuccuuccucugagccuu

SEQ ID NO: 2080342 - RNA, 15 nt, Human
uuucucugauacaga

SEQ ID NO: 2080343 - RNA, 21 nt, Human
cucaagcuaugugagcucacc

SEQ ID NO: 2080344 - RNA, 11 nt, Human
aaagauucaau

SEQ ID NO: 2080345 - RNA, 21 nt, Human
auauuuccuuauucagaauuu

SEQ ID NO: 2080346 - RNA, 17 nt, Human
uuacagagacagaaagc

SEQ ID NO: 2080347 - RNA, 17 nt, Human
ugugcauauuuuauuau

SEQ ID NO: 2080348 - RNA, 18 nt, Human
ggcuccggacgcugcugc

SEQ ID NO: 2080349 - RNA, 18 nt, Human
gccuccagcugccccggg

SEQ ID NO: 2080350 - RNA, 22 nt, Human
aaaaaaccugagccccaaaagg

SEQ ID NO: 2080351 - RNA, 17 nt, Human
aaccuucugaggagcug

SEQ ID NO: 2080352 - RNA, 14 nt, Human
ucccugcugcccuu

SEQ ID NO: 2080353 - RNA, 14 nt, Human
acccaaaaggcaga

SEQ ID NO: 2080354 - RNA, 20 nt, Human
cugcucgcccacuuccuccc

SEQ ID NO: 2080355 - RNA, 16 nt, Human
ccugagcuugcagaga

SEQ ID NO: 2080356 - RNA, 14 nt, Human
aacgucuuaaauau

SEQ ID NO: 2080357 - RNA, 18 nt, Human
uacauuuguauaaaauaa

SEQ ID NO: 2080358 - RNA, 20 nt, Human
cgcauccuagucucuaucau

SEQ ID NO: 2080359 - RNA, 23 nt, Human
cacacuguccauucuuccuccca

SEQ ID NO: 2080360 - RNA, 22 nt, Human
ucugcuaugcuauugaaguuuu

SEQ ID NO: 2080361 - RNA, 12 nt, Human
aggaaauauuuu

SEQ ID NO: 2080362 - RNA, 19 nt, Human
cccuuccccucugcagcuu

SEQ ID NO: 2080363 - RNA, 17 nt, Human
cuucugaggagcuguug

SEQ ID NO: 2080364 - RNA, 15 nt, Human
ccggagccuccagcu

SEQ ID NO: 2080365 - RNA, 20 nt, Human
ccccuauccuacuuccccuu

SEQ ID NO: 2080366 - RNA, 19 nt, Human
acuauuauauuuccaagaa

SEQ ID NO: 2080367 - RNA, 17 nt, Human
cugcacuccagccugag

SEQ ID NO: 2080368 - RNA, 21 nt, Human
gacugcuaguuuauauagaaa

SEQ ID NO: 2080369 - RNA, 15 nt, Human
cgcucggccugcucg

SEQ ID NO: 2080370 - RNA, 15 nt, Human
augggacagggagga

SEQ ID NO: 2080371 - RNA, 14 nt, Human
cuucacccugaggu

SEQ ID NO: 2080372 - RNA, 22 nt, Human
cagcccuggugggcagagaggu

SEQ ID NO: 2080373 - RNA, 20 nt, Human
aaacuuuaugcuaagugaaa

SEQ ID NO: 2080374 - RNA, 15 nt, Human
uagauaggccauggg

SEQ ID NO: 2080375 - RNA, 15 nt, Human
aaauguauucuuuua

SEQ ID NO: 2080376 - RNA, 17 nt, Human
caggagcaucuccucaa

SEQ ID NO: 2080377 - RNA, 22 nt, Human
aacugauguaaguaaacggucu

SEQ ID NO: 2080378 - RNA, 17 nt, Human
auucaaugccccugaau

SEQ ID NO: 2080379 - RNA, 23 nt, Human
auuccugacugcuaguuuauaua

SEQ ID NO: 2080380 - RNA, 13 nt, Human
agacagcucugca

SEQ ID NO: 2080381 - RNA, 13 nt, Human
auuuucaugcugu

SEQ ID NO: 2080382 - RNA, 12 nt, Human
uaguuuuuaaag

SEQ ID NO: 2080383 - RNA, 18 nt, Human
gcccacuuccucccggcc

SEQ ID NO: 2080384 - RNA, 15 nt, Human
gcagcucaggcuggc

SEQ ID NO: 2080385 - RNA, 21 nt, Human
gggagccugaucaccugcccu

SEQ ID NO: 2080386 - RNA, 15 nt, Human
gcuaauaucuuaucu

SEQ ID NO: 2080387 - RNA, 17 nt, Human
agcuaaauauauauuuu

SEQ ID NO: 2080388 - RNA, 22 nt, Human
ugaguguugccuaauuuguuuu

SEQ ID NO: 2080389 - RNA, 21 nt, Human
cagagguccacaacacacaga

SEQ ID NO: 2080390 - RNA, 16 nt, Human
auuuguauaaaauaau

SEQ ID NO: 2080391 - RNA, 13 nt, Human
ucaucccacccgc

SEQ ID NO: 2080392 - RNA, 17 nt, Human
ccucuggcuccagcugg

SEQ ID NO: 2080393 - RNA, 21 nt, Human
agaagcuagaaaacaggcaaa

SEQ ID NO: 2080394 - RNA, 14 nt, Human
cuucccacacuguc

SEQ ID NO: 2080395 - RNA, 17 nt, Human
caggcuggcgugcagca

SEQ ID NO: 2080396 - RNA, 12 nt, Human
uuauuauaguca

SEQ ID NO: 2080397 - RNA, 16 nt, Human
ccuuccccucugcagc

SEQ ID NO: 2080398 - RNA, 11 nt, Human
gcaugguuuag

SEQ ID NO: 2080399 - RNA, 12 nt, Human
uauuuuaauguu

SEQ ID NO: 2080400 - RNA, 19 nt, Human
aaaguaugugcauauuuua

SEQ ID NO: 2080401 - RNA, 21 nt, Human
gcuccgcgcagcucaggcugg

SEQ ID NO: 2080402 - RNA, 21 nt, Human
agucucccucccuuggggccu

SEQ ID NO: 2080403 - RNA, 15 nt, Human
ccugcaaagcccagc

SEQ ID NO: 2080404 - RNA, 19 nt, Human
ggagggcgcggggcgggga

SEQ ID NO: 2080405 - RNA, 19 nt, Human
aguuauuuuuaaacuguaa

SEQ ID NO: 2080406 - RNA, 17 nt, Human
uaugcuauugaaguuuu

SEQ ID NO: 2080407 - RNA, 13 nt, Human
ccuuugcaccucc

SEQ ID NO: 2080408 - RNA, 14 nt, Human
cccacacuguccau

SEQ ID NO: 2080409 - RNA, 15 nt, Human
cucccuuggggccua

SEQ ID NO: 2080410 - RNA, 22 nt, Human
caaauuuacagagacagaaagc

SEQ ID NO: 2080411 - RNA, 21 nt, Human
aagaagagccggagccuccag

SEQ ID NO: 2080412 - RNA, 21 nt, Human
ccaaggaugccccgucccccu

SEQ ID NO: 2080413 - RNA, 15 nt, Human
aagaagugaaaaucu

SEQ ID NO: 2080414 - RNA, 20 nt, Human
aaggagccaaacauccuaca

SEQ ID NO: 2080415 - RNA, 22 nt, Human
uggaagccagaucuaugccaca

SEQ ID NO: 2080416 - RNA, 16 nt, Human
gcuccaagaauuucua

SEQ ID NO: 2080417 - RNA, 18 nt, Human
gaagcaccaaucaugaau

SEQ ID NO: 2080418 - RNA, 15 nt, Human
uauuucacuuuagaa

SEQ ID NO: 2080419 - RNA, 18 nt, Human
agucuucagcagagaagu

SEQ ID NO: 2080420 - RNA, 20 nt, Human
aauaucuuuuuuuuaauaaa

SEQ ID NO: 2080421 - RNA, 15 nt, Human
gcucgcuuccgcauc

SEQ ID NO: 2080422 - RNA, 16 nt, Human
ccgcauccuagucucu

SEQ ID NO: 2080423 - RNA, 20 nt, Human
cugucacgugugggcaaugu

SEQ ID NO: 2080424 - RNA, 22 nt, Human
aaacauccuacaagacacagug

SEQ ID NO: 2080425 - RNA, 14 nt, Human
caagaaggaaagau

SEQ ID NO: 2080426 - RNA, 23 nt, Human
gaaaaaguucugcagauaaacag

SEQ ID NO: 2080427 - RNA, 22 nt, Human
uuccuagucuguuuucccuccu

SEQ ID NO: 2080428 - RNA, 18 nt, Human
uacauaaaguaugugcau

SEQ ID NO: 2080429 - RNA, 16 nt, Human
cucaauaaaguacaag

SEQ ID NO: 2080430 - RNA, 13 nt, Human
acagcccuucuuu

SEQ ID NO: 2080431 - RNA, 17 nt, Human
auaucuuaucuuccuau

SEQ ID NO: 2080432 - RNA, 20 nt, Human
ucagaaggaaagaauaacca

SEQ ID NO: 2080433 - RNA, 12 nt, Human
guccccagagcu

SEQ ID NO: 2080434 - RNA, 22 nt, Human
cggagccgggaaagaagagccg

SEQ ID NO: 2080435 - RNA, 16 nt, Human
ucagucucccucccuu

SEQ ID NO: 2080436 - RNA, 19 nt, Human
caggcagauguuccuaaua

SEQ ID NO: 2080437 - RNA, 23 nt, Human
ugauguuucauaagaauucuguu

SEQ ID NO: 2080438 - RNA, 15 nt, Human
ucuugaggcacagaa

SEQ ID NO: 2080439 - RNA, 22 nt, Human
aauugacccacaagaaaugaaa

SEQ ID NO: 2080440 - RNA, 20 nt, Human
gagccugaucaccugcccug

SEQ ID NO: 2080441 - RNA, 14 nt, Human
uuucuaugaaauau

SEQ ID NO: 2080442 - RNA, 23 nt, Human
aucucuucuggguuccuuccucu

SEQ ID NO: 2080443 - RNA, 18 nt, Human
uggcucuggacaggcacu

SEQ ID NO: 2080444 - RNA, 16 nt, Human
auuccaccuacaugag

SEQ ID NO: 2080445 - RNA, 23 nt, Human
aaugcuccuccagggagucucag

SEQ ID NO: 2080446 - RNA, 20 nt, Human
auccucgaggcccuagcauu

SEQ ID NO: 2080447 - RNA, 16 nt, Human
gacuauuauauuucca

SEQ ID NO: 2080448 - RNA, 18 nt, Human
ugagcucagcccuggugg

SEQ ID NO: 2080449 - RNA, 14 nt, Human
gcucgcccacuucc

SEQ ID NO: 2080450 - RNA, 13 nt, Human
ccugagcuugcag

SEQ ID NO: 2080451 - RNA, 14 nt, Human
ucuuuuuuuuaaua

SEQ ID NO: 2080452 - RNA, 19 nt, Human
uaaugaaguguuuagcaua

SEQ ID NO: 2080453 - RNA, 21 nt, Human
agucacuaguuguaauuuuuu

SEQ ID NO: 2080454 - RNA, 14 nt, Human
acaagagcuuaaca

SEQ ID NO: 2080455 - RNA, 19 nt, Human
gucaaucagccuaguugau

SEQ ID NO: 2080456 - RNA, 23 nt, Human
cccacuggacucaccucccccau

SEQ ID NO: 2080457 - RNA, 23 nt, Human
ucccgcuguuccucgccacgcuc

SEQ ID NO: 2080458 - RNA, 14 nt, Human
aucaccaaggcuga

SEQ ID NO: 2080459 - RNA, 19 nt, Human
accccugagcuugcagaga

SEQ ID NO: 2080460 - RNA, 16 nt, Human
aaauaguuuaugauuc

SEQ ID NO: 2080461 - RNA, 17 nt, Human
cgcucaucccacccgcc

SEQ ID NO: 2080462 - RNA, 18 nt, Human
ccgggccgacggagccgg

SEQ ID NO: 2080463 - RNA, 17 nt, Human
aggcuggcgugcagcau

SEQ ID NO: 2080464 - RNA, 15 nt, Human
aagccuggcaaggga

SEQ ID NO: 2080465 - RNA, 12 nt, Human
gggaaagaagag

SEQ ID NO: 2080466 - RNA, 17 nt, Human
cucaugagggcuggaug

SEQ ID NO: 2080467 - RNA, 20 nt, Human
ucagaauuucuaaaaguuua

SEQ ID NO: 2080468 - RNA, 20 nt, Human
gaaacauuugguaaggggaa

SEQ ID NO: 2080469 - RNA, 16 nt, Human
ucccugccccccagcc

SEQ ID NO: 2080470 - RNA, 13 nt, Human
auauauauuuuuu

SEQ ID NO: 2080471 - RNA, 17 nt, Human
cugaucaccugcccugc

SEQ ID NO: 2080472 - RNA, 21 nt, Human
cuuccaggcuggcgugcagca

SEQ ID NO: 2080473 - RNA, 13 nt, Human
cucugcagcuucc

SEQ ID NO: 2080474 - RNA, 17 nt, Human
uuagauagaugaagaag

SEQ ID NO: 2080475 - RNA, 19 nt, Human
accauuuuggcaagcucua

SEQ ID NO: 2080476 - RNA, 20 nt, Human
uagaugcaguucugaagaag

SEQ ID NO: 2080477 - RNA, 12 nt, Human
acaccuuaucua

SEQ ID NO: 2080478 - RNA, 20 nt, Human
cuacuuccccuuccuaauuc

SEQ ID NO: 2080479 - RNA, 18 nt, Human
acuuuaugcuaagugaaa

SEQ ID NO: 2080480 - RNA, 23 nt, Human
auaaaguaugugcauauuuuauu

SEQ ID NO: 2080481 - RNA, 21 nt, Human
agacaagaaggaaagauuuug

SEQ ID NO: 2080482 - RNA, 14 nt, Human
aaccagagccugag

SEQ ID NO: 2080483 - RNA, 20 nt, Human
aauuguaggugacuauuaua

SEQ ID NO: 2080484 - RNA, 18 nt, Human
gaggcuccacuuggucug

SEQ ID NO: 2080485 - RNA, 15 nt, Human
auuucuaugaaauau

SEQ ID NO: 2080486 - RNA, 13 nt, Human
cugggucgccggc

SEQ ID NO: 2080487 - RNA, 19 nt, Human
acucugucucaguccauga

SEQ ID NO: 2080488 - RNA, 15 nt, Human
cuguauguccuuggu

SEQ ID NO: 2080489 - RNA, 23 nt, Human
uguucccuggggcuuuaacuccu

SEQ ID NO: 2080490 - RNA, 13 nt, Human
cucagaaaacaag

SEQ ID NO: 2080491 - RNA, 14 nt, Human
cagauccccaagcc

SEQ ID NO: 2080492 - RNA, 16 nt, Human
gccuaagugcagcccc

SEQ ID NO: 2080493 - RNA, 17 nt, Human
agacacacugaagaagc

SEQ ID NO: 2080494 - RNA, 12 nt, Human
cagacacaugug

SEQ ID NO: 2080495 - RNA, 18 nt, Human
cucuauguucuaagaagu

SEQ ID NO: 2080496 - RNA, 18 nt, Human
agguccacaacacacaga

SEQ ID NO: 2080497 - RNA, 23 nt, Human
acuggcuaauuagcauggccaca

SEQ ID NO: 2080498 - RNA, 22 nt, Human
cccacuuccucccggccgcgcu

SEQ ID NO: 2080499 - RNA, 15 nt, Human
ccaucucaggugugu

SEQ ID NO: 2080500 - RNA, 16 nt, Human
ucgcuuccgcauccua

SEQ ID NO: 2080501 - RNA, 16 nt, Human
ccuagucucuaucauu

SEQ ID NO: 2080502 - RNA, 21 nt, Human
uccccuugggggugguggaug

SEQ ID NO: 2080503 - RNA, 19 nt, Human
uuaaauggaaguaaauguu

SEQ ID NO: 2080504 - RNA, 20 nt, Human
auuuccuuauucagaauuuc

SEQ ID NO: 2080505 - RNA, 19 nt, Human
gaaggcaccucucuggguu

SEQ ID NO: 2080506 - RNA, 16 nt, Human
ccuucccacacugucc

SEQ ID NO: 2080507 - RNA, 19 nt, Human
auccuacaagacacaguga

SEQ ID NO: 2080508 - RNA, 15 nt, Human
ggccaccugcugagc

SEQ ID NO: 2080509 - RNA, 15 nt, Human
cuugugaggagcugg

SEQ ID NO: 2080510 - RNA, 15 nt, Human
ccgugggccugagac

SEQ ID NO: 2080511 - RNA, 17 nt, Human
cacauguuccccuuggg

SEQ ID NO: 2080512 - RNA, 22 nt, Human
uuugcuguuauuuuaucugcua

SEQ ID NO: 2080513 - RNA, 22 nt, Human
agcauuguuggcuguuccugca

SEQ ID NO: 2080514 - RNA, 19 nt, Human
guggauuuaauguggaaau

SEQ ID NO: 2080515 - RNA, 18 nt, Human
uuguacucugaaaguuuu

SEQ ID NO: 2080516 - RNA, 15 nt, Human
uaaauucuuucauuu

SEQ ID NO: 2080517 - RNA, 15 nt, Human
gggaaagaagagccg

SEQ ID NO: 2080518 - RNA, 20 nt, Human
auaacaaugcuguauuuuaa

SEQ ID NO: 2080519 - RNA, 22 nt, Human
gucucagcuucacccugaggug

SEQ ID NO: 2080520 - RNA, 17 nt, Human
uuaaauggucaauuuug

SEQ ID NO: 2080521 - RNA, 14 nt, Human
cauuuacuuuuaaa

SEQ ID NO: 2080522 - RNA, 22 nt, Human
uuucuaggacugaauuaugaaa

SEQ ID NO: 2080523 - RNA, 20 nt, Human
caccuccuaagaaggcaccu

SEQ ID NO: 2080524 - RNA, 21 nt, Human
ggagacauugaggcaggcacu

SEQ ID NO: 2080525 - RNA, 15 nt, Human
uuaaguauuuuauua

SEQ ID NO: 2080526 - RNA, 13 nt, Human
aguguuuagcaua

SEQ ID NO: 2080527 - RNA, 22 nt, Human
aaagggcauggguuuuauuaua

SEQ ID NO: 2080528 - RNA, 17 nt, Human
agaaucacuugaacccg

SEQ ID NO: 2080529 - RNA, 21 nt, Human
cugcgcucggccugcucgccc

SEQ ID NO: 2080530 - RNA, 21 nt, Human
auaauuuuuauauuugaaaua

SEQ ID NO: 2080531 - RNA, 14 nt, Human
uauuaaguauuuua

SEQ ID NO: 2080532 - RNA, 16 nt, Human
cccacuggacucaccu

SEQ ID NO: 2080533 - RNA, 19 nt, Human
caucaaggguacacugccu

SEQ ID NO: 2080534 - RNA, 21 nt, Human
auuccuuuuucucuccucucc

SEQ ID NO: 2080535 - RNA, 19 nt, Human
guauucuuuuaguuuuuaa

SEQ ID NO: 2080536 - RNA, 14 nt, Human
cagagaaguuuucu

SEQ ID NO: 2080537 - RNA, 18 nt, Human
ccaaccuucugaggagcu

SEQ ID NO: 2080538 - RNA, 15 nt, Human
cuuuucccaacucca

SEQ ID NO: 2080539 - RNA, 12 nt, Human
aaaagaaagaaa

SEQ ID NO: 2080540 - RNA, 14 nt, Human
cgcgcugcgcgccg

SEQ ID NO: 2080541 - RNA, 14 nt, Human
ugguauguuuucag

SEQ ID NO: 2080542 - RNA, 18 nt, Human
ucucagguguguugcagu

SEQ ID NO: 2080543 - RNA, 14 nt, Human
cagucucccucccu

SEQ ID NO: 2080544 - RNA, 14 nt, Human
gaggcacagaaacu

SEQ ID NO: 2080545 - RNA, 16 nt, Human
ccagucccuccccaaa

SEQ ID NO: 2080546 - RNA, 20 nt, Human
cugcacuccagccugagcga

SEQ ID NO: 2080547 - RNA, 16 nt, Human
aguuuauauagaaaug

SEQ ID NO: 2080548 - RNA, 16 nt, Human
uucucuaggaaauauu

SEQ ID NO: 2080549 - RNA, 20 nt, Human
uuaaguuuuuuuuuaaaaaa

SEQ ID NO: 2080550 - RNA, 17 nt, Human
ucuauguagaauauauu

SEQ ID NO: 2080551 - RNA, 13 nt, Human
cagcucaggcugg

SEQ ID NO: 2080552 - RNA, 16 nt, Human
cuuagcccuuccccuc

SEQ ID NO: 2080553 - RNA, 21 nt, Human
cccuauccuacuuccccuucc

SEQ ID NO: 2080554 - RNA, 20 nt, Human
gcauuguuggcuguuccugc

SEQ ID NO: 2080555 - RNA, 16 nt, Human
uucaaugccccugaau

SEQ ID NO: 2080556 - RNA, 16 nt, Human
gagcucgugggacagu

SEQ ID NO: 2080557 - RNA, 14 nt, Human
gauuaguacacacu

SEQ ID NO: 2080558 - RNA, 20 nt, Human
accgcuguacgcgagcgcgc

SEQ ID NO: 2080559 - RNA, 15 nt, Human
gccucuuagaugcag

SEQ ID NO: 2080560 - RNA, 21 nt, Human
ccagggcuacgcgcgcuccgc

SEQ ID NO: 2080561 - RNA, 15 nt, Human
uagaauauauuuccu

SEQ ID NO: 2080562 - RNA, 21 nt, Human
cucaguccaugaagauguaga

SEQ ID NO: 2080563 - RNA, 22 nt, Human
ugaagcaaaauuuuuucucuag

SEQ ID NO: 2080564 - RNA, 21 nt, Human
gauguggggaaguuaggaacu

SEQ ID NO: 2080565 - RNA, 19 nt, Human
uacucuuauaucuauauuu

SEQ ID NO: 2080566 - RNA, 19 nt, Human
cggccuccauccugaggcu

SEQ ID NO: 2080567 - RNA, 21 nt, Human
gccacgcucugggucgccggc

SEQ ID NO: 2080568 - RNA, 14 nt, Human
cgcugcgcgccgcg

SEQ ID NO: 2080569 - RNA, 15 nt, Human
agucuguuuucccuc

SEQ ID NO: 2080570 - RNA, 19 nt, Human
cugagccucagucucccuc

SEQ ID NO: 2080571 - RNA, 14 nt, Human
ucagucucccuccc

SEQ ID NO: 2080572 - RNA, 14 nt, Human
uuaugauuaaguaa

SEQ ID NO: 2080573 - RNA, 22 nt, Human
gaauaucuccgucaacucauau

SEQ ID NO: 2080574 - RNA, 16 nt, Human
acuguauguccuuggu

SEQ ID NO: 2080575 - RNA, 18 nt, Human
aaauggaaguaaauguug

SEQ ID NO: 2080576 - RNA, 18 nt, Human
cuuuucccaacuccagaa

SEQ ID NO: 2080577 - RNA, 14 nt, Human
auauuuauuuuaau

SEQ ID NO: 2080578 - RNA, 15 nt, Human
cacuuccucccggcc

SEQ ID NO: 2080579 - RNA, 22 nt, Human
gugugaccacugcagaagacag

SEQ ID NO: 2080580 - RNA, 23 nt, Human
ucaauaucuuuuuuuuaauaaac

SEQ ID NO: 2080581 - RNA, 18 nt, Human
gaaggugaucuggcucug

SEQ ID NO: 2080582 - RNA, 22 nt, Human
uccgcauccuagucucuaucau

SEQ ID NO: 2080583 - RNA, 22 nt, Human
cugugccguccccagagcuaca

SEQ ID NO: 2080584 - RNA, 15 nt, Human
uauuuucaugcuguu

SEQ ID NO: 2080585 - RNA, 14 nt, Human
aguacuucccgcug

SEQ ID NO: 2080586 - RNA, 16 nt, Human
agggaggacgcucucu

SEQ ID NO: 2080587 - RNA, 18 nt, Human
aucagcaucccuagaaag

SEQ ID NO: 2080588 - RNA, 13 nt, Human
ugugcggccuggu

SEQ ID NO: 2080589 - RNA, 22 nt, Human
agaaagugacaagcucacagac

SEQ ID NO: 2080590 - RNA, 21 nt, Human
aauuuguuuucccuucuuaca

SEQ ID NO: 2080591 - RNA, 16 nt, Human
ugugcauauuuuauua

SEQ ID NO: 2080592 - RNA, 13 nt, Human
gccacaagaaccc

SEQ ID NO: 2080593 - RNA, 15 nt, Human
auaggaaauauuuua

SEQ ID NO: 2080594 - RNA, 14 nt, Human
gggcuggaugcucu

SEQ ID NO: 2080595 - RNA, 14 nt, Human
ugagaugcuagaac

SEQ ID NO: 2080596 - RNA, 22 nt, Human
acauggcuggagcuagaauuug

SEQ ID NO: 2080597 - RNA, 14 nt, Human
gggaagacaagaag

SEQ ID NO: 2080598 - RNA, 13 nt, Human
uuaugcuaaguga

SEQ ID NO: 2080599 - RNA, 20 nt, Human
uuguaggugacuauuauauu

SEQ ID NO: 2080600 - RNA, 18 nt, Human
agauccccaagccuggca

SEQ ID NO: 2080601 - RNA, 13 nt, Human
aucaggcuggcca

SEQ ID NO: 2080602 - RNA, 22 nt, Human
cccagcccuccuuaucaaagga

SEQ ID NO: 2080603 - RNA, 18 nt, Human
cuuuccaugaguugcagu

SEQ ID NO: 2080604 - RNA, 15 nt, Human
uguuaucuucacuuu

SEQ ID NO: 2080605 - RNA, 17 nt, Human
cucgugggacagucacc

SEQ ID NO: 2080606 - RNA, 17 nt, Human
acccacuggacucaccu

SEQ ID NO: 2080607 - RNA, 23 nt, Human
cagagucaagggugugugcagca

SEQ ID NO: 2080608 - RNA, 12 nt, Human
ugagagacacac

SEQ ID NO: 2080609 - RNA, 15 nt, Human
cuugaaaacuuuaug

SEQ ID NO: 2080610 - RNA, 14 nt, Human
ccagcuggccggga

SEQ ID NO: 2080611 - RNA, 17 nt, Human
ugaccacugcagaagac

SEQ ID NO: 2080612 - RNA, 13 nt, Human
agcugccucucuc

SEQ ID NO: 2080613 - RNA, 16 nt, Human
cgcucaucccacccgc

SEQ ID NO: 2080614 - RNA, 21 nt, Human
aagauauuaacugagaaggcu

SEQ ID NO: 2080615 - RNA, 18 nt, Human
uggagggaagccuugggg

SEQ ID NO: 2080616 - RNA, 18 nt, Human
uauuuuacauaaauuuag

SEQ ID NO: 2080617 - RNA, 14 nt, Human
cuggaaaucagggu

SEQ ID NO: 2080618 - RNA, 21 nt, Human
uagggugauauuaaccagggg

SEQ ID NO: 2080619 - RNA, 19 nt, Human
uugugccccugcacuccag

SEQ ID NO: 2080620 - RNA, 14 nt, Human
ccaucccggccggc

SEQ ID NO: 2080621 - RNA, 18 nt, Human
cuccccaaaugcuuucca

SEQ ID NO: 2080622 - RNA, 14 nt, Human
agaaauaggaaaua

SEQ ID NO: 2080623 - RNA, 19 nt, Human
ccgggcgugguggugagug

SEQ ID NO: 2080624 - RNA, 13 nt, Human
cccaaaaggcaga

SEQ ID NO: 2080625 - RNA, 20 nt, Human
aaauaauuuuuauauuugaa

SEQ ID NO: 2080626 - RNA, 17 nt, Human
ugcuguucaugaaagau

SEQ ID NO: 2080627 - RNA, 15 nt, Human
ggcuggcgugcagca

SEQ ID NO: 2080628 - RNA, 14 nt, Human
uaugaauuacauuu

SEQ ID NO: 2080629 - RNA, 11 nt, Human
acugggacagg

SEQ ID NO: 2080630 - RNA, 18 nt, Human
agugucaaugcagccccc

SEQ ID NO: 2080631 - RNA, 18 nt, Human
cuccauccugaggcucca

SEQ ID NO: 2080632 - RNA, 17 nt, Human
auauuuuacauaaauuu

SEQ ID NO: 2080633 - RNA, 16 nt, Human
gcaggcagauguuccu

SEQ ID NO: 2080634 - RNA, 18 nt, Human
uuauuauauauauauauu

SEQ ID NO: 2080635 - RNA, 14 nt, Human
aagcaacccaaaug

SEQ ID NO: 2080636 - RNA, 18 nt, Human
cagcuuauugucuaguga

SEQ ID NO: 2080637 - RNA, 20 nt, Human
uagaagucacauuccugaac

SEQ ID NO: 2080638 - RNA, 15 nt, Human
uggauuccucacuuu

SEQ ID NO: 2080639 - RNA, 18 nt, Human
ccuguucgcgcgccuccg

SEQ ID NO: 2080640 - RNA, 15 nt, Human
auuguagcauccugg

SEQ ID NO: 2080641 - RNA, 13 nt, Human
gaaccuaggguga

SEQ ID NO: 2080642 - RNA, 23 nt, Human
cugagaaggcuguggauuuaaug

SEQ ID NO: 2080643 - RNA, 16 nt, Human
accucugccucagaaa

SEQ ID NO: 2080644 - RNA, 22 nt, Human
agacccacuggacucaccuccc

SEQ ID NO: 2080645 - RNA, 15 nt, Human
ugaaacccugucucu

SEQ ID NO: 2080646 - RNA, 20 nt, Human
agaggagaaacuggaacucu

SEQ ID NO: 2080647 - RNA, 12 nt, Human
cucauggaauug

SEQ ID NO: 2080648 - RNA, 15 nt, Human
ccucucuuccucccu

SEQ ID NO: 2080649 - RNA, 17 nt, Human
gccaugugcagccacca

SEQ ID NO: 2080650 - RNA, 17 nt, Human
gcgcccucuggcugcug

SEQ ID NO: 2080651 - RNA, 17 nt, Human
uauuuauuaaguauuuu

SEQ ID NO: 2080652 - RNA, 19 nt, Human
auucagaauuucuaaaagu

SEQ ID NO: 2080653 - RNA, 17 nt, Human
uauauauuuuuuucuga

SEQ ID NO: 2080654 - RNA, 22 nt, Human
cgguccuugcugcaccugugcc

SEQ ID NO: 2080655 - RNA, 21 nt, Human
caguaguuagcuuucuuccug

SEQ ID NO: 2080656 - RNA, 13 nt, Human
uccucccggccgc

SEQ ID NO: 2080657 - RNA, 13 nt, Human
guggcgcuggcug

SEQ ID NO: 2080658 - RNA, 23 nt, Human
ucugauacagaaaaguugaauuu

SEQ ID NO: 2080659 - RNA, 18 nt, Human
uguugcagugucugcugg

SEQ ID NO: 2080660 - RNA, 23 nt, Human
agcccuccuuaucaaaggacacc

SEQ ID NO: 2080661 - RNA, 18 nt, Human
ggagccgggaaagaagag

SEQ ID NO: 2080662 - RNA, 21 nt, Human
gagccggagccuccagcugcc

SEQ ID NO: 2080663 - RNA, 21 nt, Human
uccauccugaggcuccacuug

SEQ ID NO: 2080664 - RNA, 22 nt, Human
caccucccccaucucuucuggg

SEQ ID NO: 2080665 - RNA, 23 nt, Human
uggaaauguuuacagauccccaa

SEQ ID NO: 2080666 - RNA, 14 nt, Human
acuuugauuuuaua

SEQ ID NO: 2080667 - RNA, 16 nt, Human
ugaaguccaagcauuu

SEQ ID NO: 2080668 - RNA, 17 nt, Human
ccccuggccaaggaaga

SEQ ID NO: 2080669 - RNA, 13 nt, Human
aucaaugaaugaa

SEQ ID NO: 2080670 - RNA, 17 nt, Human
cauuuguauaaaauaau

SEQ ID NO: 2080671 - RNA, 19 nt, Human
cuuccagauccuggaaauc

SEQ ID NO: 2080672 - RNA, 21 nt, Human
ugccuaggcauagcccugccu

SEQ ID NO: 2080673 - RNA, 23 nt, Human
acuuauuguagcauccuggaaua

SEQ ID NO: 2080674 - RNA, 15 nt, Human
augugcagccaccag

SEQ ID NO: 2080675 - RNA, 11 nt, Human
agacacaugug

SEQ ID NO: 2080676 - RNA, 16 nt, Human
cagcuuuccucaaaac

SEQ ID NO: 2080677 - RNA, 17 nt, Human
accugugccguccccag

SEQ ID NO: 2080678 - RNA, 16 nt, Human
uagaaaacaggcaaau

SEQ ID NO: 2080679 - RNA, 14 nt, Human
cagagguugcagug

SEQ ID NO: 2080680 - RNA, 20 nt, Human
ccucaagcuaugugagcuca

SEQ ID NO: 2080681 - RNA, 21 nt, Human
cuaguaucaaaagaaagaaaa

SEQ ID NO: 2080682 - RNA, 16 nt, Human
cagucucccucccuug

SEQ ID NO: 2080683 - RNA, 12 nt, Human
auggguuuuauu

SEQ ID NO: 2080684 - RNA, 20 nt, Human
aggugacuauuauauuucca

SEQ ID NO: 2080685 - RNA, 15 nt, Human
guguugcagugucug

SEQ ID NO: 2080686 - RNA, 22 nt, Human
ggaaaugauguuucauaagaau

SEQ ID NO: 2080687 - RNA, 18 nt, Human
ccuuugcaccuccaugga

SEQ ID NO: 2080688 - RNA, 14 nt, Human
gcuggcgugcagca

SEQ ID NO: 2080689 - RNA, 16 nt, Human
gaaagaagagccggag

SEQ ID NO: 2080690 - RNA, 22 nt, Human
gagucaagggugugugcagcau

SEQ ID NO: 2080691 - RNA, 13 nt, Human
acaagagcuuaac

SEQ ID NO: 2080692 - RNA, 17 nt, Human
cauccuagucucuauca

SEQ ID NO: 2080693 - RNA, 13 nt, Human
aucauuaaaguuc

SEQ ID NO: 2080694 - RNA, 19 nt, Human
acucuuauaucuauauuuu

SEQ ID NO: 2080695 - RNA, 17 nt, Human
auuuuaauaauguuuca

SEQ ID NO: 2080696 - RNA, 20 nt, Human
cuggccaccugcugagcccc

SEQ ID NO: 2080697 - RNA, 13 nt, Human
aaacauccuacaa

SEQ ID NO: 2080698 - RNA, 19 nt, Human
gguuccuuccucugagccu

SEQ ID NO: 2080699 - RNA, 21 nt, Human
agcuacuuauuguagcauccu

SEQ ID NO: 2080700 - RNA, 19 nt, Human
cacaggaaccacaagacug

SEQ ID NO: 2080701 - RNA, 17 nt, Human
ccugucgguuuauucac

SEQ ID NO: 2080702 - RNA, 20 nt, Human
cuuauucacaagacccaaaa

SEQ ID NO: 2080703 - RNA, 19 nt, Human
uggaacaguuaccucugcc

SEQ ID NO: 2080704 - RNA, 14 nt, Human
uuuuaaaaaagaaa

SEQ ID NO: 2080705 - RNA, 11 nt, Human
agaauauauuu

SEQ ID NO: 2080706 - RNA, 21 nt, Human
cgacagugagacucugucuca

SEQ ID NO: 2080707 - RNA, 19 nt, Human
ucucuaucauuaaaguucu

SEQ ID NO: 2080708 - RNA, 22 nt, Human
cagacacaugugcuggccaccu

SEQ ID NO: 2080709 - RNA, 18 nt, Human
auuaaguuuuuuuuuaaa

SEQ ID NO: 2080710 - RNA, 13 nt, Human
cuccagcugcccc

SEQ ID NO: 2080711 - RNA, 18 nt, Human
ugccauaauuacuauguc

SEQ ID NO: 2080712 - RNA, 20 nt, Human
agccuaguugaucagcuuau

SEQ ID NO: 2080713 - RNA, 20 nt, Human
cucgcccacuuccucccggc

SEQ ID NO: 2080714 - RNA, 21 nt, Human
gcaggaccaucccggccggcg

SEQ ID NO: 2080715 - RNA, 22 nt, Human
agugagcagucaggaaagagaa

SEQ ID NO: 2080716 - RNA, 14 nt, Human
uacccccugggagc

SEQ ID NO: 2080717 - RNA, 15 nt, Human
aagaaggaaagauuu

SEQ ID NO: 2080718 - RNA, 21 nt, Human
ccaaagugugacucauuaaau

SEQ ID NO: 2080719 - RNA, 18 nt, Human
cuggggcuuuaacuccug

SEQ ID NO: 2080720 - RNA, 14 nt, Human
cuacaagacacagu

SEQ ID NO: 2080721 - RNA, 23 nt, Human
gcgcuggcugcgcucggccugcu

SEQ ID NO: 2080722 - RNA, 18 nt, Human
uauaacaaugcuguauuu

SEQ ID NO: 2080723 - RNA, 21 nt, Human
guccccuauccuacuuccccu

SEQ ID NO: 2080724 - RNA, 14 nt, Human
uauauauuuuagau

SEQ ID NO: 2080725 - RNA, 16 nt, Human
auuuuaauaauguuuc

SEQ ID NO: 2080726 - RNA, 19 nt, Human
uggcaaacugccaucauuu

SEQ ID NO: 2080727 - RNA, 18 nt, Human
ccaagcugguggcucugu

SEQ ID NO: 2080728 - RNA, 22 nt, Human
uaucuauguagaauauauuucc

SEQ ID NO: 2080729 - RNA, 15 nt, Human
uugacccacaagaaa

SEQ ID NO: 2080730 - RNA, 17 nt, Human
ucucucacuuguuuuau

SEQ ID NO: 2080731 - RNA, 16 nt, Human
cugagcgacagugaga

SEQ ID NO: 2080732 - RNA, 12 nt, Human
agcuuucuuccu

SEQ ID NO: 2080733 - RNA, 19 nt, Human
augcccacggcuggagcug

SEQ ID NO: 2080734 - RNA, 17 nt, Human
uauuuuuuucugaaauu

SEQ ID NO: 2080735 - RNA, 17 nt, Human
uuuuauaugcuauuuau

SEQ ID NO: 2080736 - RNA, 22 nt, Human
cuuuccacagaagcuccaggua

SEQ ID NO: 2080737 - RNA, 23 nt, Human
caacggggugaaacccugucucu

SEQ ID NO: 2080738 - RNA, 14 nt, Human
cuaagcauuccaac

SEQ ID NO: 2080739 - RNA, 13 nt, Human
cuauuauauuucc

SEQ ID NO: 2080740 - RNA, 17 nt, Human
agaagagccggagccuc

SEQ ID NO: 2080741 - RNA, 19 nt, Human
auguuuacagauccccaag

SEQ ID NO: 2080742 - RNA, 23 nt, Human
aggcuuuaaaacuuauccuccau

SEQ ID NO: 2080743 - RNA, 19 nt, Human
ccuccagggagucucagcu

SEQ ID NO: 2080744 - RNA, 21 nt, Human
caacacacagauuugagcuca

SEQ ID NO: 2080745 - RNA, 22 nt, Human
ccgcgcagcucaggcuggcacc

SEQ ID NO: 2080746 - RNA, 16 nt, Human
gccucucucauccacu

SEQ ID NO: 2080747 - RNA, 19 nt, Human
uccacaaguaaaaggaaau

SEQ ID NO: 2080748 - RNA, 22 nt, Human
gaagugaaaaucuacacuccag

SEQ ID NO: 2080749 - RNA, 19 nt, Human
agaugagagaacagggcug

SEQ ID NO: 2080750 - RNA, 14 nt, Human
uauauuuccuuauu

SEQ ID NO: 2080751 - RNA, 18 nt, Human
gccccugcacuccagccu

SEQ ID NO: 2080752 - RNA, 19 nt, Human
auauauuuuuuuuuuuaaa

SEQ ID NO: 2080753 - RNA, 11 nt, Human
ucaccuccccc

SEQ ID NO: 2080754 - RNA, 21 nt, Human
uccuucagccugaaagaggaa

SEQ ID NO: 2080755 - RNA, 15 nt, Human
gcuguuaaucuuuca

SEQ ID NO: 2080756 - RNA, 21 nt, Human
cgcccacuuccucccggccgc

SEQ ID NO: 2080757 - RNA, 13 nt, Human
acacacaugaagu

SEQ ID NO: 2080758 - RNA, 19 nt, Human
gugacuuaaugccacuaaa

SEQ ID NO: 2080759 - RNA, 19 nt, Human
cugcgcgccgcgcuccucg

SEQ ID NO: 2080760 - RNA, 20 nt, Human
ccagcuugaaaccuucacuu

SEQ ID NO: 2080761 - RNA, 15 nt, Human
ggccuccauccugag

SEQ ID NO: 2080762 - RNA, 15 nt, Human
gcccacuagacccac

SEQ ID NO: 2080763 - RNA, 19 nt, Human
ugagcgcccacuagaccca

SEQ ID NO: 2080764 - RNA, 20 nt, Human
uugaacccgggaggcagagg

SEQ ID NO: 2080765 - RNA, 22 nt, Human
aauuuaaaaaaaaaccugagcc

SEQ ID NO: 2080766 - RNA, 17 nt, Human
uaucuuuuuuuuaauaa

SEQ ID NO: 2080767 - RNA, 23 nt, Human
aaagcccagcuugaaaccuucac

SEQ ID NO: 2080768 - RNA, 20 nt, Human
uuccacagaagcuccaggua

SEQ ID NO: 2080769 - RNA, 15 nt, Human
uugcucauggaauug

SEQ ID NO: 2080770 - RNA, 15 nt, Human
cggagccuccagcug

SEQ ID NO: 2080771 - RNA, 17 nt, Human
ccaagcugguggcucug

SEQ ID NO: 2080772 - RNA, 16 nt, Human
caggcugagccucagu

SEQ ID NO: 2080773 - RNA, 14 nt, Human
ggagcaucuccuca

SEQ ID NO: 2080774 - RNA, 18 nt, Human
cauguuccccuugggggu

SEQ ID NO: 2080775 - RNA, 18 nt, Human
ccauccugccccugagcc

SEQ ID NO: 2080776 - RNA, 19 nt, Human
ggcaccgcuguacgcgagc

SEQ ID NO: 2080777 - RNA, 15 nt, Human
gauccugcaauucca

SEQ ID NO: 2080778 - RNA, 23 nt, Human
cacaagaaaugaaagcagggacu

SEQ ID NO: 2080779 - RNA, 18 nt, Human
agcugcucaauaaaguac

SEQ ID NO: 2080780 - RNA, 18 nt, Human
uuuugugggaaauccaca

SEQ ID NO: 2080781 - RNA, 19 nt, Human
cuaccuguucgcgcgccuc

SEQ ID NO: 2080782 - RNA, 20 nt, Human
aauaauuuuuauauuugaaa

SEQ ID NO: 2080783 - RNA, 19 nt, Human
cugcaaagcccagcuugaa

SEQ ID NO: 2080784 - RNA, 18 nt, Human
cuccagccugagcgacag

SEQ ID NO: 2080785 - RNA, 15 nt, Human
cuucucuucacaguc

SEQ ID NO: 2080786 - RNA, 15 nt, Human
aagugaaaaucuaca

SEQ ID NO: 2080787 - RNA, 20 nt, Human
ccauacuaauuauacccccu

SEQ ID NO: 2080788 - RNA, 13 nt, Human
uuccuucugcucc

SEQ ID NO: 2080789 - RNA, 15 nt, Human
ugauuucauucaaua

SEQ ID NO: 2080790 - RNA, 17 nt, Human
cucaggcuggcaccgcu

SEQ ID NO: 2080791 - RNA, 13 nt, Human
uuuuaauuugguu

SEQ ID NO: 2080792 - RNA, 13 nt, Human
aauuauuucacuu

SEQ ID NO: 2080793 - RNA, 14 nt, Human
gagccgggaaagaa

SEQ ID NO: 2080794 - RNA, 21 nt, Human
caagacugcacaucaaaauau

SEQ ID NO: 2080795 - RNA, 12 nt, Human
gucauuguucuu

SEQ ID NO: 2080796 - RNA, 15 nt, Human
cauuccaagccucau

SEQ ID NO: 2080797 - RNA, 21 nt, Human
ugccuguaaucacagcuacuu

SEQ ID NO: 2080798 - RNA, 21 nt, Human
aagacaagaaggaaagauuuu

SEQ ID NO: 2080799 - RNA, 14 nt, Human
agucucccucccuu

SEQ ID NO: 2080800 - RNA, 16 nt, Human
cuguucgcgcgccucc

SEQ ID NO: 2080801 - RNA, 13 nt, Human
cacuuugaagagu

SEQ ID NO: 2080802 - RNA, 23 nt, Human
gcuggccuugugaggagcuggaa

SEQ ID NO: 2080803 - RNA, 18 nt, Human
agagaaugagagacacac

SEQ ID NO: 2080804 - RNA, 12 nt, Human
auuauauuucca

SEQ ID NO: 2080805 - RNA, 22 nt, Human
gccccggggaggggcgcucgcu

SEQ ID NO: 2080806 - RNA, 16 nt, Human
agguacuucaaauccu

SEQ ID NO: 2080807 - RNA, 14 nt, Human
gaaagcagaacagu

SEQ ID NO: 2080808 - RNA, 18 nt, Human
caaguaaaaggaaaugcu

SEQ ID NO: 2080809 - RNA, 21 nt, Human
gaagcuagaaaacaggcaaau

SEQ ID NO: 2080810 - RNA, 19 nt, Human
cugccccccagcccuccuu

SEQ ID NO: 2080811 - RNA, 21 nt, Human
auuuuuucucuaggaaauauu

SEQ ID NO: 2080812 - RNA, 15 nt, Human
ugucaauaaaaucca

SEQ ID NO: 2080813 - RNA, 14 nt, Human
cagccaccagucca

SEQ ID NO: 2080814 - RNA, 17 nt, Human
uuuaaaaaaaaaacgua

SEQ ID NO: 2080815 - RNA, 14 nt, Human
ccaccugcugagcc

SEQ ID NO: 2080816 - RNA, 23 nt, Human
uauguuaaaacugggacagggga

SEQ ID NO: 2080817 - RNA, 16 nt, Human
aguugaauuuuacaug

SEQ ID NO: 2080818 - RNA, 14 nt, Human
cccugaggugagca

SEQ ID NO: 2080819 - RNA, 20 nt, Human
uccagccugagcgacaguga

SEQ ID NO: 2080820 - RNA, 16 nt, Human
aacaauuugaauauaa

SEQ ID NO: 2080821 - RNA, 19 nt, Human
caaguaaaaggaaaugcuc

SEQ ID NO: 2080822 - RNA, 21 nt, Human
aggacagcccuucuuuccaca

SEQ ID NO: 2080823 - RNA, 15 nt, Human
gaaaugauguuucau

SEQ ID NO: 2080824 - RNA, 21 nt, Human
ccggggaggggcgcucgcuuc

SEQ ID NO: 2080825 - RNA, 18 nt, Human
accaccugccuauauuuu

SEQ ID NO: 2080826 - RNA, 23 nt, Human
ugcagagguccacaacacacaga

SEQ ID NO: 2080827 - RNA, 19 nt, Human
uguuugccgcuuaagcuuu

SEQ ID NO: 2080828 - RNA, 22 nt, Human
aagucccugcugcccuuccccu

SEQ ID NO: 2080829 - RNA, 22 nt, Human
ugcuggagacauugaggcaggc

SEQ ID NO: 2080830 - RNA, 14 nt, Human
aagucccugcugcc

SEQ ID NO: 2080831 - RNA, 21 nt, Human
cccccauuguggucacaggaa

SEQ ID NO: 2080832 - RNA, 17 nt, Human
caauucgauccccuguc

SEQ ID NO: 2080833 - RNA, 12 nt, Human
gaugagagaaca

SEQ ID NO: 2080834 - RNA, 15 nt, Human
cuccucaacucugag

SEQ ID NO: 2080835 - RNA, 14 nt, Human
ccacccgcccaccg

SEQ ID NO: 2080836 - RNA, 14 nt, Human
ugagguugugugug

SEQ ID NO: 2080837 - RNA, 19 nt, Human
cucggccugcucgcccacu

SEQ ID NO: 2080838 - RNA, 20 nt, Human
aaaacuuauccuccaugaau

SEQ ID NO: 2080839 - RNA, 16 nt, Human
aucaauuuaaaaaaaa

SEQ ID NO: 2080840 - RNA, 23 nt, Human
cacagaaacuccuguucaugccc

SEQ ID NO: 2080841 - RNA, 23 nt, Human
uaggauggcuaguaucaaaagaa

SEQ ID NO: 2080842 - RNA, 15 nt, Human
uaguauggcaaacug

SEQ ID NO: 2080843 - RNA, 14 nt, Human
uauuauauuuccaa

SEQ ID NO: 2080844 - RNA, 17 nt, Human
ugguucccuugaugaag

SEQ ID NO: 2080845 - RNA, 14 nt, Human
cacaacacacagau

SEQ ID NO: 2080846 - RNA, 12 nt, Human
ggcugaugcagu

SEQ ID NO: 2080847 - RNA, 21 nt, Human
aaaauaugccccauucaacau

SEQ ID NO: 2080848 - RNA, 18 nt, Human
gcuauaggauguggggaa

SEQ ID NO: 2080849 - RNA, 16 nt, Human
caugguuuagaaagcu

SEQ ID NO: 2080850 - RNA, 13 nt, Human
uauuucuaugaaa

SEQ ID NO: 2080851 - RNA, 14 nt, Human
cuuggucugugaga

SEQ ID NO: 2080852 - RNA, 16 nt, Human
uaaacgucuuaaauau

SEQ ID NO: 2080853 - RNA, 12 nt, Human
uacuaaaugcuc

SEQ ID NO: 2080854 - RNA, 17 nt, Human
cccacuggacucaccuc

SEQ ID NO: 2080855 - RNA, 23 nt, Human
uugauuuuauaugcuauuuauua

SEQ ID NO: 2080856 - RNA, 17 nt, Human
cugguggcgcuggcugc

SEQ ID NO: 2080857 - RNA, 13 nt, Human
uaccccuggccaa

SEQ ID NO: 2080858 - RNA, 23 nt, Human
cuuaagaagacugcauuauauuu

SEQ ID NO: 2080859 - RNA, 20 nt, Human
cugccgugggccugagacca

SEQ ID NO: 2080860 - RNA, 19 nt, Human
cuuuuggaagguauuuaau

SEQ ID NO: 2080861 - RNA, 18 nt, Human
auccccaagccuggcaag

SEQ ID NO: 2080862 - RNA, 18 nt, Human
acacuguccauucuuccu

SEQ ID NO: 2080863 - RNA, 14 nt, Human
guuccuucugcucc

SEQ ID NO: 2080864 - RNA, 19 nt, Human
gcuccgcgcagcucaggcu

SEQ ID NO: 2080865 - RNA, 19 nt, Human
gaauacucuuauaucuaua

SEQ ID NO: 2080866 - RNA, 23 nt, Human
uaauuuguaguguuggagaagaa

SEQ ID NO: 2080867 - RNA, 21 nt, Human
aaauaauuuuuauauuugaaa

SEQ ID NO: 2080868 - RNA, 12 nt, Human
gcgagccccagg

SEQ ID NO: 2080869 - RNA, 17 nt, Human
ucgggauuaguacacac

SEQ ID NO: 2080870 - RNA, 18 nt, Human
gccuuggggcugaugcag

SEQ ID NO: 2080871 - RNA, 21 nt, Human
cccuagaaagccaugugcagc

SEQ ID NO: 2080872 - RNA, 20 nt, Human
aggcugagaugggagaauca

SEQ ID NO: 2080873 - RNA, 15 nt, Human
gcgcgccuccgcuac

SEQ ID NO: 2080874 - RNA, 20 nt, Human
aucuauguagaauauauuuc

SEQ ID NO: 2080875 - RNA, 22 nt, Human
ucaacuccaaacugacucuuaa

SEQ ID NO: 2080876 - RNA, 21 nt, Human
aacuuauccuccaugaauauc

SEQ ID NO: 2080877 - RNA, 11 nt, Human
caucuagugag

SEQ ID NO: 2080878 - RNA, 21 nt, Human
auuuaauagguuuggacaaaa

SEQ ID NO: 2080879 - RNA, 15 nt, Human
ucuaugaaauauuau

SEQ ID NO: 2080880 - RNA, 20 nt, Human
uuuaaauagcuuuuuucucu

SEQ ID NO: 2080881 - RNA, 15 nt, Human
acucaccucccccau

SEQ ID NO: 2080882 - RNA, 20 nt, Human
ggagccugaucaccugcccu

SEQ ID NO: 2080883 - RNA, 21 nt, Human
caucucagguguguugcagug

SEQ ID NO: 2080884 - RNA, 18 nt, Human
aucuggcucuggacaggc

SEQ ID NO: 2080885 - RNA, 18 nt, Human
uuuguuaaaugauuucau

SEQ ID NO: 2080886 - RNA, 17 nt, Human
gcagcauuguuggcugu

SEQ ID NO: 2080887 - RNA, 13 nt, Human
cacacugaagaag

SEQ ID NO: 2080888 - RNA, 23 nt, Human
cauuguggucacaggaaguagag

SEQ ID NO: 2080889 - RNA, 16 nt, Human
ccugagcgacagugag

SEQ ID NO: 2080890 - RNA, 19 nt, Human
gaaaaugucauuguucuug

SEQ ID NO: 2080891 - RNA, 12 nt, Human
cugaggagcugu

SEQ ID NO: 2080892 - RNA, 13 nt, Human
gggaggggcgcuc

SEQ ID NO: 2080893 - RNA, 12 nt, Human
cuggcuccagcu

SEQ ID NO: 2080894 - RNA, 16 nt, Human
uucccaacuccagaaa

SEQ ID NO: 2080895 - RNA, 19 nt, Human
cucaccucccccaucucuu

SEQ ID NO: 2080896 - RNA, 23 nt, Human
acucuauguucuaagaagugaaa

SEQ ID NO: 2080897 - RNA, 14 nt, Human
cauuuaguuauaaa

SEQ ID NO: 2080898 - RNA, 20 nt, Human
cugcugcccuuccccuuccc

SEQ ID NO: 2080899 - RNA, 20 nt, Human
augcuucuguuuuauaauuu

SEQ ID NO: 2080900 - RNA, 18 nt, Human
guuaguauuguccagguc

SEQ ID NO: 2080901 - RNA, 11 nt, Human
guauggcaaac

SEQ ID NO: 2080902 - RNA, 19 nt, Human
cuuacucuugauuguggga

SEQ ID NO: 2080903 - RNA, 18 nt, Human
ggaggacgcucucuggcc

SEQ ID NO: 2080904 - RNA, 15 nt, Human
uugccuaauuuguuu

SEQ ID NO: 2080905 - RNA, 18 nt, Human
caaaaagcuacuuauugu

SEQ ID NO: 2080906 - RNA, 21 nt, Human
auuauauuuauuacuguaaga

SEQ ID NO: 2080907 - RNA, 13 nt, Human
gggcugaagcugu

SEQ ID NO: 2080908 - RNA, 15 nt, Human
auauugacuuuuuau

SEQ ID NO: 2080909 - RNA, 12 nt, Human
cccucugcagcu

SEQ ID NO: 2080910 - RNA, 24 nt, Human
ccccugagcuugcagagaugaggc

SEQ ID NO: 2080911 - RNA, 17 nt, Human
aagcacagugaucaagu

SEQ ID NO: 2080912 - RNA, 20 nt, Human
acaagacacagugaccauac

SEQ ID NO: 2080913 - RNA, 19 nt, Human
auuggagcucgugggacag

SEQ ID NO: 2080914 - RNA, 17 nt, Human
ccgcgcagcucaggcug

SEQ ID NO: 2080915 - RNA, 14 nt, Human
acuauuauauuucc

SEQ ID NO: 2080916 - RNA, 16 nt, Human
uaucaaaagaaagaaa

SEQ ID NO: 2080917 - RNA, 18 nt, Human
uauauuuccuuauucaga

SEQ ID NO: 2080918 - RNA, 14 nt, Human
acaagcagcccuua

SEQ ID NO: 2080919 - RNA, 23 nt, Human
uuuauaugcuucuguuuuauaau

SEQ ID NO: 2080920 - RNA, 13 nt, Human
uaguuuauauaga

SEQ ID NO: 2080921 - RNA, 18 nt, Human
augagcacgcauggaaaa

SEQ ID NO: 2080922 - RNA, 19 nt, Human
gccccccagcccuccuuau

SEQ ID NO: 2080923 - RNA, 13 nt, Human
augcuagaacucc

SEQ ID NO: 2080924 - RNA, 17 nt, Human
ucccugcugcccuuccc

SEQ ID NO: 2080925 - RNA, 15 nt, Human
gccccauucaacauc

SEQ ID NO: 2080926 - RNA, 16 nt, Human
caauguucccccucuc

SEQ ID NO: 2080927 - RNA, 17 nt, Human
ucccuccccaaaugcuu

SEQ ID NO: 2080928 - RNA, 16 nt, Human
uuucugaaauuuccug

SEQ ID NO: 2080929 - RNA, 18 nt, Human
auauuuuuuucugaaauu

SEQ ID NO: 2080930 - RNA, 18 nt, Human
caaggcugauuaaaccaa

SEQ ID NO: 2080931 - RNA, 19 nt, Human
augaaagcagggacuugaa

SEQ ID NO: 2080932 - RNA, 14 nt, Human
aucaguuauuuuua

SEQ ID NO: 2080933 - RNA, 13 nt, Human
agaaaugaaagca

SEQ ID NO: 2080934 - RNA, 23 nt, Human
uuuguauaaaauaauuuuuauau

SEQ ID NO: 2080935 - RNA, 14 nt, Human
uguauucuuuuagu

SEQ ID NO: 2080936 - RNA, 18 nt, Human
uguccauucuuccuccca

SEQ ID NO: 2080937 - RNA, 16 nt, Human
acugauguaaguaaac

SEQ ID NO: 2080938 - RNA, 15 nt, Human
aaaaacguauugcau

SEQ ID NO: 2080939 - RNA, 21 nt, Human
ugaacaaauuuacagagacag

SEQ ID NO: 2080940 - RNA, 22 nt, Human
cuugaauuguaggugacuauua

SEQ ID NO: 2080941 - RNA, 22 nt, Human
caccagucugacuguuuccauc

SEQ ID NO: 2080942 - RNA, 19 nt, Human
gucccugcugcccuucccc

SEQ ID NO: 2080943 - RNA, 15 nt, Human
gccguccccagagcu

SEQ ID NO: 2080944 - RNA, 16 nt, Human
gcuuccauuguugucu

SEQ ID NO: 2080945 - RNA, 18 nt, Human
gcgcuggcugcgcucggc

SEQ ID NO: 2080946 - RNA, 19 nt, Human
uaucuauguagaauauauu

SEQ ID NO: 2080947 - RNA, 17 nt, Human
uuauauuugaaauauug

SEQ ID NO: 2080948 - RNA, 16 nt, Human
aguaaaggcaaacuua

SEQ ID NO: 2080949 - RNA, 13 nt, Human
cugccuucucaac

SEQ ID NO: 2080950 - RNA, 13 nt, Human
ucacauuccugaa

SEQ ID NO: 2080951 - RNA, 18 nt, Human
ggggcuuuaacuccugcu

SEQ ID NO: 2080952 - RNA, 19 nt, Human
guccaggucuaccaaaaau

SEQ ID NO: 2080953 - RNA, 16 nt, Human
ugagcucagcccuggu

SEQ ID NO: 2080954 - RNA, 17 nt, Human
gugccuguaaucacagc

SEQ ID NO: 2080955 - RNA, 16 nt, Human
ugaaguacucauacau

SEQ ID NO: 2080956 - RNA, 19 nt, Human
ugcuugucccuguggaagu

SEQ ID NO: 2080957 - RNA, 18 nt, Human
cgcgagcgcgcgcgcccu

SEQ ID NO: 2080958 - RNA, 19 nt, Human
uauuuaauuauuucacuuu

SEQ ID NO: 2080959 - RNA, 15 nt, Human
auaucuuaucuuccu

SEQ ID NO: 2080960 - RNA, 23 nt, Human
gcuguggauuuaauguggaaaug

SEQ ID NO: 2080961 - RNA, 15 nt, Human
aggcagauguuccua

SEQ ID NO: 2080962 - RNA, 13 nt, Human
cgcgcccucuggc

SEQ ID NO: 2080963 - RNA, 11 nt, Human
uuauuuuuaaa

SEQ ID NO: 2080964 - RNA, 16 nt, Human
gacaagcucacagacc

SEQ ID NO: 2080965 - RNA, 21 nt, Human
ccuccagcugccccggggagg

SEQ ID NO: 2080966 - RNA, 20 nt, Human
agggaagacaagaaggaaag

SEQ ID NO: 2080967 - RNA, 14 nt, Human
uggcucugugugcu

SEQ ID NO: 2080968 - RNA, 19 nt, Human
uucccuugaugaagaaguu

SEQ ID NO: 2080969 - RNA, 14 nt, Human
acgcgcgcuccgcg

SEQ ID NO: 2080970 - RNA, 16 nt, Human
acaaggaugaauuaag

SEQ ID NO: 2080971 - RNA, 15 nt, Human
gaauauauuuccuua

SEQ ID NO: 2080972 - RNA, 21 nt, Human
cagacacaugugcuggccacc

SEQ ID NO: 2080973 - RNA, 17 nt, Human
acaagaaaugaaagcag

SEQ ID NO: 2080974 - RNA, 21 nt, Human
aaaaaguucugcagauaaaca

SEQ ID NO: 2080975 - RNA, 20 nt, Human
augcaguuguugcccacagc

SEQ ID NO: 2080976 - RNA, 17 nt, Human
uaucaguuauuuuuaaa

SEQ ID NO: 2080977 - RNA, 12 nt, Human
aucauuuacuuu

SEQ ID NO: 2080978 - RNA, 15 nt, Human
cgaagcaccaucauu

SEQ ID NO: 2080979 - RNA, 15 nt, Human
auuauagucacuagu

SEQ ID NO: 2080980 - RNA, 22 nt, Human
uccaugaguugcaguuuuuucc

SEQ ID NO: 2080981 - RNA, 15 nt, Human
ucugucucaguccau

SEQ ID NO: 2080982 - RNA, 21 nt, Human
agggugauauuaaccaggggc

SEQ ID NO: 2080983 - RNA, 14 nt, Human
uugauggaaauaca

SEQ ID NO: 2080984 - RNA, 20 nt, Human
cgcucggccugcucgcccac

SEQ ID NO: 2080985 - RNA, 16 nt, Human
gacauugaggcaggca

SEQ ID NO: 2080986 - RNA, 15 nt, Human
aguaugugcauauuu

SEQ ID NO: 2080987 - RNA, 16 nt, Human
ccccaucucuucuggg

SEQ ID NO: 2080988 - RNA, 20 nt, Human
acuaaauugacacuuaaaaa

SEQ ID NO: 2080989 - RNA, 16 nt, Human
cugagccucagucucc

SEQ ID NO: 2080990 - RNA, 16 nt, Human
cggggagcgagcccca

SEQ ID NO: 2080991 - RNA, 15 nt, Human
ccaucccggccggcg

SEQ ID NO: 2080992 - RNA, 15 nt, Human
cuggguuccuuccuc

SEQ ID NO: 2080993 - RNA, 17 nt, Human
aucaaggguacacugcc

SEQ ID NO: 2080994 - RNA, 19 nt, Human
ccccugagcuugcagagau

SEQ ID NO: 2080995 - RNA, 14 nt, Human
cucccucccuuggg

SEQ ID NO: 2080996 - RNA, 15 nt, Human
gacagggaggacgcu

SEQ ID NO: 2080997 - RNA, 14 nt, Human
gagcccauggcacu

SEQ ID NO: 2080998 - RNA, 18 nt, Human
acagaaagcagaacagug

SEQ ID NO: 2080999 - RNA, 23 nt, Human
ucggccuccauccugaggcucca

SEQ ID NO: 2081000 - RNA, 23 nt, Human
augaauaucaguuauuuuuaaac

SEQ ID NO: 2081001 - RNA, 14 nt, Human
auuuuaucugcuau

SEQ ID NO: 2081002 - RNA, 13 nt, Human
cacaacacacaga

SEQ ID NO: 2081003 - RNA, 16 nt, Human
cuggccuucggccucc

SEQ ID NO: 2081004 - RNA, 22 nt, Human
cgcuggcugcgcucggccugcu

SEQ ID NO: 2081005 - RNA, 15 nt, Human
aggguuuggaagcca

SEQ ID NO: 2081006 - RNA, 21 nt, Human
cgagccccaggcggguccggg

SEQ ID NO: 2081007 - RNA, 22 nt, Human
caucgcaauguaagacucggga

SEQ ID NO: 2081008 - RNA, 15 nt, Human
gccgacggagccggg

SEQ ID NO: 2081009 - RNA, 14 nt, Human
cucuggcuccagcu

SEQ ID NO: 2081010 - RNA, 16 nt, Human
uuuauauuugaaauau

SEQ ID NO: 2081011 - RNA, 19 nt, Human
gcucauggaauuggagcuc

SEQ ID NO: 2081012 - RNA, 17 nt, Human
cccggccggcgcgcuca

SEQ ID NO: 2081013 - RNA, 19 nt, Human
cgccacgcucugggucgcc

SEQ ID NO: 2081014 - RNA, 15 nt, Human
gagccggagccucca

SEQ ID NO: 2081015 - RNA, 16 nt, Human
ggcugagccucagucu

SEQ ID NO: 2081016 - RNA, 14 nt, Human
aaauaggaaauauu

SEQ ID NO: 2081017 - RNA, 15 nt, Human
agacagcucugcaua

SEQ ID NO: 2081018 - RNA, 14 nt, Human
ccccugagcuugca

SEQ ID NO: 2081019 - RNA, 22 nt, Human
cucugagccuugggaccccuga

SEQ ID NO: 2081020 - RNA, 16 nt, Human
uacauuuguauaaaau

SEQ ID NO: 2081021 - RNA, 13 nt, Human
uuuauuauauaua

SEQ ID NO: 2081022 - RNA, 17 nt, Human
aggccaugggacaggga

SEQ ID NO: 2081023 - RNA, 16 nt, Human
aagcuacuuauuguag

SEQ ID NO: 2081024 - RNA, 17 nt, Human
ccugugccguccccaga

SEQ ID NO: 2081025 - RNA, 13 nt, Human
ccaaggaugcccc

SEQ ID NO: 2081026 - RNA, 15 nt, Human
uuugauaugugaaca

SEQ ID NO: 2081027 - RNA, 22 nt, Human
gaauuaaguuuuuuuuuaaaaa

SEQ ID NO: 2081028 - RNA, 16 nt, Human
gcgcagcucaggcugg

SEQ ID NO: 2081029 - RNA, 19 nt, Human
cuggccuucggccuccauc

SEQ ID NO: 2081030 - RNA, 23 nt, Human
gucucccucccuuggggccuaug

SEQ ID NO: 2081031 - RNA, 20 nt, Human
aagaugguaccaccagucug

SEQ ID NO: 2081032 - RNA, 18 nt, Human
cugcucaauaaaguacaa

SEQ ID NO: 2081033 - RNA, 22 nt, Human
cacuguccauucuuccucccau

SEQ ID NO: 2081034 - RNA, 22 nt, Human
uauccuacuuccccuuccuaau

SEQ ID NO: 2081035 - RNA, 17 nt, Human
uucucuaggaaauauuu

SEQ ID NO: 2081036 - RNA, 21 nt, Human
uacaugagguacugagaguga

SEQ ID NO: 2081037 - RNA, 22 nt, Human
uuuauugaggcuuuaaaacuua

SEQ ID NO: 2081038 - RNA, 23 nt, Human
gaaaaugucauuguucuugugaa

SEQ ID NO: 2081039 - RNA, 15 nt, Human
cuacaagacacagug

SEQ ID NO: 2081040 - RNA, 12 nt, Human
ucuuaagaagac

SEQ ID NO: 2081041 - RNA, 19 nt, Human
aagcuaugugagcucacca

SEQ ID NO: 2081042 - RNA, 20 nt, Human
acggagccgggaaagaagag

SEQ ID NO: 2081043 - RNA, 15 nt, Human
ugauucaaaugucua

SEQ ID NO: 2081044 - RNA, 24 nt, Human
uggccgggagccugaucaccugcc

SEQ ID NO: 2081045 - RNA, 16 nt, Human
cugcacuccagccuga

SEQ ID NO: 2081046 - RNA, 16 nt, Human
uaaaauccauacauuu

SEQ ID NO: 2081047 - RNA, 13 nt, Human
agccuccagcugc

SEQ ID NO: 2081048 - RNA, 14 nt, Human
aaaagaaacauuug

SEQ ID NO: 2081049 - RNA, 19 nt, Human
acuucccgcuguuccucgc

SEQ ID NO: 2081050 - RNA, 20 nt, Human
ccaucugguccuaagucccu

SEQ ID NO: 2081051 - RNA, 14 nt, Human
cagauuugagcuca

SEQ ID NO: 2081052 - RNA, 17 nt, Human
gaaaaucaggcuggcca

SEQ ID NO: 2081053 - RNA, 17 nt, Human
cgcgagcgcgcgcgccc

SEQ ID NO: 2081054 - RNA, 17 nt, Human
ccaaaagguauuuuaau

SEQ ID NO: 2081055 - RNA, 21 nt, Human
ccuaauuuguuuucccuucuu

SEQ ID NO: 2081056 - RNA, 23 nt, Human
aacuccugcuagaacagucucuu

SEQ ID NO: 2081057 - RNA, 22 nt, Human
uauuucuaugaaauauuauguu

SEQ ID NO: 2081058 - RNA, 16 nt, Human
aagacugcacaucaaa

SEQ ID NO: 2081059 - RNA, 20 nt, Human
ugcugcccuuccccuuccca

SEQ ID NO: 2081060 - RNA, 20 nt, Human
ucuucuggguuccuuccucu

SEQ ID NO: 2081061 - RNA, 17 nt, Human
aaaaguugaauuuuaca

SEQ ID NO: 2081062 - RNA, 16 nt, Human
cagauccccaagccug

SEQ ID NO: 2081063 - RNA, 16 nt, Human
uagaaagccaugugca

SEQ ID NO: 2081064 - RNA, 16 nt, Human
aauuuaguauuuuguu

SEQ ID NO: 2081065 - RNA, 22 nt, Human
acagauuugagcucagcccugg

SEQ ID NO: 2081066 - RNA, 17 nt, Human
cuaguuguaauuuuuuu

SEQ ID NO: 2081067 - RNA, 22 nt, Human
uuaaaaaaaaaacguauugcau

SEQ ID NO: 2081068 - RNA, 22 nt, Human
cccugaauuuaaauagcuuuuu

SEQ ID NO: 2081069 - RNA, 14 nt, Human
gcugguggcucugu

SEQ ID NO: 2081070 - RNA, 22 nt, Human
cacuaguauuucuaugaaauau

SEQ ID NO: 2081071 - RNA, 14 nt, Human
ccuugaugaagaag

SEQ ID NO: 2081072 - RNA, 16 nt, Human
ugauaugugaacaguu

SEQ ID NO: 2081073 - RNA, 14 nt, Human
uauuuauuuuaaua

SEQ ID NO: 2081074 - RNA, 18 nt, Human
auggccacaucugagccc

SEQ ID NO: 2081075 - RNA, 13 nt, Human
aagcuucuguucc

SEQ ID NO: 2081076 - RNA, 18 nt, Human
auaccccuggccaaggaa

SEQ ID NO: 2081077 - RNA, 20 nt, Human
auucccagccagcacagccu

SEQ ID NO: 2081078 - RNA, 17 nt, Human
cgucaacucauauuuuc

SEQ ID NO: 2081079 - RNA, 19 nt, Human
cagagaugaggccgccaug

SEQ ID NO: 2081080 - RNA, 17 nt, Human
uccgucaacucauauuu

SEQ ID NO: 2081081 - RNA, 18 nt, Human
gaagcaaaauuuuuucuc

SEQ ID NO: 2081082 - RNA, 17 nt, Human
augauuaaguaaugaua

SEQ ID NO: 2081083 - RNA, 22 nt, Human
cgcgcgccuccgcuacuuccag

SEQ ID NO: 2081084 - RNA, 21 nt, Human
uuauauauauuuuuuucugaa

SEQ ID NO: 2081085 - RNA, 22 nt, Human
aaguggaacgagacaagcagcc

SEQ ID NO: 2081086 - RNA, 14 nt, Human
agcucguggaacag

SEQ ID NO: 2081087 - RNA, 21 nt, Human
cuggccuucggccuccauccu

SEQ ID NO: 2081088 - RNA, 19 nt, Human
acuccuguucaugcccaua

SEQ ID NO: 2081089 - RNA, 23 nt, Human
agaguuuagcuggaaaaguaugu

SEQ ID NO: 2081090 - RNA, 16 nt, Human
cacuuaaaaaugguuu

SEQ ID NO: 2081091 - RNA, 16 nt, Human
ucuucaacucccugcc

SEQ ID NO: 2081092 - RNA, 20 nt, Human
agcccuuccccucugcagcu

SEQ ID NO: 2081093 - RNA, 19 nt, Human
agcucugcccauccugccc

SEQ ID NO: 2081094 - RNA, 16 nt, Human
uaagaaauaggaaaua

SEQ ID NO: 2081095 - RNA, 13 nt, Human
caucccacccgcc

SEQ ID NO: 2081096 - RNA, 17 nt, Human
caccucccccaucucuu

SEQ ID NO: 2081097 - RNA, 16 nt, Human
uugucaauaaaaucca

SEQ ID NO: 2081098 - RNA, 16 nt, Human
uuaaauagcuuuuuuc

SEQ ID NO: 2081099 - RNA, 15 nt, Human
agguauuuaauaggu

SEQ ID NO: 2081100 - RNA, 14 nt, Human
auagguuuggacaa

SEQ ID NO: 2081101 - RNA, 18 nt, Human
cugcugcccuuccccuuc

SEQ ID NO: 2081102 - RNA, 21 nt, Human
agccucuuagaugcaguucug

SEQ ID NO: 2081103 - RNA, 15 nt, Human
cauguccacugguuc

SEQ ID NO: 2081104 - RNA, 16 nt, Human
ugacacuuaaaaaugg

SEQ ID NO: 2081105 - RNA, 23 nt, Human
cagcugccccggggaggggcgcu

SEQ ID NO: 2081106 - RNA, 19 nt, Human
guacugagagugaacaaau

SEQ ID NO: 2081107 - RNA, 13 nt, Human
auaaaaauauaua

SEQ ID NO: 2081108 - RNA, 16 nt, Human
cuccauccugaggcuc

SEQ ID NO: 2081109 - RNA, 18 nt, Human
cagauaugauucaaaugu

SEQ ID NO: 2081110 - RNA, 12 nt, Human
cuuaagcuuuca

SEQ ID NO: 2081111 - RNA, 17 nt, Human
uccucacuuugaagagu

SEQ ID NO: 2081112 - RNA, 17 nt, Human
cugguccuaagucccug

SEQ ID NO: 2081113 - RNA, 17 nt, Human
ugcccauaccccuggcc

SEQ ID NO: 2081114 - RNA, 21 nt, Human
cacuaucuggguuuugggggg

SEQ ID NO: 2081115 - RNA, 22 nt, Human
aaagcuuugugcagauucuuua

SEQ ID NO: 2081116 - RNA, 17 nt, Human
gaaugagagacacacug

SEQ ID NO: 2081117 - RNA, 19 nt, Human
uguccauucuuccucccau

SEQ ID NO: 2081118 - RNA, 16 nt, Human
agaauauauuuccuua

SEQ ID NO: 2081119 - RNA, 14 nt, Human
auguagaauauauu

SEQ ID NO: 2081120 - RNA, 14 nt, Human
ucuccucaacucug

SEQ ID NO: 2081121 - RNA, 22 nt, Human
aucuauguagaauauauuuccu

SEQ ID NO: 2081122 - RNA, 16 nt, Human
ccaggcugagccucag

SEQ ID NO: 2081123 - RNA, 19 nt, Human
auugaggacacugauaugg

SEQ ID NO: 2081124 - RNA, 20 nt, Human
cucggacggcuccggacgcu

SEQ ID NO: 2081125 - RNA, 18 nt, Human
cagagucaagggugugug

SEQ ID NO: 2081126 - RNA, 22 nt, Human
agaugaucaguaugaaaauguc

SEQ ID NO: 2081127 - RNA, 12 nt, Human
ugugaggagcug

SEQ ID NO: 2081128 - RNA, 18 nt, Human
uucagcagagaaguuuuc

SEQ ID NO: 2081129 - RNA, 12 nt, Human
cugcccuucccc

SEQ ID NO: 2081130 - RNA, 22 nt, Human
ggguuccuuccucugagccuug

SEQ ID NO: 2081131 - RNA, 14 nt, Human
gccgcgcuccucgg

SEQ ID NO: 2081132 - RNA, 17 nt, Human
auaaaguaugugcauau

SEQ ID NO: 2081133 - RNA, 17 nt, Human
augcuguucaugaaaga

SEQ ID NO: 2081134 - RNA, 21 nt, Human
guuuguuuauuuguuuuucca

SEQ ID NO: 2081135 - RNA, 23 nt, Human
aguuauuuuuaauuugguuuuca

SEQ ID NO: 2081136 - RNA, 13 nt, Human
guuuaaguucuau

SEQ ID NO: 2081137 - RNA, 17 nt, Human
cccacuagacccacugg

SEQ ID NO: 2081138 - RNA, 17 nt, Human
cuacaggccccaucugg

SEQ ID NO: 2081139 - RNA, 17 nt, Human
cuggagggaagccuugg

SEQ ID NO: 2081140 - RNA, 19 nt, Human
agacucgggauuaguacac

SEQ ID NO: 2081141 - RNA, 14 nt, Human
auuuguauaaaaua

SEQ ID NO: 2081142 - RNA, 14 nt, Human
cugucucaguccau

SEQ ID NO: 2081143 - RNA, 20 nt, Human
ggcuaauaucuuaucuuccu

SEQ ID NO: 2081144 - RNA, 19 nt, Human
acagugauuaccagggacu

SEQ ID NO: 2081145 - RNA, 21 nt, Human
cuagucuguuuucccuccuug

SEQ ID NO: 2081146 - RNA, 16 nt, Human
gcaucccuagaaagcc

SEQ ID NO: 2081147 - RNA, 21 nt, Human
gaagucacauuccugaacagg

SEQ ID NO: 2081148 - RNA, 14 nt, Human
cucagucucccucc

SEQ ID NO: 2081149 - RNA, 16 nt, Human
ccucaaaacuucagac

SEQ ID NO: 2081150 - RNA, 20 nt, Human
auacucuuauaucuauauuu

SEQ ID NO: 2081151 - RNA, 13 nt, Human
uuuguuucagugc

SEQ ID NO: 2081152 - RNA, 21 nt, Human
uugccuaggcauagcccugcc

SEQ ID NO: 2081153 - RNA, 14 nt, Human
cugccagcuggccu

SEQ ID NO: 2081154 - RNA, 16 nt, Human
gaguuccuucugcucc

SEQ ID NO: 2081155 - RNA, 18 nt, Human
ggaaacaagucagucauu

SEQ ID NO: 2081156 - RNA, 21 nt, Human
ucccuggggcuuuaacuccug

SEQ ID NO: 2081157 - RNA, 22 nt, Human
uuuauggcacuaguauuucuau

SEQ ID NO: 2081158 - RNA, 19 nt, Human
uacaaaaaaaaaaaaaaau

SEQ ID NO: 2081159 - RNA, 23 nt, Human
auuccugaacaggauauucucac

SEQ ID NO: 2081160 - RNA, 15 nt, Human
cccaucucaggugug

SEQ ID NO: 2081161 - RNA, 21 nt, Human
cagcucaggcuggcaccgcug

SEQ ID NO: 2081162 - RNA, 21 nt, Human
gaugcccacggcuggagcugc

SEQ ID NO: 2081163 - RNA, 22 nt, Human
gcgcggcgggagggcgcggggc

SEQ ID NO: 2081164 - RNA, 19 nt, Human
acagucaccucauggaauu

SEQ ID NO: 2081165 - RNA, 20 nt, Human
cggcccugugcggccugguc

SEQ ID NO: 2081166 - RNA, 16 nt, Human
cugcugagucccaggc

SEQ ID NO: 2081167 - RNA, 16 nt, Human
cucucuuccucccugg

SEQ ID NO: 2081168 - RNA, 13 nt, Human
aaguucuagugac

SEQ ID NO: 2081169 - RNA, 22 nt, Human
uugccuaggcauagcccugccu

SEQ ID NO: 2081170 - RNA, 13 nt, Human
cuuagcccuuccc

SEQ ID NO: 2081171 - RNA, 20 nt, Human
auauguuagagaauuuccuu

SEQ ID NO: 2081172 - RNA, 13 nt, Human
aggcuagauguau

SEQ ID NO: 2081173 - RNA, 17 nt, Human
guccaaagggcaugggu

SEQ ID NO: 2081174 - RNA, 21 nt, Human
aucuuuuuuuuaauaaaccau

SEQ ID NO: 2081175 - RNA, 19 nt, Human
aucuauguagaauauauuu

SEQ ID NO: 2081176 - RNA, 14 nt, Human
uuuguauaaaauaa

SEQ ID NO: 2081177 - RNA, 20 nt, Human
uuaaauggucaauuuuguua

SEQ ID NO: 2081178 - RNA, 18 nt, Human
ccuugggaccccugagcu

SEQ ID NO: 2081179 - RNA, 14 nt, Human
aagugugacucauu

SEQ ID NO: 2081180 - RNA, 12 nt, Human
cuuaucuuccua

SEQ ID NO: 2081181 - RNA, 15 nt, Human
aaaacaggcaaauuc

SEQ ID NO: 2081182 - RNA, 20 nt, Human
acggcuccggacgcugcugc

SEQ ID NO: 2081183 - RNA, 14 nt, Human
ggccgggagccuga

SEQ ID NO: 2081184 - RNA, 19 nt, Human
ggcugcugguggcgcuggc

SEQ ID NO: 2081185 - RNA, 17 nt, Human
uucacuuuuauaagaaa

SEQ ID NO: 2081186 - RNA, 15 nt, Human
uuuuaggaauacaua

SEQ ID NO: 2081187 - RNA, 20 nt, Human
gcccauccugccccugagcc

SEQ ID NO: 2081188 - RNA, 22 nt, Human
uuuccaagcaaguauuagaaua

SEQ ID NO: 2081189 - RNA, 15 nt, Human
ucccccaucucuucu

SEQ ID NO: 2081190 - RNA, 14 nt, Human
cagagucaagggug

SEQ ID NO: 2081191 - RNA, 14 nt, Human
guccacaaguaaaa

SEQ ID NO: 2081192 - RNA, 17 nt, Human
gucucagcuucacccug

SEQ ID NO: 2081193 - RNA, 22 nt, Human
gcuccgcgcagcucaggcuggc

SEQ ID NO: 2081194 - RNA, 21 nt, Human
uguauaaaauaauuuuuauau

SEQ ID NO: 2081195 - RNA, 19 nt, Human
cuucuggguuccuuccucu

SEQ ID NO: 2081196 - RNA, 15 nt, Human
aaauaauuuuuauau

SEQ ID NO: 2081197 - RNA, 21 nt, Human
aauaauguuucaaacauauau

SEQ ID NO: 2081198 - RNA, 14 nt, Human
cucugccucagaaa

SEQ ID NO: 2081199 - RNA, 23 nt, Human
uaagaaauaggaaauauuuuaau

SEQ ID NO: 2081200 - RNA, 17 nt, Human
agaacucccuuucaaca

SEQ ID NO: 2081201 - RNA, 19 nt, Human
gaggcagagguugcaguga

SEQ ID NO: 2081202 - RNA, 21 nt, Human
ccuuccccucugcagcuucca

SEQ ID NO: 2081203 - RNA, 21 nt, Human
caaagcccagcuugaaaccuu

SEQ ID NO: 2081204 - RNA, 22 nt, Human
cacagauuugagcucagcccug

SEQ ID NO: 2081205 - RNA, 12 nt, Human
guugauggaaau

SEQ ID NO: 2081206 - RNA, 21 nt, Human
gucucagugucaaugcagccc

SEQ ID NO: 2081207 - RNA, 18 nt, Human
cccgggccgacggagccg

SEQ ID NO: 2081208 - RNA, 13 nt, Human
ugguccuaagucc

SEQ ID NO: 2081209 - RNA, 18 nt, Human
auuuauuacuguaagaaa

SEQ ID NO: 2081210 - RNA, 21 nt, Human
ugguccuaagucccugcugcc

SEQ ID NO: 2081211 - RNA, 20 nt, Human
gaaauacacuguuaucuuca

SEQ ID NO: 2081212 - RNA, 18 nt, Human
aauaucaguuauuuuuaa

SEQ ID NO: 2081213 - RNA, 18 nt, Human
ggaccaucccggccggcg

SEQ ID NO: 2081214 - RNA, 23 nt, Human
caggaaucacuggcuguuaaucu

SEQ ID NO: 2081215 - RNA, 20 nt, Human
agcagcccuuagcccuuccc

SEQ ID NO: 2081216 - RNA, 19 nt, Human
guacaagagcuuaacagug

SEQ ID NO: 2081217 - RNA, 18 nt, Human
ccugcaaagcccagcuug

SEQ ID NO: 2081218 - RNA, 15 nt, Human
cuuaagaagacugca

SEQ ID NO: 2081219 - RNA, 19 nt, Human
cuguuauuuuaucugcuau

SEQ ID NO: 2081220 - RNA, 16 nt, Human
ccugccccccagcccu

SEQ ID NO: 2081221 - RNA, 15 nt, Human
cgagacaagcagccc

SEQ ID NO: 2081222 - RNA, 20 nt, Human
gcgcgcucaucccacccgcc

SEQ ID NO: 2081223 - RNA, 17 nt, Human
agcgacagugagacucu

SEQ ID NO: 2081224 - RNA, 16 nt, Human
auaucaauuuaaaaaa

SEQ ID NO: 2081225 - RNA, 16 nt, Human
uggggauagugaggca

SEQ ID NO: 2081226 - RNA, 21 nt, Human
ugcuggccaccugcugagccc

SEQ ID NO: 2081227 - RNA, 17 nt, Human
auucagaauuucuaaaa

SEQ ID NO: 2081228 - RNA, 15 nt, Human
agagacagaaagcag

SEQ ID NO: 2081229 - RNA, 18 nt, Human
cccaagccuggcaaggga

SEQ ID NO: 2081230 - RNA, 13 nt, Human
acacuuaaaaaug

SEQ ID NO: 2081231 - RNA, 18 nt, Human
ccggagccuccagcugcc

SEQ ID NO: 2081232 - RNA, 20 nt, Human
ggccaugggacagggaggac

SEQ ID NO: 2081233 - RNA, 19 nt, Human
ccccuauccuacuuccccu

SEQ ID NO: 2081234 - RNA, 16 nt, Human
caugggacagggagga

SEQ ID NO: 2081235 - RNA, 17 nt, Human
gggaaauccacacugag

SEQ ID NO: 2081236 - RNA, 16 nt, Human
ucaaaagaaagaaaau

SEQ ID NO: 2081237 - RNA, 17 nt, Human
uguucuaagaagugaaa

SEQ ID NO: 2081238 - RNA, 18 nt, Human
ucaacucauauuuucaug

SEQ ID NO: 2081239 - RNA, 22 nt, Human
acaugagguacugagagugaac

SEQ ID NO: 2081240 - RNA, 21 nt, Human
uaguauuucuaugaaauauua

SEQ ID NO: 2081241 - RNA, 21 nt, Human
acaagaaggaaagauuuuguu

SEQ ID NO: 2081242 - RNA, 16 nt, Human
uaccccuggccaagga

SEQ ID NO: 2081243 - RNA, 17 nt, Human
gcgcucaucccacccgc

SEQ ID NO: 2081244 - RNA, 13 nt, Human
uauauauuuuuuu

SEQ ID NO: 2081245 - RNA, 14 nt, Human
ccaugggacaggga

SEQ ID NO: 2081246 - RNA, 15 nt, Human
auuucauucaauauc

SEQ ID NO: 2081247 - RNA, 16 nt, Human
cuuuaugcuaagugaa

SEQ ID NO: 2081248 - RNA, 16 nt, Human
auuuuuuuuuuuaaaa

SEQ ID NO: 2081249 - RNA, 13 nt, Human
agcgacagugaga

SEQ ID NO: 2081250 - RNA, 19 nt, Human
auaucaguuauuuuuaaac

SEQ ID NO: 2081251 - RNA, 20 nt, Human
guguggaaggugaucuggcu

SEQ ID NO: 2081252 - RNA, 14 nt, Human
gagcucagcccugg

SEQ ID NO: 2081253 - RNA, 15 nt, Human
gugaccacugcagaa

SEQ ID NO: 2081254 - RNA, 16 nt, Human
agaugagagaacaggg

SEQ ID NO: 2081255 - RNA, 15 nt, Human
cccugccccccagcc

SEQ ID NO: 2081256 - RNA, 16 nt, Human
ucugcagauaaacagu

SEQ ID NO: 2081257 - RNA, 17 nt, Human
uaauuccacagcugcuc

SEQ ID NO: 2081258 - RNA, 12 nt, Human
gcaaagcccagc

SEQ ID NO: 2081259 - RNA, 13 nt, Human
uccagcugccccg

SEQ ID NO: 2081260 - RNA, 24 nt, Human
cuggcuaauuagcauggccacauc

SEQ ID NO: 2081261 - RNA, 14 nt, Human
caccaaccuucuga

SEQ ID NO: 2081262 - RNA, 17 nt, Human
aguauuucuaugaaaua

SEQ ID NO: 2081263 - RNA, 23 nt, Human
ugccccggggaggggcgcucgcu

SEQ ID NO: 2081264 - RNA, 19 nt, Human
cuguacgcgagcgcgcgcg

SEQ ID NO: 2081265 - RNA, 22 nt, Human
gaugguucccuugaugaagaag

SEQ ID NO: 2081266 - RNA, 23 nt, Human
gucucagcuucacccugagguga

SEQ ID NO: 2081267 - RNA, 21 nt, Human
ucauucagauaugauucaaau

SEQ ID NO: 2081268 - RNA, 19 nt, Human
ccaccugccuauauuuuuu

SEQ ID NO: 2081269 - RNA, 16 nt, Human
ugcagugucugcugga

SEQ ID NO: 2081270 - RNA, 18 nt, Human
cccacuagacccacugga

SEQ ID NO: 2081271 - RNA, 19 nt, Human
cuucuuacaaugcauucug

SEQ ID NO: 2081272 - RNA, 16 nt, Human
auacuauuuaauuauu

SEQ ID NO: 2081273 - RNA, 16 nt, Human
cccuauccuacuuccc

SEQ ID NO: 2081274 - RNA, 17 nt, Human
augcccacggcuggagc

SEQ ID NO: 2081275 - RNA, 14 nt, Human
uuuuauaagaaaua

SEQ ID NO: 2081276 - RNA, 19 nt, Human
acauuuguauaaaauaauu

SEQ ID NO: 2081277 - RNA, 20 nt, Human
acaaugacuuguacucugaa

SEQ ID NO: 2081278 - RNA, 17 nt, Human
gccugagcgacagugag

SEQ ID NO: 2081279 - RNA, 14 nt, Human
ucuuccucccauuc

SEQ ID NO: 2081280 - RNA, 14 nt, Human
aaaagaaagaaaau

SEQ ID NO: 2081281 - RNA, 17 nt, Human
gccccccagcccuccuu

SEQ ID NO: 2081282 - RNA, 23 nt, Human
cacuggacucaccucccccaucu

SEQ ID NO: 2081283 - RNA, 13 nt, Human
ccucuggcuccag

SEQ ID NO: 2081284 - RNA, 12 nt, Human
uuuuauauuuga

SEQ ID NO: 2081285 - RNA, 12 nt, Human
acucccugcccc

SEQ ID NO: 2081286 - RNA, 15 nt, Human
cacaggacagcccuu

SEQ ID NO: 2081287 - RNA, 12 nt, Human
aggggcgcucgc

SEQ ID NO: 2081288 - RNA, 16 nt, Human
acuuuuauaagaaaua

SEQ ID NO: 2081289 - RNA, 15 nt, Human
aaagaaagaaaauca

SEQ ID NO: 2081290 - RNA, 19 nt, Human
auaauuuuuauauuugaaa

SEQ ID NO: 2081291 - RNA, 17 nt, Human
ccacugcagaagacagu

SEQ ID NO: 2081292 - RNA, 23 nt, Human
cccggccggcgcgcucaucccac

SEQ ID NO: 2081293 - RNA, 21 nt, Human
cccccucuggcuccagcuggc

SEQ ID NO: 2081294 - RNA, 22 nt, Human
cuuccuaauuccacagcugcuc

SEQ ID NO: 2081295 - RNA, 14 nt, Human
ccugccccccagcc

SEQ ID NO: 2081296 - RNA, 18 nt, Human
aagaaauaggaaauauuu

SEQ ID NO: 2081297 - RNA, 15 nt, Human
cuaguaauuggaaag

SEQ ID NO: 2081298 - RNA, 14 nt, Human
cuguaaucacagcu

SEQ ID NO: 2081299 - RNA, 23 nt, Human
ucaugcccauaccccuggccaag

SEQ ID NO: 2081300 - RNA, 18 nt, Human
ugaagagugugaggaaaa

SEQ ID NO: 2081301 - RNA, 23 nt, Human
cucuacuaaaaauacaaaaaaaa

SEQ ID NO: 2081302 - RNA, 14 nt, Human
gaucuaugccacaa

SEQ ID NO: 2081303 - RNA, 20 nt, Human
caagcucuaucaccaaggag

SEQ ID NO: 2081304 - RNA, 19 nt, Human
ucgcccacuuccucccggc

SEQ ID NO: 2081305 - RNA, 22 nt, Human
aauuguaggugacuauuauauu

SEQ ID NO: 2081306 - RNA, 15 nt, Human
gcagagguugcagug

SEQ ID NO: 2081307 - RNA, 20 nt, Human
ucgcaggaccaucccggccg

SEQ ID NO: 2081308 - RNA, 22 nt, Human
agggagucucagcuucacccug

SEQ ID NO: 2081309 - RNA, 20 nt, Human
acaccuuaucuauguagaau

SEQ ID NO: 2081310 - RNA, 13 nt, Human
uaauuuuuauauu

SEQ ID NO: 2081311 - RNA, 17 nt, Human
cauuaaaguucuaguga

SEQ ID NO: 2081312 - RNA, 14 nt, Human
uuucugaaauuucc

SEQ ID NO: 2081313 - RNA, 22 nt, Human
uuauaagaaauaggaaauauuu

SEQ ID NO: 2081314 - RNA, 13 nt, Human
auuuuaaaagaau

SEQ ID NO: 2081315 - RNA, 20 nt, Human
gacggcuccggacgcugcug

SEQ ID NO: 2081316 - RNA, 20 nt, Human
cugagguuguguguggaagg

SEQ ID NO: 2081317 - RNA, 19 nt, Human
cauuguugucugcaacucu

SEQ ID NO: 2081318 - RNA, 18 nt, Human
ccacuuggucugugagau

SEQ ID NO: 2081319 - RNA, 21 nt, Human
aaugucauuguucuugugaac

SEQ ID NO: 2081320 - RNA, 13 nt, Human
cauuuguauaaaa

SEQ ID NO: 2081321 - RNA, 22 nt, Human
caagcucuaucaccaaggagcc

SEQ ID NO: 2081322 - RNA, 23 nt, Human
gccccugcacuccagccugagcg

SEQ ID NO: 2081323 - RNA, 22 nt, Human
cugccaaaacaucaaccugcca

SEQ ID NO: 2081324 - RNA, 18 nt, Human
cuaauuagcauggccaca

SEQ ID NO: 2081325 - RNA, 23 nt, Human
uuagaugcaguucugaagaagau

SEQ ID NO: 2081326 - RNA, 15 nt, Human
gccuaauuuguuuuc

SEQ ID NO: 2081327 - RNA, 23 nt, Human
ucuaggacugaauuaugaaacuu

SEQ ID NO: 2081328 - RNA, 12 nt, Human
caggacagcccu

SEQ ID NO: 2081329 - RNA, 16 nt, Human
uauaucaauuuaaaaa

SEQ ID NO: 2081330 - RNA, 14 nt, Human
cuuuuaguuuuuaa

SEQ ID NO: 2081331 - RNA, 20 nt, Human
ucugaaaguuuuggaaacgu

SEQ ID NO: 2081332 - RNA, 15 nt, Human
ugcagauaaacagua

SEQ ID NO: 2081333 - RNA, 14 nt, Human
ggggcggggagcga

SEQ ID NO: 2081334 - RNA, 12 nt, Human
ccccuugccaua

SEQ ID NO: 2081335 - RNA, 22 nt, Human
ggacagcccuucuuuccacaga

SEQ ID NO: 2081336 - RNA, 18 nt, Human
gcacuccagccugagcga

SEQ ID NO: 2081337 - RNA, 16 nt, Human
ggcgggagggcgcggg

SEQ ID NO: 2081338 - RNA, 16 nt, Human
cucagcccuggugggc

SEQ ID NO: 2081339 - RNA, 19 nt, Human
aaugagcacgcauggaaaa

SEQ ID NO: 2081340 - RNA, 17 nt, Human
gccaugggacagggagg

SEQ ID NO: 2081341 - RNA, 12 nt, Human
ucuacacuccag

SEQ ID NO: 2081342 - RNA, 21 nt, Human
cgaaguauccuucagccugaa

SEQ ID NO: 2081343 - RNA, 18 nt, Human
gcagcccuuagcccuucc

SEQ ID NO: 2081344 - RNA, 19 nt, Human
uccccuauccuacuucccc

SEQ ID NO: 2081345 - RNA, 18 nt, Human
aaaaguucugcagauaaa

SEQ ID NO: 2081346 - RNA, 16 nt, Human
uggaaacgaagcacca

SEQ ID NO: 2081347 - RNA, 13 nt, Human
gggcggggagcga

SEQ ID NO: 2081348 - RNA, 21 nt, Human
uuuauauaagcuuguauuccu

SEQ ID NO: 2081349 - RNA, 22 nt, Human
aucucuucuggguuccuuccuc

SEQ ID NO: 2081350 - RNA, 15 nt, Human
ugcuguauuuuaaaa

SEQ ID NO: 2081351 - RNA, 17 nt, Human
agguccacaacacacag

SEQ ID NO: 2081352 - RNA, 15 nt, Human
ccuguucgcgcgccu

SEQ ID NO: 2081353 - RNA, 21 nt, Human
uauuacuguaagaaaauauca

SEQ ID NO: 2081354 - RNA, 19 nt, Human
ugaacaaauuuacagagac

SEQ ID NO: 2081355 - RNA, 16 nt, Human
gcugcugguggcgcug

SEQ ID NO: 2081356 - RNA, 14 nt, Human
guccauugggcagg

SEQ ID NO: 2081357 - RNA, 12 nt, Human
guagacacacau

SEQ ID NO: 2081358 - RNA, 12 nt, Human
aaaaaaacguau

SEQ ID NO: 2081359 - RNA, 17 nt, Human
uugcaguuuuuuccuag

SEQ ID NO: 2081360 - RNA, 23 nt, Human
ucaaugccccugaauuuaaauag

SEQ ID NO: 2081361 - RNA, 13 nt, Human
agcucugcccauc

SEQ ID NO: 2081362 - RNA, 14 nt, Human
ucaacucauauuuu

SEQ ID NO: 2081363 - RNA, 17 nt, Human
ucagacauagaauuaac

SEQ ID NO: 2081364 - RNA, 13 nt, Human
cugaaauuuccug

SEQ ID NO: 2081365 - RNA, 23 nt, Human
cagagguugcagugagccgagau

SEQ ID NO: 2081366 - RNA, 20 nt, Human
aauuuuuucucuaggaaaua

SEQ ID NO: 2081367 - RNA, 21 nt, Human
uccuacaagacacagugacca

SEQ ID NO: 2081368 - RNA, 17 nt, Human
cucagucucccucccuu

SEQ ID NO: 2081369 - RNA, 19 nt, Human
auucccagccagcacagcc

SEQ ID NO: 2081370 - RNA, 15 nt, Human
uauauauauauauuu

SEQ ID NO: 2081371 - RNA, 14 nt, Human
uggccaccugcuga

SEQ ID NO: 2081372 - RNA, 21 nt, Human
uucagcucagcuaaugaagug

SEQ ID NO: 2081373 - RNA, 12 nt, Human
aaugcagccccc

SEQ ID NO: 2081374 - RNA, 14 nt, Human
gccccaucuggucc

SEQ ID NO: 2081375 - RNA, 13 nt, Human
cucgccacgcucu

SEQ ID NO: 2081376 - RNA, 20 nt, Human
guauuuaauagguuuggaca

SEQ ID NO: 2081377 - RNA, 16 nt, Human
gagaaacuggaacucu

SEQ ID NO: 2081378 - RNA, 19 nt, Human
caaggaugccccguccccc

SEQ ID NO: 2081379 - RNA, 15 nt, Human
cugccagcuggccuu

SEQ ID NO: 2081380 - RNA, 15 nt, Human
cauuuacuuuuaaac

SEQ ID NO: 2081381 - RNA, 13 nt, Human
uuuaaaaaaaaac

SEQ ID NO: 2081382 - RNA, 21 nt, Human
cuguuaucuucacuuuuauaa

SEQ ID NO: 2081383 - RNA, 14 nt, Human
ugacacuuaaaaau

SEQ ID NO: 2081384 - RNA, 15 nt, Human
ucaagggugugugca

SEQ ID NO: 2081385 - RNA, 16 nt, Human
cccuuuacccccauga

SEQ ID NO: 2081386 - RNA, 20 nt, Human
uaauucugguagcuaaauau

SEQ ID NO: 2081387 - RNA, 16 nt, Human
augcuaagugaaauaa

SEQ ID NO: 2081388 - RNA, 18 nt, Human
aaggaugccccguccccc

SEQ ID NO: 2081389 - RNA, 19 nt, Human
augaaguacucauacaugu

SEQ ID NO: 2081390 - RNA, 17 nt, Human
cguaaucguguccccua

SEQ ID NO: 2081391 - RNA, 16 nt, Human
auuccuuaagauauua

SEQ ID NO: 2081392 - RNA, 18 nt, Human
ccaagccuggcaagggaa

SEQ ID NO: 2081393 - RNA, 19 nt, Human
gcugcccuuccccuuccca

SEQ ID NO: 2081394 - RNA, 15 nt, Human
agugacaagcucaca

SEQ ID NO: 2081395 - RNA, 16 nt, Human
guucugcacacagcac

SEQ ID NO: 2081396 - RNA, 12 nt, Human
cauguuccccuu

SEQ ID NO: 2081397 - RNA, 19 nt, Human
gucaaauugugugaaaggu

SEQ ID NO: 2081398 - RNA, 21 nt, Human
aaugaauggcuaagcaaaaug

SEQ ID NO: 2081399 - RNA, 14 nt, Human
gaaacgaagcacca

SEQ ID NO: 2081400 - RNA, 17 nt, Human
agucugacuguuuccau

SEQ ID NO: 2081401 - RNA, 16 nt, Human
aaauccacacugagcu

SEQ ID NO: 2081402 - RNA, 15 nt, Human
cuaagcaaaauguga

SEQ ID NO: 2081403 - RNA, 14 nt, Human
cggacggcuccgga

SEQ ID NO: 2081404 - RNA, 22 nt, Human
cugaggcuccacuuggucugug

SEQ ID NO: 2081405 - RNA, 15 nt, Human
aucuuuaacccacua

SEQ ID NO: 2081406 - RNA, 23 nt, Human
agucccugcugcccuuccccuuc

SEQ ID NO: 2081407 - RNA, 23 nt, Human
uuucccaucucagguguguugca

SEQ ID NO: 2081408 - RNA, 14 nt, Human
gacggagccgggaa

SEQ ID NO: 2081409 - RNA, 22 nt, Human
ugguccuaagucccugcugccc

SEQ ID NO: 2081410 - RNA, 16 nt, Human
acuuguuuuauuuaac

SEQ ID NO: 2081411 - RNA, 16 nt, Human
auaguaccucugcuau

SEQ ID NO: 2081412 - RNA, 15 nt, Human
aaaaaagaaacauuu

SEQ ID NO: 2081413 - RNA, 23 nt, Human
gcuggcgugcagcaucagcaucc

SEQ ID NO: 2081414 - RNA, 22 nt, Human
auaacaaugcuguauuuuaaaa

SEQ ID NO: 2081415 - RNA, 19 nt, Human
ccagaucuaugccacaaga

SEQ ID NO: 2081416 - RNA, 17 nt, Human
acuuccagauccuggaa

SEQ ID NO: 2081417 - RNA, 14 nt, Human
ugagcucagcccug

SEQ ID NO: 2081418 - RNA, 20 nt, Human
ugagcgcccacuagacccac

SEQ ID NO: 2081419 - RNA, 23 nt, Human
cuucaacucccugccccccagcc

SEQ ID NO: 2081420 - RNA, 12 nt, Human
gcccccgggccg

SEQ ID NO: 2081421 - RNA, 23 nt, Human
cuuuccaauaaagaguuccuucu

SEQ ID NO: 2081422 - RNA, 18 nt, Human
gaugcaguucugaagaag

SEQ ID NO: 2081423 - RNA, 23 nt, Human
cucagucucccucccuuggggcc

SEQ ID NO: 2081424 - RNA, 14 nt, Human
agggcuaauaucuu

SEQ ID NO: 2081425 - RNA, 12 nt, Human
cauaaaguaugu

SEQ ID NO: 2081426 - RNA, 16 nt, Human
agcuacaggccccauc

SEQ ID NO: 2081427 - RNA, 15 nt, Human
gcugguggcgcuggc

SEQ ID NO: 2081428 - RNA, 19 nt, Human
augcagagguccacaacac

SEQ ID NO: 2081429 - RNA, 15 nt, Human
ggacucaccuccccc

SEQ ID NO: 2081430 - RNA, 22 nt, Human
acagaaaaguugaauuuuacau

SEQ ID NO: 2081431 - RNA, 17 nt, Human
ccugccccccagcccuc

SEQ ID NO: 2081432 - RNA, 19 nt, Human
augugcauauuuuauuaua

SEQ ID NO: 2081433 - RNA, 14 nt, Human
acacugaagaagca

SEQ ID NO: 2081434 - RNA, 21 nt, Human
cccacuggacucaccuccccc

SEQ ID NO: 2081435 - RNA, 17 nt, Human
gccuaagugcagccccg

SEQ ID NO: 2081436 - RNA, 18 nt, Human
cugagaccaaggcccccg

SEQ ID NO: 2081437 - RNA, 18 nt, Human
uuuaguuauaaaaauaua

SEQ ID NO: 2081438 - RNA, 16 nt, Human
aucaaguuauuuuuaa

SEQ ID NO: 2081439 - RNA, 18 nt, Human
aagggaauuucuucaacu

SEQ ID NO: 2081440 - RNA, 23 nt, Human
aggaccggccuuugcaccuccau

SEQ ID NO: 2081441 - RNA, 21 nt, Human
gccugaucaccugcccugcug

SEQ ID NO: 2081442 - RNA, 14 nt, Human
ggacucaccucccc

SEQ ID NO: 2081443 - RNA, 17 nt, Human
ugcagcgaguacuuccc

SEQ ID NO: 2081444 - RNA, 17 nt, Human
agaaaugaaagcaggga

SEQ ID NO: 2081445 - RNA, 13 nt, Human
ccuuccccuuccc

SEQ ID NO: 2081446 - RNA, 14 nt, Human
ugcuguauuuuaaa

SEQ ID NO: 2081447 - RNA, 22 nt, Human
agacucgggauuaguacacacu

SEQ ID NO: 2081448 - RNA, 18 nt, Human
cugcccuuccccuuccca

SEQ ID NO: 2081449 - RNA, 17 nt, Human
accugagccccaaaagg

SEQ ID NO: 2081450 - RNA, 20 nt, Human
gcagagaugaggccgccaug

SEQ ID NO: 2081451 - RNA, 18 nt, Human
acggcuccggacgcugcu

SEQ ID NO: 2081452 - RNA, 16 nt, Human
auauuuccaagaaaua

SEQ ID NO: 2081453 - RNA, 19 nt, Human
uaucacuugucaauaaaau

SEQ ID NO: 2081454 - RNA, 17 nt, Human
aaagaaacauuugguaa

SEQ ID NO: 2081455 - RNA, 16 nt, Human
cacuuuccaauaaaga

SEQ ID NO: 2081456 - RNA, 19 nt, Human
uguggauuuaauguggaaa

SEQ ID NO: 2081457 - RNA, 12 nt, Human
caacccaaaugu

SEQ ID NO: 2081458 - RNA, 15 nt, Human
cuucugaggagcugu

SEQ ID NO: 2081459 - RNA, 12 nt, Human
aucguguccccu

SEQ ID NO: 2081460 - RNA, 15 nt, Human
uuaauuuguaguguu

SEQ ID NO: 2081461 - RNA, 21 nt, Human
uggggaauauguuagagaauu

SEQ ID NO: 2081462 - RNA, 18 nt, Human
uccaggcuggcgugcagc

SEQ ID NO: 2081463 - RNA, 21 nt, Human
aagaaauaggaaauauuuuaa

SEQ ID NO: 2081464 - RNA, 16 nt, Human
uauaaauuuaucauuu

SEQ ID NO: 2081465 - RNA, 22 nt, Human
cgcgcagcucaggcuggcaccg

SEQ ID NO: 2081466 - RNA, 21 nt, Human
ccgacggagccgggaaagaag

SEQ ID NO: 2081467 - RNA, 19 nt, Human
uccagaaagugacaagcuc

SEQ ID NO: 2081468 - RNA, 14 nt, Human
auggaaguaaaugu

SEQ ID NO: 2081469 - RNA, 23 nt, Human
caacacccugagguugugugugg

SEQ ID NO: 2081470 - RNA, 23 nt, Human
caaauacgugggcauucaaaugu

SEQ ID NO: 2081471 - RNA, 15 nt, Human
ugcuucuguuuuaua

SEQ ID NO: 2081472 - RNA, 15 nt, Human
agggaagacaagaag

SEQ ID NO: 2081473 - RNA, 13 nt, Human
cuuccucccauuc

SEQ ID NO: 2081474 - RNA, 23 nt, Human
acuuuccaauaaagaguuccuuc

SEQ ID NO: 2081475 - RNA, 23 nt, Human
uugacccucacaggagcaucucc

SEQ ID NO: 2081476 - RNA, 20 nt, Human
cacuagacccacuggacuca

SEQ ID NO: 2081477 - RNA, 20 nt, Human
uaggaauugacccacaagaa

SEQ ID NO: 2081478 - RNA, 17 nt, Human
aaucuuucacaggggac

SEQ ID NO: 2081479 - RNA, 23 nt, Human
caucaacagauaaauaguuuaug

SEQ ID NO: 2081480 - RNA, 21 nt, Human
uuuuaauuugguuuucacauu

SEQ ID NO: 2081481 - RNA, 18 nt, Human
gaugccccgucccccucu

SEQ ID NO: 2081482 - RNA, 17 nt, Human
gacagucaccucaugga

SEQ ID NO: 2081483 - RNA, 12 nt, Human
cggccggcgcgc

SEQ ID NO: 2081484 - RNA, 19 nt, Human
aauuugauaugugaacagu

SEQ ID NO: 2081485 - RNA, 14 nt, Human
agguugcagugagc

SEQ ID NO: 2081486 - RNA, 19 nt, Human
uuuuaucugcuaugcuauu

SEQ ID NO: 2081487 - RNA, 20 nt, Human
gaagagccggagccuccagc

SEQ ID NO: 2081488 - RNA, 23 nt, Human
aucuaugccacaagaacccccuu

SEQ ID NO: 2081489 - RNA, 19 nt, Human
uuguacucugaaaguuuug

SEQ ID NO: 2081490 - RNA, 14 nt, Human
aauggcuaagcaaa

SEQ ID NO: 2081491 - RNA, 15 nt, Human
gucaaugcagccccc

SEQ ID NO: 2081492 - RNA, 23 nt, Human
ccacaccaaccuucugaggagcu

SEQ ID NO: 2081493 - RNA, 16 nt, Human
uagagaauuuccuuac

SEQ ID NO: 2081494 - RNA, 14 nt, Human
accacaagacugca

SEQ ID NO: 2081495 - RNA, 15 nt, Human
gccccugcacuccag

SEQ ID NO: 2081496 - RNA, 19 nt, Human
cucaagcuaugugagcuca

SEQ ID NO: 2081497 - RNA, 18 nt, Human
ugagccaccaagcuggug

SEQ ID NO: 2081498 - RNA, 17 nt, Human
cucugauccgagcucag

SEQ ID NO: 2081499 - RNA, 14 nt, Human
acuggacucaccuc

SEQ ID NO: 2081500 - RNA, 21 nt, Human
ccauccugccccugagcccau

SEQ ID NO: 2081501 - RNA, 18 nt, Human
ugcuauuuauuaaguauu

SEQ ID NO: 2081502 - RNA, 15 nt, Human
agccgggaaagaaga

SEQ ID NO: 2081503 - RNA, 16 nt, Human
uuccgcauccuagucu

SEQ ID NO: 2081504 - RNA, 20 nt, Human
ccuguucgcgcgccuccgcu

SEQ ID NO: 2081505 - RNA, 20 nt, Human
gaccauacuaauuauacccc

SEQ ID NO: 2081506 - RNA, 12 nt, Human
uaccuccaagga

SEQ ID NO: 2081507 - RNA, 17 nt, Human
aguuuauauagaaaugu

SEQ ID NO: 2081508 - RNA, 16 nt, Human
uccucacuuugaagag

SEQ ID NO: 2081509 - RNA, 23 nt, Human
ccccucuggcuccagcuggccgg

SEQ ID NO: 2081510 - RNA, 19 nt, Human
uauguagaauauauuuccu

SEQ ID NO: 2081511 - RNA, 19 nt, Human
agaugcuagaacucccuuu

SEQ ID NO: 2081512 - RNA, 16 nt, Human
cuguccauucuuccuc

SEQ ID NO: 2081513 - RNA, 21 nt, Human
cucuucuggguuccuuccucu

SEQ ID NO: 2081514 - RNA, 23 nt, Human
aaagauucaaugccccugaauuu

SEQ ID NO: 2081515 - RNA, 14 nt, Human
auauauuuccuuau

SEQ ID NO: 2081516 - RNA, 14 nt, Human
uaauuauuucacuu

SEQ ID NO: 2081517 - RNA, 22 nt, Human
aaugggcacaggguuuauguuu

SEQ ID NO: 2081518 - RNA, 18 nt, Human
aggcauagcccugccuca

SEQ ID NO: 2081519 - RNA, 17 nt, Human
cgcgcugcgcgccgcgc

SEQ ID NO: 2081520 - RNA, 21 nt, Human
aaaaacguauugcauuuaauu

SEQ ID NO: 2081521 - RNA, 16 nt, Human
cucgccacgcucuggg

SEQ ID NO: 2081522 - RNA, 11 nt, Human
ugggggcagca

SEQ ID NO: 2081523 - RNA, 16 nt, Human
gaccaaggcccccggg

SEQ ID NO: 2081524 - RNA, 15 nt, Human
cagugucugcuggag

SEQ ID NO: 2081525 - RNA, 19 nt, Human
cugacugcuaguuuauaua

SEQ ID NO: 2081526 - RNA, 14 nt, Human
cugggucgccggca

SEQ ID NO: 2081527 - RNA, 14 nt, Human
agccuccagcugcc

SEQ ID NO: 2081528 - RNA, 22 nt, Human
gcagagagguagggauggggcu

SEQ ID NO: 2081529 - RNA, 22 nt, Human
aggacaccauuuuggcaagcuc

SEQ ID NO: 2081530 - RNA, 12 nt, Human
ggggcggcggcc

SEQ ID NO: 2081531 - RNA, 17 nt, Human
caucgcagacacaugug

SEQ ID NO: 2081532 - RNA, 21 nt, Human
gcgcucggccugcucgcccac

SEQ ID NO: 2081533 - RNA, 12 nt, Human
auaacuggaaac

SEQ ID NO: 2081534 - RNA, 15 nt, Human
gcacagccucuuaga

SEQ ID NO: 2081535 - RNA, 14 nt, Human
aaucucaauauuuc

SEQ ID NO: 2081536 - RNA, 14 nt, Human
cgagccccaggcgg

SEQ ID NO: 2081537 - RNA, 20 nt, Human
auauauuuuuuuuuuuaaaa

SEQ ID NO: 2081538 - RNA, 20 nt, Human
cccugcacuccagccugagc

SEQ ID NO: 2081539 - RNA, 21 nt, Human
gccggcgcgcucaucccaccc

SEQ ID NO: 2081540 - RNA, 15 nt, Human
accucccccaucucu

SEQ ID NO: 2081541 - RNA, 13 nt, Human
aaaaaugguuuaa

SEQ ID NO: 2081542 - RNA, 15 nt, Human
ucacaggacagcccu

SEQ ID NO: 2081543 - RNA, 20 nt, Human
caucccuagaaagccaugug

SEQ ID NO: 2081544 - RNA, 16 nt, Human
auaacuggaaacuuca

SEQ ID NO: 2081545 - RNA, 15 nt, Human
acaagacccaaaagg

SEQ ID NO: 2081546 - RNA, 15 nt, Human
uuauaugcuauuuau

SEQ ID NO: 2081547 - RNA, 16 nt, Human
gucuaucuuugagcgc

SEQ ID NO: 2081548 - RNA, 22 nt, Human
ugaauggcuaagcaaaauguga

SEQ ID NO: 2081549 - RNA, 20 nt, Human
guaucaaaagaaagaaaauc

SEQ ID NO: 2081550 - RNA, 20 nt, Human
agaagaacugaaaucauacu

SEQ ID NO: 2081551 - RNA, 21 nt, Human
aaaauuuuuucucuaggaaau

SEQ ID NO: 2081552 - RNA, 15 nt, Human
ccuggugggcagaga

SEQ ID NO: 2081553 - RNA, 21 nt, Human
cggcuccggacgcugcugccg

SEQ ID NO: 2081554 - RNA, 17 nt, Human
cagucucuugaggcaca

SEQ ID NO: 2081555 - RNA, 22 nt, Human
aauuuuuucucuaggaaauauu

SEQ ID NO: 2081556 - RNA, 22 nt, Human
aagaauuucuaggacugaauua

SEQ ID NO: 2081557 - RNA, 20 nt, Human
cucagcuucacccugaggug

SEQ ID NO: 2081558 - RNA, 21 nt, Human
uuuuauggcacuaguauuucu

SEQ ID NO: 2081559 - RNA, 18 nt, Human
uguauucuuuuaguuuuu

SEQ ID NO: 2081560 - RNA, 20 nt, Human
agcuuauugucuagugaaac

SEQ ID NO: 2081561 - RNA, 22 nt, Human
ucucagcuucacccugagguga

SEQ ID NO: 2081562 - RNA, 22 nt, Human
agccaaacauccuacaagacac

SEQ ID NO: 2081563 - RNA, 14 nt, Human
uaguaucaaaagaa

SEQ ID NO: 2081564 - RNA, 16 nt, Human
guugauggaaauacac

SEQ ID NO: 2081565 - RNA, 19 nt, Human
ccgcagggugaacugcagc

SEQ ID NO: 2081566 - RNA, 14 nt, Human
ugaggcuuuaaaac

SEQ ID NO: 2081567 - RNA, 15 nt, Human
cuccagggagucuca

SEQ ID NO: 2081568 - RNA, 15 nt, Human
gacaguauggcagcu

SEQ ID NO: 2081569 - RNA, 23 nt, Human
cucagcccuggugggcagagagg

SEQ ID NO: 2081570 - RNA, 19 nt, Human
uuaauuugguuuucacauu

SEQ ID NO: 2081571 - RNA, 17 nt, Human
acagaaaaguugaauuu

SEQ ID NO: 2081572 - RNA, 12 nt, Human
augaccaacauc

SEQ ID NO: 2081573 - RNA, 14 nt, Human
aucaaaagaaagaa

SEQ ID NO: 2081574 - RNA, 18 nt, Human
gccuucggccuccauccu

SEQ ID NO: 2081575 - RNA, 21 nt, Human
cuggccaccugcugagcccca

SEQ ID NO: 2081576 - RNA, 17 nt, Human
cuaauaucuuaucuucc

SEQ ID NO: 2081577 - RNA, 15 nt, Human
cauuuaguuauaaaa

SEQ ID NO: 2081578 - RNA, 18 nt, Human
uagcccuuccccucugca

SEQ ID NO: 2081579 - RNA, 18 nt, Human
ugugcuggccaccugcug

SEQ ID NO: 2081580 - RNA, 22 nt, Human
aucuccgucaacucauauuuuc

SEQ ID NO: 2081581 - RNA, 16 nt, Human
uauucagaauuucuaa

SEQ ID NO: 2081582 - RNA, 13 nt, Human
ccaggcugagccu

SEQ ID NO: 2081583 - RNA, 16 nt, Human
agaugcuagaacuccc

SEQ ID NO: 2081584 - RNA, 14 nt, Human
agcucaccaguccc

SEQ ID NO: 2081585 - RNA, 23 nt, Human
gguggcgcuggcugcgcucggcc

SEQ ID NO: 2081586 - RNA, 21 nt, Human
uuccugacugcuaguuuauau

SEQ ID NO: 2081587 - RNA, 16 nt, Human
gccucagucucccucc

SEQ ID NO: 2081588 - RNA, 17 nt, Human
ccuauccuacuuccccu

SEQ ID NO: 2081589 - RNA, 23 nt, Human
ccgcagggugaacugcagcgagu

SEQ ID NO: 2081590 - RNA, 14 nt, Human
ccucggacggcucc

SEQ ID NO: 2081591 - RNA, 16 nt, Human
ccuggugggcagagag

SEQ ID NO: 2081592 - RNA, 17 nt, Human
ggcccugugcggccugg

SEQ ID NO: 2081593 - RNA, 18 nt, Human
cacuccagugagacagcu

SEQ ID NO: 2081594 - RNA, 14 nt, Human
uuuuauaugcuauu

SEQ ID NO: 2081595 - RNA, 21 nt, Human
gccucaagcuaugugagcuca

SEQ ID NO: 2081596 - RNA, 17 nt, Human
ccucagucucccucccu

SEQ ID NO: 2081597 - RNA, 19 nt, Human
aagugugacucauuaaaug

SEQ ID NO: 2081598 - RNA, 21 nt, Human
gaaggaaagaauaaccaacac

SEQ ID NO: 2081599 - RNA, 14 nt, Human
guauuuuaaaagaa

SEQ ID NO: 2081600 - RNA, 16 nt, Human
ugcuguucaugaaaga

SEQ ID NO: 2081601 - RNA, 15 nt, Human
guuuuauuauauaua

SEQ ID NO: 2081602 - RNA, 17 nt, Human
cuauauuuuacauaaau

SEQ ID NO: 2081603 - RNA, 13 nt, Human
ccaccugccuaua

SEQ ID NO: 2081604 - RNA, 22 nt, Human
gaugcaguuguugcccacagcu

SEQ ID NO: 2081605 - RNA, 21 nt, Human
caggcacuaucuggguuuugg

SEQ ID NO: 2081606 - RNA, 13 nt, Human
gaagagccggagc

SEQ ID NO: 2081607 - RNA, 21 nt, Human
cagcccuuagcccuuccccuc

SEQ ID NO: 2081608 - RNA, 23 nt, Human
uccaaacugacucuuaagaagac

SEQ ID NO: 2081609 - RNA, 14 nt, Human
aaccugagccccaa

SEQ ID NO: 2081610 - RNA, 19 nt, Human
ccauccugccccugagccc

SEQ ID NO: 2081611 - RNA, 23 nt, Human
uuuauuaggaguaccauaauucu

SEQ ID NO: 2081612 - RNA, 18 nt, Human
ucucuaggaaauauuuau

SEQ ID NO: 2081613 - RNA, 16 nt, Human
acugcuaguuuauaua

SEQ ID NO: 2081614 - RNA, 16 nt, Human
aggguguguaaguaga

SEQ ID NO: 2081615 - RNA, 14 nt, Human
auauuugaaauauu

SEQ ID NO: 2081616 - RNA, 20 nt, Human
aucccggccggcgcgcucau

SEQ ID NO: 2081617 - RNA, 23 nt, Human
cuagacccacuggacucaccucc

SEQ ID NO: 2081618 - RNA, 15 nt, Human
aguucugaagaagau

SEQ ID NO: 2081619 - RNA, 19 nt, Human
cagcuacuugggaggcuga

SEQ ID NO: 2081620 - RNA, 23 nt, Human
guuguaauuuuuuugugggaaau

SEQ ID NO: 2081621 - RNA, 14 nt, Human
ggagccuccagcug

SEQ ID NO: 2081622 - RNA, 19 nt, Human
aaauaugccccauucaaca

SEQ ID NO: 2081623 - RNA, 14 nt, Human
cccggccggcgcgc

SEQ ID NO: 2081624 - RNA, 17 nt, Human
ucgcagacacaugugcu

SEQ ID NO: 2081625 - RNA, 23 nt, Human
acguaaucguguccccuauccua

SEQ ID NO: 2081626 - RNA, 18 nt, Human
uuggggccuaugcagagg

SEQ ID NO: 2081627 - RNA, 15 nt, Human
ccuugccaugugcua

SEQ ID NO: 2081628 - RNA, 17 nt, Human
cgccuccgcuacuucca

SEQ ID NO: 2081629 - RNA, 23 nt, Human
uuuccaucaaggguacacugccu

SEQ ID NO: 2081630 - RNA, 15 nt, Human
ugguuuagaaagcuu

SEQ ID NO: 2081631 - RNA, 21 nt, Human
cugagccucagucucccuccc

SEQ ID NO: 2081632 - RNA, 16 nt, Human
gugagacagcucugca

SEQ ID NO: 2081633 - RNA, 20 nt, Human
aagucacauuccugaacagg

SEQ ID NO: 2081634 - RNA, 20 nt, Human
acaagacccaaaaggcagaa

SEQ ID NO: 2081635 - RNA, 13 nt, Human
uauuuaauuauuu

SEQ ID NO: 2081636 - RNA, 16 nt, Human
cauuuguauaaaauaa

SEQ ID NO: 2081637 - RNA, 22 nt, Human
aagcugguggcucugugugcuc

SEQ ID NO: 2081638 - RNA, 14 nt, Human
agcguugagccacc

SEQ ID NO: 2081639 - RNA, 12 nt, Human
guaaaggcaaac

SEQ ID NO: 2081640 - RNA, 18 nt, Human
uuauuacuguaagaaaau

SEQ ID NO: 2081641 - RNA, 22 nt, Human
ugaccauacuaauuauaccccc

SEQ ID NO: 2081642 - RNA, 12 nt, Human
uccaaagggcau

SEQ ID NO: 2081643 - RNA, 18 nt, Human
agcauuguuggcuguucc

SEQ ID NO: 2081644 - RNA, 23 nt, Human
cacagauuugagcucagcccugg

SEQ ID NO: 2081645 - RNA, 20 nt, Human
ccagggcuacgcgcgcuccg

SEQ ID NO: 2081646 - RNA, 19 nt, Human
caauaaagaguuccuucug

SEQ ID NO: 2081647 - RNA, 19 nt, Human
cagauucuuuacccccugg

SEQ ID NO: 2081648 - RNA, 15 nt, Human
gucccaggcugagcc

SEQ ID NO: 2081649 - RNA, 13 nt, Human
gggcggcggcccu

SEQ ID NO: 2081650 - RNA, 18 nt, Human
ucuucuggguuccuuccu

SEQ ID NO: 2081651 - RNA, 17 nt, Human
cuaccuguucgcgcgcc

SEQ ID NO: 2081652 - RNA, 23 nt, Human
gaggcauuuaggccaugggacag

SEQ ID NO: 2081653 - RNA, 20 nt, Human
cucuguucugcacacagcac

SEQ ID NO: 2081654 - RNA, 21 nt, Human
gcggcgggagggcgcggggcg

SEQ ID NO: 2081655 - RNA, 22 nt, Human
ccacagcuguaugauucccagc

SEQ ID NO: 2081656 - RNA, 13 nt, Human
uagcauggccaca

SEQ ID NO: 2081657 - RNA, 22 nt, Human
aauuacauuuguauaaaauaau

SEQ ID NO: 2081658 - RNA, 13 nt, Human
gcagaacagugau

SEQ ID NO: 2081659 - RNA, 20 nt, Human
gcucgcccacuuccucccgg

SEQ ID NO: 2081660 - RNA, 19 nt, Human
aaugaauggcuaagcaaaa

SEQ ID NO: 2081661 - RNA, 16 nt, Human
ccccugcacuccagcc

SEQ ID NO: 2081662 - RNA, 16 nt, Human
auaucuauauuuuaca

SEQ ID NO: 2081663 - RNA, 18 nt, Human
cuaggcauagcccugccu

SEQ ID NO: 2081664 - RNA, 16 nt, Human
cucucucauccacuuu

SEQ ID NO: 2081665 - RNA, 15 nt, Human
uaucaguccaaaggg

SEQ ID NO: 2081666 - RNA, 17 nt, Human
uacagaaaaguugaauu

SEQ ID NO: 2081667 - RNA, 11 nt, Human
cuauuuaauua

SEQ ID NO: 2081668 - RNA, 17 nt, Human
auguuuacagaucccca

SEQ ID NO: 2081669 - RNA, 19 nt, Human
aagccaugugcagccacca

SEQ ID NO: 2081670 - RNA, 18 nt, Human
aauuuuagacauucuuua

SEQ ID NO: 2081671 - RNA, 17 nt, Human
cucguggaacaguuacc

SEQ ID NO: 2081672 - RNA, 16 nt, Human
acaugaaguccaagca

SEQ ID NO: 2081673 - RNA, 17 nt, Human
uuuccaugaguugcagu

SEQ ID NO: 2081674 - RNA, 23 nt, Human
gagaaaugagcacgcauggaaaa

SEQ ID NO: 2081675 - RNA, 15 nt, Human
aucaaaggacaccau

SEQ ID NO: 2081676 - RNA, 20 nt, Human
agcugccccggggaggggcg

SEQ ID NO: 2081677 - RNA, 11 nt, Human
aaccugagccc

SEQ ID NO: 2081678 - RNA, 21 nt, Human
uacauaaaguaugugcauauu

SEQ ID NO: 2081679 - RNA, 15 nt, Human
ggagccuccagcugc

SEQ ID NO: 2081680 - RNA, 17 nt, Human
caagaaaugaaagcagg

SEQ ID NO: 2081681 - RNA, 16 nt, Human
aaguaaaggcaaacuu

SEQ ID NO: 2081682 - RNA, 15 nt, Human
ucccacccgcccacc

SEQ ID NO: 2081683 - RNA, 23 nt, Human
agccaccaguccauugggcaggc

SEQ ID NO: 2081684 - RNA, 15 nt, Human
uccuacaagacacag

SEQ ID NO: 2081685 - RNA, 18 nt, Human
aguuuauauagaaaugua

SEQ ID NO: 2081686 - RNA, 19 nt, Human
ugggacaggggagaaccua

SEQ ID NO: 2081687 - RNA, 18 nt, Human
gccugagcgacagugaga

SEQ ID NO: 2081688 - RNA, 18 nt, Human
auguuagagaauuuccuu

SEQ ID NO: 2081689 - RNA, 23 nt, Human
gccgggaaagaagagccggagcc

SEQ ID NO: 2081690 - RNA, 16 nt, Human
cuguacgcgagcgcgc

SEQ ID NO: 2081691 - RNA, 20 nt, Human
uccaagccucauguccacug

SEQ ID NO: 2081692 - RNA, 22 nt, Human
uucugguagcuaaauauauauu

SEQ ID NO: 2081693 - RNA, 17 nt, Human
ccaaggaugccccgucc

SEQ ID NO: 2081694 - RNA, 22 nt, Human
cuucaacucccugccccccagc

SEQ ID NO: 2081695 - RNA, 16 nt, Human
ccacuuggucugugag

SEQ ID NO: 2081696 - RNA, 21 nt, Human
ugaccauacuaauuauacccc

SEQ ID NO: 2081697 - RNA, 14 nt, Human
agcucuaucaccaa

SEQ ID NO: 2081698 - RNA, 15 nt, Human
gccuaagugcagccc

SEQ ID NO: 2081699 - RNA, 16 nt, Human
ggaggggcgcucgcuu

SEQ ID NO: 2081700 - RNA, 16 nt, Human
uccugcaauuccacuu

SEQ ID NO: 2081701 - RNA, 14 nt, Human
ggcauucaaaugua

SEQ ID NO: 2081702 - RNA, 16 nt, Human
ccuaagugcagccccg

SEQ ID NO: 2081703 - RNA, 23 nt, Human
cuaguaauuggaaaggcagcucu

SEQ ID NO: 2081704 - RNA, 15 nt, Human
ucugcagauaaacag

SEQ ID NO: 2081705 - RNA, 16 nt, Human
uucugaaauuuccugg

SEQ ID NO: 2081706 - RNA, 15 nt, Human
ccgucccccucuggc

SEQ ID NO: 2081707 - RNA, 19 nt, Human
ugaaaccaaaccagagccu

SEQ ID NO: 2081708 - RNA, 17 nt, Human
gggcaguguucccuggg

SEQ ID NO: 2081709 - RNA, 16 nt, Human
gaaguaucuugguugu

SEQ ID NO: 2081710 - RNA, 19 nt, Human
agccuccagcugccccggg

SEQ ID NO: 2081711 - RNA, 19 nt, Human
guaaagcuuugugcagauu

SEQ ID NO: 2081712 - RNA, 18 nt, Human
agauauuaacugagaagg

SEQ ID NO: 2081713 - RNA, 19 nt, Human
caagaaggaaagauuuugu

SEQ ID NO: 2081714 - RNA, 17 nt, Human
gaaagccaugugcagcc

SEQ ID NO: 2081715 - RNA, 18 nt, Human
aguauuuuguuucagugc

SEQ ID NO: 2081716 - RNA, 19 nt, Human
uuuccaagaaauauuccuu

SEQ ID NO: 2081717 - RNA, 21 nt, Human
gugccguccccagagcuacag

SEQ ID NO: 2081718 - RNA, 21 nt, Human
uuucaugcuguucaugaaaga

SEQ ID NO: 2081719 - RNA, 15 nt, Human
ugccucucucaucca

SEQ ID NO: 2081720 - RNA, 13 nt, Human
augcuguucauga

SEQ ID NO: 2081721 - RNA, 12 nt, Human
ggcagcaccucc

SEQ ID NO: 2081722 - RNA, 20 nt, Human
gcgcggggcggggagcgagc

SEQ ID NO: 2081723 - RNA, 16 nt, Human
uuacccccugggagcc

SEQ ID NO: 2081724 - RNA, 22 nt, Human
cuccugccuaagugcagccccg

SEQ ID NO: 2081725 - RNA, 17 nt, Human
cagggcugaagcugugu

SEQ ID NO: 2081726 - RNA, 15 nt, Human
ucccuuuguccacaa

SEQ ID NO: 2081727 - RNA, 16 nt, Human
ugccucaccccuugcc

SEQ ID NO: 2081728 - RNA, 21 nt, Human
auccccaagccuggcaaggga

SEQ ID NO: 2081729 - RNA, 14 nt, Human
aagcuacuuauugu

SEQ ID NO: 2081730 - RNA, 18 nt, Human
aauuuuuuugugggaaau

SEQ ID NO: 2081731 - RNA, 18 nt, Human
acuguuaucuucacuuuu

SEQ ID NO: 2081732 - RNA, 16 nt, Human
guccauucuuccuccc

SEQ ID NO: 2081733 - RNA, 14 nt, Human
caguucugaagaag

SEQ ID NO: 2081734 - RNA, 17 nt, Human
agauagaugaagaagcu

SEQ ID NO: 2081735 - RNA, 15 nt, Human
ggcaauagucaaauu

SEQ ID NO: 2081736 - RNA, 17 nt, Human
ccuacuuccccuuccua

SEQ ID NO: 2081737 - RNA, 22 nt, Human
uuaccucugccucagaaaacaa

SEQ ID NO: 2081738 - RNA, 10 nt, Human
uuuuuaaaaa

SEQ ID NO: 2081739 - RNA, 19 nt, Human
ucuugugaacccaaagugu

SEQ ID NO: 2081740 - RNA, 17 nt, Human
uugugaagcaaaauuuu

SEQ ID NO: 2081741 - RNA, 12 nt, Human
aucuucacuuuu

SEQ ID NO: 2081742 - RNA, 22 nt, Human
cucagcccuggugggcagagag

SEQ ID NO: 2081743 - RNA, 21 nt, Human
ugaauuaugaaacuuuuggaa

SEQ ID NO: 2081744 - RNA, 14 nt, Human
ccugccccugagcc

SEQ ID NO: 2081745 - RNA, 18 nt, Human
gaagagccggagccucca

SEQ ID NO: 2081746 - RNA, 12 nt, Human
accccugagcuu

SEQ ID NO: 2081747 - RNA, 21 nt, Human
ccaguccauugggcaggcaga

SEQ ID NO: 2081748 - RNA, 21 nt, Human
caccagucugacuguuuccau

SEQ ID NO: 2081749 - RNA, 11 nt, Human
accauuuuuac

SEQ ID NO: 2081750 - RNA, 19 nt, Human
agcagcuuauucacaagac

SEQ ID NO: 2081751 - RNA, 15 nt, Human
cccugcugcccuucc

SEQ ID NO: 2081752 - RNA, 15 nt, Human
cccugagguugugug

SEQ ID NO: 2081753 - RNA, 14 nt, Human
aggggaccagagag

SEQ ID NO: 2081754 - RNA, 20 nt, Human
ugagagugaacaaauuuaca

SEQ ID NO: 2081755 - RNA, 14 nt, Human
cuauuauauuucca

SEQ ID NO: 2081756 - RNA, 19 nt, Human
cagagucaagggugugugc

SEQ ID NO: 2081757 - RNA, 19 nt, Human
ggagccuccagcugccccg

SEQ ID NO: 2081758 - RNA, 23 nt, Human
ggaugguucccuugaugaagaag

SEQ ID NO: 2081759 - RNA, 14 nt, Human
ucucagaaggaaag

SEQ ID NO: 2081760 - RNA, 17 nt, Human
aagcuuccauuguuguc

SEQ ID NO: 2081761 - RNA, 22 nt, Human
guacacugccuucucaacucca

SEQ ID NO: 2081762 - RNA, 13 nt, Human
aaauccuugaaga

SEQ ID NO: 2081763 - RNA, 21 nt, Human
agucaagggugugugcagcau

SEQ ID NO: 2081764 - RNA, 14 nt, Human
augauguuuagaaa

SEQ ID NO: 2081765 - RNA, 17 nt, Human
uaugccacaagaacccc

SEQ ID NO: 2081766 - RNA, 13 nt, Human
ucugcagcuucca

SEQ ID NO: 2081767 - RNA, 18 nt, Human
cugaaggguaauuauaua

SEQ ID NO: 2081768 - RNA, 11 nt, Human
ggucacaggaa

SEQ ID NO: 2081769 - RNA, 17 nt, Human
cugcgcucggccugcuc

SEQ ID NO: 2081770 - RNA, 15 nt, Human
uucugcacacagcac

SEQ ID NO: 2081771 - RNA, 16 nt, Human
cuuuuaguuuuuaaag

SEQ ID NO: 2081772 - RNA, 13 nt, Human
cagaaacuccugu

SEQ ID NO: 2081773 - RNA, 20 nt, Human
cuuccccucugcagcuucca

SEQ ID NO: 2081774 - RNA, 12 nt, Human
cacaacacacag

SEQ ID NO: 2081775 - RNA, 18 nt, Human
gcauggccacaucugagc

SEQ ID NO: 2081776 - RNA, 13 nt, Human
aguaugaaaaugu

SEQ ID NO: 2081777 - RNA, 19 nt, Human
cccccucuggcuccagcug

SEQ ID NO: 2081778 - RNA, 16 nt, Human
uccuagucucuaucau

SEQ ID NO: 2081779 - RNA, 15 nt, Human
ugagcucagcccugg

SEQ ID NO: 2081780 - RNA, 17 nt, Human
acuaguuguaauuuuuu

SEQ ID NO: 2081781 - RNA, 12 nt, Human
gcauccuagucu

SEQ ID NO: 2081782 - RNA, 14 nt, Human
acugccaucauuua

SEQ ID NO: 2081783 - RNA, 17 nt, Human
acaucgcagacacaugu

SEQ ID NO: 2081784 - RNA, 15 nt, Human
uuacagagacagaaa

SEQ ID NO: 2081785 - RNA, 13 nt, Human
caucgcagacaca

SEQ ID NO: 2081786 - RNA, 22 nt, Human
ccauucuuccucccauucagga

SEQ ID NO: 2081787 - RNA, 20 nt, Human
cugagccucagucucccucc

SEQ ID NO: 2081788 - RNA, 13 nt, Human
uuucuaaaaguuu

SEQ ID NO: 2081789 - RNA, 22 nt, Human
ugaaaaaguucugcagauaaac

SEQ ID NO: 2081790 - RNA, 18 nt, Human
ugcucgcccacuuccucc

SEQ ID NO: 2081791 - RNA, 15 nt, Human
cugcccuuccccuuc

SEQ ID NO: 2081792 - RNA, 20 nt, Human
guugagccaccaagcuggug

SEQ ID NO: 2081793 - RNA, 18 nt, Human
aaagaaaaucaggcuggc

SEQ ID NO: 2081794 - RNA, 21 nt, Human
guuguaauuuuuuugugggaa

SEQ ID NO: 2081795 - RNA, 14 nt, Human
ccuuaucaaaggac

SEQ ID NO: 2081796 - RNA, 17 nt, Human
acucaccucccccaucu

SEQ ID NO: 2081797 - RNA, 19 nt, Human
ugagguaaccucauuauca

SEQ ID NO: 2081798 - RNA, 16 nt, Human
agccucagucucccuc

SEQ ID NO: 2081799 - RNA, 22 nt, Human
caaugcuguauuuuaaaagaau

SEQ ID NO: 2081800 - RNA, 21 nt, Human
auaguuacccaaauuaagaga

SEQ ID NO: 2081801 - RNA, 23 nt, Human
cucauguccacugguucuucuug

SEQ ID NO: 2081802 - RNA, 20 nt, Human
guccccuauccuacuucccc

SEQ ID NO: 2081803 - RNA, 23 nt, Human
ggaugaauuaaguuuuuuuuuaa

SEQ ID NO: 2081804 - RNA, 15 nt, Human
ccacaucugagcccc

SEQ ID NO: 2081805 - RNA, 15 nt, Human
cccccagcccuccuu

SEQ ID NO: 2081806 - RNA, 23 nt, Human
gccggcgcgcucaucccacccgc

SEQ ID NO: 2081807 - RNA, 13 nt, Human
agcccagcuugaa

SEQ ID NO: 2081808 - RNA, 18 nt, Human
ugggauacuauuuaauua

SEQ ID NO: 2081809 - RNA, 22 nt, Human
gucacaggaaguagaggaggcc

SEQ ID NO: 2081810 - RNA, 16 nt, Human
cagggacuugaaccca

SEQ ID NO: 2081811 - RNA, 12 nt, Human
aguuauaaaaau

SEQ ID NO: 2081812 - RNA, 17 nt, Human
augaucaguaugaaaau

SEQ ID NO: 2081813 - RNA, 13 nt, Human
cuuuccaugaguu

SEQ ID NO: 2081814 - RNA, 16 nt, Human
cacacuguccauucuu

SEQ ID NO: 2081815 - RNA, 22 nt, Human
ggcauuuaggccaugggacagg

SEQ ID NO: 2081816 - RNA, 22 nt, Human
cuggagacauugaggcaggcac

SEQ ID NO: 2081817 - RNA, 20 nt, Human
guuccuuccucugagccuug

SEQ ID NO: 2081818 - RNA, 19 nt, Human
ccccuucccacacugucca

SEQ ID NO: 2081819 - RNA, 13 nt, Human
accaacacccuga

SEQ ID NO: 2081820 - RNA, 22 nt, Human
cggggagcgagccccaggcggg

SEQ ID NO: 2081821 - RNA, 13 nt, Human
gcuguacgcgagc

SEQ ID NO: 2081822 - RNA, 12 nt, Human
acccccugggag

SEQ ID NO: 2081823 - RNA, 22 nt, Human
uuccccuuccuaauuccacagc

SEQ ID NO: 2081824 - RNA, 23 nt, Human
gggccuaugcagagguccacaac

SEQ ID NO: 2081825 - RNA, 21 nt, Human
gguuuucacauuggaaacaag

SEQ ID NO: 2081826 - RNA, 19 nt, Human
caaagugucuugaauugua

SEQ ID NO: 2081827 - RNA, 24 nt, Human
ugucuugaauuguaggugacuauu

SEQ ID NO: 2081828 - RNA, 21 nt, Human
cucagcuucacccugagguga

SEQ ID NO: 2081829 - RNA, 20 nt, Human
cccuuccuaauuccacagcu

SEQ ID NO: 2081830 - RNA, 15 nt, Human
uuauauauauuuuuu

SEQ ID NO: 2081831 - RNA, 20 nt, Human
ucaauaaaauccauacauuu

SEQ ID NO: 2081832 - RNA, 22 nt, Human
uguuuuuccaguaguuagcuuu

SEQ ID NO: 2081833 - RNA, 17 nt, Human
cucucauccacuuucca

SEQ ID NO: 2081834 - RNA, 15 nt, Human
uuccaagaaauauuc

SEQ ID NO: 2081835 - RNA, 20 nt, Human
uucuaggacugaauuaugaa

SEQ ID NO: 2081836 - RNA, 14 nt, Human
cggggaggggcgcu

SEQ ID NO: 2081837 - RNA, 11 nt, Human
acuuugaagag

SEQ ID NO: 2081838 - RNA, 15 nt, Human
gaccacugcagaaga

SEQ ID NO: 2081839 - RNA, 20 nt, Human
gagccucagucucccucccu

SEQ ID NO: 2081840 - RNA, 14 nt, Human
cacaagaaaugaaa

SEQ ID NO: 2081841 - RNA, 15 nt, Human
caggcaaauuccuga

SEQ ID NO: 2081842 - RNA, 20 nt, Human
cugagaccaaggcccccggg

SEQ ID NO: 2081843 - RNA, 22 nt, Human
aaucacuggcuguuaaucuuuc

SEQ ID NO: 2081844 - RNA, 12 nt, Human
uauauuuccuua

SEQ ID NO: 2081845 - RNA, 17 nt, Human
uagaauauauuuccuua

SEQ ID NO: 2081846 - RNA, 15 nt, Human
gaauaaccaacaccc

SEQ ID NO: 2081847 - RNA, 16 nt, Human
cgcuuccgcauccuag

SEQ ID NO: 2081848 - RNA, 20 nt, Human
aucauuuaguuauaaaaaua

SEQ ID NO: 2081849 - RNA, 16 nt, Human
acggagccgggaaaga

SEQ ID NO: 2081850 - RNA, 17 nt, Human
agguuuuaaagcuucca

SEQ ID NO: 2081851 - RNA, 11 nt, Human
gcauccuaguc

SEQ ID NO: 2081852 - RNA, 21 nt, Human
uucccgcuguuccucgccacg

SEQ ID NO: 2081853 - RNA, 12 nt, Human
cuccaaggaccg

SEQ ID NO: 2081854 - RNA, 16 nt, Human
ggagccuccagcugcc

SEQ ID NO: 2081855 - RNA, 20 nt, Human
ugagucccaggcugagccuc

SEQ ID NO: 2081856 - RNA, 16 nt, Human
aacgagacaagcagcc

SEQ ID NO: 2081857 - RNA, 14 nt, Human
cauuaaaguucuag

SEQ ID NO: 2081858 - RNA, 15 nt, Human
aaacaauuugaauau

SEQ ID NO: 2081859 - RNA, 18 nt, Human
caguuguugcccacagcu

SEQ ID NO: 2081860 - RNA, 18 nt, Human
caagcuaugugagcucac

SEQ ID NO: 2081861 - RNA, 22 nt, Human
cuggguuccuuccucugagccu

SEQ ID NO: 2081862 - RNA, 16 nt, Human
aauuucuucaacuccc

SEQ ID NO: 2081863 - RNA, 14 nt, Human
cucgcccacuuccu

SEQ ID NO: 2081864 - RNA, 19 nt, Human
cuccagcuggccgggagcc

SEQ ID NO: 2081865 - RNA, 17 nt, Human
auuuaguuauaaaaaua

SEQ ID NO: 2081866 - RNA, 14 nt, Human
agaugcuagaacuc

SEQ ID NO: 2081867 - RNA, 14 nt, Human
auauauuuuagaua

SEQ ID NO: 2081868 - RNA, 13 nt, Human
cuuaucaaaggac

SEQ ID NO: 2081869 - RNA, 23 nt, Human
uguugagguaccuccaaggaccg

SEQ ID NO: 2081870 - RNA, 17 nt, Human
cauaguaccucugcuau

SEQ ID NO: 2081871 - RNA, 15 nt, Human
cucguggaacaguua

SEQ ID NO: 2081872 - RNA, 15 nt, Human
ugccccgucccccuc

SEQ ID NO: 2081873 - RNA, 14 nt, Human
gacaagaaggaaag

SEQ ID NO: 2081874 - RNA, 19 nt, Human
uggagccuacuaaaugcuc

SEQ ID NO: 2081875 - RNA, 20 nt, Human
gcgcugcgcgccgcgcuccu

SEQ ID NO: 2081876 - RNA, 16 nt, Human
agugucaaugcagccc

SEQ ID NO: 2081877 - RNA, 24 nt, Human
auauucucacagcuccaagaauuu

SEQ ID NO: 2081878 - RNA, 17 nt, Human
caucagcaucccuagaa

SEQ ID NO: 2081879 - RNA, 13 nt, Human
uauauuuuagaua

SEQ ID NO: 2081880 - RNA, 14 nt, Human
ucaaugcagccccc

SEQ ID NO: 2081881 - RNA, 16 nt, Human
ccaugugcagccacca

SEQ ID NO: 2081882 - RNA, 14 nt, Human
aaaacuucagacau

SEQ ID NO: 2081883 - RNA, 14 nt, Human
cuggccgggagccu

SEQ ID NO: 2081884 - RNA, 19 nt, Human
cccauggcacucuauguuc

SEQ ID NO: 2081885 - RNA, 22 nt, Human
agacucugucucaguccaugaa

SEQ ID NO: 2081886 - RNA, 17 nt, Human
ccccugaauuuaaauag

SEQ ID NO: 2081887 - RNA, 21 nt, Human
accagagccugaguguugccu

SEQ ID NO: 2081888 - RNA, 13 nt, Human
agaauauauuucc

SEQ ID NO: 2081889 - RNA, 15 nt, Human
augauaacuggaaac

SEQ ID NO: 2081890 - RNA, 12 nt, Human
cucuaucauuaa

SEQ ID NO: 2081891 - RNA, 16 nt, Human
ccuccuuaucaaagga

SEQ ID NO: 2081892 - RNA, 11 nt, Human
ccugagcccca

SEQ ID NO: 2081893 - RNA, 14 nt, Human
auuuauuaaguauu

SEQ ID NO: 2081894 - RNA, 15 nt, Human
gcuguauuuuaaaag

SEQ ID NO: 2081895 - RNA, 18 nt, Human
cugcagcgaguacuuccc

SEQ ID NO: 2081896 - RNA, 15 nt, Human
agguguguugcagug

SEQ ID NO: 2081897 - RNA, 17 nt, Human
cagacaucaacagauaa

SEQ ID NO: 2081898 - RNA, 13 nt, Human
auccugaggcucc

SEQ ID NO: 2081899 - RNA, 21 nt, Human
uaucuuccuauaauuuuagac

SEQ ID NO: 2081900 - RNA, 13 nt, Human
gguuuuaaagcuu

SEQ ID NO: 2081901 - RNA, 21 nt, Human
cuuuuguagaagucacauucc

SEQ ID NO: 2081902 - RNA, 14 nt, Human
ggccuucggccucc

SEQ ID NO: 2081903 - RNA, 22 nt, Human
caaggaugccccgucccccucu

SEQ ID NO: 2081904 - RNA, 14 nt, Human
uauguauauuuuau

SEQ ID NO: 2081905 - RNA, 19 nt, Human
auuuuagauagaugaagaa

SEQ ID NO: 2081906 - RNA, 14 nt, Human
cugcugagucccag

SEQ ID NO: 2081907 - RNA, 21 nt, Human
cuuuccaauaaagaguuccuu

SEQ ID NO: 2081908 - RNA, 12 nt, Human
aaaugaaagcag

SEQ ID NO: 2081909 - RNA, 15 nt, Human
gcgagcgcgcgcgcc

SEQ ID NO: 2081910 - RNA, 17 nt, Human
ugacuauuauauuucca

SEQ ID NO: 2081911 - RNA, 21 nt, Human
uagaugagagaacagggcuga

SEQ ID NO: 2081912 - RNA, 15 nt, Human
acauccuacaagaca

SEQ ID NO: 2081913 - RNA, 20 nt, Human
agcauuguuggcuguuccug

SEQ ID NO: 2081914 - RNA, 20 nt, Human
acggacgaaccuugaaaacu

SEQ ID NO: 2081915 - RNA, 16 nt, Human
ggcauggguuuuauua

SEQ ID NO: 2081916 - RNA, 20 nt, Human
gaauacucuuauaucuauau

SEQ ID NO: 2081917 - RNA, 13 nt, Human
uuuuauaugcuau

SEQ ID NO: 2081918 - RNA, 17 nt, Human
caugagggcuggaugcu

SEQ ID NO: 2081919 - RNA, 16 nt, Human
ccucauuaucagucca

SEQ ID NO: 2081920 - RNA, 14 nt, Human
cggggagcgagccc

SEQ ID NO: 2081921 - RNA, 12 nt, Human
uagcauuucucc

SEQ ID NO: 2081922 - RNA, 19 nt, Human
gcaggcacugccaaaacau

SEQ ID NO: 2081923 - RNA, 11 nt, Human
gguuuuauuau

SEQ ID NO: 2081924 - RNA, 11 nt, Human
ccuucccacac

SEQ ID NO: 2081925 - RNA, 12 nt, Human
cgcucggccugc

SEQ ID NO: 2081926 - RNA, 15 nt, Human
ugggacagggaggac

SEQ ID NO: 2081927 - RNA, 15 nt, Human
cuggaaacacauguu

SEQ ID NO: 2081928 - RNA, 22 nt, Human
aaacaaggaugaauuaaguuuu

SEQ ID NO: 2081929 - RNA, 22 nt, Human
cgcgcuccgcgcagcucaggcu

SEQ ID NO: 2081930 - RNA, 11 nt, Human
augggacaggg

SEQ ID NO: 2081931 - RNA, 17 nt, Human
agugagacagcucugca

SEQ ID NO: 2081932 - RNA, 19 nt, Human
gcugccccggggaggggcg

SEQ ID NO: 2081933 - RNA, 18 nt, Human
aaacugccaucauuuacu

SEQ ID NO: 2081934 - RNA, 22 nt, Human
agucauucagauaugauucaaa

SEQ ID NO: 2081935 - RNA, 16 nt, Human
auacauguuacaacac

SEQ ID NO: 2081936 - RNA, 12 nt, Human
agcuuuuuucuc

SEQ ID NO: 2081937 - RNA, 21 nt, Human
cugcccugcugagucccaggc

SEQ ID NO: 2081938 - RNA, 19 nt, Human
caacucccugccccccagc

SEQ ID NO: 2081939 - RNA, 16 nt, Human
cugcgcgccgcgcucc

SEQ ID NO: 2081940 - RNA, 17 nt, Human
acuguccauucuuccuc

SEQ ID NO: 2081941 - RNA, 17 nt, Human
gaucuggcucuggacag

SEQ ID NO: 2081942 - RNA, 14 nt, Human
auuauauauauuuu

SEQ ID NO: 2081943 - RNA, 16 nt, Human
uuauauuuccaagaaa

SEQ ID NO: 2081944 - RNA, 20 nt, Human
uccucaugagggcuggaugc

SEQ ID NO: 2081945 - RNA, 15 nt, Human
uccaagccucauguc

SEQ ID NO: 2081946 - RNA, 15 nt, Human
aauuauuucacuuua

SEQ ID NO: 2081947 - RNA, 16 nt, Human
ccacuuauaggaauug

SEQ ID NO: 2081948 - RNA, 15 nt, Human
auauagaaauguauu

SEQ ID NO: 2081949 - RNA, 14 nt, Human
ugagcucaccaguc

SEQ ID NO: 2081950 - RNA, 14 nt, Human
gcuggcaccgcugu

SEQ ID NO: 2081951 - RNA, 12 nt, Human
cuguuaucuuca

SEQ ID NO: 2081952 - RNA, 22 nt, Human
ccgggagccugaucaccugccc

SEQ ID NO: 2081953 - RNA, 14 nt, Human
acccgcccaccgca

SEQ ID NO: 2081954 - RNA, 14 nt, Human
cgcuccgcgcagcu

SEQ ID NO: 2081955 - RNA, 15 nt, Human
aaaaguugaauuuua

SEQ ID NO: 2081956 - RNA, 22 nt, Human
uagacacacaugaaguccaagc

SEQ ID NO: 2081957 - RNA, 15 nt, Human
uauuuauuuuaauaa

SEQ ID NO: 2081958 - RNA, 16 nt, Human
cgcuguuccucgccac

SEQ ID NO: 2081959 - RNA, 23 nt, Human
uguggaaggugaucuggcucugg

SEQ ID NO: 2081960 - RNA, 19 nt, Human
acuuuuauaagaaauagga

SEQ ID NO: 2081961 - RNA, 13 nt, Human
gguccacaacaca

SEQ ID NO: 2081962 - RNA, 20 nt, Human
cuauguagaauauauuuccu

SEQ ID NO: 2081963 - RNA, 19 nt, Human
gcugcaccugugccguccc

SEQ ID NO: 2081964 - RNA, 18 nt, Human
uuacuguaagaaaauauc

SEQ ID NO: 2081965 - RNA, 18 nt, Human
ucuauguagaauauauuu

SEQ ID NO: 2081966 - RNA, 20 nt, Human
gaugcccacggcuggagcug

SEQ ID NO: 2081967 - RNA, 17 nt, Human
uaugugcauauuuuauu

SEQ ID NO: 2081968 - RNA, 18 nt, Human
uaaauugacacuuaaaaa

SEQ ID NO: 2081969 - RNA, 14 nt, Human
auuguccaggucua

SEQ ID NO: 2081970 - RNA, 20 nt, Human
ugcagccaccaguccauugg

SEQ ID NO: 2081971 - RNA, 17 nt, Human
cggcuggagcugccucu

SEQ ID NO: 2081972 - RNA, 20 nt, Human
gcuugcagagaugaggccgc

SEQ ID NO: 2081973 - RNA, 22 nt, Human
gcuauuugcuguuauuuuaucu

SEQ ID NO: 2081974 - RNA, 14 nt, Human
cagauccuggaaau

SEQ ID NO: 2081975 - RNA, 16 nt, Human
gaaauguauucuuuua

SEQ ID NO: 2081976 - RNA, 16 nt, Human
cuuccucccuggaauc

SEQ ID NO: 2081977 - RNA, 22 nt, Human
ggccggcgcgcucaucccaccc

SEQ ID NO: 2081978 - RNA, 12 nt, Human
cucccugccccc

SEQ ID NO: 2081979 - RNA, 23 nt, Human
uagacacacaugaaguccaagca

SEQ ID NO: 2081980 - RNA, 16 nt, Human
cuggcugcgcucggcc

SEQ ID NO: 2081981 - RNA, 13 nt, Human
cgaguacuucccg

SEQ ID NO: 2081982 - RNA, 20 nt, Human
ugccccccagcccuccuuau

SEQ ID NO: 2081983 - RNA, 14 nt, Human
uugacccacaagaa

SEQ ID NO: 2081984 - RNA, 19 nt, Human
uccccagagcuacaggccc

SEQ ID NO: 2081985 - RNA, 22 nt, Human
gaggggagcaugggaagugacg

SEQ ID NO: 2081986 - RNA, 16 nt, Human
ucuuggggaauauguu

SEQ ID NO: 2081987 - RNA, 23 nt, Human
gcugaguguuucacaccuuaucu

SEQ ID NO: 2081988 - RNA, 14 nt, Human
aguuuuuuuuuaaa

SEQ ID NO: 2081989 - RNA, 15 nt, Human
cgcgccgcgcuccuc

SEQ ID NO: 2081990 - RNA, 23 nt, Human
ugucuucaggggccacaccaacc

SEQ ID NO: 2081991 - RNA, 16 nt, Human
cgcccacuuccucccg

SEQ ID NO: 2081992 - RNA, 19 nt, Human
gcuuguauuccuuuuucuc

SEQ ID NO: 2081993 - RNA, 16 nt, Human
ccugcaaagcccagcu

SEQ ID NO: 2081994 - RNA, 19 nt, Human
aaaccgaacugauguaagu

SEQ ID NO: 2081995 - RNA, 21 nt, Human
caagacccaaaaggcagaagc

SEQ ID NO: 2081996 - RNA, 14 nt, Human
agacaucaacagau

SEQ ID NO: 2081997 - RNA, 12 nt, Human
gaaggggcggcg

SEQ ID NO: 2081998 - RNA, 19 nt, Human
agcguugagccaccaagcu

SEQ ID NO: 2081999 - RNA, 16 nt, Human
cuacacuccagugaga

SEQ ID NO: 2082000 - RNA, 13 nt, Human
ccccagcccuccu

SEQ ID NO: 2082001 - RNA, 19 nt, Human
uauauuuuuuguuaaauga

SEQ ID NO: 2082002 - RNA, 20 nt, Human
cacuguggguagacacacau

SEQ ID NO: 2082003 - RNA, 19 nt, Human
uauuuaaccucuaaauucu

SEQ ID NO: 2082004 - RNA, 13 nt, Human
ccaaaagguauuu

SEQ ID NO: 2082005 - RNA, 17 nt, Human
aaauguucaucaaugaa

SEQ ID NO: 2082006 - RNA, 12 nt, Human
ccugccagcugg

SEQ ID NO: 2082007 - RNA, 15 nt, Human
aaauauuuauuuuaa

SEQ ID NO: 2082008 - RNA, 21 nt, Human
acaguuaccucugccucagaa

SEQ ID NO: 2082009 - RNA, 21 nt, Human
gaaagcagggacuugaaccca

SEQ ID NO: 2082010 - RNA, 19 nt, Human
agagaacagggcugaagcu

SEQ ID NO: 2082011 - RNA, 19 nt, Human
aauuuuguuauguauauuu

SEQ ID NO: 2082012 - RNA, 15 nt, Human
uaauuugguuuucac

SEQ ID NO: 2082013 - RNA, 22 nt, Human
agcgcgcgcgcccucuggcugc

SEQ ID NO: 2082014 - RNA, 22 nt, Human
acacuguccauucuuccuccca

SEQ ID NO: 2082015 - RNA, 20 nt, Human
auuuauugaggcuuuaaaac

SEQ ID NO: 2082016 - RNA, 16 nt, Human
agguugcagugagccg

SEQ ID NO: 2082017 - RNA, 22 nt, Human
aguauguuagugcaaauuguca

SEQ ID NO: 2082018 - RNA, 14 nt, Human
ucucuaucauuaaa

SEQ ID NO: 2082019 - RNA, 16 nt, Human
uggcaauugacuauag

SEQ ID NO: 2082020 - RNA, 23 nt, Human
cucuugaggcacagaaacuccug

SEQ ID NO: 2082021 - RNA, 13 nt, Human
uaguuuuuaaagu

SEQ ID NO: 2082022 - RNA, 22 nt, Human
aucuucacuuuuauaagaaaua

SEQ ID NO: 2082023 - RNA, 15 nt, Human
cuuuaaaacuuaucc

SEQ ID NO: 2082024 - RNA, 19 nt, Human
caccugugccguccccaga

SEQ ID NO: 2082025 - RNA, 18 nt, Human
ccucuggcuccagcuggc

SEQ ID NO: 2082026 - RNA, 19 nt, Human
cccugccucaagcuaugug

SEQ ID NO: 2082027 - RNA, 22 nt, Human
ucuacuaaaaauacaaaaaaaa

SEQ ID NO: 2082028 - RNA, 22 nt, Human
ggcugcugguggcgcuggcugc

SEQ ID NO: 2082029 - RNA, 18 nt, Human
gccccgucccccucuggc

SEQ ID NO: 2082030 - RNA, 23 nt, Human
ucuuagaugcaguucugaagaag

SEQ ID NO: 2082031 - RNA, 13 nt, Human
cgcugcgcgccgc

SEQ ID NO: 2082032 - RNA, 20 nt, Human
ggcuccggacgcugcugccg

SEQ ID NO: 2082033 - RNA, 13 nt, Human
cauggaaaaguuu

SEQ ID NO: 2082034 - RNA, 14 nt, Human
uaaaguaugugcau

SEQ ID NO: 2082035 - RNA, 18 nt, Human
gcuccgcgcagcucaggc

SEQ ID NO: 2082036 - RNA, 15 nt, Human
auauuuuuuguuaaa

SEQ ID NO: 2082037 - RNA, 15 nt, Human
auuucacuuuagaaa

SEQ ID NO: 2082038 - RNA, 12 nt, Human
uaagaagacugc

SEQ ID NO: 2082039 - RNA, 22 nt, Human
auuacuguaagaaaauaucacu

SEQ ID NO: 2082040 - RNA, 19 nt, Human
cucuguucugcacacagca

SEQ ID NO: 2082041 - RNA, 16 nt, Human
cuaagucccugcugcc

SEQ ID NO: 2082042 - RNA, 23 nt, Human
uguucuugugaacccaaagugug

SEQ ID NO: 2082043 - RNA, 14 nt, Human
gaacgagacaagca

SEQ ID NO: 2082044 - RNA, 22 nt, Human
agaagcaccaaucaugaauuag

SEQ ID NO: 2082045 - RNA, 17 nt, Human
gcaagcucuaucaccaa

SEQ ID NO: 2082046 - RNA, 16 nt, Human
agcccugccucaagcu

SEQ ID NO: 2082047 - RNA, 18 nt, Human
gagucccaggcugagccu

SEQ ID NO: 2082048 - RNA, 18 nt, Human
uucaaugccccugaauuu

SEQ ID NO: 2082049 - RNA, 16 nt, Human
gaauauaaauuuauca

SEQ ID NO: 2082050 - RNA, 15 nt, Human
ggccuucggccucca

SEQ ID NO: 2082051 - RNA, 14 nt, Human
cucaggcuggcacc

SEQ ID NO: 2082052 - RNA, 21 nt, Human
ccuggugccucaccccuugcc

SEQ ID NO: 2082053 - RNA, 19 nt, Human
gaaugggggcagcaccucc

SEQ ID NO: 2082054 - RNA, 21 nt, Human
cuccauggaaacgaagcacca

SEQ ID NO: 2082055 - RNA, 20 nt, Human
caccgcagggugaacugcag

SEQ ID NO: 2082056 - RNA, 18 nt, Human
uuugaagcacagugauca

SEQ ID NO: 2082057 - RNA, 16 nt, Human
aagaagcuagaaaaca

SEQ ID NO: 2082058 - RNA, 14 nt, Human
cugcugguggcgcu

SEQ ID NO: 2082059 - RNA, 17 nt, Human
cuuccucugagccuugg

SEQ ID NO: 2082060 - RNA, 22 nt, Human
uaauucugguagcuaaauauau

SEQ ID NO: 2082061 - RNA, 16 nt, Human
gucuucaggggccaca

SEQ ID NO: 2082062 - RNA, 18 nt, Human
gacccacuggacucaccu

SEQ ID NO: 2082063 - RNA, 20 nt, Human
aaauccuugaagauuuacca

SEQ ID NO: 2082064 - RNA, 21 nt, Human
ugggaggcugagaugggagaa

SEQ ID NO: 2082065 - RNA, 19 nt, Human
gcugcugguggcgcuggcu

SEQ ID NO: 2082066 - RNA, 23 nt, Human
ggucucagugucaaugcagcccc

SEQ ID NO: 2082067 - RNA, 18 nt, Human
uaaguuuuuuuuuaaaaa

SEQ ID NO: 2082068 - RNA, 16 nt, Human
cuaguuuauauagaaa

SEQ ID NO: 2082069 - RNA, 18 nt, Human
uucucuaggaaauauuua

SEQ ID NO: 2082070 - RNA, 16 nt, Human
ggggcagcaccuccua

SEQ ID NO: 2082071 - RNA, 23 nt, Human
ggaacaguuaccucugccucaga

SEQ ID NO: 2082072 - RNA, 15 nt, Human
ccagcacagccucuu

SEQ ID NO: 2082073 - RNA, 12 nt, Human
ucuauguagaau

SEQ ID NO: 2082074 - RNA, 15 nt, Human
augcccauaccccug

SEQ ID NO: 2082075 - RNA, 17 nt, Human
agucuucagcagagaag

SEQ ID NO: 2082076 - RNA, 11 nt, Human
auacucuuaua

SEQ ID NO: 2082077 - RNA, 14 nt, Human
cugaggcuccacuu

SEQ ID NO: 2082078 - RNA, 18 nt, Human
acagucucuugaggcaca

SEQ ID NO: 2082079 - RNA, 19 nt, Human
gcacuaguauuucuaugaa

SEQ ID NO: 2082080 - RNA, 17 nt, Human
ugucuucaggggccaca

SEQ ID NO: 2082081 - RNA, 14 nt, Human
ucccuugaugaaga

SEQ ID NO: 2082082 - RNA, 21 nt, Human
uuccuagucuguuuucccucc

SEQ ID NO: 2082083 - RNA, 23 nt, Human
agcucugcccauccugccccuga

SEQ ID NO: 2082084 - RNA, 16 nt, Human
gcuguuaaucuuucaa

SEQ ID NO: 2082085 - RNA, 18 nt, Human
gacauuugcucauggaau

SEQ ID NO: 2082086 - RNA, 23 nt, Human
uacuuccagggcuacgcgcgcuc

SEQ ID NO: 2082087 - RNA, 17 nt, Human
gcucaccagucccuccc

SEQ ID NO: 2082088 - RNA, 21 nt, Human
cuccagggagucucagcuuca

SEQ ID NO: 2082089 - RNA, 15 nt, Human
auaucuauauuuuac

SEQ ID NO: 2082090 - RNA, 20 nt, Human
ggccuaugcagagguccaca

SEQ ID NO: 2082091 - RNA, 15 nt, Human
aagccagauuuuccu

SEQ ID NO: 2082092 - RNA, 18 nt, Human
auggaaguaaauguuguu

SEQ ID NO: 2082093 - RNA, 17 nt, Human
acuguaaagcuuugugc

SEQ ID NO: 2082094 - RNA, 17 nt, Human
cuagaaaacaggcaaau

SEQ ID NO: 2082095 - RNA, 17 nt, Human
agcccuuccccucugca

SEQ ID NO: 2082096 - RNA, 23 nt, Human
aucaccaaggcugauuaaaccaa

SEQ ID NO: 2082097 - RNA, 21 nt, Human
acaugagguacugagagugaa

SEQ ID NO: 2082098 - RNA, 19 nt, Human
ggccugcucgcccacuucc

SEQ ID NO: 2082099 - RNA, 17 nt, Human
uaauuuuuauauuugaa

SEQ ID NO: 2082100 - RNA, 20 nt, Human
uauuuauuacuguaagaaaa

SEQ ID NO: 2082101 - RNA, 19 nt, Human
gccugaucaccugcccugc

SEQ ID NO: 2082102 - RNA, 17 nt, Human
cccugcugcccuucccc

SEQ ID NO: 2082103 - RNA, 20 nt, Human
augaagauacugaaauaaac

SEQ ID NO: 2082104 - RNA, 17 nt, Human
aaggugaucuggcucug

SEQ ID NO: 2082105 - RNA, 13 nt, Human
uaagugcagcccc

SEQ ID NO: 2082106 - RNA, 16 nt, Human
gacauuugcucaugga

SEQ ID NO: 2082107 - RNA, 17 nt, Human
acacuaagagagaauga

SEQ ID NO: 2082108 - RNA, 20 nt, Human
gacauuugcucauggaauug

SEQ ID NO: 2082109 - RNA, 23 nt, Human
cuggccgggagccugaucaccug

SEQ ID NO: 2082110 - RNA, 17 nt, Human
cugagaugggagaauca

SEQ ID NO: 2082111 - RNA, 16 nt, Human
uguugagguaccucca

SEQ ID NO: 2082112 - RNA, 14 nt, Human
ggcaccucucuggg

SEQ ID NO: 2082113 - RNA, 23 nt, Human
uccacaaguaaaaggaaaugcuc

SEQ ID NO: 2082114 - RNA, 14 nt, Human
cugcuaguuuauau

SEQ ID NO: 2082115 - RNA, 22 nt, Human
gcuccuccagggagucucagcu

SEQ ID NO: 2082116 - RNA, 17 nt, Human
augcagagguccacaac

SEQ ID NO: 2082117 - RNA, 14 nt, Human
gaaugauuaugaau

SEQ ID NO: 2082118 - RNA, 20 nt, Human
ggguuccuuccucugagccu

SEQ ID NO: 2082119 - RNA, 22 nt, Human
acuuauuguagcauccuggaau

SEQ ID NO: 2082120 - RNA, 15 nt, Human
caggaaguagaggag

SEQ ID NO: 2082121 - RNA, 18 nt, Human
agcaaaauuuuuucucua

SEQ ID NO: 2082122 - RNA, 14 nt, Human
uccagauccuggaa

SEQ ID NO: 2082123 - RNA, 18 nt, Human
uucaauaucuuuuuuuua

SEQ ID NO: 2082124 - RNA, 14 nt, Human
gagcuuuuguagaa

SEQ ID NO: 2082125 - RNA, 16 nt, Human
augcuguauuuuaaaa

SEQ ID NO: 2082126 - RNA, 20 nt, Human
aacaaugcuguauuuuaaaa

SEQ ID NO: 2082127 - RNA, 14 nt, Human
ccacuggacucacc

SEQ ID NO: 2082128 - RNA, 22 nt, Human
ugaauuguaggugacuauuaua

SEQ ID NO: 2082129 - RNA, 20 nt, Human
uagcauuuguguugaagagg

SEQ ID NO: 2082130 - RNA, 19 nt, Human
gcccuuccccucugcagcu

SEQ ID NO: 2082131 - RNA, 23 nt, Human
auuuaaauagcuuuuuucucuga

SEQ ID NO: 2082132 - RNA, 18 nt, Human
auagucaaauugugugaa

SEQ ID NO: 2082133 - RNA, 13 nt, Human
aacacaacuauau

SEQ ID NO: 2082134 - RNA, 19 nt, Human
aguuguaauuuuuuugugg

SEQ ID NO: 2082135 - RNA, 21 nt, Human
cuugaggcacagaaacuccug

SEQ ID NO: 2082136 - RNA, 21 nt, Human
ggcgcuggcugcgcucggccu

SEQ ID NO: 2082137 - RNA, 17 nt, Human
gaagcaccaaucaugaa

SEQ ID NO: 2082138 - RNA, 14 nt, Human
aucucuucucagaa

SEQ ID NO: 2082139 - RNA, 19 nt, Human
agucccuccccaaaugcuu

SEQ ID NO: 2082140 - RNA, 17 nt, Human
cugagcgacagugagac

SEQ ID NO: 2082141 - RNA, 12 nt, Human
ccagucccuccc

SEQ ID NO: 2082142 - RNA, 19 nt, Human
uauuuuaauaauguuucaa

SEQ ID NO: 2082143 - RNA, 12 nt, Human
acacugaagaag

SEQ ID NO: 2082144 - RNA, 13 nt, Human
cacaacuauauug

SEQ ID NO: 2082145 - RNA, 16 nt, Human
ucuaaaaguuuaaguu

SEQ ID NO: 2082146 - RNA, 11 nt, Human
ccggccgcgcu

SEQ ID NO: 2082147 - RNA, 20 nt, Human
uguaaagcuuugugcagauu

SEQ ID NO: 2082148 - RNA, 21 nt, Human
gcauggccacaucugagcccc

SEQ ID NO: 2082149 - RNA, 12 nt, Human
cggcccugugcg

SEQ ID NO: 2082150 - RNA, 19 nt, Human
ucccgcuguuccucgccac

SEQ ID NO: 2082151 - RNA, 18 nt, Human
agugcacuaauguguaag

SEQ ID NO: 2082152 - RNA, 14 nt, Human
acgcauggaaaagu

SEQ ID NO: 2082153 - RNA, 21 nt, Human
cugccccggggaggggcgcuc

SEQ ID NO: 2082154 - RNA, 20 nt, Human
auaaauggcuuccuggcaau

SEQ ID NO: 2082155 - RNA, 16 nt, Human
cagggcuacgcgcgcu

SEQ ID NO: 2082156 - RNA, 11 nt, Human
aagucccugcu

SEQ ID NO: 2082157 - RNA, 23 nt, Human
augaauuaaguuuuuuuuuaaaa

SEQ ID NO: 2082158 - RNA, 16 nt, Human
ggccuccauccugagg

SEQ ID NO: 2082159 - RNA, 17 nt, Human
cuuccuaauuccacagc

SEQ ID NO: 2082160 - RNA, 14 nt, Human
aaagagaacuucca

SEQ ID NO: 2082161 - RNA, 20 nt, Human
ccagugagacagcucugcau

SEQ ID NO: 2082162 - RNA, 16 nt, Human
cuggguugaagggcag

SEQ ID NO: 2082163 - RNA, 19 nt, Human
ugccucaagcuaugugagc

SEQ ID NO: 2082164 - RNA, 18 nt, Human
ucuaugaaauauuauguu

SEQ ID NO: 2082165 - RNA, 18 nt, Human
uuuuauaucaauuuaaaa

SEQ ID NO: 2082166 - RNA, 19 nt, Human
ggcgggagggcgcggggcg

SEQ ID NO: 2082167 - RNA, 19 nt, Human
cccacuggacucaccuccc

SEQ ID NO: 2082168 - RNA, 12 nt, Human
ucccccucuggc

SEQ ID NO: 2082169 - RNA, 23 nt, Human
gaccccugagcuugcagagauga

SEQ ID NO: 2082170 - RNA, 15 nt, Human
auuuuaaaagaauga

SEQ ID NO: 2082171 - RNA, 17 nt, Human
gcugccucucucaucca

SEQ ID NO: 2082172 - RNA, 17 nt, Human
aacugccaucauuuacu

SEQ ID NO: 2082173 - RNA, 17 nt, Human
ucugguagcuaaauaua

SEQ ID NO: 2082174 - RNA, 19 nt, Human
ucuucacuuuuauaagaaa

SEQ ID NO: 2082175 - RNA, 15 nt, Human
ccaggcggguccggg

SEQ ID NO: 2082176 - RNA, 15 nt, Human
ggccugagaccaagg

SEQ ID NO: 2082177 - RNA, 13 nt, Human
uguuuucccuccu

SEQ ID NO: 2082178 - RNA, 14 nt, Human
gccucagucucccu

SEQ ID NO: 2082179 - RNA, 18 nt, Human
cugcugguggcgcuggcu

SEQ ID NO: 2082180 - RNA, 20 nt, Human
aacagucucuugaggcacag

SEQ ID NO: 2082181 - RNA, 14 nt, Human
agaaaugaaagcag

SEQ ID NO: 2082182 - RNA, 18 nt, Human
uuuaauuugguuuucaca

SEQ ID NO: 2082183 - RNA, 17 nt, Human
acuugaacccauauuug

SEQ ID NO: 2082184 - RNA, 16 nt, Human
aaaauccauacauuug

SEQ ID NO: 2082185 - RNA, 22 nt, Human
accuaacgaaguauccuucagc

SEQ ID NO: 2082186 - RNA, 16 nt, Human
acauccuacaagacac

SEQ ID NO: 2082187 - RNA, 18 nt, Human
caaggcuagaaccaccug

SEQ ID NO: 2082188 - RNA, 10 nt, Human
ggggaggggc

SEQ ID NO: 2082189 - RNA, 14 nt, Human
uaaaauccauacau

SEQ ID NO: 2082190 - RNA, 15 nt, Human
caaaauggaauacuc

SEQ ID NO: 2082191 - RNA, 17 nt, Human
cccaucucagguguguu

SEQ ID NO: 2082192 - RNA, 14 nt, Human
uggacucaccuccc

SEQ ID NO: 2082193 - RNA, 23 nt, Human
agccccaaguggaacgagacaag

SEQ ID NO: 2082194 - RNA, 18 nt, Human
uaauuagcauggccacau

SEQ ID NO: 2082195 - RNA, 22 nt, Human
aaaugauguuucauaagaauuc

SEQ ID NO: 2082196 - RNA, 23 nt, Human
gcuaugcuauugaaguuuuggca

SEQ ID NO: 2082197 - RNA, 14 nt, Human
uuagagaauuuccu

SEQ ID NO: 2082198 - RNA, 14 nt, Human
auuuccaagaaaua

SEQ ID NO: 2082199 - RNA, 21 nt, Human
cccccucuccucucuuccucc

SEQ ID NO: 2082200 - RNA, 20 nt, Human
agaaggcuguggauuuaaug

SEQ ID NO: 2082201 - RNA, 15 nt, Human
cucccugccccccag

SEQ ID NO: 2082202 - RNA, 17 nt, Human
uaaccucuaaauucuuu

SEQ ID NO: 2082203 - RNA, 21 nt, Human
auaguuguaccgcaaugugac

SEQ ID NO: 2082204 - RNA, 14 nt, Human
uaaauaguuuauga

SEQ ID NO: 2082205 - RNA, 14 nt, Human
uauuugaaauauug

SEQ ID NO: 2082206 - RNA, 21 nt, Human
ugagaaggcuguggauuuaau

SEQ ID NO: 2082207 - RNA, 13 nt, Human
guuguguguggaa

SEQ ID NO: 2082208 - RNA, 16 nt, Human
acaugugcuggccacc

SEQ ID NO: 2082209 - RNA, 12 nt, Human
ggaggcugagau

SEQ ID NO: 2082210 - RNA, 19 nt, Human
cuagaguuuagcuggaaaa

SEQ ID NO: 2082211 - RNA, 17 nt, Human
guggcucugugugcucu

SEQ ID NO: 2082212 - RNA, 19 nt, Human
auuuugugaagcaaaauuu

SEQ ID NO: 2082213 - RNA, 15 nt, Human
uaggaaauauuuauu

SEQ ID NO: 2082214 - RNA, 19 nt, Human
cuucacccugaggugagca

SEQ ID NO: 2082215 - RNA, 17 nt, Human
auguugacaugggacau

SEQ ID NO: 2082216 - RNA, 20 nt, Human
ugagagacacacugaagaag

SEQ ID NO: 2082217 - RNA, 22 nt, Human
ugauaguuguaccgcaauguga

SEQ ID NO: 2082218 - RNA, 22 nt, Human
ugucucuacuaaaaauacaaaa

SEQ ID NO: 2082219 - RNA, 14 nt, Human
uaauaucuuaucuu

SEQ ID NO: 2082220 - RNA, 14 nt, Human
ugcuucuguuuuau

SEQ ID NO: 2082221 - RNA, 14 nt, Human
gcugauuaaaccaa

SEQ ID NO: 2082222 - RNA, 17 nt, Human
gccgcgcugcgcgccgc

SEQ ID NO: 2082223 - RNA, 14 nt, Human
cgcgcccucuggcu

SEQ ID NO: 2082224 - RNA, 19 nt, Human
ucaguccaugaagauguag

SEQ ID NO: 2082225 - RNA, 17 nt, Human
uggcuaagcaaaaugug

SEQ ID NO: 2082226 - RNA, 16 nt, Human
cauggguuuuauuaua

SEQ ID NO: 2082227 - RNA, 21 nt, Human
acucauuaaauggaaguaaau

SEQ ID NO: 2082228 - RNA, 23 nt, Human
ggucuaucuuugagcgcccacua

SEQ ID NO: 2082229 - RNA, 12 nt, Human
gcucagcccugg

SEQ ID NO: 2082230 - RNA, 16 nt, Human
gucuguuuucccuccu

SEQ ID NO: 2082231 - RNA, 18 nt, Human
agaagcaacccaaauguu

SEQ ID NO: 2082232 - RNA, 14 nt, Human
cacccugagguugu

SEQ ID NO: 2082233 - RNA, 13 nt, Human
auguagaauauau

SEQ ID NO: 2082234 - RNA, 14 nt, Human
auccuugaagauuu

SEQ ID NO: 2082235 - RNA, 14 nt, Human
auuuaauuauuuca

SEQ ID NO: 2082236 - RNA, 16 nt, Human
cuagaacucccuuuca

SEQ ID NO: 2082237 - RNA, 20 nt, Human
aaugauguuucauaagaauu

SEQ ID NO: 2082238 - RNA, 13 nt, Human
uggcuccagcugg

SEQ ID NO: 2082239 - RNA, 22 nt, Human
caggggccacaccaaccuucug

SEQ ID NO: 2082240 - RNA, 20 nt, Human
cagcuggccgggagccugau

SEQ ID NO: 2082241 - RNA, 21 nt, Human
gaaaaguauguuagugcaaau

SEQ ID NO: 2082242 - RNA, 19 nt, Human
ucaccaaggcugauuaaac

SEQ ID NO: 2082243 - RNA, 21 nt, Human
gcgcucaucccacccgcccac

SEQ ID NO: 2082244 - RNA, 19 nt, Human
gacggagccgggaaagaag

SEQ ID NO: 2082245 - RNA, 21 nt, Human
auucauagcagcuuauucaca

SEQ ID NO: 2082246 - RNA, 20 nt, Human
cagccugagcgacagugaga

SEQ ID NO: 2082247 - RNA, 16 nt, Human
uauuuuaauguuucuu

SEQ ID NO: 2082248 - RNA, 19 nt, Human
cggggcggggagcgagccc

SEQ ID NO: 2082249 - RNA, 13 nt, Human
cucaccuccccca

SEQ ID NO: 2082250 - RNA, 20 nt, Human
ccaacacccugagguugugu

SEQ ID NO: 2082251 - RNA, 21 nt, Human
gaagagccggagccuccagcu

SEQ ID NO: 2082252 - RNA, 15 nt, Human
ucuaggacugaauua

SEQ ID NO: 2082253 - RNA, 14 nt, Human
caucauuuacuuuu

SEQ ID NO: 2082254 - RNA, 16 nt, Human
aaagcuacuuauugua

SEQ ID NO: 2082255 - RNA, 16 nt, Human
cuaaauucuuucauuu

SEQ ID NO: 2082256 - RNA, 19 nt, Human
uccauccugaggcuccacu

SEQ ID NO: 2082257 - RNA, 20 nt, Human
aagggcuguuauaaucuuuc

SEQ ID NO: 2082258 - RNA, 15 nt, Human
auaucaauuuaaaaa

SEQ ID NO: 2082259 - RNA, 16 nt, Staphylococcus aureus subsp. aureus MW2
uuuucuugguuugaga

SEQ ID NO: 2082260 - RNA, 21 nt, Staphylococcus aureus subsp. aureus MW2
uuuucugugaccaauagaauu

SEQ ID NO: 2082261 - RNA, 18 nt, Staphylococcus aureus subsp. aureus MW2
uuuucuugaaauaaacau

SEQ ID NO: 2082262 - RNA, 21 nt, Staphylococcus aureus subsp. aureus MW2
uuuugcgaccggauguuucuu

SEQ ID NO: 2082263 - RNA, 16 nt, Staphylococcus aureus subsp. aureus MW2
uuuugcgcuucuagua

SEQ ID NO: 2082264 - RNA, 18 nt, Staphylococcus aureus subsp. aureus MW2
uuuuaguucacaugaauu

SEQ ID NO: 2082265 - RNA, 20 nt, Staphylococcus aureus subsp. aureus MW2
uuuguccgauuuauuugaga

SEQ ID NO: 2082266 - RNA, 13 nt, Staphylococcus aureus subsp. aureus MW2
uuugucguuacua

SEQ ID NO: 2082267 - RNA, 16 nt, Staphylococcus aureus subsp. aureus MW2
uuuguaugauaaccau

SEQ ID NO: 2082268 - RNA, 16 nt, Staphylococcus aureus subsp. aureus MW2
uuuguauuaauuugaa

SEQ ID NO: 2082269 - RNA, 17 nt, Staphylococcus aureus subsp. aureus MW2
uuuguauugacaucuuc

SEQ ID NO: 2082270 - RNA, 22 nt, Staphylococcus aureus subsp. aureus MW2
uuuuaccagcaugaaucgcauu

SEQ ID NO: 2082271 - RNA, 16 nt, Staphylococcus aureus subsp. aureus MW2
uuuuacaaguuguuca

SEQ ID NO: 2082272 - RNA, 12 nt, Staphylococcus aureus subsp. aureus MW2
uuuccaauccau

SEQ ID NO: 2082273 - RNA, 13 nt, Staphylococcus aureus subsp. aureus MW2
uuuccaauccauu

SEQ ID NO: 2082274 - RNA, 21 nt, Staphylococcus aureus subsp. aureus MW2
uuucaucuuuuucacuaauca

SEQ ID NO: 2082275 - RNA, 13 nt, Staphylococcus aureus subsp. aureus MW2
uuuauaaacaaua

SEQ ID NO: 2082276 - RNA, 19 nt, Staphylococcus aureus subsp. aureus MW2
uuuagucauuacaaaucau

SEQ ID NO: 2082277 - RNA, 22 nt, Staphylococcus aureus subsp. aureus MW2
uuuauacagugaaucuaaacua

SEQ ID NO: 2082278 - RNA, 13 nt, Staphylococcus aureus subsp. aureus MW2
uuuauacuuaaua

SEQ ID NO: 2082279 - RNA, 13 nt, Staphylococcus aureus subsp. aureus MW2
uuuaagaaugcga

SEQ ID NO: 2082280 - RNA, 19 nt, Staphylococcus aureus subsp. aureus MW2
uuuaagcuuacgacauacu

SEQ ID NO: 2082281 - RNA, 23 nt, Staphylococcus aureus subsp. aureus MW2
uuuaacuuuaauuaaagcaucuu

SEQ ID NO: 2082282 - RNA, 22 nt, Staphylococcus aureus subsp. aureus MW2
uuuaauagcgauaagcaugaua

SEQ ID NO: 2082283 - RNA, 19 nt, Staphylococcus aureus subsp. aureus MW2
uuuaaguuuauaaucaguu

SEQ ID NO: 2082284 - RNA, 12 nt, Staphylococcus aureus subsp. aureus MW2
uuuaaaugauau

SEQ ID NO: 2082285 - RNA, 20 nt, Staphylococcus aureus subsp. aureus MW2
uuuaaaugauuucacuucau

SEQ ID NO: 2082286 - RNA, 21 nt, Staphylococcus aureus subsp. aureus MW2
uuuaaaaauaaaaaaccaaua

SEQ ID NO: 2082287 - RNA, 23 nt, Staphylococcus aureus subsp. aureus MW2
uuuaacauauagauaucuguaua

SEQ ID NO: 2082288 - RNA, 23 nt, Staphylococcus aureus subsp. aureus MW2
uuuaacaucauuuuuggaugaua

SEQ ID NO: 2082289 - RNA, 12 nt, Staphylococcus aureus subsp. aureus MW2
uuguauaacuaa

SEQ ID NO: 2082290 - RNA, 16 nt, Staphylococcus aureus subsp. aureus MW2
uuguaugauaaccauu

SEQ ID NO: 2082291 - RNA, 13 nt, Staphylococcus aureus subsp. aureus MW2
uuuaaacgcucau

SEQ ID NO: 2082292 - RNA, 13 nt, Staphylococcus aureus subsp. aureus MW2
uuuaaaaaguaau

SEQ ID NO: 2082293 - RNA, 13 nt, Staphylococcus aureus subsp. aureus MW2
uugcuuauguaca

SEQ ID NO: 2082294 - RNA, 14 nt, Staphylococcus aureus subsp. aureus MW2
uugcuugcuuacaa

SEQ ID NO: 2082295 - RNA, 24 nt, Staphylococcus aureus subsp. aureus MW2
uuggcaaacuauuaauagcaccau

SEQ ID NO: 2082296 - RNA, 17 nt, Staphylococcus aureus subsp. aureus MW2
uugccauucauacacua

SEQ ID NO: 2082297 - RNA, 18 nt, Staphylococcus aureus subsp. aureus MW2
uugauuaucauaugaaca

SEQ ID NO: 2082298 - RNA, 13 nt, Staphylococcus aureus subsp. aureus MW2
uugauauuuaccg

SEQ ID NO: 2082299 - RNA, 22 nt, Staphylococcus aureus subsp. aureus MW2
uugaaccggaaauuaaaucuac

SEQ ID NO: 2082300 - RNA, 17 nt, Staphylococcus aureus subsp. aureus MW2
uugaagaauauaaacua

SEQ ID NO: 2082301 - RNA, 15 nt, Staphylococcus aureus subsp. aureus MW2
uugaaucuuguugaa

SEQ ID NO: 2082302 - RNA, 16 nt, Staphylococcus aureus subsp. aureus MW2
uugaauauacuuaauu

SEQ ID NO: 2082303 - RNA, 16 nt, Staphylococcus aureus subsp. aureus MW2
uggaucacgauaaugu

SEQ ID NO: 2082304 - RNA, 20 nt, Staphylococcus aureus subsp. aureus MW2
uggauuuuauuuucaaaugu

SEQ ID NO: 2082305 - RNA, 19 nt, Staphylococcus aureus subsp. aureus MW2
uggccaaccaccauaugcu

SEQ ID NO: 2082306 - RNA, 22 nt, Staphylococcus aureus subsp. aureus MW2
uguguacguuucaauguaucaa

SEQ ID NO: 2082307 - RNA, 15 nt, Staphylococcus aureus subsp. aureus MW2
ugugcaugagacuua

SEQ ID NO: 2082308 - RNA, 22 nt, Staphylococcus aureus subsp. aureus MW2
uguguuaauacuucauauccuu

SEQ ID NO: 2082309 - RNA, 23 nt, Staphylococcus aureus subsp. aureus MW2
uguuaauucaggauggaaugaua

SEQ ID NO: 2082310 - RNA, 17 nt, Staphylococcus aureus subsp. aureus MW2
uguuauccaaaacauuu

SEQ ID NO: 2082311 - RNA, 15 nt, Staphylococcus aureus subsp. aureus MW2
uguuaucuugcuuau

SEQ ID NO: 2082312 - RNA, 18 nt, Staphylococcus aureus subsp. aureus MW2
uguugaauaauuaauguu

SEQ ID NO: 2082313 - RNA, 22 nt, Staphylococcus aureus subsp. aureus MW2
uguugaaacuguaucaacauau

SEQ ID NO: 2082314 - RNA, 18 nt, Staphylococcus aureus subsp. aureus MW2
uguccgagacuauauuca

SEQ ID NO: 2082315 - RNA, 20 nt, Staphylococcus aureus subsp. aureus MW2
uguagcuccuaaagcugcaa

SEQ ID NO: 2082316 - RNA, 23 nt, Staphylococcus aureus subsp. aureus MW2
uguaauuuucacuuucaaugaca

SEQ ID NO: 2082317 - RNA, 14 nt, Staphylococcus aureus subsp. aureus MW2
uguaccaucaauaa

SEQ ID NO: 2082318 - RNA, 14 nt, Staphylococcus aureus subsp. aureus MW2
ugguugaauaacac

SEQ ID NO: 2082319 - RNA, 15 nt, Staphylococcus aureus subsp. aureus MW2
ugguaacguucuacu

SEQ ID NO: 2082320 - RNA, 20 nt, Staphylococcus aureus subsp. aureus MW2
uuacuucuaauaguaaugau

SEQ ID NO: 2082321 - RNA, 22 nt, Staphylococcus aureus subsp. aureus MW2
uuacuuauauuuuaaugaccua

SEQ ID NO: 2082322 - RNA, 15 nt, Staphylococcus aureus subsp. aureus MW2
uuaguaauaacaucu

SEQ ID NO: 2082323 - RNA, 22 nt, Staphylococcus aureus subsp. aureus MW2
uuauaguacguuugcauauccu

SEQ ID NO: 2082324 - RNA, 22 nt, Staphylococcus aureus subsp. aureus MW2
uuauaucauaacuuaacucuau

SEQ ID NO: 2082325 - RNA, 23 nt, Staphylococcus aureus subsp. aureus MW2
uuagucaucaaccucauuugaca

SEQ ID NO: 2082326 - RNA, 16 nt, Staphylococcus aureus subsp. aureus MW2
uuagguuuaucauggu

SEQ ID NO: 2082327 - RNA, 19 nt, Staphylococcus aureus subsp. aureus MW2
uuaucuuuacgauaaacua

SEQ ID NO: 2082328 - RNA, 18 nt, Staphylococcus aureus subsp. aureus MW2
uuaucuguaauuaaucca

SEQ ID NO: 2082329 - RNA, 21 nt, Staphylococcus aureus subsp. aureus MW2
uuaucuaaaauuggugacacu

SEQ ID NO: 2082330 - RNA, 21 nt, Staphylococcus aureus subsp. aureus MW2
uuaaauucaucuuaucaagaa

SEQ ID NO: 2082331 - RNA, 18 nt, Staphylococcus aureus subsp. aureus MW2
uuaacaauuuuaucugaa

SEQ ID NO: 2082332 - RNA, 13 nt, Staphylococcus aureus subsp. aureus MW2
uuaacaucugaau

SEQ ID NO: 2082333 - RNA, 15 nt, Staphylococcus aureus subsp. aureus MW2
uuaaauugaaauguu

SEQ ID NO: 2082334 - RNA, 20 nt, Staphylococcus aureus subsp. aureus MW2
uuaacaaugcgauuaaacuc

SEQ ID NO: 2082335 - RNA, 14 nt, Staphylococcus aureus subsp. aureus MW2
uuaacaaugaacca

SEQ ID NO: 2082336 - RNA, 19 nt, Staphylococcus aureus subsp. aureus MW2
uguuuaucuccuaaaggua

SEQ ID NO: 2082337 - RNA, 15 nt, Staphylococcus aureus subsp. aureus MW2
uuaacuugaaauguu

SEQ ID NO: 2082338 - RNA, 23 nt, Staphylococcus aureus subsp. aureus MW2
uuaacaucuucauguaugaagua

SEQ ID NO: 2082339 - RNA, 15 nt, Staphylococcus aureus subsp. aureus MW2
uuaacugcaaacuug

SEQ ID NO: 2082340 - RNA, 17 nt, Staphylococcus aureus subsp. aureus MW2
uuacaaaugaagguguu

SEQ ID NO: 2082341 - RNA, 22 nt, Staphylococcus aureus subsp. aureus MW2
uuacaaugcgguauugcauguu

SEQ ID NO: 2082342 - RNA, 14 nt, Staphylococcus aureus subsp. aureus MW2
uuaaugaacgaauu

SEQ ID NO: 2082343 - RNA, 23 nt, Staphylococcus aureus subsp. aureus MW2
uuaaugaaucuguagucauagcu

SEQ ID NO: 2082344 - RNA, 11 nt, Staphylococcus aureus subsp. aureus MW2
uuaaucgcauu

SEQ ID NO: 2082345 - RNA, 18 nt, Staphylococcus aureus subsp. aureus MW2
uuaauccucauuaugaga

SEQ ID NO: 2082346 - RNA, 17 nt, Staphylococcus aureus subsp. aureus MW2
uucaucaaacaacauca

SEQ ID NO: 2082347 - RNA, 13 nt, Staphylococcus aureus subsp. aureus MW2
uucauauuuaaug

SEQ ID NO: 2082348 - RNA, 13 nt, Staphylococcus aureus subsp. aureus MW2
uucauaaaugcuu

SEQ ID NO: 2082349 - RNA, 18 nt, Staphylococcus aureus subsp. aureus MW2
uucauacacuuuaacaua

SEQ ID NO: 2082350 - RNA, 15 nt, Staphylococcus aureus subsp. aureus MW2
uucauacauaacaca

SEQ ID NO: 2082351 - RNA, 11 nt, Staphylococcus aureus subsp. aureus MW2
uucaucaugca

SEQ ID NO: 2082352 - RNA, 20 nt, Staphylococcus aureus subsp. aureus MW2
uuauuaacaaaagugaaugu

SEQ ID NO: 2082353 - RNA, 20 nt, Staphylococcus aureus subsp. aureus MW2
uucaaaugugaaagucaucc

SEQ ID NO: 2082354 - RNA, 19 nt, Staphylococcus aureus subsp. aureus MW2
uucaaauggacuaacguca

SEQ ID NO: 2082355 - RNA, 14 nt, Staphylococcus aureus subsp. aureus MW2
uucaacauaacuca

SEQ ID NO: 2082356 - RNA, 20 nt, Staphylococcus aureus subsp. aureus MW2
uucaauuuuaccagcaugaa

SEQ ID NO: 2082357 - RNA, 21 nt, Staphylococcus aureus subsp. aureus MW2
uucaaaugcuuaauaaaauca

SEQ ID NO: 2082358 - RNA, 21 nt, Staphylococcus aureus subsp. aureus MW2
uuauuaauuaaaaaauuccua

SEQ ID NO: 2082359 - RNA, 12 nt, Staphylococcus aureus subsp. aureus MW2
uuauuaaaucag

SEQ ID NO: 2082360 - RNA, 16 nt, Staphylococcus aureus subsp. aureus MW2
uuauguucagaacuac

SEQ ID NO: 2082361 - RNA, 17 nt, Staphylococcus aureus subsp. aureus MW2
uuaugcggucuaaaugc

SEQ ID NO: 2082362 - RNA, 13 nt, Staphylococcus aureus subsp. aureus MW2
uuaugaucaauaa

SEQ ID NO: 2082363 - RNA, 16 nt, Staphylococcus aureus subsp. aureus MW2
uuaugaaagugaauug

SEQ ID NO: 2082364 - RNA, 22 nt, Staphylococcus aureus subsp. aureus MW2
ucguagcaugacauuaaggcuu

SEQ ID NO: 2082365 - RNA, 17 nt, Staphylococcus aureus subsp. aureus MW2
ucguuguucauaaucau

SEQ ID NO: 2082366 - RNA, 16 nt, Staphylococcus aureus subsp. aureus MW2
ucuaaaacuaaaggua

SEQ ID NO: 2082367 - RNA, 22 nt, Staphylococcus aureus subsp. aureus MW2
ucuaaaugauggguaguuaaua

SEQ ID NO: 2082368 - RNA, 15 nt, Staphylococcus aureus subsp. aureus MW2
ucuauaaaaagaaua

SEQ ID NO: 2082369 - RNA, 17 nt, Staphylococcus aureus subsp. aureus MW2
ucuaguguucucauuau

SEQ ID NO: 2082370 - RNA, 14 nt, Staphylococcus aureus subsp. aureus MW2
ucuagguuagaauu

SEQ ID NO: 2082371 - RNA, 14 nt, Staphylococcus aureus subsp. aureus MW2
ucuaucaacgucac

SEQ ID NO: 2082372 - RNA, 23 nt, Staphylococcus aureus subsp. aureus MW2
ucuauaauaaaucggacugauag

SEQ ID NO: 2082373 - RNA, 20 nt, Staphylococcus aureus subsp. aureus MW2
ucuauccaaagacauacagu

SEQ ID NO: 2082374 - RNA, 18 nt, Staphylococcus aureus subsp. aureus MW2
ucuaauacuucuaacgca

SEQ ID NO: 2082375 - RNA, 17 nt, Staphylococcus aureus subsp. aureus MW2
ucuagagauaacuagaa

SEQ ID NO: 2082376 - RNA, 14 nt, Staphylococcus aureus subsp. aureus MW2
ucgcaaugucaucu

SEQ ID NO: 2082377 - RNA, 18 nt, Staphylococcus aureus subsp. aureus MW2
ugcauaaaaccuucaauc

SEQ ID NO: 2082378 - RNA, 13 nt, Staphylococcus aureus subsp. aureus MW2
ugcauacauaucu

SEQ ID NO: 2082379 - RNA, 18 nt, Staphylococcus aureus subsp. aureus MW2
ugcagucgcaauggcaau

SEQ ID NO: 2082380 - RNA, 23 nt, Staphylococcus aureus subsp. aureus MW2
ugcgccaguuucuaauaaugcau

SEQ ID NO: 2082381 - RNA, 21 nt, Staphylococcus aureus subsp. aureus MW2
ugcgauggucauguguugcaa

SEQ ID NO: 2082382 - RNA, 14 nt, Staphylococcus aureus subsp. aureus MW2
ugagguaaaacuac

SEQ ID NO: 2082383 - RNA, 12 nt, Staphylococcus aureus subsp. aureus MW2
ugacugaaugag

SEQ ID NO: 2082384 - RNA, 18 nt, Staphylococcus aureus subsp. aureus MW2
ugauuuuaccuguuucua

SEQ ID NO: 2082385 - RNA, 15 nt, Staphylococcus aureus subsp. aureus MW2
ugauuuuacuugaau

SEQ ID NO: 2082386 - RNA, 17 nt, Staphylococcus aureus subsp. aureus MW2
ugauuaaaguguuucaa

SEQ ID NO: 2082387 - RNA, 22 nt, Staphylococcus aureus subsp. aureus MW2
ugauuagcgcaccaauuaucaa

SEQ ID NO: 2082388 - RNA, 16 nt, Staphylococcus aureus subsp. aureus MW2
ugaugcgcuucuaacu

SEQ ID NO: 2082389 - RNA, 17 nt, Staphylococcus aureus subsp. aureus MW2
ugauaaaaauccuauga

SEQ ID NO: 2082390 - RNA, 13 nt, Staphylococcus aureus subsp. aureus MW2
ugaguuguugcaa

SEQ ID NO: 2082391 - RNA, 16 nt, Staphylococcus aureus subsp. aureus MW2
ugaguuuaaucgcauu

SEQ ID NO: 2082392 - RNA, 13 nt, Staphylococcus aureus subsp. aureus MW2
ugacgaguagauu

SEQ ID NO: 2082393 - RNA, 16 nt, Staphylococcus aureus subsp. aureus MW2
ugaccuucaguuucua

SEQ ID NO: 2082394 - RNA, 16 nt, Staphylococcus aureus subsp. aureus MW2
ugaaaugauacauuau

SEQ ID NO: 2082395 - RNA, 22 nt, Staphylococcus aureus subsp. aureus MW2
ugaaccaagaaugugaugauua

SEQ ID NO: 2082396 - RNA, 18 nt, Staphylococcus aureus subsp. aureus MW2
ugaaauuucauaaaguuu

SEQ ID NO: 2082397 - RNA, 13 nt, Staphylococcus aureus subsp. aureus MW2
ugaaugaaccuuu

SEQ ID NO: 2082398 - RNA, 18 nt, Staphylococcus aureus subsp. aureus MW2
ugaauuuaggaaugaaua

SEQ ID NO: 2082399 - RNA, 18 nt, Staphylococcus aureus subsp. aureus MW2
ugaaguaaugugcauugc

SEQ ID NO: 2082400 - RNA, 14 nt, Staphylococcus aureus subsp. aureus MW2
ugaauaauuccagu

SEQ ID NO: 2082401 - RNA, 22 nt, Staphylococcus aureus subsp. aureus MW2
ugaaguuaacuauaacaauagu

SEQ ID NO: 2082402 - RNA, 15 nt, Staphylococcus aureus subsp. aureus MW2
ugaagagaaaauuug

SEQ ID NO: 2082403 - RNA, 18 nt, Staphylococcus aureus subsp. aureus MW2
uaugauauauguaacaua

SEQ ID NO: 2082404 - RNA, 22 nt, Staphylococcus aureus subsp. aureus MW2
uaucuucagauucccaaauagu

SEQ ID NO: 2082405 - RNA, 15 nt, Staphylococcus aureus subsp. aureus MW2
uaucuucuaauucca

SEQ ID NO: 2082406 - RNA, 20 nt, Staphylococcus aureus subsp. aureus MW2
uaucugcucuuuaucaccau

SEQ ID NO: 2082407 - RNA, 14 nt, Staphylococcus aureus subsp. aureus MW2
uauuaguauucaaa

SEQ ID NO: 2082408 - RNA, 16 nt, Staphylococcus aureus subsp. aureus MW2
uauuauaaaauagaag

SEQ ID NO: 2082409 - RNA, 15 nt, Staphylococcus aureus subsp. aureus MW2
uauuauuaacuguac

SEQ ID NO: 2082410 - RNA, 18 nt, Staphylococcus aureus subsp. aureus MW2
uauuauaaaauagaagua

SEQ ID NO: 2082411 - RNA, 21 nt, Staphylococcus aureus subsp. aureus MW2
uauugauugugacuuguauca

SEQ ID NO: 2082412 - RNA, 15 nt, Staphylococcus aureus subsp. aureus MW2
uaugcuguguaucau

SEQ ID NO: 2082413 - RNA, 21 nt, Staphylococcus aureus subsp. aureus MW2
uauuacuacauaauuuaucaa

SEQ ID NO: 2082414 - RNA, 18 nt, Staphylococcus aureus subsp. aureus MW2
uauggaaaauuuuaucaa

SEQ ID NO: 2082415 - RNA, 19 nt, Staphylococcus aureus subsp. aureus MW2
ucaaaaauguuaucuagua

SEQ ID NO: 2082416 - RNA, 17 nt, Staphylococcus aureus subsp. aureus MW2
ucaaaaagucucauuau

SEQ ID NO: 2082417 - RNA, 12 nt, Staphylococcus aureus subsp. aureus MW2
uauuuuguuuua

SEQ ID NO: 2082418 - RNA, 12 nt, Staphylococcus aureus subsp. aureus MW2
uauuuaccuucu

SEQ ID NO: 2082419 - RNA, 22 nt, Staphylococcus aureus subsp. aureus MW2
uauuuacaauguuaucuugcuu

SEQ ID NO: 2082420 - RNA, 19 nt, Staphylococcus aureus subsp. aureus MW2
uauuuucugccauaaacau

SEQ ID NO: 2082421 - RNA, 20 nt, Staphylococcus aureus subsp. aureus MW2
uauuuaugaguuugauguuu

SEQ ID NO: 2082422 - RNA, 15 nt, Staphylococcus aureus subsp. aureus MW2
uauuucaauacccua

SEQ ID NO: 2082423 - RNA, 17 nt, Staphylococcus aureus subsp. aureus MW2
ucaaccucauuugacau

SEQ ID NO: 2082424 - RNA, 11 nt, Staphylococcus aureus subsp. aureus MW2
ucaacaucaug

SEQ ID NO: 2082425 - RNA, 18 nt, Staphylococcus aureus subsp. aureus MW2
ucaaauugcguuguuuca

SEQ ID NO: 2082426 - RNA, 15 nt, Staphylococcus aureus subsp. aureus MW2
ucaaauuacuuauuc

SEQ ID NO: 2082427 - RNA, 23 nt, Staphylococcus aureus subsp. aureus MW2
ucaaaauucugacuaacauuggu

SEQ ID NO: 2082428 - RNA, 20 nt, Staphylococcus aureus subsp. aureus MW2
ucaaagauuuauaaauguuu

SEQ ID NO: 2082429 - RNA, 17 nt, Staphylococcus aureus subsp. aureus MW2
ucaacguauaagugaua

SEQ ID NO: 2082430 - RNA, 15 nt, Staphylococcus aureus subsp. aureus MW2
ucaacgggaacauca

SEQ ID NO: 2082431 - RNA, 14 nt, Staphylococcus aureus subsp. aureus MW2
ucaauaugaccuuu

SEQ ID NO: 2082432 - RNA, 16 nt, Staphylococcus aureus subsp. aureus MW2
ucagauucaaacguuu

SEQ ID NO: 2082433 - RNA, 17 nt, Staphylococcus aureus subsp. aureus MW2
ucacuaauggauaugau

SEQ ID NO: 2082434 - RNA, 13 nt, Staphylococcus aureus subsp. aureus MW2
ucacuaaaguaaa

SEQ ID NO: 2082435 - RNA, 18 nt, Staphylococcus aureus subsp. aureus MW2
ucacucggcagauguuca

SEQ ID NO: 2082436 - RNA, 22 nt, Staphylococcus aureus subsp. aureus MW2
ucacuccucuauuuuaugauuu

SEQ ID NO: 2082437 - RNA, 14 nt, Staphylococcus aureus subsp. aureus MW2
ucaccuaaugcuuu

SEQ ID NO: 2082438 - RNA, 19 nt, Staphylococcus aureus subsp. aureus MW2
ucacaugccaucuuuguaa

SEQ ID NO: 2082439 - RNA, 22 nt, Staphylococcus aureus subsp. aureus MW2
ucaauuuaguucacaauuucgu

SEQ ID NO: 2082440 - RNA, 20 nt, Staphylococcus aureus subsp. aureus MW2
ucaauuuaucgagaacauca

SEQ ID NO: 2082441 - RNA, 16 nt, Staphylococcus aureus subsp. aureus MW2
ucaauugcgauauacg

SEQ ID NO: 2082442 - RNA, 20 nt, Staphylococcus aureus subsp. aureus MW2
ucaauucuagucaaccuugc

SEQ ID NO: 2082443 - RNA, 14 nt, Staphylococcus aureus subsp. aureus MW2
ucaauuaauuuagu

SEQ ID NO: 2082444 - RNA, 16 nt, Staphylococcus aureus subsp. aureus MW2
ucaaugcuuucaucuu

SEQ ID NO: 2082445 - RNA, 19 nt, Staphylococcus aureus subsp. aureus MW2
ucaauuuuaccauguuuua

SEQ ID NO: 2082446 - RNA, 14 nt, Staphylococcus aureus subsp. aureus MW2
ucaauuucaccuug

SEQ ID NO: 2082447 - RNA, 12 nt, Staphylococcus aureus subsp. aureus MW2
ucacaccugcaa

SEQ ID NO: 2082448 - RNA, 20 nt, Staphylococcus aureus subsp. aureus MW2
ucaccauuuacuucauaagu

SEQ ID NO: 2082449 - RNA, 18 nt, Staphylococcus aureus subsp. aureus MW2
ucacccuucccuaucaua

SEQ ID NO: 2082450 - RNA, 22 nt, Staphylococcus aureus subsp. aureus MW2
ucauacguucaaucgcaucugu

SEQ ID NO: 2082451 - RNA, 18 nt, Staphylococcus aureus subsp. aureus MW2
ucauagaccuaugaauuu

SEQ ID NO: 2082452 - RNA, 14 nt, Staphylococcus aureus subsp. aureus MW2
ucauagcauuaaga

SEQ ID NO: 2082453 - RNA, 17 nt, Staphylococcus aureus subsp. aureus MW2
ucauacacaaugccuuu

SEQ ID NO: 2082454 - RNA, 15 nt, Staphylococcus aureus subsp. aureus MW2
ucagucauucacaua

SEQ ID NO: 2082455 - RNA, 18 nt, Staphylococcus aureus subsp. aureus MW2
ucaucuuucaaugcauau

SEQ ID NO: 2082456 - RNA, 17 nt, Staphylococcus aureus subsp. aureus MW2
ucaucuguccgauaucu

SEQ ID NO: 2082457 - RNA, 21 nt, Staphylococcus aureus subsp. aureus MW2
ucaucuguugauaaugcuacu

SEQ ID NO: 2082458 - RNA, 22 nt, Staphylococcus aureus subsp. aureus MW2
ucauuagaaaaggcucauuugu

SEQ ID NO: 2082459 - RNA, 21 nt, Staphylococcus aureus subsp. aureus MW2
ucaucuaaaaugaguuguuca

SEQ ID NO: 2082460 - RNA, 20 nt, Staphylococcus aureus subsp. aureus MW2
ucauaugguuaucuuaucga

SEQ ID NO: 2082461 - RNA, 20 nt, Staphylococcus aureus subsp. aureus MW2
ucauaugcaucaacagauac

SEQ ID NO: 2082462 - RNA, 16 nt, Staphylococcus aureus subsp. aureus MW2
ucauuaguuguaucag

SEQ ID NO: 2082463 - RNA, 15 nt, Staphylococcus aureus subsp. aureus MW2
ucauuaguuguauca

SEQ ID NO: 2082464 - RNA, 15 nt, Staphylococcus aureus subsp. aureus MW2
ucauuuguuaacgau

SEQ ID NO: 2082465 - RNA, 16 nt, Staphylococcus aureus subsp. aureus MW2
ucauuuggcguucaac

SEQ ID NO: 2082466 - RNA, 17 nt, Staphylococcus aureus subsp. aureus MW2
ucauuuuucguuguuca

SEQ ID NO: 2082467 - RNA, 17 nt, Staphylococcus aureus subsp. aureus MW2
uccccaacuuaauacga

SEQ ID NO: 2082468 - RNA, 22 nt, Staphylococcus aureus subsp. aureus MW2
uccccacguuuugaacauguuu

SEQ ID NO: 2082469 - RNA, 12 nt, Staphylococcus aureus subsp. aureus MW2
uccauaguaauc

SEQ ID NO: 2082470 - RNA, 18 nt, Staphylococcus aureus subsp. aureus MW2
uccaucaauaccauaauu

SEQ ID NO: 2082471 - RNA, 21 nt, Staphylococcus aureus subsp. aureus MW2
uccauauaugaugauuuaagu

SEQ ID NO: 2082472 - RNA, 23 nt, Staphylococcus aureus subsp. aureus MW2
guugugauauauaguaggguauu

SEQ ID NO: 2082473 - RNA, 13 nt, Staphylococcus aureus subsp. aureus MW2
guuuaaucgcauu

SEQ ID NO: 2082474 - RNA, 16 nt, Staphylococcus aureus subsp. aureus MW2
guuuaacuaaaccauu

SEQ ID NO: 2082475 - RNA, 16 nt, Staphylococcus aureus subsp. aureus MW2
guuccuuugauguuca

SEQ ID NO: 2082476 - RNA, 20 nt, Staphylococcus aureus subsp. aureus MW2
guucaauuguuacuuuaacu

SEQ ID NO: 2082477 - RNA, 18 nt, Staphylococcus aureus subsp. aureus MW2
guucaaauguugaaugug

SEQ ID NO: 2082478 - RNA, 20 nt, Staphylococcus aureus subsp. aureus MW2
guuaucgauuuuaucgaaau

SEQ ID NO: 2082479 - RNA, 16 nt, Staphylococcus aureus subsp. aureus MW2
guuaucguucaauguu

SEQ ID NO: 2082480 - RNA, 21 nt, Staphylococcus aureus subsp. aureus MW2
guuaauauugguuauauauug

SEQ ID NO: 2082481 - RNA, 22 nt, Staphylococcus aureus subsp. aureus MW2
uaccaucuucgacuacaaguuu

SEQ ID NO: 2082482 - RNA, 17 nt, Staphylococcus aureus subsp. aureus MW2
uaccaauuuuuagcauu

SEQ ID NO: 2082483 - RNA, 14 nt, Staphylococcus aureus subsp. aureus MW2
uaccagcauccauu

SEQ ID NO: 2082484 - RNA, 16 nt, Staphylococcus aureus subsp. aureus MW2
uacauauguguaugau

SEQ ID NO: 2082485 - RNA, 17 nt, Staphylococcus aureus subsp. aureus MW2
uacaucaucaaguucac

SEQ ID NO: 2082486 - RNA, 13 nt, Staphylococcus aureus subsp. aureus MW2
uacauccauacuu

SEQ ID NO: 2082487 - RNA, 19 nt, Staphylococcus aureus subsp. aureus MW2
uacgauugaguugaaaaua

SEQ ID NO: 2082488 - RNA, 15 nt, Staphylococcus aureus subsp. aureus MW2
uacucauauugaaua

SEQ ID NO: 2082489 - RNA, 14 nt, Staphylococcus aureus subsp. aureus MW2
uacugaugaacaua

SEQ ID NO: 2082490 - RNA, 13 nt, Staphylococcus aureus subsp. aureus MW2
uacuaauuaaagc

SEQ ID NO: 2082491 - RNA, 12 nt, Staphylococcus aureus subsp. aureus MW2
uacuauuaaagg

SEQ ID NO: 2082492 - RNA, 19 nt, Staphylococcus aureus subsp. aureus MW2
uacuuggaaaauacuauac

SEQ ID NO: 2082493 - RNA, 13 nt, Staphylococcus aureus subsp. aureus MW2
uacuugaaacauc

SEQ ID NO: 2082494 - RNA, 20 nt, Staphylococcus aureus subsp. aureus MW2
uacuuuaaaauuguauagaa

SEQ ID NO: 2082495 - RNA, 20 nt, Staphylococcus aureus subsp. aureus MW2
uacuuucugcccacuuaaua

SEQ ID NO: 2082496 - RNA, 20 nt, Staphylococcus aureus subsp. aureus MW2
uagacuuauuugaaugcaaa

SEQ ID NO: 2082497 - RNA, 16 nt, Staphylococcus aureus subsp. aureus MW2
uagcacugaaaucuag

SEQ ID NO: 2082498 - RNA, 12 nt, Staphylococcus aureus subsp. aureus MW2
uagcaauaucau

SEQ ID NO: 2082499 - RNA, 19 nt, Staphylococcus aureus subsp. aureus MW2
uagcaauuugagcaauucu

SEQ ID NO: 2082500 - RNA, 15 nt, Staphylococcus aureus subsp. aureus MW2
uagcauaaaauuucu

SEQ ID NO: 2082501 - RNA, 20 nt, Staphylococcus aureus subsp. aureus MW2
uagccauugaauagguggcu

SEQ ID NO: 2082502 - RNA, 16 nt, Staphylococcus aureus subsp. aureus MW2
uaauagagaaacguaa

SEQ ID NO: 2082503 - RNA, 18 nt, Staphylococcus aureus subsp. aureus MW2
uaauaggauuauuaucaa

SEQ ID NO: 2082504 - RNA, 21 nt, Staphylococcus aureus subsp. aureus MW2
uaauagaacgaaauaguucaa

SEQ ID NO: 2082505 - RNA, 19 nt, Staphylococcus aureus subsp. aureus MW2
uaauacuucauauccuuca

SEQ ID NO: 2082506 - RNA, 18 nt, Staphylococcus aureus subsp. aureus MW2
uaauacguugcucaccua

SEQ ID NO: 2082507 - RNA, 16 nt, Staphylococcus aureus subsp. aureus MW2
uaauacgcaauugaua

SEQ ID NO: 2082508 - RNA, 13 nt, Staphylococcus aureus subsp. aureus MW2
uaauaaaaucauc

SEQ ID NO: 2082509 - RNA, 14 nt, Staphylococcus aureus subsp. aureus MW2
uaauaguuaacgau

SEQ ID NO: 2082510 - RNA, 15 nt, Staphylococcus aureus subsp. aureus MW2
uaauauccugcaguu

SEQ ID NO: 2082511 - RNA, 17 nt, Staphylococcus aureus subsp. aureus MW2
uaaugauaguguaugaa

SEQ ID NO: 2082512 - RNA, 15 nt, Staphylococcus aureus subsp. aureus MW2
uaaugauaguguaug

SEQ ID NO: 2082513 - RNA, 14 nt, Staphylococcus aureus subsp. aureus MW2
uaaguagaugauua

SEQ ID NO: 2082514 - RNA, 12 nt, Staphylococcus aureus subsp. aureus MW2
uaaguagcucaa

SEQ ID NO: 2082515 - RNA, 12 nt, Staphylococcus aureus subsp. aureus MW2
uaaguaguucaa

SEQ ID NO: 2082516 - RNA, 12 nt, Staphylococcus aureus subsp. aureus MW2
uaaguacuucaa

SEQ ID NO: 2082517 - RNA, 17 nt, Staphylococcus aureus subsp. aureus MW2
uaagccuguuugacaca

SEQ ID NO: 2082518 - RNA, 16 nt, Staphylococcus aureus subsp. aureus MW2
uaagucacgauauagu

SEQ ID NO: 2082519 - RNA, 13 nt, Staphylococcus aureus subsp. aureus MW2
uaaguucaccuaa

SEQ ID NO: 2082520 - RNA, 16 nt, Staphylococcus aureus subsp. aureus MW2
uaacugcaaacuugau

SEQ ID NO: 2082521 - RNA, 17 nt, Staphylococcus aureus subsp. aureus MW2
uaacuuaacucuaucaa

SEQ ID NO: 2082522 - RNA, 18 nt, Staphylococcus aureus subsp. aureus MW2
uaauuuuaccuguuucuu

SEQ ID NO: 2082523 - RNA, 13 nt, Staphylococcus aureus subsp. aureus MW2
uaauuuucacuuu

SEQ ID NO: 2082524 - RNA, 13 nt, Staphylococcus aureus subsp. aureus MW2
uaauuuuguuuca

SEQ ID NO: 2082525 - RNA, 18 nt, Staphylococcus aureus subsp. aureus MW2
uaauuuuuugacacgucg

SEQ ID NO: 2082526 - RNA, 18 nt, Staphylococcus aureus subsp. aureus MW2
uaauuuuucuuucaggcu

SEQ ID NO: 2082527 - RNA, 17 nt, Staphylococcus aureus subsp. aureus MW2
uacagauaggaaacuua

SEQ ID NO: 2082528 - RNA, 14 nt, Staphylococcus aureus subsp. aureus MW2
uacagagaaucaau

SEQ ID NO: 2082529 - RNA, 18 nt, Staphylococcus aureus subsp. aureus MW2
uacagaucucaauccaau

SEQ ID NO: 2082530 - RNA, 15 nt, Staphylococcus aureus subsp. aureus MW2
uacaccacuuaggau

SEQ ID NO: 2082531 - RNA, 21 nt, Staphylococcus aureus subsp. aureus MW2
uacagauuucugcaaaauguu

SEQ ID NO: 2082532 - RNA, 16 nt, Staphylococcus aureus subsp. aureus MW2
uacagccauugacaca

SEQ ID NO: 2082533 - RNA, 20 nt, Staphylococcus aureus subsp. aureus MW2
uaauugaaaauaaucuuacu

SEQ ID NO: 2082534 - RNA, 18 nt, Staphylococcus aureus subsp. aureus MW2
uaauuucuuuugaaucuu

SEQ ID NO: 2082535 - RNA, 19 nt, Staphylococcus aureus subsp. aureus MW2
uaauucuucaucuucuuca

SEQ ID NO: 2082536 - RNA, 17 nt, Staphylococcus aureus subsp. aureus MW2
uaauucuguuguuucga

SEQ ID NO: 2082537 - RNA, 14 nt, Staphylococcus aureus subsp. aureus MW2
uaauucugaaauca

SEQ ID NO: 2082538 - RNA, 17 nt, Staphylococcus aureus subsp. aureus MW2
uaauguuacauuugaag

SEQ ID NO: 2082539 - RNA, 21 nt, Staphylococcus aureus subsp. aureus MW2
uaauguguaaauuuuguaaug

SEQ ID NO: 2082540 - RNA, 23 nt, Staphylococcus aureus subsp. aureus MW2
uaaugccaccguggaauuuacca

SEQ ID NO: 2082541 - RNA, 16 nt, Staphylococcus aureus subsp. aureus MW2
uaaugcacuaccauca

SEQ ID NO: 2082542 - RNA, 20 nt, Staphylococcus aureus subsp. aureus MW2
uaaugcaacuaaguugacua

SEQ ID NO: 2082543 - RNA, 18 nt, Staphylococcus aureus subsp. aureus MW2
uaauguuccauauaaccu

SEQ ID NO: 2082544 - RNA, 20 nt, Staphylococcus aureus subsp. aureus MW2
uaauguugcaaaauuaagag

SEQ ID NO: 2082545 - RNA, 23 nt, Staphylococcus aureus subsp. aureus MW2
uaauguuucuucaauugucucaa

SEQ ID NO: 2082546 - RNA, 23 nt, Staphylococcus aureus subsp. aureus MW2
uaauuaaaagugcaaguccaaau

SEQ ID NO: 2082547 - RNA, 22 nt, Staphylococcus aureus subsp. aureus MW2
uaauuaaacuaauagcauuugu

SEQ ID NO: 2082548 - RNA, 16 nt, Staphylococcus aureus subsp. aureus MW2
uaauuaaacuuuauga

SEQ ID NO: 2082549 - RNA, 15 nt, Staphylococcus aureus subsp. aureus MW2
uaacgcaaugucuug

SEQ ID NO: 2082550 - RNA, 19 nt, Staphylococcus aureus subsp. aureus MW2
uaacgcacugcauuaucaa

SEQ ID NO: 2082551 - RNA, 23 nt, Staphylococcus aureus subsp. aureus MW2
uaacgaagauuuuguugaaacug

SEQ ID NO: 2082552 - RNA, 17 nt, Staphylococcus aureus subsp. aureus MW2
uaaccuuuaaaacguua

SEQ ID NO: 2082553 - RNA, 14 nt, Staphylococcus aureus subsp. aureus MW2
uaacauuugucaua

SEQ ID NO: 2082554 - RNA, 16 nt, Staphylococcus aureus subsp. aureus MW2
uaaccaaaccauuaau

SEQ ID NO: 2082555 - RNA, 14 nt, Staphylococcus aureus subsp. aureus MW2
uaacaaugaaccau

SEQ ID NO: 2082556 - RNA, 17 nt, Staphylococcus aureus subsp. aureus MW2
uaacacaugcuucauau

SEQ ID NO: 2082557 - RNA, 20 nt, Staphylococcus aureus subsp. aureus MW2
uaacauuugcuaguagaguu

SEQ ID NO: 2082558 - RNA, 16 nt, Staphylococcus aureus subsp. aureus MW2
uaacaccaauugaaua

SEQ ID NO: 2082559 - RNA, 21 nt, Staphylococcus aureus subsp. aureus MW2
uaaccacaucauucgaauacu

SEQ ID NO: 2082560 - RNA, 14 nt, Staphylococcus aureus subsp. aureus MW2
uaacaaauuagaau

SEQ ID NO: 2082561 - RNA, 14 nt, Staphylococcus aureus subsp. aureus MW2
uaacaaacauuaau

SEQ ID NO: 2082562 - RNA, 12 nt, Staphylococcus aureus subsp. aureus MW2
uaacaaacguug

SEQ ID NO: 2082563 - RNA, 17 nt, Staphylococcus aureus subsp. aureus MW2
uaaauggaaagacguuu

SEQ ID NO: 2082564 - RNA, 23 nt, Staphylococcus aureus subsp. aureus MW2
uaaaucuuuuagcuuuuguaaag

SEQ ID NO: 2082565 - RNA, 21 nt, Staphylococcus aureus subsp. aureus MW2
uaaaugaaauaggugcuugua

SEQ ID NO: 2082566 - RNA, 16 nt, Staphylococcus aureus subsp. aureus MW2
uaaauccgcuuguuca

SEQ ID NO: 2082567 - RNA, 22 nt, Staphylococcus aureus subsp. aureus MW2
uaaauaguaagguuugaacucu

SEQ ID NO: 2082568 - RNA, 15 nt, Staphylococcus aureus subsp. aureus MW2
uaaaguuuuguucaa

SEQ ID NO: 2082569 - RNA, 16 nt, Staphylococcus aureus subsp. aureus MW2
uaaaagucagcgauaa

SEQ ID NO: 2082570 - RNA, 18 nt, Staphylococcus aureus subsp. aureus MW2
uaaaaaucuuaugauguc

SEQ ID NO: 2082571 - RNA, 17 nt, Staphylococcus aureus subsp. aureus MW2
uaaaaauaguucuuuaa

SEQ ID NO: 2082572 - RNA, 17 nt, Staphylococcus aureus subsp. aureus MW2
uaaaaacguucaaucgu

SEQ ID NO: 2082573 - RNA, 14 nt, Staphylococcus aureus subsp. aureus MW2
guuucaauguauca

SEQ ID NO: 2082574 - RNA, 19 nt, Staphylococcus aureus subsp. aureus MW2
guuuaauguuuaauaauac

SEQ ID NO: 2082575 - RNA, 13 nt, Staphylococcus aureus subsp. aureus MW2
uaaaauaccugca

SEQ ID NO: 2082576 - RNA, 18 nt, Staphylococcus aureus subsp. aureus MW2
uaaagauggcugcaucaa

SEQ ID NO: 2082577 - RNA, 17 nt, Staphylococcus aureus subsp. aureus MW2
ggauugaaaaaagcuag

SEQ ID NO: 2082578 - RNA, 21 nt, Staphylococcus aureus subsp. aureus MW2
ggucuacgaucaaaaucaugc

SEQ ID NO: 2082579 - RNA, 22 nt, Staphylococcus aureus subsp. aureus MW2
gguaugacaguaaucaaaguau

SEQ ID NO: 2082580 - RNA, 18 nt, Staphylococcus aureus subsp. aureus MW2
gggugggacgacgaaaua

SEQ ID NO: 2082581 - RNA, 16 nt, Staphylococcus aureus subsp. aureus MW2
guacguuaaucaguga

SEQ ID NO: 2082582 - RNA, 17 nt, Staphylococcus aureus subsp. aureus MW2
guauagaugcuaaugua

SEQ ID NO: 2082583 - RNA, 18 nt, Staphylococcus aureus subsp. aureus MW2
guaucaucccauugcauu

SEQ ID NO: 2082584 - RNA, 20 nt, Staphylococcus aureus subsp. aureus MW2
guaucaugcuuuuuaauguu

SEQ ID NO: 2082585 - RNA, 18 nt, Staphylococcus aureus subsp. aureus MW2
gucacauguaccacauuu

SEQ ID NO: 2082586 - RNA, 12 nt, Staphylococcus aureus subsp. aureus MW2
gguuaacacguu

SEQ ID NO: 2082587 - RNA, 14 nt, Staphylococcus aureus subsp. aureus MW2
guaaaucaugacau

SEQ ID NO: 2082588 - RNA, 23 nt, Staphylococcus aureus subsp. aureus MW2
guaauguguuaauacuucauauc

SEQ ID NO: 2082589 - RNA, 14 nt, Staphylococcus aureus subsp. aureus MW2
guaauucuuuacca

SEQ ID NO: 2082590 - RNA, 17 nt, Staphylococcus aureus subsp. aureus MW2
guacacuuuugauuguu

SEQ ID NO: 2082591 - RNA, 18 nt, Staphylococcus aureus subsp. aureus MW2
guacauauguguaugaua

SEQ ID NO: 2082592 - RNA, 23 nt, Staphylococcus aureus subsp. aureus MW2
guacauuuauuuaaugugcauau

SEQ ID NO: 2082593 - RNA, 14 nt, Staphylococcus aureus subsp. aureus MW2
gugauuuuaccugu

SEQ ID NO: 2082594 - RNA, 12 nt, Staphylococcus aureus subsp. aureus MW2
gugcguaucgag

SEQ ID NO: 2082595 - RNA, 22 nt, Staphylococcus aureus subsp. aureus MW2
guccauaaauauuaaauucauc

SEQ ID NO: 2082596 - RNA, 16 nt, Staphylococcus aureus subsp. aureus MW2
gcgaaaaagcuaaaga

SEQ ID NO: 2082597 - RNA, 20 nt, Staphylococcus aureus subsp. aureus MW2
gcgaguucuuuuugaugauc

SEQ ID NO: 2082598 - RNA, 15 nt, Staphylococcus aureus subsp. aureus MW2
gcgucaccuaaugcu

SEQ ID NO: 2082599 - RNA, 16 nt, Staphylococcus aureus subsp. aureus MW2
gcuaaugcuaguaacu

SEQ ID NO: 2082600 - RNA, 14 nt, Staphylococcus aureus subsp. aureus MW2
gcuaauacuaauca

SEQ ID NO: 2082601 - RNA, 14 nt, Staphylococcus aureus subsp. aureus MW2
gcuaauaucaauaa

SEQ ID NO: 2082602 - RNA, 14 nt, Staphylococcus aureus subsp. aureus MW2
gcuaauucauucaa

SEQ ID NO: 2082603 - RNA, 19 nt, Staphylococcus aureus subsp. aureus MW2
ggaauacagaugaugcuuc

SEQ ID NO: 2082604 - RNA, 20 nt, Staphylococcus aureus subsp. aureus MW2
gcuucuuuaaauacaucgga

SEQ ID NO: 2082605 - RNA, 21 nt, Staphylococcus aureus subsp. aureus MW2
gcuuuaauaauaugauaucca

SEQ ID NO: 2082606 - RNA, 16 nt, Staphylococcus aureus subsp. aureus MW2
gcuucagccauaauau

SEQ ID NO: 2082607 - RNA, 12 nt, Staphylococcus aureus subsp. aureus MW2
gcuucauaugga

SEQ ID NO: 2082608 - RNA, 15 nt, Staphylococcus aureus subsp. aureus MW2
aauauuuuauuacau

SEQ ID NO: 2082609 - RNA, 20 nt, Staphylococcus aureus subsp. aureus MW2
uggucuuuuaauuaaaagug

SEQ ID NO: 2082610 - RNA, 18 nt, Staphylococcus aureus subsp. aureus MW2
uggucugauuuugcauuu

SEQ ID NO: 2082611 - RNA, 17 nt, Staphylococcus aureus subsp. aureus MW2
uggucauguguugcaau

SEQ ID NO: 2082612 - RNA, 17 nt, Staphylococcus aureus subsp. aureus MW2
ugguuucaaaaucaauu

SEQ ID NO: 2082613 - RNA, 23 nt, Staphylococcus aureus subsp. aureus MW2
uguaaugucucuuuucacgaaua

SEQ ID NO: 2082614 - RNA, 20 nt, Staphylococcus aureus subsp. aureus MW2
uguaauuaauacaucaauau

SEQ ID NO: 2082615 - RNA, 19 nt, Staphylococcus aureus subsp. aureus MW2
aaucacgauuuucaaguaa

SEQ ID NO: 2082616 - RNA, 22 nt, Staphylococcus aureus subsp. aureus MW2
aauauuagucauuugaugguuu

SEQ ID NO: 2082617 - RNA, 15 nt, Staphylococcus aureus subsp. aureus MW2
aauauuguauugauc

SEQ ID NO: 2082618 - RNA, 21 nt, Staphylococcus aureus subsp. aureus MW2
aauauuuagauuggucaaacu

SEQ ID NO: 2082619 - RNA, 21 nt, Staphylococcus aureus subsp. aureus MW2
aauaugaucuaacaucauuaa

SEQ ID NO: 2082620 - RNA, 14 nt, Staphylococcus aureus subsp. aureus MW2
uggcuaaugacuuc

SEQ ID NO: 2082621 - RNA, 22 nt, Staphylococcus aureus subsp. aureus MW2
aauaucuugucauggcaagauu

SEQ ID NO: 2082622 - RNA, 20 nt, Staphylococcus aureus subsp. aureus MW2
uggggugggacgacgaaaua

SEQ ID NO: 2082623 - RNA, 15 nt, Staphylococcus aureus subsp. aureus MW2
aauauaaacaucuuc

SEQ ID NO: 2082624 - RNA, 22 nt, Staphylococcus aureus subsp. aureus MW2
ugcuucacuaaaaaucuauaua

SEQ ID NO: 2082625 - RNA, 15 nt, Staphylococcus aureus subsp. aureus MW2
ugcuucauaaauguu

SEQ ID NO: 2082626 - RNA, 16 nt, Staphylococcus aureus subsp. aureus MW2
ugcuuggauaauugca

SEQ ID NO: 2082627 - RNA, 17 nt, Staphylococcus aureus subsp. aureus MW2
ugcuucucguaguucga

SEQ ID NO: 2082628 - RNA, 18 nt, Staphylococcus aureus subsp. aureus MW2
ugcuuuucauuuaauguu

SEQ ID NO: 2082629 - RNA, 13 nt, Staphylococcus aureus subsp. aureus MW2
aauauauguauaa

SEQ ID NO: 2082630 - RNA, 16 nt, Staphylococcus aureus subsp. aureus MW2
aauauagaagauauaa

SEQ ID NO: 2082631 - RNA, 22 nt, Staphylococcus aureus subsp. aureus MW2
aauauacuugaagcaucgauuu

SEQ ID NO: 2082632 - RNA, 19 nt, Staphylococcus aureus subsp. aureus MW2
aauauacuugccuucaaau

SEQ ID NO: 2082633 - RNA, 17 nt, Staphylococcus aureus subsp. aureus MW2
aauauacgagacauuuc

SEQ ID NO: 2082634 - RNA, 14 nt, Staphylococcus aureus subsp. aureus MW2
ugucuaaucgacuu

SEQ ID NO: 2082635 - RNA, 22 nt, Staphylococcus aureus subsp. aureus MW2
ugugcaauuagaauauauguau

SEQ ID NO: 2082636 - RNA, 14 nt, Staphylococcus aureus subsp. aureus MW2
uguuauuaaacgca

SEQ ID NO: 2082637 - RNA, 15 nt, Staphylococcus aureus subsp. aureus MW2
uguucaaagacacgg

SEQ ID NO: 2082638 - RNA, 18 nt, Staphylococcus aureus subsp. aureus MW2
uguuauugaugaucaauu

SEQ ID NO: 2082639 - RNA, 13 nt, Staphylococcus aureus subsp. aureus MW2
uguuauugcuuau

SEQ ID NO: 2082640 - RNA, 21 nt, Staphylococcus aureus subsp. aureus MW2
uuacgccaacaagguuucaag

SEQ ID NO: 2082641 - RNA, 20 nt, Staphylococcus aureus subsp. aureus MW2
uuacuauggcauuauugccu

SEQ ID NO: 2082642 - RNA, 19 nt, Staphylococcus aureus subsp. aureus MW2
uuacuaucucuucugucua

SEQ ID NO: 2082643 - RNA, 21 nt, Staphylococcus aureus subsp. aureus MW2
uuagcaaaaauauuuaaacua

SEQ ID NO: 2082644 - RNA, 18 nt, Staphylococcus aureus subsp. aureus MW2
uuagagauuguaagaauu

SEQ ID NO: 2082645 - RNA, 13 nt, Staphylococcus aureus subsp. aureus MW2
uuaguaugacuua

SEQ ID NO: 2082646 - RNA, 17 nt, Staphylococcus aureus subsp. aureus MW2
uuaguacacguguauug

SEQ ID NO: 2082647 - RNA, 23 nt, Staphylococcus aureus subsp. aureus MW2
uuagcuaagccuguuugacacau

SEQ ID NO: 2082648 - RNA, 16 nt, Staphylococcus aureus subsp. aureus MW2
uuaucauuauucgcau

SEQ ID NO: 2082649 - RNA, 14 nt, Staphylococcus aureus subsp. aureus MW2
uuaaucguaacaua

SEQ ID NO: 2082650 - RNA, 22 nt, Staphylococcus aureus subsp. aureus MW2
uuacauuuuaauaaaaucaucu

SEQ ID NO: 2082651 - RNA, 15 nt, Staphylococcus aureus subsp. aureus MW2
uuacagaacguucau

SEQ ID NO: 2082652 - RNA, 18 nt, Staphylococcus aureus subsp. aureus MW2
uuaauacgauaauaacua

SEQ ID NO: 2082653 - RNA, 19 nt, Staphylococcus aureus subsp. aureus MW2
uuaauacgauaauaacuag

SEQ ID NO: 2082654 - RNA, 19 nt, Staphylococcus aureus subsp. aureus MW2
uuaacauauagauaucugu

SEQ ID NO: 2082655 - RNA, 16 nt, Staphylococcus aureus subsp. aureus MW2
uguucuuguaauccua

SEQ ID NO: 2082656 - RNA, 14 nt, Staphylococcus aureus subsp. aureus MW2
uguugaauauacua

SEQ ID NO: 2082657 - RNA, 14 nt, Staphylococcus aureus subsp. aureus MW2
aaucacgcuaacau

SEQ ID NO: 2082658 - RNA, 17 nt, Staphylococcus aureus subsp. aureus MW2
uucuccuucaauguuca

SEQ ID NO: 2082659 - RNA, 21 nt, Staphylococcus aureus subsp. aureus MW2
uucugcggauuaucuaacuca

SEQ ID NO: 2082660 - RNA, 14 nt, Staphylococcus aureus subsp. aureus MW2
uucauuguaacuca

SEQ ID NO: 2082661 - RNA, 16 nt, Staphylococcus aureus subsp. aureus MW2
uucacuuuaacuucuu

SEQ ID NO: 2082662 - RNA, 13 nt, Staphylococcus aureus subsp. aureus MW2
uucagaugcuaca

SEQ ID NO: 2082663 - RNA, 17 nt, Staphylococcus aureus subsp. aureus MW2
uucacgauauaacauua

SEQ ID NO: 2082664 - RNA, 23 nt, Staphylococcus aureus subsp. aureus MW2
uucaucuuuaugcaaaauuaaug

SEQ ID NO: 2082665 - RNA, 19 nt, Staphylococcus aureus subsp. aureus MW2
uucaucuuuuuuaucaugu

SEQ ID NO: 2082666 - RNA, 19 nt, Staphylococcus aureus subsp. aureus MW2
uucaucguuuacuacauca

SEQ ID NO: 2082667 - RNA, 19 nt, Staphylococcus aureus subsp. aureus MW2
uucaucgucucacuuaaua

SEQ ID NO: 2082668 - RNA, 16 nt, Staphylococcus aureus subsp. aureus MW2
uucagggucaacauca

SEQ ID NO: 2082669 - RNA, 19 nt, Staphylococcus aureus subsp. aureus MW2
uuuggaugaacaaaauaac

SEQ ID NO: 2082670 - RNA, 14 nt, Staphylococcus aureus subsp. aureus MW2
uuuuaaucuguaug

SEQ ID NO: 2082671 - RNA, 11 nt, Staphylococcus aureus subsp. aureus MW2
uuugaugauuu

SEQ ID NO: 2082672 - RNA, 14 nt, Staphylococcus aureus subsp. aureus MW2
uuugauaaugauag

SEQ ID NO: 2082673 - RNA, 18 nt, Staphylococcus aureus subsp. aureus MW2
uuugacuucaguacaauc

SEQ ID NO: 2082674 - RNA, 15 nt, Staphylococcus aureus subsp. aureus MW2
uuuaaaucauugcgu

SEQ ID NO: 2082675 - RNA, 19 nt, Staphylococcus aureus subsp. aureus MW2
uuuaaaucuuuuagcuuuu

SEQ ID NO: 2082676 - RNA, 13 nt, Staphylococcus aureus subsp. aureus MW2
uuuaauuaaagca

SEQ ID NO: 2082677 - RNA, 17 nt, Staphylococcus aureus subsp. aureus MW2
uuuaauguuaaacaaua

SEQ ID NO: 2082678 - RNA, 16 nt, Staphylococcus aureus subsp. aureus MW2
uuuccgccagcuucua

SEQ ID NO: 2082679 - RNA, 16 nt, Staphylococcus aureus subsp. aureus MW2
uuuccgccagcuucuu

SEQ ID NO: 2082680 - RNA, 20 nt, Staphylococcus aureus subsp. aureus MW2
uuucugucccacucccauug

SEQ ID NO: 2082681 - RNA, 19 nt, Staphylococcus aureus subsp. aureus MW2
uuucugguaaaaaaauaac

SEQ ID NO: 2082682 - RNA, 18 nt, Staphylococcus aureus subsp. aureus MW2
uuucuggucacuaaugca

SEQ ID NO: 2082683 - RNA, 15 nt, Staphylococcus aureus subsp. aureus MW2
uuucugaaaugauac

SEQ ID NO: 2082684 - RNA, 15 nt, Staphylococcus aureus subsp. aureus MW2
aaugugaccuuaugu

SEQ ID NO: 2082685 - RNA, 16 nt, Staphylococcus aureus subsp. aureus MW2
aauggucgugcuugcg

SEQ ID NO: 2082686 - RNA, 14 nt, Staphylococcus aureus subsp. aureus MW2
aaugggucauuaaa

SEQ ID NO: 2082687 - RNA, 16 nt, Staphylococcus aureus subsp. aureus MW2
aaugccucugcaacgc

SEQ ID NO: 2082688 - RNA, 14 nt, Staphylococcus aureus subsp. aureus MW2
aaugacgauacgua

SEQ ID NO: 2082689 - RNA, 20 nt, Staphylococcus aureus subsp. aureus MW2
uuuuucacuuauaacauucu

SEQ ID NO: 2082690 - RNA, 12 nt, Staphylococcus aureus subsp. aureus MW2
uuuuuaucaugu

SEQ ID NO: 2082691 - RNA, 13 nt, Staphylococcus aureus subsp. aureus MW2
uuuuuaucaugau

SEQ ID NO: 2082692 - RNA, 18 nt, Staphylococcus aureus subsp. aureus MW2
uuuuuaacaaaauauacu

SEQ ID NO: 2082693 - RNA, 19 nt, Staphylococcus aureus subsp. aureus MW2
uuuuuaacaaaauauacua

SEQ ID NO: 2082694 - RNA, 13 nt, Staphylococcus aureus subsp. aureus MW2
uuuuuaacuaaua

SEQ ID NO: 2082695 - RNA, 18 nt, Staphylococcus aureus subsp. aureus MW2
uuuuuaacuuuaacaucu

SEQ ID NO: 2082696 - RNA, 14 nt, Staphylococcus aureus subsp. aureus MW2
uuuuauaaaucauu

SEQ ID NO: 2082697 - RNA, 20 nt, Staphylococcus aureus subsp. aureus MW2
uuuuagcucuuguucaagua

SEQ ID NO: 2082698 - RNA, 12 nt, Staphylococcus aureus subsp. aureus MW2
aaucguauugaa

SEQ ID NO: 2082699 - RNA, 14 nt, Staphylococcus aureus subsp. aureus MW2
aaucuauauaacgc

SEQ ID NO: 2082700 - RNA, 21 nt, Staphylococcus aureus subsp. aureus MW2
aaugaaaagcuuguuacaagc

SEQ ID NO: 2082701 - RNA, 23 nt, Staphylococcus aureus subsp. aureus MW2
aaugaauaaugacaaauuaucac

SEQ ID NO: 2082702 - RNA, 15 nt, Staphylococcus aureus subsp. aureus MW2
uugauggauauucaa

SEQ ID NO: 2082703 - RNA, 12 nt, Staphylococcus aureus subsp. aureus MW2
uugauuaaacug

SEQ ID NO: 2082704 - RNA, 18 nt, Staphylococcus aureus subsp. aureus MW2
uugauuaacacaauccuu

SEQ ID NO: 2082705 - RNA, 16 nt, Staphylococcus aureus subsp. aureus MW2
uucuguaauaauauca

SEQ ID NO: 2082706 - RNA, 15 nt, Staphylococcus aureus subsp. aureus MW2
uucuucaauuuaaug

SEQ ID NO: 2082707 - RNA, 18 nt, Staphylococcus aureus subsp. aureus MW2
uugauuuuuugaaauguu

SEQ ID NO: 2082708 - RNA, 21 nt, Staphylococcus aureus subsp. aureus MW2
uugauuuuuuagacaaauguu

SEQ ID NO: 2082709 - RNA, 18 nt, Staphylococcus aureus subsp. aureus MW2
uugcacgucuuguaucaa

SEQ ID NO: 2082710 - RNA, 19 nt, Staphylococcus aureus subsp. aureus MW2
aaucagguuuaaacaguuu

SEQ ID NO: 2082711 - RNA, 16 nt, Staphylococcus aureus subsp. aureus MW2
aaucagucauucacau

SEQ ID NO: 2082712 - RNA, 21 nt, Staphylococcus aureus subsp. aureus MW2
aaucagucauucacauacauu

SEQ ID NO: 2082713 - RNA, 12 nt, Staphylococcus aureus subsp. aureus MW2
aaucaucacaca

SEQ ID NO: 2082714 - RNA, 20 nt, Staphylococcus aureus subsp. aureus MW2
uugugcugucaaacaacaau

SEQ ID NO: 2082715 - RNA, 22 nt, Staphylococcus aureus subsp. aureus MW2
uugucguucucguguaaaaugc

SEQ ID NO: 2082716 - RNA, 22 nt, Staphylococcus aureus subsp. aureus MW2
uuguauuguuuguagaaauuag

SEQ ID NO: 2082717 - RNA, 15 nt, Staphylococcus aureus subsp. aureus MW2
uuguaacacacuuau

SEQ ID NO: 2082718 - RNA, 19 nt, Staphylococcus aureus subsp. aureus MW2
aaucgauacuaauaucuuc

SEQ ID NO: 2082719 - RNA, 14 nt, Staphylococcus aureus subsp. aureus MW2
aaucgauugguaaa

SEQ ID NO: 2082720 - RNA, 22 nt, Staphylococcus aureus subsp. aureus MW2
aauccacaucccaauuuaaacu

SEQ ID NO: 2082721 - RNA, 21 nt, Staphylococcus aureus subsp. aureus MW2
acgcuguuuuuaaaugcuuua

SEQ ID NO: 2082722 - RNA, 23 nt, Staphylococcus aureus subsp. aureus MW2
acguugguuuaaaaauugauauu

SEQ ID NO: 2082723 - RNA, 12 nt, Staphylococcus aureus subsp. aureus MW2
acuaaaugaauu

SEQ ID NO: 2082724 - RNA, 22 nt, Staphylococcus aureus subsp. aureus MW2
acuaaauugagaaguauuauga

SEQ ID NO: 2082725 - RNA, 20 nt, Staphylococcus aureus subsp. aureus MW2
acuaaaacaugauacguggu

SEQ ID NO: 2082726 - RNA, 19 nt, Staphylococcus aureus subsp. aureus MW2
acuaaaaggucaucugaug

SEQ ID NO: 2082727 - RNA, 14 nt, Staphylococcus aureus subsp. aureus MW2
acuaaaggaauuuc

SEQ ID NO: 2082728 - RNA, 20 nt, Staphylococcus aureus subsp. aureus MW2
acugccauucuuuuucucaa

SEQ ID NO: 2082729 - RNA, 16 nt, Staphylococcus aureus subsp. aureus MW2
acucgcaaucgagaug

SEQ ID NO: 2082730 - RNA, 17 nt, Staphylococcus aureus subsp. aureus MW2
acuccaauuaccaauga

SEQ ID NO: 2082731 - RNA, 21 nt, Staphylococcus aureus subsp. aureus MW2
acuauauucaaugauuaguaa

SEQ ID NO: 2082732 - RNA, 23 nt, Staphylococcus aureus subsp. aureus MW2
accuacaauuuuccuuucaauaa

SEQ ID NO: 2082733 - RNA, 22 nt, Staphylococcus aureus subsp. aureus MW2
accuuucgcgacuucauuacaa

SEQ ID NO: 2082734 - RNA, 23 nt, Staphylococcus aureus subsp. aureus MW2
acgcaauuuaauauuauaaguug

SEQ ID NO: 2082735 - RNA, 20 nt, Staphylococcus aureus subsp. aureus MW2
acgcaauguugucguuucua

SEQ ID NO: 2082736 - RNA, 14 nt, Staphylococcus aureus subsp. aureus MW2
acacacuuauaauc

SEQ ID NO: 2082737 - RNA, 15 nt, Staphylococcus aureus subsp. aureus MW2
acacagaagcuggcg

SEQ ID NO: 2082738 - RNA, 21 nt, Staphylococcus aureus subsp. aureus MW2
acacgcgguaaaacgaaguca

SEQ ID NO: 2082739 - RNA, 15 nt, Staphylococcus aureus subsp. aureus MW2
acaaauggccuuaga

SEQ ID NO: 2082740 - RNA, 17 nt, Staphylococcus aureus subsp. aureus MW2
acaaauguucuauagaa

SEQ ID NO: 2082741 - RNA, 11 nt, Staphylococcus aureus subsp. aureus MW2
acaacauguuu

SEQ ID NO: 2082742 - RNA, 20 nt, Staphylococcus aureus subsp. aureus MW2
aauguuccuuguuuuaaacu

SEQ ID NO: 2082743 - RNA, 18 nt, Staphylococcus aureus subsp. aureus MW2
aauguuagauuucaaacg

SEQ ID NO: 2082744 - RNA, 14 nt, Staphylococcus aureus subsp. aureus MW2
aauguuaucuugcu

SEQ ID NO: 2082745 - RNA, 17 nt, Staphylococcus aureus subsp. aureus MW2
aauguuaacugcaaacu

SEQ ID NO: 2082746 - RNA, 13 nt, Staphylococcus aureus subsp. aureus MW2
aauguuuaacaau

SEQ ID NO: 2082747 - RNA, 18 nt, Staphylococcus aureus subsp. aureus MW2
aauguuucaaauuuauac

SEQ ID NO: 2082748 - RNA, 15 nt, Staphylococcus aureus subsp. aureus MW2
acaaacauuccucua

SEQ ID NO: 2082749 - RNA, 15 nt, Staphylococcus aureus subsp. aureus MW2
acaaacuucacauua

SEQ ID NO: 2082750 - RNA, 15 nt, Staphylococcus aureus subsp. aureus MW2
acaaaaguaugauuu

SEQ ID NO: 2082751 - RNA, 19 nt, Staphylococcus aureus subsp. aureus MW2
acaagcuuuuuucaauucu

SEQ ID NO: 2082752 - RNA, 13 nt, Staphylococcus aureus subsp. aureus MW2
acaauuucgcuua

SEQ ID NO: 2082753 - RNA, 15 nt, Staphylococcus aureus subsp. aureus MW2
acaauuuagaugagu

SEQ ID NO: 2082754 - RNA, 23 nt, Staphylococcus aureus subsp. aureus MW2
acaauugguuguuucaauucaau

SEQ ID NO: 2082755 - RNA, 15 nt, Staphylococcus aureus subsp. aureus MW2
acaauuaaagugaau

SEQ ID NO: 2082756 - RNA, 17 nt, Staphylococcus aureus subsp. aureus MW2
acaauaauaccuucaau

SEQ ID NO: 2082757 - RNA, 13 nt, Staphylococcus aureus subsp. aureus MW2
acaauaugauuaa

SEQ ID NO: 2082758 - RNA, 13 nt, Staphylococcus aureus subsp. aureus MW2
acaaucacagcaa

SEQ ID NO: 2082759 - RNA, 16 nt, Staphylococcus aureus subsp. aureus MW2
acaauauuuuuacaua

SEQ ID NO: 2082760 - RNA, 19 nt, Staphylococcus aureus subsp. aureus MW2
acauuuuuagcuuuaguua

SEQ ID NO: 2082761 - RNA, 13 nt, Staphylococcus aureus subsp. aureus MW2
acauuucuucaau

SEQ ID NO: 2082762 - RNA, 17 nt, Staphylococcus aureus subsp. aureus MW2
acaucuucauguaugaa

SEQ ID NO: 2082763 - RNA, 18 nt, Staphylococcus aureus subsp. aureus MW2
acauaagaaaaagcagua

SEQ ID NO: 2082764 - RNA, 17 nt, Staphylococcus aureus subsp. aureus MW2
acauaacucaaauaucu

SEQ ID NO: 2082765 - RNA, 15 nt, Staphylococcus aureus subsp. aureus MW2
acagugacugauuca

SEQ ID NO: 2082766 - RNA, 21 nt, Staphylococcus aureus subsp. aureus MW2
aauacauuucuguauaaacgc

SEQ ID NO: 2082767 - RNA, 14 nt, Staphylococcus aureus subsp. aureus MW2
ucgcgaaaacguug

SEQ ID NO: 2082768 - RNA, 13 nt, Staphylococcus aureus subsp. aureus MW2
uccuuuguuugua

SEQ ID NO: 2082769 - RNA, 18 nt, Staphylococcus aureus subsp. aureus MW2
uccuuuuuuuaugucuuu

SEQ ID NO: 2082770 - RNA, 17 nt, Staphylococcus aureus subsp. aureus MW2
ucucuaguaucugauac

SEQ ID NO: 2082771 - RNA, 14 nt, Staphylococcus aureus subsp. aureus MW2
ucucauagucaucu

SEQ ID NO: 2082772 - RNA, 20 nt, Staphylococcus aureus subsp. aureus MW2
ucuuggcauuuuuucauuau

SEQ ID NO: 2082773 - RNA, 19 nt, Staphylococcus aureus subsp. aureus MW2
ucuuucaaugcauauucua

SEQ ID NO: 2082774 - RNA, 16 nt, Staphylococcus aureus subsp. aureus MW2
ucuuaaaauaugauuu

SEQ ID NO: 2082775 - RNA, 14 nt, Staphylococcus aureus subsp. aureus MW2
ucuuaucaagaaua

SEQ ID NO: 2082776 - RNA, 22 nt, Staphylococcus aureus subsp. aureus MW2
ucuucaauucuuacaccugcaa

SEQ ID NO: 2082777 - RNA, 16 nt, Staphylococcus aureus subsp. aureus MW2
ucuucucgcauacugu

SEQ ID NO: 2082778 - RNA, 15 nt, Staphylococcus aureus subsp. aureus MW2
ucuucgucaaauuca

SEQ ID NO: 2082779 - RNA, 14 nt, Staphylococcus aureus subsp. aureus MW2
ucuucgauggcugc

SEQ ID NO: 2082780 - RNA, 13 nt, Staphylococcus aureus subsp. aureus MW2
ucuuccaaucaac

SEQ ID NO: 2082781 - RNA, 16 nt, Staphylococcus aureus subsp. aureus MW2
ucuucauguucuuaua

SEQ ID NO: 2082782 - RNA, 12 nt, Staphylococcus aureus subsp. aureus MW2
ugcauauucacg

SEQ ID NO: 2082783 - RNA, 17 nt, Staphylococcus aureus subsp. aureus MW2
ugaugguguugcauuag

SEQ ID NO: 2082784 - RNA, 16 nt, Staphylococcus aureus subsp. aureus MW2
ugcacuaccaucagua

SEQ ID NO: 2082785 - RNA, 15 nt, Staphylococcus aureus subsp. aureus MW2
ugcagauuagguuac

SEQ ID NO: 2082786 - RNA, 18 nt, Staphylococcus aureus subsp. aureus MW2
ugaccuaacaauuugagg

SEQ ID NO: 2082787 - RNA, 18 nt, Staphylococcus aureus subsp. aureus MW2
ugaugaacauaccugcau

SEQ ID NO: 2082788 - RNA, 20 nt, Staphylococcus aureus subsp. aureus MW2
ugaugaacauaccugcauau

SEQ ID NO: 2082789 - RNA, 14 nt, Staphylococcus aureus subsp. aureus MW2
ugaugaacuuaaug

SEQ ID NO: 2082790 - RNA, 15 nt, Staphylococcus aureus subsp. aureus MW2
ugauauuaacuguac

SEQ ID NO: 2082791 - RNA, 13 nt, Staphylococcus aureus subsp. aureus MW2
ugauauugaucug

SEQ ID NO: 2082792 - RNA, 20 nt, Staphylococcus aureus subsp. aureus MW2
ugauauuuaccgucuuauga

SEQ ID NO: 2082793 - RNA, 16 nt, Staphylococcus aureus subsp. aureus MW2
ugaucgcauguuugua

SEQ ID NO: 2082794 - RNA, 21 nt, Staphylococcus aureus subsp. aureus MW2
ugaggccauaagccauaugcu

SEQ ID NO: 2082795 - RNA, 21 nt, Staphylococcus aureus subsp. aureus MW2
ugauaaaaggggaaaucauuu

SEQ ID NO: 2082796 - RNA, 22 nt, Staphylococcus aureus subsp. aureus MW2
ugauaucuacagagaaucaauu

SEQ ID NO: 2082797 - RNA, 15 nt, Staphylococcus aureus subsp. aureus MW2
ugauaaauaaugcau

SEQ ID NO: 2082798 - RNA, 22 nt, Staphylococcus aureus subsp. aureus MW2
ugagcuuuguuagcaucugcau

SEQ ID NO: 2082799 - RNA, 20 nt, Staphylococcus aureus subsp. aureus MW2
uaugcuuauucugaaaaaua

SEQ ID NO: 2082800 - RNA, 22 nt, Staphylococcus aureus subsp. aureus MW2
uaugccuuugauuuuacuugaa

SEQ ID NO: 2082801 - RNA, 14 nt, Staphylococcus aureus subsp. aureus MW2
uauucguauucaaa

SEQ ID NO: 2082802 - RNA, 19 nt, Staphylococcus aureus subsp. aureus MW2
uauucuucauuuauaacau

SEQ ID NO: 2082803 - RNA, 18 nt, Staphylococcus aureus subsp. aureus MW2
uauucgcuuaaaaacgcu

SEQ ID NO: 2082804 - RNA, 24 nt, Staphylococcus aureus subsp. aureus MW2
uauucgauaauauaacugcaugua

SEQ ID NO: 2082805 - RNA, 12 nt, Staphylococcus aureus subsp. aureus MW2
uauguacaauca

SEQ ID NO: 2082806 - RNA, 13 nt, Staphylococcus aureus subsp. aureus MW2
uauguacaaucau

SEQ ID NO: 2082807 - RNA, 16 nt, Staphylococcus aureus subsp. aureus MW2
uauguguuguguauca

SEQ ID NO: 2082808 - RNA, 16 nt, Staphylococcus aureus subsp. aureus MW2
uauuuuauaauaaccu

SEQ ID NO: 2082809 - RNA, 20 nt, Staphylococcus aureus subsp. aureus MW2
uauuugauagaaaucagcuu

SEQ ID NO: 2082810 - RNA, 20 nt, Staphylococcus aureus subsp. aureus MW2
uauuucacucuacaauccua

SEQ ID NO: 2082811 - RNA, 13 nt, Staphylococcus aureus subsp. aureus MW2
uauuuuguaguuc

SEQ ID NO: 2082812 - RNA, 16 nt, Staphylococcus aureus subsp. aureus MW2
uauuuuuaugauucua

SEQ ID NO: 2082813 - RNA, 15 nt, Staphylococcus aureus subsp. aureus MW2
uauugaagaugcuuu

SEQ ID NO: 2082814 - RNA, 19 nt, Staphylococcus aureus subsp. aureus MW2
uauuuaaaaugcuuguuca

SEQ ID NO: 2082815 - RNA, 18 nt, Staphylococcus aureus subsp. aureus MW2
uauuuaaucguaacauau

SEQ ID NO: 2082816 - RNA, 19 nt, Staphylococcus aureus subsp. aureus MW2
uauuuagauaaaaaauacu

SEQ ID NO: 2082817 - RNA, 17 nt, Staphylococcus aureus subsp. aureus MW2
uauuucacucuacaauc

SEQ ID NO: 2082818 - RNA, 19 nt, Staphylococcus aureus subsp. aureus MW2
ucaacauuacaugcaccuu

SEQ ID NO: 2082819 - RNA, 21 nt, Staphylococcus aureus subsp. aureus MW2
ucaacauauaaaucauuucgu

SEQ ID NO: 2082820 - RNA, 19 nt, Staphylococcus aureus subsp. aureus MW2
ucaaauggagcaacgauac

SEQ ID NO: 2082821 - RNA, 16 nt, Staphylococcus aureus subsp. aureus MW2
uauuuuuuauguuuua

SEQ ID NO: 2082822 - RNA, 17 nt, Staphylococcus aureus subsp. aureus MW2
uauuuuuuuaauaccau

SEQ ID NO: 2082823 - RNA, 14 nt, Staphylococcus aureus subsp. aureus MW2
ucaaaagaaauugu

SEQ ID NO: 2082824 - RNA, 16 nt, Staphylococcus aureus subsp. aureus MW2
uagcugggaauacagc

SEQ ID NO: 2082825 - RNA, 13 nt, Staphylococcus aureus subsp. aureus MW2
uagcuuaaugcau

SEQ ID NO: 2082826 - RNA, 13 nt, Staphylococcus aureus subsp. aureus MW2
uagguuuaauguu

SEQ ID NO: 2082827 - RNA, 22 nt, Staphylococcus aureus subsp. aureus MW2
uaguagacgguaucaucugcau

SEQ ID NO: 2082828 - RNA, 16 nt, Staphylococcus aureus subsp. aureus MW2
uaguaguuuauaucaa

SEQ ID NO: 2082829 - RNA, 13 nt, Staphylococcus aureus subsp. aureus MW2
uaguauauucaac

SEQ ID NO: 2082830 - RNA, 12 nt, Staphylococcus aureus subsp. aureus MW2
uaguaugacuua

SEQ ID NO: 2082831 - RNA, 18 nt, Staphylococcus aureus subsp. aureus MW2
uaucauuauucauacguu

SEQ ID NO: 2082832 - RNA, 21 nt, Staphylococcus aureus subsp. aureus MW2
uaucauuuggcguucaacauu

SEQ ID NO: 2082833 - RNA, 17 nt, Staphylococcus aureus subsp. aureus MW2
uauccugauuuaauguu

SEQ ID NO: 2082834 - RNA, 19 nt, Staphylococcus aureus subsp. aureus MW2
uauauagauugccauucau

SEQ ID NO: 2082835 - RNA, 13 nt, Staphylococcus aureus subsp. aureus MW2
uaucaaagucucu

SEQ ID NO: 2082836 - RNA, 22 nt, Staphylococcus aureus subsp. aureus MW2
uaucaaguaugcgccauacaua

SEQ ID NO: 2082837 - RNA, 15 nt, Staphylococcus aureus subsp. aureus MW2
uaucaauugaaugaa

SEQ ID NO: 2082838 - RNA, 13 nt, Staphylococcus aureus subsp. aureus MW2
uaucaucauacuu

SEQ ID NO: 2082839 - RNA, 20 nt, Staphylococcus aureus subsp. aureus MW2
uaucaucugcaagugcuuca

SEQ ID NO: 2082840 - RNA, 13 nt, Staphylococcus aureus subsp. aureus MW2
uauaauaccuaca

SEQ ID NO: 2082841 - RNA, 18 nt, Staphylococcus aureus subsp. aureus MW2
uauaagucugauuugaua

SEQ ID NO: 2082842 - RNA, 19 nt, Staphylococcus aureus subsp. aureus MW2
uauagcaucauaaaguaaa

SEQ ID NO: 2082843 - RNA, 20 nt, Staphylococcus aureus subsp. aureus MW2
uauagucuuaaacauaacau

SEQ ID NO: 2082844 - RNA, 21 nt, Staphylococcus aureus subsp. aureus MW2
uauaacauguauauggcauua

SEQ ID NO: 2082845 - RNA, 15 nt, Staphylococcus aureus subsp. aureus MW2
uauaaauuaucagaa

SEQ ID NO: 2082846 - RNA, 18 nt, Staphylococcus aureus subsp. aureus MW2
uauaagccuuuucaaaca

SEQ ID NO: 2082847 - RNA, 22 nt, Staphylococcus aureus subsp. aureus MW2
uauaagccuuuucaaacauauu

SEQ ID NO: 2082848 - RNA, 15 nt, Staphylococcus aureus subsp. aureus MW2
uaguuuuucauauuc

SEQ ID NO: 2082849 - RNA, 16 nt, Staphylococcus aureus subsp. aureus MW2
uauaaagucguaucau

SEQ ID NO: 2082850 - RNA, 13 nt, Staphylococcus aureus subsp. aureus MW2
uauaaaguugaca

SEQ ID NO: 2082851 - RNA, 16 nt, Staphylococcus aureus subsp. aureus MW2
uacucuaacuuaccau

SEQ ID NO: 2082852 - RNA, 19 nt, Staphylococcus aureus subsp. aureus MW2
uacuuacgaauagaaaaua

SEQ ID NO: 2082853 - RNA, 17 nt, Staphylococcus aureus subsp. aureus MW2
uacuuauucaaauguuu

SEQ ID NO: 2082854 - RNA, 13 nt, Staphylococcus aureus subsp. aureus MW2
uacucauuuagcu

SEQ ID NO: 2082855 - RNA, 12 nt, Staphylococcus aureus subsp. aureus MW2
uacucauauuga

SEQ ID NO: 2082856 - RNA, 16 nt, Staphylococcus aureus subsp. aureus MW2
uacuccuuucauacau

SEQ ID NO: 2082857 - RNA, 23 nt, Staphylococcus aureus subsp. aureus MW2
uagaaucuacgauuuucaagacc

SEQ ID NO: 2082858 - RNA, 16 nt, Staphylococcus aureus subsp. aureus MW2
uagaaauugugcuuuu

SEQ ID NO: 2082859 - RNA, 21 nt, Staphylococcus aureus subsp. aureus MW2
uacuucuaacgcaacugaaac

SEQ ID NO: 2082860 - RNA, 15 nt, Staphylococcus aureus subsp. aureus MW2
uagauaaaucaagaa

SEQ ID NO: 2082861 - RNA, 11 nt, Staphylococcus aureus subsp. aureus MW2
uagaugcauaa

SEQ ID NO: 2082862 - RNA, 22 nt, Staphylococcus aureus subsp. aureus MW2
uagccaaaggcaaaauguaucg

SEQ ID NO: 2082863 - RNA, 16 nt, Staphylococcus aureus subsp. aureus MW2
uagcaugacauuaagg

SEQ ID NO: 2082864 - RNA, 23 nt, Staphylococcus aureus subsp. aureus MW2
uaccuaaugcgacaucgccaauu

SEQ ID NO: 2082865 - RNA, 19 nt, Staphylococcus aureus subsp. aureus MW2
uaccuauuugcugaaugaa

SEQ ID NO: 2082866 - RNA, 17 nt, Staphylococcus aureus subsp. aureus MW2
uacgcugucucauuaau

SEQ ID NO: 2082867 - RNA, 17 nt, Staphylococcus aureus subsp. aureus MW2
uacaaacacccacaauu

SEQ ID NO: 2082868 - RNA, 14 nt, Staphylococcus aureus subsp. aureus MW2
uacaaagugauuua

SEQ ID NO: 2082869 - RNA, 17 nt, Staphylococcus aureus subsp. aureus MW2
uacaaaacauauucagu

SEQ ID NO: 2082870 - RNA, 15 nt, Staphylococcus aureus subsp. aureus MW2
uacaaaacauuacgu

SEQ ID NO: 2082871 - RNA, 13 nt, Staphylococcus aureus subsp. aureus MW2
uaccauuccaaaa

SEQ ID NO: 2082872 - RNA, 19 nt, Staphylococcus aureus subsp. aureus MW2
uacccaaaaaauuguauaa

SEQ ID NO: 2082873 - RNA, 17 nt, Staphylococcus aureus subsp. aureus MW2
uaccaucuuuaauacga

SEQ ID NO: 2082874 - RNA, 20 nt, Staphylococcus aureus subsp. aureus MW2
uaccauauuuuuuaguaaua

SEQ ID NO: 2082875 - RNA, 16 nt, Staphylococcus aureus subsp. aureus MW2
uaccgaauuggaugaa

SEQ ID NO: 2082876 - RNA, 18 nt, Staphylococcus aureus subsp. aureus MW2
ucaguauuaggauuuacu

SEQ ID NO: 2082877 - RNA, 20 nt, Staphylococcus aureus subsp. aureus MW2
ucauauugcacauaaacuuu

SEQ ID NO: 2082878 - RNA, 23 nt, Staphylococcus aureus subsp. aureus MW2
ucaucaacacacacaguuuauaa

SEQ ID NO: 2082879 - RNA, 17 nt, Staphylococcus aureus subsp. aureus MW2
ucauauuuaauguuuca

SEQ ID NO: 2082880 - RNA, 19 nt, Staphylococcus aureus subsp. aureus MW2
uccaaauucauuuguauua

SEQ ID NO: 2082881 - RNA, 19 nt, Staphylococcus aureus subsp. aureus MW2
uccaaagcugaauuuuagu

SEQ ID NO: 2082882 - RNA, 19 nt, Staphylococcus aureus subsp. aureus MW2
ucaugaccaacagcuucaa

SEQ ID NO: 2082883 - RNA, 12 nt, Staphylococcus aureus subsp. aureus MW2
ucacaugaauuu

SEQ ID NO: 2082884 - RNA, 20 nt, Staphylococcus aureus subsp. aureus MW2
ucacauugccuaaagacuuu

SEQ ID NO: 2082885 - RNA, 20 nt, Staphylococcus aureus subsp. aureus MW2
ucacaccugcaauguagcaa

SEQ ID NO: 2082886 - RNA, 23 nt, Staphylococcus aureus subsp. aureus MW2
ucaccaguuugugguaaugauuu

SEQ ID NO: 2082887 - RNA, 22 nt, Staphylococcus aureus subsp. aureus MW2
ucaccaucugcaacuaauauga

SEQ ID NO: 2082888 - RNA, 13 nt, Staphylococcus aureus subsp. aureus MW2
ucaccaacugaac

SEQ ID NO: 2082889 - RNA, 15 nt, Staphylococcus aureus subsp. aureus MW2
aauacaaauauuaag

SEQ ID NO: 2082890 - RNA, 23 nt, Staphylococcus aureus subsp. aureus MW2
aauacaacgacacgaacaacauu

SEQ ID NO: 2082891 - RNA, 22 nt, Staphylococcus aureus subsp. aureus MW2
ucacgauagauuuaucaccuuu

SEQ ID NO: 2082892 - RNA, 18 nt, Staphylococcus aureus subsp. aureus MW2
aagugauuuauuucauau

SEQ ID NO: 2082893 - RNA, 15 nt, Staphylococcus aureus subsp. aureus MW2
guguuaaucaacgua

SEQ ID NO: 2082894 - RNA, 21 nt, Staphylococcus aureus subsp. aureus MW2
aaguuaaaaccuuuucaaacu

SEQ ID NO: 2082895 - RNA, 15 nt, Staphylococcus aureus subsp. aureus MW2
guuacauauugcauu

SEQ ID NO: 2082896 - RNA, 20 nt, Staphylococcus aureus subsp. aureus MW2
aaguuauaucauaacuuaac

SEQ ID NO: 2082897 - RNA, 16 nt, Staphylococcus aureus subsp. aureus MW2
aaguuauuuauucagc

SEQ ID NO: 2082898 - RNA, 14 nt, Staphylococcus aureus subsp. aureus MW2
guuaaucaacguau

SEQ ID NO: 2082899 - RNA, 13 nt, Staphylococcus aureus subsp. aureus MW2
guuaacgauauug

SEQ ID NO: 2082900 - RNA, 13 nt, Staphylococcus aureus subsp. aureus MW2
guuaaagauguug

SEQ ID NO: 2082901 - RNA, 23 nt, Staphylococcus aureus subsp. aureus MW2
guuaaaaucgcagcaaugacacu

SEQ ID NO: 2082902 - RNA, 21 nt, Staphylococcus aureus subsp. aureus MW2
guugaagcuaauucauauuca

SEQ ID NO: 2082903 - RNA, 18 nt, Staphylococcus aureus subsp. aureus MW2
guucaaucgcaucuguua

SEQ ID NO: 2082904 - RNA, 17 nt, Staphylococcus aureus subsp. aureus MW2
guuggaaaaggucaaaa

SEQ ID NO: 2082905 - RNA, 13 nt, Staphylococcus aureus subsp. aureus MW2
guuuaaucguauu

SEQ ID NO: 2082906 - RNA, 14 nt, Staphylococcus aureus subsp. aureus MW2
guuuaaucuauaua

SEQ ID NO: 2082907 - RNA, 18 nt, Staphylococcus aureus subsp. aureus MW2
guuuauuuaauaacgaag

SEQ ID NO: 2082908 - RNA, 16 nt, Staphylococcus aureus subsp. aureus MW2
guugugcaauaccugu

SEQ ID NO: 2082909 - RNA, 20 nt, Staphylococcus aureus subsp. aureus MW2
guuguauaaaaauguauuaa

SEQ ID NO: 2082910 - RNA, 19 nt, Staphylococcus aureus subsp. aureus MW2
uaagaaugccauaccugca

SEQ ID NO: 2082911 - RNA, 14 nt, Staphylococcus aureus subsp. aureus MW2
uaacuuuuuaaagg

SEQ ID NO: 2082912 - RNA, 14 nt, Staphylococcus aureus subsp. aureus MW2
uaauaacaaauagu

SEQ ID NO: 2082913 - RNA, 21 nt, Staphylococcus aureus subsp. aureus MW2
uaauaaauuagccauuucaau

SEQ ID NO: 2082914 - RNA, 14 nt, Staphylococcus aureus subsp. aureus MW2
uaauaauguaucau

SEQ ID NO: 2082915 - RNA, 21 nt, Staphylococcus aureus subsp. aureus MW2
uaauaauacauucauuaacag

SEQ ID NO: 2082916 - RNA, 15 nt, Staphylococcus aureus subsp. aureus MW2
uaauaagucagcuaa

SEQ ID NO: 2082917 - RNA, 21 nt, Staphylococcus aureus subsp. aureus MW2
uaauacaucaucaaguucacc

SEQ ID NO: 2082918 - RNA, 13 nt, Staphylococcus aureus subsp. aureus MW2
uaauacaucuaau

SEQ ID NO: 2082919 - RNA, 16 nt, Staphylococcus aureus subsp. aureus MW2
uaauaauuuauugaua

SEQ ID NO: 2082920 - RNA, 20 nt, Staphylococcus aureus subsp. aureus MW2
uaaguuugucuuugaacaua

SEQ ID NO: 2082921 - RNA, 17 nt, Staphylococcus aureus subsp. aureus MW2
uaaguuuaaugaucagu

SEQ ID NO: 2082922 - RNA, 19 nt, Staphylococcus aureus subsp. aureus MW2
uaaggaugauuuauuaacu

SEQ ID NO: 2082923 - RNA, 23 nt, Staphylococcus aureus subsp. aureus MW2
uaauucaucuugcgccuuguuca

SEQ ID NO: 2082924 - RNA, 15 nt, Staphylococcus aureus subsp. aureus MW2
uaauggcgugcuuuu

SEQ ID NO: 2082925 - RNA, 15 nt, Staphylococcus aureus subsp. aureus MW2
uaauuaauguuucuu

SEQ ID NO: 2082926 - RNA, 14 nt, Staphylococcus aureus subsp. aureus MW2
uaauuaucuuaagu

SEQ ID NO: 2082927 - RNA, 16 nt, Staphylococcus aureus subsp. aureus MW2
uaaugcugcuucuuca

SEQ ID NO: 2082928 - RNA, 18 nt, Staphylococcus aureus subsp. aureus MW2
uaaugauauauuacauca

SEQ ID NO: 2082929 - RNA, 16 nt, Staphylococcus aureus subsp. aureus MW2
uaaugauaaauuaaag

SEQ ID NO: 2082930 - RNA, 14 nt, Staphylococcus aureus subsp. aureus MW2
uaaugaugacauca

SEQ ID NO: 2082931 - RNA, 19 nt, Staphylococcus aureus subsp. aureus MW2
uaauacuucucaauuuagu

SEQ ID NO: 2082932 - RNA, 18 nt, Staphylococcus aureus subsp. aureus MW2
uaauccgauuuugauaua

SEQ ID NO: 2082933 - RNA, 13 nt, Staphylococcus aureus subsp. aureus MW2
uaaucguguauua

SEQ ID NO: 2082934 - RNA, 16 nt, Staphylococcus aureus subsp. aureus MW2
uaaucuucuguuuaua

SEQ ID NO: 2082935 - RNA, 17 nt, Staphylococcus aureus subsp. aureus MW2
uaaugacuauaacacca

SEQ ID NO: 2082936 - RNA, 12 nt, Staphylococcus aureus subsp. aureus MW2
uaaugacuaacu

SEQ ID NO: 2082937 - RNA, 16 nt, Staphylococcus aureus subsp. aureus MW2
uaaugacacgacaccu

SEQ ID NO: 2082938 - RNA, 13 nt, Staphylococcus aureus subsp. aureus MW2
uaacaauaucauc

SEQ ID NO: 2082939 - RNA, 17 nt, Staphylococcus aureus subsp. aureus MW2
uaacacaucaugacauu

SEQ ID NO: 2082940 - RNA, 21 nt, Staphylococcus aureus subsp. aureus MW2
uaacacgauuugguugaacug

SEQ ID NO: 2082941 - RNA, 22 nt, Staphylococcus aureus subsp. aureus MW2
uaaauguuaaugcuucguaauc

SEQ ID NO: 2082942 - RNA, 13 nt, Staphylococcus aureus subsp. aureus MW2
uaacaacaugauu

SEQ ID NO: 2082943 - RNA, 22 nt, Staphylococcus aureus subsp. aureus MW2
uaaaucuauauaaaguugacaa

SEQ ID NO: 2082944 - RNA, 21 nt, Staphylococcus aureus subsp. aureus MW2
uaaaucgugcuguuaucaugg

SEQ ID NO: 2082945 - RNA, 19 nt, Staphylococcus aureus subsp. aureus MW2
uaaaucgugcccauaugau

SEQ ID NO: 2082946 - RNA, 21 nt, Staphylococcus aureus subsp. aureus MW2
uaaauccgcuuguucaacuaa

SEQ ID NO: 2082947 - RNA, 18 nt, Staphylococcus aureus subsp. aureus MW2
uaaaugauuaauaacaua

SEQ ID NO: 2082948 - RNA, 12 nt, Staphylococcus aureus subsp. aureus MW2
uaaauguaucac

SEQ ID NO: 2082949 - RNA, 23 nt, Staphylococcus aureus subsp. aureus MW2
uaaauaaacucaccaaguucacu

SEQ ID NO: 2082950 - RNA, 14 nt, Staphylococcus aureus subsp. aureus MW2
uaaaucaugacaua

SEQ ID NO: 2082951 - RNA, 15 nt, Staphylococcus aureus subsp. aureus MW2
uaaagacaccuucaa

SEQ ID NO: 2082952 - RNA, 18 nt, Staphylococcus aureus subsp. aureus MW2
uaaacucaccaaguucac

SEQ ID NO: 2082953 - RNA, 21 nt, Staphylococcus aureus subsp. aureus MW2
uaaaguguuucaacauauuau

SEQ ID NO: 2082954 - RNA, 15 nt, Staphylococcus aureus subsp. aureus MW2
uaaagguaccacugu

SEQ ID NO: 2082955 - RNA, 23 nt, Staphylococcus aureus subsp. aureus MW2
uaaaagcccccuuuucacaauau

SEQ ID NO: 2082956 - RNA, 15 nt, Staphylococcus aureus subsp. aureus MW2
uaaaacuuauaacug

SEQ ID NO: 2082957 - RNA, 23 nt, Staphylococcus aureus subsp. aureus MW2
uaaacaacauacagccauugaca

SEQ ID NO: 2082958 - RNA, 14 nt, Staphylococcus aureus subsp. aureus MW2
agcguaauggauua

SEQ ID NO: 2082959 - RNA, 16 nt, Staphylococcus aureus subsp. aureus MW2
agcaaagcaaauuagu

SEQ ID NO: 2082960 - RNA, 17 nt, Staphylococcus aureus subsp. aureus MW2
agauuuuaaacgcucau

SEQ ID NO: 2082961 - RNA, 17 nt, Staphylococcus aureus subsp. aureus MW2
agauuuuguauuagcau

SEQ ID NO: 2082962 - RNA, 20 nt, Staphylococcus aureus subsp. aureus MW2
agauauauuaauauuugauu

SEQ ID NO: 2082963 - RNA, 13 nt, Staphylococcus aureus subsp. aureus MW2
agaccucguuaca

SEQ ID NO: 2082964 - RNA, 19 nt, Staphylococcus aureus subsp. aureus MW2
agauaauuuuuaacaucau

SEQ ID NO: 2082965 - RNA, 20 nt, Staphylococcus aureus subsp. aureus MW2
agauaauuuuuaacaucauu

SEQ ID NO: 2082966 - RNA, 15 nt, Staphylococcus aureus subsp. aureus MW2
agaauugcaacgcau

SEQ ID NO: 2082967 - RNA, 21 nt, Staphylococcus aureus subsp. aureus MW2
agacaaugauuugugguaauc

SEQ ID NO: 2082968 - RNA, 17 nt, Staphylococcus aureus subsp. aureus MW2
agacaaugcaaguuggc

SEQ ID NO: 2082969 - RNA, 10 nt, Staphylococcus aureus subsp. aureus MW2
agacagaaau

SEQ ID NO: 2082970 - RNA, 19 nt, Staphylococcus aureus subsp. aureus MW2
agacagcuucucauugaaa

SEQ ID NO: 2082971 - RNA, 22 nt, Staphylococcus aureus subsp. aureus MW2
agaaugcgauuuccuuuagcaa

SEQ ID NO: 2082972 - RNA, 16 nt, Staphylococcus aureus subsp. aureus MW2
agaaucguaacggcau

SEQ ID NO: 2082973 - RNA, 13 nt, Staphylococcus aureus subsp. aureus MW2
agaauauuaagau

SEQ ID NO: 2082974 - RNA, 18 nt, Staphylococcus aureus subsp. aureus MW2
agaaguuuccaacguuau

SEQ ID NO: 2082975 - RNA, 20 nt, Staphylococcus aureus subsp. aureus MW2
agaaggggacuuaaccauuu

SEQ ID NO: 2082976 - RNA, 15 nt, Staphylococcus aureus subsp. aureus MW2
agaacaagaauuaug

SEQ ID NO: 2082977 - RNA, 15 nt, Staphylococcus aureus subsp. aureus MW2
agaaauaaucacauu

SEQ ID NO: 2082978 - RNA, 14 nt, Staphylococcus aureus subsp. aureus MW2
aguguuuuauucga

SEQ ID NO: 2082979 - RNA, 21 nt, Staphylococcus aureus subsp. aureus MW2
aguuaguuuucgugcacguuc

SEQ ID NO: 2082980 - RNA, 14 nt, Staphylococcus aureus subsp. aureus MW2
aguugguaucgauu

SEQ ID NO: 2082981 - RNA, 15 nt, Staphylococcus aureus subsp. aureus MW2
aguauugccguuauu

SEQ ID NO: 2082982 - RNA, 24 nt, Staphylococcus aureus subsp. aureus MW2
auacgagcuuugcucauagaugac

SEQ ID NO: 2082983 - RNA, 16 nt, Staphylococcus aureus subsp. aureus MW2
auacgauuuguucaau

SEQ ID NO: 2082984 - RNA, 13 nt, Staphylococcus aureus subsp. aureus MW2
auaccuugaacau

SEQ ID NO: 2082985 - RNA, 15 nt, Staphylococcus aureus subsp. aureus MW2
auaccuuauuucagc

SEQ ID NO: 2082986 - RNA, 18 nt, Staphylococcus aureus subsp. aureus MW2
auaccacggccgcucggu

SEQ ID NO: 2082987 - RNA, 21 nt, Staphylococcus aureus subsp. aureus MW2
auaccaaccaaaaccaaauga

SEQ ID NO: 2082988 - RNA, 17 nt, Staphylococcus aureus subsp. aureus MW2
auaauuuuguuucacua

SEQ ID NO: 2082989 - RNA, 18 nt, Staphylococcus aureus subsp. aureus MW2
auaauaugugcaugagac

SEQ ID NO: 2082990 - RNA, 13 nt, Staphylococcus aureus subsp. aureus MW2
auacaaauugauu

SEQ ID NO: 2082991 - RNA, 22 nt, Staphylococcus aureus subsp. aureus MW2
auacacaacgauagauaucauu

SEQ ID NO: 2082992 - RNA, 15 nt, Staphylococcus aureus subsp. aureus MW2
auacaccuucagaug

SEQ ID NO: 2082993 - RNA, 15 nt, Staphylococcus aureus subsp. aureus MW2
auacaccuauuacac

SEQ ID NO: 2082994 - RNA, 15 nt, Staphylococcus aureus subsp. aureus MW2
auaagaaucagcuaa

SEQ ID NO: 2082995 - RNA, 15 nt, Staphylococcus aureus subsp. aureus MW2
auaagaaucaucuaa

SEQ ID NO: 2082996 - RNA, 15 nt, Staphylococcus aureus subsp. aureus MW2
auaacuacacuuaau

SEQ ID NO: 2082997 - RNA, 23 nt, Staphylococcus aureus subsp. aureus MW2
auaauaccuucaauugacauuaa

SEQ ID NO: 2082998 - RNA, 12 nt, Staphylococcus aureus subsp. aureus MW2
auaauaauccac

SEQ ID NO: 2082999 - RNA, 16 nt, Staphylococcus aureus subsp. aureus MW2
auaaguuaauguaauc

SEQ ID NO: 2083000 - RNA, 18 nt, Staphylococcus aureus subsp. aureus MW2
auaaguuugguucaguag

SEQ ID NO: 2083001 - RNA, 22 nt, Staphylococcus aureus subsp. aureus MW2
auaaccaccaucccauuaaacc

SEQ ID NO: 2083002 - RNA, 17 nt, Staphylococcus aureus subsp. aureus MW2
aguuugaucauaauuca

SEQ ID NO: 2083003 - RNA, 22 nt, Staphylococcus aureus subsp. aureus MW2
aguuugaucauaauucaguguu

SEQ ID NO: 2083004 - RNA, 20 nt, Staphylococcus aureus subsp. aureus MW2
auaaccuuuaaaacaucauu

SEQ ID NO: 2083005 - RNA, 20 nt, Staphylococcus aureus subsp. aureus MW2
auaacgaagcgggacucauc

SEQ ID NO: 2083006 - RNA, 19 nt, Staphylococcus aureus subsp. aureus MW2
auaaccuuuaaaacaucau

SEQ ID NO: 2083007 - RNA, 18 nt, Staphylococcus aureus subsp. aureus MW2
auagacauuguuaaacua

SEQ ID NO: 2083008 - RNA, 14 nt, Staphylococcus aureus subsp. aureus MW2
auagaaauaacgau

SEQ ID NO: 2083009 - RNA, 18 nt, Staphylococcus aureus subsp. aureus MW2
auagaaauaacgauaccu

SEQ ID NO: 2083010 - RNA, 17 nt, Staphylococcus aureus subsp. aureus MW2
auacuuuugcaucacag

SEQ ID NO: 2083011 - RNA, 21 nt, Staphylococcus aureus subsp. aureus MW2
auacuuuuucagaaugaacuu

SEQ ID NO: 2083012 - RNA, 17 nt, Staphylococcus aureus subsp. aureus MW2
auagaaaaagggcaaaa

SEQ ID NO: 2083013 - RNA, 21 nt, Staphylococcus aureus subsp. aureus MW2
auacuuucacuuuuuauauca

SEQ ID NO: 2083014 - RNA, 21 nt, Staphylococcus aureus subsp. aureus MW2
auacuugagcaaguuauauca

SEQ ID NO: 2083015 - RNA, 16 nt, Staphylococcus aureus subsp. aureus MW2
auagcuaaugcauuau

SEQ ID NO: 2083016 - RNA, 16 nt, Staphylococcus aureus subsp. aureus MW2
auaguuucaaugccuu

SEQ ID NO: 2083017 - RNA, 19 nt, Staphylococcus aureus subsp. aureus MW2
auauaaaacggacaaguuu

SEQ ID NO: 2083018 - RNA, 19 nt, Staphylococcus aureus subsp. aureus MW2
auaguggaugcucguauag

SEQ ID NO: 2083019 - RNA, 20 nt, Staphylococcus aureus subsp. aureus MW2
auagucauaacgauuguugc

SEQ ID NO: 2083020 - RNA, 13 nt, Staphylococcus aureus subsp. aureus MW2
auaguaaucgauu

SEQ ID NO: 2083021 - RNA, 18 nt, Staphylococcus aureus subsp. aureus MW2
auaguaacagacuuuguu

SEQ ID NO: 2083022 - RNA, 13 nt, Staphylococcus aureus subsp. aureus MW2
auaucuaauucgu

SEQ ID NO: 2083023 - RNA, 17 nt, Staphylococcus aureus subsp. aureus MW2
auaucuugcuuggauaa

SEQ ID NO: 2083024 - RNA, 13 nt, Staphylococcus aureus subsp. aureus MW2
auauuauuacuua

SEQ ID NO: 2083025 - RNA, 15 nt, Staphylococcus aureus subsp. aureus MW2
auauucucugcuucu

SEQ ID NO: 2083026 - RNA, 17 nt, Staphylococcus aureus subsp. aureus MW2
auauucugcaccuguuu

SEQ ID NO: 2083027 - RNA, 13 nt, Staphylococcus aureus subsp. aureus MW2
auauugacugccu

SEQ ID NO: 2083028 - RNA, 13 nt, Staphylococcus aureus subsp. aureus MW2
auauucguuacaa

SEQ ID NO: 2083029 - RNA, 13 nt, Staphylococcus aureus subsp. aureus MW2
auauucucugcuu

SEQ ID NO: 2083030 - RNA, 13 nt, Staphylococcus aureus subsp. aureus MW2
auauucacaucuu

SEQ ID NO: 2083031 - RNA, 14 nt, Staphylococcus aureus subsp. aureus MW2
auauucacaucuuu

SEQ ID NO: 2083032 - RNA, 22 nt, Staphylococcus aureus subsp. aureus MW2
auauagcauaaaauuucugcuu

SEQ ID NO: 2083033 - RNA, 22 nt, Staphylococcus aureus subsp. aureus MW2
auauacuagcaauucacaucau

SEQ ID NO: 2083034 - RNA, 18 nt, Staphylococcus aureus subsp. aureus MW2
auauacguauacaucauu

SEQ ID NO: 2083035 - RNA, 14 nt, Staphylococcus aureus subsp. aureus MW2
auauaaauaucaau

SEQ ID NO: 2083036 - RNA, 20 nt, Staphylococcus aureus subsp. aureus MW2
auauaaagucguaucauaua

SEQ ID NO: 2083037 - RNA, 17 nt, Staphylococcus aureus subsp. aureus MW2
auauaaaauccuaagca

SEQ ID NO: 2083038 - RNA, 23 nt, Staphylococcus aureus subsp. aureus MW2
auaucgagaggguacacuucaac

SEQ ID NO: 2083039 - RNA, 15 nt, Staphylococcus aureus subsp. aureus MW2
auauauuacaucauu

SEQ ID NO: 2083040 - RNA, 16 nt, Staphylococcus aureus subsp. aureus MW2
agcuucuuaaaucaac

SEQ ID NO: 2083041 - RNA, 22 nt, Staphylococcus aureus subsp. aureus MW2
aggaaugauauaccuugauuca

SEQ ID NO: 2083042 - RNA, 19 nt, Staphylococcus aureus subsp. aureus MW2
aggacaggaauaaauuuug

SEQ ID NO: 2083043 - RNA, 13 nt, Staphylococcus aureus subsp. aureus MW2
agguaaaucuguu

SEQ ID NO: 2083044 - RNA, 20 nt, Staphylococcus aureus subsp. aureus MW2
aggcugggacauaaaucaau

SEQ ID NO: 2083045 - RNA, 13 nt, Staphylococcus aureus subsp. aureus MW2
cacaucacuauac

SEQ ID NO: 2083046 - RNA, 16 nt, Staphylococcus aureus subsp. aureus MW2
cacaucuuuuugauaa

SEQ ID NO: 2083047 - RNA, 13 nt, Staphylococcus aureus subsp. aureus MW2
cacaucgauaucu

SEQ ID NO: 2083048 - RNA, 22 nt, Staphylococcus aureus subsp. aureus MW2
cacaaaauuaggcauucaucua

SEQ ID NO: 2083049 - RNA, 15 nt, Staphylococcus aureus subsp. aureus MW2
cacacagcuucauua

SEQ ID NO: 2083050 - RNA, 14 nt, Staphylococcus aureus subsp. aureus MW2
caaugauuugauaa

SEQ ID NO: 2083051 - RNA, 14 nt, Staphylococcus aureus subsp. aureus MW2
caauucucuaacuu

SEQ ID NO: 2083052 - RNA, 18 nt, Staphylococcus aureus subsp. aureus MW2
caauguuugccagguaaa

SEQ ID NO: 2083053 - RNA, 13 nt, Staphylococcus aureus subsp. aureus MW2
caauuaaaucgau

SEQ ID NO: 2083054 - RNA, 14 nt, Staphylococcus aureus subsp. aureus MW2
caaugcuaucaugc

SEQ ID NO: 2083055 - RNA, 21 nt, Staphylococcus aureus subsp. aureus MW2
caccccuucucuaaauuacaa

SEQ ID NO: 2083056 - RNA, 13 nt, Staphylococcus aureus subsp. aureus MW2
caaaguuaaucau

SEQ ID NO: 2083057 - RNA, 16 nt, Staphylococcus aureus subsp. aureus MW2
caacagugcucuaugc

SEQ ID NO: 2083058 - RNA, 14 nt, Staphylococcus aureus subsp. aureus MW2
caacuugcacauua

SEQ ID NO: 2083059 - RNA, 14 nt, Staphylococcus aureus subsp. aureus MW2
caacuucaucuaaa

SEQ ID NO: 2083060 - RNA, 20 nt, Staphylococcus aureus subsp. aureus MW2
caacugucgguucaucuaaa

SEQ ID NO: 2083061 - RNA, 14 nt, Staphylococcus aureus subsp. aureus MW2
caagcaugucacug

SEQ ID NO: 2083062 - RNA, 19 nt, Staphylococcus aureus subsp. aureus MW2
caaaaucaacccaucaugu

SEQ ID NO: 2083063 - RNA, 15 nt, Staphylococcus aureus subsp. aureus MW2
caaaaucuuacauug

SEQ ID NO: 2083064 - RNA, 16 nt, Staphylococcus aureus subsp. aureus MW2
auuuuuccaguccauu

SEQ ID NO: 2083065 - RNA, 15 nt, Staphylococcus aureus subsp. aureus MW2
auuuuuuagcacauc

SEQ ID NO: 2083066 - RNA, 22 nt, Staphylococcus aureus subsp. aureus MW2
auuuuuucgagaugauauuaca

SEQ ID NO: 2083067 - RNA, 21 nt, Staphylococcus aureus subsp. aureus MW2
caaaaagguuguuuuucauca

SEQ ID NO: 2083068 - RNA, 15 nt, Staphylococcus aureus subsp. aureus MW2
caaaaaaagcugauu

SEQ ID NO: 2083069 - RNA, 20 nt, Staphylococcus aureus subsp. aureus MW2
caaaaaaucgaacaaaugaa

SEQ ID NO: 2083070 - RNA, 15 nt, Staphylococcus aureus subsp. aureus MW2
auuuuuaauaaugca

SEQ ID NO: 2083071 - RNA, 13 nt, Staphylococcus aureus subsp. aureus MW2
auuuuaucugaau

SEQ ID NO: 2083072 - RNA, 18 nt, Staphylococcus aureus subsp. aureus MW2
auuuuaucugaaucugcu

SEQ ID NO: 2083073 - RNA, 12 nt, Staphylococcus aureus subsp. aureus MW2
auuuuaucaucu

SEQ ID NO: 2083074 - RNA, 15 nt, Staphylococcus aureus subsp. aureus MW2
auuuuaucaucuauu

SEQ ID NO: 2083075 - RNA, 19 nt, Staphylococcus aureus subsp. aureus MW2
auuuucaaauuucuaacuu

SEQ ID NO: 2083076 - RNA, 16 nt, Staphylococcus aureus subsp. aureus MW2
auuugauaaaaaauga

SEQ ID NO: 2083077 - RNA, 16 nt, Staphylococcus aureus subsp. aureus MW2
auuuguaaacaguaug

SEQ ID NO: 2083078 - RNA, 22 nt, Staphylococcus aureus subsp. aureus MW2
auuugucauaauagauaaugca

SEQ ID NO: 2083079 - RNA, 23 nt, Staphylococcus aureus subsp. aureus MW2
auuuuaccuugagcagcaucaau

SEQ ID NO: 2083080 - RNA, 14 nt, Staphylococcus aureus subsp. aureus MW2
auuuuaacaaguga

SEQ ID NO: 2083081 - RNA, 18 nt, Staphylococcus aureus subsp. aureus MW2
auuuuaauaaaaucaucu

SEQ ID NO: 2083082 - RNA, 16 nt, Staphylococcus aureus subsp. aureus MW2
auuuguuuauggauuu

SEQ ID NO: 2083083 - RNA, 15 nt, Staphylococcus aureus subsp. aureus MW2
auuucgacuccauua

SEQ ID NO: 2083084 - RNA, 15 nt, Staphylococcus aureus subsp. aureus MW2
auuucuacucgaaac

SEQ ID NO: 2083085 - RNA, 17 nt, Staphylococcus aureus subsp. aureus MW2
auuuaucuuuuaaaauc

SEQ ID NO: 2083086 - RNA, 22 nt, Staphylococcus aureus subsp. aureus MW2
auuuaugcgauucucauuuacu

SEQ ID NO: 2083087 - RNA, 15 nt, Staphylococcus aureus subsp. aureus MW2
auuuauuauuaccau

SEQ ID NO: 2083088 - RNA, 19 nt, Staphylococcus aureus subsp. aureus MW2
auuuauuucgucgucccac

SEQ ID NO: 2083089 - RNA, 19 nt, Staphylococcus aureus subsp. aureus MW2
auuuaugugcaaucaugcu

SEQ ID NO: 2083090 - RNA, 14 nt, Staphylococcus aureus subsp. aureus MW2
auuuauuaauccau

SEQ ID NO: 2083091 - RNA, 14 nt, Staphylococcus aureus subsp. aureus MW2
auuuccacagcaau

SEQ ID NO: 2083092 - RNA, 21 nt, Staphylococcus aureus subsp. aureus MW2
auuucaucaaauccaaaaucu

SEQ ID NO: 2083093 - RNA, 19 nt, Staphylococcus aureus subsp. aureus MW2
auuuaguucgauaacacau

SEQ ID NO: 2083094 - RNA, 19 nt, Staphylococcus aureus subsp. aureus MW2
auuuaggaguauccugauu

SEQ ID NO: 2083095 - RNA, 22 nt, Staphylococcus aureus subsp. aureus MW2
auuuaauugguuucacauuguc

SEQ ID NO: 2083096 - RNA, 22 nt, Staphylococcus aureus subsp. aureus MW2
auuuagaucgauguguaacauu

SEQ ID NO: 2083097 - RNA, 15 nt, Staphylococcus aureus subsp. aureus MW2
auccauucaauguuu

SEQ ID NO: 2083098 - RNA, 12 nt, Staphylococcus aureus subsp. aureus MW2
auccaucuacac

SEQ ID NO: 2083099 - RNA, 13 nt, Staphylococcus aureus subsp. aureus MW2
aucagucauucac

SEQ ID NO: 2083100 - RNA, 13 nt, Staphylococcus aureus subsp. aureus MW2
auccaaugaugaa

SEQ ID NO: 2083101 - RNA, 15 nt, Staphylococcus aureus subsp. aureus MW2
aucauuuucaauacu

SEQ ID NO: 2083102 - RNA, 21 nt, Staphylococcus aureus subsp. aureus MW2
aucauugauauagucaaugaa

SEQ ID NO: 2083103 - RNA, 16 nt, Staphylococcus aureus subsp. aureus MW2
aucaugcucauuugau

SEQ ID NO: 2083104 - RNA, 21 nt, Staphylococcus aureus subsp. aureus MW2
aucguauugaaaaugagcuga

SEQ ID NO: 2083105 - RNA, 24 nt, Staphylococcus aureus subsp. aureus MW2
aucgccucugcuagacaaucaucu

SEQ ID NO: 2083106 - RNA, 20 nt, Staphylococcus aureus subsp. aureus MW2
auguauaguguuaauguuug

SEQ ID NO: 2083107 - RNA, 13 nt, Staphylococcus aureus subsp. aureus MW2
auguagcuuugug

SEQ ID NO: 2083108 - RNA, 21 nt, Staphylococcus aureus subsp. aureus MW2
auguacuaccuacuuguucaa

SEQ ID NO: 2083109 - RNA, 22 nt, Staphylococcus aureus subsp. aureus MW2
auguaccgaauccuucaucaau

SEQ ID NO: 2083110 - RNA, 20 nt, Staphylococcus aureus subsp. aureus MW2
augucgcacuauaaaauuca

SEQ ID NO: 2083111 - RNA, 16 nt, Staphylococcus aureus subsp. aureus MW2
auucaauuuaguucac

SEQ ID NO: 2083112 - RNA, 20 nt, Staphylococcus aureus subsp. aureus MW2
auuauuuuucucauagucau

SEQ ID NO: 2083113 - RNA, 20 nt, Staphylococcus aureus subsp. aureus MW2
auuauuugugacguauuaca

SEQ ID NO: 2083114 - RNA, 19 nt, Staphylococcus aureus subsp. aureus MW2
auuauuucgucgucccacc

SEQ ID NO: 2083115 - RNA, 15 nt, Staphylococcus aureus subsp. aureus MW2
auuaucuauccauuu

SEQ ID NO: 2083116 - RNA, 21 nt, Staphylococcus aureus subsp. aureus MW2
auuagcaaauauuauuaaauc

SEQ ID NO: 2083117 - RNA, 21 nt, Staphylococcus aureus subsp. aureus MW2
auuagagccuacucauauuca

SEQ ID NO: 2083118 - RNA, 20 nt, Staphylococcus aureus subsp. aureus MW2
auuauaaauacaugagccuu

SEQ ID NO: 2083119 - RNA, 22 nt, Staphylococcus aureus subsp. aureus MW2
auuauaguuuagauucacugua

SEQ ID NO: 2083120 - RNA, 22 nt, Staphylococcus aureus subsp. aureus MW2
auuaucaacuuuauaaccuaaa

SEQ ID NO: 2083121 - RNA, 19 nt, Staphylococcus aureus subsp. aureus MW2
auuaguaugacuuaccuaa

SEQ ID NO: 2083122 - RNA, 15 nt, Staphylococcus aureus subsp. aureus MW2
auuaggauguucagc

SEQ ID NO: 2083123 - RNA, 14 nt, Staphylococcus aureus subsp. aureus MW2
auuagaucauacau

SEQ ID NO: 2083124 - RNA, 23 nt, Staphylococcus aureus subsp. aureus MW2
auuaacucaggcugggacauaaa

SEQ ID NO: 2083125 - RNA, 15 nt, Staphylococcus aureus subsp. aureus MW2
auuaagaaaaucauu

SEQ ID NO: 2083126 - RNA, 23 nt, Staphylococcus aureus subsp. aureus MW2
auuaacauuuugaaucauacgaa

SEQ ID NO: 2083127 - RNA, 16 nt, Staphylococcus aureus subsp. aureus MW2
auguuuaagacuauaa

SEQ ID NO: 2083128 - RNA, 15 nt, Staphylococcus aureus subsp. aureus MW2
auguuugcaucacuu

SEQ ID NO: 2083129 - RNA, 24 nt, Staphylococcus aureus subsp. aureus MW2
auuacgcaaagaaaaacaucgauu

SEQ ID NO: 2083130 - RNA, 20 nt, Staphylococcus aureus subsp. aureus MW2
auuaaguacuuuuacaaacu

SEQ ID NO: 2083131 - RNA, 12 nt, Staphylococcus aureus subsp. aureus MW2
auuaaugauuca

SEQ ID NO: 2083132 - RNA, 15 nt, Staphylococcus aureus subsp. aureus MW2
auuaaugguauugau

SEQ ID NO: 2083133 - RNA, 13 nt, Staphylococcus aureus subsp. aureus MW2
auuaaugucacau

SEQ ID NO: 2083134 - RNA, 12 nt, Staphylococcus aureus subsp. aureus MW2
auuaauuacagc

SEQ ID NO: 2083135 - RNA, 21 nt, Staphylococcus aureus subsp. aureus MW2
augcaaaucaaauacaucaau

SEQ ID NO: 2083136 - RNA, 20 nt, Staphylococcus aureus subsp. aureus MW2
augauuuuucaucaauauca

SEQ ID NO: 2083137 - RNA, 17 nt, Staphylococcus aureus subsp. aureus MW2
augccauuguuauccaa

SEQ ID NO: 2083138 - RNA, 17 nt, Staphylococcus aureus subsp. aureus MW2
augacuaagauaucugg

SEQ ID NO: 2083139 - RNA, 12 nt, Staphylococcus aureus subsp. aureus MW2
aucugacauuuc

SEQ ID NO: 2083140 - RNA, 15 nt, Staphylococcus aureus subsp. aureus MW2
aucugacauuguugc

SEQ ID NO: 2083141 - RNA, 20 nt, Staphylococcus aureus subsp. aureus MW2
aucugaaaaaccaauacgaa

SEQ ID NO: 2083142 - RNA, 16 nt, Staphylococcus aureus subsp. aureus MW2
augacuuaacaucuuu

SEQ ID NO: 2083143 - RNA, 22 nt, Staphylococcus aureus subsp. aureus MW2
augaucuuuguagccuucaacu

SEQ ID NO: 2083144 - RNA, 22 nt, Staphylococcus aureus subsp. aureus MW2
augauuuauuaacucaugcuga

SEQ ID NO: 2083145 - RNA, 17 nt, Staphylococcus aureus subsp. aureus MW2
augauuuauuaacucau

SEQ ID NO: 2083146 - RNA, 18 nt, Staphylococcus aureus subsp. aureus MW2
cccguaauaauuuacagg

SEQ ID NO: 2083147 - RNA, 19 nt, Staphylococcus aureus subsp. aureus MW2
ccgaaaguuagacuaaaaa

SEQ ID NO: 2083148 - RNA, 18 nt, Staphylococcus aureus subsp. aureus MW2
cccgcuuauugcauugua

SEQ ID NO: 2083149 - RNA, 18 nt, Staphylococcus aureus subsp. aureus MW2
ccaucuggcguuaaccau

SEQ ID NO: 2083150 - RNA, 16 nt, Staphylococcus aureus subsp. aureus MW2
ccauaaucuucauuaa

SEQ ID NO: 2083151 - RNA, 19 nt, Staphylococcus aureus subsp. aureus MW2
caucucaacuaaucgugua

SEQ ID NO: 2083152 - RNA, 21 nt, Staphylococcus aureus subsp. aureus MW2
caucucuuauaaguucaacca

SEQ ID NO: 2083153 - RNA, 18 nt, Staphylococcus aureus subsp. aureus MW2
caucuuuguuuucaaacu

SEQ ID NO: 2083154 - RNA, 15 nt, Staphylococcus aureus subsp. aureus MW2
caugaauuuucauca

SEQ ID NO: 2083155 - RNA, 20 nt, Staphylococcus aureus subsp. aureus MW2
caugccagaugcaaugauac

SEQ ID NO: 2083156 - RNA, 21 nt, Staphylococcus aureus subsp. aureus MW2
ccaagucuaaaugcaauaugu

SEQ ID NO: 2083157 - RNA, 14 nt, Staphylococcus aureus subsp. aureus MW2
cauucucauucagu

SEQ ID NO: 2083158 - RNA, 14 nt, Staphylococcus aureus subsp. aureus MW2
cauucauuugcaaa

SEQ ID NO: 2083159 - RNA, 19 nt, Staphylococcus aureus subsp. aureus MW2
cauucauaauuuguugaua

SEQ ID NO: 2083160 - RNA, 12 nt, Staphylococcus aureus subsp. aureus MW2
cauucuuauuug

SEQ ID NO: 2083161 - RNA, 22 nt, Staphylococcus aureus subsp. aureus MW2
cauucuuuaguacgcuguaauc

SEQ ID NO: 2083162 - RNA, 15 nt, Staphylococcus aureus subsp. aureus MW2
cauucuuuuucaaaa

SEQ ID NO: 2083163 - RNA, 16 nt, Staphylococcus aureus subsp. aureus MW2
cauugaacgauaacaa

SEQ ID NO: 2083164 - RNA, 13 nt, Staphylococcus aureus subsp. aureus MW2
cauuguaacucaa

SEQ ID NO: 2083165 - RNA, 22 nt, Staphylococcus aureus subsp. aureus MW2
cauuguguaucguuuuacuuuc

SEQ ID NO: 2083166 - RNA, 22 nt, Staphylococcus aureus subsp. aureus MW2
cagcuuaauuugacaaucuaaa

SEQ ID NO: 2083167 - RNA, 14 nt, Staphylococcus aureus subsp. aureus MW2
cauauacuauaugu

SEQ ID NO: 2083168 - RNA, 22 nt, Staphylococcus aureus subsp. aureus MW2
cauauauucauugauuguuaau

SEQ ID NO: 2083169 - RNA, 19 nt, Staphylococcus aureus subsp. aureus MW2
cauauuacuucucaucgaa

SEQ ID NO: 2083170 - RNA, 22 nt, Staphylococcus aureus subsp. aureus MW2
cauauggacguaacuguuuuaa

SEQ ID NO: 2083171 - RNA, 17 nt, Staphylococcus aureus subsp. aureus MW2
caucacauaacuaugcu

SEQ ID NO: 2083172 - RNA, 19 nt, Staphylococcus aureus subsp. aureus MW2
caucaacagauacuucagu

SEQ ID NO: 2083173 - RNA, 17 nt, Staphylococcus aureus subsp. aureus MW2
caucaguuguguaauaa

SEQ ID NO: 2083174 - RNA, 15 nt, Staphylococcus aureus subsp. aureus MW2
caucauauucaacua

SEQ ID NO: 2083175 - RNA, 20 nt, Staphylococcus aureus subsp. aureus MW2
cauccaauuauguuuaucua

SEQ ID NO: 2083176 - RNA, 22 nt, Staphylococcus aureus subsp. aureus MW2
caucauuuauaugauguucaau

SEQ ID NO: 2083177 - RNA, 15 nt, Staphylococcus aureus subsp. aureus MW2
caucauggucaacuu

SEQ ID NO: 2083178 - RNA, 14 nt, Staphylococcus aureus subsp. aureus MW2
cauaacgcacugca

SEQ ID NO: 2083179 - RNA, 19 nt, Staphylococcus aureus subsp. aureus MW2
cauaaccuugcuuugcaua

SEQ ID NO: 2083180 - RNA, 22 nt, Staphylococcus aureus subsp. aureus MW2
cauaccaaauaaauaagugaua

SEQ ID NO: 2083181 - RNA, 18 nt, Staphylococcus aureus subsp. aureus MW2
cauauaaugguugaauaa

SEQ ID NO: 2083182 - RNA, 22 nt, Staphylococcus aureus subsp. aureus MW2
cauauacguauacaucauuaga

SEQ ID NO: 2083183 - RNA, 20 nt, Staphylococcus aureus subsp. aureus MW2
cauauaaagucguaucauau

SEQ ID NO: 2083184 - RNA, 14 nt, Staphylococcus aureus subsp. aureus MW2
cauauaauaugugc

SEQ ID NO: 2083185 - RNA, 22 nt, Staphylococcus aureus subsp. aureus MW2
cauacuuuuagcaacaguauuu

SEQ ID NO: 2083186 - RNA, 19 nt, Staphylococcus aureus subsp. aureus MW2
cacuuaauaucaguagcau

SEQ ID NO: 2083187 - RNA, 21 nt, Staphylococcus aureus subsp. aureus MW2
cacuuucaguaauuguuacua

SEQ ID NO: 2083188 - RNA, 22 nt, Staphylococcus aureus subsp. aureus MW2
cacugcaauggcuaaugacuuc

SEQ ID NO: 2083189 - RNA, 16 nt, Staphylococcus aureus subsp. aureus MW2
cacugccuuuuuguaa

SEQ ID NO: 2083190 - RNA, 14 nt, Staphylococcus aureus subsp. aureus MW2
cacugccguuugaa

SEQ ID NO: 2083191 - RNA, 14 nt, Staphylococcus aureus subsp. aureus MW2
cacgcauuacuuua

SEQ ID NO: 2083192 - RNA, 14 nt, Staphylococcus aureus subsp. aureus MW2
cagauucaaacguu

SEQ ID NO: 2083193 - RNA, 19 nt, Staphylococcus aureus subsp. aureus MW2
cagaaugguaauucaccau

SEQ ID NO: 2083194 - RNA, 16 nt, Staphylococcus aureus subsp. aureus MW2
cagaauuucaucaaau

SEQ ID NO: 2083195 - RNA, 14 nt, Staphylococcus aureus subsp. aureus MW2
cagcaugaaguggg

SEQ ID NO: 2083196 - RNA, 17 nt, Staphylococcus aureus subsp. aureus MW2
cgauauuucuaguugca

SEQ ID NO: 2083197 - RNA, 18 nt, Staphylococcus aureus subsp. aureus MW2
cgauagaaagcgucuuuu

SEQ ID NO: 2083198 - RNA, 12 nt, Staphylococcus aureus subsp. aureus MW2
cgaggucuuuaa

SEQ ID NO: 2083199 - RNA, 17 nt, Staphylococcus aureus subsp. aureus MW2
cgacuucauuacaaaca

SEQ ID NO: 2083200 - RNA, 14 nt, Staphylococcus aureus subsp. aureus MW2
cgaauaauccaguc

SEQ ID NO: 2083201 - RNA, 13 nt, Staphylococcus aureus subsp. aureus MW2
cgaagaaugauac

SEQ ID NO: 2083202 - RNA, 17 nt, Staphylococcus aureus subsp. aureus MW2
ccuaucacgauuucagc

SEQ ID NO: 2083203 - RNA, 15 nt, Staphylococcus aureus subsp. aureus MW2
ccguaaugagaguaa

SEQ ID NO: 2083204 - RNA, 17 nt, Staphylococcus aureus subsp. aureus MW2
gagcuugggacagaaaa

SEQ ID NO: 2083205 - RNA, 23 nt, Staphylococcus aureus subsp. aureus MW2
gaguacauuuauuuaaugugcau

SEQ ID NO: 2083206 - RNA, 14 nt, Staphylococcus aureus subsp. aureus MW2
gaguugaacaacua

SEQ ID NO: 2083207 - RNA, 22 nt, Staphylococcus aureus subsp. aureus MW2
gauaauuaaaauaagauauaua

SEQ ID NO: 2083208 - RNA, 18 nt, Staphylococcus aureus subsp. aureus MW2
gauaauguaaaaugauga

SEQ ID NO: 2083209 - RNA, 20 nt, Staphylococcus aureus subsp. aureus MW2
gauaaguuuuugaauaucua

SEQ ID NO: 2083210 - RNA, 14 nt, Staphylococcus aureus subsp. aureus MW2
gaucaagugcagau

SEQ ID NO: 2083211 - RNA, 22 nt, Staphylococcus aureus subsp. aureus MW2
gauauuuacagcgauuguuaaa

SEQ ID NO: 2083212 - RNA, 20 nt, Staphylococcus aureus subsp. aureus MW2
gagcccuuagcaauaucauc

SEQ ID NO: 2083213 - RNA, 13 nt, Staphylococcus aureus subsp. aureus MW2
gaugagaaauguu

SEQ ID NO: 2083214 - RNA, 18 nt, Staphylococcus aureus subsp. aureus MW2
gaugauuuauuaacucau

SEQ ID NO: 2083215 - RNA, 22 nt, Staphylococcus aureus subsp. aureus MW2
gauggcguaagcaguuaauaag

SEQ ID NO: 2083216 - RNA, 18 nt, Staphylococcus aureus subsp. aureus MW2
gcaaaaauaauaugaauu

SEQ ID NO: 2083217 - RNA, 13 nt, Staphylococcus aureus subsp. aureus MW2
gcaaaacuaauca

SEQ ID NO: 2083218 - RNA, 13 nt, Staphylococcus aureus subsp. aureus MW2
gauuuuauuauga

SEQ ID NO: 2083219 - RNA, 19 nt, Staphylococcus aureus subsp. aureus MW2
gauuaccaaguaaugauac

SEQ ID NO: 2083220 - RNA, 14 nt, Staphylococcus aureus subsp. aureus MW2
gauuaacauaacua

SEQ ID NO: 2083221 - RNA, 23 nt, Staphylococcus aureus subsp. aureus MW2
gauuaaaaguaucgccaaucuau

SEQ ID NO: 2083222 - RNA, 18 nt, Staphylococcus aureus subsp. aureus MW2
gauguuuaacuaaaccau

SEQ ID NO: 2083223 - RNA, 22 nt, Staphylococcus aureus subsp. aureus MW2
gcauaugguaaaucgucauuau

SEQ ID NO: 2083224 - RNA, 15 nt, Staphylococcus aureus subsp. aureus MW2
gcaauacgcaauguu

SEQ ID NO: 2083225 - RNA, 14 nt, Staphylococcus aureus subsp. aureus MW2
gcacgagaaauguc

SEQ ID NO: 2083226 - RNA, 14 nt, Staphylococcus aureus subsp. aureus MW2
gcacgucuuguauc

SEQ ID NO: 2083227 - RNA, 17 nt, Staphylococcus aureus subsp. aureus MW2
gccaacuugcacauuau

SEQ ID NO: 2083228 - RNA, 14 nt, Staphylococcus aureus subsp. aureus MW2
gccaauuaauucuu

SEQ ID NO: 2083229 - RNA, 15 nt, Staphylococcus aureus subsp. aureus MW2
gaagaaugauacugu

SEQ ID NO: 2083230 - RNA, 23 nt, Staphylococcus aureus subsp. aureus MW2
gaaacgcuuugcagauugauaua

SEQ ID NO: 2083231 - RNA, 15 nt, Staphylococcus aureus subsp. aureus MW2
gaagcugacgaaaag

SEQ ID NO: 2083232 - RNA, 14 nt, Staphylococcus aureus subsp. aureus MW2
gacauuaaucaugc

SEQ ID NO: 2083233 - RNA, 18 nt, Staphylococcus aureus subsp. aureus MW2
gaccaacuugcacauuau

SEQ ID NO: 2083234 - RNA, 20 nt, Staphylococcus aureus subsp. aureus MW2
gaaggucuacuaaauaacua

SEQ ID NO: 2083235 - RNA, 13 nt, Staphylococcus aureus subsp. aureus MW2
gaaguucuuaugc

SEQ ID NO: 2083236 - RNA, 23 nt, Staphylococcus aureus subsp. aureus MW2
gaauauagauuuuguauuagcau

SEQ ID NO: 2083237 - RNA, 13 nt, Staphylococcus aureus subsp. aureus MW2
gaauaaauugaua

SEQ ID NO: 2083238 - RNA, 17 nt, Staphylococcus aureus subsp. aureus MW2
gaauguuuuugauagua

SEQ ID NO: 2083239 - RNA, 15 nt, Staphylococcus aureus subsp. aureus MW2
gaauuaugaucaaua

SEQ ID NO: 2083240 - RNA, 22 nt, Staphylococcus aureus subsp. aureus MW2
cugcaccuaacgcuaaugauaa

SEQ ID NO: 2083241 - RNA, 15 nt, Staphylococcus aureus subsp. aureus MW2
cuuguaauauaacaa

SEQ ID NO: 2083242 - RNA, 22 nt, Staphylococcus aureus subsp. aureus MW2
cuuucuuuccgccagucaucau

SEQ ID NO: 2083243 - RNA, 15 nt, Staphylococcus aureus subsp. aureus MW2
cuuugauaucuacag

SEQ ID NO: 2083244 - RNA, 18 nt, Staphylococcus aureus subsp. aureus MW2
cuuugcauacauaucuuu

SEQ ID NO: 2083245 - RNA, 22 nt, Staphylococcus aureus subsp. aureus MW2
cuuucauaguuauuaaaucuuu

SEQ ID NO: 2083246 - RNA, 20 nt, Staphylococcus aureus subsp. aureus MW2
gaaaauaaucgaacagaaaa

SEQ ID NO: 2083247 - RNA, 21 nt, Staphylococcus aureus subsp. aureus MW2
gaaaaaacuuuucauggaguc

SEQ ID NO: 2083248 - RNA, 19 nt, Staphylococcus aureus subsp. aureus MW2
gaaaaacuguaaaucauca

SEQ ID NO: 2083249 - RNA, 17 nt, Staphylococcus aureus subsp. aureus MW2
cuucuccguauuuaccu

SEQ ID NO: 2083250 - RNA, 18 nt, Staphylococcus aureus subsp. aureus MW2
cuucuuuuucuugcauac

SEQ ID NO: 2083251 - RNA, 16 nt, Staphylococcus aureus subsp. aureus MW2
cuucaauugucucaau

SEQ ID NO: 2083252 - RNA, 20 nt, Staphylococcus aureus subsp. aureus MW2
cuucccaucuuuuagguaau

SEQ ID NO: 2083253 - RNA, 14 nt, Staphylococcus aureus subsp. aureus MW2
cuucgaagucauau

SEQ ID NO: 2083254 - RNA, 15 nt, Staphylococcus aureus subsp. aureus MW2
cuucgacuacaaguu

SEQ ID NO: 2083255 - RNA, 17 nt, Staphylococcus aureus subsp. aureus MW2
cuuaauugaauuaaauc

SEQ ID NO: 2083256 - RNA, 13 nt, Staphylococcus aureus subsp. aureus MW2
cuuacaaauauug

SEQ ID NO: 2083257 - RNA, 18 nt, Staphylococcus aureus subsp. aureus MW2
cuuaauauauucggcaaa

SEQ ID NO: 2083258 - RNA, 13 nt, Staphylococcus aureus subsp. aureus MW2
cuuacauugauaa

SEQ ID NO: 2083259 - RNA, 17 nt, Staphylococcus aureus subsp. aureus MW2
cuguuucacguaaugaa

SEQ ID NO: 2083260 - RNA, 22 nt, Staphylococcus aureus subsp. aureus MW2
cuuacugcuguuuuuagguuau

SEQ ID NO: 2083261 - RNA, 14 nt, Staphylococcus aureus subsp. aureus MW2
cuuaugauagugcu

SEQ ID NO: 2083262 - RNA, 15 nt, Staphylococcus aureus subsp. aureus MW2
cuuauuugaaaugau

SEQ ID NO: 2083263 - RNA, 14 nt, Staphylococcus aureus subsp. aureus MW2
cuucaacgucaucu

SEQ ID NO: 2083264 - RNA, 15 nt, Staphylococcus aureus subsp. aureus MW2
cuucaacuucaucua

SEQ ID NO: 2083265 - RNA, 23 nt, Staphylococcus aureus subsp. aureus MW2
cuguauaaauaaccgcacuuucu

SEQ ID NO: 2083266 - RNA, 18 nt, Staphylococcus aureus subsp. aureus MW2
cuguauaaccauaaugaa

SEQ ID NO: 2083267 - RNA, 16 nt, Staphylococcus aureus subsp. aureus MW2
cguuuaauaccuauga

SEQ ID NO: 2083268 - RNA, 18 nt, Staphylococcus aureus subsp. aureus MW2
cguuuaagaaaucaacaa

SEQ ID NO: 2083269 - RNA, 17 nt, Staphylococcus aureus subsp. aureus MW2
cuaaaacaaauucauau

SEQ ID NO: 2083270 - RNA, 19 nt, Staphylococcus aureus subsp. aureus MW2
cuaaaaaugucguauaugu

SEQ ID NO: 2083271 - RNA, 18 nt, Staphylococcus aureus subsp. aureus MW2
cuaaaauucuuucagcua

SEQ ID NO: 2083272 - RNA, 17 nt, Staphylococcus aureus subsp. aureus MW2
cuaaacauuuuauacuc

SEQ ID NO: 2083273 - RNA, 15 nt, Staphylococcus aureus subsp. aureus MW2
cuaaaccucaacauu

SEQ ID NO: 2083274 - RNA, 15 nt, Staphylococcus aureus subsp. aureus MW2
cuaaacgcuaaaauu

SEQ ID NO: 2083275 - RNA, 14 nt, Staphylococcus aureus subsp. aureus MW2
cuaaacguucaugu

SEQ ID NO: 2083276 - RNA, 22 nt, Staphylococcus aureus subsp. aureus MW2
cuaaaugcacuagcaacaucuu

SEQ ID NO: 2083277 - RNA, 21 nt, Staphylococcus aureus subsp. aureus MW2
cuaaagcgauuuccaucauuu

SEQ ID NO: 2083278 - RNA, 13 nt, Staphylococcus aureus subsp. aureus MW2
cuaaauacgagug

SEQ ID NO: 2083279 - RNA, 15 nt, Staphylococcus aureus subsp. aureus MW2
cuaaaaagucuuuaa

SEQ ID NO: 2083280 - RNA, 20 nt, Staphylococcus aureus subsp. aureus MW2
cuaaaaacagcaguaagaca

SEQ ID NO: 2083281 - RNA, 22 nt, Staphylococcus aureus subsp. aureus MW2
cuaauaaaaccgguacuuucau

SEQ ID NO: 2083282 - RNA, 15 nt, Staphylococcus aureus subsp. aureus MW2
cuaauagcauuugua

SEQ ID NO: 2083283 - RNA, 16 nt, Staphylococcus aureus subsp. aureus MW2
cuaaucugccguguuu

SEQ ID NO: 2083284 - RNA, 18 nt, Staphylococcus aureus subsp. aureus MW2
cuaacucauaaucaacau

SEQ ID NO: 2083285 - RNA, 13 nt, Staphylococcus aureus subsp. aureus MW2
cuaagauacguug

SEQ ID NO: 2083286 - RNA, 16 nt, Staphylococcus aureus subsp. aureus MW2
cuaagaauguaaugag

SEQ ID NO: 2083287 - RNA, 20 nt, Staphylococcus aureus subsp. aureus MW2
cuacaaaguuuauacuuaau

SEQ ID NO: 2083288 - RNA, 12 nt, Staphylococcus aureus subsp. aureus MW2
cuaauucacuuu

SEQ ID NO: 2083289 - RNA, 14 nt, Staphylococcus aureus subsp. aureus MW2
cuaauucauucaau

SEQ ID NO: 2083290 - RNA, 15 nt, Staphylococcus aureus subsp. aureus MW2
cuaguuauuucauag

SEQ ID NO: 2083291 - RNA, 23 nt, Staphylococcus aureus subsp. aureus MW2
cuauaauaauuggaaucaucuuu

SEQ ID NO: 2083292 - RNA, 20 nt, Staphylococcus aureus subsp. aureus MW2
cuauaaauacuuuugcauca

SEQ ID NO: 2083293 - RNA, 20 nt, Staphylococcus aureus subsp. aureus MW2
cuauaaucauuaaguaaucu

SEQ ID NO: 2083294 - RNA, 17 nt, Staphylococcus aureus subsp. aureus MW2
cuacgcugaugaaugau

SEQ ID NO: 2083295 - RNA, 19 nt, Staphylococcus aureus subsp. aureus MW2
cuauuuaucauacuucaaa

SEQ ID NO: 2083296 - RNA, 15 nt, Staphylococcus aureus subsp. aureus MW2
cugcaauguagcaau

SEQ ID NO: 2083297 - RNA, 20 nt, Staphylococcus aureus subsp. aureus MW2
cugaaacgccucaacacuuu

SEQ ID NO: 2083298 - RNA, 15 nt, Staphylococcus aureus subsp. aureus MW2
cugaaacgccucaac

SEQ ID NO: 2083299 - RNA, 18 nt, Staphylococcus aureus subsp. aureus MW2
cugaaaucuagaccuuca

SEQ ID NO: 2083300 - RNA, 15 nt, Staphylococcus aureus subsp. aureus MW2
cucuaaauauaauag

SEQ ID NO: 2083301 - RNA, 14 nt, Staphylococcus aureus subsp. aureus MW2
cucaugcacuuuau

SEQ ID NO: 2083302 - RNA, 18 nt, Staphylococcus aureus subsp. aureus MW2
cucccuucaaaguuuuca

SEQ ID NO: 2083303 - RNA, 13 nt, Staphylococcus aureus subsp. aureus MW2
cucgaaaccagcu

SEQ ID NO: 2083304 - RNA, 14 nt, Staphylococcus aureus subsp. aureus MW2
cuacaauuauaugu

SEQ ID NO: 2083305 - RNA, 19 nt, Staphylococcus aureus subsp. aureus MW2
cuacaaucauaccggcaaa

SEQ ID NO: 2083306 - RNA, 17 nt, Staphylococcus aureus subsp. aureus MW2
cuaauaaguuaccuucg

SEQ ID NO: 2083307 - RNA, 21 nt, Staphylococcus aureus subsp. aureus MW2
cuaauaaaaccgguacuuuca

SEQ ID NO: 2083308 - RNA, 16 nt, Staphylococcus aureus subsp. aureus MW2
cuaauacuuucacuuu

SEQ ID NO: 2083309 - RNA, 20 nt, Staphylococcus aureus subsp. aureus MW2
cuagcuuucuuuuucaucuu

SEQ ID NO: 2083310 - RNA, 22 nt, Staphylococcus aureus subsp. aureus MW2
cuacuuugaagggagcauuuca

SEQ ID NO: 2083311 - RNA, 20 nt, Staphylococcus aureus subsp. aureus MW2
cuagagcuaauucagcauau

SEQ ID NO: 2083312 - RNA, 19 nt, Staphylococcus aureus subsp. aureus MW2
cuaaauuauuuauucauua

SEQ ID NO: 2083313 - RNA, 23 nt, Staphylococcus aureus subsp. aureus MW2
cuaacauaccuaauaacgcauau

SEQ ID NO: 2083314 - RNA, 22 nt, Staphylococcus aureus subsp. aureus MW2
cuaaagggacaggcguaucugu

SEQ ID NO: 2083315 - RNA, 15 nt, Staphylococcus aureus subsp. aureus MW2
cuaaaguauuaucua

SEQ ID NO: 2083316 - RNA, 23 nt, Staphylococcus aureus subsp. aureus MW2
cuaaauaguagacgguaucaucu

SEQ ID NO: 2083317 - RNA, 22 nt, Staphylococcus aureus subsp. aureus MW2
cuaaauaguuuuucauauucac

SEQ ID NO: 2083318 - RNA, 20 nt, Staphylococcus aureus subsp. aureus MW2
cuaaagauuucaguucauca

SEQ ID NO: 2083319 - RNA, 23 nt, Staphylococcus aureus subsp. aureus MW2
cguuuugcuaaccaucauaaaug

SEQ ID NO: 2083320 - RNA, 20 nt, Staphylococcus aureus subsp. aureus MW2
cguuucgucagauucaaacg

SEQ ID NO: 2083321 - RNA, 15 nt, Staphylococcus aureus subsp. aureus MW2
cgguucauaaugauc

SEQ ID NO: 2083322 - RNA, 19 nt, Staphylococcus aureus subsp. aureus MW2
cgucaucaaaacguuugaa

SEQ ID NO: 2083323 - RNA, 21 nt, Staphylococcus aureus subsp. aureus MW2
cgucccauaauagcuagguuu

SEQ ID NO: 2083324 - RNA, 12 nt, Staphylococcus aureus subsp. aureus MW2
cuugauggcaac

SEQ ID NO: 2083325 - RNA, 22 nt, Staphylococcus aureus subsp. aureus MW2
cuuguaaaucacgauuuucaag

SEQ ID NO: 2083326 - RNA, 21 nt, Staphylococcus aureus subsp. aureus MW2
cuuccuccgccaucaauauuu

SEQ ID NO: 2083327 - RNA, 17 nt, Staphylococcus aureus subsp. aureus MW2
cuugaacagauucaccu

SEQ ID NO: 2083328 - RNA, 13 nt, Staphylococcus aureus subsp. aureus MW2
cuucuucaggauc

SEQ ID NO: 2083329 - RNA, 14 nt, Staphylococcus aureus subsp. aureus MW2
cugaaauguagaca

SEQ ID NO: 2083330 - RNA, 21 nt, Staphylococcus aureus subsp. aureus MW2
gaccgugguucaaaaaucaua

SEQ ID NO: 2083331 - RNA, 15 nt, Staphylococcus aureus subsp. aureus MW2
aacgggaacaucaua

SEQ ID NO: 2083332 - RNA, 17 nt, Staphylococcus aureus subsp. aureus MW2
gaccacggucuugauau

SEQ ID NO: 2083333 - RNA, 13 nt, Staphylococcus aureus subsp. aureus MW2
aacgagauuacac

SEQ ID NO: 2083334 - RNA, 21 nt, Staphylococcus aureus subsp. aureus MW2
gacauuuuaucugaaaauauc

SEQ ID NO: 2083335 - RNA, 15 nt, Staphylococcus aureus subsp. aureus MW2
gaccaacagcuucaa

SEQ ID NO: 2083336 - RNA, 15 nt, Staphylococcus aureus subsp. aureus MW2
gaccaacuugcacau

SEQ ID NO: 2083337 - RNA, 17 nt, Staphylococcus aureus subsp. aureus MW2
gacauuccaaaaccgaa

SEQ ID NO: 2083338 - RNA, 20 nt, Staphylococcus aureus subsp. aureus MW2
gacauuaaaaaaucgaacua

SEQ ID NO: 2083339 - RNA, 19 nt, Staphylococcus aureus subsp. aureus MW2
gacauuacaucuuuaagcu

SEQ ID NO: 2083340 - RNA, 19 nt, Staphylococcus aureus subsp. aureus MW2
gaagauuagaugauauuua

SEQ ID NO: 2083341 - RNA, 16 nt, Staphylococcus aureus subsp. aureus MW2
gaaguagauugauauc

SEQ ID NO: 2083342 - RNA, 14 nt, Staphylococcus aureus subsp. aureus MW2
gaaugaaguaggcu

SEQ ID NO: 2083343 - RNA, 19 nt, Staphylococcus aureus subsp. aureus MW2
gaagucuuucaacaaaaug

SEQ ID NO: 2083344 - RNA, 15 nt, Staphylococcus aureus subsp. aureus MW2
gaagaauauaaacua

SEQ ID NO: 2083345 - RNA, 14 nt, Staphylococcus aureus subsp. aureus MW2
gaagaaaucaucga

SEQ ID NO: 2083346 - RNA, 16 nt, Staphylococcus aureus subsp. aureus MW2
gaacauaccugcauau

SEQ ID NO: 2083347 - RNA, 22 nt, Staphylococcus aureus subsp. aureus MW2
cuuguuucgucagauucaaacg

SEQ ID NO: 2083348 - RNA, 21 nt, Staphylococcus aureus subsp. aureus MW2
cuuguucuccgaucaugccuu

SEQ ID NO: 2083349 - RNA, 16 nt, Staphylococcus aureus subsp. aureus MW2
gcauuuaaacaaagcu

SEQ ID NO: 2083350 - RNA, 15 nt, Staphylococcus aureus subsp. aureus MW2
gcauuacuacaaacu

SEQ ID NO: 2083351 - RNA, 15 nt, Staphylococcus aureus subsp. aureus MW2
gcaugaaucgcauuu

SEQ ID NO: 2083352 - RNA, 19 nt, Staphylococcus aureus subsp. aureus MW2
gcauaaccaaguaauucuu

SEQ ID NO: 2083353 - RNA, 19 nt, Staphylococcus aureus subsp. aureus MW2
gcaucacaguguugaauuu

SEQ ID NO: 2083354 - RNA, 16 nt, Staphylococcus aureus subsp. aureus MW2
gcauauucuaucguug

SEQ ID NO: 2083355 - RNA, 15 nt, Staphylococcus aureus subsp. aureus MW2
gcaucauugaauguu

SEQ ID NO: 2083356 - RNA, 13 nt, Staphylococcus aureus subsp. aureus MW2
gccauaaucuuca

SEQ ID NO: 2083357 - RNA, 12 nt, Staphylococcus aureus subsp. aureus MW2
gccaucaauauu

SEQ ID NO: 2083358 - RNA, 16 nt, Staphylococcus aureus subsp. aureus MW2
gcccucauaaaucaug

SEQ ID NO: 2083359 - RNA, 23 nt, Staphylococcus aureus subsp. aureus MW2
aagaguacagcgguuuguaugau

SEQ ID NO: 2083360 - RNA, 13 nt, Staphylococcus aureus subsp. aureus MW2
gagauuuaacaau

SEQ ID NO: 2083361 - RNA, 21 nt, Staphylococcus aureus subsp. aureus MW2
gagaugaucagggaaaucauc

SEQ ID NO: 2083362 - RNA, 23 nt, Staphylococcus aureus subsp. aureus MW2
gagaugaucagggaaaucaucug

SEQ ID NO: 2083363 - RNA, 23 nt, Staphylococcus aureus subsp. aureus MW2
gagaagcuugcgauaaguucagc

SEQ ID NO: 2083364 - RNA, 19 nt, Staphylococcus aureus subsp. aureus MW2
gacugaaugagaaugcgcu

SEQ ID NO: 2083365 - RNA, 20 nt, Staphylococcus aureus subsp. aureus MW2
gacugaacgaaaaugcacuu

SEQ ID NO: 2083366 - RNA, 14 nt, Staphylococcus aureus subsp. aureus MW2
aacguucacuuggu

SEQ ID NO: 2083367 - RNA, 13 nt, Staphylococcus aureus subsp. aureus MW2
aacuacaauucau

SEQ ID NO: 2083368 - RNA, 18 nt, Staphylococcus aureus subsp. aureus MW2
aacucaaaaagccaacac

SEQ ID NO: 2083369 - RNA, 13 nt, Staphylococcus aureus subsp. aureus MW2
gauaaauaaugca

SEQ ID NO: 2083370 - RNA, 21 nt, Staphylococcus aureus subsp. aureus MW2
gaucguucuuugauuagcaua

SEQ ID NO: 2083371 - RNA, 20 nt, Staphylococcus aureus subsp. aureus MW2
gaucauuuucauuuaacccu

SEQ ID NO: 2083372 - RNA, 20 nt, Staphylococcus aureus subsp. aureus MW2
gaucgcccauacuaaauaag

SEQ ID NO: 2083373 - RNA, 15 nt, Staphylococcus aureus subsp. aureus MW2
gauuaucuaacucau

SEQ ID NO: 2083374 - RNA, 14 nt, Staphylococcus aureus subsp. aureus MW2
gauucccaaauagu

SEQ ID NO: 2083375 - RNA, 23 nt, Staphylococcus aureus subsp. aureus MW2
gauugucaauuuaaagucuucau

SEQ ID NO: 2083376 - RNA, 23 nt, Staphylococcus aureus subsp. aureus MW2
gcaaugucaucuugacacaauga

SEQ ID NO: 2083377 - RNA, 16 nt, Staphylococcus aureus subsp. aureus MW2
gcaauaucaucauuua

SEQ ID NO: 2083378 - RNA, 22 nt, Staphylococcus aureus subsp. aureus MW2
gcaagccaucaauauugauauc

SEQ ID NO: 2083379 - RNA, 18 nt, Staphylococcus aureus subsp. aureus MW2
aagggaauggauuacagc

SEQ ID NO: 2083380 - RNA, 16 nt, Staphylococcus aureus subsp. aureus MW2
ggaacaugauucauga

SEQ ID NO: 2083381 - RNA, 21 nt, Staphylococcus aureus subsp. aureus MW2
aaguaaacgagacaucaucua

SEQ ID NO: 2083382 - RNA, 23 nt, Staphylococcus aureus subsp. aureus MW2
gggagccaauuucuacagacaau

SEQ ID NO: 2083383 - RNA, 15 nt, Staphylococcus aureus subsp. aureus MW2
ggucaauuuuaccau

SEQ ID NO: 2083384 - RNA, 15 nt, Staphylococcus aureus subsp. aureus MW2
aaguaauaauggcaa

SEQ ID NO: 2083385 - RNA, 22 nt, Staphylococcus aureus subsp. aureus MW2
ggucuucgcaaucauuagcgaa

SEQ ID NO: 2083386 - RNA, 13 nt, Staphylococcus aureus subsp. aureus MW2
guauauacgauug

SEQ ID NO: 2083387 - RNA, 17 nt, Staphylococcus aureus subsp. aureus MW2
aaguaugagagauagaa

SEQ ID NO: 2083388 - RNA, 15 nt, Staphylococcus aureus subsp. aureus MW2
aaguauguugucaua

SEQ ID NO: 2083389 - RNA, 14 nt, Staphylococcus aureus subsp. aureus MW2
guacaaaauaauga

SEQ ID NO: 2083390 - RNA, 13 nt, Staphylococcus aureus subsp. aureus MW2
guaccaauugauu

SEQ ID NO: 2083391 - RNA, 16 nt, Staphylococcus aureus subsp. aureus MW2
guaaaauauacuugaa

SEQ ID NO: 2083392 - RNA, 20 nt, Staphylococcus aureus subsp. aureus MW2
guaagcuuagaaacgaaauu

SEQ ID NO: 2083393 - RNA, 23 nt, Staphylococcus aureus subsp. aureus MW2
guaacuaacauguuauugcuuau

SEQ ID NO: 2083394 - RNA, 18 nt, Staphylococcus aureus subsp. aureus MW2
guauucauacgcuauugc

SEQ ID NO: 2083395 - RNA, 20 nt, Staphylococcus aureus subsp. aureus MW2
guauuauuaguuuugaaguu

SEQ ID NO: 2083396 - RNA, 13 nt, Staphylococcus aureus subsp. aureus MW2
guauggauguauu

SEQ ID NO: 2083397 - RNA, 14 nt, Staphylococcus aureus subsp. aureus MW2
gucaaguaaauguu

SEQ ID NO: 2083398 - RNA, 16 nt, Staphylococcus aureus subsp. aureus MW2
gucaacuuuuuuaacu

SEQ ID NO: 2083399 - RNA, 21 nt, Staphylococcus aureus subsp. aureus MW2
gcuaauuuuuucaucauucaa

SEQ ID NO: 2083400 - RNA, 20 nt, Staphylococcus aureus subsp. aureus MW2
aagcuuguuacaagcgcauu

SEQ ID NO: 2083401 - RNA, 13 nt, Staphylococcus aureus subsp. aureus MW2
aagcuuaagugcc

SEQ ID NO: 2083402 - RNA, 15 nt, Staphylococcus aureus subsp. aureus MW2
gcugcaucaauauga

SEQ ID NO: 2083403 - RNA, 19 nt, Staphylococcus aureus subsp. aureus MW2
gcgcuguuccaaauucauu

SEQ ID NO: 2083404 - RNA, 17 nt, Staphylococcus aureus subsp. aureus MW2
aagccugauguaccacu

SEQ ID NO: 2083405 - RNA, 17 nt, Staphylococcus aureus subsp. aureus MW2
aagcugucuuacugcug

SEQ ID NO: 2083406 - RNA, 13 nt, Staphylococcus aureus subsp. aureus MW2
aagcuagcuacaa

SEQ ID NO: 2083407 - RNA, 17 nt, Staphylococcus aureus subsp. aureus MW2
aagcucuuaaucuauaa

SEQ ID NO: 2083408 - RNA, 16 nt, Staphylococcus aureus subsp. aureus MW2
aagcauaucuuuauca

SEQ ID NO: 2083409 - RNA, 21 nt, Staphylococcus aureus subsp. aureus MW2
gcgccuuguucaauucagcaa

SEQ ID NO: 2083410 - RNA, 17 nt, Staphylococcus aureus subsp. aureus MW2
aacagauacuucaguac

SEQ ID NO: 2083411 - RNA, 23 nt, Staphylococcus aureus subsp. aureus MW2
cgccucaaauggagcaacgauac

SEQ ID NO: 2083412 - RNA, 17 nt, Staphylococcus aureus subsp. aureus MW2
aacacuucguauugaau

SEQ ID NO: 2083413 - RNA, 23 nt, Staphylococcus aureus subsp. aureus MW2
aacagaauuauuugauuauguaa

SEQ ID NO: 2083414 - RNA, 20 nt, Staphylococcus aureus subsp. aureus MW2
aacagcacauuuuuaguuag

SEQ ID NO: 2083415 - RNA, 19 nt, Staphylococcus aureus subsp. aureus MW2
cgcucaugaguuucucauc

SEQ ID NO: 2083416 - RNA, 17 nt, Staphylococcus aureus subsp. aureus MW2
cggauuaucuaacucau

SEQ ID NO: 2083417 - RNA, 19 nt, Staphylococcus aureus subsp. aureus MW2
aacagucuuuggauaugcg

SEQ ID NO: 2083418 - RNA, 16 nt, Staphylococcus aureus subsp. aureus MW2
cgggcuauauuugaua

SEQ ID NO: 2083419 - RNA, 16 nt, Staphylococcus aureus subsp. aureus MW2
aacauuagcaugauaa

SEQ ID NO: 2083420 - RNA, 19 nt, Staphylococcus aureus subsp. aureus MW2
aacaagguacacuagucuu

SEQ ID NO: 2083421 - RNA, 14 nt, Staphylococcus aureus subsp. aureus MW2
aacaauaucaucua

SEQ ID NO: 2083422 - RNA, 15 nt, Staphylococcus aureus subsp. aureus MW2
aacaaucagauaagu

SEQ ID NO: 2083423 - RNA, 18 nt, Staphylococcus aureus subsp. aureus MW2
aacaaugcgaagaaauca

SEQ ID NO: 2083424 - RNA, 18 nt, Staphylococcus aureus subsp. aureus MW2
cgacaucgccaauuugau

SEQ ID NO: 2083425 - RNA, 19 nt, Staphylococcus aureus subsp. aureus MW2
ccuuaaauauaguugccau

SEQ ID NO: 2083426 - RNA, 14 nt, Staphylococcus aureus subsp. aureus MW2
ccuucgcauacuuu

SEQ ID NO: 2083427 - RNA, 15 nt, Staphylococcus aureus subsp. aureus MW2
ccuuugguucaauca

SEQ ID NO: 2083428 - RNA, 16 nt, Staphylococcus aureus subsp. aureus MW2
ccuuuaugugcaucau

SEQ ID NO: 2083429 - RNA, 16 nt, Staphylococcus aureus subsp. aureus MW2
cgaacaugaaugauau

SEQ ID NO: 2083430 - RNA, 18 nt, Staphylococcus aureus subsp. aureus MW2
cgaugacuuugucuuuaa

SEQ ID NO: 2083431 - RNA, 15 nt, Staphylococcus aureus subsp. aureus MW2
cgauaauagauaaug

SEQ ID NO: 2083432 - RNA, 17 nt, Staphylococcus aureus subsp. aureus MW2
cgauaacuacacuuaau

SEQ ID NO: 2083433 - RNA, 18 nt, Staphylococcus aureus subsp. aureus MW2
cgagcuuugcucauagau

SEQ ID NO: 2083434 - RNA, 18 nt, Staphylococcus aureus subsp. aureus MW2
cgcacaucuaagugauau

SEQ ID NO: 2083435 - RNA, 20 nt, Staphylococcus aureus subsp. aureus MW2
cgcaaugccacaucauagca

SEQ ID NO: 2083436 - RNA, 18 nt, Staphylococcus aureus subsp. aureus MW2
cgcauacagaucucaauc

SEQ ID NO: 2083437 - RNA, 20 nt, Staphylococcus aureus subsp. aureus MW2
ccuaaaaauaaaaucaacuu

SEQ ID NO: 2083438 - RNA, 19 nt, Staphylococcus aureus subsp. aureus MW2
ccuaccauuacugcagcau

SEQ ID NO: 2083439 - RNA, 13 nt, Staphylococcus aureus subsp. aureus MW2
ccuaaugcgacau

SEQ ID NO: 2083440 - RNA, 21 nt, Staphylococcus aureus subsp. aureus MW2
ccuaauguaauuauugcauca

SEQ ID NO: 2083441 - RNA, 14 nt, Staphylococcus aureus subsp. aureus MW2
ccuaaagacuuuau

SEQ ID NO: 2083442 - RNA, 19 nt, Staphylococcus aureus subsp. aureus MW2
ccguuaacguguuguuaac

SEQ ID NO: 2083443 - RNA, 13 nt, Staphylococcus aureus subsp. aureus MW2
aacaaaaauugcu

SEQ ID NO: 2083444 - RNA, 18 nt, Staphylococcus aureus subsp. aureus MW2
aaauuugugauuaugcau

SEQ ID NO: 2083445 - RNA, 15 nt, Staphylococcus aureus subsp. aureus MW2
aaauugaaauuaucc

SEQ ID NO: 2083446 - RNA, 19 nt, Staphylococcus aureus subsp. aureus MW2
aaauugcaauggcaaccuu

SEQ ID NO: 2083447 - RNA, 13 nt, Staphylococcus aureus subsp. aureus MW2
aaauuaaucacau

SEQ ID NO: 2083448 - RNA, 13 nt, Staphylococcus aureus subsp. aureus MW2
aaauuacuugaau

SEQ ID NO: 2083449 - RNA, 13 nt, Staphylococcus aureus subsp. aureus MW2
aaauguuaacgau

SEQ ID NO: 2083450 - RNA, 15 nt, Staphylococcus aureus subsp. aureus MW2
cacuuagcaaucucu

SEQ ID NO: 2083451 - RNA, 20 nt, Staphylococcus aureus subsp. aureus MW2
cagaccaacgcuuaauggcg

SEQ ID NO: 2083452 - RNA, 20 nt, Staphylococcus aureus subsp. aureus MW2
cacgcgguaaaacgaaguca

SEQ ID NO: 2083453 - RNA, 19 nt, Staphylococcus aureus subsp. aureus MW2
cacgcggugggcgaaauca

SEQ ID NO: 2083454 - RNA, 16 nt, Staphylococcus aureus subsp. aureus MW2
cacgcguccgaaguca

SEQ ID NO: 2083455 - RNA, 13 nt, Staphylococcus aureus subsp. aureus MW2
aaagaaaucucua

SEQ ID NO: 2083456 - RNA, 16 nt, Staphylococcus aureus subsp. aureus MW2
aaacuuagugucacau

SEQ ID NO: 2083457 - RNA, 18 nt, Staphylococcus aureus subsp. aureus MW2
aaacuuagugucacauua

SEQ ID NO: 2083458 - RNA, 16 nt, Staphylococcus aureus subsp. aureus MW2
aaacuucuaucacacg

SEQ ID NO: 2083459 - RNA, 13 nt, Staphylococcus aureus subsp. aureus MW2
aaacuucuuguuu

SEQ ID NO: 2083460 - RNA, 20 nt, Staphylococcus aureus subsp. aureus MW2
cacguaauugaguuguugca

SEQ ID NO: 2083461 - RNA, 22 nt, Staphylococcus aureus subsp. aureus MW2
cagcuuguccauaguaaucgau

SEQ ID NO: 2083462 - RNA, 22 nt, Staphylococcus aureus subsp. aureus MW2
caucauuuuucguuguucauaa

SEQ ID NO: 2083463 - RNA, 15 nt, Staphylococcus aureus subsp. aureus MW2
caucauguuuaucua

SEQ ID NO: 2083464 - RNA, 16 nt, Staphylococcus aureus subsp. aureus MW2
caucaugaaauuagau

SEQ ID NO: 2083465 - RNA, 20 nt, Staphylococcus aureus subsp. aureus MW2
cauaauacacauugcaacgu

SEQ ID NO: 2083466 - RNA, 23 nt, Staphylococcus aureus subsp. aureus MW2
cauaaauaagcguaaaaucaugu

SEQ ID NO: 2083467 - RNA, 16 nt, Staphylococcus aureus subsp. aureus MW2
cauaaaaugaguugaa

SEQ ID NO: 2083468 - RNA, 18 nt, Staphylococcus aureus subsp. aureus MW2
cauaaaauaccagaugaa

SEQ ID NO: 2083469 - RNA, 12 nt, Staphylococcus aureus subsp. aureus MW2
cauaaucaacau

SEQ ID NO: 2083470 - RNA, 14 nt, Staphylococcus aureus subsp. aureus MW2
cauaguaaucgauu

SEQ ID NO: 2083471 - RNA, 20 nt, Staphylococcus aureus subsp. aureus MW2
cauaguauacauaauucaau

SEQ ID NO: 2083472 - RNA, 13 nt, Staphylococcus aureus subsp. aureus MW2
cauaucuuucaau

SEQ ID NO: 2083473 - RNA, 18 nt, Staphylococcus aureus subsp. aureus MW2
cauaucuauaucgucgau

SEQ ID NO: 2083474 - RNA, 19 nt, Staphylococcus aureus subsp. aureus MW2
cauaucucaagauauccau

SEQ ID NO: 2083475 - RNA, 17 nt, Staphylococcus aureus subsp. aureus MW2
cauaucauagaaucgua

SEQ ID NO: 2083476 - RNA, 18 nt, Staphylococcus aureus subsp. aureus MW2
cauauaguuguaucaaau

SEQ ID NO: 2083477 - RNA, 15 nt, Staphylococcus aureus subsp. aureus MW2
cauauaauaugugca

SEQ ID NO: 2083478 - RNA, 21 nt, Staphylococcus aureus subsp. aureus MW2
cauauaauuuuaauauuaugu

SEQ ID NO: 2083479 - RNA, 21 nt, Staphylococcus aureus subsp. aureus MW2
cauauacauaccacacuuuaa

SEQ ID NO: 2083480 - RNA, 14 nt, Staphylococcus aureus subsp. aureus MW2
caucaaauucucau

SEQ ID NO: 2083481 - RNA, 20 nt, Staphylococcus aureus subsp. aureus MW2
caguaauauguugcuuauca

SEQ ID NO: 2083482 - RNA, 15 nt, Staphylococcus aureus subsp. aureus MW2
caguacaaauaacaa

SEQ ID NO: 2083483 - RNA, 21 nt, Staphylococcus aureus subsp. aureus MW2
caguaauugugacgaccgugu

SEQ ID NO: 2083484 - RNA, 19 nt, Staphylococcus aureus subsp. aureus MW2
cauguuauauuaugaacau

SEQ ID NO: 2083485 - RNA, 13 nt, Staphylococcus aureus subsp. aureus MW2
cauuaagaugauu

SEQ ID NO: 2083486 - RNA, 14 nt, Staphylococcus aureus subsp. aureus MW2
cauuaaaaugauau

SEQ ID NO: 2083487 - RNA, 23 nt, Staphylococcus aureus subsp. aureus MW2
cauguuggcauaaccuguuuuua

SEQ ID NO: 2083488 - RNA, 18 nt, Staphylococcus aureus subsp. aureus MW2
cauuacauauaucaacau

SEQ ID NO: 2083489 - RNA, 14 nt, Staphylococcus aureus subsp. aureus MW2
cauuaaguucauca

SEQ ID NO: 2083490 - RNA, 14 nt, Staphylococcus aureus subsp. aureus MW2
cauuaaucguauuu

SEQ ID NO: 2083491 - RNA, 20 nt, Staphylococcus aureus subsp. aureus MW2
cauuagaacuaagaugugca

SEQ ID NO: 2083492 - RNA, 21 nt, Staphylococcus aureus subsp. aureus MW2
cauuaggucuacgaucaaaau

SEQ ID NO: 2083493 - RNA, 12 nt, Staphylococcus aureus subsp. aureus MW2
cauuagcuucua

SEQ ID NO: 2083494 - RNA, 18 nt, Staphylococcus aureus subsp. aureus MW2
cauuaucaccuucaaacu

SEQ ID NO: 2083495 - RNA, 13 nt, Staphylococcus aureus subsp. aureus MW2
cauuauuugauaa

SEQ ID NO: 2083496 - RNA, 20 nt, Staphylococcus aureus subsp. aureus MW2
cauuauuguuguaucaucau

SEQ ID NO: 2083497 - RNA, 13 nt, Staphylococcus aureus subsp. aureus MW2
cauuauugccuaa

SEQ ID NO: 2083498 - RNA, 17 nt, Staphylococcus aureus subsp. aureus MW2
cauugauaagucuugau

SEQ ID NO: 2083499 - RNA, 19 nt, Staphylococcus aureus subsp. aureus MW2
cauucuucauuacaguauu

SEQ ID NO: 2083500 - RNA, 11 nt, Staphylococcus aureus subsp. aureus MW2
cauugaaugau

SEQ ID NO: 2083501 - RNA, 13 nt, Staphylococcus aureus subsp. aureus MW2
caugccuucauga

SEQ ID NO: 2083502 - RNA, 16 nt, Staphylococcus aureus subsp. aureus MW2
caugcucauuugauaa

SEQ ID NO: 2083503 - RNA, 14 nt, Staphylococcus aureus subsp. aureus MW2
cauugucaugccuu

SEQ ID NO: 2083504 - RNA, 15 nt, Staphylococcus aureus subsp. aureus MW2
cauuuaacguaucau

SEQ ID NO: 2083505 - RNA, 22 nt, Staphylococcus aureus subsp. aureus MW2
cauuuaacucaccuuuaucauu

SEQ ID NO: 2083506 - RNA, 16 nt, Staphylococcus aureus subsp. aureus MW2
cauuuagauuucauaa

SEQ ID NO: 2083507 - RNA, 20 nt, Staphylococcus aureus subsp. aureus MW2
cauuuauguguuggcuuuua

SEQ ID NO: 2083508 - RNA, 15 nt, Staphylococcus aureus subsp. aureus MW2
cauuuucaauacuug

SEQ ID NO: 2083509 - RNA, 16 nt, Staphylococcus aureus subsp. aureus MW2
cauuuggcguaaugau

SEQ ID NO: 2083510 - RNA, 23 nt, Staphylococcus aureus subsp. aureus MW2
cauuuuuuauuuuacuuacuuuu

SEQ ID NO: 2083511 - RNA, 19 nt, Staphylococcus aureus subsp. aureus MW2
ccaaauuggaaaucaacuu

SEQ ID NO: 2083512 - RNA, 19 nt, Staphylococcus aureus subsp. aureus MW2
ccaacugucgguucaucua

SEQ ID NO: 2083513 - RNA, 18 nt, Staphylococcus aureus subsp. aureus MW2
ccaauacagaacuuuaau

SEQ ID NO: 2083514 - RNA, 22 nt, Staphylococcus aureus subsp. aureus MW2
ccaauuguuucagcuuguccau

SEQ ID NO: 2083515 - RNA, 15 nt, Staphylococcus aureus subsp. aureus MW2
aaauaaucccuucaa

SEQ ID NO: 2083516 - RNA, 16 nt, Staphylococcus aureus subsp. aureus MW2
aaauaaaaauauugcg

SEQ ID NO: 2083517 - RNA, 17 nt, Staphylococcus aureus subsp. aureus MW2
aaaguuuggucaccuac

SEQ ID NO: 2083518 - RNA, 22 nt, Staphylococcus aureus subsp. aureus MW2
aaauaaacgauugauuaucaua

SEQ ID NO: 2083519 - RNA, 17 nt, Staphylococcus aureus subsp. aureus MW2
aaauaacaaacauuaau

SEQ ID NO: 2083520 - RNA, 12 nt, Staphylococcus aureus subsp. aureus MW2
aaauauuccuua

SEQ ID NO: 2083521 - RNA, 16 nt, Staphylococcus aureus subsp. aureus MW2
aaaucacgcuaacauu

SEQ ID NO: 2083522 - RNA, 22 nt, Staphylococcus aureus subsp. aureus MW2
aaauaguagacgguaucaucug

SEQ ID NO: 2083523 - RNA, 13 nt, Staphylococcus aureus subsp. aureus MW2
aaauaguuaagau

SEQ ID NO: 2083524 - RNA, 19 nt, Staphylococcus aureus subsp. aureus MW2
aaauacuugaauguaagaa

SEQ ID NO: 2083525 - RNA, 14 nt, Staphylococcus aureus subsp. aureus MW2
ccauaacugaauaa

SEQ ID NO: 2083526 - RNA, 20 nt, Staphylococcus aureus subsp. aureus MW2
ccauaaacguguacuucaau

SEQ ID NO: 2083527 - RNA, 15 nt, Staphylococcus aureus subsp. aureus MW2
ccaugcuuccauaau

SEQ ID NO: 2083528 - RNA, 15 nt, Staphylococcus aureus subsp. aureus MW2
caacuaauaacucag

SEQ ID NO: 2083529 - RNA, 22 nt, Staphylococcus aureus subsp. aureus MW2
caacuacugucaauauaacauu

SEQ ID NO: 2083530 - RNA, 18 nt, Staphylococcus aureus subsp. aureus MW2
caacguauaagugauauc

SEQ ID NO: 2083531 - RNA, 13 nt, Staphylococcus aureus subsp. aureus MW2
caauuauuucauc

SEQ ID NO: 2083532 - RNA, 19 nt, Staphylococcus aureus subsp. aureus MW2
caauuaacuugauaucauc

SEQ ID NO: 2083533 - RNA, 20 nt, Staphylococcus aureus subsp. aureus MW2
caauuaaguacuucaaagca

SEQ ID NO: 2083534 - RNA, 18 nt, Staphylococcus aureus subsp. aureus MW2
caauuaauguaaugauac

SEQ ID NO: 2083535 - RNA, 17 nt, Staphylococcus aureus subsp. aureus MW2
caauuaauuacuguaaa

SEQ ID NO: 2083536 - RNA, 19 nt, Staphylococcus aureus subsp. aureus MW2
caaugcuuccaucacauca

SEQ ID NO: 2083537 - RNA, 17 nt, Staphylococcus aureus subsp. aureus MW2
caaugccacaucauagc

SEQ ID NO: 2083538 - RNA, 17 nt, Staphylococcus aureus subsp. aureus MW2
caaucguaacuaacaug

SEQ ID NO: 2083539 - RNA, 14 nt, Staphylococcus aureus subsp. aureus MW2
caaugauaccuuua

SEQ ID NO: 2083540 - RNA, 21 nt, Staphylococcus aureus subsp. aureus MW2
caaugauguuacaaucgccau

SEQ ID NO: 2083541 - RNA, 19 nt, Staphylococcus aureus subsp. aureus MW2
caauaucacuuaaacgcuu

SEQ ID NO: 2083542 - RNA, 20 nt, Staphylococcus aureus subsp. aureus MW2
caauauagaaaaugaguaca

SEQ ID NO: 2083543 - RNA, 14 nt, Staphylococcus aureus subsp. aureus MW2
caauagguucauua

SEQ ID NO: 2083544 - RNA, 11 nt, Staphylococcus aureus subsp. aureus MW2
caaguaaugau

SEQ ID NO: 2083545 - RNA, 21 nt, Staphylococcus aureus subsp. aureus MW2
caaguaauucuuuaccauuca

SEQ ID NO: 2083546 - RNA, 17 nt, Staphylococcus aureus subsp. aureus MW2
caaucacaauauaacau

SEQ ID NO: 2083547 - RNA, 20 nt, Staphylococcus aureus subsp. aureus MW2
caauauuuucauguccaucu

SEQ ID NO: 2083548 - RNA, 20 nt, Staphylococcus aureus subsp. aureus MW2
caauaugaguuacaugguug

SEQ ID NO: 2083549 - RNA, 15 nt, Staphylococcus aureus subsp. aureus MW2
caaccuaucacgauu

SEQ ID NO: 2083550 - RNA, 13 nt, Staphylococcus aureus subsp. aureus MW2
caacaguauuaau

SEQ ID NO: 2083551 - RNA, 16 nt, Staphylococcus aureus subsp. aureus MW2
caacauagaagcuggc

SEQ ID NO: 2083552 - RNA, 14 nt, Staphylococcus aureus subsp. aureus MW2
caacauaucauaga

SEQ ID NO: 2083553 - RNA, 19 nt, Staphylococcus aureus subsp. aureus MW2
caaauaaaaucauaacgac

SEQ ID NO: 2083554 - RNA, 17 nt, Staphylococcus aureus subsp. aureus MW2
caaaguuuauacuuaau

SEQ ID NO: 2083555 - RNA, 14 nt, Staphylococcus aureus subsp. aureus MW2
caaauaaaacgcuu

SEQ ID NO: 2083556 - RNA, 15 nt, Staphylococcus aureus subsp. aureus MW2
auuuagucauuacaa

SEQ ID NO: 2083557 - RNA, 15 nt, Staphylococcus aureus subsp. aureus MW2
auuuaguaucucauu

SEQ ID NO: 2083558 - RNA, 21 nt, Staphylococcus aureus subsp. aureus MW2
caacaaaagugccagguucaa

SEQ ID NO: 2083559 - RNA, 22 nt, Staphylococcus aureus subsp. aureus MW2
caacaaaagugccagguucaau

SEQ ID NO: 2083560 - RNA, 20 nt, Staphylococcus aureus subsp. aureus MW2
caaaugcguaucgagagauu

SEQ ID NO: 2083561 - RNA, 19 nt, Staphylococcus aureus subsp. aureus MW2
caaaugcuacaucaauauu

SEQ ID NO: 2083562 - RNA, 17 nt, Staphylococcus aureus subsp. aureus MW2
cacauugucuacaaagu

SEQ ID NO: 2083563 - RNA, 18 nt, Staphylococcus aureus subsp. aureus MW2
cacagcuuguucaauacu

SEQ ID NO: 2083564 - RNA, 20 nt, Staphylococcus aureus subsp. aureus MW2
cacaucaugacauuaaucau

SEQ ID NO: 2083565 - RNA, 21 nt, Staphylococcus aureus subsp. aureus MW2
caccaguuugugguaaugauu

SEQ ID NO: 2083566 - RNA, 22 nt, Staphylococcus aureus subsp. aureus MW2
augauauugauuugauucauua

SEQ ID NO: 2083567 - RNA, 20 nt, Staphylococcus aureus subsp. aureus MW2
augacugaauuaauauccaa

SEQ ID NO: 2083568 - RNA, 13 nt, Staphylococcus aureus subsp. aureus MW2
augacuaacgaaa

SEQ ID NO: 2083569 - RNA, 19 nt, Staphylococcus aureus subsp. aureus MW2
augaaucaaaucaauauca

SEQ ID NO: 2083570 - RNA, 22 nt, Staphylococcus aureus subsp. aureus MW2
aucuuuuuuacuaaaaucacuu

SEQ ID NO: 2083571 - RNA, 23 nt, Staphylococcus aureus subsp. aureus MW2
augaauucuauccuaagcauaaa

SEQ ID NO: 2083572 - RNA, 15 nt, Staphylococcus aureus subsp. aureus MW2
aucuguauauccauu

SEQ ID NO: 2083573 - RNA, 12 nt, Staphylococcus aureus subsp. aureus MW2
aucuguaucaaa

SEQ ID NO: 2083574 - RNA, 19 nt, Staphylococcus aureus subsp. aureus MW2
aucuguugcauuaagugca

SEQ ID NO: 2083575 - RNA, 18 nt, Staphylococcus aureus subsp. aureus MW2
aucuguuacagguuuuaa

SEQ ID NO: 2083576 - RNA, 15 nt, Staphylococcus aureus subsp. aureus MW2
aucuucaguuauuug

SEQ ID NO: 2083577 - RNA, 20 nt, Staphylococcus aureus subsp. aureus MW2
aucuucacgcuuauucgaac

SEQ ID NO: 2083578 - RNA, 13 nt, Staphylococcus aureus subsp. aureus MW2
aucgucaucacuu

SEQ ID NO: 2083579 - RNA, 13 nt, Staphylococcus aureus subsp. aureus MW2
aucuaaaauuggu

SEQ ID NO: 2083580 - RNA, 14 nt, Staphylococcus aureus subsp. aureus MW2
aucuauacuuuauc

SEQ ID NO: 2083581 - RNA, 19 nt, Staphylococcus aureus subsp. aureus MW2
aucuaaaguacucaaguaa

SEQ ID NO: 2083582 - RNA, 16 nt, Staphylococcus aureus subsp. aureus MW2
aucgauacuaauaucu

SEQ ID NO: 2083583 - RNA, 21 nt, Staphylococcus aureus subsp. aureus MW2
aucgacuuuuacaaucaucac

SEQ ID NO: 2083584 - RNA, 24 nt, Staphylococcus aureus subsp. aureus MW2
aucgccaugacguauacaaauuga

SEQ ID NO: 2083585 - RNA, 14 nt, Staphylococcus aureus subsp. aureus MW2
auugauaucccuaa

SEQ ID NO: 2083586 - RNA, 19 nt, Staphylococcus aureus subsp. aureus MW2
auugcaaugcuaucaugcc

SEQ ID NO: 2083587 - RNA, 15 nt, Staphylococcus aureus subsp. aureus MW2
auuuaaaaugauucu

SEQ ID NO: 2083588 - RNA, 15 nt, Staphylococcus aureus subsp. aureus MW2
auuuaccuucaucuu

SEQ ID NO: 2083589 - RNA, 19 nt, Staphylococcus aureus subsp. aureus MW2
auuguuagauaaucucauu

SEQ ID NO: 2083590 - RNA, 18 nt, Staphylococcus aureus subsp. aureus MW2
auuguaaaaauacauaau

SEQ ID NO: 2083591 - RNA, 22 nt, Staphylococcus aureus subsp. aureus MW2
auuguaaaugaucaucguauag

SEQ ID NO: 2083592 - RNA, 14 nt, Staphylococcus aureus subsp. aureus MW2
auugguauaacaau

SEQ ID NO: 2083593 - RNA, 13 nt, Staphylococcus aureus subsp. aureus MW2
auugggucuuuau

SEQ ID NO: 2083594 - RNA, 21 nt, Staphylococcus aureus subsp. aureus MW2
auucauguucgaugauuucuu

SEQ ID NO: 2083595 - RNA, 18 nt, Staphylococcus aureus subsp. aureus MW2
auuccuuggugccgaaau

SEQ ID NO: 2083596 - RNA, 23 nt, Staphylococcus aureus subsp. aureus MW2
auucucuaacuuuaccaauauca

SEQ ID NO: 2083597 - RNA, 12 nt, Staphylococcus aureus subsp. aureus MW2
auugacaucuuc

SEQ ID NO: 2083598 - RNA, 18 nt, Staphylococcus aureus subsp. aureus MW2
auugacauucacauuauu

SEQ ID NO: 2083599 - RNA, 23 nt, Staphylococcus aureus subsp. aureus MW2
auugaauuguagauccaauuccu

SEQ ID NO: 2083600 - RNA, 14 nt, Staphylococcus aureus subsp. aureus MW2
auugaguaucaugc

SEQ ID NO: 2083601 - RNA, 15 nt, Staphylococcus aureus subsp. aureus MW2
auucuuggcguauuu

SEQ ID NO: 2083602 - RNA, 18 nt, Staphylococcus aureus subsp. aureus MW2
auucuucaucaugacuau

SEQ ID NO: 2083603 - RNA, 17 nt, Staphylococcus aureus subsp. aureus MW2
auuauagccuauccauu

SEQ ID NO: 2083604 - RNA, 21 nt, Staphylococcus aureus subsp. aureus MW2
auuauaauuguaaugcuucuu

SEQ ID NO: 2083605 - RNA, 14 nt, Staphylococcus aureus subsp. aureus MW2
auuaucauuacaga

SEQ ID NO: 2083606 - RNA, 13 nt, Staphylococcus aureus subsp. aureus MW2
auucaaaaauugu

SEQ ID NO: 2083607 - RNA, 22 nt, Staphylococcus aureus subsp. aureus MW2
auuauuucaucggcuaagccau

SEQ ID NO: 2083608 - RNA, 14 nt, Staphylococcus aureus subsp. aureus MW2
auucaguucaaaca

SEQ ID NO: 2083609 - RNA, 18 nt, Staphylococcus aureus subsp. aureus MW2
auucauaucuuucaauua

SEQ ID NO: 2083610 - RNA, 15 nt, Staphylococcus aureus subsp. aureus MW2
auucacauacauuuu

SEQ ID NO: 2083611 - RNA, 22 nt, Staphylococcus aureus subsp. aureus MW2
auucaauugcuaaaucaucuuc

SEQ ID NO: 2083612 - RNA, 21 nt, Staphylococcus aureus subsp. aureus MW2
auuagcuagcaugagcgcaua

SEQ ID NO: 2083613 - RNA, 13 nt, Staphylococcus aureus subsp. aureus MW2
auuaggcauucau

SEQ ID NO: 2083614 - RNA, 19 nt, Staphylococcus aureus subsp. aureus MW2
auuaagcaugacacucauu

SEQ ID NO: 2083615 - RNA, 22 nt, Staphylococcus aureus subsp. aureus MW2
auuaaauuuuggcgucaucauu

SEQ ID NO: 2083616 - RNA, 12 nt, Staphylococcus aureus subsp. aureus MW2
auuaacaucaug

SEQ ID NO: 2083617 - RNA, 17 nt, Staphylococcus aureus subsp. aureus MW2
auguuacauuugaagca

SEQ ID NO: 2083618 - RNA, 20 nt, Staphylococcus aureus subsp. aureus MW2
auguuccauauaaccuauuu

SEQ ID NO: 2083619 - RNA, 18 nt, Staphylococcus aureus subsp. aureus MW2
augugucacaaugaccau

SEQ ID NO: 2083620 - RNA, 19 nt, Staphylococcus aureus subsp. aureus MW2
augugaugcuugaauguuu

SEQ ID NO: 2083621 - RNA, 12 nt, Staphylococcus aureus subsp. aureus MW2
augugaugauua

SEQ ID NO: 2083622 - RNA, 22 nt, Staphylococcus aureus subsp. aureus MW2
augugaaauaaucccaaccauu

SEQ ID NO: 2083623 - RNA, 14 nt, Staphylococcus aureus subsp. aureus MW2
auguuugcaacaua

SEQ ID NO: 2083624 - RNA, 14 nt, Staphylococcus aureus subsp. aureus MW2
auguuuaaacauuu

SEQ ID NO: 2083625 - RNA, 21 nt, Staphylococcus aureus subsp. aureus MW2
auuaaaggaaaucaauccauc

SEQ ID NO: 2083626 - RNA, 21 nt, Staphylococcus aureus subsp. aureus MW2
auuaaacuuuaugaaaauggu

SEQ ID NO: 2083627 - RNA, 17 nt, Staphylococcus aureus subsp. aureus MW2
auuaaagaaacaugauu

SEQ ID NO: 2083628 - RNA, 17 nt, Staphylococcus aureus subsp. aureus MW2
auuaaaugcaauacauu

SEQ ID NO: 2083629 - RNA, 19 nt, Staphylococcus aureus subsp. aureus MW2
auuaaaaaucggacagaug

SEQ ID NO: 2083630 - RNA, 18 nt, Staphylococcus aureus subsp. aureus MW2
auuaaaauaauuaaacuu

SEQ ID NO: 2083631 - RNA, 22 nt, Staphylococcus aureus subsp. aureus MW2
auguuuucguuugcaaucaucu

SEQ ID NO: 2083632 - RNA, 21 nt, Staphylococcus aureus subsp. aureus MW2
auguuuuagugacaaacauuu

SEQ ID NO: 2083633 - RNA, 19 nt, Staphylococcus aureus subsp. aureus MW2
auguaggcgccauaaucau

SEQ ID NO: 2083634 - RNA, 18 nt, Staphylococcus aureus subsp. aureus MW2
auggugaacuguuaaacu

SEQ ID NO: 2083635 - RNA, 17 nt, Staphylococcus aureus subsp. aureus MW2
auguaaucauuauagca

SEQ ID NO: 2083636 - RNA, 14 nt, Staphylococcus aureus subsp. aureus MW2
auguaaugaaucaa

SEQ ID NO: 2083637 - RNA, 15 nt, Staphylococcus aureus subsp. aureus MW2
auguaccgaauccuu

SEQ ID NO: 2083638 - RNA, 13 nt, Staphylococcus aureus subsp. aureus MW2
auggaaaaguuuu

SEQ ID NO: 2083639 - RNA, 21 nt, Staphylococcus aureus subsp. aureus MW2
augcuuuaugugcagcuugau

SEQ ID NO: 2083640 - RNA, 22 nt, Staphylococcus aureus subsp. aureus MW2
augcuuuuuagcauauucugca

SEQ ID NO: 2083641 - RNA, 22 nt, Staphylococcus aureus subsp. aureus MW2
augcuucuaacugaauuaaagc

SEQ ID NO: 2083642 - RNA, 18 nt, Staphylococcus aureus subsp. aureus MW2
augcuuaaaaacaauauu

SEQ ID NO: 2083643 - RNA, 13 nt, Staphylococcus aureus subsp. aureus MW2
augcgauuacagu

SEQ ID NO: 2083644 - RNA, 14 nt, Staphylococcus aureus subsp. aureus MW2
aguaaaaauacauu

SEQ ID NO: 2083645 - RNA, 15 nt, Staphylococcus aureus subsp. aureus MW2
aguaaaacauuggcg

SEQ ID NO: 2083646 - RNA, 14 nt, Staphylococcus aureus subsp. aureus MW2
aguacuugaaacau

SEQ ID NO: 2083647 - RNA, 21 nt, Staphylococcus aureus subsp. aureus MW2
aguacuucaaagcaucuaauc

SEQ ID NO: 2083648 - RNA, 18 nt, Staphylococcus aureus subsp. aureus MW2
aguacgcuguaauccauu

SEQ ID NO: 2083649 - RNA, 20 nt, Staphylococcus aureus subsp. aureus MW2
aguaagauuauuuucaauua

SEQ ID NO: 2083650 - RNA, 15 nt, Staphylococcus aureus subsp. aureus MW2
aguaagaugauuuca

SEQ ID NO: 2083651 - RNA, 15 nt, Staphylococcus aureus subsp. aureus MW2
aguaacguacugugu

SEQ ID NO: 2083652 - RNA, 12 nt, Staphylococcus aureus subsp. aureus MW2
aguaacuuuguc

SEQ ID NO: 2083653 - RNA, 13 nt, Staphylococcus aureus subsp. aureus MW2
aguuuaaucgcau

SEQ ID NO: 2083654 - RNA, 22 nt, Staphylococcus aureus subsp. aureus MW2
aguugaagccccuggugauuca

SEQ ID NO: 2083655 - RNA, 23 nt, Staphylococcus aureus subsp. aureus MW2
agugcuuaugaaugaaaucagca

SEQ ID NO: 2083656 - RNA, 21 nt, Staphylococcus aureus subsp. aureus MW2
agugaaguuugacgguauaaa

SEQ ID NO: 2083657 - RNA, 21 nt, Staphylococcus aureus subsp. aureus MW2
agucaaugacuuaacaucuuu

SEQ ID NO: 2083658 - RNA, 14 nt, Staphylococcus aureus subsp. aureus MW2
aguaugucaucuuc

SEQ ID NO: 2083659 - RNA, 14 nt, Staphylococcus aureus subsp. aureus MW2
auaacguucacuug

SEQ ID NO: 2083660 - RNA, 21 nt, Staphylococcus aureus subsp. aureus MW2
auaacguucgccaacuaaauc

SEQ ID NO: 2083661 - RNA, 19 nt, Staphylococcus aureus subsp. aureus MW2
auaacuguuuaucaugaug

SEQ ID NO: 2083662 - RNA, 22 nt, Staphylococcus aureus subsp. aureus MW2
auaacuuuuuaaaggaccacuu

SEQ ID NO: 2083663 - RNA, 19 nt, Staphylococcus aureus subsp. aureus MW2
auaaguaaucauaauaauc

SEQ ID NO: 2083664 - RNA, 17 nt, Staphylococcus aureus subsp. aureus MW2
auaaccuguaauugaug

SEQ ID NO: 2083665 - RNA, 21 nt, Staphylococcus aureus subsp. aureus MW2
auaaccauaguaacaaaauga

SEQ ID NO: 2083666 - RNA, 20 nt, Staphylococcus aureus subsp. aureus MW2
auaacaccgcaaugccacau

SEQ ID NO: 2083667 - RNA, 21 nt, Staphylococcus aureus subsp. aureus MW2
auaacauccccuucuugagca

SEQ ID NO: 2083668 - RNA, 23 nt, Staphylococcus aureus subsp. aureus MW2
auaacauugaacgauaacaauuu

SEQ ID NO: 2083669 - RNA, 18 nt, Staphylococcus aureus subsp. aureus MW2
aguuugauagaugauaca

SEQ ID NO: 2083670 - RNA, 21 nt, Staphylococcus aureus subsp. aureus MW2
auaccuacaaauauguaauca

SEQ ID NO: 2083671 - RNA, 20 nt, Staphylococcus aureus subsp. aureus MW2
auacgaauuucauaguuauc

SEQ ID NO: 2083672 - RNA, 16 nt, Staphylococcus aureus subsp. aureus MW2
auacgacaaucacagc

SEQ ID NO: 2083673 - RNA, 16 nt, Staphylococcus aureus subsp. aureus MW2
auaauacaauuuuagc

SEQ ID NO: 2083674 - RNA, 19 nt, Staphylococcus aureus subsp. aureus MW2
auaauuggcugaugaacuu

SEQ ID NO: 2083675 - RNA, 13 nt, Staphylococcus aureus subsp. aureus MW2
auaauuucaguag

SEQ ID NO: 2083676 - RNA, 18 nt, Staphylococcus aureus subsp. aureus MW2
auaauuuuuaacaucauu

SEQ ID NO: 2083677 - RNA, 12 nt, Staphylococcus aureus subsp. aureus MW2
auacauugauaa

SEQ ID NO: 2083678 - RNA, 23 nt, Staphylococcus aureus subsp. aureus MW2
auacaucaucaaguucaccguaa

SEQ ID NO: 2083679 - RNA, 14 nt, Staphylococcus aureus subsp. aureus MW2
auacaucaauaucu

SEQ ID NO: 2083680 - RNA, 22 nt, Staphylococcus aureus subsp. aureus MW2
auacaucggaauucaaccaauu

SEQ ID NO: 2083681 - RNA, 20 nt, Staphylococcus aureus subsp. aureus MW2
auacaaacacccacaauugu

SEQ ID NO: 2083682 - RNA, 22 nt, Staphylococcus aureus subsp. aureus MW2
auacaaaccuaucaucaaucgu

SEQ ID NO: 2083683 - RNA, 17 nt, Staphylococcus aureus subsp. aureus MW2
auaauuuuuugacacgu

SEQ ID NO: 2083684 - RNA, 14 nt, Staphylococcus aureus subsp. aureus MW2
auacaguuguacca

SEQ ID NO: 2083685 - RNA, 21 nt, Staphylococcus aureus subsp. aureus MW2
auacugagucauucaaucauc

SEQ ID NO: 2083686 - RNA, 16 nt, Staphylococcus aureus subsp. aureus MW2
auacucugaaaagccu

SEQ ID NO: 2083687 - RNA, 21 nt, Staphylococcus aureus subsp. aureus MW2
auacucaucuguccgauaucu

SEQ ID NO: 2083688 - RNA, 18 nt, Staphylococcus aureus subsp. aureus MW2
auaugcuauguaaaucgu

SEQ ID NO: 2083689 - RNA, 17 nt, Staphylococcus aureus subsp. aureus MW2
auauacauuuacauauu

SEQ ID NO: 2083690 - RNA, 21 nt, Staphylococcus aureus subsp. aureus MW2
auauacguugauuaacacauu

SEQ ID NO: 2083691 - RNA, 20 nt, Staphylococcus aureus subsp. aureus MW2
auauaacuauggucaucaau

SEQ ID NO: 2083692 - RNA, 20 nt, Staphylococcus aureus subsp. aureus MW2
auauaaccuauuucauugau

SEQ ID NO: 2083693 - RNA, 23 nt, Staphylococcus aureus subsp. aureus MW2
auauaacauguauauggcauuaa

SEQ ID NO: 2083694 - RNA, 13 nt, Staphylococcus aureus subsp. aureus MW2
auauaacguucgc

SEQ ID NO: 2083695 - RNA, 17 nt, Staphylococcus aureus subsp. aureus MW2
auauaaauaaaagccaa

SEQ ID NO: 2083696 - RNA, 16 nt, Staphylococcus aureus subsp. aureus MW2
auauaaauagcuucuu

SEQ ID NO: 2083697 - RNA, 13 nt, Staphylococcus aureus subsp. aureus MW2
auauaaaucauuu

SEQ ID NO: 2083698 - RNA, 20 nt, Staphylococcus aureus subsp. aureus MW2
auauaaacuauuaaaucauu

SEQ ID NO: 2083699 - RNA, 15 nt, Staphylococcus aureus subsp. aureus MW2
auagguauaaucauu

SEQ ID NO: 2083700 - RNA, 14 nt, Staphylococcus aureus subsp. aureus MW2
aucaaauugaccau

SEQ ID NO: 2083701 - RNA, 20 nt, Staphylococcus aureus subsp. aureus MW2
aucaaauuacaaauuaucua

SEQ ID NO: 2083702 - RNA, 23 nt, Staphylococcus aureus subsp. aureus MW2
auauuauauuuugaaucaguaua

SEQ ID NO: 2083703 - RNA, 14 nt, Staphylococcus aureus subsp. aureus MW2
aucaaaguaucagu

SEQ ID NO: 2083704 - RNA, 17 nt, Staphylococcus aureus subsp. aureus MW2
auauguguuucuagcuu

SEQ ID NO: 2083705 - RNA, 13 nt, Staphylococcus aureus subsp. aureus MW2
aucaauuaaacuu

SEQ ID NO: 2083706 - RNA, 14 nt, Staphylococcus aureus subsp. aureus MW2
aucaacuucauaua

SEQ ID NO: 2083707 - RNA, 22 nt, Staphylococcus aureus subsp. aureus MW2
aucaauuucgacuccauuagcu

SEQ ID NO: 2083708 - RNA, 15 nt, Staphylococcus aureus subsp. aureus MW2
aucacucaacugaug

SEQ ID NO: 2083709 - RNA, 19 nt, Staphylococcus aureus subsp. aureus MW2
agcguuccauuaaugcauu

SEQ ID NO: 2083710 - RNA, 14 nt, Staphylococcus aureus subsp. aureus MW2
agcaucgaacaauc

SEQ ID NO: 2083711 - RNA, 14 nt, Staphylococcus aureus subsp. aureus MW2
agcaccagcacauc

SEQ ID NO: 2083712 - RNA, 18 nt, Staphylococcus aureus subsp. aureus MW2
agauuuuguauuagcauc

SEQ ID NO: 2083713 - RNA, 14 nt, Staphylococcus aureus subsp. aureus MW2
agauuuuuucauag

SEQ ID NO: 2083714 - RNA, 15 nt, Staphylococcus aureus subsp. aureus MW2
agcaauucgauauga

SEQ ID NO: 2083715 - RNA, 18 nt, Staphylococcus aureus subsp. aureus MW2
aaaccgagcgaccguggu

SEQ ID NO: 2083716 - RNA, 13 nt, Staphylococcus aureus subsp. aureus MW2
acuguaaaucauc

SEQ ID NO: 2083717 - RNA, 18 nt, Staphylococcus aureus subsp. aureus MW2
acucuaucaaauuacuua

SEQ ID NO: 2083718 - RNA, 19 nt, Staphylococcus aureus subsp. aureus MW2
acucuucuaaguuauuaca

SEQ ID NO: 2083719 - RNA, 19 nt, Staphylococcus aureus subsp. aureus MW2
acuuuagcauauucgcuua

SEQ ID NO: 2083720 - RNA, 19 nt, Staphylococcus aureus subsp. aureus MW2
acuuuauagggcgcacauu

SEQ ID NO: 2083721 - RNA, 20 nt, Staphylococcus aureus subsp. aureus MW2
acuauuuuuuagacuuuauu

SEQ ID NO: 2083722 - RNA, 13 nt, Staphylococcus aureus subsp. aureus MW2
acucccauuggca

SEQ ID NO: 2083723 - RNA, 20 nt, Staphylococcus aureus subsp. aureus MW2
acuccuuacaauaaagacau

SEQ ID NO: 2083724 - RNA, 18 nt, Staphylococcus aureus subsp. aureus MW2
aaaccaguuuaguauuaa

SEQ ID NO: 2083725 - RNA, 14 nt, Staphylococcus aureus subsp. aureus MW2
aaaccaauaauccg

SEQ ID NO: 2083726 - RNA, 19 nt, Staphylococcus aureus subsp. aureus MW2
aaacaucacuugcuguugc

SEQ ID NO: 2083727 - RNA, 17 nt, Staphylococcus aureus subsp. aureus MW2
acgccgaauaauccagu

SEQ ID NO: 2083728 - RNA, 14 nt, Staphylococcus aureus subsp. aureus MW2
accugcuucuguaa

SEQ ID NO: 2083729 - RNA, 16 nt, Staphylococcus aureus subsp. aureus MW2
accuuaauaaugaauu

SEQ ID NO: 2083730 - RNA, 16 nt, Staphylococcus aureus subsp. aureus MW2
acgcauaccacuugaa

SEQ ID NO: 2083731 - RNA, 13 nt, Staphylococcus aureus subsp. aureus MW2
aauuuguaauucc

SEQ ID NO: 2083732 - RNA, 12 nt, Staphylococcus aureus subsp. aureus MW2
aauuuucaucau

SEQ ID NO: 2083733 - RNA, 18 nt, Staphylococcus aureus subsp. aureus MW2
acaaaauacccugcuuua

SEQ ID NO: 2083734 - RNA, 12 nt, Staphylococcus aureus subsp. aureus MW2
acaucaauaucu

SEQ ID NO: 2083735 - RNA, 12 nt, Staphylococcus aureus subsp. aureus MW2
acauacagucaa

SEQ ID NO: 2083736 - RNA, 16 nt, Staphylococcus aureus subsp. aureus MW2
acagugaacaccccuu

SEQ ID NO: 2083737 - RNA, 14 nt, Staphylococcus aureus subsp. aureus MW2
acauauaaaucauu

SEQ ID NO: 2083738 - RNA, 15 nt, Staphylococcus aureus subsp. aureus MW2
acaugauucaugaua

SEQ ID NO: 2083739 - RNA, 20 nt, Staphylococcus aureus subsp. aureus MW2
acaucuucguaugaguucuu

SEQ ID NO: 2083740 - RNA, 13 nt, Staphylococcus aureus subsp. aureus MW2
acauguaaugaau

SEQ ID NO: 2083741 - RNA, 19 nt, Staphylococcus aureus subsp. aureus MW2
acauuaaaaugauaucuga

SEQ ID NO: 2083742 - RNA, 20 nt, Staphylococcus aureus subsp. aureus MW2
acauuaaagaaaauaucuga

SEQ ID NO: 2083743 - RNA, 15 nt, Staphylococcus aureus subsp. aureus MW2
acauuagcauuaaau

SEQ ID NO: 2083744 - RNA, 18 nt, Staphylococcus aureus subsp. aureus MW2
acauuggauuacuuccau

SEQ ID NO: 2083745 - RNA, 16 nt, Staphylococcus aureus subsp. aureus MW2
acauuuaaagauugau

SEQ ID NO: 2083746 - RNA, 18 nt, Staphylococcus aureus subsp. aureus MW2
acauuucugaugcuagcu

SEQ ID NO: 2083747 - RNA, 23 nt, Staphylococcus aureus subsp. aureus MW2
acauuuugauacguaaacacuuu

SEQ ID NO: 2083748 - RNA, 17 nt, Staphylococcus aureus subsp. aureus MW2
accaaaaacagaggucu

SEQ ID NO: 2083749 - RNA, 11 nt, Staphylococcus aureus subsp. aureus MW2
accaaucgaag

SEQ ID NO: 2083750 - RNA, 14 nt, Staphylococcus aureus subsp. aureus MW2
accaaggagaugau

SEQ ID NO: 2083751 - RNA, 13 nt, Staphylococcus aureus subsp. aureus MW2
accaauuagcaug

SEQ ID NO: 2083752 - RNA, 15 nt, Staphylococcus aureus subsp. aureus MW2
accaccauaugcuaa

SEQ ID NO: 2083753 - RNA, 19 nt, Staphylococcus aureus subsp. aureus MW2
accaccugauaaugcaugu

SEQ ID NO: 2083754 - RNA, 20 nt, Staphylococcus aureus subsp. aureus MW2
aaaauguuaucuaguacauc

SEQ ID NO: 2083755 - RNA, 14 nt, Staphylococcus aureus subsp. aureus MW2
acccaaaaaauugu

SEQ ID NO: 2083756 - RNA, 21 nt, Staphylococcus aureus subsp. aureus MW2
aagcuagaaguucuuaugcag

SEQ ID NO: 2083757 - RNA, 15 nt, Staphylococcus aureus subsp. aureus MW2
aagcuaaguauauaa

SEQ ID NO: 2083758 - RNA, 14 nt, Staphylococcus aureus subsp. aureus MW2
aagccuucuauaua

SEQ ID NO: 2083759 - RNA, 16 nt, Staphylococcus aureus subsp. aureus MW2
aagcauuaaguucauc

SEQ ID NO: 2083760 - RNA, 19 nt, Staphylococcus aureus subsp. aureus MW2
aagcaaagaugauacccaa

SEQ ID NO: 2083761 - RNA, 23 nt, Staphylococcus aureus subsp. aureus MW2
aacuaagucacgauauaguguuu

SEQ ID NO: 2083762 - RNA, 22 nt, Staphylococcus aureus subsp. aureus MW2
aacuaauuuaaagcaucauaua

SEQ ID NO: 2083763 - RNA, 20 nt, Staphylococcus aureus subsp. aureus MW2
aacuacuucaucacucgcaa

SEQ ID NO: 2083764 - RNA, 17 nt, Staphylococcus aureus subsp. aureus MW2
aacuagaacaagaauua

SEQ ID NO: 2083765 - RNA, 15 nt, Staphylococcus aureus subsp. aureus MW2
aagcuuuaacuugau

SEQ ID NO: 2083766 - RNA, 13 nt, Staphylococcus aureus subsp. aureus MW2
aagcuuugacaua

SEQ ID NO: 2083767 - RNA, 15 nt, Staphylococcus aureus subsp. aureus MW2
aagcuuaucaacgau

SEQ ID NO: 2083768 - RNA, 23 nt, Staphylococcus aureus subsp. aureus MW2
aaguauuuucuuaguuugacauc

SEQ ID NO: 2083769 - RNA, 18 nt, Staphylococcus aureus subsp. aureus MW2
aaguaugaguuauuaagc

SEQ ID NO: 2083770 - RNA, 15 nt, Staphylococcus aureus subsp. aureus MW2
aauaauuuaacuaau

SEQ ID NO: 2083771 - RNA, 17 nt, Staphylococcus aureus subsp. aureus MW2
aauaauacauucauuaa

SEQ ID NO: 2083772 - RNA, 14 nt, Staphylococcus aureus subsp. aureus MW2
aauacaugauauaa

SEQ ID NO: 2083773 - RNA, 21 nt, Staphylococcus aureus subsp. aureus MW2
aaguuuucauuuaacauguau

SEQ ID NO: 2083774 - RNA, 14 nt, Staphylococcus aureus subsp. aureus MW2
aauaaaaucaucuu

SEQ ID NO: 2083775 - RNA, 16 nt, Staphylococcus aureus subsp. aureus MW2
aauaaacaacugcaau

SEQ ID NO: 2083776 - RNA, 21 nt, Staphylococcus aureus subsp. aureus MW2
aauaaagagguacuagaauua

SEQ ID NO: 2083777 - RNA, 20 nt, Staphylococcus aureus subsp. aureus MW2
aauaagacuucccuauaugu

SEQ ID NO: 2083778 - RNA, 20 nt, Staphylococcus aureus subsp. aureus MW2
aauaaggaagcguaugaugu

SEQ ID NO: 2083779 - RNA, 21 nt, Staphylococcus aureus subsp. aureus MW2
aauaagguauggcuagucuuu

SEQ ID NO: 2083780 - RNA, 20 nt, Staphylococcus aureus subsp. aureus MW2
aauaagugauaaauaaugca

SEQ ID NO: 2083781 - RNA, 14 nt, Staphylococcus aureus subsp. aureus MW2
aaugguuucaaaau

SEQ ID NO: 2083782 - RNA, 14 nt, Staphylococcus aureus subsp. aureus MW2
aauguauucaguca

SEQ ID NO: 2083783 - RNA, 20 nt, Staphylococcus aureus subsp. aureus MW2
aauggcaauuaaaacuauaa

SEQ ID NO: 2083784 - RNA, 17 nt, Staphylococcus aureus subsp. aureus MW2
aaucugaagguaauuua

SEQ ID NO: 2083785 - RNA, 19 nt, Staphylococcus aureus subsp. aureus MW2
aaucuuaggugucaucgcu

SEQ ID NO: 2083786 - RNA, 14 nt, Staphylococcus aureus subsp. aureus MW2
aaugaugcugccau

SEQ ID NO: 2083787 - RNA, 21 nt, Staphylococcus aureus subsp. aureus MW2
aaugaugacaucaauaucuuc

SEQ ID NO: 2083788 - RNA, 13 nt, Staphylococcus aureus subsp. aureus MW2
aaugauaauccac

SEQ ID NO: 2083789 - RNA, 21 nt, Staphylococcus aureus subsp. aureus MW2
aauguuaacugcaaacuugau

SEQ ID NO: 2083790 - RNA, 19 nt, Staphylococcus aureus subsp. aureus MW2
aaugugcgaccuuucauag

SEQ ID NO: 2083791 - RNA, 21 nt, Staphylococcus aureus subsp. aureus MW2
aauuaauuccuggugcaauaa

SEQ ID NO: 2083792 - RNA, 13 nt, Staphylococcus aureus subsp. aureus MW2
aauuaauuaucau

SEQ ID NO: 2083793 - RNA, 14 nt, Staphylococcus aureus subsp. aureus MW2
aauuaauuacuuuc

SEQ ID NO: 2083794 - RNA, 21 nt, Staphylococcus aureus subsp. aureus MW2
aauguuacacaaauuaaaacu

SEQ ID NO: 2083795 - RNA, 17 nt, Staphylococcus aureus subsp. aureus MW2
aauguuaggugcuuggu

SEQ ID NO: 2083796 - RNA, 22 nt, Staphylococcus aureus subsp. aureus MW2
aauuauuucuagcauguaagcu

SEQ ID NO: 2083797 - RNA, 15 nt, Staphylococcus aureus subsp. aureus MW2
aauuaucuuaaguca

SEQ ID NO: 2083798 - RNA, 19 nt, Staphylococcus aureus subsp. aureus MW2
aauuagcaugacuguaagu

SEQ ID NO: 2083799 - RNA, 19 nt, Staphylococcus aureus subsp. aureus MW2
aauuacuuucauuguaaau

SEQ ID NO: 2083800 - RNA, 20 nt, Staphylococcus aureus subsp. aureus MW2
aauucgucuguuucauauau

SEQ ID NO: 2083801 - RNA, 22 nt, Staphylococcus aureus subsp. aureus MW2
aauuuaucgagaacaucaucau

SEQ ID NO: 2083802 - RNA, 16 nt, Staphylococcus aureus subsp. aureus MW2
aauuuaauauuauaag

SEQ ID NO: 2083803 - RNA, 17 nt, Staphylococcus aureus subsp. aureus MW2
aaucgguacgaagugca

SEQ ID NO: 2083804 - RNA, 23 nt, Staphylococcus aureus subsp. aureus MW2
aaucguuaauuuccaauaucuuc

SEQ ID NO: 2083805 - RNA, 22 nt, Staphylococcus aureus subsp. aureus MW2
aaucguuucauacacuuuaaca

SEQ ID NO: 2083806 - RNA, 22 nt, Staphylococcus aureus subsp. aureus MW2
aaucuaaaaauccauucaucgu

SEQ ID NO: 2083807 - RNA, 17 nt, Staphylococcus aureus subsp. aureus MW2
aaucuaauccugguaua

SEQ ID NO: 2083808 - RNA, 20 nt, Staphylococcus aureus subsp. aureus MW2
aauccuuuauauuuaguuag

SEQ ID NO: 2083809 - RNA, 16 nt, Staphylococcus aureus subsp. aureus MW2
aauccggaacauuaaa

SEQ ID NO: 2083810 - RNA, 22 nt, Staphylococcus aureus subsp. aureus MW2
aauauaaauuucuucauaguuc

SEQ ID NO: 2083811 - RNA, 21 nt, Staphylococcus aureus subsp. aureus MW2
aauaguuuuucauauucacau

SEQ ID NO: 2083812 - RNA, 14 nt, Staphylococcus aureus subsp. aureus MW2
aaucaggaauguuu

SEQ ID NO: 2083813 - RNA, 13 nt, Staphylococcus aureus subsp. aureus MW2
aauaguaacgucu

SEQ ID NO: 2083814 - RNA, 22 nt, Staphylococcus aureus subsp. aureus MW2
aaucccaaguuacgauaucaua

SEQ ID NO: 2083815 - RNA, 22 nt, Staphylococcus aureus subsp. aureus MW2
aaucauuguaaaugaucaucgu

SEQ ID NO: 2083816 - RNA, 13 nt, Staphylococcus aureus subsp. aureus MW2
aaucauugcguaa

SEQ ID NO: 2083817 - RNA, 23 nt, Staphylococcus aureus subsp. aureus MW2
aaucauuuguguauaaaugucau

SEQ ID NO: 2083818 - RNA, 23 nt, Staphylococcus aureus subsp. aureus MW2
aaucauuagucaucaaccucauu

SEQ ID NO: 2083819 - RNA, 18 nt, Staphylococcus aureus subsp. aureus MW2
aauccaagugacaacauu

SEQ ID NO: 2083820 - RNA, 16 nt, Staphylococcus aureus subsp. aureus MW2
aacguaaacaugguuc

SEQ ID NO: 2083821 - RNA, 16 nt, Staphylococcus aureus subsp. aureus MW2
aaccuuugcuaaauca

SEQ ID NO: 2083822 - RNA, 14 nt, Staphylococcus aureus subsp. aureus MW2
aacgauaagaauua

SEQ ID NO: 2083823 - RNA, 18 nt, Staphylococcus aureus subsp. aureus MW2
aacgcaauuaaccuugau

SEQ ID NO: 2083824 - RNA, 21 nt, Staphylococcus aureus subsp. aureus MW2
aaccaaaaaauccaagcgcuu

SEQ ID NO: 2083825 - RNA, 20 nt, Staphylococcus aureus subsp. aureus MW2
aaccacaacaaugaauccaa

SEQ ID NO: 2083826 - RNA, 14 nt, Staphylococcus aureus subsp. aureus MW2
aacauuagcauuaa

SEQ ID NO: 2083827 - RNA, 14 nt, Staphylococcus aureus subsp. aureus MW2
aacauuacguucua

SEQ ID NO: 2083828 - RNA, 16 nt, Staphylococcus aureus subsp. aureus MW2
aacauuucaauugcau

SEQ ID NO: 2083829 - RNA, 20 nt, Staphylococcus aureus subsp. aureus MW2
aacaugaaugauauugauuu

SEQ ID NO: 2083830 - RNA, 15 nt, Staphylococcus aureus subsp. aureus MW2
aacaucugaaucuga

SEQ ID NO: 2083831 - RNA, 22 nt, Staphylococcus aureus subsp. aureus MW2
aacaucgauuuaucauuauuug

SEQ ID NO: 2083832 - RNA, 20 nt, Staphylococcus aureus subsp. aureus MW2
aacaucgauugauaauguaa

SEQ ID NO: 2083833 - RNA, 19 nt, Staphylococcus aureus subsp. aureus MW2
aacauagucggcaugaugc

SEQ ID NO: 2083834 - RNA, 18 nt, Staphylococcus aureus subsp. aureus MW2
aacaguuuuauuaucuuu

SEQ ID NO: 2083835 - RNA, 22 nt, Staphylococcus aureus subsp. aureus MW2
aacauagaagcuggcggaaagu

SEQ ID NO: 2083836 - RNA, 17 nt, Staphylococcus aureus subsp. aureus MW2
aaccauuucauuucagu

SEQ ID NO: 2083837 - RNA, 19 nt, Staphylococcus aureus subsp. aureus MW2
aaccauucuaccaguugau

SEQ ID NO: 2083838 - RNA, 21 nt, Staphylococcus aureus subsp. aureus MW2
aaccauguguaggcaauugag

SEQ ID NO: 2083839 - RNA, 17 nt, Staphylococcus aureus subsp. aureus MW2
aaccaucucaacuaauc

SEQ ID NO: 2083840 - RNA, 23 nt, Staphylococcus aureus subsp. aureus MW2
aaagauucggaaaauaugauaac

SEQ ID NO: 2083841 - RNA, 18 nt, Staphylococcus aureus subsp. aureus MW2
aaacuaucuacaccauua

SEQ ID NO: 2083842 - RNA, 22 nt, Staphylococcus aureus subsp. aureus MW2
aaaaauccuaugaauaaauugu

SEQ ID NO: 2083843 - RNA, 16 nt, Staphylococcus aureus subsp. aureus MW2
aaagcuagaaguucuu

SEQ ID NO: 2083844 - RNA, 14 nt, Staphylococcus aureus subsp. aureus MW2
aaagcaaugucuug

SEQ ID NO: 2083845 - RNA, 20 nt, Staphylococcus aureus subsp. aureus MW2
aaagcaaugucuugauugaa

SEQ ID NO: 2083846 - RNA, 16 nt, Staphylococcus aureus subsp. aureus MW2
aaagugcgauuaucag

SEQ ID NO: 2083847 - RNA, 18 nt, Staphylococcus aureus subsp. aureus MW2
aaaggcguuagcuuacuu

SEQ ID NO: 2083848 - RNA, 18 nt, Staphylococcus aureus subsp. aureus MW2
aaaguuguuuaacuucuu

SEQ ID NO: 2083849 - RNA, 23 nt, Staphylococcus aureus subsp. aureus MW2
aaauauguauguuuuaucaauau

SEQ ID NO: 2083850 - RNA, 13 nt, Staphylococcus aureus subsp. aureus MW2
aaauaugauugaa

SEQ ID NO: 2083851 - RNA, 12 nt, Staphylococcus aureus subsp. aureus MW2
aaauaucaacag

SEQ ID NO: 2083852 - RNA, 12 nt, Staphylococcus aureus subsp. aureus MW2
aacaaguacaau

SEQ ID NO: 2083853 - RNA, 20 nt, Staphylococcus aureus subsp. aureus MW2
aacaauaucaucuaaauggu

SEQ ID NO: 2083854 - RNA, 22 nt, Staphylococcus aureus subsp. aureus MW2
aacaauacguuuucggauugaa

SEQ ID NO: 2083855 - RNA, 16 nt, Staphylococcus aureus subsp. aureus MW2
aacaacuuuauuauac

SEQ ID NO: 2083856 - RNA, 23 nt, Staphylococcus aureus subsp. aureus MW2
aaaagcugaugugacaaaguuua

SEQ ID NO: 2083857 - RNA, 20 nt, Staphylococcus aureus subsp. aureus MW2
aaaaggaagaacagcacauu

SEQ ID NO: 2083858 - RNA, 18 nt, Staphylococcus aureus subsp. aureus MW2
aaaagagguuuucauuaa

SEQ ID NO: 2083859 - RNA, 19 nt, Staphylococcus aureus subsp. aureus MW2
aaaagccaucuuaccuuua

SEQ ID NO: 2083860 - RNA, 16 nt, Staphylococcus aureus subsp. aureus MW2
aaauugucucacuugu

SEQ ID NO: 2083861 - RNA, 13 nt, Staphylococcus aureus subsp. aureus MW2
aaauuguauagaa

SEQ ID NO: 2083862 - RNA, 21 nt, Staphylococcus aureus subsp. aureus MW2
aaauugcucauugugcuugau

SEQ ID NO: 2083863 - RNA, 17 nt, Staphylococcus aureus subsp. aureus MW2
aaauucgaacuaucaau

SEQ ID NO: 2083864 - RNA, 17 nt, Staphylococcus aureus subsp. aureus MW2
aaauucauuuguauuaa

SEQ ID NO: 2083865 - RNA, 19 nt, Staphylococcus aureus subsp. aureus MW2
aaauuaggcauucaucuaa

SEQ ID NO: 2083866 - RNA, 13 nt, Staphylococcus aureus subsp. aureus MW2
aaauuaucauuaa

SEQ ID NO: 2083867 - RNA, 18 nt, Staphylococcus aureus subsp. aureus MW2
aaauuaggcauucaucua

SEQ ID NO: 2083868 - RNA, 16 nt, Staphylococcus aureus subsp. aureus MW2
aaaucaacaucaucuu

SEQ ID NO: 2083869 - RNA, 17 nt, Staphylococcus aureus subsp. aureus MW2
aaauguaaaaucauuaa

SEQ ID NO: 2083870 - RNA, 13 nt, Staphylococcus aureus subsp. aureus MW2
aaaugaaccauuu

SEQ ID NO: 2083871 - RNA, 20 nt, Staphylococcus aureus subsp. aureus MW2
uuuuucauaauuaauaacau

SEQ ID NO: 2083872 - RNA, 13 nt, Staphylococcus aureus subsp. aureus MW2
uuuugguuguucu

SEQ ID NO: 2083873 - RNA, 22 nt, Staphylococcus aureus subsp. aureus MW2
uuuucuaaagcuugaucaaauu

SEQ ID NO: 2083874 - RNA, 21 nt, Staphylococcus aureus subsp. aureus MW2
uuuuaaaaaacauaccugcau

SEQ ID NO: 2083875 - RNA, 14 nt, Staphylococcus aureus subsp. aureus MW2
uuugauaaucgaau

SEQ ID NO: 2083876 - RNA, 15 nt, Staphylococcus aureus subsp. aureus MW2
uuugaauaccuacag

SEQ ID NO: 2083877 - RNA, 12 nt, Staphylococcus aureus subsp. aureus MW2
uuugacauauca

SEQ ID NO: 2083878 - RNA, 13 nt, Staphylococcus aureus subsp. aureus MW2
uuugacauaucau

SEQ ID NO: 2083879 - RNA, 16 nt, Staphylococcus aureus subsp. aureus MW2
uuuccgaauaaagguc

SEQ ID NO: 2083880 - RNA, 23 nt, Staphylococcus aureus subsp. aureus MW2
uuucuacacagcuaaacgcaaua

SEQ ID NO: 2083881 - RNA, 20 nt, Staphylococcus aureus subsp. aureus MW2
uuucuaucaaauaaugaaua

SEQ ID NO: 2083882 - RNA, 23 nt, Staphylococcus aureus subsp. aureus MW2
uuucuauaucuauuuaucauacu

SEQ ID NO: 2083883 - RNA, 13 nt, Staphylococcus aureus subsp. aureus MW2
uuucuagcuuguu

SEQ ID NO: 2083884 - RNA, 12 nt, Staphylococcus aureus subsp. aureus MW2
uuuaccacuuau

SEQ ID NO: 2083885 - RNA, 22 nt, Staphylococcus aureus subsp. aureus MW2
uuguuaauucaacggaacuacu

SEQ ID NO: 2083886 - RNA, 15 nt, Staphylococcus aureus subsp. aureus MW2
uuguuuccuacacug

SEQ ID NO: 2083887 - RNA, 19 nt, Staphylococcus aureus subsp. aureus MW2
uuuaucuccuaaagguaac

SEQ ID NO: 2083888 - RNA, 12 nt, Staphylococcus aureus subsp. aureus MW2
uuuaucuguauc

SEQ ID NO: 2083889 - RNA, 22 nt, Staphylococcus aureus subsp. aureus MW2
uuuagaugcauaaaaaaagaac

SEQ ID NO: 2083890 - RNA, 22 nt, Staphylococcus aureus subsp. aureus MW2
uuucagacuguggacaaacuga

SEQ ID NO: 2083891 - RNA, 14 nt, Staphylococcus aureus subsp. aureus MW2
uuucagagauauuu

SEQ ID NO: 2083892 - RNA, 23 nt, Staphylococcus aureus subsp. aureus MW2
uuguaaaucacgauuuucaagua

SEQ ID NO: 2083893 - RNA, 23 nt, Staphylococcus aureus subsp. aureus MW2
uuguacgauaacuacacuuaaua

SEQ ID NO: 2083894 - RNA, 16 nt, Staphylococcus aureus subsp. aureus MW2
uuguagccuucaacua

SEQ ID NO: 2083895 - RNA, 15 nt, Staphylococcus aureus subsp. aureus MW2
uugaaacuguaucaa

SEQ ID NO: 2083896 - RNA, 15 nt, Staphylococcus aureus subsp. aureus MW2
uugaaauguuuauca

SEQ ID NO: 2083897 - RNA, 23 nt, Staphylococcus aureus subsp. aureus MW2
uuggcggggccccaacauagaag

SEQ ID NO: 2083898 - RNA, 19 nt, Staphylococcus aureus subsp. aureus MW2
uggcuugaaguuguuucuc

SEQ ID NO: 2083899 - RNA, 15 nt, Staphylococcus aureus subsp. aureus MW2
ugguagagauagcau

SEQ ID NO: 2083900 - RNA, 16 nt, Staphylococcus aureus subsp. aureus MW2
ugcuuuuaauaguguu

SEQ ID NO: 2083901 - RNA, 19 nt, Staphylococcus aureus subsp. aureus MW2
ugcuuuuauuuuuaauguu

SEQ ID NO: 2083902 - RNA, 12 nt, Staphylococcus aureus subsp. aureus MW2
ugguucaaauau

SEQ ID NO: 2083903 - RNA, 19 nt, Staphylococcus aureus subsp. aureus MW2
ugguuaacaucuucaugua

SEQ ID NO: 2083904 - RNA, 16 nt, Staphylococcus aureus subsp. aureus MW2
uggugaguuggcauca

SEQ ID NO: 2083905 - RNA, 22 nt, Staphylococcus aureus subsp. aureus MW2
ugguauuagaacuucucuuuga

SEQ ID NO: 2083906 - RNA, 22 nt, Staphylococcus aureus subsp. aureus MW2
uguaucaucauaaucaagaaua

SEQ ID NO: 2083907 - RNA, 21 nt, Staphylococcus aureus subsp. aureus MW2
uguaucucugaaaaacuucuu

SEQ ID NO: 2083908 - RNA, 12 nt, Staphylococcus aureus subsp. aureus MW2
uguaugcauaua

SEQ ID NO: 2083909 - RNA, 16 nt, Staphylococcus aureus subsp. aureus MW2
uguauaauacaugaua

SEQ ID NO: 2083910 - RNA, 16 nt, Staphylococcus aureus subsp. aureus MW2
uguauaccuauuccua

SEQ ID NO: 2083911 - RNA, 14 nt, Staphylococcus aureus subsp. aureus MW2
uguaacacacuuau

SEQ ID NO: 2083912 - RNA, 13 nt, Staphylococcus aureus subsp. aureus MW2
uguaaaguugaua

SEQ ID NO: 2083913 - RNA, 18 nt, Staphylococcus aureus subsp. aureus MW2
uguccauaguaaucgauu

SEQ ID NO: 2083914 - RNA, 19 nt, Staphylococcus aureus subsp. aureus MW2
uguccagcuuaauuugaca

SEQ ID NO: 2083915 - RNA, 13 nt, Staphylococcus aureus subsp. aureus MW2
ugucuagauuuca

SEQ ID NO: 2083916 - RNA, 15 nt, Staphylococcus aureus subsp. aureus MW2
uuccaucacaucaua

SEQ ID NO: 2083917 - RNA, 16 nt, Staphylococcus aureus subsp. aureus MW2
uucauuugaaauaguu

SEQ ID NO: 2083918 - RNA, 13 nt, Staphylococcus aureus subsp. aureus MW2
uucauugcuuggu

SEQ ID NO: 2083919 - RNA, 15 nt, Staphylococcus aureus subsp. aureus MW2
uuccaaacacacugu

SEQ ID NO: 2083920 - RNA, 23 nt, Staphylococcus aureus subsp. aureus MW2
uuauugacauugcaaaagugguu

SEQ ID NO: 2083921 - RNA, 14 nt, Staphylococcus aureus subsp. aureus MW2
uuauuaugaauuau

SEQ ID NO: 2083922 - RNA, 14 nt, Staphylococcus aureus subsp. aureus MW2
uuauucgaacgaua

SEQ ID NO: 2083923 - RNA, 13 nt, Staphylococcus aureus subsp. aureus MW2
uuauuuaaaaugc

SEQ ID NO: 2083924 - RNA, 21 nt, Staphylococcus aureus subsp. aureus MW2
uucacgauuuuuaaaaugcuu

SEQ ID NO: 2083925 - RNA, 20 nt, Staphylococcus aureus subsp. aureus MW2
uucaauucuagucaaccuug

SEQ ID NO: 2083926 - RNA, 19 nt, Staphylococcus aureus subsp. aureus MW2
uucaaugaauucauuuuau

SEQ ID NO: 2083927 - RNA, 19 nt, Staphylococcus aureus subsp. aureus MW2
uucaauaaaaaugguauuc

SEQ ID NO: 2083928 - RNA, 19 nt, Staphylococcus aureus subsp. aureus MW2
uucaauaauucaucaaguu

SEQ ID NO: 2083929 - RNA, 23 nt, Staphylococcus aureus subsp. aureus MW2
uuaaucaaauauuuuauuacauc

SEQ ID NO: 2083930 - RNA, 23 nt, Staphylococcus aureus subsp. aureus MW2
uuaauauaauuacaaguuacauu

SEQ ID NO: 2083931 - RNA, 13 nt, Staphylococcus aureus subsp. aureus MW2
uuaaacaugaaca

SEQ ID NO: 2083932 - RNA, 19 nt, Staphylococcus aureus subsp. aureus MW2
uuaaacaaguugauaacua

SEQ ID NO: 2083933 - RNA, 19 nt, Staphylococcus aureus subsp. aureus MW2
uuaaacauaacaugaccua

SEQ ID NO: 2083934 - RNA, 14 nt, Staphylococcus aureus subsp. aureus MW2
uuaaauaaugauaa

SEQ ID NO: 2083935 - RNA, 13 nt, Staphylococcus aureus subsp. aureus MW2
uuaaauaugaaua

SEQ ID NO: 2083936 - RNA, 21 nt, Staphylococcus aureus subsp. aureus MW2
uuaaaggucuuaaucauugcu

SEQ ID NO: 2083937 - RNA, 14 nt, Staphylococcus aureus subsp. aureus MW2
uuaaaucaacauca

SEQ ID NO: 2083938 - RNA, 17 nt, Staphylococcus aureus subsp. aureus MW2
uguuguacauguauugg

SEQ ID NO: 2083939 - RNA, 22 nt, Staphylococcus aureus subsp. aureus MW2
uguuuagggaaucccauaccua

SEQ ID NO: 2083940 - RNA, 15 nt, Staphylococcus aureus subsp. aureus MW2
uguuuuuacaaaugu

SEQ ID NO: 2083941 - RNA, 19 nt, Staphylococcus aureus subsp. aureus MW2
uuaaaaauugcaaugcuau

SEQ ID NO: 2083942 - RNA, 16 nt, Staphylococcus aureus subsp. aureus MW2
uuaaaaauaguucuuu

SEQ ID NO: 2083943 - RNA, 13 nt, Staphylococcus aureus subsp. aureus MW2
uuagccauuucaa

SEQ ID NO: 2083944 - RNA, 13 nt, Staphylococcus aureus subsp. aureus MW2
uuagcaaaugguc

SEQ ID NO: 2083945 - RNA, 19 nt, Staphylococcus aureus subsp. aureus MW2
uuaguucguguuugaaugu

SEQ ID NO: 2083946 - RNA, 13 nt, Staphylococcus aureus subsp. aureus MW2
uuacguugaaugu

SEQ ID NO: 2083947 - RNA, 20 nt, Staphylococcus aureus subsp. aureus MW2
uuaauuuguauuuaaaauca

SEQ ID NO: 2083948 - RNA, 17 nt, Staphylococcus aureus subsp. aureus MW2
uuaauuugaauaccuac

SEQ ID NO: 2083949 - RNA, 17 nt, Staphylococcus aureus subsp. aureus MW2
uucucuaacuuuaccaa

SEQ ID NO: 2083950 - RNA, 21 nt, Staphylococcus aureus subsp. aureus MW2
uucucugcuucuaaaacauca

SEQ ID NO: 2083951 - RNA, 16 nt, Staphylococcus aureus subsp. aureus MW2
uucuucagguguuuua

SEQ ID NO: 2083952 - RNA, 19 nt, Staphylococcus aureus subsp. aureus MW2
uucuucaucauauucgccu

SEQ ID NO: 2083953 - RNA, 15 nt, Staphylococcus aureus subsp. aureus MW2
uucuggucacuaaug

SEQ ID NO: 2083954 - RNA, 20 nt, Staphylococcus aureus subsp. aureus MW2
uucugcuucgugguuaguaa

SEQ ID NO: 2083955 - RNA, 17 nt, Staphylococcus aureus subsp. aureus MW2
uucuguccaaaaagguu

SEQ ID NO: 2083956 - RNA, 16 nt, Staphylococcus aureus subsp. aureus MW2
uucuaguagcuugaau

SEQ ID NO: 2083957 - RNA, 16 nt, Staphylococcus aureus subsp. aureus MW2
uucuaguuuaacauua

SEQ ID NO: 2083958 - RNA, 19 nt, Staphylococcus aureus subsp. aureus MW2
uucuaauacaccaaaucca

SEQ ID NO: 2083959 - RNA, 15 nt, Staphylococcus aureus subsp. aureus MW2
uucuaaaacaucacu

SEQ ID NO: 2083960 - RNA, 19 nt, Staphylococcus aureus subsp. aureus MW2
uucguuuuaauaaauuguu

SEQ ID NO: 2083961 - RNA, 17 nt, Staphylococcus aureus subsp. aureus MW2
uucguugauuaacauua

SEQ ID NO: 2083962 - RNA, 19 nt, Staphylococcus aureus subsp. aureus MW2
uucgccuucuaauaaugcu

SEQ ID NO: 2083963 - RNA, 15 nt, Staphylococcus aureus subsp. aureus MW2
ucuauuagauacaua

SEQ ID NO: 2083964 - RNA, 12 nt, Staphylococcus aureus subsp. aureus MW2
ucugaaucugaa

SEQ ID NO: 2083965 - RNA, 19 nt, Staphylococcus aureus subsp. aureus MW2
ucuuaguuuagguugauuu

SEQ ID NO: 2083966 - RNA, 20 nt, Staphylococcus aureus subsp. aureus MW2
ucugucaaauuggacuuaug

SEQ ID NO: 2083967 - RNA, 21 nt, Staphylococcus aureus subsp. aureus MW2
ucuucauuuucauuguauguu

SEQ ID NO: 2083968 - RNA, 18 nt, Staphylococcus aureus subsp. aureus MW2
ucuucauaaucguauuca

SEQ ID NO: 2083969 - RNA, 21 nt, Staphylococcus aureus subsp. aureus MW2
ucuucgcgaccguguuguuga

SEQ ID NO: 2083970 - RNA, 19 nt, Staphylococcus aureus subsp. aureus MW2
ucuuuuucccaugcuucua

SEQ ID NO: 2083971 - RNA, 13 nt, Staphylococcus aureus subsp. aureus MW2
ucuuuuguuuuua

SEQ ID NO: 2083972 - RNA, 21 nt, Staphylococcus aureus subsp. aureus MW2
ucuuuuguuuucacuguuuua

SEQ ID NO: 2083973 - RNA, 13 nt, Staphylococcus aureus subsp. aureus MW2
ucuuuuguuuuca

SEQ ID NO: 2083974 - RNA, 19 nt, Staphylococcus aureus subsp. aureus MW2
ucuuuugauagcuaaugca

SEQ ID NO: 2083975 - RNA, 21 nt, Staphylococcus aureus subsp. aureus MW2
ucuuuacuccaaaguaacaua

SEQ ID NO: 2083976 - RNA, 22 nt, Staphylococcus aureus subsp. aureus MW2
ucuuggauguuuucguuugcaa

SEQ ID NO: 2083977 - RNA, 16 nt, Staphylococcus aureus subsp. aureus MW2
ucuuguucuaauuguu

SEQ ID NO: 2083978 - RNA, 19 nt, Staphylococcus aureus subsp. aureus MW2
ucuuguuucaaacaaagcu

SEQ ID NO: 2083979 - RNA, 15 nt, Staphylococcus aureus subsp. aureus MW2
ucuuuaauacgaauu

SEQ ID NO: 2083980 - RNA, 14 nt, Staphylococcus aureus subsp. aureus MW2
ucuuuacaacagua

SEQ ID NO: 2083981 - RNA, 16 nt, Staphylococcus aureus subsp. aureus MW2
ugaugucauguauugu

SEQ ID NO: 2083982 - RNA, 13 nt, Staphylococcus aureus subsp. aureus MW2
ugauguuacaauc

SEQ ID NO: 2083983 - RNA, 16 nt, Staphylococcus aureus subsp. aureus MW2
ugauguguugcauuac

SEQ ID NO: 2083984 - RNA, 23 nt, Staphylococcus aureus subsp. aureus MW2
ugauuaaaaguguugacuuuauc

SEQ ID NO: 2083985 - RNA, 15 nt, Staphylococcus aureus subsp. aureus MW2
ugauggauauucaau

SEQ ID NO: 2083986 - RNA, 16 nt, Staphylococcus aureus subsp. aureus MW2
ugcaacuacgauaccg

SEQ ID NO: 2083987 - RNA, 21 nt, Staphylococcus aureus subsp. aureus MW2
ugauugcucuaagcauucagu

SEQ ID NO: 2083988 - RNA, 23 nt, Staphylococcus aureus subsp. aureus MW2
ugauuggcacagucaaugacuua

SEQ ID NO: 2083989 - RNA, 20 nt, Staphylococcus aureus subsp. aureus MW2
ugcacuaauggcacuuaaua

SEQ ID NO: 2083990 - RNA, 21 nt, Staphylococcus aureus subsp. aureus MW2
ugacuuuaucaauugaaugaa

SEQ ID NO: 2083991 - RNA, 14 nt, Staphylococcus aureus subsp. aureus MW2
ugagaaaauaucau

SEQ ID NO: 2083992 - RNA, 18 nt, Staphylococcus aureus subsp. aureus MW2
ugagaaauguuaacgaua

SEQ ID NO: 2083993 - RNA, 22 nt, Staphylococcus aureus subsp. aureus MW2
ugagauaaacgcacugcugcaa

SEQ ID NO: 2083994 - RNA, 17 nt, Staphylococcus aureus subsp. aureus MW2
ugagcaaguuauaucau

SEQ ID NO: 2083995 - RNA, 16 nt, Staphylococcus aureus subsp. aureus MW2
ugauaacgucauucuu

SEQ ID NO: 2083996 - RNA, 21 nt, Staphylococcus aureus subsp. aureus MW2
ugauacgaugcgugaguugaa

SEQ ID NO: 2083997 - RNA, 16 nt, Staphylococcus aureus subsp. aureus MW2
ugauagcuaaugcauu

SEQ ID NO: 2083998 - RNA, 23 nt, Staphylococcus aureus subsp. aureus MW2
ugauaguagcuuaaugcaucuau

SEQ ID NO: 2083999 - RNA, 23 nt, Staphylococcus aureus subsp. aureus MW2
ugauauuucgguuagucuuaauc

SEQ ID NO: 2084000 - RNA, 23 nt, Staphylococcus aureus subsp. aureus MW2
ugauaucgaaacgcuuugcagau

SEQ ID NO: 2084001 - RNA, 21 nt, Staphylococcus aureus subsp. aureus MW2
ugauauugaaaguguaugcau

SEQ ID NO: 2084002 - RNA, 16 nt, Staphylococcus aureus subsp. aureus MW2
ugcauuacuacaaacu

SEQ ID NO: 2084003 - RNA, 20 nt, Staphylococcus aureus subsp. aureus MW2
ugcauuaauuucaugugcaa

SEQ ID NO: 2084004 - RNA, 14 nt, Staphylococcus aureus subsp. aureus MW2
ugccaucaauuucu

SEQ ID NO: 2084005 - RNA, 15 nt, Staphylococcus aureus subsp. aureus MW2
ugccauucauacacu

SEQ ID NO: 2084006 - RNA, 21 nt, Staphylococcus aureus subsp. aureus MW2
ugcccuagguuuauauaucac

SEQ ID NO: 2084007 - RNA, 21 nt, Staphylococcus aureus subsp. aureus MW2
ugccgaaauuguucuaauaca

SEQ ID NO: 2084008 - RNA, 19 nt, Staphylococcus aureus subsp. aureus MW2
ugccuuaugucauauacua

SEQ ID NO: 2084009 - RNA, 20 nt, Staphylococcus aureus subsp. aureus MW2
ugcgguaauugaaucguauu

SEQ ID NO: 2084010 - RNA, 16 nt, Staphylococcus aureus subsp. aureus MW2
ugcuguuuuauucaau

SEQ ID NO: 2084011 - RNA, 17 nt, Staphylococcus aureus subsp. aureus MW2
ugcuuaauuuauguguu

SEQ ID NO: 2084012 - RNA, 23 nt, Staphylococcus aureus subsp. aureus MW2
ugcuucauauggacguaacuguu

SEQ ID NO: 2084013 - RNA, 17 nt, Staphylococcus aureus subsp. aureus MW2
ugcuugaucuugcuuau

SEQ ID NO: 2084014 - RNA, 21 nt, Staphylococcus aureus subsp. aureus MW2
ugcuugauaagaagugcuuau

SEQ ID NO: 2084015 - RNA, 14 nt, Staphylococcus aureus subsp. aureus MW2
ugcuugguuugauu

SEQ ID NO: 2084016 - RNA, 20 nt, Staphylococcus aureus subsp. aureus MW2
ugcuuggauaauugcauuac

SEQ ID NO: 2084017 - RNA, 13 nt, Staphylococcus aureus subsp. aureus MW2
ugcuuuaacugua

SEQ ID NO: 2084018 - RNA, 18 nt, Staphylococcus aureus subsp. aureus MW2
ugcugcuguacaauuucg

SEQ ID NO: 2084019 - RNA, 17 nt, Staphylococcus aureus subsp. aureus MW2
ugcuaaaaaauuugcau

SEQ ID NO: 2084020 - RNA, 17 nt, Staphylococcus aureus subsp. aureus MW2
ugcuaaaaaguuagcaa

SEQ ID NO: 2084021 - RNA, 17 nt, Staphylococcus aureus subsp. aureus MW2
uauuuaauguuucaaau

SEQ ID NO: 2084022 - RNA, 14 nt, Staphylococcus aureus subsp. aureus MW2
uauuuaauguuuua

SEQ ID NO: 2084023 - RNA, 14 nt, Staphylococcus aureus subsp. aureus MW2
uauuuaaacgguaa

SEQ ID NO: 2084024 - RNA, 20 nt, Staphylococcus aureus subsp. aureus MW2
uauuuaaaaugcuuguucaa

SEQ ID NO: 2084025 - RNA, 18 nt, Staphylococcus aureus subsp. aureus MW2
uauuguucucuggauugc

SEQ ID NO: 2084026 - RNA, 17 nt, Staphylococcus aureus subsp. aureus MW2
uauuguuuaugucuugc

SEQ ID NO: 2084027 - RNA, 21 nt, Staphylococcus aureus subsp. aureus MW2
uauuugcuuuuuguguaucug

SEQ ID NO: 2084028 - RNA, 16 nt, Staphylococcus aureus subsp. aureus MW2
uauuugaaaaaguguu

SEQ ID NO: 2084029 - RNA, 12 nt, Staphylococcus aureus subsp. aureus MW2
uauuuguuguua

SEQ ID NO: 2084030 - RNA, 14 nt, Staphylococcus aureus subsp. aureus MW2
uauuuguguuuuua

SEQ ID NO: 2084031 - RNA, 12 nt, Staphylococcus aureus subsp. aureus MW2
uccaaagacaua

SEQ ID NO: 2084032 - RNA, 17 nt, Staphylococcus aureus subsp. aureus MW2
ucauuauuguuguauca

SEQ ID NO: 2084033 - RNA, 13 nt, Staphylococcus aureus subsp. aureus MW2
ucaucauguucua

SEQ ID NO: 2084034 - RNA, 13 nt, Staphylococcus aureus subsp. aureus MW2
ucaucaugacuau

SEQ ID NO: 2084035 - RNA, 15 nt, Staphylococcus aureus subsp. aureus MW2
ucaucaugauuauuu

SEQ ID NO: 2084036 - RNA, 17 nt, Staphylococcus aureus subsp. aureus MW2
ucaguuagaagaugauu

SEQ ID NO: 2084037 - RNA, 20 nt, Staphylococcus aureus subsp. aureus MW2
ucauaaaauaccagaugaac

SEQ ID NO: 2084038 - RNA, 22 nt, Staphylococcus aureus subsp. aureus MW2
ucaucaauaaauauugauucua

SEQ ID NO: 2084039 - RNA, 14 nt, Staphylococcus aureus subsp. aureus MW2
ucaucaaguugaua

SEQ ID NO: 2084040 - RNA, 14 nt, Staphylococcus aureus subsp. aureus MW2
ucaucaauuggcaa

SEQ ID NO: 2084041 - RNA, 21 nt, Staphylococcus aureus subsp. aureus MW2
ucagucucuaaaacuuuuuca

SEQ ID NO: 2084042 - RNA, 14 nt, Staphylococcus aureus subsp. aureus MW2
ucccugaaucagga

SEQ ID NO: 2084043 - RNA, 12 nt, Staphylococcus aureus subsp. aureus MW2
uccggaacaaua

SEQ ID NO: 2084044 - RNA, 13 nt, Staphylococcus aureus subsp. aureus MW2
ucgacaucuagau

SEQ ID NO: 2084045 - RNA, 20 nt, Staphylococcus aureus subsp. aureus MW2
ucgaaaugccuucuguacgu

SEQ ID NO: 2084046 - RNA, 15 nt, Staphylococcus aureus subsp. aureus MW2
uccuuuaagaacaua

SEQ ID NO: 2084047 - RNA, 20 nt, Staphylococcus aureus subsp. aureus MW2
uccuuuaagaacauaaccua

SEQ ID NO: 2084048 - RNA, 19 nt, Staphylococcus aureus subsp. aureus MW2
uccuuuauaaauaaacaua

SEQ ID NO: 2084049 - RNA, 14 nt, Staphylococcus aureus subsp. aureus MW2
uccuuugauguuca

SEQ ID NO: 2084050 - RNA, 14 nt, Staphylococcus aureus subsp. aureus MW2
uccuuuguuuguaa

SEQ ID NO: 2084051 - RNA, 14 nt, Staphylococcus aureus subsp. aureus MW2
ucgaaaauuucagg

SEQ ID NO: 2084052 - RNA, 14 nt, Staphylococcus aureus subsp. aureus MW2
uccuucucaucauu

SEQ ID NO: 2084053 - RNA, 17 nt, Staphylococcus aureus subsp. aureus MW2
uacauuacauauaucaa

SEQ ID NO: 2084054 - RNA, 14 nt, Staphylococcus aureus subsp. aureus MW2
uacaugacauucau

SEQ ID NO: 2084055 - RNA, 14 nt, Staphylococcus aureus subsp. aureus MW2
uacauguacauuau

SEQ ID NO: 2084056 - RNA, 22 nt, Staphylococcus aureus subsp. aureus MW2
uacauugauaaauuuuuaguua

SEQ ID NO: 2084057 - RNA, 16 nt, Staphylococcus aureus subsp. aureus MW2
uaccuauuaauaucau

SEQ ID NO: 2084058 - RNA, 16 nt, Staphylococcus aureus subsp. aureus MW2
uacgaccagucgcaua

SEQ ID NO: 2084059 - RNA, 20 nt, Staphylococcus aureus subsp. aureus MW2
uaccuuaucaguguaaguuu

SEQ ID NO: 2084060 - RNA, 20 nt, Staphylococcus aureus subsp. aureus MW2
uaccuucaauugacauuaau

SEQ ID NO: 2084061 - RNA, 13 nt, Staphylococcus aureus subsp. aureus MW2
uaccuguccaaau

SEQ ID NO: 2084062 - RNA, 18 nt, Staphylococcus aureus subsp. aureus MW2
uaccuccccaacuuaaua

SEQ ID NO: 2084063 - RNA, 13 nt, Staphylococcus aureus subsp. aureus MW2
uacuaaaccgauu

SEQ ID NO: 2084064 - RNA, 18 nt, Staphylococcus aureus subsp. aureus MW2
uacuaaaaggacucauac

SEQ ID NO: 2084065 - RNA, 14 nt, Staphylococcus aureus subsp. aureus MW2
uacuaaauaacuau

SEQ ID NO: 2084066 - RNA, 13 nt, Staphylococcus aureus subsp. aureus MW2
uacguugaauguu

SEQ ID NO: 2084067 - RNA, 16 nt, Staphylococcus aureus subsp. aureus MW2
uacuucucaucgaauu

SEQ ID NO: 2084068 - RNA, 15 nt, Staphylococcus aureus subsp. aureus MW2
uacuguauaagugcu

SEQ ID NO: 2084069 - RNA, 21 nt, Staphylococcus aureus subsp. aureus MW2
uacuguuuaaauaaaauuguu

SEQ ID NO: 2084070 - RNA, 13 nt, Staphylococcus aureus subsp. aureus MW2
uacugguuaguaa

SEQ ID NO: 2084071 - RNA, 16 nt, Staphylococcus aureus subsp. aureus MW2
uaggaccuacaauuuu

SEQ ID NO: 2084072 - RNA, 14 nt, Staphylococcus aureus subsp. aureus MW2
uaggaugaaacuuu

SEQ ID NO: 2084073 - RNA, 22 nt, Staphylococcus aureus subsp. aureus MW2
uagcuuaauaauuaauaagcau

SEQ ID NO: 2084074 - RNA, 20 nt, Staphylococcus aureus subsp. aureus MW2
uagcuggcuuuuuaauuguu

SEQ ID NO: 2084075 - RNA, 12 nt, Staphylococcus aureus subsp. aureus MW2
uagcuaaugcau

SEQ ID NO: 2084076 - RNA, 15 nt, Staphylococcus aureus subsp. aureus MW2
uagccuagauaccaa

SEQ ID NO: 2084077 - RNA, 21 nt, Staphylococcus aureus subsp. aureus MW2
uagaugagaaaguaaaaguuu

SEQ ID NO: 2084078 - RNA, 15 nt, Staphylococcus aureus subsp. aureus MW2
uagauuagcuuaagu

SEQ ID NO: 2084079 - RNA, 15 nt, Staphylococcus aureus subsp. aureus MW2
uauuggcauuagcuu

SEQ ID NO: 2084080 - RNA, 18 nt, Staphylococcus aureus subsp. aureus MW2
uauucuaaucuaaauuca

SEQ ID NO: 2084081 - RNA, 19 nt, Staphylococcus aureus subsp. aureus MW2
uauucuaacuuuguaugaa

SEQ ID NO: 2084082 - RNA, 17 nt, Staphylococcus aureus subsp. aureus MW2
uauucgauaauauaacu

SEQ ID NO: 2084083 - RNA, 21 nt, Staphylococcus aureus subsp. aureus MW2
uauucgaaaaagguauucaaa

SEQ ID NO: 2084084 - RNA, 14 nt, Staphylococcus aureus subsp. aureus MW2
uauucaaaugauuu

SEQ ID NO: 2084085 - RNA, 19 nt, Staphylococcus aureus subsp. aureus MW2
uauucaguugguauaucga

SEQ ID NO: 2084086 - RNA, 19 nt, Staphylococcus aureus subsp. aureus MW2
uauucacgcguucaaaugu

SEQ ID NO: 2084087 - RNA, 21 nt, Staphylococcus aureus subsp. aureus MW2
uauucauaauaucgaugacuu

SEQ ID NO: 2084088 - RNA, 22 nt, Staphylococcus aureus subsp. aureus MW2
uauucauaauaucgaugacuuu

SEQ ID NO: 2084089 - RNA, 15 nt, Staphylococcus aureus subsp. aureus MW2
uauucauacguucaa

SEQ ID NO: 2084090 - RNA, 20 nt, Staphylococcus aureus subsp. aureus MW2
uauucauagaccuaugaauu

SEQ ID NO: 2084091 - RNA, 23 nt, Staphylococcus aureus subsp. aureus MW2
uaugauaaauauuguguuuagga

SEQ ID NO: 2084092 - RNA, 21 nt, Staphylococcus aureus subsp. aureus MW2
uauggcguauucagcuaucaa

SEQ ID NO: 2084093 - RNA, 15 nt, Staphylococcus aureus subsp. aureus MW2
uauguugcuuaucaa

SEQ ID NO: 2084094 - RNA, 13 nt, Staphylococcus aureus subsp. aureus MW2
uauguuguuucua

SEQ ID NO: 2084095 - RNA, 15 nt, Staphylococcus aureus subsp. aureus MW2
uaugugcuuuuguaa

SEQ ID NO: 2084096 - RNA, 14 nt, Staphylococcus aureus subsp. aureus MW2
uauuaaauaugcac

SEQ ID NO: 2084097 - RNA, 19 nt, Staphylococcus aureus subsp. aureus MW2
uauuaaaguaaaauauacu

SEQ ID NO: 2084098 - RNA, 13 nt, Staphylococcus aureus subsp. aureus MW2
uaucauacauauu

SEQ ID NO: 2084099 - RNA, 14 nt, Staphylococcus aureus subsp. aureus MW2
uaucagugugauuu

SEQ ID NO: 2084100 - RNA, 16 nt, Staphylococcus aureus subsp. aureus MW2
uaucaagauguuugca

SEQ ID NO: 2084101 - RNA, 22 nt, Staphylococcus aureus subsp. aureus MW2
uaucaagaauauaacgaauguu

SEQ ID NO: 2084102 - RNA, 16 nt, Staphylococcus aureus subsp. aureus MW2
uaucaacuugaaugua

SEQ ID NO: 2084103 - RNA, 14 nt, Staphylococcus aureus subsp. aureus MW2
uaucacugaaugcu

SEQ ID NO: 2084104 - RNA, 18 nt, Staphylococcus aureus subsp. aureus MW2
uaucacaacacauaaauu

SEQ ID NO: 2084105 - RNA, 19 nt, Staphylococcus aureus subsp. aureus MW2
uauccgauuuaaguugaua

SEQ ID NO: 2084106 - RNA, 22 nt, Staphylococcus aureus subsp. aureus MW2
uaucguuuuacuuucaccauuu

SEQ ID NO: 2084107 - RNA, 14 nt, Staphylococcus aureus subsp. aureus MW2
uaucuuuuaauguu

SEQ ID NO: 2084108 - RNA, 15 nt, Staphylococcus aureus subsp. aureus MW2
uauaauuggcagaua

SEQ ID NO: 2084109 - RNA, 16 nt, Staphylococcus aureus subsp. aureus MW2
uauaauuaaacuaaua

SEQ ID NO: 2084110 - RNA, 18 nt, Staphylococcus aureus subsp. aureus MW2
uauaauaugugcaugaga

SEQ ID NO: 2084111 - RNA, 18 nt, Staphylococcus aureus subsp. aureus MW2
uauaaguagcucaaaaca

SEQ ID NO: 2084112 - RNA, 21 nt, Staphylococcus aureus subsp. aureus MW2
uauaacugcauguacaucuuu

SEQ ID NO: 2084113 - RNA, 14 nt, Staphylococcus aureus subsp. aureus MW2
uauaaccgcuacaa

SEQ ID NO: 2084114 - RNA, 18 nt, Staphylococcus aureus subsp. aureus MW2
uauaguaagaaaagucac

SEQ ID NO: 2084115 - RNA, 21 nt, Staphylococcus aureus subsp. aureus MW2
uauaguaacgcauaugauugc

SEQ ID NO: 2084116 - RNA, 17 nt, Staphylococcus aureus subsp. aureus MW2
uauagggcgcacauuau

SEQ ID NO: 2084117 - RNA, 14 nt, Staphylococcus aureus subsp. aureus MW2
uauauuaaaguaaa

SEQ ID NO: 2084118 - RNA, 15 nt, Staphylococcus aureus subsp. aureus MW2
uauauuuugaaucag

SEQ ID NO: 2084119 - RNA, 18 nt, Staphylococcus aureus subsp. aureus MW2
uauagcuuuggaugauuc

SEQ ID NO: 2084120 - RNA, 21 nt, Staphylococcus aureus subsp. aureus MW2
uauaggcccuaacgguagaau

SEQ ID NO: 2084121 - RNA, 22 nt, Staphylococcus aureus subsp. aureus MW2
uauagaggauauuuauucuaag

SEQ ID NO: 2084122 - RNA, 18 nt, Staphylococcus aureus subsp. aureus MW2
uaguucagcuucuaagua

SEQ ID NO: 2084123 - RNA, 17 nt, Staphylococcus aureus subsp. aureus MW2
uaguguuauauuguauu

SEQ ID NO: 2084124 - RNA, 21 nt, Staphylococcus aureus subsp. aureus MW2
uagucuuuuuuaagcuuauca

SEQ ID NO: 2084125 - RNA, 21 nt, Staphylococcus aureus subsp. aureus MW2
uagugagcccgcaaaucgccu

SEQ ID NO: 2084126 - RNA, 13 nt, Staphylococcus aureus subsp. aureus MW2
uagugagcguauu

SEQ ID NO: 2084127 - RNA, 16 nt, Staphylococcus aureus subsp. aureus MW2
uaguaacgcauaugau

SEQ ID NO: 2084128 - RNA, 19 nt, Staphylococcus aureus subsp. aureus MW2
uaguaagguuugaacucug

SEQ ID NO: 2084129 - RNA, 18 nt, Staphylococcus aureus subsp. aureus MW2
uaguaauaguuaacgaua

SEQ ID NO: 2084130 - RNA, 15 nt, Staphylococcus aureus subsp. aureus MW2
uaguacgaaaugcau

SEQ ID NO: 2084131 - RNA, 12 nt, Staphylococcus aureus subsp. aureus MW2
uaguaguguauu

SEQ ID NO: 2084132 - RNA, 23 nt, Staphylococcus aureus subsp. aureus MW2
uagucauuacaaaucaugacaua

SEQ ID NO: 2084133 - RNA, 15 nt, Staphylococcus aureus subsp. aureus MW2
uaguauaaauaucau

SEQ ID NO: 2084134 - RNA, 13 nt, Staphylococcus aureus subsp. aureus MW2
uaguaucgauagu

SEQ ID NO: 2084135 - RNA, 17 nt, Staphylococcus aureus subsp. aureus MW2
guugaaacuguaucaac

SEQ ID NO: 2084136 - RNA, 16 nt, Staphylococcus aureus subsp. aureus MW2
guucuaaaauuaacca

SEQ ID NO: 2084137 - RNA, 23 nt, Staphylococcus aureus subsp. aureus MW2
guugcacaaauugcaauggcaac

SEQ ID NO: 2084138 - RNA, 15 nt, Staphylococcus aureus subsp. aureus MW2
guuguaccaaugaau

SEQ ID NO: 2084139 - RNA, 21 nt, Staphylococcus aureus subsp. aureus MW2
guuuagcgucguguauucaga

SEQ ID NO: 2084140 - RNA, 18 nt, Staphylococcus aureus subsp. aureus MW2
guuuagauucacuguaua

SEQ ID NO: 2084141 - RNA, 20 nt, Staphylococcus aureus subsp. aureus MW2
guuugaaggugauaauguac

SEQ ID NO: 2084142 - RNA, 18 nt, Staphylococcus aureus subsp. aureus MW2
guuuggauaaaaugauau

SEQ ID NO: 2084143 - RNA, 14 nt, Staphylococcus aureus subsp. aureus MW2
guuugaucauuuac

SEQ ID NO: 2084144 - RNA, 16 nt, Staphylococcus aureus subsp. aureus MW2
guuugauagaugauac

SEQ ID NO: 2084145 - RNA, 12 nt, Staphylococcus aureus subsp. aureus MW2
guuuugaauguu

SEQ ID NO: 2084146 - RNA, 15 nt, Staphylococcus aureus subsp. aureus MW2
guuuuauaauucgga

SEQ ID NO: 2084147 - RNA, 18 nt, Staphylococcus aureus subsp. aureus MW2
uacagaaguggugcuuua

SEQ ID NO: 2084148 - RNA, 19 nt, Staphylococcus aureus subsp. aureus MW2
uacacgaauucauuaacgu

SEQ ID NO: 2084149 - RNA, 15 nt, Staphylococcus aureus subsp. aureus MW2
uacagacaaugcaag

SEQ ID NO: 2084150 - RNA, 15 nt, Staphylococcus aureus subsp. aureus MW2
uacaggcaaugcaag

SEQ ID NO: 2084151 - RNA, 17 nt, Staphylococcus aureus subsp. aureus MW2
uaaugcuaugauuaaag

SEQ ID NO: 2084152 - RNA, 19 nt, Staphylococcus aureus subsp. aureus MW2
uaauugcguuuaauaacau

SEQ ID NO: 2084153 - RNA, 13 nt, Staphylococcus aureus subsp. aureus MW2
uaauugaugauua

SEQ ID NO: 2084154 - RNA, 23 nt, Staphylococcus aureus subsp. aureus MW2
uaaugguucucugucaaauugga

SEQ ID NO: 2084155 - RNA, 20 nt, Staphylococcus aureus subsp. aureus MW2
uaauuuaaauuacaauuagu

SEQ ID NO: 2084156 - RNA, 19 nt, Staphylococcus aureus subsp. aureus MW2
uaauuuaacaacuguucua

SEQ ID NO: 2084157 - RNA, 23 nt, Staphylococcus aureus subsp. aureus MW2
uaauuuaaaggcauaauaaccau

SEQ ID NO: 2084158 - RNA, 18 nt, Staphylococcus aureus subsp. aureus MW2
uaauugggucuuuaucaa

SEQ ID NO: 2084159 - RNA, 13 nt, Staphylococcus aureus subsp. aureus MW2
uacaacauacaug

SEQ ID NO: 2084160 - RNA, 20 nt, Staphylococcus aureus subsp. aureus MW2
uacaacaguaaucaugcauu

SEQ ID NO: 2084161 - RNA, 19 nt, Staphylococcus aureus subsp. aureus MW2
uacaaagccuuaauaucau

SEQ ID NO: 2084162 - RNA, 22 nt, Staphylococcus aureus subsp. aureus MW2
uacaaagucauuuucauucagu

SEQ ID NO: 2084163 - RNA, 18 nt, Staphylococcus aureus subsp. aureus MW2
uacaaagcacaccuaauu

SEQ ID NO: 2084164 - RNA, 19 nt, Staphylococcus aureus subsp. aureus MW2
uacaaacuucacauuaugu

SEQ ID NO: 2084165 - RNA, 14 nt, Staphylococcus aureus subsp. aureus MW2
uaagacauaugcag

SEQ ID NO: 2084166 - RNA, 16 nt, Staphylococcus aureus subsp. aureus MW2
uaagaugacugaacca

SEQ ID NO: 2084167 - RNA, 17 nt, Staphylococcus aureus subsp. aureus MW2
uaagcauuaauguucaa

SEQ ID NO: 2084168 - RNA, 22 nt, Staphylococcus aureus subsp. aureus MW2
uaagcaguugguggaugucaug

SEQ ID NO: 2084169 - RNA, 15 nt, Staphylococcus aureus subsp. aureus MW2
uaauaaaucauuagu

SEQ ID NO: 2084170 - RNA, 20 nt, Staphylococcus aureus subsp. aureus MW2
uaauaaacgcuucauaguca

SEQ ID NO: 2084171 - RNA, 23 nt, Staphylococcus aureus subsp. aureus MW2
uaauaaagaauaaacaacauaca

SEQ ID NO: 2084172 - RNA, 17 nt, Staphylococcus aureus subsp. aureus MW2
uaauauuuauuaccuua

SEQ ID NO: 2084173 - RNA, 12 nt, Staphylococcus aureus subsp. aureus MW2
uaauauugaaua

SEQ ID NO: 2084174 - RNA, 14 nt, Staphylococcus aureus subsp. aureus MW2
uaauaugagugaaa

SEQ ID NO: 2084175 - RNA, 21 nt, Staphylococcus aureus subsp. aureus MW2
uaauaugagugaaaguuugaa

SEQ ID NO: 2084176 - RNA, 13 nt, Staphylococcus aureus subsp. aureus MW2
uaauaugaauuug

SEQ ID NO: 2084177 - RNA, 20 nt, Staphylococcus aureus subsp. aureus MW2
uaauaccuuuacuuucauua

SEQ ID NO: 2084178 - RNA, 13 nt, Staphylococcus aureus subsp. aureus MW2
uaauaccaucauc

SEQ ID NO: 2084179 - RNA, 15 nt, Staphylococcus aureus subsp. aureus MW2
uaaucuggguuguaa

SEQ ID NO: 2084180 - RNA, 12 nt, Staphylococcus aureus subsp. aureus MW2
uaaucuuauucg

SEQ ID NO: 2084181 - RNA, 22 nt, Staphylococcus aureus subsp. aureus MW2
uaaucuaaaaauagauguacaa

SEQ ID NO: 2084182 - RNA, 15 nt, Staphylococcus aureus subsp. aureus MW2
uaacaucugaaucug

SEQ ID NO: 2084183 - RNA, 14 nt, Staphylococcus aureus subsp. aureus MW2
uaaauauugauaua

SEQ ID NO: 2084184 - RNA, 16 nt, Staphylococcus aureus subsp. aureus MW2
uaaaucaaacuuuuca

SEQ ID NO: 2084185 - RNA, 22 nt, Staphylococcus aureus subsp. aureus MW2
uaaauuauuuauucauuauagu

SEQ ID NO: 2084186 - RNA, 14 nt, Staphylococcus aureus subsp. aureus MW2
uaaccuacuuugau

SEQ ID NO: 2084187 - RNA, 18 nt, Staphylococcus aureus subsp. aureus MW2
uaacuuuaaaaauuaagu

SEQ ID NO: 2084188 - RNA, 14 nt, Staphylococcus aureus subsp. aureus MW2
uaaacaaguugaua

SEQ ID NO: 2084189 - RNA, 13 nt, Staphylococcus aureus subsp. aureus MW2
uaaacgaucaacu

SEQ ID NO: 2084190 - RNA, 16 nt, Staphylococcus aureus subsp. aureus MW2
uaaagcauaucucaag

SEQ ID NO: 2084191 - RNA, 15 nt, Staphylococcus aureus subsp. aureus MW2
uaaagcuaaugcaag

SEQ ID NO: 2084192 - RNA, 18 nt, Staphylococcus aureus subsp. aureus MW2
uaaagcugcgauauaacu

SEQ ID NO: 2084193 - RNA, 12 nt, Staphylococcus aureus subsp. aureus MW2
uaaauaucaugc

SEQ ID NO: 2084194 - RNA, 19 nt, Staphylococcus aureus subsp. aureus MW2
uaaauauaaaccagcugau

SEQ ID NO: 2084195 - RNA, 22 nt, Staphylococcus aureus subsp. aureus MW2
uaaaaugcuuuuuugaaauggu

SEQ ID NO: 2084196 - RNA, 12 nt, Staphylococcus aureus subsp. aureus MW2
uaaaaugcauag

SEQ ID NO: 2084197 - RNA, 17 nt, Staphylococcus aureus subsp. aureus MW2
uaaaaugcucccuucaa

SEQ ID NO: 2084198 - RNA, 16 nt, Staphylococcus aureus subsp. aureus MW2
uaaaacuuacauuaca

SEQ ID NO: 2084199 - RNA, 23 nt, Staphylococcus aureus subsp. aureus MW2
uaaaaacaaagguuuguaagaca

SEQ ID NO: 2084200 - RNA, 19 nt, Staphylococcus aureus subsp. aureus MW2
uaaaaaaauacucccuuca

SEQ ID NO: 2084201 - RNA, 20 nt, Staphylococcus aureus subsp. aureus MW2
uaaaaaaauacucccuucaa

SEQ ID NO: 2084202 - RNA, 12 nt, Staphylococcus aureus subsp. aureus MW2
gucuaacaguua

SEQ ID NO: 2084203 - RNA, 22 nt, Staphylococcus aureus subsp. aureus MW2
gugaaauaaucccaaccauucu

SEQ ID NO: 2084204 - RNA, 21 nt, Staphylococcus aureus subsp. aureus MW2
gucgccuaacuuuuauuauca

SEQ ID NO: 2084205 - RNA, 14 nt, Staphylococcus aureus subsp. aureus MW2
gucaccuucuauau

SEQ ID NO: 2084206 - RNA, 17 nt, Staphylococcus aureus subsp. aureus MW2
guaauagcaaccauauu

SEQ ID NO: 2084207 - RNA, 21 nt, Staphylococcus aureus subsp. aureus MW2
guaauacaagcaauacgauug

SEQ ID NO: 2084208 - RNA, 19 nt, Staphylococcus aureus subsp. aureus MW2
guaauauuuuuguugcaau

SEQ ID NO: 2084209 - RNA, 20 nt, Staphylococcus aureus subsp. aureus MW2
guaaaaaaagacaugagauu

SEQ ID NO: 2084210 - RNA, 17 nt, Staphylococcus aureus subsp. aureus MW2
guaaaauauacuugaag

SEQ ID NO: 2084211 - RNA, 23 nt, Staphylococcus aureus subsp. aureus MW2
guaacaucuguagguuuaauguu

SEQ ID NO: 2084212 - RNA, 20 nt, Staphylococcus aureus subsp. aureus MW2
ggccuacuuuuucaauaugu

SEQ ID NO: 2084213 - RNA, 18 nt, Staphylococcus aureus subsp. aureus MW2
ggggugggacgacgaaau

SEQ ID NO: 2084214 - RNA, 17 nt, Staphylococcus aureus subsp. aureus MW2
gggagugggacagaaau

SEQ ID NO: 2084215 - RNA, 22 nt, Staphylococcus aureus subsp. aureus MW2
gcgauucaaucuaaucuuaauu

SEQ ID NO: 2084216 - RNA, 20 nt, Staphylococcus aureus subsp. aureus MW2
gcgcauucucauucagucaa

SEQ ID NO: 2084217 - RNA, 18 nt, Staphylococcus aureus subsp. aureus MW2
gcuagaaguucuuaugca

SEQ ID NO: 2084218 - RNA, 22 nt, Staphylococcus aureus subsp. aureus MW2
gcucaagacauuacaucuuuaa

SEQ ID NO: 2084219 - RNA, 20 nt, Staphylococcus aureus subsp. aureus MW2
gcuuuuuucaauucuaguca

SEQ ID NO: 2084220 - RNA, 19 nt, Staphylococcus aureus subsp. aureus MW2
gcuuuuaugcaugcgcaaa

SEQ ID NO: 2084221 - RNA, 16 nt, Staphylococcus aureus subsp. aureus MW2
ugacacuaauuugagu

SEQ ID NO: 2084222 - RNA, 14 nt, Staphylococcus aureus subsp. aureus MW2
ugaauuaauaucca

SEQ ID NO: 2084223 - RNA, 11 nt, Staphylococcus aureus subsp. aureus MW2
ugaaucgcauu

SEQ ID NO: 2084224 - RNA, 17 nt, Staphylococcus aureus subsp. aureus MW2
ugaaugauugcauugau

SEQ ID NO: 2084225 - RNA, 14 nt, Staphylococcus aureus subsp. aureus MW2
ugaacgguagaaua

SEQ ID NO: 2084226 - RNA, 15 nt, Staphylococcus aureus subsp. aureus MW2
ugaaguaaugugcau

SEQ ID NO: 2084227 - RNA, 17 nt, Staphylococcus aureus subsp. aureus MW2
ugaaguaaaaagcguaa

SEQ ID NO: 2084228 - RNA, 23 nt, Staphylococcus aureus subsp. aureus MW2
ucuuguucuccgaucaugccuuc

SEQ ID NO: 2084229 - RNA, 23 nt, Staphylococcus aureus subsp. aureus MW2
ucuuuaaccaaaauugaugacuu

SEQ ID NO: 2084230 - RNA, 16 nt, Staphylococcus aureus subsp. aureus MW2
ucuuuagaugagauuu

SEQ ID NO: 2084231 - RNA, 16 nt, Staphylococcus aureus subsp. aureus MW2
ucuuuacggucgaauu

SEQ ID NO: 2084232 - RNA, 15 nt, Staphylococcus aureus subsp. aureus MW2
ucuuuauuaugcuga

SEQ ID NO: 2084233 - RNA, 16 nt, Staphylococcus aureus subsp. aureus MW2
ucuuuuuguuguuuua

SEQ ID NO: 2084234 - RNA, 12 nt, Staphylococcus aureus subsp. aureus MW2
ucuuuuguuuua

SEQ ID NO: 2084235 - RNA, 12 nt, Staphylococcus aureus subsp. aureus MW2
ucuuguaauguu

SEQ ID NO: 2084236 - RNA, 16 nt, Staphylococcus aureus subsp. aureus MW2
ucuugugaguuaacca

SEQ ID NO: 2084237 - RNA, 19 nt, Staphylococcus aureus subsp. aureus MW2
ucuugaaauaaacauauca

SEQ ID NO: 2084238 - RNA, 21 nt, Staphylococcus aureus subsp. aureus MW2
aauacuaagauuagcuaugaa

SEQ ID NO: 2084239 - RNA, 19 nt, Staphylococcus aureus subsp. aureus MW2
aauacuaagauuagcuaug

SEQ ID NO: 2084240 - RNA, 20 nt, Staphylococcus aureus subsp. aureus MW2
ucugugaccaauagaauuca

SEQ ID NO: 2084241 - RNA, 16 nt, Staphylococcus aureus subsp. aureus MW2
ucugucuaaaaacaua

SEQ ID NO: 2084242 - RNA, 21 nt, Staphylococcus aureus subsp. aureus MW2
aauacuguauuuuagcgucau

SEQ ID NO: 2084243 - RNA, 15 nt, Staphylococcus aureus subsp. aureus MW2
aauagaaauaaucac

SEQ ID NO: 2084244 - RNA, 18 nt, Staphylococcus aureus subsp. aureus MW2
ucugcggauuaucuaacu

SEQ ID NO: 2084245 - RNA, 18 nt, Staphylococcus aureus subsp. aureus MW2
ucuaauacuuucacuuuu

SEQ ID NO: 2084246 - RNA, 14 nt, Staphylococcus aureus subsp. aureus MW2
ucuacgaaguuaua

SEQ ID NO: 2084247 - RNA, 20 nt, Staphylococcus aureus subsp. aureus MW2
ucuagcguagcgaaaguauc

SEQ ID NO: 2084248 - RNA, 22 nt, Staphylococcus aureus subsp. aureus MW2
ucuauauaaaaacuguucauac

SEQ ID NO: 2084249 - RNA, 19 nt, Staphylococcus aureus subsp. aureus MW2
ucuauaucgucgauuucau

SEQ ID NO: 2084250 - RNA, 15 nt, Staphylococcus aureus subsp. aureus MW2
ucuauauaaauguuu

SEQ ID NO: 2084251 - RNA, 17 nt, Staphylococcus aureus subsp. aureus MW2
ucuaugguuauggugug

SEQ ID NO: 2084252 - RNA, 22 nt, Staphylococcus aureus subsp. aureus MW2
ucuaugucucggggcagaucau

SEQ ID NO: 2084253 - RNA, 19 nt, Staphylococcus aureus subsp. aureus MW2
ucuccaacucuaacagcuu

SEQ ID NO: 2084254 - RNA, 18 nt, Staphylococcus aureus subsp. aureus MW2
ugcaugaugaacuuaaug

SEQ ID NO: 2084255 - RNA, 21 nt, Staphylococcus aureus subsp. aureus MW2
ugccaccguggaauuuaccau

SEQ ID NO: 2084256 - RNA, 20 nt, Staphylococcus aureus subsp. aureus MW2
ugacuuuaaaucuuguucua

SEQ ID NO: 2084257 - RNA, 14 nt, Staphylococcus aureus subsp. aureus MW2
ugacuuuauuucua

SEQ ID NO: 2084258 - RNA, 18 nt, Staphylococcus aureus subsp. aureus MW2
ugacguauuacacgcauu

SEQ ID NO: 2084259 - RNA, 18 nt, Staphylococcus aureus subsp. aureus MW2
ugauagcuaaugcauuau

SEQ ID NO: 2084260 - RNA, 22 nt, Staphylococcus aureus subsp. aureus MW2
ugcaaauuaucauuaaauugcu

SEQ ID NO: 2084261 - RNA, 20 nt, Staphylococcus aureus subsp. aureus MW2
ugauuuggguaauguuuuua

SEQ ID NO: 2084262 - RNA, 14 nt, Staphylococcus aureus subsp. aureus MW2
ugauuuguuugauu

SEQ ID NO: 2084263 - RNA, 13 nt, Staphylococcus aureus subsp. aureus MW2
ugauuucuaucaa

SEQ ID NO: 2084264 - RNA, 21 nt, Staphylococcus aureus subsp. aureus MW2
ugcaaguauagaccauccauu

SEQ ID NO: 2084265 - RNA, 23 nt, Staphylococcus aureus subsp. aureus MW2
ugcaauaccuccccaacuuaaua

SEQ ID NO: 2084266 - RNA, 14 nt, Staphylococcus aureus subsp. aureus MW2
ugcaauugccuuau

SEQ ID NO: 2084267 - RNA, 20 nt, Staphylococcus aureus subsp. aureus MW2
ugaugauauucauauaucaa

SEQ ID NO: 2084268 - RNA, 14 nt, Staphylococcus aureus subsp. aureus MW2
ugauucaauauagu

SEQ ID NO: 2084269 - RNA, 22 nt, Staphylococcus aureus subsp. aureus MW2
ugauuaaaguguuucaacauau

SEQ ID NO: 2084270 - RNA, 16 nt, Staphylococcus aureus subsp. aureus MW2
ugauuacaacuuauuc

SEQ ID NO: 2084271 - RNA, 16 nt, Staphylococcus aureus subsp. aureus MW2
ugauuaauaacauagu

SEQ ID NO: 2084272 - RNA, 22 nt, Staphylococcus aureus subsp. aureus MW2
ugauuuaagauuuaauaaagug

SEQ ID NO: 2084273 - RNA, 18 nt, Staphylococcus aureus subsp. aureus MW2
ugauucauuacaaccauu

SEQ ID NO: 2084274 - RNA, 18 nt, Staphylococcus aureus subsp. aureus MW2
uccucaguauuuaauguu

SEQ ID NO: 2084275 - RNA, 22 nt, Staphylococcus aureus subsp. aureus MW2
uccuaauguaauuauugcauca

SEQ ID NO: 2084276 - RNA, 20 nt, Staphylococcus aureus subsp. aureus MW2
ucgauauuucuaguugcaau

SEQ ID NO: 2084277 - RNA, 17 nt, Staphylococcus aureus subsp. aureus MW2
ucgauauuuguuucgua

SEQ ID NO: 2084278 - RNA, 15 nt, Staphylococcus aureus subsp. aureus MW2
ucgauucgauuauuu

SEQ ID NO: 2084279 - RNA, 14 nt, Staphylococcus aureus subsp. aureus MW2
ucgauucgugauuu

SEQ ID NO: 2084280 - RNA, 20 nt, Staphylococcus aureus subsp. aureus MW2
ucgaacaaucggaagcauau

SEQ ID NO: 2084281 - RNA, 18 nt, Staphylococcus aureus subsp. aureus MW2
ucgaacguuugaaaaauu

SEQ ID NO: 2084282 - RNA, 11 nt, Staphylococcus aureus subsp. aureus MW2
ucggaaacaug

SEQ ID NO: 2084283 - RNA, 16 nt, Staphylococcus aureus subsp. aureus MW2
uaggaccucuuauuua

SEQ ID NO: 2084284 - RNA, 21 nt, Staphylococcus aureus subsp. aureus MW2
uaggauuguuuuuaagucguu

SEQ ID NO: 2084285 - RNA, 20 nt, Staphylococcus aureus subsp. aureus MW2
uaggcgcuguuccaaauuca

SEQ ID NO: 2084286 - RNA, 17 nt, Staphylococcus aureus subsp. aureus MW2
aaguuugauagaugaua

SEQ ID NO: 2084287 - RNA, 14 nt, Staphylococcus aureus subsp. aureus MW2
aaguugcuuagcuu

SEQ ID NO: 2084288 - RNA, 12 nt, Staphylococcus aureus subsp. aureus MW2
uacuugaaaaua

SEQ ID NO: 2084289 - RNA, 21 nt, Staphylococcus aureus subsp. aureus MW2
uacugcugcuucggcaccuuu

SEQ ID NO: 2084290 - RNA, 13 nt, Staphylococcus aureus subsp. aureus MW2
uacugcuguugaa

SEQ ID NO: 2084291 - RNA, 15 nt, Staphylococcus aureus subsp. aureus MW2
uacugcuugugugaa

SEQ ID NO: 2084292 - RNA, 21 nt, Staphylococcus aureus subsp. aureus MW2
uagacaagaugcucaaugcau

SEQ ID NO: 2084293 - RNA, 18 nt, Staphylococcus aureus subsp. aureus MW2
uacuaaaaguguuaugaa

SEQ ID NO: 2084294 - RNA, 17 nt, Staphylococcus aureus subsp. aureus MW2
uacguuuaauaaugguu

SEQ ID NO: 2084295 - RNA, 13 nt, Staphylococcus aureus subsp. aureus MW2
uacguguguagua

SEQ ID NO: 2084296 - RNA, 21 nt, Staphylococcus aureus subsp. aureus MW2
uacguguguaguagcaccgau

SEQ ID NO: 2084297 - RNA, 22 nt, Staphylococcus aureus subsp. aureus MW2
uacuauaugaaaagagaaacaa

SEQ ID NO: 2084298 - RNA, 12 nt, Staphylococcus aureus subsp. aureus MW2
uacugaaacaug

SEQ ID NO: 2084299 - RNA, 23 nt, Staphylococcus aureus subsp. aureus MW2
uacgaauaucuguugcauuaagu

SEQ ID NO: 2084300 - RNA, 15 nt, Staphylococcus aureus subsp. aureus MW2
ucaacuuguuuccua

SEQ ID NO: 2084301 - RNA, 15 nt, Staphylococcus aureus subsp. aureus MW2
ucaagaaauucgcaa

SEQ ID NO: 2084302 - RNA, 16 nt, Staphylococcus aureus subsp. aureus MW2
ucaacuuuaguuguua

SEQ ID NO: 2084303 - RNA, 12 nt, Staphylococcus aureus subsp. aureus MW2
ucaaccauuugu

SEQ ID NO: 2084304 - RNA, 21 nt, Staphylococcus aureus subsp. aureus MW2
ucaaaguaucagucauugcaa

SEQ ID NO: 2084305 - RNA, 22 nt, Staphylococcus aureus subsp. aureus MW2
ucaaaguaucuuuugcaccuuc

SEQ ID NO: 2084306 - RNA, 18 nt, Staphylococcus aureus subsp. aureus MW2
ucaaagcgauaaaguaug

SEQ ID NO: 2084307 - RNA, 18 nt, Staphylococcus aureus subsp. aureus MW2
ucaaacauauucauucua

SEQ ID NO: 2084308 - RNA, 18 nt, Staphylococcus aureus subsp. aureus MW2
ucaaacgcaccuggcaca

SEQ ID NO: 2084309 - RNA, 16 nt, Staphylococcus aureus subsp. aureus MW2
uauugggacuuauucc

SEQ ID NO: 2084310 - RNA, 18 nt, Staphylococcus aureus subsp. aureus MW2
uauugcuuauguuuuuaa

SEQ ID NO: 2084311 - RNA, 21 nt, Staphylococcus aureus subsp. aureus MW2
uauugauagcaccguaacaua

SEQ ID NO: 2084312 - RNA, 13 nt, Staphylococcus aureus subsp. aureus MW2
uauugaugaucaa

SEQ ID NO: 2084313 - RNA, 12 nt, Staphylococcus aureus subsp. aureus MW2
ucaaguaacuca

SEQ ID NO: 2084314 - RNA, 14 nt, Staphylococcus aureus subsp. aureus MW2
ucaaguaaauguuu

SEQ ID NO: 2084315 - RNA, 14 nt, Staphylococcus aureus subsp. aureus MW2
ucaauaacaccuuu

SEQ ID NO: 2084316 - RNA, 14 nt, Staphylococcus aureus subsp. aureus MW2
ucaauacuuucagu

SEQ ID NO: 2084317 - RNA, 13 nt, Staphylococcus aureus subsp. aureus MW2
ucaauguaucaag

SEQ ID NO: 2084318 - RNA, 21 nt, Staphylococcus aureus subsp. aureus MW2
ucaauauaaccgugaugaugu

SEQ ID NO: 2084319 - RNA, 16 nt, Staphylococcus aureus subsp. aureus MW2
ucaauaucauucaugu

SEQ ID NO: 2084320 - RNA, 16 nt, Staphylococcus aureus subsp. aureus MW2
ucaauaugaaaccuuu

SEQ ID NO: 2084321 - RNA, 17 nt, Staphylococcus aureus subsp. aureus MW2
ucaaugacuuaacaucu

SEQ ID NO: 2084322 - RNA, 17 nt, Staphylococcus aureus subsp. aureus MW2
uauauucaucucuuaua

SEQ ID NO: 2084323 - RNA, 18 nt, Staphylococcus aureus subsp. aureus MW2
uaucgguaauuuuuguaa

SEQ ID NO: 2084324 - RNA, 19 nt, Staphylococcus aureus subsp. aureus MW2
uagguauaguguuugacaa

SEQ ID NO: 2084325 - RNA, 20 nt, Staphylococcus aureus subsp. aureus MW2
uauacacuuuuugacauauu

SEQ ID NO: 2084326 - RNA, 17 nt, Staphylococcus aureus subsp. aureus MW2
uauauuaguagaaaccu

SEQ ID NO: 2084327 - RNA, 19 nt, Staphylococcus aureus subsp. aureus MW2
uauauggcaucaucaccau

SEQ ID NO: 2084328 - RNA, 15 nt, Staphylococcus aureus subsp. aureus MW2
uauaucuuaugauac

SEQ ID NO: 2084329 - RNA, 17 nt, Staphylococcus aureus subsp. aureus MW2
uauauauuaucguaauu

SEQ ID NO: 2084330 - RNA, 18 nt, Staphylococcus aureus subsp. aureus MW2
uauagaagcugaacguaa

SEQ ID NO: 2084331 - RNA, 20 nt, Staphylococcus aureus subsp. aureus MW2
uauacugcccaauguguuua

SEQ ID NO: 2084332 - RNA, 21 nt, Staphylococcus aureus subsp. aureus MW2
uauaccucuuagcacuuggau

SEQ ID NO: 2084333 - RNA, 14 nt, Staphylococcus aureus subsp. aureus MW2
uauuauauugaauu

SEQ ID NO: 2084334 - RNA, 15 nt, Staphylococcus aureus subsp. aureus MW2
uauuauaauuguuca

SEQ ID NO: 2084335 - RNA, 13 nt, Staphylococcus aureus subsp. aureus MW2
uauuauguaccaa

SEQ ID NO: 2084336 - RNA, 20 nt, Staphylococcus aureus subsp. aureus MW2
uauuaauuugaauaccuaca

SEQ ID NO: 2084337 - RNA, 19 nt, Staphylococcus aureus subsp. aureus MW2
uauuacugauuguuaacga

SEQ ID NO: 2084338 - RNA, 15 nt, Staphylococcus aureus subsp. aureus MW2
uauuaaauuucaaau

SEQ ID NO: 2084339 - RNA, 21 nt, Staphylococcus aureus subsp. aureus MW2
uauuaaauagaugagaaagua

SEQ ID NO: 2084340 - RNA, 19 nt, Staphylococcus aureus subsp. aureus MW2
uaugcauauaagauaauuu

SEQ ID NO: 2084341 - RNA, 12 nt, Staphylococcus aureus subsp. aureus MW2
uaugauguucaa

SEQ ID NO: 2084342 - RNA, 16 nt, Staphylococcus aureus subsp. aureus MW2
uauguuuaauguauaa

SEQ ID NO: 2084343 - RNA, 14 nt, Staphylococcus aureus subsp. aureus MW2
uaugccaaaguaau

SEQ ID NO: 2084344 - RNA, 13 nt, Staphylococcus aureus subsp. aureus MW2
uaucguuguuuua

SEQ ID NO: 2084345 - RNA, 18 nt, Staphylococcus aureus subsp. aureus MW2
uaucugacauuguugcua

SEQ ID NO: 2084346 - RNA, 13 nt, Staphylococcus aureus subsp. aureus MW2
uaucuauaugcau

SEQ ID NO: 2084347 - RNA, 21 nt, Staphylococcus aureus subsp. aureus MW2
ucacuucuuaaaauaugauuu

SEQ ID NO: 2084348 - RNA, 16 nt, Staphylococcus aureus subsp. aureus MW2
ucacuucuuacugauc

SEQ ID NO: 2084349 - RNA, 20 nt, Staphylococcus aureus subsp. aureus MW2
ucacuuggcgacauuuguaa

SEQ ID NO: 2084350 - RNA, 14 nt, Staphylococcus aureus subsp. aureus MW2
aauaauaacgucac

SEQ ID NO: 2084351 - RNA, 17 nt, Staphylococcus aureus subsp. aureus MW2
aauaauacgcaauugau

SEQ ID NO: 2084352 - RNA, 15 nt, Staphylococcus aureus subsp. aureus MW2
aauaauagcaaaauu

SEQ ID NO: 2084353 - RNA, 13 nt, Staphylococcus aureus subsp. aureus MW2
aauaacucaguaa

SEQ ID NO: 2084354 - RNA, 18 nt, Staphylococcus aureus subsp. aureus MW2
aauaacuguuuaucauga

SEQ ID NO: 2084355 - RNA, 13 nt, Staphylococcus aureus subsp. aureus MW2
aauaacauugaac

SEQ ID NO: 2084356 - RNA, 23 nt, Staphylococcus aureus subsp. aureus MW2
aauaauuagauuuaaaaugucau

SEQ ID NO: 2084357 - RNA, 19 nt, Staphylococcus aureus subsp. aureus MW2
aauaauugcuuuagaaagu

SEQ ID NO: 2084358 - RNA, 17 nt, Staphylococcus aureus subsp. aureus MW2
uccaauuuaaaaugauu

SEQ ID NO: 2084359 - RNA, 16 nt, Staphylococcus aureus subsp. aureus MW2
uccauggcuuaaauca

SEQ ID NO: 2084360 - RNA, 19 nt, Staphylococcus aureus subsp. aureus MW2
uccauauaaccuauuucau

SEQ ID NO: 2084361 - RNA, 17 nt, Staphylococcus aureus subsp. aureus MW2
uccaucgucaucacuuu

SEQ ID NO: 2084362 - RNA, 16 nt, Staphylococcus aureus subsp. aureus MW2
uccaucuacacccauu

SEQ ID NO: 2084363 - RNA, 18 nt, Staphylococcus aureus subsp. aureus MW2
ucauaaacugaaucgauu

SEQ ID NO: 2084364 - RNA, 15 nt, Staphylococcus aureus subsp. aureus MW2
ucauacauaugcuau

SEQ ID NO: 2084365 - RNA, 18 nt, Staphylococcus aureus subsp. aureus MW2
ucauacgagaaauuagaa

SEQ ID NO: 2084366 - RNA, 18 nt, Staphylococcus aureus subsp. aureus MW2
ucauauaaguaagcguaa

SEQ ID NO: 2084367 - RNA, 15 nt, Staphylococcus aureus subsp. aureus MW2
ucauaguuaucgauu

SEQ ID NO: 2084368 - RNA, 21 nt, Staphylococcus aureus subsp. aureus MW2
ucauauauugacucgaccuuu

SEQ ID NO: 2084369 - RNA, 22 nt, Staphylococcus aureus subsp. aureus MW2
ucaucacucgcaaucgagaugu

SEQ ID NO: 2084370 - RNA, 20 nt, Staphylococcus aureus subsp. aureus MW2
ucauagaugacgaucuauaa

SEQ ID NO: 2084371 - RNA, 17 nt, Staphylococcus aureus subsp. aureus MW2
ucauacuucaaacguua

SEQ ID NO: 2084372 - RNA, 14 nt, Staphylococcus aureus subsp. aureus MW2
ucauaguguuugua

SEQ ID NO: 2084373 - RNA, 13 nt, Staphylococcus aureus subsp. aureus MW2
ucaucuauucaaa

SEQ ID NO: 2084374 - RNA, 16 nt, Staphylococcus aureus subsp. aureus MW2
ucaucguucauauauu

SEQ ID NO: 2084375 - RNA, 20 nt, Staphylococcus aureus subsp. aureus MW2
ucaucaugauuacuaauaca

SEQ ID NO: 2084376 - RNA, 20 nt, Staphylococcus aureus subsp. aureus MW2
ucaucuucuucaaaacguuu

SEQ ID NO: 2084377 - RNA, 20 nt, Staphylococcus aureus subsp. aureus MW2
ucaucuuagacgcuguuuua

SEQ ID NO: 2084378 - RNA, 12 nt, Staphylococcus aureus subsp. aureus MW2
ucauguuugauu

SEQ ID NO: 2084379 - RNA, 15 nt, Staphylococcus aureus subsp. aureus MW2
ucauuaucauuaagu

SEQ ID NO: 2084380 - RNA, 19 nt, Staphylococcus aureus subsp. aureus MW2
ucauucauguucgaugauu

SEQ ID NO: 2084381 - RNA, 22 nt, Staphylococcus aureus subsp. aureus MW2
ucauuucaauauuaaaauacgg

SEQ ID NO: 2084382 - RNA, 13 nt, Staphylococcus aureus subsp. aureus MW2
ucauugaugaugu

SEQ ID NO: 2084383 - RNA, 16 nt, Staphylococcus aureus subsp. aureus MW2
ucauugcguaacauca

SEQ ID NO: 2084384 - RNA, 13 nt, Staphylococcus aureus subsp. aureus MW2
ucauugaucgauu

SEQ ID NO: 2084385 - RNA, 18 nt, Staphylococcus aureus subsp. aureus MW2
ucauuggcaauauacuuu

SEQ ID NO: 2084386 - RNA, 16 nt, Staphylococcus aureus subsp. aureus MW2
ucauuuuuucaauagu

SEQ ID NO: 2084387 - RNA, 14 nt, Staphylococcus aureus subsp. aureus MW2
uccaauaaacguug

SEQ ID NO: 2084388 - RNA, 20 nt, Staphylococcus aureus subsp. aureus MW2
uaaaccacgcacaucuaagu

SEQ ID NO: 2084389 - RNA, 12 nt, Staphylococcus aureus subsp. aureus MW2
uaacauuagcau

SEQ ID NO: 2084390 - RNA, 18 nt, Staphylococcus aureus subsp. aureus MW2
uaaccaugccagcuucua

SEQ ID NO: 2084391 - RNA, 13 nt, Staphylococcus aureus subsp. aureus MW2
uaaccacaucauu

SEQ ID NO: 2084392 - RNA, 15 nt, Staphylococcus aureus subsp. aureus MW2
uaacuacacuuaaua

SEQ ID NO: 2084393 - RNA, 15 nt, Staphylococcus aureus subsp. aureus MW2
uaacguucacuuggu

SEQ ID NO: 2084394 - RNA, 19 nt, Staphylococcus aureus subsp. aureus MW2
uaacugcgccaguuucuaa

SEQ ID NO: 2084395 - RNA, 16 nt, Staphylococcus aureus subsp. aureus MW2
uaacugcgugaauguu

SEQ ID NO: 2084396 - RNA, 18 nt, Staphylococcus aureus subsp. aureus MW2
uaacuauaaucauuaagu

SEQ ID NO: 2084397 - RNA, 20 nt, Staphylococcus aureus subsp. aureus MW2
uaacuugaacagauucaccu

SEQ ID NO: 2084398 - RNA, 15 nt, Staphylococcus aureus subsp. aureus MW2
uaacuugauuuucua

SEQ ID NO: 2084399 - RNA, 19 nt, Staphylococcus aureus subsp. aureus MW2
uaagucuaauguuggaaaa

SEQ ID NO: 2084400 - RNA, 18 nt, Staphylococcus aureus subsp. aureus MW2
uaauaugagugaaaguuu

SEQ ID NO: 2084401 - RNA, 17 nt, Staphylococcus aureus subsp. aureus MW2
uaaucaauguucuaggc

SEQ ID NO: 2084402 - RNA, 22 nt, Staphylococcus aureus subsp. aureus MW2
uaaucaagaauauaaaugauuu

SEQ ID NO: 2084403 - RNA, 15 nt, Staphylococcus aureus subsp. aureus MW2
uaauagacauuaacu

SEQ ID NO: 2084404 - RNA, 22 nt, Staphylococcus aureus subsp. aureus MW2
uaauugaugaugaugugcuuua

SEQ ID NO: 2084405 - RNA, 23 nt, Staphylococcus aureus subsp. aureus MW2
uaauugauacggaucauaaucau

SEQ ID NO: 2084406 - RNA, 19 nt, Staphylococcus aureus subsp. aureus MW2
uaauugggucuuuaucaag

SEQ ID NO: 2084407 - RNA, 22 nt, Staphylococcus aureus subsp. aureus MW2
uaauuaaauauaaagacgauuu

SEQ ID NO: 2084408 - RNA, 23 nt, Staphylococcus aureus subsp. aureus MW2
uaauuuagaagauuagaugauau

SEQ ID NO: 2084409 - RNA, 15 nt, Staphylococcus aureus subsp. aureus MW2
uaauuuaucuuaauc

SEQ ID NO: 2084410 - RNA, 14 nt, Staphylococcus aureus subsp. aureus MW2
uaauuguugcauua

SEQ ID NO: 2084411 - RNA, 15 nt, Staphylococcus aureus subsp. aureus MW2
uaauuguugcauuac

SEQ ID NO: 2084412 - RNA, 19 nt, Staphylococcus aureus subsp. aureus MW2
uaaucagugaaauaucaag

SEQ ID NO: 2084413 - RNA, 13 nt, Staphylococcus aureus subsp. aureus MW2
uaaucaugaaguu

SEQ ID NO: 2084414 - RNA, 13 nt, Staphylococcus aureus subsp. aureus MW2
uaaugucuuacuu

SEQ ID NO: 2084415 - RNA, 16 nt, Staphylococcus aureus subsp. aureus MW2
uaauguacauguauaa

SEQ ID NO: 2084416 - RNA, 20 nt, Staphylococcus aureus subsp. aureus MW2
uaauguacacuuuugauugu

SEQ ID NO: 2084417 - RNA, 22 nt, Staphylococcus aureus subsp. aureus MW2
uaaugugcgucacucacuucaa

SEQ ID NO: 2084418 - RNA, 23 nt, Staphylococcus aureus subsp. aureus MW2
uaaugucuucauaaucguauuca

SEQ ID NO: 2084419 - RNA, 15 nt, Staphylococcus aureus subsp. aureus MW2
uacaauaaugugcaa

SEQ ID NO: 2084420 - RNA, 21 nt, Staphylococcus aureus subsp. aureus MW2
uacaaguugaucaaaaauguu

SEQ ID NO: 2084421 - RNA, 13 nt, Staphylococcus aureus subsp. aureus MW2
uacaaucauuagu

SEQ ID NO: 2084422 - RNA, 14 nt, Staphylococcus aureus subsp. aureus MW2
uacaaugcugauac

SEQ ID NO: 2084423 - RNA, 20 nt, Staphylococcus aureus subsp. aureus MW2
uacauaauuuaucaauuucu

SEQ ID NO: 2084424 - RNA, 22 nt, Staphylococcus aureus subsp. aureus MW2
uacacuaaaaccuauuccuaau

SEQ ID NO: 2084425 - RNA, 13 nt, Staphylococcus aureus subsp. aureus MW2
uaccaauuagcau

SEQ ID NO: 2084426 - RNA, 14 nt, Staphylococcus aureus subsp. aureus MW2
uacauuucuguaua

SEQ ID NO: 2084427 - RNA, 16 nt, Staphylococcus aureus subsp. aureus MW2
uacauuuugaaacauc

SEQ ID NO: 2084428 - RNA, 18 nt, Staphylococcus aureus subsp. aureus MW2
uaccaacucgcuauaugu

SEQ ID NO: 2084429 - RNA, 23 nt, Staphylococcus aureus subsp. aureus MW2
uacauaacacaaguuaagugucu

SEQ ID NO: 2084430 - RNA, 13 nt, Staphylococcus aureus subsp. aureus MW2
uacaucaauuucu

SEQ ID NO: 2084431 - RNA, 18 nt, Staphylococcus aureus subsp. aureus MW2
uacaucguugccauuagu

SEQ ID NO: 2084432 - RNA, 17 nt, Staphylococcus aureus subsp. aureus MW2
uacaucaacaucgaauu

SEQ ID NO: 2084433 - RNA, 19 nt, Staphylococcus aureus subsp. aureus MW2
uacaugacauucauuuagu

SEQ ID NO: 2084434 - RNA, 21 nt, Staphylococcus aureus subsp. aureus MW2
uacaucuuuaagcucuuaauc

SEQ ID NO: 2084435 - RNA, 17 nt, Staphylococcus aureus subsp. aureus MW2
guucuuuuugaugauca

SEQ ID NO: 2084436 - RNA, 22 nt, Staphylococcus aureus subsp. aureus MW2
uaaaaagagguuuucauuaagu

SEQ ID NO: 2084437 - RNA, 19 nt, Staphylococcus aureus subsp. aureus MW2
uaaaaagaagaucccucaa

SEQ ID NO: 2084438 - RNA, 20 nt, Staphylococcus aureus subsp. aureus MW2
uaaaauauuaggugaaacca

SEQ ID NO: 2084439 - RNA, 18 nt, Staphylococcus aureus subsp. aureus MW2
uaaaauccuaagcaucgu

SEQ ID NO: 2084440 - RNA, 16 nt, Staphylococcus aureus subsp. aureus MW2
uaaaaugcucccuuca

SEQ ID NO: 2084441 - RNA, 15 nt, Staphylococcus aureus subsp. aureus MW2
uaaaacauguugaua

SEQ ID NO: 2084442 - RNA, 19 nt, Staphylococcus aureus subsp. aureus MW2
guuuuagaauaguuaccaa

SEQ ID NO: 2084443 - RNA, 17 nt, Staphylococcus aureus subsp. aureus MW2
guuuguucgacggauug

SEQ ID NO: 2084444 - RNA, 22 nt, Staphylococcus aureus subsp. aureus MW2
guuuuaccccuguugaauauac

SEQ ID NO: 2084445 - RNA, 14 nt, Staphylococcus aureus subsp. aureus MW2
guuugcauauccuu

SEQ ID NO: 2084446 - RNA, 14 nt, Staphylococcus aureus subsp. aureus MW2
guuuuaaucuuauu

SEQ ID NO: 2084447 - RNA, 17 nt, Staphylococcus aureus subsp. aureus MW2
guucauuggcaauauac

SEQ ID NO: 2084448 - RNA, 23 nt, Staphylococcus aureus subsp. aureus MW2
guuaguacggcugcuuuaacugu

SEQ ID NO: 2084449 - RNA, 18 nt, Staphylococcus aureus subsp. aureus MW2
ugguuagaaaaaaaucug

SEQ ID NO: 2084450 - RNA, 13 nt, Staphylococcus aureus subsp. aureus MW2
aaucaacuucaua

SEQ ID NO: 2084451 - RNA, 16 nt, Staphylococcus aureus subsp. aureus MW2
aauauuuuuugauauu

SEQ ID NO: 2084452 - RNA, 18 nt, Staphylococcus aureus subsp. aureus MW2
aauauuuuuuucaagaua

SEQ ID NO: 2084453 - RNA, 22 nt, Staphylococcus aureus subsp. aureus MW2
aaucaaagauuuauaaauguuu

SEQ ID NO: 2084454 - RNA, 16 nt, Staphylococcus aureus subsp. aureus MW2
uguccauaguaaucga

SEQ ID NO: 2084455 - RNA, 17 nt, Staphylococcus aureus subsp. aureus MW2
uguaacaauuuagcaaa

SEQ ID NO: 2084456 - RNA, 23 nt, Staphylococcus aureus subsp. aureus MW2
uguaacacacuuauaaucuauaa

SEQ ID NO: 2084457 - RNA, 23 nt, Staphylococcus aureus subsp. aureus MW2
aaucaauuuaucgagaacaucau

SEQ ID NO: 2084458 - RNA, 14 nt, Staphylococcus aureus subsp. aureus MW2
uguaacguacaauu

SEQ ID NO: 2084459 - RNA, 23 nt, Staphylococcus aureus subsp. aureus MW2
uguauguaagcagacuaaaagug

SEQ ID NO: 2084460 - RNA, 18 nt, Staphylococcus aureus subsp. aureus MW2
uguauguuuuaucaauau

SEQ ID NO: 2084461 - RNA, 16 nt, Staphylococcus aureus subsp. aureus MW2
uguauaguaacgcaua

SEQ ID NO: 2084462 - RNA, 20 nt, Staphylococcus aureus subsp. aureus MW2
uguauaguaacgcauaugau

SEQ ID NO: 2084463 - RNA, 16 nt, Staphylococcus aureus subsp. aureus MW2
uguauuaaucaaauau

SEQ ID NO: 2084464 - RNA, 18 nt, Staphylococcus aureus subsp. aureus MW2
uguauucaacugcguuau

SEQ ID NO: 2084465 - RNA, 13 nt, Staphylococcus aureus subsp. aureus MW2
ugucauaauccau

SEQ ID NO: 2084466 - RNA, 22 nt, Staphylococcus aureus subsp. aureus MW2
aauagacugacacaguaauucu

SEQ ID NO: 2084467 - RNA, 12 nt, Staphylococcus aureus subsp. aureus MW2
aauaguucaaau

SEQ ID NO: 2084468 - RNA, 15 nt, Staphylococcus aureus subsp. aureus MW2
ugcgacauguccaua

SEQ ID NO: 2084469 - RNA, 15 nt, Staphylococcus aureus subsp. aureus MW2
uggcaacguucuacu

SEQ ID NO: 2084470 - RNA, 24 nt, Staphylococcus aureus subsp. aureus MW2
uggauuaaauacgccaaauacuag

SEQ ID NO: 2084471 - RNA, 19 nt, Staphylococcus aureus subsp. aureus MW2
uggauaugcguauauguau

SEQ ID NO: 2084472 - RNA, 13 nt, Staphylococcus aureus subsp. aureus MW2
uggauaauugcau

SEQ ID NO: 2084473 - RNA, 13 nt, Staphylococcus aureus subsp. aureus MW2
ugcuacaauuucc

SEQ ID NO: 2084474 - RNA, 17 nt, Staphylococcus aureus subsp. aureus MW2
ugcuacaccaccugcag

SEQ ID NO: 2084475 - RNA, 16 nt, Staphylococcus aureus subsp. aureus MW2
ugcuaauuuaacugcg

SEQ ID NO: 2084476 - RNA, 18 nt, Staphylococcus aureus subsp. aureus MW2
ugcuaauauuuauagcau

SEQ ID NO: 2084477 - RNA, 15 nt, Staphylococcus aureus subsp. aureus MW2
ugcuaaugcuaguaa

SEQ ID NO: 2084478 - RNA, 15 nt, Staphylococcus aureus subsp. aureus MW2
ugcucuauauaucca

SEQ ID NO: 2084479 - RNA, 17 nt, Staphylococcus aureus subsp. aureus MW2
ugcucuaagcauucagu

SEQ ID NO: 2084480 - RNA, 22 nt, Staphylococcus aureus subsp. aureus MW2
uuuuaaaaaacauaccugcaua

SEQ ID NO: 2084481 - RNA, 20 nt, Staphylococcus aureus subsp. aureus MW2
uuuuaaaauauuaaucaauu

SEQ ID NO: 2084482 - RNA, 15 nt, Staphylococcus aureus subsp. aureus MW2
uuuuaaauucuuaua

SEQ ID NO: 2084483 - RNA, 12 nt, Staphylococcus aureus subsp. aureus MW2
uuuuaaaguaac

SEQ ID NO: 2084484 - RNA, 15 nt, Staphylococcus aureus subsp. aureus MW2
uuuuaacagcugcag

SEQ ID NO: 2084485 - RNA, 20 nt, Staphylococcus aureus subsp. aureus MW2
uuuuauuauugucaucaugu

SEQ ID NO: 2084486 - RNA, 23 nt, Staphylococcus aureus subsp. aureus MW2
uuuuauucgauaauauaacugca

SEQ ID NO: 2084487 - RNA, 17 nt, Staphylococcus aureus subsp. aureus MW2
uuuuauuaaaucguaua

SEQ ID NO: 2084488 - RNA, 13 nt, Staphylococcus aureus subsp. aureus MW2
uuuuauucuguaa

SEQ ID NO: 2084489 - RNA, 23 nt, Staphylococcus aureus subsp. aureus MW2
uuuucaaaaauuguuaaucccgu

SEQ ID NO: 2084490 - RNA, 14 nt, Staphylococcus aureus subsp. aureus MW2
uuuuauauauccug

SEQ ID NO: 2084491 - RNA, 19 nt, Staphylococcus aureus subsp. aureus MW2
uuucuaguuuaacauuacu

SEQ ID NO: 2084492 - RNA, 20 nt, Staphylococcus aureus subsp. aureus MW2
uuucgucuuguaaacuucuu

SEQ ID NO: 2084493 - RNA, 20 nt, Staphylococcus aureus subsp. aureus MW2
uuucguuagacucacuucuu

SEQ ID NO: 2084494 - RNA, 19 nt, Staphylococcus aureus subsp. aureus MW2
uuucucaaacuaucuuaua

SEQ ID NO: 2084495 - RNA, 15 nt, Staphylococcus aureus subsp. aureus MW2
uuucucaaugugaga

SEQ ID NO: 2084496 - RNA, 16 nt, Staphylococcus aureus subsp. aureus MW2
uuuguugcucagugca

SEQ ID NO: 2084497 - RNA, 14 nt, Staphylococcus aureus subsp. aureus MW2
uuuucuauggcaca

SEQ ID NO: 2084498 - RNA, 22 nt, Staphylococcus aureus subsp. aureus MW2
uuuucuagguaauacgaaugca

SEQ ID NO: 2084499 - RNA, 13 nt, Staphylococcus aureus subsp. aureus MW2
uuuugaaauggua

SEQ ID NO: 2084500 - RNA, 18 nt, Staphylococcus aureus subsp. aureus MW2
uuuugaguccauucgacu

SEQ ID NO: 2084501 - RNA, 16 nt, Staphylococcus aureus subsp. aureus MW2
uuuugaucuaaaguac

SEQ ID NO: 2084502 - RNA, 21 nt, Staphylococcus aureus subsp. aureus MW2
uuuucaugugucauaauccau

SEQ ID NO: 2084503 - RNA, 17 nt, Staphylococcus aureus subsp. aureus MW2
aaucuucuaguaauucu

SEQ ID NO: 2084504 - RNA, 21 nt, Staphylococcus aureus subsp. aureus MW2
aaucuuucuagacguauucaa

SEQ ID NO: 2084505 - RNA, 20 nt, Staphylococcus aureus subsp. aureus MW2
aaugauuucuucauuaucaa

SEQ ID NO: 2084506 - RNA, 13 nt, Staphylococcus aureus subsp. aureus MW2
aaucuguaaugca

SEQ ID NO: 2084507 - RNA, 23 nt, Staphylococcus aureus subsp. aureus MW2
aaucugcuugugugucauuacca

SEQ ID NO: 2084508 - RNA, 19 nt, Staphylococcus aureus subsp. aureus MW2
aaugcacuagcaacaucuu

SEQ ID NO: 2084509 - RNA, 17 nt, Staphylococcus aureus subsp. aureus MW2
aaugcaauauguaacaa

SEQ ID NO: 2084510 - RNA, 16 nt, Staphylococcus aureus subsp. aureus MW2
aaugcauugcacuugu

SEQ ID NO: 2084511 - RNA, 14 nt, Staphylococcus aureus subsp. aureus MW2
uuuuucuacaccua

SEQ ID NO: 2084512 - RNA, 13 nt, Staphylococcus aureus subsp. aureus MW2
uuuuggaaacaug

SEQ ID NO: 2084513 - RNA, 22 nt, Staphylococcus aureus subsp. aureus MW2
aauggaacgccgaauaauccag

SEQ ID NO: 2084514 - RNA, 19 nt, Staphylococcus aureus subsp. aureus MW2
aauuagccccaguauagaa

SEQ ID NO: 2084515 - RNA, 22 nt, Staphylococcus aureus subsp. aureus MW2
aauuaguacuugaaacaucuug

SEQ ID NO: 2084516 - RNA, 14 nt, Staphylococcus aureus subsp. aureus MW2
aauuagucauugaa

SEQ ID NO: 2084517 - RNA, 20 nt, Staphylococcus aureus subsp. aureus MW2
aauuacuaaaauaucaaaau

SEQ ID NO: 2084518 - RNA, 14 nt, Staphylococcus aureus subsp. aureus MW2
aauuccaucaucuc

SEQ ID NO: 2084519 - RNA, 13 nt, Staphylococcus aureus subsp. aureus MW2
aauucaacgucau

SEQ ID NO: 2084520 - RNA, 18 nt, Staphylococcus aureus subsp. aureus MW2
aauuaguucguguuugaa

SEQ ID NO: 2084521 - RNA, 16 nt, Staphylococcus aureus subsp. aureus MW2
aauuauuauucuaacu

SEQ ID NO: 2084522 - RNA, 21 nt, Staphylococcus aureus subsp. aureus MW2
aauuauucaugaaucgaacua

SEQ ID NO: 2084523 - RNA, 13 nt, Staphylococcus aureus subsp. aureus MW2
aauuauugacauu

SEQ ID NO: 2084524 - RNA, 14 nt, Staphylococcus aureus subsp. aureus MW2
aauuguuaucguuc

SEQ ID NO: 2084525 - RNA, 19 nt, Staphylococcus aureus subsp. aureus MW2
aauuuaauguugcaaaauu

SEQ ID NO: 2084526 - RNA, 15 nt, Staphylococcus aureus subsp. aureus MW2
aauuuagaugcauaa

SEQ ID NO: 2084527 - RNA, 18 nt, Staphylococcus aureus subsp. aureus MW2
aauuucauaguuaucgau

SEQ ID NO: 2084528 - RNA, 19 nt, Staphylococcus aureus subsp. aureus MW2
aauucuacaggcaaugcaa

SEQ ID NO: 2084529 - RNA, 23 nt, Staphylococcus aureus subsp. aureus MW2
aauugcacgucuuguaucaacau

SEQ ID NO: 2084530 - RNA, 21 nt, Staphylococcus aureus subsp. aureus MW2
aauugcguuguuucauuauca

SEQ ID NO: 2084531 - RNA, 19 nt, Staphylococcus aureus subsp. aureus MW2
uugcuagugcucuugcaau

SEQ ID NO: 2084532 - RNA, 15 nt, Staphylococcus aureus subsp. aureus MW2
uugcuauaagaacua

SEQ ID NO: 2084533 - RNA, 19 nt, Staphylococcus aureus subsp. aureus MW2
uugcuuguacgauaacuac

SEQ ID NO: 2084534 - RNA, 14 nt, Staphylococcus aureus subsp. aureus MW2
uuguacgauaacua

SEQ ID NO: 2084535 - RNA, 17 nt, Staphylococcus aureus subsp. aureus MW2
uuguucaaguaaucauu

SEQ ID NO: 2084536 - RNA, 16 nt, Staphylococcus aureus subsp. aureus MW2
uuguauaucuguauaa

SEQ ID NO: 2084537 - RNA, 19 nt, Staphylococcus aureus subsp. aureus MW2
uuguauaaaaauguauuaa

SEQ ID NO: 2084538 - RNA, 18 nt, Staphylococcus aureus subsp. aureus MW2
aauccuugagcucacgau

SEQ ID NO: 2084539 - RNA, 22 nt, Staphylococcus aureus subsp. aureus MW2
aauccuuuggacuccaucgcaa

SEQ ID NO: 2084540 - RNA, 22 nt, Staphylococcus aureus subsp. aureus MW2
uuuaggaaugaauaaagcuaac

SEQ ID NO: 2084541 - RNA, 14 nt, Staphylococcus aureus subsp. aureus MW2
uuuaggcaaauaac

SEQ ID NO: 2084542 - RNA, 14 nt, Staphylococcus aureus subsp. aureus MW2
uuuaauagcuuguu

SEQ ID NO: 2084543 - RNA, 18 nt, Staphylococcus aureus subsp. aureus MW2
uuuaauaucacgaucuuu

SEQ ID NO: 2084544 - RNA, 14 nt, Staphylococcus aureus subsp. aureus MW2
uuuaauaucuaauu

SEQ ID NO: 2084545 - RNA, 14 nt, Staphylococcus aureus subsp. aureus MW2
uuuaaucacaucuu

SEQ ID NO: 2084546 - RNA, 17 nt, Staphylococcus aureus subsp. aureus MW2
uuuaaguuuuucagggu

SEQ ID NO: 2084547 - RNA, 11 nt, Staphylococcus aureus subsp. aureus MW2
uuuacuuaauc

SEQ ID NO: 2084548 - RNA, 21 nt, Staphylococcus aureus subsp. aureus MW2
uuuacuacaucauaaacgaaa

SEQ ID NO: 2084549 - RNA, 13 nt, Staphylococcus aureus subsp. aureus MW2
uuucagaaugaac

SEQ ID NO: 2084550 - RNA, 19 nt, Staphylococcus aureus subsp. aureus MW2
uuucauauaaauagcuucu

SEQ ID NO: 2084551 - RNA, 17 nt, Staphylococcus aureus subsp. aureus MW2
uuucauaaacucuuaua

SEQ ID NO: 2084552 - RNA, 20 nt, Staphylococcus aureus subsp. aureus MW2
uuucauaaacugaaucgauu

SEQ ID NO: 2084553 - RNA, 15 nt, Staphylococcus aureus subsp. aureus MW2
uuucaugauuuacua

SEQ ID NO: 2084554 - RNA, 21 nt, Staphylococcus aureus subsp. aureus MW2
uuucaugugucauaauccauu

SEQ ID NO: 2084555 - RNA, 15 nt, Staphylococcus aureus subsp. aureus MW2
uuucauugaucgauu

SEQ ID NO: 2084556 - RNA, 14 nt, Staphylococcus aureus subsp. aureus MW2
uuucaucaaaucca

SEQ ID NO: 2084557 - RNA, 23 nt, Staphylococcus aureus subsp. aureus MW2
uuucaaaaauuguuaaucccguu

SEQ ID NO: 2084558 - RNA, 15 nt, Staphylococcus aureus subsp. aureus MW2
uuucacaauuguaua

SEQ ID NO: 2084559 - RNA, 17 nt, Staphylococcus aureus subsp. aureus MW2
uuuaucauuauuugaua

SEQ ID NO: 2084560 - RNA, 22 nt, Staphylococcus aureus subsp. aureus MW2
uuuaucaguuagcuuauuuaga

SEQ ID NO: 2084561 - RNA, 17 nt, Staphylococcus aureus subsp. aureus MW2
uuuauacuaaauugaga

SEQ ID NO: 2084562 - RNA, 16 nt, Staphylococcus aureus subsp. aureus MW2
uuuauacauuaacgau

SEQ ID NO: 2084563 - RNA, 14 nt, Staphylococcus aureus subsp. aureus MW2
uuuauuaaagaaac

SEQ ID NO: 2084564 - RNA, 14 nt, Staphylococcus aureus subsp. aureus MW2
uucauacacuuuaa

SEQ ID NO: 2084565 - RNA, 13 nt, Staphylococcus aureus subsp. aureus MW2
uucauauaaugcu

SEQ ID NO: 2084566 - RNA, 16 nt, Staphylococcus aureus subsp. aureus MW2
uuccuauuacuacaua

SEQ ID NO: 2084567 - RNA, 18 nt, Staphylococcus aureus subsp. aureus MW2
uuccuaguucuauguaua

SEQ ID NO: 2084568 - RNA, 19 nt, Staphylococcus aureus subsp. aureus MW2
uucuuucuaaaauaacuaa

SEQ ID NO: 2084569 - RNA, 12 nt, Staphylococcus aureus subsp. aureus MW2
uugaaaaucuaa

SEQ ID NO: 2084570 - RNA, 22 nt, Staphylococcus aureus subsp. aureus MW2
uucuuggucugcuguaucauca

SEQ ID NO: 2084571 - RNA, 17 nt, Staphylococcus aureus subsp. aureus MW2
uucugcaccuguuuuaa

SEQ ID NO: 2084572 - RNA, 13 nt, Staphylococcus aureus subsp. aureus MW2
uugaacauagucu

SEQ ID NO: 2084573 - RNA, 23 nt, Staphylococcus aureus subsp. aureus MW2
uugaauaauuggcugaugaacuu

SEQ ID NO: 2084574 - RNA, 22 nt, Staphylococcus aureus subsp. aureus MW2
uugaauugauuauaaugauugu

SEQ ID NO: 2084575 - RNA, 16 nt, Staphylococcus aureus subsp. aureus MW2
uucaacauauaaauca

SEQ ID NO: 2084576 - RNA, 19 nt, Staphylococcus aureus subsp. aureus MW2
uucaaaucuggcacuuaag

SEQ ID NO: 2084577 - RNA, 13 nt, Staphylococcus aureus subsp. aureus MW2
uucaaauuuacca

SEQ ID NO: 2084578 - RNA, 18 nt, Staphylococcus aureus subsp. aureus MW2
uucaaauugaacuucuuu

SEQ ID NO: 2084579 - RNA, 16 nt, Staphylococcus aureus subsp. aureus MW2
uucaacuaauaacuca

SEQ ID NO: 2084580 - RNA, 23 nt, Staphylococcus aureus subsp. aureus MW2
uuauuuucucgauacaaaggguu

SEQ ID NO: 2084581 - RNA, 12 nt, Staphylococcus aureus subsp. aureus MW2
uucaaagcgaua

SEQ ID NO: 2084582 - RNA, 19 nt, Staphylococcus aureus subsp. aureus MW2
uucaaauaaacacaucuau

SEQ ID NO: 2084583 - RNA, 17 nt, Staphylococcus aureus subsp. aureus MW2
uuauuguuguaucauca

SEQ ID NO: 2084584 - RNA, 17 nt, Staphylococcus aureus subsp. aureus MW2
uuauugguaggaggcuu

SEQ ID NO: 2084585 - RNA, 16 nt, Staphylococcus aureus subsp. aureus MW2
uucaaucgucacauca

SEQ ID NO: 2084586 - RNA, 20 nt, Staphylococcus aureus subsp. aureus MW2
uucaauuaauuuaaaugcuu

SEQ ID NO: 2084587 - RNA, 15 nt, Staphylococcus aureus subsp. aureus MW2
uucacauagccucuu

SEQ ID NO: 2084588 - RNA, 19 nt, Staphylococcus aureus subsp. aureus MW2
uucagcaucuacuaaauca

SEQ ID NO: 2084589 - RNA, 13 nt, Staphylococcus aureus subsp. aureus MW2
uuauucuaauaca

SEQ ID NO: 2084590 - RNA, 16 nt, Staphylococcus aureus subsp. aureus MW2
uuauuaggauucaaua

SEQ ID NO: 2084591 - RNA, 21 nt, Staphylococcus aureus subsp. aureus MW2
uuauuaaaauuaaauaaugau

SEQ ID NO: 2084592 - RNA, 19 nt, Staphylococcus aureus subsp. aureus MW2
uuauuaacgcaaaaauacu

SEQ ID NO: 2084593 - RNA, 23 nt, Staphylococcus aureus subsp. aureus MW2
uuaugucuuaggcgcuacaaugu

SEQ ID NO: 2084594 - RNA, 13 nt, Staphylococcus aureus subsp. aureus MW2
uuaucugaaucug

SEQ ID NO: 2084595 - RNA, 21 nt, Staphylococcus aureus subsp. aureus MW2
uuaucuacaguuuuaugaaua

SEQ ID NO: 2084596 - RNA, 14 nt, Staphylococcus aureus subsp. aureus MW2
uuacugaugaacau

SEQ ID NO: 2084597 - RNA, 13 nt, Staphylococcus aureus subsp. aureus MW2
uuacuccuuacaa

SEQ ID NO: 2084598 - RNA, 20 nt, Staphylococcus aureus subsp. aureus MW2
uuauagccuucauuugcgau

SEQ ID NO: 2084599 - RNA, 20 nt, Staphylococcus aureus subsp. aureus MW2
uuauauggaauacuacacuc

SEQ ID NO: 2084600 - RNA, 13 nt, Staphylococcus aureus subsp. aureus MW2
uuacuuauucaaa

SEQ ID NO: 2084601 - RNA, 20 nt, Staphylococcus aureus subsp. aureus MW2
uguuguugcccgcuuauugc

SEQ ID NO: 2084602 - RNA, 20 nt, Staphylococcus aureus subsp. aureus MW2
uguuuacugucaucuuuaua

SEQ ID NO: 2084603 - RNA, 14 nt, Staphylococcus aureus subsp. aureus MW2
uguguaaaugaauu

SEQ ID NO: 2084604 - RNA, 15 nt, Staphylococcus aureus subsp. aureus MW2
uuaacuaauaacuag

SEQ ID NO: 2084605 - RNA, 15 nt, Staphylococcus aureus subsp. aureus MW2
uuaacuauaacaaua

SEQ ID NO: 2084606 - RNA, 21 nt, Staphylococcus aureus subsp. aureus MW2
uguuuguuacauauugcauuu

SEQ ID NO: 2084607 - RNA, 19 nt, Staphylococcus aureus subsp. aureus MW2
uguuuguaaaucaaguguu

SEQ ID NO: 2084608 - RNA, 18 nt, Staphylococcus aureus subsp. aureus MW2
uguuugaauggcaaauau

SEQ ID NO: 2084609 - RNA, 23 nt, Staphylococcus aureus subsp. aureus MW2
uuaacugguugauaaauaaacuc

SEQ ID NO: 2084610 - RNA, 19 nt, Staphylococcus aureus subsp. aureus MW2
uuaacuuucccuacugcuu

SEQ ID NO: 2084611 - RNA, 20 nt, Staphylococcus aureus subsp. aureus MW2
uuaaguuugucuuugaacau

SEQ ID NO: 2084612 - RNA, 18 nt, Staphylococcus aureus subsp. aureus MW2
uuaagugcaauaacacca

SEQ ID NO: 2084613 - RNA, 18 nt, Staphylococcus aureus subsp. aureus MW2
uuaauucgccuaaauggu

SEQ ID NO: 2084614 - RNA, 21 nt, Staphylococcus aureus subsp. aureus MW2
uuaauuuaguucgauaacaca

SEQ ID NO: 2084615 - RNA, 15 nt, Staphylococcus aureus subsp. aureus MW2
uuaauuuuaccauca

SEQ ID NO: 2084616 - RNA, 13 nt, Staphylococcus aureus subsp. aureus MW2
uuacaacguccac

SEQ ID NO: 2084617 - RNA, 18 nt, Staphylococcus aureus subsp. aureus MW2
uuacaacuuuaguuguua

SEQ ID NO: 2084618 - RNA, 16 nt, Staphylococcus aureus subsp. aureus MW2
uuaauguuauaaauca

SEQ ID NO: 2084619 - RNA, 12 nt, Staphylococcus aureus subsp. aureus MW2
uuaauuaaacug

SEQ ID NO: 2084620 - RNA, 21 nt, Staphylococcus aureus subsp. aureus MW2
uuaauaaccuuuaaaacauca

SEQ ID NO: 2084621 - RNA, 23 nt, Staphylococcus aureus subsp. aureus MW2
acgccuggaaucgcguuuaacaa

SEQ ID NO: 2084622 - RNA, 23 nt, Staphylococcus aureus subsp. aureus MW2
acgcgaaaaaaucggacagcuga

SEQ ID NO: 2084623 - RNA, 15 nt, Staphylococcus aureus subsp. aureus MW2
acgaaauaaauuuug

SEQ ID NO: 2084624 - RNA, 20 nt, Staphylococcus aureus subsp. aureus MW2
acuacauucuucauuacagu

SEQ ID NO: 2084625 - RNA, 18 nt, Staphylococcus aureus subsp. aureus MW2
acuacagugcaugaugaa

SEQ ID NO: 2084626 - RNA, 17 nt, Staphylococcus aureus subsp. aureus MW2
acuauuaucuauccauu

SEQ ID NO: 2084627 - RNA, 16 nt, Staphylococcus aureus subsp. aureus MW2
acguaaugaaucaauu

SEQ ID NO: 2084628 - RNA, 17 nt, Staphylococcus aureus subsp. aureus MW2
acguaauuaauagguua

SEQ ID NO: 2084629 - RNA, 17 nt, Staphylococcus aureus subsp. aureus MW2
acugcauguacaucuuu

SEQ ID NO: 2084630 - RNA, 22 nt, Staphylococcus aureus subsp. aureus MW2
acucugcgauuucuaaagcgau

SEQ ID NO: 2084631 - RNA, 18 nt, Staphylococcus aureus subsp. aureus MW2
acugauauauacuagcaa

SEQ ID NO: 2084632 - RNA, 20 nt, Staphylococcus aureus subsp. aureus MW2
acugacaaugcaaguuggcg

SEQ ID NO: 2084633 - RNA, 14 nt, Staphylococcus aureus subsp. aureus MW2
acucaacugaugaa

SEQ ID NO: 2084634 - RNA, 15 nt, Staphylococcus aureus subsp. aureus MW2
acuuaacuuaagcuc

SEQ ID NO: 2084635 - RNA, 15 nt, Staphylococcus aureus subsp. aureus MW2
acuucauauaaugcu

SEQ ID NO: 2084636 - RNA, 18 nt, Staphylococcus aureus subsp. aureus MW2
acuucauauccuucauua

SEQ ID NO: 2084637 - RNA, 18 nt, Staphylococcus aureus subsp. aureus MW2
acuuggauuaccguuaaa

SEQ ID NO: 2084638 - RNA, 13 nt, Staphylococcus aureus subsp. aureus MW2
acuugauaucauc

SEQ ID NO: 2084639 - RNA, 19 nt, Staphylococcus aureus subsp. aureus MW2
acuucguuuuaccgcgugu

SEQ ID NO: 2084640 - RNA, 20 nt, Staphylococcus aureus subsp. aureus MW2
acuucuccauggcuuaaauc

SEQ ID NO: 2084641 - RNA, 16 nt, Staphylococcus aureus subsp. aureus MW2
acuuucagucguuaaa

SEQ ID NO: 2084642 - RNA, 22 nt, Staphylococcus aureus subsp. aureus MW2
acuuuaacaauuuuaucugaau

SEQ ID NO: 2084643 - RNA, 16 nt, Staphylococcus aureus subsp. aureus MW2
acuuuaacaucugaau

SEQ ID NO: 2084644 - RNA, 12 nt, Staphylococcus aureus subsp. aureus MW2
agaaaauacauu

SEQ ID NO: 2084645 - RNA, 16 nt, Staphylococcus aureus subsp. aureus MW2
acuuuuuauauugcga

SEQ ID NO: 2084646 - RNA, 14 nt, Staphylococcus aureus subsp. aureus MW2
acuuuuauuacuua

SEQ ID NO: 2084647 - RNA, 21 nt, Staphylococcus aureus subsp. aureus MW2
acauauuggcuugcuucauua

SEQ ID NO: 2084648 - RNA, 23 nt, Staphylococcus aureus subsp. aureus MW2
acaucauucacaaguucaggauc

SEQ ID NO: 2084649 - RNA, 20 nt, Staphylococcus aureus subsp. aureus MW2
acaggcaaugcaaguuggcg

SEQ ID NO: 2084650 - RNA, 16 nt, Staphylococcus aureus subsp. aureus MW2
acagcaguaagauauu

SEQ ID NO: 2084651 - RNA, 15 nt, Staphylococcus aureus subsp. aureus MW2
acacuuuucuuauca

SEQ ID NO: 2084652 - RNA, 17 nt, Staphylococcus aureus subsp. aureus MW2
aauuuuauaauaaggca

SEQ ID NO: 2084653 - RNA, 19 nt, Staphylococcus aureus subsp. aureus MW2
aauuuuaauuuuucauuaa

SEQ ID NO: 2084654 - RNA, 14 nt, Staphylococcus aureus subsp. aureus MW2
accauuuucaauaa

SEQ ID NO: 2084655 - RNA, 17 nt, Staphylococcus aureus subsp. aureus MW2
accauuucauuucagua

SEQ ID NO: 2084656 - RNA, 22 nt, Staphylococcus aureus subsp. aureus MW2
accaucucuuucuacuuaguaa

SEQ ID NO: 2084657 - RNA, 12 nt, Staphylococcus aureus subsp. aureus MW2
accaauuagcau

SEQ ID NO: 2084658 - RNA, 16 nt, Staphylococcus aureus subsp. aureus MW2
acauguuccgcuacaa

SEQ ID NO: 2084659 - RNA, 18 nt, Staphylococcus aureus subsp. aureus MW2
acauuacauuuaguacau

SEQ ID NO: 2084660 - RNA, 20 nt, Staphylococcus aureus subsp. aureus MW2
acauuaggauguucagcuaa

SEQ ID NO: 2084661 - RNA, 23 nt, Staphylococcus aureus subsp. aureus MW2
accaauuuaguccuucuuuacua

SEQ ID NO: 2084662 - RNA, 16 nt, Staphylococcus aureus subsp. aureus MW2
accaccacuuucagua

SEQ ID NO: 2084663 - RNA, 22 nt, Staphylococcus aureus subsp. aureus MW2
caccagccaauggaacgccgaa

SEQ ID NO: 2084664 - RNA, 16 nt, Staphylococcus aureus subsp. aureus MW2
caccuaauaaugcgau

SEQ ID NO: 2084665 - RNA, 15 nt, Staphylococcus aureus subsp. aureus MW2
caauuugcauaacau

SEQ ID NO: 2084666 - RNA, 20 nt, Staphylococcus aureus subsp. aureus MW2
caauuuauguaaauucaaaa

SEQ ID NO: 2084667 - RNA, 21 nt, Staphylococcus aureus subsp. aureus MW2
caauuguaguaaugaagcuuc

SEQ ID NO: 2084668 - RNA, 13 nt, Staphylococcus aureus subsp. aureus MW2
caauguauuaccu

SEQ ID NO: 2084669 - RNA, 20 nt, Staphylococcus aureus subsp. aureus MW2
caauguauuuugaucugugc

SEQ ID NO: 2084670 - RNA, 16 nt, Staphylococcus aureus subsp. aureus MW2
caaucauuagucauca

SEQ ID NO: 2084671 - RNA, 19 nt, Staphylococcus aureus subsp. aureus MW2
caaguuuauaaauuucgau

SEQ ID NO: 2084672 - RNA, 21 nt, Staphylococcus aureus subsp. aureus MW2
caauaaaaaugguauucgcau

SEQ ID NO: 2084673 - RNA, 21 nt, Staphylococcus aureus subsp. aureus MW2
caaguuuaguaucuccaucaa

SEQ ID NO: 2084674 - RNA, 19 nt, Staphylococcus aureus subsp. aureus MW2
caaguugugcugucaaaca

SEQ ID NO: 2084675 - RNA, 22 nt, Staphylococcus aureus subsp. aureus MW2
caaguugauaaugucuuacuug

SEQ ID NO: 2084676 - RNA, 18 nt, Staphylococcus aureus subsp. aureus MW2
caaguuacgauaucauac

SEQ ID NO: 2084677 - RNA, 14 nt, Staphylococcus aureus subsp. aureus MW2
caauaauaccuuca

SEQ ID NO: 2084678 - RNA, 15 nt, Staphylococcus aureus subsp. aureus MW2
caauaaucaauguuc

SEQ ID NO: 2084679 - RNA, 12 nt, Staphylococcus aureus subsp. aureus MW2
caauaaugugca

SEQ ID NO: 2084680 - RNA, 14 nt, Staphylococcus aureus subsp. aureus MW2
caauacaaaucgau

SEQ ID NO: 2084681 - RNA, 23 nt, Staphylococcus aureus subsp. aureus MW2
caauaauugcugucacuaaugga

SEQ ID NO: 2084682 - RNA, 17 nt, Staphylococcus aureus subsp. aureus MW2
caauacagaacuuuaau

SEQ ID NO: 2084683 - RNA, 19 nt, Staphylococcus aureus subsp. aureus MW2
caauaucuucuaauuccau

SEQ ID NO: 2084684 - RNA, 20 nt, Staphylococcus aureus subsp. aureus MW2
caauaugaccuuuaugugca

SEQ ID NO: 2084685 - RNA, 16 nt, Staphylococcus aureus subsp. aureus MW2
caauauacauuuacau

SEQ ID NO: 2084686 - RNA, 18 nt, Staphylococcus aureus subsp. aureus MW2
caauacgaaguuucaugu

SEQ ID NO: 2084687 - RNA, 19 nt, Staphylococcus aureus subsp. aureus MW2
caauaccuuugccguauuu

SEQ ID NO: 2084688 - RNA, 22 nt, Staphylococcus aureus subsp. aureus MW2
caauacuuuuuauauaauucgu

SEQ ID NO: 2084689 - RNA, 17 nt, Staphylococcus aureus subsp. aureus MW2
caagucuaguucgaaca

SEQ ID NO: 2084690 - RNA, 18 nt, Staphylococcus aureus subsp. aureus MW2
caacgucaucugcuugua

SEQ ID NO: 2084691 - RNA, 14 nt, Staphylococcus aureus subsp. aureus MW2
caaccuaucacgau

SEQ ID NO: 2084692 - RNA, 14 nt, Staphylococcus aureus subsp. aureus MW2
caacaagguuucaa

SEQ ID NO: 2084693 - RNA, 18 nt, Staphylococcus aureus subsp. aureus MW2
caacaacgacuuucacua

SEQ ID NO: 2084694 - RNA, 16 nt, Staphylococcus aureus subsp. aureus MW2
caacaaagagaauuuc

SEQ ID NO: 2084695 - RNA, 15 nt, Staphylococcus aureus subsp. aureus MW2
caaauugaacuucuu

SEQ ID NO: 2084696 - RNA, 18 nt, Staphylococcus aureus subsp. aureus MW2
caaauuaccauucaucgu

SEQ ID NO: 2084697 - RNA, 22 nt, Staphylococcus aureus subsp. aureus MW2
caaauucauuuguauuaauuug

SEQ ID NO: 2084698 - RNA, 19 nt, Staphylococcus aureus subsp. aureus MW2
caacaaaaugcguaucaau

SEQ ID NO: 2084699 - RNA, 13 nt, Staphylococcus aureus subsp. aureus MW2
caacacauucugg

SEQ ID NO: 2084700 - RNA, 19 nt, Staphylococcus aureus subsp. aureus MW2
caaauguugacuacucaau

SEQ ID NO: 2084701 - RNA, 14 nt, Staphylococcus aureus subsp. aureus MW2
caaacaaugcaagu

SEQ ID NO: 2084702 - RNA, 13 nt, Staphylococcus aureus subsp. aureus MW2
caaacacaguaca

SEQ ID NO: 2084703 - RNA, 16 nt, Staphylococcus aureus subsp. aureus MW2
caaacaacaaucaaau

SEQ ID NO: 2084704 - RNA, 14 nt, Staphylococcus aureus subsp. aureus MW2
auuuaaacuaguaa

SEQ ID NO: 2084705 - RNA, 20 nt, Staphylococcus aureus subsp. aureus MW2
auuuaaaaaucuacauauga

SEQ ID NO: 2084706 - RNA, 18 nt, Staphylococcus aureus subsp. aureus MW2
auuguuaauuucaacauu

SEQ ID NO: 2084707 - RNA, 13 nt, Staphylococcus aureus subsp. aureus MW2
caaauaaugugca

SEQ ID NO: 2084708 - RNA, 17 nt, Staphylococcus aureus subsp. aureus MW2
augugucauaauccauu

SEQ ID NO: 2084709 - RNA, 20 nt, Staphylococcus aureus subsp. aureus MW2
auguucuuaacaauaucauc

SEQ ID NO: 2084710 - RNA, 18 nt, Staphylococcus aureus subsp. aureus MW2
auguugacucuacuagaa

SEQ ID NO: 2084711 - RNA, 19 nt, Staphylococcus aureus subsp. aureus MW2
augucucagauucauaucu

SEQ ID NO: 2084712 - RNA, 18 nt, Staphylococcus aureus subsp. aureus MW2
augucaucuugacacaau

SEQ ID NO: 2084713 - RNA, 20 nt, Staphylococcus aureus subsp. aureus MW2
augguugaauaacacuagaa

SEQ ID NO: 2084714 - RNA, 18 nt, Staphylococcus aureus subsp. aureus MW2
auguauuauagauuacgc

SEQ ID NO: 2084715 - RNA, 17 nt, Staphylococcus aureus subsp. aureus MW2
auguauugcuauaagaa

SEQ ID NO: 2084716 - RNA, 12 nt, Staphylococcus aureus subsp. aureus MW2
auguaacuuguc

SEQ ID NO: 2084717 - RNA, 17 nt, Staphylococcus aureus subsp. aureus MW2
auguaaaugaaauaggu

SEQ ID NO: 2084718 - RNA, 20 nt, Staphylococcus aureus subsp. aureus MW2
augguaaguauaauuaaacu

SEQ ID NO: 2084719 - RNA, 15 nt, Staphylococcus aureus subsp. aureus MW2
auggcacaucagaua

SEQ ID NO: 2084720 - RNA, 20 nt, Staphylococcus aureus subsp. aureus MW2
augcuuuuuuuacaauauga

SEQ ID NO: 2084721 - RNA, 15 nt, Staphylococcus aureus subsp. aureus MW2
augcgauuacagugu

SEQ ID NO: 2084722 - RNA, 14 nt, Staphylococcus aureus subsp. aureus MW2
augccaacacguuu

SEQ ID NO: 2084723 - RNA, 12 nt, Staphylococcus aureus subsp. aureus MW2
augcauugagca

SEQ ID NO: 2084724 - RNA, 18 nt, Staphylococcus aureus subsp. aureus MW2
auucuaauacaaaccuau

SEQ ID NO: 2084725 - RNA, 18 nt, Staphylococcus aureus subsp. aureus MW2
auucuaacuuuguaugaa

SEQ ID NO: 2084726 - RNA, 19 nt, Staphylococcus aureus subsp. aureus MW2
auucuagagauaacuagaa

SEQ ID NO: 2084727 - RNA, 17 nt, Staphylococcus aureus subsp. aureus MW2
auucugaaaucaguuuu

SEQ ID NO: 2084728 - RNA, 16 nt, Staphylococcus aureus subsp. aureus MW2
auucaucaguguagca

SEQ ID NO: 2084729 - RNA, 16 nt, Staphylococcus aureus subsp. aureus MW2
auucauuacaaccauu

SEQ ID NO: 2084730 - RNA, 16 nt, Staphylococcus aureus subsp. aureus MW2
auucaucuguugauaa

SEQ ID NO: 2084731 - RNA, 15 nt, Staphylococcus aureus subsp. aureus MW2
auuaaaauaaaccac

SEQ ID NO: 2084732 - RNA, 20 nt, Staphylococcus aureus subsp. aureus MW2
auuaaauguuuacgaaguuc

SEQ ID NO: 2084733 - RNA, 19 nt, Staphylococcus aureus subsp. aureus MW2
auuaaauauuuagauuggu

SEQ ID NO: 2084734 - RNA, 18 nt, Staphylococcus aureus subsp. aureus MW2
auuaaaucugauucauua

SEQ ID NO: 2084735 - RNA, 22 nt, Staphylococcus aureus subsp. aureus MW2
auuaacacgaacugcauaggua

SEQ ID NO: 2084736 - RNA, 23 nt, Staphylococcus aureus subsp. aureus MW2
auuaugcccgauaauucuaacuu

SEQ ID NO: 2084737 - RNA, 15 nt, Staphylococcus aureus subsp. aureus MW2
auuauuuaaucuauu

SEQ ID NO: 2084738 - RNA, 20 nt, Staphylococcus aureus subsp. aureus MW2
auuauuauucuaacuuugua

SEQ ID NO: 2084739 - RNA, 20 nt, Staphylococcus aureus subsp. aureus MW2
auuaugcuugccacugcaau

SEQ ID NO: 2084740 - RNA, 16 nt, Staphylococcus aureus subsp. aureus MW2
auuggcaguaguugac

SEQ ID NO: 2084741 - RNA, 22 nt, Staphylococcus aureus subsp. aureus MW2
auuggaauacucuuuaaucuac

SEQ ID NO: 2084742 - RNA, 13 nt, Staphylococcus aureus subsp. aureus MW2
auuguaaucuauu

SEQ ID NO: 2084743 - RNA, 13 nt, Staphylococcus aureus subsp. aureus MW2
auuguaacucaau

SEQ ID NO: 2084744 - RNA, 18 nt, Staphylococcus aureus subsp. aureus MW2
auugccuaagaacuuaau

SEQ ID NO: 2084745 - RNA, 16 nt, Staphylococcus aureus subsp. aureus MW2
auucuucaucaugacu

SEQ ID NO: 2084746 - RNA, 17 nt, Staphylococcus aureus subsp. aureus MW2
auucuuuugaguccauu

SEQ ID NO: 2084747 - RNA, 23 nt, Staphylococcus aureus subsp. aureus MW2
auugaaaaaauaacuguaaaaca

SEQ ID NO: 2084748 - RNA, 14 nt, Staphylococcus aureus subsp. aureus MW2
auugaaacuaauaa

SEQ ID NO: 2084749 - RNA, 22 nt, Staphylococcus aureus subsp. aureus MW2
auugaagaauauaaacuauuaa

SEQ ID NO: 2084750 - RNA, 17 nt, Staphylococcus aureus subsp. aureus MW2
auugauuucagcaccga

SEQ ID NO: 2084751 - RNA, 12 nt, Staphylococcus aureus subsp. aureus MW2
auugaucugauu

SEQ ID NO: 2084752 - RNA, 22 nt, Staphylococcus aureus subsp. aureus MW2
augaaauuggaauagauguuga

SEQ ID NO: 2084753 - RNA, 19 nt, Staphylococcus aureus subsp. aureus MW2
aucuuuaguauuucaucau

SEQ ID NO: 2084754 - RNA, 15 nt, Staphylococcus aureus subsp. aureus MW2
aucuuuagacauaaa

SEQ ID NO: 2084755 - RNA, 13 nt, Staphylococcus aureus subsp. aureus MW2
aucuuuaguauuu

SEQ ID NO: 2084756 - RNA, 16 nt, Staphylococcus aureus subsp. aureus MW2
aucuuuuauaaugaac

SEQ ID NO: 2084757 - RNA, 18 nt, Staphylococcus aureus subsp. aureus MW2
aucuuuuuguuuaucgau

SEQ ID NO: 2084758 - RNA, 20 nt, Staphylococcus aureus subsp. aureus MW2
augacgagaauuaaagucug

SEQ ID NO: 2084759 - RNA, 22 nt, Staphylococcus aureus subsp. aureus MW2
augauacccaauauuaauccac

SEQ ID NO: 2084760 - RNA, 12 nt, Staphylococcus aureus subsp. aureus MW2
augauaaccauu

SEQ ID NO: 2084761 - RNA, 15 nt, Staphylococcus aureus subsp. aureus MW2
augauaaauuaaagc

SEQ ID NO: 2084762 - RNA, 22 nt, Staphylococcus aureus subsp. aureus MW2
augaugcuucgcacaacugcau

SEQ ID NO: 2084763 - RNA, 21 nt, Staphylococcus aureus subsp. aureus MW2
augaugcugccaucaggcuuu

SEQ ID NO: 2084764 - RNA, 23 nt, Staphylococcus aureus subsp. aureus MW2
augauuagcgcaccaauuaucaa

SEQ ID NO: 2084765 - RNA, 18 nt, Staphylococcus aureus subsp. aureus MW2
augcauaaaaaaagaacu

SEQ ID NO: 2084766 - RNA, 20 nt, Staphylococcus aureus subsp. aureus MW2
augcaugcuucucaauuugu

SEQ ID NO: 2084767 - RNA, 16 nt, Staphylococcus aureus subsp. aureus MW2
aucuauuuaucauacu

SEQ ID NO: 2084768 - RNA, 18 nt, Staphylococcus aureus subsp. aureus MW2
aucuauuuuaaacucauc

SEQ ID NO: 2084769 - RNA, 13 nt, Staphylococcus aureus subsp. aureus MW2
aucuaacaucauu

SEQ ID NO: 2084770 - RNA, 22 nt, Staphylococcus aureus subsp. aureus MW2
aucuugcuuggauaauugcauu

SEQ ID NO: 2084771 - RNA, 16 nt, Staphylococcus aureus subsp. aureus MW2
aucuucuucaucauau

SEQ ID NO: 2084772 - RNA, 22 nt, Staphylococcus aureus subsp. aureus MW2
aucuugaacaauucuucaucau

SEQ ID NO: 2084773 - RNA, 12 nt, Staphylococcus aureus subsp. aureus MW2
aucuugacacaa

SEQ ID NO: 2084774 - RNA, 15 nt, Staphylococcus aureus subsp. aureus MW2
aucuguaaugcacua

SEQ ID NO: 2084775 - RNA, 22 nt, Staphylococcus aureus subsp. aureus MW2
auccuguguaaaauaaaucaua

SEQ ID NO: 2084776 - RNA, 18 nt, Staphylococcus aureus subsp. aureus MW2
auccugugacucaaugau

SEQ ID NO: 2084777 - RNA, 22 nt, Staphylococcus aureus subsp. aureus MW2
aucgacacuuccaucaauccaa

SEQ ID NO: 2084778 - RNA, 16 nt, Staphylococcus aureus subsp. aureus MW2
agcuagcaaucccauu

SEQ ID NO: 2084779 - RNA, 18 nt, Staphylococcus aureus subsp. aureus MW2
agcuagcaucauguuggu

SEQ ID NO: 2084780 - RNA, 19 nt, Staphylococcus aureus subsp. aureus MW2
agcuaauucauauucaaau

SEQ ID NO: 2084781 - RNA, 12 nt, Staphylococcus aureus subsp. aureus MW2
agcuaaugcauu

SEQ ID NO: 2084782 - RNA, 16 nt, Staphylococcus aureus subsp. aureus MW2
agcugaacguaaguuu

SEQ ID NO: 2084783 - RNA, 19 nt, Staphylococcus aureus subsp. aureus MW2
agccauaccuuauuucagc

SEQ ID NO: 2084784 - RNA, 14 nt, Staphylococcus aureus subsp. aureus MW2
agcaugaaucgcau

SEQ ID NO: 2084785 - RNA, 15 nt, Staphylococcus aureus subsp. aureus MW2
agcaugaaucgcauu

SEQ ID NO: 2084786 - RNA, 14 nt, Staphylococcus aureus subsp. aureus MW2
agcauuucuuuauu

SEQ ID NO: 2084787 - RNA, 16 nt, Staphylococcus aureus subsp. aureus MW2
agcauuugcuguuaau

SEQ ID NO: 2084788 - RNA, 24 nt, Staphylococcus aureus subsp. aureus MW2
agagguuuugcacuaauggcacuu

SEQ ID NO: 2084789 - RNA, 13 nt, Staphylococcus aureus subsp. aureus MW2
agacucaauuuca

SEQ ID NO: 2084790 - RNA, 22 nt, Staphylococcus aureus subsp. aureus MW2
agacuacauucuucauuacagu

SEQ ID NO: 2084791 - RNA, 12 nt, Staphylococcus aureus subsp. aureus MW2
agaucaauauca

SEQ ID NO: 2084792 - RNA, 16 nt, Staphylococcus aureus subsp. aureus MW2
agaugauuucaaaugu

SEQ ID NO: 2084793 - RNA, 19 nt, Staphylococcus aureus subsp. aureus MW2
agcaacucaggaauagaug

SEQ ID NO: 2084794 - RNA, 11 nt, Staphylococcus aureus subsp. aureus MW2
agauucaaacg

SEQ ID NO: 2084795 - RNA, 15 nt, Staphylococcus aureus subsp. aureus MW2
agcaaugaguugauc

SEQ ID NO: 2084796 - RNA, 14 nt, Staphylococcus aureus subsp. aureus MW2
aggauuauuaucaa

SEQ ID NO: 2084797 - RNA, 22 nt, Staphylococcus aureus subsp. aureus MW2
aggcgcuacaauguuauauugg

SEQ ID NO: 2084798 - RNA, 16 nt, Staphylococcus aureus subsp. aureus MW2
aguccaaauaauaucu

SEQ ID NO: 2084799 - RNA, 19 nt, Staphylococcus aureus subsp. aureus MW2
agucagcuuacaauaaugu

SEQ ID NO: 2084800 - RNA, 14 nt, Staphylococcus aureus subsp. aureus MW2
aguaagacugccau

SEQ ID NO: 2084801 - RNA, 17 nt, Staphylococcus aureus subsp. aureus MW2
aguauaugucgcaaauu

SEQ ID NO: 2084802 - RNA, 18 nt, Staphylococcus aureus subsp. aureus MW2
aguaucuauacaauuaug

SEQ ID NO: 2084803 - RNA, 21 nt, Staphylococcus aureus subsp. aureus MW2
aguaaaauaaauacaauagaa

SEQ ID NO: 2084804 - RNA, 22 nt, Staphylococcus aureus subsp. aureus MW2
agugucacauuauacaauaugu

SEQ ID NO: 2084805 - RNA, 16 nt, Staphylococcus aureus subsp. aureus MW2
aguuccucgguauuca

SEQ ID NO: 2084806 - RNA, 22 nt, Staphylococcus aureus subsp. aureus MW2
aguugaagcuaauucauauuca

SEQ ID NO: 2084807 - RNA, 17 nt, Staphylococcus aureus subsp. aureus MW2
auaaacgcacugcugca

SEQ ID NO: 2084808 - RNA, 19 nt, Staphylococcus aureus subsp. aureus MW2
auaaacaucuucuucauca

SEQ ID NO: 2084809 - RNA, 13 nt, Staphylococcus aureus subsp. aureus MW2
auaaaaucauaug

SEQ ID NO: 2084810 - RNA, 13 nt, Staphylococcus aureus subsp. aureus MW2
auaaauagauaau

SEQ ID NO: 2084811 - RNA, 20 nt, Staphylococcus aureus subsp. aureus MW2
auaaagugaguauaaguuug

SEQ ID NO: 2084812 - RNA, 17 nt, Staphylococcus aureus subsp. aureus MW2
auaaauaaacucaccaa

SEQ ID NO: 2084813 - RNA, 18 nt, Staphylococcus aureus subsp. aureus MW2
auaaaaaucuuaugaugu

SEQ ID NO: 2084814 - RNA, 16 nt, Staphylococcus aureus subsp. aureus MW2
auaaaaauacauaauu

SEQ ID NO: 2084815 - RNA, 23 nt, Staphylococcus aureus subsp. aureus MW2
auaaaaaugguauucgcaucauu

SEQ ID NO: 2084816 - RNA, 18 nt, Staphylococcus aureus subsp. aureus MW2
auaaaaaaaucacgcuaa

SEQ ID NO: 2084817 - RNA, 12 nt, Staphylococcus aureus subsp. aureus MW2
auaaaaaaguug

SEQ ID NO: 2084818 - RNA, 19 nt, Staphylococcus aureus subsp. aureus MW2
auaaauuagccauuucaau

SEQ ID NO: 2084819 - RNA, 23 nt, Staphylococcus aureus subsp. aureus MW2
auaaauuuugagaaaauaucauu

SEQ ID NO: 2084820 - RNA, 14 nt, Staphylococcus aureus subsp. aureus MW2
auaaauucuaucua

SEQ ID NO: 2084821 - RNA, 12 nt, Staphylococcus aureus subsp. aureus MW2
auaaauucucua

SEQ ID NO: 2084822 - RNA, 17 nt, Staphylococcus aureus subsp. aureus MW2
auaagcaaagaugauac

SEQ ID NO: 2084823 - RNA, 13 nt, Staphylococcus aureus subsp. aureus MW2
auaacacaucaug

SEQ ID NO: 2084824 - RNA, 15 nt, Staphylococcus aureus subsp. aureus MW2
auaacacaucaugac

SEQ ID NO: 2084825 - RNA, 16 nt, Staphylococcus aureus subsp. aureus MW2
auaaucauaaugagac

SEQ ID NO: 2084826 - RNA, 12 nt, Staphylococcus aureus subsp. aureus MW2
auaauucaucuu

SEQ ID NO: 2084827 - RNA, 13 nt, Staphylococcus aureus subsp. aureus MW2
auaauugcauuac

SEQ ID NO: 2084828 - RNA, 17 nt, Staphylococcus aureus subsp. aureus MW2
auaauuggcagauagaa

SEQ ID NO: 2084829 - RNA, 17 nt, Staphylococcus aureus subsp. aureus MW2
auaauugcugucacuaa

SEQ ID NO: 2084830 - RNA, 17 nt, Staphylococcus aureus subsp. aureus MW2
auacacugcacaucaua

SEQ ID NO: 2084831 - RNA, 18 nt, Staphylococcus aureus subsp. aureus MW2
auacacuuuuugacauau

SEQ ID NO: 2084832 - RNA, 23 nt, Staphylococcus aureus subsp. aureus MW2
auaauguauaaaacagaauuuca

SEQ ID NO: 2084833 - RNA, 23 nt, Staphylococcus aureus subsp. aureus MW2
auaauuaacugcggcaugcgauu

SEQ ID NO: 2084834 - RNA, 15 nt, Staphylococcus aureus subsp. aureus MW2
auaauuaauuaugcc

SEQ ID NO: 2084835 - RNA, 15 nt, Staphylococcus aureus subsp. aureus MW2
auaaugacugacacu

SEQ ID NO: 2084836 - RNA, 15 nt, Staphylococcus aureus subsp. aureus MW2
auaaucuacugcugu

SEQ ID NO: 2084837 - RNA, 19 nt, Staphylococcus aureus subsp. aureus MW2
auacaugauauaaauaggu

SEQ ID NO: 2084838 - RNA, 18 nt, Staphylococcus aureus subsp. aureus MW2
auacauaugcuauaucca

SEQ ID NO: 2084839 - RNA, 18 nt, Staphylococcus aureus subsp. aureus MW2
auacguugauguaauucu

SEQ ID NO: 2084840 - RNA, 19 nt, Staphylococcus aureus subsp. aureus MW2
auacuaacguaaaggcgau

SEQ ID NO: 2084841 - RNA, 20 nt, Staphylococcus aureus subsp. aureus MW2
auacuccaguuuauaacugg

SEQ ID NO: 2084842 - RNA, 15 nt, Staphylococcus aureus subsp. aureus MW2
auagauagaaauugu

SEQ ID NO: 2084843 - RNA, 15 nt, Staphylococcus aureus subsp. aureus MW2
aucaaaugguacagu

SEQ ID NO: 2084844 - RNA, 16 nt, Staphylococcus aureus subsp. aureus MW2
auauuuucgcaaaauu

SEQ ID NO: 2084845 - RNA, 18 nt, Staphylococcus aureus subsp. aureus MW2
aucaaagauuuuguugaa

SEQ ID NO: 2084846 - RNA, 18 nt, Staphylococcus aureus subsp. aureus MW2
aucaaagaaauguaugac

SEQ ID NO: 2084847 - RNA, 23 nt, Staphylococcus aureus subsp. aureus MW2
aucaaagaaauguaugacauaaa

SEQ ID NO: 2084848 - RNA, 17 nt, Staphylococcus aureus subsp. aureus MW2
aucaaaguuuucaggaa

SEQ ID NO: 2084849 - RNA, 16 nt, Staphylococcus aureus subsp. aureus MW2
aucaauaacuauaauc

SEQ ID NO: 2084850 - RNA, 17 nt, Staphylococcus aureus subsp. aureus MW2
auaucaauuguugcaaa

SEQ ID NO: 2084851 - RNA, 22 nt, Staphylococcus aureus subsp. aureus MW2
auaucauuauuaccuuugcuaa

SEQ ID NO: 2084852 - RNA, 16 nt, Staphylococcus aureus subsp. aureus MW2
auaucauuuuauccaa

SEQ ID NO: 2084853 - RNA, 19 nt, Staphylococcus aureus subsp. aureus MW2
auauggaauuucauauaau

SEQ ID NO: 2084854 - RNA, 23 nt, Staphylococcus aureus subsp. aureus MW2
auaugaccuuuaugugcaucauu

SEQ ID NO: 2084855 - RNA, 23 nt, Staphylococcus aureus subsp. aureus MW2
auauguugcuuaucaacagcuuc

SEQ ID NO: 2084856 - RNA, 12 nt, Staphylococcus aureus subsp. aureus MW2
auauuuaaacuc

SEQ ID NO: 2084857 - RNA, 19 nt, Staphylococcus aureus subsp. aureus MW2
auauuaugccauucauuaa

SEQ ID NO: 2084858 - RNA, 19 nt, Staphylococcus aureus subsp. aureus MW2
auauuuagauuuauaacga

SEQ ID NO: 2084859 - RNA, 15 nt, Staphylococcus aureus subsp. aureus MW2
aucacuguagauuca

SEQ ID NO: 2084860 - RNA, 23 nt, Staphylococcus aureus subsp. aureus MW2
aucacugaaugcuaauacuaauc

SEQ ID NO: 2084861 - RNA, 20 nt, Staphylococcus aureus subsp. aureus MW2
aucacaucauaccaauccga

SEQ ID NO: 2084862 - RNA, 14 nt, Staphylococcus aureus subsp. aureus MW2
ccaucauaaauguu

SEQ ID NO: 2084863 - RNA, 17 nt, Staphylococcus aureus subsp. aureus MW2
ccauaccuuauuucagc

SEQ ID NO: 2084864 - RNA, 14 nt, Staphylococcus aureus subsp. aureus MW2
ccauacucuaacuu

SEQ ID NO: 2084865 - RNA, 19 nt, Staphylococcus aureus subsp. aureus MW2
ccauuaauaaaacugcaau

SEQ ID NO: 2084866 - RNA, 17 nt, Staphylococcus aureus subsp. aureus MW2
ccagcaaauacuucaag

SEQ ID NO: 2084867 - RNA, 13 nt, Staphylococcus aureus subsp. aureus MW2
cauucacuucaag

SEQ ID NO: 2084868 - RNA, 20 nt, Staphylococcus aureus subsp. aureus MW2
cauuaguucuguugauauuu

SEQ ID NO: 2084869 - RNA, 19 nt, Staphylococcus aureus subsp. aureus MW2
cauuaguuugaucauuuac

SEQ ID NO: 2084870 - RNA, 18 nt, Staphylococcus aureus subsp. aureus MW2
cauuaggaaaacuucaau

SEQ ID NO: 2084871 - RNA, 21 nt, Staphylococcus aureus subsp. aureus MW2
cauuagcgcaagagauaagaa

SEQ ID NO: 2084872 - RNA, 20 nt, Staphylococcus aureus subsp. aureus MW2
cauuauuacugauuguuaac

SEQ ID NO: 2084873 - RNA, 23 nt, Staphylococcus aureus subsp. aureus MW2
cauuauuugcugcuaauugauac

SEQ ID NO: 2084874 - RNA, 20 nt, Staphylococcus aureus subsp. aureus MW2
cauucaaacuccuuucuaag

SEQ ID NO: 2084875 - RNA, 24 nt, Staphylococcus aureus subsp. aureus MW2
cauguuugauucuaaauaaucgaa

SEQ ID NO: 2084876 - RNA, 13 nt, Staphylococcus aureus subsp. aureus MW2
cauuaaauuccau

SEQ ID NO: 2084877 - RNA, 15 nt, Staphylococcus aureus subsp. aureus MW2
cauuagaucauacau

SEQ ID NO: 2084878 - RNA, 17 nt, Staphylococcus aureus subsp. aureus MW2
cauuaauuucaugugca

SEQ ID NO: 2084879 - RNA, 23 nt, Staphylococcus aureus subsp. aureus MW2
cauuacauuuggcguaaugauau

SEQ ID NO: 2084880 - RNA, 14 nt, Staphylococcus aureus subsp. aureus MW2
cauuaauuucaugu

SEQ ID NO: 2084881 - RNA, 12 nt, Staphylococcus aureus subsp. aureus MW2
cauuaauguuca

SEQ ID NO: 2084882 - RNA, 14 nt, Staphylococcus aureus subsp. aureus MW2
cauuaauccuuuau

SEQ ID NO: 2084883 - RNA, 12 nt, Staphylococcus aureus subsp. aureus MW2
cauuuuguuuca

SEQ ID NO: 2084884 - RNA, 17 nt, Staphylococcus aureus subsp. aureus MW2
cauuuauaugauguuca

SEQ ID NO: 2084885 - RNA, 13 nt, Staphylococcus aureus subsp. aureus MW2
cauuuaucaacaa

SEQ ID NO: 2084886 - RNA, 22 nt, Staphylococcus aureus subsp. aureus MW2
cauuuagaugauucuuaucauu

SEQ ID NO: 2084887 - RNA, 13 nt, Staphylococcus aureus subsp. aureus MW2
cauuuagauuuca

SEQ ID NO: 2084888 - RNA, 14 nt, Staphylococcus aureus subsp. aureus MW2
cauuuacuucauaa

SEQ ID NO: 2084889 - RNA, 17 nt, Staphylococcus aureus subsp. aureus MW2
cauugcacuaugcauaa

SEQ ID NO: 2084890 - RNA, 21 nt, Staphylococcus aureus subsp. aureus MW2
cauugcaaaagugguuguucc

SEQ ID NO: 2084891 - RNA, 20 nt, Staphylococcus aureus subsp. aureus MW2
caugcugaaucgaguuugaa

SEQ ID NO: 2084892 - RNA, 22 nt, Staphylococcus aureus subsp. aureus MW2
ccaaccaugcuuuuuagcauau

SEQ ID NO: 2084893 - RNA, 16 nt, Staphylococcus aureus subsp. aureus MW2
ccaauguguuuaacuu

SEQ ID NO: 2084894 - RNA, 20 nt, Staphylococcus aureus subsp. aureus MW2
cagcuucuuuaacaauugau

SEQ ID NO: 2084895 - RNA, 23 nt, Staphylococcus aureus subsp. aureus MW2
caguggcauuuaaaaaucuacau

SEQ ID NO: 2084896 - RNA, 13 nt, Staphylococcus aureus subsp. aureus MW2
caguguagcacaa

SEQ ID NO: 2084897 - RNA, 21 nt, Staphylococcus aureus subsp. aureus MW2
cauaauaucuuacuacuuaau

SEQ ID NO: 2084898 - RNA, 21 nt, Staphylococcus aureus subsp. aureus MW2
cauaaucguauucauaucauu

SEQ ID NO: 2084899 - RNA, 14 nt, Staphylococcus aureus subsp. aureus MW2
cauaaucuucauua

SEQ ID NO: 2084900 - RNA, 14 nt, Staphylococcus aureus subsp. aureus MW2
cauacacuaucauu

SEQ ID NO: 2084901 - RNA, 15 nt, Staphylococcus aureus subsp. aureus MW2
cauaauuuaaaugau

SEQ ID NO: 2084902 - RNA, 18 nt, Staphylococcus aureus subsp. aureus MW2
cauaauuaggauuaacau

SEQ ID NO: 2084903 - RNA, 17 nt, Staphylococcus aureus subsp. aureus MW2
cauaccuaauaacgcau

SEQ ID NO: 2084904 - RNA, 20 nt, Staphylococcus aureus subsp. aureus MW2
cauaagucacaguaucuuca

SEQ ID NO: 2084905 - RNA, 16 nt, Staphylococcus aureus subsp. aureus MW2
cauaauagauaaugca

SEQ ID NO: 2084906 - RNA, 15 nt, Staphylococcus aureus subsp. aureus MW2
cauaaaucaauguuc

SEQ ID NO: 2084907 - RNA, 13 nt, Staphylococcus aureus subsp. aureus MW2
cauaaaaccuuca

SEQ ID NO: 2084908 - RNA, 14 nt, Staphylococcus aureus subsp. aureus MW2
cauaaaccaugauu

SEQ ID NO: 2084909 - RNA, 22 nt, Staphylococcus aureus subsp. aureus MW2
cauaaaaaggucuauguacaau

SEQ ID NO: 2084910 - RNA, 17 nt, Staphylococcus aureus subsp. aureus MW2
caguaaaaauacauuuu

SEQ ID NO: 2084911 - RNA, 15 nt, Staphylococcus aureus subsp. aureus MW2
caguaauauguugcu

SEQ ID NO: 2084912 - RNA, 19 nt, Staphylococcus aureus subsp. aureus MW2
cagucaauuuuuucaucuu

SEQ ID NO: 2084913 - RNA, 20 nt, Staphylococcus aureus subsp. aureus MW2
caguauguagcuuaacguug

SEQ ID NO: 2084914 - RNA, 19 nt, Staphylococcus aureus subsp. aureus MW2
caguaaucaaaguaucagu

SEQ ID NO: 2084915 - RNA, 20 nt, Staphylococcus aureus subsp. aureus MW2
cauccuuaauacguugcuca

SEQ ID NO: 2084916 - RNA, 14 nt, Staphylococcus aureus subsp. aureus MW2
caucaauauugaua

SEQ ID NO: 2084917 - RNA, 14 nt, Staphylococcus aureus subsp. aureus MW2
caucaaguugauaa

SEQ ID NO: 2084918 - RNA, 16 nt, Staphylococcus aureus subsp. aureus MW2
caucaacuauuuacau

SEQ ID NO: 2084919 - RNA, 14 nt, Staphylococcus aureus subsp. aureus MW2
cacuagcuaaugca

SEQ ID NO: 2084920 - RNA, 21 nt, Staphylococcus aureus subsp. aureus MW2
cacuaggauguucaucaacau

SEQ ID NO: 2084921 - RNA, 17 nt, Staphylococcus aureus subsp. aureus MW2
cacuaauggcacuuaau

SEQ ID NO: 2084922 - RNA, 14 nt, Staphylococcus aureus subsp. aureus MW2
cacguuugaaugaa

SEQ ID NO: 2084923 - RNA, 16 nt, Staphylococcus aureus subsp. aureus MW2
cacucauauuacuuug

SEQ ID NO: 2084924 - RNA, 17 nt, Staphylococcus aureus subsp. aureus MW2
cacucauuuuuugcaaa

SEQ ID NO: 2084925 - RNA, 19 nt, Staphylococcus aureus subsp. aureus MW2
cacuucugaaaauaaccau

SEQ ID NO: 2084926 - RNA, 18 nt, Staphylococcus aureus subsp. aureus MW2
cacuuuuuuguucaauca

SEQ ID NO: 2084927 - RNA, 21 nt, Staphylococcus aureus subsp. aureus MW2
cagaacugccaauauaacauu

SEQ ID NO: 2084928 - RNA, 18 nt, Staphylococcus aureus subsp. aureus MW2
gauauucgcgaacguuau

SEQ ID NO: 2084929 - RNA, 19 nt, Staphylococcus aureus subsp. aureus MW2
gauacuuuuaaaaucuuga

SEQ ID NO: 2084930 - RNA, 18 nt, Staphylococcus aureus subsp. aureus MW2
gauaaaucuucuuuagcu

SEQ ID NO: 2084931 - RNA, 17 nt, Staphylococcus aureus subsp. aureus MW2
gaguuuaaucgcauugu

SEQ ID NO: 2084932 - RNA, 13 nt, Staphylococcus aureus subsp. aureus MW2
gauaaaaccaccu

SEQ ID NO: 2084933 - RNA, 20 nt, Staphylococcus aureus subsp. aureus MW2
gaugcuaauguaaucugaac

SEQ ID NO: 2084934 - RNA, 18 nt, Staphylococcus aureus subsp. aureus MW2
gauuauagguauaagaau

SEQ ID NO: 2084935 - RNA, 21 nt, Staphylococcus aureus subsp. aureus MW2
gauuuaucaccuuuaggcaaa

SEQ ID NO: 2084936 - RNA, 20 nt, Staphylococcus aureus subsp. aureus MW2
gcaacuguaaaugaaauggu

SEQ ID NO: 2084937 - RNA, 15 nt, Staphylococcus aureus subsp. aureus MW2
gcaauaacacaucau

SEQ ID NO: 2084938 - RNA, 11 nt, Staphylococcus aureus subsp. aureus MW2
gcaaucaucug

SEQ ID NO: 2084939 - RNA, 21 nt, Staphylococcus aureus subsp. aureus MW2
gcacuuuauuaaaaauccuca

SEQ ID NO: 2084940 - RNA, 17 nt, Staphylococcus aureus subsp. aureus MW2
gcacuugucucaaauua

SEQ ID NO: 2084941 - RNA, 14 nt, Staphylococcus aureus subsp. aureus MW2
gcaucccgaaaguu

SEQ ID NO: 2084942 - RNA, 14 nt, Staphylococcus aureus subsp. aureus MW2
gcauaaaucaacuu

SEQ ID NO: 2084943 - RNA, 22 nt, Staphylococcus aureus subsp. aureus MW2
gcauuaaucguauuuuuaagcu

SEQ ID NO: 2084944 - RNA, 18 nt, Staphylococcus aureus subsp. aureus MW2
gcauuaaauuccauguca

SEQ ID NO: 2084945 - RNA, 13 nt, Staphylococcus aureus subsp. aureus MW2
gcauuaucaacuu

SEQ ID NO: 2084946 - RNA, 15 nt, Staphylococcus aureus subsp. aureus MW2
gcauuaaauuccaug

SEQ ID NO: 2084947 - RNA, 19 nt, Staphylococcus aureus subsp. aureus MW2
gcaucuuguucuucgucaa

SEQ ID NO: 2084948 - RNA, 19 nt, Staphylococcus aureus subsp. aureus MW2
gcaucuguuaacugaauuu

SEQ ID NO: 2084949 - RNA, 17 nt, Staphylococcus aureus subsp. aureus MW2
cguuaaaucacauauga

SEQ ID NO: 2084950 - RNA, 21 nt, Staphylococcus aureus subsp. aureus MW2
cguuauaaguacaaauaauac

SEQ ID NO: 2084951 - RNA, 22 nt, Staphylococcus aureus subsp. aureus MW2
cguucauauaugauaaauauug

SEQ ID NO: 2084952 - RNA, 13 nt, Staphylococcus aureus subsp. aureus MW2
cgucuguuucaua

SEQ ID NO: 2084953 - RNA, 20 nt, Staphylococcus aureus subsp. aureus MW2
cgucuauacuccaguuuaua

SEQ ID NO: 2084954 - RNA, 15 nt, Staphylococcus aureus subsp. aureus MW2
cucuauacccuuuau

SEQ ID NO: 2084955 - RNA, 22 nt, Staphylococcus aureus subsp. aureus MW2
cucuaugcuuuuauagauuuua

SEQ ID NO: 2084956 - RNA, 15 nt, Staphylococcus aureus subsp. aureus MW2
cucuagugcuuuguc

SEQ ID NO: 2084957 - RNA, 23 nt, Staphylococcus aureus subsp. aureus MW2
cucuaacuuuaccaauaucaugc

SEQ ID NO: 2084958 - RNA, 15 nt, Staphylococcus aureus subsp. aureus MW2
cucuaaaagccaucu

SEQ ID NO: 2084959 - RNA, 20 nt, Staphylococcus aureus subsp. aureus MW2
cucuaaagguaccacuguau

SEQ ID NO: 2084960 - RNA, 18 nt, Staphylococcus aureus subsp. aureus MW2
cucuaaaacgauuaauag

SEQ ID NO: 2084961 - RNA, 15 nt, Staphylococcus aureus subsp. aureus MW2
cugcaacgccuuuau

SEQ ID NO: 2084962 - RNA, 18 nt, Staphylococcus aureus subsp. aureus MW2
cugaugaacauaccugca

SEQ ID NO: 2084963 - RNA, 17 nt, Staphylococcus aureus subsp. aureus MW2
cugaucgcauguuugua

SEQ ID NO: 2084964 - RNA, 17 nt, Staphylococcus aureus subsp. aureus MW2
cucgcauacugucaucu

SEQ ID NO: 2084965 - RNA, 13 nt, Staphylococcus aureus subsp. aureus MW2
cuaucuucaucau

SEQ ID NO: 2084966 - RNA, 14 nt, Staphylococcus aureus subsp. aureus MW2
cuaugaccaugaua

SEQ ID NO: 2084967 - RNA, 17 nt, Staphylococcus aureus subsp. aureus MW2
cuaucuuuucaucguuc

SEQ ID NO: 2084968 - RNA, 12 nt, Staphylococcus aureus subsp. aureus MW2
cucaauucucua

SEQ ID NO: 2084969 - RNA, 23 nt, Staphylococcus aureus subsp. aureus MW2
cucaauccugauuccacuacaau

SEQ ID NO: 2084970 - RNA, 17 nt, Staphylococcus aureus subsp. aureus MW2
cuacacgaguguuauca

SEQ ID NO: 2084971 - RNA, 17 nt, Staphylococcus aureus subsp. aureus MW2
cuacaggcaaugcaagu

SEQ ID NO: 2084972 - RNA, 23 nt, Staphylococcus aureus subsp. aureus MW2
cuacuuugucugcaauuucauag

SEQ ID NO: 2084973 - RNA, 15 nt, Staphylococcus aureus subsp. aureus MW2
cuacuuuuucaucuu

SEQ ID NO: 2084974 - RNA, 14 nt, Staphylococcus aureus subsp. aureus MW2
cuagauaugccuau

SEQ ID NO: 2084975 - RNA, 21 nt, Staphylococcus aureus subsp. aureus MW2
cuacuaaaggaauuucaaacg

SEQ ID NO: 2084976 - RNA, 16 nt, Staphylococcus aureus subsp. aureus MW2
cucauugugcuugaua

SEQ ID NO: 2084977 - RNA, 17 nt, Staphylococcus aureus subsp. aureus MW2
cucaauuuaguauaaau

SEQ ID NO: 2084978 - RNA, 19 nt, Staphylococcus aureus subsp. aureus MW2
gaauccaauuucucuaugu

SEQ ID NO: 2084979 - RNA, 16 nt, Staphylococcus aureus subsp. aureus MW2
gaauuugcacaaagau

SEQ ID NO: 2084980 - RNA, 18 nt, Staphylococcus aureus subsp. aureus MW2
gaaugacguuaucaucuc

SEQ ID NO: 2084981 - RNA, 20 nt, Staphylococcus aureus subsp. aureus MW2
gacacaucacuauacgcaau

SEQ ID NO: 2084982 - RNA, 12 nt, Staphylococcus aureus subsp. aureus MW2
gacaaucgaaug

SEQ ID NO: 2084983 - RNA, 14 nt, Staphylococcus aureus subsp. aureus MW2
gagauaaaaucaua

SEQ ID NO: 2084984 - RNA, 19 nt, Staphylococcus aureus subsp. aureus MW2
gacugaacgaaaaugcgcu

SEQ ID NO: 2084985 - RNA, 23 nt, Staphylococcus aureus subsp. aureus MW2
gacuuuuaaaaaacauaccugca

SEQ ID NO: 2084986 - RNA, 15 nt, Staphylococcus aureus subsp. aureus MW2
gacuguaaguaugua

SEQ ID NO: 2084987 - RNA, 20 nt, Staphylococcus aureus subsp. aureus MW2
cuuagucauguuuggcauaa

SEQ ID NO: 2084988 - RNA, 23 nt, Staphylococcus aureus subsp. aureus MW2
cuuagcguacgauauagugcuug

SEQ ID NO: 2084989 - RNA, 18 nt, Staphylococcus aureus subsp. aureus MW2
cuguuuucauuuguuaac

SEQ ID NO: 2084990 - RNA, 15 nt, Staphylococcus aureus subsp. aureus MW2
cuguagaaacacuuu

SEQ ID NO: 2084991 - RNA, 19 nt, Staphylococcus aureus subsp. aureus MW2
cuguaaacgauacugcuuu

SEQ ID NO: 2084992 - RNA, 14 nt, Staphylococcus aureus subsp. aureus MW2
cuguaauaccuuua

SEQ ID NO: 2084993 - RNA, 19 nt, Staphylococcus aureus subsp. aureus MW2
cuguaaugcacuaccauca

SEQ ID NO: 2084994 - RNA, 18 nt, Staphylococcus aureus subsp. aureus MW2
cuucgauggcugcaacaa

SEQ ID NO: 2084995 - RNA, 13 nt, Staphylococcus aureus subsp. aureus MW2
cuuauagaaugau

SEQ ID NO: 2084996 - RNA, 22 nt, Staphylococcus aureus subsp. aureus MW2
cuuaucaagaauauaacgaaug

SEQ ID NO: 2084997 - RNA, 20 nt, Staphylococcus aureus subsp. aureus MW2
cuucauaagucacaguaucu

SEQ ID NO: 2084998 - RNA, 17 nt, Staphylococcus aureus subsp. aureus MW2
cuucauauuuagguaau

SEQ ID NO: 2084999 - RNA, 17 nt, Staphylococcus aureus subsp. aureus MW2
cuggucguacuuucaaa

SEQ ID NO: 2085000 - RNA, 16 nt, Staphylococcus aureus subsp. aureus MW2
gaacuaagaugugcau

SEQ ID NO: 2085001 - RNA, 12 nt, Staphylococcus aureus subsp. aureus MW2
gaacaucugaaa

SEQ ID NO: 2085002 - RNA, 16 nt, Staphylococcus aureus subsp. aureus MW2
gaaauuucgacaucua

SEQ ID NO: 2085003 - RNA, 14 nt, Staphylococcus aureus subsp. aureus MW2
cuuuaaagguauug

SEQ ID NO: 2085004 - RNA, 21 nt, Staphylococcus aureus subsp. aureus MW2
cuuuaacugcgugaauguuac

SEQ ID NO: 2085005 - RNA, 13 nt, Staphylococcus aureus subsp. aureus MW2
cuuuaacuucuuu

SEQ ID NO: 2085006 - RNA, 13 nt, Staphylococcus aureus subsp. aureus MW2
cuuuaacauuuau

SEQ ID NO: 2085007 - RNA, 15 nt, Staphylococcus aureus subsp. aureus MW2
cuuuaaaauucucua

SEQ ID NO: 2085008 - RNA, 22 nt, Staphylococcus aureus subsp. aureus MW2
cuuuaaaauucucuagugcuuu

SEQ ID NO: 2085009 - RNA, 23 nt, Staphylococcus aureus subsp. aureus MW2
cuuuaaaaauugcaaugcuauca

SEQ ID NO: 2085010 - RNA, 15 nt, Staphylococcus aureus subsp. aureus MW2
cuuuaaaacaucauu

SEQ ID NO: 2085011 - RNA, 20 nt, Staphylococcus aureus subsp. aureus MW2
cuuuaaaacguuaguacuuu

SEQ ID NO: 2085012 - RNA, 14 nt, Staphylococcus aureus subsp. aureus MW2
cuuguuuuaaacuu

SEQ ID NO: 2085013 - RNA, 16 nt, Staphylococcus aureus subsp. aureus MW2
cuuuaauuucauuuau

SEQ ID NO: 2085014 - RNA, 16 nt, Staphylococcus aureus subsp. aureus MW2
cuuuagaaacaccuuu

SEQ ID NO: 2085015 - RNA, 18 nt, Staphylococcus aureus subsp. aureus MW2
cuuuaauuuucuugccau

SEQ ID NO: 2085016 - RNA, 15 nt, Staphylococcus aureus subsp. aureus MW2
cuuguaaacuucuuu

SEQ ID NO: 2085017 - RNA, 17 nt, Staphylococcus aureus subsp. aureus MW2
cuuggugccgaaauugu

SEQ ID NO: 2085018 - RNA, 20 nt, Staphylococcus aureus subsp. aureus MW2
gaaaucaguuuuugaauauu

SEQ ID NO: 2085019 - RNA, 22 nt, Staphylococcus aureus subsp. aureus MW2
gaaaucagcuuuucuucaacua

SEQ ID NO: 2085020 - RNA, 14 nt, Staphylococcus aureus subsp. aureus MW2
gaaauagaaauguc

SEQ ID NO: 2085021 - RNA, 16 nt, Staphylococcus aureus subsp. aureus MW2
gaaauacuugaaugua

SEQ ID NO: 2085022 - RNA, 17 nt, Staphylococcus aureus subsp. aureus MW2
cuuuuuaggaaugauag

SEQ ID NO: 2085023 - RNA, 13 nt, Staphylococcus aureus subsp. aureus MW2
cuuuuuaucauga

SEQ ID NO: 2085024 - RNA, 18 nt, Staphylococcus aureus subsp. aureus MW2
cuuuuucaauucuaguca

SEQ ID NO: 2085025 - RNA, 16 nt, Staphylococcus aureus subsp. aureus MW2
cuuuuaauaguguuau

SEQ ID NO: 2085026 - RNA, 16 nt, Staphylococcus aureus subsp. aureus MW2
cuuuuaauagaucuuu

SEQ ID NO: 2085027 - RNA, 15 nt, Staphylococcus aureus subsp. aureus MW2
cuuuuacaaucauca

SEQ ID NO: 2085028 - RNA, 15 nt, Staphylococcus aureus subsp. aureus MW2
cuuuucacaauauac

SEQ ID NO: 2085029 - RNA, 20 nt, Staphylococcus aureus subsp. aureus MW2
cuuuugauguuuaugacaaa

SEQ ID NO: 2085030 - RNA, 19 nt, Staphylococcus aureus subsp. aureus MW2
cuuuuguaauugaaaugau

SEQ ID NO: 2085031 - RNA, 11 nt, Staphylococcus aureus subsp. aureus MW2
cuuuuguuaau

SEQ ID NO: 2085032 - RNA, 17 nt, Staphylococcus aureus subsp. aureus MW2
cgaagucauaugcauac

SEQ ID NO: 2085033 - RNA, 20 nt, Staphylococcus aureus subsp. aureus MW2
ccuucaaagauuuuaccuug

SEQ ID NO: 2085034 - RNA, 14 nt, Staphylococcus aureus subsp. aureus MW2
cgaacaugaaugau

SEQ ID NO: 2085035 - RNA, 21 nt, Staphylococcus aureus subsp. aureus MW2
ccuauuuuuugagcacuuaau

SEQ ID NO: 2085036 - RNA, 19 nt, Staphylococcus aureus subsp. aureus MW2
ccuauuuuacaaucaacuu

SEQ ID NO: 2085037 - RNA, 13 nt, Staphylococcus aureus subsp. aureus MW2
cgcuuuuucauag

SEQ ID NO: 2085038 - RNA, 15 nt, Staphylococcus aureus subsp. aureus MW2
aaaauaauagauaau

SEQ ID NO: 2085039 - RNA, 17 nt, Staphylococcus aureus subsp. aureus MW2
aaaauaacuaagugaau

SEQ ID NO: 2085040 - RNA, 20 nt, Staphylococcus aureus subsp. aureus MW2
aaaauaccugcaaugaugau

SEQ ID NO: 2085041 - RNA, 22 nt, Staphylococcus aureus subsp. aureus MW2
aaaauaauuaugaaaagugaau

SEQ ID NO: 2085042 - RNA, 21 nt, Staphylococcus aureus subsp. aureus MW2
aaaauauuuaaacuaguaaua

SEQ ID NO: 2085043 - RNA, 21 nt, Staphylococcus aureus subsp. aureus MW2
aaaaucaaauugacgcauuaa

SEQ ID NO: 2085044 - RNA, 19 nt, Staphylococcus aureus subsp. aureus MW2
aaaaguguugacuuuauca

SEQ ID NO: 2085045 - RNA, 14 nt, Staphylococcus aureus subsp. aureus MW2
aaaaguauaugaau

SEQ ID NO: 2085046 - RNA, 13 nt, Staphylococcus aureus subsp. aureus MW2
aaaagccaccuau

SEQ ID NO: 2085047 - RNA, 22 nt, Staphylococcus aureus subsp. aureus MW2
aaaagguuaauauuaaauuuug

SEQ ID NO: 2085048 - RNA, 16 nt, Staphylococcus aureus subsp. aureus MW2
aaaagguuagauggau

SEQ ID NO: 2085049 - RNA, 12 nt, Staphylococcus aureus subsp. aureus MW2
aaaaugaaugaa

SEQ ID NO: 2085050 - RNA, 19 nt, Staphylococcus aureus subsp. aureus MW2
aaaaucucauaauaauuca

SEQ ID NO: 2085051 - RNA, 13 nt, Staphylococcus aureus subsp. aureus MW2
aaaaugaaaugaa

SEQ ID NO: 2085052 - RNA, 16 nt, Staphylococcus aureus subsp. aureus MW2
aaaauuagcgauacuu

SEQ ID NO: 2085053 - RNA, 18 nt, Staphylococcus aureus subsp. aureus MW2
aaaaagacagcaguagga

SEQ ID NO: 2085054 - RNA, 14 nt, Staphylococcus aureus subsp. aureus MW2
aaaaccuucaguaa

SEQ ID NO: 2085055 - RNA, 18 nt, Staphylococcus aureus subsp. aureus MW2
aaaacgauuaauaguuuu

SEQ ID NO: 2085056 - RNA, 19 nt, Staphylococcus aureus subsp. aureus MW2
aaaacagcaguaagauauu

SEQ ID NO: 2085057 - RNA, 14 nt, Staphylococcus aureus subsp. aureus MW2
aaaacauaaucauu

SEQ ID NO: 2085058 - RNA, 19 nt, Staphylococcus aureus subsp. aureus MW2
aaaaauugcaaugcuauca

SEQ ID NO: 2085059 - RNA, 12 nt, Staphylococcus aureus subsp. aureus MW2
aaaaauguaaau

SEQ ID NO: 2085060 - RNA, 13 nt, Staphylococcus aureus subsp. aureus MW2
aaaagaguacauu

SEQ ID NO: 2085061 - RNA, 16 nt, Staphylococcus aureus subsp. aureus MW2
aaaaagcaguaagaga

SEQ ID NO: 2085062 - RNA, 18 nt, Staphylococcus aureus subsp. aureus MW2
aaagggcgaaauggauuc

SEQ ID NO: 2085063 - RNA, 17 nt, Staphylococcus aureus subsp. aureus MW2
aaacauuaaucuauaua

SEQ ID NO: 2085064 - RNA, 15 nt, Staphylococcus aureus subsp. aureus MW2
aaacauccaauuaug

SEQ ID NO: 2085065 - RNA, 13 nt, Staphylococcus aureus subsp. aureus MW2
aaacaguguagca

SEQ ID NO: 2085066 - RNA, 13 nt, Staphylococcus aureus subsp. aureus MW2
aaacauaaucauu

SEQ ID NO: 2085067 - RNA, 18 nt, Staphylococcus aureus subsp. aureus MW2
aaaccaaaaauaauuaug

SEQ ID NO: 2085068 - RNA, 19 nt, Staphylococcus aureus subsp. aureus MW2
aaacagcaguaagaugauu

SEQ ID NO: 2085069 - RNA, 15 nt, Staphylococcus aureus subsp. aureus MW2
aaaauugcuauauua

SEQ ID NO: 2085070 - RNA, 12 nt, Staphylococcus aureus subsp. aureus MW2
aaaauuguaagu

SEQ ID NO: 2085071 - RNA, 12 nt, Staphylococcus aureus subsp. aureus MW2
aaacaacaucac

SEQ ID NO: 2085072 - RNA, 15 nt, Staphylococcus aureus subsp. aureus MW2
aaacaacaucgauuu

SEQ ID NO: 2085073 - RNA, 14 nt, Staphylococcus aureus subsp. aureus MW2
aaacaacaucgauu

SEQ ID NO: 2085074 - RNA, 17 nt, Staphylococcus aureus subsp. aureus MW2
aaacacccugcuuauca

SEQ ID NO: 2085075 - RNA, 16 nt, Staphylococcus aureus subsp. aureus MW2
aaaccuuuucaaacua

SEQ ID NO: 2085076 - RNA, 19 nt, Staphylococcus aureus subsp. aureus MW2
aaaccugguggcacgcauu

SEQ ID NO: 2085077 - RNA, 12 nt, Staphylococcus aureus subsp. aureus MW2
aaaccuaacaua

SEQ ID NO: 2085078 - RNA, 15 nt, Staphylococcus aureus subsp. aureus MW2
aaauuaaucacauaa

SEQ ID NO: 2085079 - RNA, 14 nt, Staphylococcus aureus subsp. aureus MW2
aaauguugaaugug

SEQ ID NO: 2085080 - RNA, 16 nt, Staphylococcus aureus subsp. aureus MW2
aaaacuaucugauuaa

SEQ ID NO: 2085081 - RNA, 16 nt, Staphylococcus aureus subsp. aureus MW2
aaaacuacuucaucug

SEQ ID NO: 2085082 - RNA, 17 nt, Staphylococcus aureus subsp. aureus MW2
aaauuagccauuucaau

SEQ ID NO: 2085083 - RNA, 21 nt, Staphylococcus aureus subsp. aureus MW2
aaauuuugauuuaccuucauc

SEQ ID NO: 2085084 - RNA, 20 nt, Staphylococcus aureus subsp. aureus MW2
aaauuuaacucaacuuaaau

SEQ ID NO: 2085085 - RNA, 16 nt, Staphylococcus aureus subsp. aureus MW2
aaauuuaaauauugaa

SEQ ID NO: 2085086 - RNA, 22 nt, Staphylococcus aureus subsp. aureus MW2
aaaaggucuauguacaaucauu

SEQ ID NO: 2085087 - RNA, 17 nt, Staphylococcus aureus subsp. aureus MW2
aaaagguuagauggauu

SEQ ID NO: 2085088 - RNA, 18 nt, Staphylococcus aureus subsp. aureus MW2
aacaauugacguguaauc

SEQ ID NO: 2085089 - RNA, 19 nt, Staphylococcus aureus subsp. aureus MW2
aacaccccuucucuaaauu

SEQ ID NO: 2085090 - RNA, 16 nt, Staphylococcus aureus subsp. aureus MW2
aacaccccagcuugac

SEQ ID NO: 2085091 - RNA, 19 nt, Staphylococcus aureus subsp. aureus MW2
aacaccauuauagacauaa

SEQ ID NO: 2085092 - RNA, 23 nt, Staphylococcus aureus subsp. aureus MW2
aaaugauuaaaguguuucaacau

SEQ ID NO: 2085093 - RNA, 16 nt, Staphylococcus aureus subsp. aureus MW2
aaaugauuaauaacau

SEQ ID NO: 2085094 - RNA, 16 nt, Staphylococcus aureus subsp. aureus MW2
aaaugucaguuuugaa

SEQ ID NO: 2085095 - RNA, 20 nt, Staphylococcus aureus subsp. aureus MW2
aaaacagcaguaagauuauu

SEQ ID NO: 2085096 - RNA, 16 nt, Staphylococcus aureus subsp. aureus MW2
aaaaauuguuaauccc

SEQ ID NO: 2085097 - RNA, 20 nt, Staphylococcus aureus subsp. aureus MW2
aaaucaugacauaaaacuua

SEQ ID NO: 2085098 - RNA, 19 nt, Staphylococcus aureus subsp. aureus MW2
aaaucauucauuugcaaag

SEQ ID NO: 2085099 - RNA, 13 nt, Staphylococcus aureus subsp. aureus MW2
aaauccaaugaug

SEQ ID NO: 2085100 - RNA, 11 nt, Staphylococcus aureus subsp. aureus MW2
aaaucauugcg

SEQ ID NO: 2085101 - RNA, 13 nt, Staphylococcus aureus subsp. aureus MW2
aaauaaacauauc

SEQ ID NO: 2085102 - RNA, 12 nt, Staphylococcus aureus subsp. aureus MW2
aaaucagcuuuu

SEQ ID NO: 2085103 - RNA, 21 nt, Staphylococcus aureus subsp. aureus MW2
aauuuuuucaucauucaaacu

SEQ ID NO: 2085104 - RNA, 20 nt, Staphylococcus aureus subsp. aureus MW2
aauuucucacugcuguucuu

SEQ ID NO: 2085105 - RNA, 20 nt, Staphylococcus aureus subsp. aureus MW2
aauuucuacagacaaugcaa

SEQ ID NO: 2085106 - RNA, 21 nt, Staphylococcus aureus subsp. aureus MW2
aauuuccugcagucauuugau

SEQ ID NO: 2085107 - RNA, 20 nt, Staphylococcus aureus subsp. aureus MW2
acaaagauuauugaaauuug

SEQ ID NO: 2085108 - RNA, 20 nt, Staphylococcus aureus subsp. aureus MW2
acaaauauacuugccuucaa

SEQ ID NO: 2085109 - RNA, 16 nt, Staphylococcus aureus subsp. aureus MW2
acaagccaagauaaau

SEQ ID NO: 2085110 - RNA, 14 nt, Staphylococcus aureus subsp. aureus MW2
acaauaucacuuaa

SEQ ID NO: 2085111 - RNA, 19 nt, Staphylococcus aureus subsp. aureus MW2
acaaucaacuuagaauuua

SEQ ID NO: 2085112 - RNA, 15 nt, Staphylococcus aureus subsp. aureus MW2
acacacccaaauuua

SEQ ID NO: 2085113 - RNA, 16 nt, Staphylococcus aureus subsp. aureus MW2
acacagcuucauuaau

SEQ ID NO: 2085114 - RNA, 20 nt, Staphylococcus aureus subsp. aureus MW2
acaauuuuaauuuuucauua

SEQ ID NO: 2085115 - RNA, 16 nt, Staphylococcus aureus subsp. aureus MW2
acaauuuucucauuaa

SEQ ID NO: 2085116 - RNA, 18 nt, Staphylococcus aureus subsp. aureus MW2
acaaucuaaauguaaaau

SEQ ID NO: 2085117 - RNA, 12 nt, Staphylococcus aureus subsp. aureus MW2
acaaugccuuua

SEQ ID NO: 2085118 - RNA, 13 nt, Staphylococcus aureus subsp. aureus MW2
aaugcuuucaaau

SEQ ID NO: 2085119 - RNA, 13 nt, Staphylococcus aureus subsp. aureus MW2
aaugacuucacau

SEQ ID NO: 2085120 - RNA, 23 nt, Staphylococcus aureus subsp. aureus MW2
aaugcacgcgugccaacaucuuc

SEQ ID NO: 2085121 - RNA, 18 nt, Staphylococcus aureus subsp. aureus MW2
aaugccgagauuauuaug

SEQ ID NO: 2085122 - RNA, 17 nt, Staphylococcus aureus subsp. aureus MW2
aaucaccuuuuuuaacu

SEQ ID NO: 2085123 - RNA, 12 nt, Staphylococcus aureus subsp. aureus MW2
aaucacaucuuu

SEQ ID NO: 2085124 - RNA, 17 nt, Staphylococcus aureus subsp. aureus MW2
aaucuuuuccuaaaccu

SEQ ID NO: 2085125 - RNA, 16 nt, Staphylococcus aureus subsp. aureus MW2
aaugaccaauagccau

SEQ ID NO: 2085126 - RNA, 14 nt, Staphylococcus aureus subsp. aureus MW2
aauuaaccccuuca

SEQ ID NO: 2085127 - RNA, 17 nt, Staphylococcus aureus subsp. aureus MW2
aauuaaauauuuaaccu

SEQ ID NO: 2085128 - RNA, 17 nt, Staphylococcus aureus subsp. aureus MW2
aauuaauacaucaauau

SEQ ID NO: 2085129 - RNA, 23 nt, Staphylococcus aureus subsp. aureus MW2
aauuaauacaucaauaucuucua

SEQ ID NO: 2085130 - RNA, 15 nt, Staphylococcus aureus subsp. aureus MW2
aauggggacauguuc

SEQ ID NO: 2085131 - RNA, 18 nt, Staphylococcus aureus subsp. aureus MW2
aauugcuaaaucaucuuc

SEQ ID NO: 2085132 - RNA, 15 nt, Staphylococcus aureus subsp. aureus MW2
aauuuaaaugcuuaa

SEQ ID NO: 2085133 - RNA, 18 nt, Staphylococcus aureus subsp. aureus MW2
acacauauaguuguauca

SEQ ID NO: 2085134 - RNA, 22 nt, Staphylococcus aureus subsp. aureus MW2
aaaagucccgcuuaaaaugauu

SEQ ID NO: 2085135 - RNA, 13 nt, Staphylococcus aureus subsp. aureus MW2
aaaauaaugauac

SEQ ID NO: 2085136 - RNA, 17 nt, Staphylococcus aureus subsp. aureus MW2
aaaauaccaaauaugac

SEQ ID NO: 2085137 - RNA, 21 nt, Staphylococcus aureus subsp. aureus MW2
aaaauacgguacagauaggaa

SEQ ID NO: 2085138 - RNA, 16 nt, Staphylococcus aureus subsp. aureus MW2
aaaauaauaugaauuu

SEQ ID NO: 2085139 - RNA, 13 nt, Staphylococcus aureus subsp. aureus MW2
aaaauaauaugaa

SEQ ID NO: 2085140 - RNA, 20 nt, Staphylococcus aureus subsp. aureus MW2
acacgcggugggcgaaauca

SEQ ID NO: 2085141 - RNA, 21 nt, Staphylococcus aureus subsp. aureus MW2
acagcgucaccuaaugcuuua

SEQ ID NO: 2085142 - RNA, 14 nt, Staphylococcus aureus subsp. aureus MW2
aaggaugaugugaa

SEQ ID NO: 2085143 - RNA, 12 nt, Staphylococcus aureus subsp. aureus MW2
aagccaugauac

SEQ ID NO: 2085144 - RNA, 16 nt, Staphylococcus aureus subsp. aureus MW2
aagucuguauauggcg

SEQ ID NO: 2085145 - RNA, 21 nt, Staphylococcus aureus subsp. aureus MW2
aagucucauuaucaccaccuu

SEQ ID NO: 2085146 - RNA, 15 nt, Staphylococcus aureus subsp. aureus MW2
aagugccagguucaa

SEQ ID NO: 2085147 - RNA, 22 nt, Staphylococcus aureus subsp. aureus MW2
aagucguucucuuaaauaugaa

SEQ ID NO: 2085148 - RNA, 14 nt, Staphylococcus aureus subsp. aureus MW2
aagugggauaugaa

SEQ ID NO: 2085149 - RNA, 19 nt, Staphylococcus aureus subsp. aureus MW2
aaguguugaccauuaucaa

SEQ ID NO: 2085150 - RNA, 18 nt, Staphylococcus aureus subsp. aureus MW2
aauaaugugcaaguuggc

SEQ ID NO: 2085151 - RNA, 18 nt, Staphylococcus aureus subsp. aureus MW2
aauaauuggaaucaucuu

SEQ ID NO: 2085152 - RNA, 17 nt, Staphylococcus aureus subsp. aureus MW2
aauaaugacgagaauua

SEQ ID NO: 2085153 - RNA, 14 nt, Staphylococcus aureus subsp. aureus MW2
aauaauguaucauu

SEQ ID NO: 2085154 - RNA, 14 nt, Staphylococcus aureus subsp. aureus MW2
aauaaugauacuaa

SEQ ID NO: 2085155 - RNA, 23 nt, Staphylococcus aureus subsp. aureus MW2
aauaauaucaccuuuuuuaagau

SEQ ID NO: 2085156 - RNA, 12 nt, Staphylococcus aureus subsp. aureus MW2
aauaacauguuu

SEQ ID NO: 2085157 - RNA, 14 nt, Staphylococcus aureus subsp. aureus MW2
aauaaccauucacu

SEQ ID NO: 2085158 - RNA, 13 nt, Staphylococcus aureus subsp. aureus MW2
aaguugauaacua

SEQ ID NO: 2085159 - RNA, 16 nt, Staphylococcus aureus subsp. aureus MW2
aaguuuauacuuaaua

SEQ ID NO: 2085160 - RNA, 17 nt, Staphylococcus aureus subsp. aureus MW2
aauaaauuuagauauaa

SEQ ID NO: 2085161 - RNA, 14 nt, Staphylococcus aureus subsp. aureus MW2
aauaaaucuaucua

SEQ ID NO: 2085162 - RNA, 21 nt, Staphylococcus aureus subsp. aureus MW2
aauaaaucuaucuauucaaau

SEQ ID NO: 2085163 - RNA, 16 nt, Staphylococcus aureus subsp. aureus MW2
aauacuaagauuagcu

SEQ ID NO: 2085164 - RNA, 22 nt, Staphylococcus aureus subsp. aureus MW2
aauauagcugugauuugaucaa

SEQ ID NO: 2085165 - RNA, 20 nt, Staphylococcus aureus subsp. aureus MW2
aauaugacgaucuucaugaa

SEQ ID NO: 2085166 - RNA, 21 nt, Staphylococcus aureus subsp. aureus MW2
aauauaguaauaaaagucgau

SEQ ID NO: 2085167 - RNA, 20 nt, Staphylococcus aureus subsp. aureus MW2
aaucaaauauuuuauuacau

SEQ ID NO: 2085168 - RNA, 17 nt, Staphylococcus aureus subsp. aureus MW2
aauauuuuuaucaucgu

SEQ ID NO: 2085169 - RNA, 20 nt, Staphylococcus aureus subsp. aureus MW2
aaucaauuuaucgagaacau

SEQ ID NO: 2085170 - RNA, 20 nt, Staphylococcus aureus subsp. aureus MW2
aaucaauuucaccuuguaaa

SEQ ID NO: 2085171 - RNA, 16 nt, Staphylococcus aureus subsp. aureus MW2
aaucaaccuuugcuaa

SEQ ID NO: 2085172 - RNA, 20 nt, Staphylococcus aureus subsp. aureus MW2
aauauuauaaaaagauauaa

SEQ ID NO: 2085173 - RNA, 13 nt, Staphylococcus aureus subsp. aureus MW2
aauaugcuaugua

SEQ ID NO: 2085174 - RNA, 19 nt, Staphylococcus aureus subsp. aureus MW2
aauauucguagcaugacau

SEQ ID NO: 2085175 - RNA, 22 nt, Staphylococcus aureus subsp. aureus MW2
aauauucguagcaugacauuaa

SEQ ID NO: 2085176 - RNA, 19 nt, Staphylococcus aureus subsp. aureus MW2
aauauucaauaauucauca

SEQ ID NO: 2085177 - RNA, 15 nt, Staphylococcus aureus subsp. aureus MW2
aauauugauaucgaa

SEQ ID NO: 2085178 - RNA, 15 nt, Staphylococcus aureus subsp. aureus MW2
aacacgacaaucgaa

SEQ ID NO: 2085179 - RNA, 22 nt, Staphylococcus aureus subsp. aureus MW2
aaccuauuuuuuauaugaugaa

SEQ ID NO: 2085180 - RNA, 19 nt, Staphylococcus aureus subsp. aureus MW2
aaccguauuauuaguuuug

SEQ ID NO: 2085181 - RNA, 21 nt, Staphylococcus aureus subsp. aureus MW2
aaccuuaauuauuuucucgau

SEQ ID NO: 2085182 - RNA, 21 nt, Staphylococcus aureus subsp. aureus MW2
aacuaucuacaccauuaucgc

SEQ ID NO: 2085183 - RNA, 15 nt, Staphylococcus aureus subsp. aureus MW2
aacucaaaccuguuu

SEQ ID NO: 2085184 - RNA, 18 nt, Staphylococcus aureus subsp. aureus MW2
aacggcauaauacacauu

SEQ ID NO: 2085185 - RNA, 15 nt, Staphylococcus aureus subsp. aureus MW2
aacugauaauugaug

SEQ ID NO: 2085186 - RNA, 20 nt, Staphylococcus aureus subsp. aureus MW2
aacuuguuguuauuuauuug

SEQ ID NO: 2085187 - RNA, 22 nt, Staphylococcus aureus subsp. aureus MW2
aacugucgcucauccucauuaa

SEQ ID NO: 2085188 - RNA, 15 nt, Staphylococcus aureus subsp. aureus MW2
aacuuaacucuauca

SEQ ID NO: 2085189 - RNA, 20 nt, Staphylococcus aureus subsp. aureus MW2
aagaaugugaacaucuaguu

SEQ ID NO: 2085190 - RNA, 18 nt, Staphylococcus aureus subsp. aureus MW2
aagaauguguuaaucaac

SEQ ID NO: 2085191 - RNA, 17 nt, Staphylococcus aureus subsp. aureus MW2
aagaagugacaucguug

SEQ ID NO: 2085192 - RNA, 16 nt, Staphylococcus aureus subsp. aureus MW2
aagacagguuacuuuu

SEQ ID NO: 2085193 - RNA, 13 nt, Staphylococcus aureus subsp. aureus MW2
aaacaacaucacu

SEQ ID NO: 2085194 - RNA, 23 nt, Staphylococcus aureus subsp. aureus MW2
aaacaauacguuuucggauugaa

SEQ ID NO: 2085195 - RNA, 13 nt, Staphylococcus aureus subsp. aureus MW2
aaaauuucaguac

SEQ ID NO: 2085196 - RNA, 14 nt, Staphylococcus aureus subsp. aureus MW2
acgaguguuaucac

SEQ ID NO: 2085197 - RNA, 18 nt, Staphylococcus aureus subsp. aureus MW2
acgaacaaggcgacuucu

SEQ ID NO: 2085198 - RNA, 19 nt, Staphylococcus aureus subsp. aureus MW2
accuuguuucaagcuuaau

SEQ ID NO: 2085199 - RNA, 21 nt, Staphylococcus aureus subsp. aureus MW2
accguuaguacggcugcuuua

SEQ ID NO: 2085200 - RNA, 19 nt, Staphylococcus aureus subsp. aureus MW2
accucuuuuguuuaguaug

SEQ ID NO: 2085201 - RNA, 18 nt, Staphylococcus aureus subsp. aureus MW2
accucuuguaauguuggc

SEQ ID NO: 2085202 - RNA, 22 nt, Staphylococcus aureus subsp. aureus MW2
accucuguuuuguugguguuua

SEQ ID NO: 2085203 - RNA, 22 nt, Staphylococcus aureus subsp. aureus MW2
accgauuguuucaccagcuugu

SEQ ID NO: 2085204 - RNA, 23 nt, Staphylococcus aureus subsp. aureus MW2
acauaaauguucgaauaggauug

SEQ ID NO: 2085205 - RNA, 14 nt, Staphylococcus aureus subsp. aureus MW2
acaguuacuucagu

SEQ ID NO: 2085206 - RNA, 15 nt, Staphylococcus aureus subsp. aureus MW2
acauaaacaauaacu

SEQ ID NO: 2085207 - RNA, 15 nt, Staphylococcus aureus subsp. aureus MW2
acauaaaucaauauu

SEQ ID NO: 2085208 - RNA, 22 nt, Staphylococcus aureus subsp. aureus MW2
aaaauauuacuaacaaccguuu

SEQ ID NO: 2085209 - RNA, 13 nt, Staphylococcus aureus subsp. aureus MW2
aaaauaucacuaa

SEQ ID NO: 2085210 - RNA, 12 nt, Staphylococcus aureus subsp. aureus MW2
aaaaucuauaua

SEQ ID NO: 2085211 - RNA, 15 nt, Staphylococcus aureus subsp. aureus MW2
aaaaugauagauuca

SEQ ID NO: 2085212 - RNA, 16 nt, Staphylococcus aureus subsp. aureus MW2
accauuuacuucauaa

SEQ ID NO: 2085213 - RNA, 15 nt, Staphylococcus aureus subsp. aureus MW2
aaaauucuggauuaa

SEQ ID NO: 2085214 - RNA, 14 nt, Staphylococcus aureus subsp. aureus MW2
aaaauuagaauucg

SEQ ID NO: 2085215 - RNA, 18 nt, Staphylococcus aureus subsp. aureus MW2
aaaauuagacguguaaau

SEQ ID NO: 2085216 - RNA, 23 nt, Staphylococcus aureus subsp. aureus MW2
aaaauuagggguggaaauaugaa

SEQ ID NO: 2085217 - RNA, 18 nt, Staphylococcus aureus subsp. aureus MW2
acuaaucguuguggcuuu

SEQ ID NO: 2085218 - RNA, 15 nt, Staphylococcus aureus subsp. aureus MW2
acuaauaacuaguau

SEQ ID NO: 2085219 - RNA, 16 nt, Staphylococcus aureus subsp. aureus MW2
acuaagaugacugaac

SEQ ID NO: 2085220 - RNA, 16 nt, Staphylococcus aureus subsp. aureus MW2
acuaauguaaagccac

SEQ ID NO: 2085221 - RNA, 14 nt, Staphylococcus aureus subsp. aureus MW2
acguucauggauuc

SEQ ID NO: 2085222 - RNA, 16 nt, Staphylococcus aureus subsp. aureus MW2
acguuuccaauccauu

SEQ ID NO: 2085223 - RNA, 19 nt, Staphylococcus aureus subsp. aureus MW2
acuaaaaguguuaugaauu

SEQ ID NO: 2085224 - RNA, 20 nt, Staphylococcus aureus subsp. aureus MW2
acguuuucuagguaauacga

SEQ ID NO: 2085225 - RNA, 17 nt, Staphylococcus aureus subsp. aureus MW2
aaacacccacaauugug

SEQ ID NO: 2085226 - RNA, 22 nt, Staphylococcus aureus subsp. aureus MW2
aaacaccuuucgcgacuucauu

SEQ ID NO: 2085227 - RNA, 14 nt, Staphylococcus aureus subsp. aureus MW2
acggaaauaaccac

SEQ ID NO: 2085228 - RNA, 18 nt, Staphylococcus aureus subsp. aureus MW2
acgcuuuaaaucauugcg

SEQ ID NO: 2085229 - RNA, 20 nt, Staphylococcus aureus subsp. aureus MW2
agacucuccaccauaugugg

SEQ ID NO: 2085230 - RNA, 17 nt, Staphylococcus aureus subsp. aureus MW2
agacuuauucaacguau

SEQ ID NO: 2085231 - RNA, 15 nt, Staphylococcus aureus subsp. aureus MW2
agaugauauuacaua

SEQ ID NO: 2085232 - RNA, 15 nt, Staphylococcus aureus subsp. aureus MW2
agaugauaacgucau

SEQ ID NO: 2085233 - RNA, 21 nt, Staphylococcus aureus subsp. aureus MW2
acuuuuuauuaguauucaaaa

SEQ ID NO: 2085234 - RNA, 14 nt, Staphylococcus aureus subsp. aureus MW2
acuuugucuguauu

SEQ ID NO: 2085235 - RNA, 12 nt, Staphylococcus aureus subsp. aureus MW2
acuuucuuuauu

SEQ ID NO: 2085236 - RNA, 21 nt, Staphylococcus aureus subsp. aureus MW2
agaaaggcuagcuaaaauuug

SEQ ID NO: 2085237 - RNA, 22 nt, Staphylococcus aureus subsp. aureus MW2
agaaauguuaacgauagacauu

SEQ ID NO: 2085238 - RNA, 16 nt, Staphylococcus aureus subsp. aureus MW2
agaaauaaucacauua

SEQ ID NO: 2085239 - RNA, 15 nt, Staphylococcus aureus subsp. aureus MW2
agaaauguaugacau

SEQ ID NO: 2085240 - RNA, 21 nt, Staphylococcus aureus subsp. aureus MW2
agaaauuguguuucuuuuauu

SEQ ID NO: 2085241 - RNA, 16 nt, Staphylococcus aureus subsp. aureus MW2
agaagauuagaugaua

SEQ ID NO: 2085242 - RNA, 12 nt, Staphylococcus aureus subsp. aureus MW2
agaaugauauaa

SEQ ID NO: 2085243 - RNA, 22 nt, Staphylococcus aureus subsp. aureus MW2
agaauuauuugauuauguaaau

SEQ ID NO: 2085244 - RNA, 17 nt, Staphylococcus aureus subsp. aureus MW2
acugccauauagauauu

SEQ ID NO: 2085245 - RNA, 19 nt, Staphylococcus aureus subsp. aureus MW2
acugccaauaaaaugcaau

SEQ ID NO: 2085246 - RNA, 15 nt, Staphylococcus aureus subsp. aureus MW2
acuauaacaccaauu

SEQ ID NO: 2085247 - RNA, 12 nt, Staphylococcus aureus subsp. aureus MW2
acuauacgcaau

SEQ ID NO: 2085248 - RNA, 14 nt, Staphylococcus aureus subsp. aureus MW2
acucuugaaacaca

SEQ ID NO: 2085249 - RNA, 16 nt, Staphylococcus aureus subsp. aureus MW2
acuuaaugcuucaaau

SEQ ID NO: 2085250 - RNA, 13 nt, Staphylococcus aureus subsp. aureus MW2
acuuaauaaccau

SEQ ID NO: 2085251 - RNA, 22 nt, Staphylococcus aureus subsp. aureus MW2
gccauucauaaaugacugaauu

SEQ ID NO: 2085252 - RNA, 15 nt, Staphylococcus aureus subsp. aureus MW2
aagauauaaacauuu

SEQ ID NO: 2085253 - RNA, 19 nt, Staphylococcus aureus subsp. aureus MW2
aagauuauuugcgauauca

SEQ ID NO: 2085254 - RNA, 14 nt, Staphylococcus aureus subsp. aureus MW2
aagauuauuauuac

SEQ ID NO: 2085255 - RNA, 16 nt, Staphylococcus aureus subsp. aureus MW2
aagauguguugaaacu

SEQ ID NO: 2085256 - RNA, 22 nt, Staphylococcus aureus subsp. aureus MW2
aagauguugaaaaguauaugaa

SEQ ID NO: 2085257 - RNA, 15 nt, Staphylococcus aureus subsp. aureus MW2
aagauguauaugaau

SEQ ID NO: 2085258 - RNA, 22 nt, Staphylococcus aureus subsp. aureus MW2
gcaacauauuuucacaaucaua

SEQ ID NO: 2085259 - RNA, 13 nt, Staphylococcus aureus subsp. aureus MW2
aacuuuuacuuuc

SEQ ID NO: 2085260 - RNA, 19 nt, Staphylococcus aureus subsp. aureus MW2
aacuuuaguauauucaaca

SEQ ID NO: 2085261 - RNA, 13 nt, Staphylococcus aureus subsp. aureus MW2
gcaggaaugauau

SEQ ID NO: 2085262 - RNA, 19 nt, Staphylococcus aureus subsp. aureus MW2
gcagcgauacguuuauauc

SEQ ID NO: 2085263 - RNA, 17 nt, Staphylococcus aureus subsp. aureus MW2
aagaacaugauacugaa

SEQ ID NO: 2085264 - RNA, 19 nt, Staphylococcus aureus subsp. aureus MW2
aagaagugccguauucuuu

SEQ ID NO: 2085265 - RNA, 18 nt, Staphylococcus aureus subsp. aureus MW2
aagaagucgaauucaccu

SEQ ID NO: 2085266 - RNA, 16 nt, Staphylococcus aureus subsp. aureus MW2
gcaguaaguugauuuc

SEQ ID NO: 2085267 - RNA, 19 nt, Staphylococcus aureus subsp. aureus MW2
gagguacuagaauuaacua

SEQ ID NO: 2085268 - RNA, 14 nt, Staphylococcus aureus subsp. aureus MW2
gagcucauguuuca

SEQ ID NO: 2085269 - RNA, 15 nt, Staphylococcus aureus subsp. aureus MW2
gauacguaaacacuu

SEQ ID NO: 2085270 - RNA, 15 nt, Staphylococcus aureus subsp. aureus MW2
gauacauaaaacauc

SEQ ID NO: 2085271 - RNA, 14 nt, Staphylococcus aureus subsp. aureus MW2
gauaacgagugaaa

SEQ ID NO: 2085272 - RNA, 16 nt, Staphylococcus aureus subsp. aureus MW2
gauggucauguguugc

SEQ ID NO: 2085273 - RNA, 14 nt, Staphylococcus aureus subsp. aureus MW2
gauuuuuugauaug

SEQ ID NO: 2085274 - RNA, 21 nt, Staphylococcus aureus subsp. aureus MW2
gauuuuauauaaaaagaagau

SEQ ID NO: 2085275 - RNA, 15 nt, Staphylococcus aureus subsp. aureus MW2
gauucaugauauguu

SEQ ID NO: 2085276 - RNA, 17 nt, Staphylococcus aureus subsp. aureus MW2
aacugcuuuuuauuaug

SEQ ID NO: 2085277 - RNA, 21 nt, Staphylococcus aureus subsp. aureus MW2
aacuuaauacgauaauaacua

SEQ ID NO: 2085278 - RNA, 21 nt, Staphylococcus aureus subsp. aureus MW2
aacuuaauaaccauguaaaau

SEQ ID NO: 2085279 - RNA, 22 nt, Staphylococcus aureus subsp. aureus MW2
gaugauauucauauaucaagua

SEQ ID NO: 2085280 - RNA, 17 nt, Staphylococcus aureus subsp. aureus MW2
cgguuugaaaaauggug

SEQ ID NO: 2085281 - RNA, 15 nt, Staphylococcus aureus subsp. aureus MW2
cguaaauuuuaucua

SEQ ID NO: 2085282 - RNA, 22 nt, Staphylococcus aureus subsp. aureus MW2
cguaacuguuuuaaauuaacuu

SEQ ID NO: 2085283 - RNA, 18 nt, Staphylococcus aureus subsp. aureus MW2
cguacaaaauaaugauac

SEQ ID NO: 2085284 - RNA, 14 nt, Staphylococcus aureus subsp. aureus MW2
cguauuuuaaugau

SEQ ID NO: 2085285 - RNA, 21 nt, Staphylococcus aureus subsp. aureus MW2
cguguuugaauguuuuugaua

SEQ ID NO: 2085286 - RNA, 17 nt, Staphylococcus aureus subsp. aureus MW2
cguuaaaacacccugcu

SEQ ID NO: 2085287 - RNA, 21 nt, Staphylococcus aureus subsp. aureus MW2
cguuauuuucaauauuugaua

SEQ ID NO: 2085288 - RNA, 16 nt, Staphylococcus aureus subsp. aureus MW2
aaccgacuuguugaua

SEQ ID NO: 2085289 - RNA, 13 nt, Staphylococcus aureus subsp. aureus MW2
cugauuucacuuc

SEQ ID NO: 2085290 - RNA, 20 nt, Staphylococcus aureus subsp. aureus MW2
cugauucaaaaauuguuaau

SEQ ID NO: 2085291 - RNA, 12 nt, Staphylococcus aureus subsp. aureus MW2
cugcagucgcuu

SEQ ID NO: 2085292 - RNA, 21 nt, Staphylococcus aureus subsp. aureus MW2
cugaaacauuuauaaaucuuu

SEQ ID NO: 2085293 - RNA, 12 nt, Staphylococcus aureus subsp. aureus MW2
cucuuuaaacuc

SEQ ID NO: 2085294 - RNA, 15 nt, Staphylococcus aureus subsp. aureus MW2
cucuaaguucaccua

SEQ ID NO: 2085295 - RNA, 21 nt, Staphylococcus aureus subsp. aureus MW2
cugaaugcucaucuucuaauu

SEQ ID NO: 2085296 - RNA, 19 nt, Staphylococcus aureus subsp. aureus MW2
cucacuuguccuaaguuau

SEQ ID NO: 2085297 - RNA, 14 nt, Staphylococcus aureus subsp. aureus MW2
cucauuauaaugau

SEQ ID NO: 2085298 - RNA, 16 nt, Staphylococcus aureus subsp. aureus MW2
cucauguuucaguaua

SEQ ID NO: 2085299 - RNA, 22 nt, Staphylococcus aureus subsp. aureus MW2
cucauuaaccuuacauaggaua

SEQ ID NO: 2085300 - RNA, 14 nt, Staphylococcus aureus subsp. aureus MW2
cuauuuuccaucac

SEQ ID NO: 2085301 - RNA, 17 nt, Staphylococcus aureus subsp. aureus MW2
cuauucguuugaauuau

SEQ ID NO: 2085302 - RNA, 16 nt, Staphylococcus aureus subsp. aureus MW2
cuauuauuuuacuuug

SEQ ID NO: 2085303 - RNA, 24 nt, Staphylococcus aureus subsp. aureus MW2
cuacguguguaguagcaccgauuu

SEQ ID NO: 2085304 - RNA, 17 nt, Staphylococcus aureus subsp. aureus MW2
cuacuaaaggaauuuca

SEQ ID NO: 2085305 - RNA, 15 nt, Staphylococcus aureus subsp. aureus MW2
cuaguucagcuucua

SEQ ID NO: 2085306 - RNA, 21 nt, Staphylococcus aureus subsp. aureus MW2
cuaguucgauucaugaauaau

SEQ ID NO: 2085307 - RNA, 18 nt, Staphylococcus aureus subsp. aureus MW2
cuauaaacgucacuuuau

SEQ ID NO: 2085308 - RNA, 17 nt, Staphylococcus aureus subsp. aureus MW2
cuauaaauacgucaucu

SEQ ID NO: 2085309 - RNA, 16 nt, Staphylococcus aureus subsp. aureus MW2
cuauaaucuaucuugu

SEQ ID NO: 2085310 - RNA, 16 nt, Staphylococcus aureus subsp. aureus MW2
cuauauauaugcaucc

SEQ ID NO: 2085311 - RNA, 17 nt, Staphylococcus aureus subsp. aureus MW2
cuauauauccauucaau

SEQ ID NO: 2085312 - RNA, 19 nt, Staphylococcus aureus subsp. aureus MW2
aacgauaguguacacgaau

SEQ ID NO: 2085313 - RNA, 12 nt, Staphylococcus aureus subsp. aureus MW2
aacgauauugcu

SEQ ID NO: 2085314 - RNA, 22 nt, Staphylococcus aureus subsp. aureus MW2
gaauuuaggaaugaauaaagcu

SEQ ID NO: 2085315 - RNA, 16 nt, Staphylococcus aureus subsp. aureus MW2
gaagugguauuaacua

SEQ ID NO: 2085316 - RNA, 13 nt, Staphylococcus aureus subsp. aureus MW2
gaauaacacuaga

SEQ ID NO: 2085317 - RNA, 12 nt, Staphylococcus aureus subsp. aureus MW2
gaauauuuaagu

SEQ ID NO: 2085318 - RNA, 12 nt, Staphylococcus aureus subsp. aureus MW2
gaaucacauuaa

SEQ ID NO: 2085319 - RNA, 20 nt, Staphylococcus aureus subsp. aureus MW2
gacauagguauaaucauuua

SEQ ID NO: 2085320 - RNA, 20 nt, Staphylococcus aureus subsp. aureus MW2
cuuccaauuuaaaaugauuc

SEQ ID NO: 2085321 - RNA, 13 nt, Staphylococcus aureus subsp. aureus MW2
cuucauagucacu

SEQ ID NO: 2085322 - RNA, 15 nt, Staphylococcus aureus subsp. aureus MW2
cuucaguacgguuau

SEQ ID NO: 2085323 - RNA, 14 nt, Staphylococcus aureus subsp. aureus MW2
cuucaagugccauu

SEQ ID NO: 2085324 - RNA, 17 nt, Staphylococcus aureus subsp. aureus MW2
cuucaacuacuucauca

SEQ ID NO: 2085325 - RNA, 23 nt, Staphylococcus aureus subsp. aureus MW2
cuuauucaaauguuuacugucau

SEQ ID NO: 2085326 - RNA, 19 nt, Staphylococcus aureus subsp. aureus MW2
cuguauagcuggcuuuuua

SEQ ID NO: 2085327 - RNA, 16 nt, Staphylococcus aureus subsp. aureus MW2
cuguuaaagauguuga

SEQ ID NO: 2085328 - RNA, 22 nt, Staphylococcus aureus subsp. aureus MW2
cuuaaucaagcuagcaucaugu

SEQ ID NO: 2085329 - RNA, 23 nt, Staphylococcus aureus subsp. aureus MW2
cuuaucgccuggugcaggcauca

SEQ ID NO: 2085330 - RNA, 20 nt, Staphylococcus aureus subsp. aureus MW2
cuuaaaucaacaucaucuuu

SEQ ID NO: 2085331 - RNA, 15 nt, Staphylococcus aureus subsp. aureus MW2
cuuaaauagugcuuu

SEQ ID NO: 2085332 - RNA, 16 nt, Staphylococcus aureus subsp. aureus MW2
cuuaaaaucagucauu

SEQ ID NO: 2085333 - RNA, 16 nt, Staphylococcus aureus subsp. aureus MW2
cuuaaaaacaauauug

SEQ ID NO: 2085334 - RNA, 15 nt, Staphylococcus aureus subsp. aureus MW2
cuuaauaagucagcu

SEQ ID NO: 2085335 - RNA, 21 nt, Staphylococcus aureus subsp. aureus MW2
cuuaaguaagauuuaaacauc

SEQ ID NO: 2085336 - RNA, 12 nt, Staphylococcus aureus subsp. aureus MW2
cuuaacaucuuu

SEQ ID NO: 2085337 - RNA, 14 nt, Staphylococcus aureus subsp. aureus MW2
cuuuaaauguauca

SEQ ID NO: 2085338 - RNA, 20 nt, Staphylococcus aureus subsp. aureus MW2
cuuuaccaguaacagcuaag

SEQ ID NO: 2085339 - RNA, 20 nt, Staphylococcus aureus subsp. aureus MW2
cuuuaaugaaagcaucuugc

SEQ ID NO: 2085340 - RNA, 15 nt, Staphylococcus aureus subsp. aureus MW2
cuuuaauuuaucauu

SEQ ID NO: 2085341 - RNA, 20 nt, Staphylococcus aureus subsp. aureus MW2
cuuuauuugauaauauugga

SEQ ID NO: 2085342 - RNA, 12 nt, Staphylococcus aureus subsp. aureus MW2
cuuuaucaacaa

SEQ ID NO: 2085343 - RNA, 21 nt, Staphylococcus aureus subsp. aureus MW2
cuuuaugcaaaauuaaugaac

SEQ ID NO: 2085344 - RNA, 21 nt, Staphylococcus aureus subsp. aureus MW2
cuuggaaguaucugugaauau

SEQ ID NO: 2085345 - RNA, 19 nt, Staphylococcus aureus subsp. aureus MW2
cuugcucuaauucaaugau

SEQ ID NO: 2085346 - RNA, 18 nt, Staphylococcus aureus subsp. aureus MW2
cuuuggauaugcguauau

SEQ ID NO: 2085347 - RNA, 23 nt, Staphylococcus aureus subsp. aureus MW2
cuuucuucagaaccuugaaugau

SEQ ID NO: 2085348 - RNA, 21 nt, Staphylococcus aureus subsp. aureus MW2
cuuucuuuuucaucuuucaaa

SEQ ID NO: 2085349 - RNA, 22 nt, Staphylococcus aureus subsp. aureus MW2
cuuuuguuaauauugguuauau

SEQ ID NO: 2085350 - RNA, 13 nt, Staphylococcus aureus subsp. aureus MW2
cuuuucuauucga

SEQ ID NO: 2085351 - RNA, 19 nt, Staphylococcus aureus subsp. aureus MW2
cuuuuaaaaucuugaugau

SEQ ID NO: 2085352 - RNA, 15 nt, Staphylococcus aureus subsp. aureus MW2
cuuuuauuuucauaa

SEQ ID NO: 2085353 - RNA, 22 nt, Staphylococcus aureus subsp. aureus MW2
cuuuucagcaguugcacaaauu

SEQ ID NO: 2085354 - RNA, 17 nt, Staphylococcus aureus subsp. aureus MW2
cuuuuuguuuugaaugu

SEQ ID NO: 2085355 - RNA, 14 nt, Staphylococcus aureus subsp. aureus MW2
aaccuauauuaagc

SEQ ID NO: 2085356 - RNA, 21 nt, Staphylococcus aureus subsp. aureus MW2
aaccugacuuuccgccagcuu

SEQ ID NO: 2085357 - RNA, 20 nt, Staphylococcus aureus subsp. aureus MW2
gaaaauaaccauucacuuau

SEQ ID NO: 2085358 - RNA, 15 nt, Staphylococcus aureus subsp. aureus MW2
gaaacaucuugauau

SEQ ID NO: 2085359 - RNA, 16 nt, Staphylococcus aureus subsp. aureus MW2
gaaacaucuugauauu

SEQ ID NO: 2085360 - RNA, 17 nt, Staphylococcus aureus subsp. aureus MW2
gaaacaugauugaaauc

SEQ ID NO: 2085361 - RNA, 20 nt, Staphylococcus aureus subsp. aureus MW2
gaaaauuuauucaaaucaua

SEQ ID NO: 2085362 - RNA, 18 nt, Staphylococcus aureus subsp. aureus MW2
gaaauaaacauaucauca

SEQ ID NO: 2085363 - RNA, 20 nt, Staphylococcus aureus subsp. aureus MW2
gaaaugauaagaaucaucua

SEQ ID NO: 2085364 - RNA, 20 nt, Staphylococcus aureus subsp. aureus MW2
gaaauuagaaccaucauuua

SEQ ID NO: 2085365 - RNA, 17 nt, Staphylococcus aureus subsp. aureus MW2
gccguuuuugaaaugua

SEQ ID NO: 2085366 - RNA, 22 nt, Staphylococcus aureus subsp. aureus MW2
gcgaaacuuagugucacauuau

SEQ ID NO: 2085367 - RNA, 17 nt, Staphylococcus aureus subsp. aureus MW2
aagcgggacucaucgag

SEQ ID NO: 2085368 - RNA, 13 nt, Staphylococcus aureus subsp. aureus MW2
aagcuaauaucaa

SEQ ID NO: 2085369 - RNA, 20 nt, Staphylococcus aureus subsp. aureus MW2
gcugaugaacuucuacaguu

SEQ ID NO: 2085370 - RNA, 17 nt, Staphylococcus aureus subsp. aureus MW2
gcuuuuuuuauggugug

SEQ ID NO: 2085371 - RNA, 13 nt, Staphylococcus aureus subsp. aureus MW2
gcuuuaaaucauu

SEQ ID NO: 2085372 - RNA, 14 nt, Staphylococcus aureus subsp. aureus MW2
gcuucauaaauguu

SEQ ID NO: 2085373 - RNA, 13 nt, Staphylococcus aureus subsp. aureus MW2
gcuguuugauauu

SEQ ID NO: 2085374 - RNA, 16 nt, Staphylococcus aureus subsp. aureus MW2
ggcauaaccuguaauu

SEQ ID NO: 2085375 - RNA, 13 nt, Staphylococcus aureus subsp. aureus MW2
ggaucggcauugu

SEQ ID NO: 2085376 - RNA, 16 nt, Staphylococcus aureus subsp. aureus MW2
ggaugugacaaauacu

SEQ ID NO: 2085377 - RNA, 15 nt, Staphylococcus aureus subsp. aureus MW2
ggauuaucuguaauu

SEQ ID NO: 2085378 - RNA, 17 nt, Staphylococcus aureus subsp. aureus MW2
ggcuccaaacauagaga

SEQ ID NO: 2085379 - RNA, 21 nt, Staphylococcus aureus subsp. aureus MW2
ggcucauuuguuaaauucauc

SEQ ID NO: 2085380 - RNA, 16 nt, Staphylococcus aureus subsp. aureus MW2
gguuauuuucaaugau

SEQ ID NO: 2085381 - RNA, 14 nt, Staphylococcus aureus subsp. aureus MW2
gguguuuagucuuu

SEQ ID NO: 2085382 - RNA, 16 nt, Staphylococcus aureus subsp. aureus MW2
guagcuaaugcaacua

SEQ ID NO: 2085383 - RNA, 16 nt, Staphylococcus aureus subsp. aureus MW2
guauaagaaucagcua

SEQ ID NO: 2085384 - RNA, 20 nt, Staphylococcus aureus subsp. aureus MW2
guauaauuaaacuaauagca

SEQ ID NO: 2085385 - RNA, 18 nt, Staphylococcus aureus subsp. aureus MW2
aagucugcugguaacucu

SEQ ID NO: 2085386 - RNA, 23 nt, Staphylococcus aureus subsp. aureus MW2
guaauuauuuuucucaacaguuu

SEQ ID NO: 2085387 - RNA, 19 nt, Staphylococcus aureus subsp. aureus MW2
guaauucaccaucauauuc

SEQ ID NO: 2085388 - RNA, 16 nt, Staphylococcus aureus subsp. aureus MW2
guaacaaaugcguauc

SEQ ID NO: 2085389 - RNA, 17 nt, Staphylococcus aureus subsp. aureus MW2
guaaacauaaccuugcu

SEQ ID NO: 2085390 - RNA, 14 nt, Staphylococcus aureus subsp. aureus MW2
guacguuugcauau

SEQ ID NO: 2085391 - RNA, 15 nt, Staphylococcus aureus subsp. aureus MW2
ggugacucaaugaau

SEQ ID NO: 2085392 - RNA, 19 nt, Staphylococcus aureus subsp. aureus MW2
ggucauuaaaugaaauauc

SEQ ID NO: 2085393 - RNA, 19 nt, Staphylococcus aureus subsp. aureus MW2
ggggugggacgacgaaaua

SEQ ID NO: 2085394 - RNA, 18 nt, Staphylococcus aureus subsp. aureus MW2
ggggcccaaacauagaga

SEQ ID NO: 2085395 - RNA, 15 nt, Staphylococcus aureus subsp. aureus MW2
gucauucaaucauca

SEQ ID NO: 2085396 - RNA, 21 nt, Staphylococcus aureus subsp. aureus MW2
guccaugcguggugugaaugu

SEQ ID NO: 2085397 - RNA, 18 nt, Staphylococcus aureus subsp. aureus MW2
gucuaugucaaauugaac

SEQ ID NO: 2085398 - RNA, 16 nt, Staphylococcus aureus subsp. aureus MW2
gucuaugaauaauguu

SEQ ID NO: 2085399 - RNA, 14 nt, Staphylococcus aureus subsp. aureus MW2
cgcuucuaacucac

SEQ ID NO: 2085400 - RNA, 19 nt, Staphylococcus aureus subsp. aureus MW2
aaccagcuaaaccaucugu

SEQ ID NO: 2085401 - RNA, 20 nt, Staphylococcus aureus subsp. aureus MW2
aacauuuaaaaaaugcgcuu

SEQ ID NO: 2085402 - RNA, 15 nt, Staphylococcus aureus subsp. aureus MW2
aacauuuagauuuca

SEQ ID NO: 2085403 - RNA, 15 nt, Staphylococcus aureus subsp. aureus MW2
aaccaaaccauuaau

SEQ ID NO: 2085404 - RNA, 14 nt, Staphylococcus aureus subsp. aureus MW2
aaccaacaauuggu

SEQ ID NO: 2085405 - RNA, 19 nt, Staphylococcus aureus subsp. aureus MW2
aaccaacuuucucaaguaa

SEQ ID NO: 2085406 - RNA, 16 nt, Staphylococcus aureus subsp. aureus MW2
aaccacgcaucaugua

SEQ ID NO: 2085407 - RNA, 13 nt, Staphylococcus aureus subsp. aureus MW2
aaccacgauaucu

SEQ ID NO: 2085408 - RNA, 14 nt, Staphylococcus aureus subsp. aureus MW2
aaccaaguaauucu

SEQ ID NO: 2085409 - RNA, 21 nt, Staphylococcus aureus subsp. aureus MW2
aaccaucugugucagcauuca

SEQ ID NO: 2085410 - RNA, 18 nt, Staphylococcus aureus subsp. aureus MW2
aaccaugcuuuuuagcau

SEQ ID NO: 2085411 - RNA, 18 nt, Staphylococcus aureus subsp. aureus MW2
aacauugcuguaaccccu

SEQ ID NO: 2085412 - RNA, 12 nt, Staphylococcus aureus subsp. aureus MW2
aacaucaucguc

SEQ ID NO: 2085413 - RNA, 15 nt, Staphylococcus aureus subsp. aureus MW2
aacaucuucuucauc

SEQ ID NO: 2085414 - RNA, 22 nt, Staphylococcus aureus subsp. aureus MW2
aacaucuucauguaugaaguaa

SEQ ID NO: 2085415 - RNA, 11 nt, Staphylococcus aureus subsp. aureus MW2
aacauaucauc

SEQ ID NO: 2085416 - RNA, 22 nt, Staphylococcus aureus subsp. aureus MW2
aacaucacagaaaauacauuuc

SEQ ID NO: 2085417 - RNA, 20 nt, Staphylococcus aureus subsp. aureus MW2
aacaguggaauacagaugau

SEQ ID NO: 2085418 - RNA, 16 nt, Staphylococcus aureus subsp. aureus MW2
cgauaucuaagucgau

SEQ ID NO: 2085419 - RNA, 16 nt, Staphylococcus aureus subsp. aureus MW2
aacaacuaagauauau

SEQ ID NO: 2085420 - RNA, 22 nt, Staphylococcus aureus subsp. aureus MW2
aacaaagaagcuggcggaaagu

SEQ ID NO: 2085421 - RNA, 22 nt, Staphylococcus aureus subsp. aureus MW2
cgaacuagacaagaugcucaau

SEQ ID NO: 2085422 - RNA, 12 nt, Staphylococcus aureus subsp. aureus MW2
cgccagcuucua

SEQ ID NO: 2085423 - RNA, 12 nt, Staphylococcus aureus subsp. aureus MW2
cgccagcuucuu

SEQ ID NO: 2085424 - RNA, 22 nt, Staphylococcus aureus subsp. aureus MW2
cgcauuguuucuagcuuuaauu

SEQ ID NO: 2085425 - RNA, 21 nt, Staphylococcus aureus subsp. aureus MW2
cgauuaauauaagucuauuau

SEQ ID NO: 2085426 - RNA, 14 nt, Staphylococcus aureus subsp. aureus MW2
cgauuaaaugaugc

SEQ ID NO: 2085427 - RNA, 17 nt, Staphylococcus aureus subsp. aureus MW2
cgaugcauauucaucau

SEQ ID NO: 2085428 - RNA, 20 nt, Staphylococcus aureus subsp. aureus MW2
ccaaguaauucuuuaccauu

SEQ ID NO: 2085429 - RNA, 22 nt, Staphylococcus aureus subsp. aureus MW2
aaagcggguuggcgagaauuca

SEQ ID NO: 2085430 - RNA, 13 nt, Staphylococcus aureus subsp. aureus MW2
ccaacuugcacau

SEQ ID NO: 2085431 - RNA, 14 nt, Staphylococcus aureus subsp. aureus MW2
ccaaaguaccaucu

SEQ ID NO: 2085432 - RNA, 20 nt, Staphylococcus aureus subsp. aureus MW2
aaagcuguaguuucaacuuu

SEQ ID NO: 2085433 - RNA, 15 nt, Staphylococcus aureus subsp. aureus MW2
aaagggaauggauua

SEQ ID NO: 2085434 - RNA, 22 nt, Staphylococcus aureus subsp. aureus MW2
ccaugucaugaauuuucaucau

SEQ ID NO: 2085435 - RNA, 22 nt, Staphylococcus aureus subsp. aureus MW2
aaaucgauacuaauaucuucuu

SEQ ID NO: 2085436 - RNA, 14 nt, Staphylococcus aureus subsp. aureus MW2
ccauugcacuaugc

SEQ ID NO: 2085437 - RNA, 16 nt, Staphylococcus aureus subsp. aureus MW2
aaaucuuuuagcuuuu

SEQ ID NO: 2085438 - RNA, 17 nt, Staphylococcus aureus subsp. aureus MW2
aaaucuucaagugccau

SEQ ID NO: 2085439 - RNA, 22 nt, Staphylococcus aureus subsp. aureus MW2
caguauuaauuacauguuggca

SEQ ID NO: 2085440 - RNA, 12 nt, Staphylococcus aureus subsp. aureus MW2
cagucagcuuuu

SEQ ID NO: 2085441 - RNA, 14 nt, Staphylococcus aureus subsp. aureus MW2
caguauaugucgca

SEQ ID NO: 2085442 - RNA, 19 nt, Staphylococcus aureus subsp. aureus MW2
caucaguaacauguaauga

SEQ ID NO: 2085443 - RNA, 21 nt, Staphylococcus aureus subsp. aureus MW2
caucaaucguaacuaacaugu

SEQ ID NO: 2085444 - RNA, 18 nt, Staphylococcus aureus subsp. aureus MW2
caucaauaucuucuucua

SEQ ID NO: 2085445 - RNA, 18 nt, Staphylococcus aureus subsp. aureus MW2
caucaauuucuguaauaa

SEQ ID NO: 2085446 - RNA, 18 nt, Staphylococcus aureus subsp. aureus MW2
cauauucauaauaucgau

SEQ ID NO: 2085447 - RNA, 18 nt, Staphylococcus aureus subsp. aureus MW2
cauagauaauugcuauaa

SEQ ID NO: 2085448 - RNA, 16 nt, Staphylococcus aureus subsp. aureus MW2
cauauguuguuucuaa

SEQ ID NO: 2085449 - RNA, 15 nt, Staphylococcus aureus subsp. aureus MW2
cauacacuugguuau

SEQ ID NO: 2085450 - RNA, 19 nt, Staphylococcus aureus subsp. aureus MW2
cauacacuugguuaucauu

SEQ ID NO: 2085451 - RNA, 14 nt, Staphylococcus aureus subsp. aureus MW2
cauacacaaugauu

SEQ ID NO: 2085452 - RNA, 22 nt, Staphylococcus aureus subsp. aureus MW2
cauacuugucguauucuucaau

SEQ ID NO: 2085453 - RNA, 15 nt, Staphylococcus aureus subsp. aureus MW2
cauacuucguuguca

SEQ ID NO: 2085454 - RNA, 12 nt, Staphylococcus aureus subsp. aureus MW2
cauacguucaau

SEQ ID NO: 2085455 - RNA, 21 nt, Staphylococcus aureus subsp. aureus MW2
cauaacaccgcaaugccacau

SEQ ID NO: 2085456 - RNA, 13 nt, Staphylococcus aureus subsp. aureus MW2
caguuaauaagaa

SEQ ID NO: 2085457 - RNA, 24 nt, Staphylococcus aureus subsp. aureus MW2
cauaaugaacaagggccauccauu

SEQ ID NO: 2085458 - RNA, 20 nt, Staphylococcus aureus subsp. aureus MW2
caugauaaaguauguuguca

SEQ ID NO: 2085459 - RNA, 15 nt, Staphylococcus aureus subsp. aureus MW2
caugacgauaaugaa

SEQ ID NO: 2085460 - RNA, 19 nt, Staphylococcus aureus subsp. aureus MW2
caucuguuaauucaggaug

SEQ ID NO: 2085461 - RNA, 14 nt, Staphylococcus aureus subsp. aureus MW2
caucuucaauauuu

SEQ ID NO: 2085462 - RNA, 21 nt, Staphylococcus aureus subsp. aureus MW2
caugauacugaaauuucauaa

SEQ ID NO: 2085463 - RNA, 20 nt, Staphylococcus aureus subsp. aureus MW2
caucgguaucgaauguuuca

SEQ ID NO: 2085464 - RNA, 15 nt, Staphylococcus aureus subsp. aureus MW2
caucuauuauuaugu

SEQ ID NO: 2085465 - RNA, 18 nt, Staphylococcus aureus subsp. aureus MW2
caucuaaauaguuuuuca

SEQ ID NO: 2085466 - RNA, 18 nt, Staphylococcus aureus subsp. aureus MW2
caucuaaaugguuaucua

SEQ ID NO: 2085467 - RNA, 21 nt, Staphylococcus aureus subsp. aureus MW2
caucguauagaugugucuuuu

SEQ ID NO: 2085468 - RNA, 22 nt, Staphylococcus aureus subsp. aureus MW2
cagcauuaccagcaauuucgau

SEQ ID NO: 2085469 - RNA, 21 nt, Staphylococcus aureus subsp. aureus MW2
cagaaauuuaauauuguuaau

SEQ ID NO: 2085470 - RNA, 21 nt, Staphylococcus aureus subsp. aureus MW2
cacuucuguaccgaauuggau

SEQ ID NO: 2085471 - RNA, 21 nt, Staphylococcus aureus subsp. aureus MW2
cacuuggauuuuaauuauuug

SEQ ID NO: 2085472 - RNA, 20 nt, Staphylococcus aureus subsp. aureus MW2
cacuauaaaagccaugauac

SEQ ID NO: 2085473 - RNA, 17 nt, Staphylococcus aureus subsp. aureus MW2
cacguugugcaauaccu

SEQ ID NO: 2085474 - RNA, 14 nt, Staphylococcus aureus subsp. aureus MW2
cagacuccuaaauu

SEQ ID NO: 2085475 - RNA, 16 nt, Staphylococcus aureus subsp. aureus MW2
cagacuaaaaguggcc

SEQ ID NO: 2085476 - RNA, 14 nt, Staphylococcus aureus subsp. aureus MW2
cagacaaugcaagu

SEQ ID NO: 2085477 - RNA, 23 nt, Staphylococcus aureus subsp. aureus MW2
cagaguugucauucuucaucgca

SEQ ID NO: 2085478 - RNA, 13 nt, Staphylococcus aureus subsp. aureus MW2
cagcgguuuguau

SEQ ID NO: 2085479 - RNA, 20 nt, Staphylococcus aureus subsp. aureus MW2
caccguggaauuuaccauuu

SEQ ID NO: 2085480 - RNA, 16 nt, Staphylococcus aureus subsp. aureus MW2
caccugcaauuuguaa

SEQ ID NO: 2085481 - RNA, 18 nt, Staphylococcus aureus subsp. aureus MW2
caccuuucgcgacuucau

SEQ ID NO: 2085482 - RNA, 13 nt, Staphylococcus aureus subsp. aureus MW2
cacgaauucauua

SEQ ID NO: 2085483 - RNA, 23 nt, Staphylococcus aureus subsp. aureus MW2
cacgaucaguugagucaauuucu

SEQ ID NO: 2085484 - RNA, 18 nt, Staphylococcus aureus subsp. aureus MW2
cacgauagucauaacgau

SEQ ID NO: 2085485 - RNA, 14 nt, Staphylococcus aureus subsp. aureus MW2
caccaaguucacua

SEQ ID NO: 2085486 - RNA, 21 nt, Staphylococcus aureus subsp. aureus MW2
cacaccuaauucauauauacu

SEQ ID NO: 2085487 - RNA, 13 nt, Staphylococcus aureus subsp. aureus MW2
caauacgaaguuu

SEQ ID NO: 2085488 - RNA, 15 nt, Staphylococcus aureus subsp. aureus MW2
caauacgaauaucug

SEQ ID NO: 2085489 - RNA, 19 nt, Staphylococcus aureus subsp. aureus MW2
caauaauugaugaaagacu

SEQ ID NO: 2085490 - RNA, 20 nt, Staphylococcus aureus subsp. aureus MW2
caauuguugcaaaauacgau

SEQ ID NO: 2085491 - RNA, 22 nt, Staphylococcus aureus subsp. aureus MW2
cacaaaugaauggagcaugauu

SEQ ID NO: 2085492 - RNA, 13 nt, Staphylococcus aureus subsp. aureus MW2
cacaaaugcuaca

SEQ ID NO: 2085493 - RNA, 18 nt, Staphylococcus aureus subsp. aureus MW2
cacaaaugcuacaucaau

SEQ ID NO: 2085494 - RNA, 17 nt, Staphylococcus aureus subsp. aureus MW2
caauuucuauuuaaaca

SEQ ID NO: 2085495 - RNA, 17 nt, Staphylococcus aureus subsp. aureus MW2
caaugucuacuuugaag

SEQ ID NO: 2085496 - RNA, 16 nt, Staphylococcus aureus subsp. aureus MW2
cacaauauacauuuac

SEQ ID NO: 2085497 - RNA, 14 nt, Staphylococcus aureus subsp. aureus MW2
cacaauuguauaau

SEQ ID NO: 2085498 - RNA, 15 nt, Staphylococcus aureus subsp. aureus MW2
caacuugcacauuau

SEQ ID NO: 2085499 - RNA, 24 nt, Staphylococcus aureus subsp. aureus MW2
caacuuuuuaauaauacuucuaau

SEQ ID NO: 2085500 - RNA, 17 nt, Staphylococcus aureus subsp. aureus MW2
caacuuagaauuuacaa

SEQ ID NO: 2085501 - RNA, 23 nt, Staphylococcus aureus subsp. aureus MW2
caacuguucuaaaauuaaccauu

SEQ ID NO: 2085502 - RNA, 14 nt, Staphylococcus aureus subsp. aureus MW2
caagucgcaucgua

SEQ ID NO: 2085503 - RNA, 18 nt, Staphylococcus aureus subsp. aureus MW2
caauaacacaucaugaca

SEQ ID NO: 2085504 - RNA, 15 nt, Staphylococcus aureus subsp. aureus MW2
caauaaugugcaagu

SEQ ID NO: 2085505 - RNA, 22 nt, Staphylococcus aureus subsp. aureus MW2
caauaaaacuauguguauaugu

SEQ ID NO: 2085506 - RNA, 12 nt, Staphylococcus aureus subsp. aureus MW2
augccacaucau

SEQ ID NO: 2085507 - RNA, 19 nt, Staphylococcus aureus subsp. aureus MW2
augcccaaccacgauaucu

SEQ ID NO: 2085508 - RNA, 16 nt, Staphylococcus aureus subsp. aureus MW2
augccauucauuaagc

SEQ ID NO: 2085509 - RNA, 17 nt, Staphylococcus aureus subsp. aureus MW2
augguacuaaaguugca

SEQ ID NO: 2085510 - RNA, 20 nt, Staphylococcus aureus subsp. aureus MW2
augguuuucuuuuucuauac

SEQ ID NO: 2085511 - RNA, 18 nt, Staphylococcus aureus subsp. aureus MW2
augguuucaaaaucaauu

SEQ ID NO: 2085512 - RNA, 13 nt, Staphylococcus aureus subsp. aureus MW2
augguuaucacuu

SEQ ID NO: 2085513 - RNA, 20 nt, Staphylococcus aureus subsp. aureus MW2
auguauguuuuaucaauauu

SEQ ID NO: 2085514 - RNA, 19 nt, Staphylococcus aureus subsp. aureus MW2
auguauaucgacaccauuu

SEQ ID NO: 2085515 - RNA, 13 nt, Staphylococcus aureus subsp. aureus MW2
auguaugcuugua

SEQ ID NO: 2085516 - RNA, 18 nt, Staphylococcus aureus subsp. aureus MW2
auguaacguuucuuugua

SEQ ID NO: 2085517 - RNA, 13 nt, Staphylococcus aureus subsp. aureus MW2
auguaaaaucauu

SEQ ID NO: 2085518 - RNA, 19 nt, Staphylococcus aureus subsp. aureus MW2
auguaagcuaucguaaaca

SEQ ID NO: 2085519 - RNA, 18 nt, Staphylococcus aureus subsp. aureus MW2
auguaaaaaauaucuugu

SEQ ID NO: 2085520 - RNA, 17 nt, Staphylococcus aureus subsp. aureus MW2
augucauuugaauccaa

SEQ ID NO: 2085521 - RNA, 18 nt, Staphylococcus aureus subsp. aureus MW2
augucagucguuguauaa

SEQ ID NO: 2085522 - RNA, 20 nt, Staphylococcus aureus subsp. aureus MW2
augcugcaagucucauaucu

SEQ ID NO: 2085523 - RNA, 17 nt, Staphylococcus aureus subsp. aureus MW2
auggauaugauaaccaa

SEQ ID NO: 2085524 - RNA, 13 nt, Staphylococcus aureus subsp. aureus MW2
aucugcaacuaau

SEQ ID NO: 2085525 - RNA, 12 nt, Staphylococcus aureus subsp. aureus MW2
aucugaaucugc

SEQ ID NO: 2085526 - RNA, 20 nt, Staphylococcus aureus subsp. aureus MW2
aucguuaauuuccaauaucu

SEQ ID NO: 2085527 - RNA, 22 nt, Staphylococcus aureus subsp. aureus MW2
aucguagcaccagcacaucaaa

SEQ ID NO: 2085528 - RNA, 23 nt, Staphylococcus aureus subsp. aureus MW2
augauuaaaaaucaaagaggcuu

SEQ ID NO: 2085529 - RNA, 19 nt, Staphylococcus aureus subsp. aureus MW2
augauuugauauuucaaau

SEQ ID NO: 2085530 - RNA, 21 nt, Staphylococcus aureus subsp. aureus MW2
augcaucaacagauacuucag

SEQ ID NO: 2085531 - RNA, 14 nt, Staphylococcus aureus subsp. aureus MW2
augcacuguauagc

SEQ ID NO: 2085532 - RNA, 19 nt, Staphylococcus aureus subsp. aureus MW2
aucuugacacaaugauuca

SEQ ID NO: 2085533 - RNA, 15 nt, Staphylococcus aureus subsp. aureus MW2
aucuugguucagcuu

SEQ ID NO: 2085534 - RNA, 13 nt, Staphylococcus aureus subsp. aureus MW2
augaaaaaguaaa

SEQ ID NO: 2085535 - RNA, 16 nt, Staphylococcus aureus subsp. aureus MW2
augaaagcaucuugca

SEQ ID NO: 2085536 - RNA, 15 nt, Staphylococcus aureus subsp. aureus MW2
augacaucaauaucu

SEQ ID NO: 2085537 - RNA, 22 nt, Staphylococcus aureus subsp. aureus MW2
caaacacugccaauauaacauu

SEQ ID NO: 2085538 - RNA, 16 nt, Staphylococcus aureus subsp. aureus MW2
caaaauauacuaaauu

SEQ ID NO: 2085539 - RNA, 16 nt, Staphylococcus aureus subsp. aureus MW2
caaacguuuucacuuc

SEQ ID NO: 2085540 - RNA, 13 nt, Staphylococcus aureus subsp. aureus MW2
caaagguuuguaa

SEQ ID NO: 2085541 - RNA, 13 nt, Staphylococcus aureus subsp. aureus MW2
caaaguagacauu

SEQ ID NO: 2085542 - RNA, 16 nt, Staphylococcus aureus subsp. aureus MW2
caaauauuuuaucugu

SEQ ID NO: 2085543 - RNA, 15 nt, Staphylococcus aureus subsp. aureus MW2
caaaucaauaccaac

SEQ ID NO: 2085544 - RNA, 13 nt, Staphylococcus aureus subsp. aureus MW2
caaaucaauauca

SEQ ID NO: 2085545 - RNA, 15 nt, Staphylococcus aureus subsp. aureus MW2
caaaucaauaucauu

SEQ ID NO: 2085546 - RNA, 15 nt, Staphylococcus aureus subsp. aureus MW2
caaacuugauucaau

SEQ ID NO: 2085547 - RNA, 20 nt, Staphylococcus aureus subsp. aureus MW2
caaagaaccacgcaucaugu

SEQ ID NO: 2085548 - RNA, 21 nt, Staphylococcus aureus subsp. aureus MW2
caaagcacaccuaauucauau

SEQ ID NO: 2085549 - RNA, 14 nt, Staphylococcus aureus subsp. aureus MW2
caaaggcuucaugu

SEQ ID NO: 2085550 - RNA, 20 nt, Staphylococcus aureus subsp. aureus MW2
caaauuugaauauacuuaau

SEQ ID NO: 2085551 - RNA, 15 nt, Staphylococcus aureus subsp. aureus MW2
caaauuauuaacgca

SEQ ID NO: 2085552 - RNA, 22 nt, Staphylococcus aureus subsp. aureus MW2
caacacuacccacacagguaaa

SEQ ID NO: 2085553 - RNA, 16 nt, Staphylococcus aureus subsp. aureus MW2
auuuuuuaauauacga

SEQ ID NO: 2085554 - RNA, 13 nt, Staphylococcus aureus subsp. aureus MW2
auuuuuugggcuu

SEQ ID NO: 2085555 - RNA, 16 nt, Staphylococcus aureus subsp. aureus MW2
auuuuuauagauaagg

SEQ ID NO: 2085556 - RNA, 16 nt, Staphylococcus aureus subsp. aureus MW2
auuuuucuccaguuuu

SEQ ID NO: 2085557 - RNA, 19 nt, Staphylococcus aureus subsp. aureus MW2
auuuugagacaaaaaauga

SEQ ID NO: 2085558 - RNA, 13 nt, Staphylococcus aureus subsp. aureus MW2
auuuugaguauuu

SEQ ID NO: 2085559 - RNA, 13 nt, Staphylococcus aureus subsp. aureus MW2
auuuuuaucaucu

SEQ ID NO: 2085560 - RNA, 20 nt, Staphylococcus aureus subsp. aureus MW2
caaaaauacuccuuucauac

SEQ ID NO: 2085561 - RNA, 17 nt, Staphylococcus aureus subsp. aureus MW2
caaaacgcauuucaugu

SEQ ID NO: 2085562 - RNA, 16 nt, Staphylococcus aureus subsp. aureus MW2
caaaacguuugaagaa

SEQ ID NO: 2085563 - RNA, 12 nt, Staphylococcus aureus subsp. aureus MW2
caaaagaugaaa

SEQ ID NO: 2085564 - RNA, 19 nt, Staphylococcus aureus subsp. aureus MW2
auuugaugguuuaauugca

SEQ ID NO: 2085565 - RNA, 15 nt, Staphylococcus aureus subsp. aureus MW2
auuugauuaguaauu

SEQ ID NO: 2085566 - RNA, 19 nt, Staphylococcus aureus subsp. aureus MW2
auuugaagcauuaaguuca

SEQ ID NO: 2085567 - RNA, 19 nt, Staphylococcus aureus subsp. aureus MW2
auuuuaaacaugaacaauc

SEQ ID NO: 2085568 - RNA, 23 nt, Staphylococcus aureus subsp. aureus MW2
auuuuauauauccuguuucauau

SEQ ID NO: 2085569 - RNA, 16 nt, Staphylococcus aureus subsp. aureus MW2
auuuuaugauuugauu

SEQ ID NO: 2085570 - RNA, 20 nt, Staphylococcus aureus subsp. aureus MW2
auuuuauugaguaucaugcu

SEQ ID NO: 2085571 - RNA, 23 nt, Staphylococcus aureus subsp. aureus MW2
auuuucaaauuucuaacuuguuu

SEQ ID NO: 2085572 - RNA, 13 nt, Staphylococcus aureus subsp. aureus MW2
auuuuacuuugua

SEQ ID NO: 2085573 - RNA, 16 nt, Staphylococcus aureus subsp. aureus MW2
auuuuacaaucaacuu

SEQ ID NO: 2085574 - RNA, 12 nt, Staphylococcus aureus subsp. aureus MW2
auuggcagauag

SEQ ID NO: 2085575 - RNA, 23 nt, Staphylococcus aureus subsp. aureus MW2
auuggcgggccccaacauagaag

SEQ ID NO: 2085576 - RNA, 15 nt, Staphylococcus aureus subsp. aureus MW2
auugugaaaucuauu

SEQ ID NO: 2085577 - RNA, 22 nt, Staphylococcus aureus subsp. aureus MW2
auucuaaaacggaaauaaccac

SEQ ID NO: 2085578 - RNA, 19 nt, Staphylococcus aureus subsp. aureus MW2
auuucagaaauacauccau

SEQ ID NO: 2085579 - RNA, 14 nt, Staphylococcus aureus subsp. aureus MW2
auuuauauuccauu

SEQ ID NO: 2085580 - RNA, 20 nt, Staphylococcus aureus subsp. aureus MW2
auuuaucugcgaaaugcauu

SEQ ID NO: 2085581 - RNA, 14 nt, Staphylococcus aureus subsp. aureus MW2
auuuaaauuacagu

SEQ ID NO: 2085582 - RNA, 17 nt, Staphylococcus aureus subsp. aureus MW2
auuuaaaugcuuucaaa

SEQ ID NO: 2085583 - RNA, 20 nt, Staphylococcus aureus subsp. aureus MW2
auuuaaaugcuuucaaauac

SEQ ID NO: 2085584 - RNA, 12 nt, Staphylococcus aureus subsp. aureus MW2
auuuaaucuauu

SEQ ID NO: 2085585 - RNA, 12 nt, Staphylococcus aureus subsp. aureus MW2
auuuaauaugcu

SEQ ID NO: 2085586 - RNA, 21 nt, Staphylococcus aureus subsp. aureus MW2
auuuauaacgacguaauccuu

SEQ ID NO: 2085587 - RNA, 18 nt, Staphylococcus aureus subsp. aureus MW2
auuucacuuuaacuucuu

SEQ ID NO: 2085588 - RNA, 21 nt, Staphylococcus aureus subsp. aureus MW2
auuucaguaggacacauaaau

SEQ ID NO: 2085589 - RNA, 17 nt, Staphylococcus aureus subsp. aureus MW2
auuucccuggaaaauga

SEQ ID NO: 2085590 - RNA, 14 nt, Staphylococcus aureus subsp. aureus MW2
auuccaaaaauugu

SEQ ID NO: 2085591 - RNA, 15 nt, Staphylococcus aureus subsp. aureus MW2
auucccaaagcgaau

SEQ ID NO: 2085592 - RNA, 13 nt, Staphylococcus aureus subsp. aureus MW2
aaacuaaucaaau

SEQ ID NO: 2085593 - RNA, 16 nt, Staphylococcus aureus subsp. aureus MW2
auuauugaaacuaaua

SEQ ID NO: 2085594 - RNA, 15 nt, Staphylococcus aureus subsp. aureus MW2
auuacaaacauaauc

SEQ ID NO: 2085595 - RNA, 20 nt, Staphylococcus aureus subsp. aureus MW2
auuaauguuucuucaauugu

SEQ ID NO: 2085596 - RNA, 14 nt, Staphylococcus aureus subsp. aureus MW2
auuaauguaaugau

SEQ ID NO: 2085597 - RNA, 17 nt, Staphylococcus aureus subsp. aureus MW2
agguaauaaagcugauu

SEQ ID NO: 2085598 - RNA, 14 nt, Staphylococcus aureus subsp. aureus MW2
agguauaaucauuu

SEQ ID NO: 2085599 - RNA, 15 nt, Staphylococcus aureus subsp. aureus MW2
agguuacaauaaugu

SEQ ID NO: 2085600 - RNA, 19 nt, Staphylococcus aureus subsp. aureus MW2
agucagcauacaauaaugu

SEQ ID NO: 2085601 - RNA, 20 nt, Staphylococcus aureus subsp. aureus MW2
agugguaaaaaugaaccauu

SEQ ID NO: 2085602 - RNA, 14 nt, Staphylococcus aureus subsp. aureus MW2
agugauucaggauu

SEQ ID NO: 2085603 - RNA, 13 nt, Staphylococcus aureus subsp. aureus MW2
auaaaaugcuaca

SEQ ID NO: 2085604 - RNA, 21 nt, Staphylococcus aureus subsp. aureus MW2
auaaaaguacuuuaaaauugu

SEQ ID NO: 2085605 - RNA, 22 nt, Staphylococcus aureus subsp. aureus MW2
auaaaucauuaguuguaucagu

SEQ ID NO: 2085606 - RNA, 15 nt, Staphylococcus aureus subsp. aureus MW2
auaaaucaugaaauu

SEQ ID NO: 2085607 - RNA, 18 nt, Staphylococcus aureus subsp. aureus MW2
auaaauccaaugaugaau

SEQ ID NO: 2085608 - RNA, 14 nt, Staphylococcus aureus subsp. aureus MW2
auaaaucaauguac

SEQ ID NO: 2085609 - RNA, 17 nt, Staphylococcus aureus subsp. aureus MW2
auaaagcuuugacauau

SEQ ID NO: 2085610 - RNA, 16 nt, Staphylococcus aureus subsp. aureus MW2
auaaaguguaaauuug

SEQ ID NO: 2085611 - RNA, 14 nt, Staphylococcus aureus subsp. aureus MW2
auaaaguugacaau

SEQ ID NO: 2085612 - RNA, 23 nt, Staphylococcus aureus subsp. aureus MW2
auaaauaaaagcccccuuuucac

SEQ ID NO: 2085613 - RNA, 17 nt, Staphylococcus aureus subsp. aureus MW2
auaaaacgcuucauaua

SEQ ID NO: 2085614 - RNA, 19 nt, Staphylococcus aureus subsp. aureus MW2
auaaaaaucuuaugauguc

SEQ ID NO: 2085615 - RNA, 15 nt, Staphylococcus aureus subsp. aureus MW2
auaaauuagaugaaa

SEQ ID NO: 2085616 - RNA, 19 nt, Staphylococcus aureus subsp. aureus MW2
auaaauuuugaauuacaga

SEQ ID NO: 2085617 - RNA, 15 nt, Staphylococcus aureus subsp. aureus MW2
auaaauuagccauuu

SEQ ID NO: 2085618 - RNA, 18 nt, Staphylococcus aureus subsp. aureus MW2
auaaauuagccauuucaa

SEQ ID NO: 2085619 - RNA, 21 nt, Staphylococcus aureus subsp. aureus MW2
auaauccgagucauacucauc

SEQ ID NO: 2085620 - RNA, 13 nt, Staphylococcus aureus subsp. aureus MW2
auaaucuaguauc

SEQ ID NO: 2085621 - RNA, 16 nt, Staphylococcus aureus subsp. aureus MW2
auaaugaaguuaugaa

SEQ ID NO: 2085622 - RNA, 14 nt, Staphylococcus aureus subsp. aureus MW2
auaauggacgguau

SEQ ID NO: 2085623 - RNA, 21 nt, Staphylococcus aureus subsp. aureus MW2
auaaugcagauucuucaccaa

SEQ ID NO: 2085624 - RNA, 14 nt, Staphylococcus aureus subsp. aureus MW2
auaauguucccuua

SEQ ID NO: 2085625 - RNA, 12 nt, Staphylococcus aureus subsp. aureus MW2
auaauuaaacua

SEQ ID NO: 2085626 - RNA, 15 nt, Staphylococcus aureus subsp. aureus MW2
auaauucagaugaau

SEQ ID NO: 2085627 - RNA, 16 nt, Staphylococcus aureus subsp. aureus MW2
auaauuacuaaccuaa

SEQ ID NO: 2085628 - RNA, 22 nt, Staphylococcus aureus subsp. aureus MW2
auacaaggcauauccgaaaauu

SEQ ID NO: 2085629 - RNA, 20 nt, Staphylococcus aureus subsp. aureus MW2
auagcuaaauaaauuagagc

SEQ ID NO: 2085630 - RNA, 18 nt, Staphylococcus aureus subsp. aureus MW2
auagcuagcaaucccauu

SEQ ID NO: 2085631 - RNA, 20 nt, Staphylococcus aureus subsp. aureus MW2
auacacguaacgcaguugaa

SEQ ID NO: 2085632 - RNA, 20 nt, Staphylococcus aureus subsp. aureus MW2
auacaggaaauugaagcguu

SEQ ID NO: 2085633 - RNA, 19 nt, Staphylococcus aureus subsp. aureus MW2
auaguaccaagcuucauua

SEQ ID NO: 2085634 - RNA, 14 nt, Staphylococcus aureus subsp. aureus MW2
auauaguuauaugu

SEQ ID NO: 2085635 - RNA, 15 nt, Staphylococcus aureus subsp. aureus MW2
auauauaacaaguac

SEQ ID NO: 2085636 - RNA, 15 nt, Staphylococcus aureus subsp. aureus MW2
auagugacauuccaa

SEQ ID NO: 2085637 - RNA, 14 nt, Staphylococcus aureus subsp. aureus MW2
auaucaagauguuu

SEQ ID NO: 2085638 - RNA, 22 nt, Staphylococcus aureus subsp. aureus MW2
auaucaacauguuccgcuacaa

SEQ ID NO: 2085639 - RNA, 15 nt, Staphylococcus aureus subsp. aureus MW2
auaucaauaauucgu

SEQ ID NO: 2085640 - RNA, 20 nt, Staphylococcus aureus subsp. aureus MW2
auaugaauuuagaugcauaa

SEQ ID NO: 2085641 - RNA, 17 nt, Staphylococcus aureus subsp. aureus MW2
auaugaguuacaugguu

SEQ ID NO: 2085642 - RNA, 21 nt, Staphylococcus aureus subsp. aureus MW2
auaugaauuuagaugcauaaa

SEQ ID NO: 2085643 - RNA, 17 nt, Staphylococcus aureus subsp. aureus MW2
auaugaucuaacaucau

SEQ ID NO: 2085644 - RNA, 17 nt, Staphylococcus aureus subsp. aureus MW2
auauucuuaaaagacau

SEQ ID NO: 2085645 - RNA, 18 nt, Staphylococcus aureus subsp. aureus MW2
auauucuaauugcacauu

SEQ ID NO: 2085646 - RNA, 16 nt, Staphylococcus aureus subsp. aureus MW2
auauucauucuagcau

SEQ ID NO: 2085647 - RNA, 18 nt, Staphylococcus aureus subsp. aureus MW2
aucaacgauuuugucuuu

SEQ ID NO: 2085648 - RNA, 16 nt, Staphylococcus aureus subsp. aureus MW2
aucaacgagucauaaa

SEQ ID NO: 2085649 - RNA, 14 nt, Staphylococcus aureus subsp. aureus MW2
aucaaaaucaugcu

SEQ ID NO: 2085650 - RNA, 17 nt, Staphylococcus aureus subsp. aureus MW2
aucaacccaucauguac

SEQ ID NO: 2085651 - RNA, 23 nt, Staphylococcus aureus subsp. aureus MW2
auauuggcaguucugaaacauuu

SEQ ID NO: 2085652 - RNA, 21 nt, Staphylococcus aureus subsp. aureus MW2
auauuuaacgaaaauuaagau

SEQ ID NO: 2085653 - RNA, 21 nt, Staphylococcus aureus subsp. aureus MW2
auauuuagguaauacaucauc

SEQ ID NO: 2085654 - RNA, 16 nt, Staphylococcus aureus subsp. aureus MW2
auauuucuaaaccauu

SEQ ID NO: 2085655 - RNA, 16 nt, Staphylococcus aureus subsp. aureus MW2
aucaauauaauuuggu

SEQ ID NO: 2085656 - RNA, 19 nt, Staphylococcus aureus subsp. aureus MW2
aucaagucgcaucguagca

SEQ ID NO: 2085657 - RNA, 18 nt, Staphylococcus aureus subsp. aureus MW2
aucacgauuuucaaguaa

SEQ ID NO: 2085658 - RNA, 16 nt, Staphylococcus aureus subsp. aureus MW2
aucaugccuucaugaa

SEQ ID NO: 2085659 - RNA, 23 nt, Staphylococcus aureus subsp. aureus MW2
aucaugaaauuaaaaacaccuuc

SEQ ID NO: 2085660 - RNA, 14 nt, Staphylococcus aureus subsp. aureus MW2
aucaucgccagcau

SEQ ID NO: 2085661 - RNA, 19 nt, Staphylococcus aureus subsp. aureus MW2
auccuaagcauaaaucaac

SEQ ID NO: 2085662 - RNA, 15 nt, Staphylococcus aureus subsp. aureus MW2
auccugccaauauau

SEQ ID NO: 2085663 - RNA, 15 nt, Staphylococcus aureus subsp. aureus MW2
auccuuuaaaucauu

SEQ ID NO: 2085664 - RNA, 22 nt, Staphylococcus aureus subsp. aureus MW2
aucauuaaaucugauucauuaa

SEQ ID NO: 2085665 - RNA, 22 nt, Staphylococcus aureus subsp. aureus MW2
aucauggcuuauacacuuacaa

SEQ ID NO: 2085666 - RNA, 15 nt, Staphylococcus aureus subsp. aureus MW2
aucaugcgcaauauu

SEQ ID NO: 2085667 - RNA, 18 nt, Staphylococcus aureus subsp. aureus MW2
aucauggcacaucagaua

SEQ ID NO: 2085668 - RNA, 18 nt, Staphylococcus aureus subsp. aureus MW2
aucauugaauguuggauc

SEQ ID NO: 2085669 - RNA, 24 nt, Staphylococcus aureus subsp. aureus MW2
aucauugaauguuggaucggcauu

SEQ ID NO: 2085670 - RNA, 14 nt, Staphylococcus aureus subsp. aureus MW2
auccaaugcauaaa

SEQ ID NO: 2085671 - RNA, 23 nt, Staphylococcus aureus subsp. aureus MW2
auccaagucuaaaugcaauaugu

SEQ ID NO: 2085672 - RNA, 19 nt, Staphylococcus aureus subsp. aureus MW2
agccugcaacccauguggu

SEQ ID NO: 2085673 - RNA, 21 nt, Staphylococcus aureus subsp. aureus MW2
agccugagcgugucauuaaca

SEQ ID NO: 2085674 - RNA, 21 nt, Staphylococcus aureus subsp. aureus MW2
agcgaaaguaucuaugaaauu

SEQ ID NO: 2085675 - RNA, 20 nt, Staphylococcus aureus subsp. aureus MW2
agccaugauacgaugcguga

SEQ ID NO: 2085676 - RNA, 20 nt, Staphylococcus aureus subsp. aureus MW2
agcauaugguaaaucgucau

SEQ ID NO: 2085677 - RNA, 13 nt, Staphylococcus aureus subsp. aureus MW2
agccauaauaucu

SEQ ID NO: 2085678 - RNA, 13 nt, Staphylococcus aureus subsp. aureus MW2
agcauaaaucaac

SEQ ID NO: 2085679 - RNA, 15 nt, Staphylococcus aureus subsp. aureus MW2
agauuauauuaucau

SEQ ID NO: 2085680 - RNA, 16 nt, Staphylococcus aureus subsp. aureus MW2
aggcauuguguaugag

SEQ ID NO: 2085681 - RNA, 18 nt, Staphylococcus aureus subsp. aureus MW2
aggaucaagugcagaugu

SEQ ID NO: 2085682 - RNA, 20 nt, Staphylococcus aureus subsp. aureus MW2
aaacgguaacaaagauuauu

SEQ ID NO: 2085683 - RNA, 16 nt, Staphylococcus aureus subsp. aureus MW2
aggaccacucaauucu

SEQ ID NO: 2085684 - RNA, 17 nt, Staphylococcus aureus subsp. aureus MW2
aggaauagcuacaauua

SEQ ID NO: 2085685 - RNA, 20 nt, Staphylococcus aureus subsp. aureus MW2
agcuucuuuaacaauugauu

SEQ ID NO: 2085686 - RNA, 22 nt, Staphylococcus aureus subsp. aureus MW2
agcuuguuuguuacauauugca

SEQ ID NO: 2085687 - RNA, 13 nt, Staphylococcus aureus subsp. aureus MW2
agcuaaaaguuuc

SEQ ID NO: 2085688 - RNA, 23 nt, Staphylococcus aureus subsp. aureus MW2
uuuuuuguugguuuuuaaaagua

SEQ ID NO: 2085689 - RNA, 16 nt, Staphylococcus aureus subsp. aureus MW2
uuuuucaucauuaaaa

SEQ ID NO: 2085690 - RNA, 19 nt, Staphylococcus aureus subsp. aureus MW2
uuuuucauaauuaauaaca

SEQ ID NO: 2085691 - RNA, 22 nt, Staphylococcus aureus subsp. aureus MW2
uuuuucauaaauauuuaaaaua

SEQ ID NO: 2085692 - RNA, 17 nt, Staphylococcus aureus subsp. aureus MW2
uuuuguacauuauuaau

SEQ ID NO: 2085693 - RNA, 16 nt, Staphylococcus aureus subsp. aureus MW2
uuuugugauuuuuaau

SEQ ID NO: 2085694 - RNA, 17 nt, Staphylococcus aureus subsp. aureus MW2
uuuuguguucggaauuu

SEQ ID NO: 2085695 - RNA, 22 nt, Staphylococcus aureus subsp. aureus MW2
uuuuguugcucagugcauuuuu

SEQ ID NO: 2085696 - RNA, 15 nt, Staphylococcus aureus subsp. aureus MW2
uuuuguuaauuuuuu

SEQ ID NO: 2085697 - RNA, 14 nt, Staphylococcus aureus subsp. aureus MW2
uuuuguuauugaau

SEQ ID NO: 2085698 - RNA, 12 nt, Staphylococcus aureus subsp. aureus MW2
uuuuguuuugcu

SEQ ID NO: 2085699 - RNA, 22 nt, Staphylococcus aureus subsp. aureus MW2
uuuuuaaaaaauuuaaauaaua

SEQ ID NO: 2085700 - RNA, 17 nt, Staphylococcus aureus subsp. aureus MW2
uuuuuaaaaaauuuaaa

SEQ ID NO: 2085701 - RNA, 16 nt, Staphylococcus aureus subsp. aureus MW2
uuuuguuucaaauuuu

SEQ ID NO: 2085702 - RNA, 18 nt, Staphylococcus aureus subsp. aureus MW2
uuuuguaacguucuuaua

SEQ ID NO: 2085703 - RNA, 23 nt, Staphylococcus aureus subsp. aureus MW2
uuuuguaauugaaaugauagaug

SEQ ID NO: 2085704 - RNA, 21 nt, Staphylococcus aureus subsp. aureus MW2
uuuugggaauuguauuaauca

SEQ ID NO: 2085705 - RNA, 18 nt, Staphylococcus aureus subsp. aureus MW2
uuuuggaacauauucaua

SEQ ID NO: 2085706 - RNA, 15 nt, Staphylococcus aureus subsp. aureus MW2
uuuugcgaaaauauc

SEQ ID NO: 2085707 - RNA, 23 nt, Staphylococcus aureus subsp. aureus MW2
uuuugcccuuauauuuuuuacaa

SEQ ID NO: 2085708 - RNA, 15 nt, Staphylococcus aureus subsp. aureus MW2
uuuugcuaaccauca

SEQ ID NO: 2085709 - RNA, 18 nt, Staphylococcus aureus subsp. aureus MW2
uuuugcguuuuuaaauaa

SEQ ID NO: 2085710 - RNA, 14 nt, Staphylococcus aureus subsp. aureus MW2
uuuuuaaaucuaca

SEQ ID NO: 2085711 - RNA, 13 nt, Staphylococcus aureus subsp. aureus MW2
uuuuuaaauuuaa

SEQ ID NO: 2085712 - RNA, 16 nt, Staphylococcus aureus subsp. aureus MW2
uuuuuaaagcugggga

SEQ ID NO: 2085713 - RNA, 17 nt, Staphylococcus aureus subsp. aureus MW2
uuuuuaaaugcuuuaaa

SEQ ID NO: 2085714 - RNA, 16 nt, Staphylococcus aureus subsp. aureus MW2
uuuuuaaaauuaucaa

SEQ ID NO: 2085715 - RNA, 21 nt, Staphylococcus aureus subsp. aureus MW2
uuuuuaauauacgagacauuu

SEQ ID NO: 2085716 - RNA, 12 nt, Staphylococcus aureus subsp. aureus MW2
uuuuuaacaaaa

SEQ ID NO: 2085717 - RNA, 16 nt, Staphylococcus aureus subsp. aureus MW2
uuuuuaacugccauau

SEQ ID NO: 2085718 - RNA, 18 nt, Staphylococcus aureus subsp. aureus MW2
uuuuuaauguauucuucu

SEQ ID NO: 2085719 - RNA, 12 nt, Staphylococcus aureus subsp. aureus MW2
uuuuuaauguua

SEQ ID NO: 2085720 - RNA, 17 nt, Staphylococcus aureus subsp. aureus MW2
uuuuuaauuuuaucucc

SEQ ID NO: 2085721 - RNA, 19 nt, Staphylococcus aureus subsp. aureus MW2
uuuuuaauuuguauuuaaa

SEQ ID NO: 2085722 - RNA, 15 nt, Staphylococcus aureus subsp. aureus MW2
uuuuuauuauacacu

SEQ ID NO: 2085723 - RNA, 13 nt, Staphylococcus aureus subsp. aureus MW2
uuuuuauuuacuc

SEQ ID NO: 2085724 - RNA, 13 nt, Staphylococcus aureus subsp. aureus MW2
uuuuucaaauaaa

SEQ ID NO: 2085725 - RNA, 23 nt, Staphylococcus aureus subsp. aureus MW2
uuuuucacuaaucauuuuuucaa

SEQ ID NO: 2085726 - RNA, 19 nt, Staphylococcus aureus subsp. aureus MW2
uuuuucaauuaaauguuua

SEQ ID NO: 2085727 - RNA, 22 nt, Staphylococcus aureus subsp. aureus MW2
uuuuuaguuagaaaguauuuau

SEQ ID NO: 2085728 - RNA, 15 nt, Staphylococcus aureus subsp. aureus MW2
uuuuuaguaauaaca

SEQ ID NO: 2085729 - RNA, 19 nt, Staphylococcus aureus subsp. aureus MW2
uuuuuagguuauauuuaaa

SEQ ID NO: 2085730 - RNA, 23 nt, Staphylococcus aureus subsp. aureus MW2
uuuuuauauuauuucaauacccu

SEQ ID NO: 2085731 - RNA, 20 nt, Staphylococcus aureus subsp. aureus MW2
uuuuuaucuguagaaacacu

SEQ ID NO: 2085732 - RNA, 12 nt, Staphylococcus aureus subsp. aureus MW2
uuuuuauuauaa

SEQ ID NO: 2085733 - RNA, 18 nt, Staphylococcus aureus subsp. aureus MW2
uuuucuugguuugagaau

SEQ ID NO: 2085734 - RNA, 22 nt, Staphylococcus aureus subsp. aureus MW2
uuuucuugcauacgaauuaaaa

SEQ ID NO: 2085735 - RNA, 17 nt, Staphylococcus aureus subsp. aureus MW2
uuuucuugaaauaaaca

SEQ ID NO: 2085736 - RNA, 19 nt, Staphylococcus aureus subsp. aureus MW2
uuuucuggucacuaaugca

SEQ ID NO: 2085737 - RNA, 14 nt, Staphylococcus aureus subsp. aureus MW2
uuuucucuauuaau

SEQ ID NO: 2085738 - RNA, 15 nt, Staphylococcus aureus subsp. aureus MW2
uuuucgauuaauucu

SEQ ID NO: 2085739 - RNA, 15 nt, Staphylococcus aureus subsp. aureus MW2
uuuucgccaaaaacu

SEQ ID NO: 2085740 - RNA, 22 nt, Staphylococcus aureus subsp. aureus MW2
uuuucgccaaaaacuuuauauu

SEQ ID NO: 2085741 - RNA, 21 nt, Staphylococcus aureus subsp. aureus MW2
uuuucgcaaaauuuauuucgu

SEQ ID NO: 2085742 - RNA, 14 nt, Staphylococcus aureus subsp. aureus MW2
uuuugcaaaauuuu

SEQ ID NO: 2085743 - RNA, 22 nt, Staphylococcus aureus subsp. aureus MW2
uuuugcaucacagauaaugcau

SEQ ID NO: 2085744 - RNA, 21 nt, Staphylococcus aureus subsp. aureus MW2
uuuugcaucacagauaaugca

SEQ ID NO: 2085745 - RNA, 12 nt, Staphylococcus aureus subsp. aureus MW2
uuuucuuuuguu

SEQ ID NO: 2085746 - RNA, 12 nt, Staphylococcus aureus subsp. aureus MW2
uuuugagauauu

SEQ ID NO: 2085747 - RNA, 20 nt, Staphylococcus aureus subsp. aureus MW2
uuuugagagauuauuuaaaa

SEQ ID NO: 2085748 - RNA, 13 nt, Staphylococcus aureus subsp. aureus MW2
uuuugacuauucu

SEQ ID NO: 2085749 - RNA, 14 nt, Staphylococcus aureus subsp. aureus MW2
uuuucaaauuucua

SEQ ID NO: 2085750 - RNA, 22 nt, Staphylococcus aureus subsp. aureus MW2
uuuucacgaauaucuuaaagaa

SEQ ID NO: 2085751 - RNA, 17 nt, Staphylococcus aureus subsp. aureus MW2
uuuucacgauuuuuaaa

SEQ ID NO: 2085752 - RNA, 17 nt, Staphylococcus aureus subsp. aureus MW2
uuuucacuaaucauuuu

SEQ ID NO: 2085753 - RNA, 20 nt, Staphylococcus aureus subsp. aureus MW2
uuuucaaaaucuuuaucagu

SEQ ID NO: 2085754 - RNA, 20 nt, Staphylococcus aureus subsp. aureus MW2
uuuucaaacauauucauucu

SEQ ID NO: 2085755 - RNA, 22 nt, Staphylococcus aureus subsp. aureus MW2
uuuaccuucgcauacuuuuuca

SEQ ID NO: 2085756 - RNA, 16 nt, Staphylococcus aureus subsp. aureus MW2
uuuaccgugaauauaa

SEQ ID NO: 2085757 - RNA, 21 nt, Staphylococcus aureus subsp. aureus MW2
uuuucauagaacaaaauguag

SEQ ID NO: 2085758 - RNA, 18 nt, Staphylococcus aureus subsp. aureus MW2
uuuucauaaauauuuaaa

SEQ ID NO: 2085759 - RNA, 18 nt, Staphylococcus aureus subsp. aureus MW2
uuuucaucauuaaaauca

SEQ ID NO: 2085760 - RNA, 22 nt, Staphylococcus aureus subsp. aureus MW2
uuuucagcuaauugucguucuu

SEQ ID NO: 2085761 - RNA, 19 nt, Staphylococcus aureus subsp. aureus MW2
uuuucagcaucuacuaaau

SEQ ID NO: 2085762 - RNA, 19 nt, Staphylococcus aureus subsp. aureus MW2
uuuuccuaaaccucuaaau

SEQ ID NO: 2085763 - RNA, 22 nt, Staphylococcus aureus subsp. aureus MW2
uuuuccuuuugaauaauaaacu

SEQ ID NO: 2085764 - RNA, 20 nt, Staphylococcus aureus subsp. aureus MW2
ucugaugaggcaauauuaaa

SEQ ID NO: 2085765 - RNA, 15 nt, Staphylococcus aureus subsp. aureus MW2
ucugaucgacuaauu

SEQ ID NO: 2085766 - RNA, 14 nt, Staphylococcus aureus subsp. aureus MW2
ucugacuuuuaaaa

SEQ ID NO: 2085767 - RNA, 18 nt, Staphylococcus aureus subsp. aureus MW2
ucugacuaacauugguac

SEQ ID NO: 2085768 - RNA, 14 nt, Staphylococcus aureus subsp. aureus MW2
ucucuuugaagggu

SEQ ID NO: 2085769 - RNA, 17 nt, Staphylococcus aureus subsp. aureus MW2
ucugaaaaauauuuaaa

SEQ ID NO: 2085770 - RNA, 18 nt, Staphylococcus aureus subsp. aureus MW2
ucugaaaaauauuuaaau

SEQ ID NO: 2085771 - RNA, 19 nt, Staphylococcus aureus subsp. aureus MW2
ucugaaaaaauuaauaauu

SEQ ID NO: 2085772 - RNA, 22 nt, Staphylococcus aureus subsp. aureus MW2
ucugaagguaauuuaacauuuu

SEQ ID NO: 2085773 - RNA, 18 nt, Staphylococcus aureus subsp. aureus MW2
ucugaaguagauugauau

SEQ ID NO: 2085774 - RNA, 23 nt, Staphylococcus aureus subsp. aureus MW2
ucucuguguuggggcccaucccc

SEQ ID NO: 2085775 - RNA, 20 nt, Staphylococcus aureus subsp. aureus MW2
ucucuauuaauuuucucaaa

SEQ ID NO: 2085776 - RNA, 18 nt, Staphylococcus aureus subsp. aureus MW2
ucucuauuuauaacacuu

SEQ ID NO: 2085777 - RNA, 15 nt, Staphylococcus aureus subsp. aureus MW2
ucucuuauuuuaaaa

SEQ ID NO: 2085778 - RNA, 14 nt, Staphylococcus aureus subsp. aureus MW2
ucucuuuaccagua

SEQ ID NO: 2085779 - RNA, 18 nt, Staphylococcus aureus subsp. aureus MW2
ucucuaguaucugauacc

SEQ ID NO: 2085780 - RNA, 18 nt, Staphylococcus aureus subsp. aureus MW2
ucucuagugcuuugucuu

SEQ ID NO: 2085781 - RNA, 19 nt, Staphylococcus aureus subsp. aureus MW2
ucucuaaaacuuuuucaau

SEQ ID NO: 2085782 - RNA, 23 nt, Staphylococcus aureus subsp. aureus MW2
ucucuaaaaagcggacugaaaga

SEQ ID NO: 2085783 - RNA, 15 nt, Staphylococcus aureus subsp. aureus MW2
ucucguguauacaac

SEQ ID NO: 2085784 - RNA, 17 nt, Staphylococcus aureus subsp. aureus MW2
ucucguugcacaacagu

SEQ ID NO: 2085785 - RNA, 14 nt, Staphylococcus aureus subsp. aureus MW2
ucucgucuuuuguc

SEQ ID NO: 2085786 - RNA, 14 nt, Staphylococcus aureus subsp. aureus MW2
ucucguaauaaugu

SEQ ID NO: 2085787 - RNA, 23 nt, Staphylococcus aureus subsp. aureus MW2
ucucgauuuuuuuauauuuuaag

SEQ ID NO: 2085788 - RNA, 21 nt, Staphylococcus aureus subsp. aureus MW2
ucucauugaaaucgucuuacu

SEQ ID NO: 2085789 - RNA, 17 nt, Staphylococcus aureus subsp. aureus MW2
ucuaccaauaauucccu

SEQ ID NO: 2085790 - RNA, 24 nt, Staphylococcus aureus subsp. aureus MW2
ucuacauuaaagaaaauaucugaa

SEQ ID NO: 2085791 - RNA, 19 nt, Staphylococcus aureus subsp. aureus MW2
ucuacaugaaucaacaaua

SEQ ID NO: 2085792 - RNA, 14 nt, Staphylococcus aureus subsp. aureus MW2
ucucauuauaauga

SEQ ID NO: 2085793 - RNA, 21 nt, Staphylococcus aureus subsp. aureus MW2
ucucauuauaaugauuuuuau

SEQ ID NO: 2085794 - RNA, 18 nt, Staphylococcus aureus subsp. aureus MW2
ucucaugccaaaaacauu

SEQ ID NO: 2085795 - RNA, 18 nt, Staphylococcus aureus subsp. aureus MW2
ucucauuaaccuuacaua

SEQ ID NO: 2085796 - RNA, 18 nt, Staphylococcus aureus subsp. aureus MW2
ucucaucuucuaaaucaa

SEQ ID NO: 2085797 - RNA, 20 nt, Staphylococcus aureus subsp. aureus MW2
ucucaucuauuuaauaaugu

SEQ ID NO: 2085798 - RNA, 21 nt, Staphylococcus aureus subsp. aureus MW2
ucuguaaauuaucuaaagaaa

SEQ ID NO: 2085799 - RNA, 13 nt, Staphylococcus aureus subsp. aureus MW2
ucuguaauuaauc

SEQ ID NO: 2085800 - RNA, 22 nt, Staphylococcus aureus subsp. aureus MW2
ucuguaaauuaucuaaagaaau

SEQ ID NO: 2085801 - RNA, 15 nt, Staphylococcus aureus subsp. aureus MW2
ucuguaccguauuuu

SEQ ID NO: 2085802 - RNA, 17 nt, Staphylococcus aureus subsp. aureus MW2
ucugucuaaaaacauaa

SEQ ID NO: 2085803 - RNA, 21 nt, Staphylococcus aureus subsp. aureus MW2
ucugucggacuccuuuuacuu

SEQ ID NO: 2085804 - RNA, 18 nt, Staphylococcus aureus subsp. aureus MW2
ucuguaccguauuuuaau

SEQ ID NO: 2085805 - RNA, 14 nt, Staphylococcus aureus subsp. aureus MW2
ucugucaaauugga

SEQ ID NO: 2085806 - RNA, 15 nt, Staphylococcus aureus subsp. aureus MW2
ucuggaacuuuaaua

SEQ ID NO: 2085807 - RNA, 16 nt, Staphylococcus aureus subsp. aureus MW2
ucuggaacaauaauca

SEQ ID NO: 2085808 - RNA, 21 nt, Staphylococcus aureus subsp. aureus MW2
ucuggaacaauaaucaauguu

SEQ ID NO: 2085809 - RNA, 17 nt, Staphylococcus aureus subsp. aureus MW2
ucugcucuuuuuguaug

SEQ ID NO: 2085810 - RNA, 21 nt, Staphylococcus aureus subsp. aureus MW2
ucugcuaacucugaucuaaaa

SEQ ID NO: 2085811 - RNA, 18 nt, Staphylococcus aureus subsp. aureus MW2
ucugcuagacaaucaucu

SEQ ID NO: 2085812 - RNA, 13 nt, Staphylococcus aureus subsp. aureus MW2
ucugcaauuucau

SEQ ID NO: 2085813 - RNA, 18 nt, Staphylococcus aureus subsp. aureus MW2
ucugcaccuguuuuaauu

SEQ ID NO: 2085814 - RNA, 17 nt, Staphylococcus aureus subsp. aureus MW2
ucuuaccauuuauccuu

SEQ ID NO: 2085815 - RNA, 19 nt, Staphylococcus aureus subsp. aureus MW2
ucuguuacagguuuuaaaa

SEQ ID NO: 2085816 - RNA, 22 nt, Staphylococcus aureus subsp. aureus MW2
ucuuacuacuuaauuaauaauu

SEQ ID NO: 2085817 - RNA, 23 nt, Staphylococcus aureus subsp. aureus MW2
ucuuacuacuuaauuaauaauuu

SEQ ID NO: 2085818 - RNA, 18 nt, Staphylococcus aureus subsp. aureus MW2
ucuuacugcuuuuuuaaa

SEQ ID NO: 2085819 - RNA, 21 nt, Staphylococcus aureus subsp. aureus MW2
ucuuaucaagaauauaacgaa

SEQ ID NO: 2085820 - RNA, 16 nt, Staphylococcus aureus subsp. aureus MW2
ucuuauauuuaugaua

SEQ ID NO: 2085821 - RNA, 13 nt, Staphylococcus aureus subsp. aureus MW2
ucuuauaaaauaa

SEQ ID NO: 2085822 - RNA, 13 nt, Staphylococcus aureus subsp. aureus MW2
ucuuauaacaaaa

SEQ ID NO: 2085823 - RNA, 17 nt, Staphylococcus aureus subsp. aureus MW2
ucuuauagauuuuucag

SEQ ID NO: 2085824 - RNA, 13 nt, Staphylococcus aureus subsp. aureus MW2
ucuuauaaaaauc

SEQ ID NO: 2085825 - RNA, 18 nt, Staphylococcus aureus subsp. aureus MW2
ucuuaucauuucaaauaa

SEQ ID NO: 2085826 - RNA, 18 nt, Staphylococcus aureus subsp. aureus MW2
ucuucaauuaaugauuca

SEQ ID NO: 2085827 - RNA, 21 nt, Staphylococcus aureus subsp. aureus MW2
ucuucaauauuuaaauuuuaa

SEQ ID NO: 2085828 - RNA, 18 nt, Staphylococcus aureus subsp. aureus MW2
ucuucaauuucauuuuug

SEQ ID NO: 2085829 - RNA, 13 nt, Staphylococcus aureus subsp. aureus MW2
ucuucaauugucu

SEQ ID NO: 2085830 - RNA, 13 nt, Staphylococcus aureus subsp. aureus MW2
ucuucaauuuuac

SEQ ID NO: 2085831 - RNA, 15 nt, Staphylococcus aureus subsp. aureus MW2
ucuucaacuuucucu

SEQ ID NO: 2085832 - RNA, 16 nt, Staphylococcus aureus subsp. aureus MW2
ucuucaacuuucucua

SEQ ID NO: 2085833 - RNA, 20 nt, Staphylococcus aureus subsp. aureus MW2
ucuucaacauaacucaaaua

SEQ ID NO: 2085834 - RNA, 22 nt, Staphylococcus aureus subsp. aureus MW2
ucuucaacaauuucaaugucug

SEQ ID NO: 2085835 - RNA, 14 nt, Staphylococcus aureus subsp. aureus MW2
ucuuauuuuuaugc

SEQ ID NO: 2085836 - RNA, 14 nt, Staphylococcus aureus subsp. aureus MW2
ucuucaaaaaauaa

SEQ ID NO: 2085837 - RNA, 15 nt, Staphylococcus aureus subsp. aureus MW2
ucuuauuuuaaaaua

SEQ ID NO: 2085838 - RNA, 18 nt, Staphylococcus aureus subsp. aureus MW2
ucuuauuuuguuuuaaaa

SEQ ID NO: 2085839 - RNA, 15 nt, Staphylococcus aureus subsp. aureus MW2
ucuuauuuguuuaau

SEQ ID NO: 2085840 - RNA, 18 nt, Staphylococcus aureus subsp. aureus MW2
ucuuauuuguaauuucag

SEQ ID NO: 2085841 - RNA, 19 nt, Staphylococcus aureus subsp. aureus MW2
ucuucacuaaaaauauauu

SEQ ID NO: 2085842 - RNA, 23 nt, Staphylococcus aureus subsp. aureus MW2
ucuucaucaauaacuauaaucau

SEQ ID NO: 2085843 - RNA, 12 nt, Staphylococcus aureus subsp. aureus MW2
ucuucaucuuuu

SEQ ID NO: 2085844 - RNA, 12 nt, Staphylococcus aureus subsp. aureus MW2
ucuucaucuuua

SEQ ID NO: 2085845 - RNA, 18 nt, Staphylococcus aureus subsp. aureus MW2
ucuuccacacaaauguau

SEQ ID NO: 2085846 - RNA, 19 nt, Staphylococcus aureus subsp. aureus MW2
ucuuccacacaaauguaua

SEQ ID NO: 2085847 - RNA, 13 nt, Staphylococcus aureus subsp. aureus MW2
ucuucaucauauu

SEQ ID NO: 2085848 - RNA, 16 nt, Staphylococcus aureus subsp. aureus MW2
ucuucaucuucuucaa

SEQ ID NO: 2085849 - RNA, 14 nt, Staphylococcus aureus subsp. aureus MW2
ugaaacugaaguug

SEQ ID NO: 2085850 - RNA, 13 nt, Staphylococcus aureus subsp. aureus MW2
ugaaagaaaaaac

SEQ ID NO: 2085851 - RNA, 14 nt, Staphylococcus aureus subsp. aureus MW2
ugaaagaaaaaacu

SEQ ID NO: 2085852 - RNA, 15 nt, Staphylococcus aureus subsp. aureus MW2
ugaaagaaaaaacuu

SEQ ID NO: 2085853 - RNA, 21 nt, Staphylococcus aureus subsp. aureus MW2
ugaaagaaaaaacuuuucaug

SEQ ID NO: 2085854 - RNA, 22 nt, Staphylococcus aureus subsp. aureus MW2
ugaaacugauuggacugauaau

SEQ ID NO: 2085855 - RNA, 16 nt, Staphylococcus aureus subsp. aureus MW2
ugaaacuuuaauacua

SEQ ID NO: 2085856 - RNA, 22 nt, Staphylococcus aureus subsp. aureus MW2
ugaaaccuuugguucaaucauu

SEQ ID NO: 2085857 - RNA, 20 nt, Staphylococcus aureus subsp. aureus MW2
ugaaaguauuagauauauuu

SEQ ID NO: 2085858 - RNA, 22 nt, Staphylococcus aureus subsp. aureus MW2
ugaaaguacuuggaaaauacua

SEQ ID NO: 2085859 - RNA, 14 nt, Staphylococcus aureus subsp. aureus MW2
ugaaaguuguuuaa

SEQ ID NO: 2085860 - RNA, 16 nt, Staphylococcus aureus subsp. aureus MW2
ugaaaguuguuuaacu

SEQ ID NO: 2085861 - RNA, 14 nt, Staphylococcus aureus subsp. aureus MW2
ugaaagauacugcu

SEQ ID NO: 2085862 - RNA, 17 nt, Staphylococcus aureus subsp. aureus MW2
ugaaagcaccuaaaaua

SEQ ID NO: 2085863 - RNA, 18 nt, Staphylococcus aureus subsp. aureus MW2
ugaaagcaccuaaaauag

SEQ ID NO: 2085864 - RNA, 20 nt, Staphylococcus aureus subsp. aureus MW2
ugaaagcaccuaaaauagaa

SEQ ID NO: 2085865 - RNA, 22 nt, Staphylococcus aureus subsp. aureus MW2
ugaaagcaccuaaaauagaaaa

SEQ ID NO: 2085866 - RNA, 14 nt, Staphylococcus aureus subsp. aureus MW2
ugaaacacaaaaag

SEQ ID NO: 2085867 - RNA, 21 nt, Staphylococcus aureus subsp. aureus MW2
ugaaacaugagcucaucuguc

SEQ ID NO: 2085868 - RNA, 12 nt, Staphylococcus aureus subsp. aureus MW2
ugaaacauuuau

SEQ ID NO: 2085869 - RNA, 23 nt, Staphylococcus aureus subsp. aureus MW2
ugaaacauuuauaaaucuuugau

SEQ ID NO: 2085870 - RNA, 22 nt, Staphylococcus aureus subsp. aureus MW2
ugaaaaucaguugcuucauaaa

SEQ ID NO: 2085871 - RNA, 22 nt, Staphylococcus aureus subsp. aureus MW2
ugaaaaucuuuaacucuugaaa

SEQ ID NO: 2085872 - RNA, 18 nt, Staphylococcus aureus subsp. aureus MW2
ugaaaauaccaagugcuu

SEQ ID NO: 2085873 - RNA, 19 nt, Staphylococcus aureus subsp. aureus MW2
ugaaaauaaucgaacagaa

SEQ ID NO: 2085874 - RNA, 13 nt, Staphylococcus aureus subsp. aureus MW2
ugaaaauaaucuu

SEQ ID NO: 2085875 - RNA, 17 nt, Staphylococcus aureus subsp. aureus MW2
ugaaaaguaauuaaaua

SEQ ID NO: 2085876 - RNA, 14 nt, Staphylococcus aureus subsp. aureus MW2
ugaaaacauuauua

SEQ ID NO: 2085877 - RNA, 14 nt, Staphylococcus aureus subsp. aureus MW2
ugaaaaauauuuaa

SEQ ID NO: 2085878 - RNA, 19 nt, Staphylococcus aureus subsp. aureus MW2
ugaaaaauauuuaaauaga

SEQ ID NO: 2085879 - RNA, 17 nt, Staphylococcus aureus subsp. aureus MW2
ugaaaaagauucggaaa

SEQ ID NO: 2085880 - RNA, 21 nt, Staphylococcus aureus subsp. aureus MW2
ugaaaaagacaauuucuauuu

SEQ ID NO: 2085881 - RNA, 12 nt, Staphylococcus aureus subsp. aureus MW2
ugaaaacuucuc

SEQ ID NO: 2085882 - RNA, 11 nt, Staphylococcus aureus subsp. aureus MW2
ugaaaacuucu

SEQ ID NO: 2085883 - RNA, 19 nt, Staphylococcus aureus subsp. aureus MW2
ugaaccauuuaacucaccu

SEQ ID NO: 2085884 - RNA, 15 nt, Staphylococcus aureus subsp. aureus MW2
ugaaccggaaauuaa

SEQ ID NO: 2085885 - RNA, 18 nt, Staphylococcus aureus subsp. aureus MW2
ugaaccaauccaauauac

SEQ ID NO: 2085886 - RNA, 16 nt, Staphylococcus aureus subsp. aureus MW2
ugaacgagagagaaaa

SEQ ID NO: 2085887 - RNA, 20 nt, Staphylococcus aureus subsp. aureus MW2
ugaacgagagagaaaagcua

SEQ ID NO: 2085888 - RNA, 22 nt, Staphylococcus aureus subsp. aureus MW2
ugaacgagagagaaaagcuaga

SEQ ID NO: 2085889 - RNA, 16 nt, Staphylococcus aureus subsp. aureus MW2
ugaacgaaagagaaaa

SEQ ID NO: 2085890 - RNA, 20 nt, Staphylococcus aureus subsp. aureus MW2
ugaacgaaagagaaaagcua

SEQ ID NO: 2085891 - RNA, 22 nt, Staphylococcus aureus subsp. aureus MW2
ugaacgaaagagaaaagcuaga

SEQ ID NO: 2085892 - RNA, 22 nt, Staphylococcus aureus subsp. aureus MW2
ugaacaacauugagauuaucuu

SEQ ID NO: 2085893 - RNA, 19 nt, Staphylococcus aureus subsp. aureus MW2
ugaacaacaaauuuugauu

SEQ ID NO: 2085894 - RNA, 13 nt, Staphylococcus aureus subsp. aureus MW2
ugaacaauaauau

SEQ ID NO: 2085895 - RNA, 22 nt, Staphylococcus aureus subsp. aureus MW2
ugaacaucuaguuauuucauag

SEQ ID NO: 2085896 - RNA, 17 nt, Staphylococcus aureus subsp. aureus MW2
ugaacaucauuuaauug

SEQ ID NO: 2085897 - RNA, 15 nt, Staphylococcus aureus subsp. aureus MW2
ugaacaugaaauuaa

SEQ ID NO: 2085898 - RNA, 16 nt, Staphylococcus aureus subsp. aureus MW2
ugaacaugaaauuaau

SEQ ID NO: 2085899 - RNA, 16 nt, Staphylococcus aureus subsp. aureus MW2
ugaacauauuauaaaa

SEQ ID NO: 2085900 - RNA, 20 nt, Staphylococcus aureus subsp. aureus MW2
ugaacauauuauaaaagugu

SEQ ID NO: 2085901 - RNA, 14 nt, Staphylococcus aureus subsp. aureus MW2
ugaaauuuauuaua

SEQ ID NO: 2085902 - RNA, 21 nt, Staphylococcus aureus subsp. aureus MW2
ugaaauugcgugcguuuaaca

SEQ ID NO: 2085903 - RNA, 15 nt, Staphylococcus aureus subsp. aureus MW2
ugaaauggaaaguaa

SEQ ID NO: 2085904 - RNA, 17 nt, Staphylococcus aureus subsp. aureus MW2
ugaaauggaaaguaaua

SEQ ID NO: 2085905 - RNA, 21 nt, Staphylococcus aureus subsp. aureus MW2
ugaaaugguaucuaaauguga

SEQ ID NO: 2085906 - RNA, 23 nt, Staphylococcus aureus subsp. aureus MW2
ugaaauguagacaauaaaucuuu

SEQ ID NO: 2085907 - RNA, 16 nt, Staphylococcus aureus subsp. aureus MW2
ugaaauuaauuaucuu

SEQ ID NO: 2085908 - RNA, 12 nt, Staphylococcus aureus subsp. aureus MW2
ugaaauguuuaa

SEQ ID NO: 2085909 - RNA, 16 nt, Staphylococcus aureus subsp. aureus MW2
ugaaauuaaauucaaa

SEQ ID NO: 2085910 - RNA, 21 nt, Staphylococcus aureus subsp. aureus MW2
ugaaauuaacgucaacagcau

SEQ ID NO: 2085911 - RNA, 21 nt, Staphylococcus aureus subsp. aureus MW2
ugaaauuauuauuuaaauuuu

SEQ ID NO: 2085912 - RNA, 20 nt, Staphylococcus aureus subsp. aureus MW2
ugaaauuauuauuuaaauuu

SEQ ID NO: 2085913 - RNA, 19 nt, Staphylococcus aureus subsp. aureus MW2
ugaaauuagaaaaauauga

SEQ ID NO: 2085914 - RNA, 20 nt, Staphylococcus aureus subsp. aureus MW2
ugaaauugacaguuuccaua

SEQ ID NO: 2085915 - RNA, 15 nt, Staphylococcus aureus subsp. aureus MW2
ugaaauucuuuugua

SEQ ID NO: 2085916 - RNA, 19 nt, Staphylococcus aureus subsp. aureus MW2
ugaaaugauaaaaauccua

SEQ ID NO: 2085917 - RNA, 20 nt, Staphylococcus aureus subsp. aureus MW2
ugaaaucuauugugauauau

SEQ ID NO: 2085918 - RNA, 14 nt, Staphylococcus aureus subsp. aureus MW2
ugaaaucauuuaaa

SEQ ID NO: 2085919 - RNA, 17 nt, Staphylococcus aureus subsp. aureus MW2
ugaaaucgauacuaaua

SEQ ID NO: 2085920 - RNA, 19 nt, Staphylococcus aureus subsp. aureus MW2
ugaaauaauauaaaaacaa

SEQ ID NO: 2085921 - RNA, 14 nt, Staphylococcus aureus subsp. aureus MW2
ugaaauaauauuaa

SEQ ID NO: 2085922 - RNA, 16 nt, Staphylococcus aureus subsp. aureus MW2
ugaaauauuuaucuuu

SEQ ID NO: 2085923 - RNA, 16 nt, Staphylococcus aureus subsp. aureus MW2
ugaaauaucgagaggg

SEQ ID NO: 2085924 - RNA, 19 nt, Staphylococcus aureus subsp. aureus MW2
ugaaauauuuaucuuuaga

SEQ ID NO: 2085925 - RNA, 22 nt, Staphylococcus aureus subsp. aureus MW2
ugaaauaggugcuuguaaaauu

SEQ ID NO: 2085926 - RNA, 18 nt, Staphylococcus aureus subsp. aureus MW2
ugaaauauagugauugaa

SEQ ID NO: 2085927 - RNA, 17 nt, Staphylococcus aureus subsp. aureus MW2
ucuuguuuucauuuaaa

SEQ ID NO: 2085928 - RNA, 21 nt, Staphylococcus aureus subsp. aureus MW2
ucuuguuuagggaaucccaua

SEQ ID NO: 2085929 - RNA, 16 nt, Staphylococcus aureus subsp. aureus MW2
ucuuuaagcuuaaaua

SEQ ID NO: 2085930 - RNA, 14 nt, Staphylococcus aureus subsp. aureus MW2
ucuuguucuaaaaa

SEQ ID NO: 2085931 - RNA, 21 nt, Staphylococcus aureus subsp. aureus MW2
ucuuggacauuguaaaaugcu

SEQ ID NO: 2085932 - RNA, 17 nt, Staphylococcus aureus subsp. aureus MW2
ucuuggccaauuaacuu

SEQ ID NO: 2085933 - RNA, 21 nt, Staphylococcus aureus subsp. aureus MW2
ucuuccccaccuaaucagaua

SEQ ID NO: 2085934 - RNA, 14 nt, Staphylococcus aureus subsp. aureus MW2
ucuuucgucuugua

SEQ ID NO: 2085935 - RNA, 17 nt, Staphylococcus aureus subsp. aureus MW2
ucuuucuaaaauaacua

SEQ ID NO: 2085936 - RNA, 20 nt, Staphylococcus aureus subsp. aureus MW2
ucuuucuuagugaaucuucu

SEQ ID NO: 2085937 - RNA, 23 nt, Staphylococcus aureus subsp. aureus MW2
ucuuuccacagcuuguucaauac

SEQ ID NO: 2085938 - RNA, 19 nt, Staphylococcus aureus subsp. aureus MW2
ucuuucauaguuauuaaau

SEQ ID NO: 2085939 - RNA, 12 nt, Staphylococcus aureus subsp. aureus MW2
ucuuuaauagcu

SEQ ID NO: 2085940 - RNA, 17 nt, Staphylococcus aureus subsp. aureus MW2
ucuuuaauauaaauuuu

SEQ ID NO: 2085941 - RNA, 18 nt, Staphylococcus aureus subsp. aureus MW2
ucuuuaauauaaauuuug

SEQ ID NO: 2085942 - RNA, 14 nt, Staphylococcus aureus subsp. aureus MW2
ucuuuaaugaaagc

SEQ ID NO: 2085943 - RNA, 14 nt, Staphylococcus aureus subsp. aureus MW2
ucuuuacaacagua

SEQ ID NO: 2085944 - RNA, 15 nt, Staphylococcus aureus subsp. aureus MW2
ucuuuacaacaguaa

SEQ ID NO: 2085945 - RNA, 13 nt, Staphylococcus aureus subsp. aureus MW2
ucuuuauauuuau

SEQ ID NO: 2085946 - RNA, 14 nt, Staphylococcus aureus subsp. aureus MW2
ucuuuauauuuauc

SEQ ID NO: 2085947 - RNA, 20 nt, Staphylococcus aureus subsp. aureus MW2
ucuuugauaacaauuuuaaa

SEQ ID NO: 2085948 - RNA, 22 nt, Staphylococcus aureus subsp. aureus MW2
ucuuugacauguguuaaaccaa

SEQ ID NO: 2085949 - RNA, 20 nt, Staphylococcus aureus subsp. aureus MW2
ucuuucuuuucugaauguau

SEQ ID NO: 2085950 - RNA, 18 nt, Staphylococcus aureus subsp. aureus MW2
ucuuuggucuaaagcuua

SEQ ID NO: 2085951 - RNA, 22 nt, Staphylococcus aureus subsp. aureus MW2
ucuuuggucuaaagcuuauuaa

SEQ ID NO: 2085952 - RNA, 18 nt, Staphylococcus aureus subsp. aureus MW2
ucuuuguugcaaugcaua

SEQ ID NO: 2085953 - RNA, 14 nt, Staphylococcus aureus subsp. aureus MW2
ucuuuuaauauuuu

SEQ ID NO: 2085954 - RNA, 12 nt, Staphylococcus aureus subsp. aureus MW2
ucuuuuaauucu

SEQ ID NO: 2085955 - RNA, 19 nt, Staphylococcus aureus subsp. aureus MW2
ucuuuguaaccuaaaaaca

SEQ ID NO: 2085956 - RNA, 15 nt, Staphylococcus aureus subsp. aureus MW2
ucuuugucaucuuuu

SEQ ID NO: 2085957 - RNA, 13 nt, Staphylococcus aureus subsp. aureus MW2
ucuuuguauuuau

SEQ ID NO: 2085958 - RNA, 18 nt, Staphylococcus aureus subsp. aureus MW2
ucuuuguguuugcuuuuu

SEQ ID NO: 2085959 - RNA, 21 nt, Staphylococcus aureus subsp. aureus MW2
ucuuuuauacauguacauuau

SEQ ID NO: 2085960 - RNA, 17 nt, Staphylococcus aureus subsp. aureus MW2
ucuuuuagaauucuaaa

SEQ ID NO: 2085961 - RNA, 22 nt, Staphylococcus aureus subsp. aureus MW2
ucuuuuauggugggaagguaaa

SEQ ID NO: 2085962 - RNA, 22 nt, Staphylococcus aureus subsp. aureus MW2
ucuuuuauauuuuuaucaucuu

SEQ ID NO: 2085963 - RNA, 23 nt, Staphylococcus aureus subsp. aureus MW2
ucuuuuuuauagugguaaaaagu

SEQ ID NO: 2085964 - RNA, 12 nt, Staphylococcus aureus subsp. aureus MW2
ucuuuuuuauua

SEQ ID NO: 2085965 - RNA, 19 nt, Staphylococcus aureus subsp. aureus MW2
ucuuuuuuauuaaguauau

SEQ ID NO: 2085966 - RNA, 23 nt, Staphylococcus aureus subsp. aureus MW2
ucuuuuuuaagcuuaucaacgau

SEQ ID NO: 2085967 - RNA, 15 nt, Staphylococcus aureus subsp. aureus MW2
ucuuuuuucaauguu

SEQ ID NO: 2085968 - RNA, 17 nt, Staphylococcus aureus subsp. aureus MW2
ucuuuuucuaaauaaac

SEQ ID NO: 2085969 - RNA, 13 nt, Staphylococcus aureus subsp. aureus MW2
ucuuuuucuaaau

SEQ ID NO: 2085970 - RNA, 15 nt, Staphylococcus aureus subsp. aureus MW2
ucuuuuucuugcaua

SEQ ID NO: 2085971 - RNA, 21 nt, Staphylococcus aureus subsp. aureus MW2
ucuuuuugauaauguucccuu

SEQ ID NO: 2085972 - RNA, 15 nt, Staphylococcus aureus subsp. aureus MW2
ucuuuuuguccccag

SEQ ID NO: 2085973 - RNA, 19 nt, Staphylococcus aureus subsp. aureus MW2
ucuuuuuguuguuuuaauu

SEQ ID NO: 2085974 - RNA, 11 nt, Staphylococcus aureus subsp. aureus MW2
ucuuuuuuaaa

SEQ ID NO: 2085975 - RNA, 18 nt, Staphylococcus aureus subsp. aureus MW2
ucuuuuuuguuauaucua

SEQ ID NO: 2085976 - RNA, 22 nt, Staphylococcus aureus subsp. aureus MW2
ucuuuuuuuaauguguaaauuu

SEQ ID NO: 2085977 - RNA, 13 nt, Staphylococcus aureus subsp. aureus MW2
ucuuuuuuuaaug

SEQ ID NO: 2085978 - RNA, 18 nt, Staphylococcus aureus subsp. aureus MW2
ucuuuuuuuaugaaaaga

SEQ ID NO: 2085979 - RNA, 17 nt, Staphylococcus aureus subsp. aureus MW2
ugaaaaaaauuuucauu

SEQ ID NO: 2085980 - RNA, 22 nt, Staphylococcus aureus subsp. aureus MW2
ugaaaaaauaacuguaaaacau

SEQ ID NO: 2085981 - RNA, 21 nt, Staphylococcus aureus subsp. aureus MW2
ucuuuuuaauauuuuuuucaa

SEQ ID NO: 2085982 - RNA, 21 nt, Staphylococcus aureus subsp. aureus MW2
ucuuuuguuaugauauacgag

SEQ ID NO: 2085983 - RNA, 15 nt, Staphylococcus aureus subsp. aureus MW2
ucuuuuuaucaugau

SEQ ID NO: 2085984 - RNA, 14 nt, Staphylococcus aureus subsp. aureus MW2
ucuuuuuauuuacu

SEQ ID NO: 2085985 - RNA, 23 nt, Staphylococcus aureus subsp. aureus MW2
ucuuuugcaaauuggaaaaauaa

SEQ ID NO: 2085986 - RNA, 19 nt, Staphylococcus aureus subsp. aureus MW2
ucuuuugcaccuucaagua

SEQ ID NO: 2085987 - RNA, 15 nt, Staphylococcus aureus subsp. aureus MW2
ucuuuucgaaauucu

SEQ ID NO: 2085988 - RNA, 22 nt, Staphylococcus aureus subsp. aureus MW2
ucggauugaaccggaaauuaaa

SEQ ID NO: 2085989 - RNA, 16 nt, Staphylococcus aureus subsp. aureus MW2
ucggauuaaaaguauc

SEQ ID NO: 2085990 - RNA, 19 nt, Staphylococcus aureus subsp. aureus MW2
ucgcuuuucuaauuuuucu

SEQ ID NO: 2085991 - RNA, 18 nt, Staphylococcus aureus subsp. aureus MW2
ucggauaccaaaacucaa

SEQ ID NO: 2085992 - RNA, 13 nt, Staphylococcus aureus subsp. aureus MW2
ucggcucucgcuu

SEQ ID NO: 2085993 - RNA, 16 nt, Staphylococcus aureus subsp. aureus MW2
ucggcuuuguaaaauu

SEQ ID NO: 2085994 - RNA, 18 nt, Staphylococcus aureus subsp. aureus MW2
ucgggaucuaauuuuucc

SEQ ID NO: 2085995 - RNA, 18 nt, Staphylococcus aureus subsp. aureus MW2
ucggggccccaacacaga

SEQ ID NO: 2085996 - RNA, 21 nt, Staphylococcus aureus subsp. aureus MW2
ucggggccccaacacagagaa

SEQ ID NO: 2085997 - RNA, 14 nt, Staphylococcus aureus subsp. aureus MW2
ucgggcuaguuuuu

SEQ ID NO: 2085998 - RNA, 16 nt, Staphylococcus aureus subsp. aureus MW2
ucguaacauuuaaaaa

SEQ ID NO: 2085999 - RNA, 18 nt, Staphylococcus aureus subsp. aureus MW2
ucguaaacacuauaaaag

SEQ ID NO: 2086000 - RNA, 19 nt, Staphylococcus aureus subsp. aureus MW2
ucgguauucaauucuguga

SEQ ID NO: 2086001 - RNA, 14 nt, Staphylococcus aureus subsp. aureus MW2
ucgguaugauauuu

SEQ ID NO: 2086002 - RNA, 18 nt, Staphylococcus aureus subsp. aureus MW2
ucgguacuugccuauuuu

SEQ ID NO: 2086003 - RNA, 21 nt, Staphylococcus aureus subsp. aureus MW2
ucguauauguaauuagaguag

SEQ ID NO: 2086004 - RNA, 14 nt, Staphylococcus aureus subsp. aureus MW2
ucguauaagaauca

SEQ ID NO: 2086005 - RNA, 19 nt, Staphylococcus aureus subsp. aureus MW2
ucguaauguguuaauacuu

SEQ ID NO: 2086006 - RNA, 14 nt, Staphylococcus aureus subsp. aureus MW2
ucguaaugaugaca

SEQ ID NO: 2086007 - RNA, 15 nt, Staphylococcus aureus subsp. aureus MW2
ucguauucuucaaua

SEQ ID NO: 2086008 - RNA, 16 nt, Staphylococcus aureus subsp. aureus MW2
ucguauucuuuuaaua

SEQ ID NO: 2086009 - RNA, 20 nt, Staphylococcus aureus subsp. aureus MW2
ucgucccaccccaacuugca

SEQ ID NO: 2086010 - RNA, 15 nt, Staphylococcus aureus subsp. aureus MW2
ucgucgcugauacau

SEQ ID NO: 2086011 - RNA, 14 nt, Staphylococcus aureus subsp. aureus MW2
ucgucgcuaauaaa

SEQ ID NO: 2086012 - RNA, 14 nt, Staphylococcus aureus subsp. aureus MW2
ucuaaaaacauaaa

SEQ ID NO: 2086013 - RNA, 14 nt, Staphylococcus aureus subsp. aureus MW2
ucguuuuuuuagcu

SEQ ID NO: 2086014 - RNA, 21 nt, Staphylococcus aureus subsp. aureus MW2
ucuaaaaaaauguugacauac

SEQ ID NO: 2086015 - RNA, 16 nt, Staphylococcus aureus subsp. aureus MW2
ucuaaaaacauaaaaa

SEQ ID NO: 2086016 - RNA, 19 nt, Staphylococcus aureus subsp. aureus MW2
ucuaaaaagcggacugaaa

SEQ ID NO: 2086017 - RNA, 16 nt, Staphylococcus aureus subsp. aureus MW2
ucuaaaaagucuuuaa

SEQ ID NO: 2086018 - RNA, 14 nt, Staphylococcus aureus subsp. aureus MW2
ucuaaauaaaauua

SEQ ID NO: 2086019 - RNA, 18 nt, Staphylococcus aureus subsp. aureus MW2
ucuaaauaaaauuaaaac

SEQ ID NO: 2086020 - RNA, 16 nt, Staphylococcus aureus subsp. aureus MW2
ucuaaagcuugaucaa

SEQ ID NO: 2086021 - RNA, 20 nt, Staphylococcus aureus subsp. aureus MW2
ucuaaauauaauagaaauaa

SEQ ID NO: 2086022 - RNA, 17 nt, Staphylococcus aureus subsp. aureus MW2
ucuaacuuuaccaauau

SEQ ID NO: 2086023 - RNA, 12 nt, Staphylococcus aureus subsp. aureus MW2
ucuaacuuugua

SEQ ID NO: 2086024 - RNA, 14 nt, Staphylococcus aureus subsp. aureus MW2
ucuaacugaauuaa

SEQ ID NO: 2086025 - RNA, 15 nt, Staphylococcus aureus subsp. aureus MW2
ucuaacgguaaauaa

SEQ ID NO: 2086026 - RNA, 18 nt, Staphylococcus aureus subsp. aureus MW2
ucuaaauuauuuauucau

SEQ ID NO: 2086027 - RNA, 15 nt, Staphylococcus aureus subsp. aureus MW2
ucuaaguuauuacaa

SEQ ID NO: 2086028 - RNA, 21 nt, Staphylococcus aureus subsp. aureus MW2
ucuaauuguuguaauucuuuu

SEQ ID NO: 2086029 - RNA, 21 nt, Staphylococcus aureus subsp. aureus MW2
ucuaauuguugugcaacauug

SEQ ID NO: 2086030 - RNA, 23 nt, Staphylococcus aureus subsp. aureus MW2
ucuaauuguugugcaacauugau

SEQ ID NO: 2086031 - RNA, 16 nt, Staphylococcus aureus subsp. aureus MW2
ucuaauacauacugau

SEQ ID NO: 2086032 - RNA, 17 nt, Staphylococcus aureus subsp. aureus MW2
ucuaauacauacugauu

SEQ ID NO: 2086033 - RNA, 14 nt, Staphylococcus aureus subsp. aureus MW2
ucuaauaauuuaau

SEQ ID NO: 2086034 - RNA, 19 nt, Staphylococcus aureus subsp. aureus MW2
ucuaauuguuguaauucuu

SEQ ID NO: 2086035 - RNA, 22 nt, Staphylococcus aureus subsp. aureus MW2
ucuacaaacaaugcaaguuggc

SEQ ID NO: 2086036 - RNA, 15 nt, Staphylococcus aureus subsp. aureus MW2
ucuacauaauuugaa

SEQ ID NO: 2086037 - RNA, 18 nt, Staphylococcus aureus subsp. aureus MW2
ucuacauaugaaaaaugu

SEQ ID NO: 2086038 - RNA, 22 nt, Staphylococcus aureus subsp. aureus MW2
ucuacaggcaaugcaaguuggc

SEQ ID NO: 2086039 - RNA, 18 nt, Staphylococcus aureus subsp. aureus MW2
ucuacaaaguuaaucaua

SEQ ID NO: 2086040 - RNA, 17 nt, Staphylococcus aureus subsp. aureus MW2
ucguuagaugaaugccu

SEQ ID NO: 2086041 - RNA, 18 nt, Staphylococcus aureus subsp. aureus MW2
ucguuacuaccuauuaau

SEQ ID NO: 2086042 - RNA, 16 nt, Staphylococcus aureus subsp. aureus MW2
ucguuaaggaaagcuu

SEQ ID NO: 2086043 - RNA, 22 nt, Staphylococcus aureus subsp. aureus MW2
ucguuaacaaucaguaauaaug

SEQ ID NO: 2086044 - RNA, 16 nt, Staphylococcus aureus subsp. aureus MW2
ucguucccauucuuug

SEQ ID NO: 2086045 - RNA, 21 nt, Staphylococcus aureus subsp. aureus MW2
ucguucauauauuuuguuaau

SEQ ID NO: 2086046 - RNA, 19 nt, Staphylococcus aureus subsp. aureus MW2
ucguucaucgcuaauacuu

SEQ ID NO: 2086047 - RNA, 15 nt, Staphylococcus aureus subsp. aureus MW2
ucguucaauuucgau

SEQ ID NO: 2086048 - RNA, 15 nt, Staphylococcus aureus subsp. aureus MW2
ucguucauauauuuu

SEQ ID NO: 2086049 - RNA, 15 nt, Staphylococcus aureus subsp. aureus MW2
ucguucucuuaaaua

SEQ ID NO: 2086050 - RNA, 15 nt, Staphylococcus aureus subsp. aureus MW2
ucguuguugaaauua

SEQ ID NO: 2086051 - RNA, 17 nt, Staphylococcus aureus subsp. aureus MW2
ucguuguugaaauuaaa

SEQ ID NO: 2086052 - RNA, 17 nt, Staphylococcus aureus subsp. aureus MW2
ucguugucacuauugca

SEQ ID NO: 2086053 - RNA, 17 nt, Staphylococcus aureus subsp. aureus MW2
ucguuuauuuuaaauuu

SEQ ID NO: 2086054 - RNA, 18 nt, Staphylococcus aureus subsp. aureus MW2
ucguuuacuacaucauaa

SEQ ID NO: 2086055 - RNA, 21 nt, Staphylococcus aureus subsp. aureus MW2
ucguuuuuugauuguaauaau

SEQ ID NO: 2086056 - RNA, 14 nt, Staphylococcus aureus subsp. aureus MW2
uccuucaucaauaa

SEQ ID NO: 2086057 - RNA, 19 nt, Staphylococcus aureus subsp. aureus MW2
uccuucagucuucauguuc

SEQ ID NO: 2086058 - RNA, 13 nt, Staphylococcus aureus subsp. aureus MW2
uccuuauuuuucg

SEQ ID NO: 2086059 - RNA, 20 nt, Staphylococcus aureus subsp. aureus MW2
uccuuggaaacgauauagac

SEQ ID NO: 2086060 - RNA, 22 nt, Staphylococcus aureus subsp. aureus MW2
uccuucgcuaugaccaugauau

SEQ ID NO: 2086061 - RNA, 24 nt, Staphylococcus aureus subsp. aureus MW2
ucagcgauaggcgcgaaaugaccu

SEQ ID NO: 2086062 - RNA, 17 nt, Staphylococcus aureus subsp. aureus MW2
uccuguguaaaauaaau

SEQ ID NO: 2086063 - RNA, 14 nt, Staphylococcus aureus subsp. aureus MW2
uccugcuuauuaau

SEQ ID NO: 2086064 - RNA, 17 nt, Staphylococcus aureus subsp. aureus MW2
ucgaacugauggaaaag

SEQ ID NO: 2086065 - RNA, 15 nt, Staphylococcus aureus subsp. aureus MW2
ucgaacuaucaauau

SEQ ID NO: 2086066 - RNA, 15 nt, Staphylococcus aureus subsp. aureus MW2
ucgaacagaaaaucg

SEQ ID NO: 2086067 - RNA, 12 nt, Staphylococcus aureus subsp. aureus MW2
ucgaacagaaaa

SEQ ID NO: 2086068 - RNA, 17 nt, Staphylococcus aureus subsp. aureus MW2
ucgaaaugccuucugua

SEQ ID NO: 2086069 - RNA, 15 nt, Staphylococcus aureus subsp. aureus MW2
ucgaaagccaauuaa

SEQ ID NO: 2086070 - RNA, 16 nt, Staphylococcus aureus subsp. aureus MW2
uccuuuugaauaauaa

SEQ ID NO: 2086071 - RNA, 20 nt, Staphylococcus aureus subsp. aureus MW2
uccuuuugaauaauaaacuu

SEQ ID NO: 2086072 - RNA, 13 nt, Staphylococcus aureus subsp. aureus MW2
uccuuuuugacuc

SEQ ID NO: 2086073 - RNA, 13 nt, Staphylococcus aureus subsp. aureus MW2
ucgaaaagaaauu

SEQ ID NO: 2086074 - RNA, 19 nt, Staphylococcus aureus subsp. aureus MW2
ucgaaaauagcuauuaaaa

SEQ ID NO: 2086075 - RNA, 22 nt, Staphylococcus aureus subsp. aureus MW2
uccuuuaccguguucaggugua

SEQ ID NO: 2086076 - RNA, 17 nt, Staphylococcus aureus subsp. aureus MW2
uccuuuagcaaaaauau

SEQ ID NO: 2086077 - RNA, 17 nt, Staphylococcus aureus subsp. aureus MW2
uccuuucaauaauaaau

SEQ ID NO: 2086078 - RNA, 23 nt, Staphylococcus aureus subsp. aureus MW2
uccuuugauguucacuaaaugug

SEQ ID NO: 2086079 - RNA, 14 nt, Staphylococcus aureus subsp. aureus MW2
ucgaguuuguuucu

SEQ ID NO: 2086080 - RNA, 14 nt, Staphylococcus aureus subsp. aureus MW2
ucgaguaauacuuu

SEQ ID NO: 2086081 - RNA, 17 nt, Staphylococcus aureus subsp. aureus MW2
ucgaucgguauuuucau

SEQ ID NO: 2086082 - RNA, 22 nt, Staphylococcus aureus subsp. aureus MW2
ucgauauggucuuuuaauauuu

SEQ ID NO: 2086083 - RNA, 20 nt, Staphylococcus aureus subsp. aureus MW2
ucgauauucuccaacucuaa

SEQ ID NO: 2086084 - RNA, 13 nt, Staphylococcus aureus subsp. aureus MW2
ucgauauuucuag

SEQ ID NO: 2086085 - RNA, 16 nt, Staphylococcus aureus subsp. aureus MW2
ucgauaugaccauagu

SEQ ID NO: 2086086 - RNA, 23 nt, Staphylococcus aureus subsp. aureus MW2
ucgcaccgucaaacuuaaaacua

SEQ ID NO: 2086087 - RNA, 22 nt, Staphylococcus aureus subsp. aureus MW2
ucgauuuagaagaacaauaauu

SEQ ID NO: 2086088 - RNA, 22 nt, Staphylococcus aureus subsp. aureus MW2
ucgauugguuuaaaaagucaaa

SEQ ID NO: 2086089 - RNA, 16 nt, Staphylococcus aureus subsp. aureus MW2
ucgauugguaaaucua

SEQ ID NO: 2086090 - RNA, 16 nt, Staphylococcus aureus subsp. aureus MW2
ucgauugcguuuucua

SEQ ID NO: 2086091 - RNA, 17 nt, Staphylococcus aureus subsp. aureus MW2
ucgauuuuggcacauaa

SEQ ID NO: 2086092 - RNA, 20 nt, Staphylococcus aureus subsp. aureus MW2
ucgccuaaaaauaaaaucaa

SEQ ID NO: 2086093 - RNA, 21 nt, Staphylococcus aureus subsp. aureus MW2
ucgcccuuuagccaaugcuuc

SEQ ID NO: 2086094 - RNA, 14 nt, Staphylococcus aureus subsp. aureus MW2
ucgcauauuuugau

SEQ ID NO: 2086095 - RNA, 16 nt, Staphylococcus aureus subsp. aureus MW2
ucgcauacuuuuucag

SEQ ID NO: 2086096 - RNA, 11 nt, Staphylococcus aureus subsp. aureus MW2
ucgccaauguu

SEQ ID NO: 2086097 - RNA, 20 nt, Staphylococcus aureus subsp. aureus MW2
ucgccauuguccaacugcuu

SEQ ID NO: 2086098 - RNA, 14 nt, Staphylococcus aureus subsp. aureus MW2
ugauaacgagcuaa

SEQ ID NO: 2086099 - RNA, 18 nt, Staphylococcus aureus subsp. aureus MW2
ugauaacgucauucuuua

SEQ ID NO: 2086100 - RNA, 19 nt, Staphylococcus aureus subsp. aureus MW2
ugauaacuauuuaauuauu

SEQ ID NO: 2086101 - RNA, 15 nt, Staphylococcus aureus subsp. aureus MW2
ugauaagaagugcuu

SEQ ID NO: 2086102 - RNA, 17 nt, Staphylococcus aureus subsp. aureus MW2
ugauaagaagugcuuau

SEQ ID NO: 2086103 - RNA, 20 nt, Staphylococcus aureus subsp. aureus MW2
ugauaacaauuuuaaaucuu

SEQ ID NO: 2086104 - RNA, 23 nt, Staphylococcus aureus subsp. aureus MW2
ugauaacacccgucccauaaaag

SEQ ID NO: 2086105 - RNA, 21 nt, Staphylococcus aureus subsp. aureus MW2
ugauaacaaccuauuaauuga

SEQ ID NO: 2086106 - RNA, 19 nt, Staphylococcus aureus subsp. aureus MW2
ugauaacaauuuuaaaucu

SEQ ID NO: 2086107 - RNA, 18 nt, Staphylococcus aureus subsp. aureus MW2
ugauaagucuugauggug

SEQ ID NO: 2086108 - RNA, 18 nt, Staphylococcus aureus subsp. aureus MW2
ugauaauauuauucuuua

SEQ ID NO: 2086109 - RNA, 13 nt, Staphylococcus aureus subsp. aureus MW2
ugauaaugcaugu

SEQ ID NO: 2086110 - RNA, 21 nt, Staphylococcus aureus subsp. aureus MW2
ugauaauccaccaaauacagu

SEQ ID NO: 2086111 - RNA, 14 nt, Staphylococcus aureus subsp. aureus MW2
ugauacauaaaaug

SEQ ID NO: 2086112 - RNA, 14 nt, Staphylococcus aureus subsp. aureus MW2
ugauaauuuuucuu

SEQ ID NO: 2086113 - RNA, 19 nt, Staphylococcus aureus subsp. aureus MW2
ugauaaugucuuacuuguc

SEQ ID NO: 2086114 - RNA, 19 nt, Staphylococcus aureus subsp. aureus MW2
ugauaauuaaugccauugu

SEQ ID NO: 2086115 - RNA, 23 nt, Staphylococcus aureus subsp. aureus MW2
ugauaaugguugauuugauuuaa

SEQ ID NO: 2086116 - RNA, 16 nt, Staphylococcus aureus subsp. aureus MW2
ugauaauuaauuaaaa

SEQ ID NO: 2086117 - RNA, 18 nt, Staphylococcus aureus subsp. aureus MW2
ugauacauuauuaaauag

SEQ ID NO: 2086118 - RNA, 13 nt, Staphylococcus aureus subsp. aureus MW2
ugauacauuauua

SEQ ID NO: 2086119 - RNA, 16 nt, Staphylococcus aureus subsp. aureus MW2
ugauacauucuauuaa

SEQ ID NO: 2086120 - RNA, 19 nt, Staphylococcus aureus subsp. aureus MW2
ugauacgccuaaauauuua

SEQ ID NO: 2086121 - RNA, 15 nt, Staphylococcus aureus subsp. aureus MW2
ugauacgcuuuuuaa

SEQ ID NO: 2086122 - RNA, 16 nt, Staphylococcus aureus subsp. aureus MW2
ugauacgcuuuuuaaa

SEQ ID NO: 2086123 - RNA, 17 nt, Staphylococcus aureus subsp. aureus MW2
ugauaccuuuaaaucua

SEQ ID NO: 2086124 - RNA, 18 nt, Staphylococcus aureus subsp. aureus MW2
ugauacgugguuuuauuu

SEQ ID NO: 2086125 - RNA, 14 nt, Staphylococcus aureus subsp. aureus MW2
ugagcaucuugucu

SEQ ID NO: 2086126 - RNA, 16 nt, Staphylococcus aureus subsp. aureus MW2
ugagcaucuugucuag

SEQ ID NO: 2086127 - RNA, 16 nt, Staphylococcus aureus subsp. aureus MW2
ugagucaauuucuuua

SEQ ID NO: 2086128 - RNA, 19 nt, Staphylococcus aureus subsp. aureus MW2
ugagucauucaaucaucaa

SEQ ID NO: 2086129 - RNA, 21 nt, Staphylococcus aureus subsp. aureus MW2
ugagucuuggacauuguaaaa

SEQ ID NO: 2086130 - RNA, 22 nt, Staphylococcus aureus subsp. aureus MW2
ugagucuuggacauuguaaaau

SEQ ID NO: 2086131 - RNA, 15 nt, Staphylococcus aureus subsp. aureus MW2
ugaguugaaaauaau

SEQ ID NO: 2086132 - RNA, 14 nt, Staphylococcus aureus subsp. aureus MW2
ugaguuggcaucag

SEQ ID NO: 2086133 - RNA, 23 nt, Staphylococcus aureus subsp. aureus MW2
ugaguuggcaucagacuaaaaug

SEQ ID NO: 2086134 - RNA, 12 nt, Staphylococcus aureus subsp. aureus MW2
ugaguuuaaaaa

SEQ ID NO: 2086135 - RNA, 14 nt, Staphylococcus aureus subsp. aureus MW2
ugaguuuaaaaaua

SEQ ID NO: 2086136 - RNA, 14 nt, Staphylococcus aureus subsp. aureus MW2
ugaguuuuuuaaaa

SEQ ID NO: 2086137 - RNA, 14 nt, Staphylococcus aureus subsp. aureus MW2
ugauaaaaaaugaa

SEQ ID NO: 2086138 - RNA, 22 nt, Staphylococcus aureus subsp. aureus MW2
ugaucaaaaauguuaucuagua

SEQ ID NO: 2086139 - RNA, 16 nt, Staphylococcus aureus subsp. aureus MW2
ugauauaaacuacuaa

SEQ ID NO: 2086140 - RNA, 14 nt, Staphylococcus aureus subsp. aureus MW2
ugaucaaaaauguu

SEQ ID NO: 2086141 - RNA, 15 nt, Staphylococcus aureus subsp. aureus MW2
ugauauuaggcuuaa

SEQ ID NO: 2086142 - RNA, 18 nt, Staphylococcus aureus subsp. aureus MW2
ugauauguuuccucuuua

SEQ ID NO: 2086143 - RNA, 18 nt, Staphylococcus aureus subsp. aureus MW2
ugauaugugaaaaagcua

SEQ ID NO: 2086144 - RNA, 14 nt, Staphylococcus aureus subsp. aureus MW2
ugauaugugaaaaa

SEQ ID NO: 2086145 - RNA, 17 nt, Staphylococcus aureus subsp. aureus MW2
ugauagcuaaugcauua

SEQ ID NO: 2086146 - RNA, 15 nt, Staphylococcus aureus subsp. aureus MW2
ugauagcuaaugcau

SEQ ID NO: 2086147 - RNA, 22 nt, Staphylococcus aureus subsp. aureus MW2
ugauaguagcuuaaugcaucua

SEQ ID NO: 2086148 - RNA, 23 nt, Staphylococcus aureus subsp. aureus MW2
ugauauaaaaagugaaaguauua

SEQ ID NO: 2086149 - RNA, 17 nt, Staphylococcus aureus subsp. aureus MW2
ugauauaaaaagugaaa

SEQ ID NO: 2086150 - RNA, 12 nt, Staphylococcus aureus subsp. aureus MW2
ugauauaaaaag

SEQ ID NO: 2086151 - RNA, 17 nt, Staphylococcus aureus subsp. aureus MW2
ugauaguuucuaaucuu

SEQ ID NO: 2086152 - RNA, 20 nt, Staphylococcus aureus subsp. aureus MW2
ugauaguguaugaauggcaa

SEQ ID NO: 2086153 - RNA, 22 nt, Staphylococcus aureus subsp. aureus MW2
ugauagugguagccaauaucau

SEQ ID NO: 2086154 - RNA, 14 nt, Staphylococcus aureus subsp. aureus MW2
ugauacucaauaaa

SEQ ID NO: 2086155 - RNA, 23 nt, Staphylococcus aureus subsp. aureus MW2
ugauagagagcauaguuuucaua

SEQ ID NO: 2086156 - RNA, 15 nt, Staphylococcus aureus subsp. aureus MW2
ugauagaugauacau

SEQ ID NO: 2086157 - RNA, 14 nt, Staphylococcus aureus subsp. aureus MW2
ugauagauucaaaa

SEQ ID NO: 2086158 - RNA, 15 nt, Staphylococcus aureus subsp. aureus MW2
ugauagcguaaauga

SEQ ID NO: 2086159 - RNA, 19 nt, Staphylococcus aureus subsp. aureus MW2
ugauagcguaaaugauggc

SEQ ID NO: 2086160 - RNA, 22 nt, Staphylococcus aureus subsp. aureus MW2
ugaugagaugaggcgauaaaag

SEQ ID NO: 2086161 - RNA, 14 nt, Staphylococcus aureus subsp. aureus MW2
ugaugaaagacuga

SEQ ID NO: 2086162 - RNA, 15 nt, Staphylococcus aureus subsp. aureus MW2
ugaucuuuaaauaua

SEQ ID NO: 2086163 - RNA, 24 nt, Staphylococcus aureus subsp. aureus MW2
ugaucuuuuuuauauucaacuuau

SEQ ID NO: 2086164 - RNA, 19 nt, Staphylococcus aureus subsp. aureus MW2
ugaugauacccgcgauacu

SEQ ID NO: 2086165 - RNA, 15 nt, Staphylococcus aureus subsp. aureus MW2
ugaugauauucauau

SEQ ID NO: 2086166 - RNA, 14 nt, Staphylococcus aureus subsp. aureus MW2
ugaucauaauucag

SEQ ID NO: 2086167 - RNA, 23 nt, Staphylococcus aureus subsp. aureus MW2
ugaucuaaaaccauagagcauuu

SEQ ID NO: 2086168 - RNA, 12 nt, Staphylococcus aureus subsp. aureus MW2
ugcaaaaauaau

SEQ ID NO: 2086169 - RNA, 15 nt, Staphylococcus aureus subsp. aureus MW2
ugcaaacacaguaca

SEQ ID NO: 2086170 - RNA, 15 nt, Staphylococcus aureus subsp. aureus MW2
ugcaaaauguuacac

SEQ ID NO: 2086171 - RNA, 12 nt, Staphylococcus aureus subsp. aureus MW2
ugcaaaaucaac

SEQ ID NO: 2086172 - RNA, 16 nt, Staphylococcus aureus subsp. aureus MW2
ugcaaaugccucuuuu

SEQ ID NO: 2086173 - RNA, 14 nt, Staphylococcus aureus subsp. aureus MW2
ugcaaaugccucuu

SEQ ID NO: 2086174 - RNA, 20 nt, Staphylococcus aureus subsp. aureus MW2
ugcaaauacgaguguuuuaa

SEQ ID NO: 2086175 - RNA, 21 nt, Staphylococcus aureus subsp. aureus MW2
ugcaaauagcgauuuuaaaga

SEQ ID NO: 2086176 - RNA, 19 nt, Staphylococcus aureus subsp. aureus MW2
ugcaaauauaucaucucua

SEQ ID NO: 2086177 - RNA, 15 nt, Staphylococcus aureus subsp. aureus MW2
ugauuuuuaaaaaua

SEQ ID NO: 2086178 - RNA, 12 nt, Staphylococcus aureus subsp. aureus MW2
ugauuuugcuuu

SEQ ID NO: 2086179 - RNA, 14 nt, Staphylococcus aureus subsp. aureus MW2
ugauuuugaauaua

SEQ ID NO: 2086180 - RNA, 20 nt, Staphylococcus aureus subsp. aureus MW2
ugauuuucuuucauaaauug

SEQ ID NO: 2086181 - RNA, 16 nt, Staphylococcus aureus subsp. aureus MW2
ugauuuucuaaagcuu

SEQ ID NO: 2086182 - RNA, 17 nt, Staphylococcus aureus subsp. aureus MW2
ugauuuagcauacauua

SEQ ID NO: 2086183 - RNA, 14 nt, Staphylococcus aureus subsp. aureus MW2
ugauuuacgugcau

SEQ ID NO: 2086184 - RNA, 21 nt, Staphylococcus aureus subsp. aureus MW2
ugauuuacgugcauuguaaua

SEQ ID NO: 2086185 - RNA, 17 nt, Staphylococcus aureus subsp. aureus MW2
ugauuuaauuuuuaaug

SEQ ID NO: 2086186 - RNA, 16 nt, Staphylococcus aureus subsp. aureus MW2
ugauuguaauaucuaa

SEQ ID NO: 2086187 - RNA, 22 nt, Staphylococcus aureus subsp. aureus MW2
ugauugcugcuguacaauuucg

SEQ ID NO: 2086188 - RNA, 17 nt, Staphylococcus aureus subsp. aureus MW2
ugauugcaaauuaucau

SEQ ID NO: 2086189 - RNA, 14 nt, Staphylococcus aureus subsp. aureus MW2
ugauugauaugguu

SEQ ID NO: 2086190 - RNA, 12 nt, Staphylococcus aureus subsp. aureus MW2
ugauugaacaau

SEQ ID NO: 2086191 - RNA, 18 nt, Staphylococcus aureus subsp. aureus MW2
ugauugaacaauaauaug

SEQ ID NO: 2086192 - RNA, 22 nt, Staphylococcus aureus subsp. aureus MW2
ugauugaaugaagcuaguugaa

SEQ ID NO: 2086193 - RNA, 16 nt, Staphylococcus aureus subsp. aureus MW2
ugauuauauuuuucuu

SEQ ID NO: 2086194 - RNA, 23 nt, Staphylococcus aureus subsp. aureus MW2
ugauuccaaguauuuucucuaua

SEQ ID NO: 2086195 - RNA, 18 nt, Staphylococcus aureus subsp. aureus MW2
ugauuacauucuauacuu

SEQ ID NO: 2086196 - RNA, 13 nt, Staphylococcus aureus subsp. aureus MW2
ugauuacaacuua

SEQ ID NO: 2086197 - RNA, 17 nt, Staphylococcus aureus subsp. aureus MW2
ugauuaauuauugagaa

SEQ ID NO: 2086198 - RNA, 17 nt, Staphylococcus aureus subsp. aureus MW2
ugauuaauccuauacgu

SEQ ID NO: 2086199 - RNA, 23 nt, Staphylococcus aureus subsp. aureus MW2
ugauuaguuucugacuuuuaaaa

SEQ ID NO: 2086200 - RNA, 22 nt, Staphylococcus aureus subsp. aureus MW2
ugauuacguugguuuaaaaauu

SEQ ID NO: 2086201 - RNA, 16 nt, Staphylococcus aureus subsp. aureus MW2
ugaugcgaaaccuuuc

SEQ ID NO: 2086202 - RNA, 20 nt, Staphylococcus aureus subsp. aureus MW2
ugauuaaaauccgcuuuauu

SEQ ID NO: 2086203 - RNA, 18 nt, Staphylococcus aureus subsp. aureus MW2
ugcaccuaacgcuaauga

SEQ ID NO: 2086204 - RNA, 23 nt, Staphylococcus aureus subsp. aureus MW2
ugcacuaauggcacuuaauauaa

SEQ ID NO: 2086205 - RNA, 17 nt, Staphylococcus aureus subsp. aureus MW2
ugcaauuucauaguguu

SEQ ID NO: 2086206 - RNA, 16 nt, Staphylococcus aureus subsp. aureus MW2
ugcaacuuauaauauu

SEQ ID NO: 2086207 - RNA, 14 nt, Staphylococcus aureus subsp. aureus MW2
ugcaacuuauaaua

SEQ ID NO: 2086208 - RNA, 22 nt, Staphylococcus aureus subsp. aureus MW2
ugcaacuaaguugacuauauaa

SEQ ID NO: 2086209 - RNA, 16 nt, Staphylococcus aureus subsp. aureus MW2
ugcaauagcuauaacu

SEQ ID NO: 2086210 - RNA, 17 nt, Staphylococcus aureus subsp. aureus MW2
ugcaauaggaugaaacu

SEQ ID NO: 2086211 - RNA, 15 nt, Staphylococcus aureus subsp. aureus MW2
ugcaauauguaacaa

SEQ ID NO: 2086212 - RNA, 13 nt, Staphylococcus aureus subsp. aureus MW2
ugcaauauuauau

SEQ ID NO: 2086213 - RNA, 14 nt, Staphylococcus aureus subsp. aureus MW2
ugcaacauuuugag

SEQ ID NO: 2086214 - RNA, 19 nt, Staphylococcus aureus subsp. aureus MW2
ugcaacgucccaacaacau

SEQ ID NO: 2086215 - RNA, 20 nt, Staphylococcus aureus subsp. aureus MW2
ugcaacgucccaacaacaua

SEQ ID NO: 2086216 - RNA, 14 nt, Staphylococcus aureus subsp. aureus MW2
ugcaacaauuugca

SEQ ID NO: 2086217 - RNA, 22 nt, Staphylococcus aureus subsp. aureus MW2
ugcaacagaaccgaaaauaauc

SEQ ID NO: 2086218 - RNA, 15 nt, Staphylococcus aureus subsp. aureus MW2
ugacguaauuaauag

SEQ ID NO: 2086219 - RNA, 19 nt, Staphylococcus aureus subsp. aureus MW2
ugacguucugaucggcuuu

SEQ ID NO: 2086220 - RNA, 17 nt, Staphylococcus aureus subsp. aureus MW2
ugacugagaaaaauauu

SEQ ID NO: 2086221 - RNA, 17 nt, Staphylococcus aureus subsp. aureus MW2
ugacuuacauuuuaaua

SEQ ID NO: 2086222 - RNA, 13 nt, Staphylococcus aureus subsp. aureus MW2
ugacuuaacaucu

SEQ ID NO: 2086223 - RNA, 14 nt, Staphylococcus aureus subsp. aureus MW2
ugacuguuaaacaa

SEQ ID NO: 2086224 - RNA, 19 nt, Staphylococcus aureus subsp. aureus MW2
ugacuagggguuuuuaaua

SEQ ID NO: 2086225 - RNA, 19 nt, Staphylococcus aureus subsp. aureus MW2
ugacuagaggauagacaac

SEQ ID NO: 2086226 - RNA, 23 nt, Staphylococcus aureus subsp. aureus MW2
ugacuauguuguuuaaauuucaa

SEQ ID NO: 2086227 - RNA, 16 nt, Staphylococcus aureus subsp. aureus MW2
ugacuaugaaacugga

SEQ ID NO: 2086228 - RNA, 15 nt, Staphylococcus aureus subsp. aureus MW2
ugacuaauaaaacuu

SEQ ID NO: 2086229 - RNA, 19 nt, Staphylococcus aureus subsp. aureus MW2
ugacuaaguuuguuuucuu

SEQ ID NO: 2086230 - RNA, 14 nt, Staphylococcus aureus subsp. aureus MW2
ugagaaaguaaaag

SEQ ID NO: 2086231 - RNA, 16 nt, Staphylococcus aureus subsp. aureus MW2
ugagaaacuuuuucga

SEQ ID NO: 2086232 - RNA, 16 nt, Staphylococcus aureus subsp. aureus MW2
ugagaaaguaaaaguu

SEQ ID NO: 2086233 - RNA, 17 nt, Staphylococcus aureus subsp. aureus MW2
ugagaauugcaacgcau

SEQ ID NO: 2086234 - RNA, 15 nt, Staphylococcus aureus subsp. aureus MW2
ugagauaaaaucaua

SEQ ID NO: 2086235 - RNA, 16 nt, Staphylococcus aureus subsp. aureus MW2
ugagauaaaaucauau

SEQ ID NO: 2086236 - RNA, 16 nt, Staphylococcus aureus subsp. aureus MW2
ugagacuauuauaauu

SEQ ID NO: 2086237 - RNA, 14 nt, Staphylococcus aureus subsp. aureus MW2
ugagcaacaaaaga

SEQ ID NO: 2086238 - RNA, 14 nt, Staphylococcus aureus subsp. aureus MW2
ugacccuugucagu

SEQ ID NO: 2086239 - RNA, 15 nt, Staphylococcus aureus subsp. aureus MW2
ugaccgacaaagcuu

SEQ ID NO: 2086240 - RNA, 17 nt, Staphylococcus aureus subsp. aureus MW2
ugaccgacaaagcuugu

SEQ ID NO: 2086241 - RNA, 23 nt, Staphylococcus aureus subsp. aureus MW2
ugacauucaucacaaauaaggaa

SEQ ID NO: 2086242 - RNA, 15 nt, Staphylococcus aureus subsp. aureus MW2
ugacauggaaaauau

SEQ ID NO: 2086243 - RNA, 23 nt, Staphylococcus aureus subsp. aureus MW2
ugacauggaaaauauauuauaaa

SEQ ID NO: 2086244 - RNA, 21 nt, Staphylococcus aureus subsp. aureus MW2
ugacauuuucaaguuuaaaau

SEQ ID NO: 2086245 - RNA, 16 nt, Staphylococcus aureus subsp. aureus MW2
ugacauuuuaaaucua

SEQ ID NO: 2086246 - RNA, 18 nt, Staphylococcus aureus subsp. aureus MW2
ugacauuugaccaaguau

SEQ ID NO: 2086247 - RNA, 19 nt, Staphylococcus aureus subsp. aureus MW2
ugacacaaugauucaucag

SEQ ID NO: 2086248 - RNA, 21 nt, Staphylococcus aureus subsp. aureus MW2
ugacacaaugauucaucagug

SEQ ID NO: 2086249 - RNA, 15 nt, Staphylococcus aureus subsp. aureus MW2
ugacaucuauuucuu

SEQ ID NO: 2086250 - RNA, 15 nt, Staphylococcus aureus subsp. aureus MW2
ugacgaaaagucagc

SEQ ID NO: 2086251 - RNA, 16 nt, Staphylococcus aureus subsp. aureus MW2
ugacgaaaagucagcu

SEQ ID NO: 2086252 - RNA, 18 nt, Staphylococcus aureus subsp. aureus MW2
ugacgaaaagucagcuua

SEQ ID NO: 2086253 - RNA, 20 nt, Staphylococcus aureus subsp. aureus MW2
ugacgaaaagucagcuuaca

SEQ ID NO: 2086254 - RNA, 13 nt, Staphylococcus aureus subsp. aureus MW2
ugaccuuauauuu

SEQ ID NO: 2086255 - RNA, 20 nt, Staphylococcus aureus subsp. aureus MW2
ugacgcggguaauauuuuug

SEQ ID NO: 2086256 - RNA, 18 nt, Staphylococcus aureus subsp. aureus MW2
ugacgcgugaauuaaaaa

SEQ ID NO: 2086257 - RNA, 13 nt, Staphylococcus aureus subsp. aureus MW2
ugaacuaaauuga

SEQ ID NO: 2086258 - RNA, 19 nt, Staphylococcus aureus subsp. aureus MW2
ugaacuaaaacaauaauaa

SEQ ID NO: 2086259 - RNA, 12 nt, Staphylococcus aureus subsp. aureus MW2
ugaacguuuauu

SEQ ID NO: 2086260 - RNA, 15 nt, Staphylococcus aureus subsp. aureus MW2
ugaacuucucuuagu

SEQ ID NO: 2086261 - RNA, 19 nt, Staphylococcus aureus subsp. aureus MW2
ugaagaaggaugaguuuaa

SEQ ID NO: 2086262 - RNA, 21 nt, Staphylococcus aureus subsp. aureus MW2
ugaagaauguuucauaugcau

SEQ ID NO: 2086263 - RNA, 19 nt, Staphylococcus aureus subsp. aureus MW2
ugaagaauauaaacuauua

SEQ ID NO: 2086264 - RNA, 15 nt, Staphylococcus aureus subsp. aureus MW2
ugaagagaaaauuug

SEQ ID NO: 2086265 - RNA, 18 nt, Staphylococcus aureus subsp. aureus MW2
ugaagagcuuuuaguaaa

SEQ ID NO: 2086266 - RNA, 23 nt, Staphylococcus aureus subsp. aureus MW2
ugaagagcuuuuaguaaauaauu

SEQ ID NO: 2086267 - RNA, 19 nt, Staphylococcus aureus subsp. aureus MW2
ugaagcuagagaaauauag

SEQ ID NO: 2086268 - RNA, 24 nt, Staphylococcus aureus subsp. aureus MW2
ugaaggccauuuuuauuuaacacu

SEQ ID NO: 2086269 - RNA, 17 nt, Staphylococcus aureus subsp. aureus MW2
ugaaggccauuuuuauu

SEQ ID NO: 2086270 - RNA, 15 nt, Staphylococcus aureus subsp. aureus MW2
ugaagguaauuuaac

SEQ ID NO: 2086271 - RNA, 17 nt, Staphylococcus aureus subsp. aureus MW2
ugaaguaauauauaaaa

SEQ ID NO: 2086272 - RNA, 21 nt, Staphylococcus aureus subsp. aureus MW2
ugaagcauuaaguucaucaug

SEQ ID NO: 2086273 - RNA, 19 nt, Staphylococcus aureus subsp. aureus MW2
ugaagaugcuuuaauuaaa

SEQ ID NO: 2086274 - RNA, 17 nt, Staphylococcus aureus subsp. aureus MW2
ugaauggagcaugauua

SEQ ID NO: 2086275 - RNA, 15 nt, Staphylococcus aureus subsp. aureus MW2
ugaauggcauuuaau

SEQ ID NO: 2086276 - RNA, 19 nt, Staphylococcus aureus subsp. aureus MW2
ugaauggcauuuaauacua

SEQ ID NO: 2086277 - RNA, 12 nt, Staphylococcus aureus subsp. aureus MW2
ugaauggcucgu

SEQ ID NO: 2086278 - RNA, 20 nt, Staphylococcus aureus subsp. aureus MW2
ugaaucgaguuugaaauaau

SEQ ID NO: 2086279 - RNA, 22 nt, Staphylococcus aureus subsp. aureus MW2
ugaaucgaagcccuuugauuua

SEQ ID NO: 2086280 - RNA, 23 nt, Staphylococcus aureus subsp. aureus MW2
ugaaucaacaguuuuauuaucuu

SEQ ID NO: 2086281 - RNA, 16 nt, Staphylococcus aureus subsp. aureus MW2
ugaaucagaugauuua

SEQ ID NO: 2086282 - RNA, 14 nt, Staphylococcus aureus subsp. aureus MW2
ugaaucaguauaau

SEQ ID NO: 2086283 - RNA, 16 nt, Staphylococcus aureus subsp. aureus MW2
ugaaucccauaaugac

SEQ ID NO: 2086284 - RNA, 15 nt, Staphylococcus aureus subsp. aureus MW2
ugaauuuuauaaauu

SEQ ID NO: 2086285 - RNA, 21 nt, Staphylococcus aureus subsp. aureus MW2
ugaauuuuauaaauuaaaugc

SEQ ID NO: 2086286 - RNA, 18 nt, Staphylococcus aureus subsp. aureus MW2
ugaauuuucguucaauuu

SEQ ID NO: 2086287 - RNA, 21 nt, Staphylococcus aureus subsp. aureus MW2
ugaauuuuaauauauuuggag

SEQ ID NO: 2086288 - RNA, 17 nt, Staphylococcus aureus subsp. aureus MW2
ugaauuaaagcaucgaa

SEQ ID NO: 2086289 - RNA, 20 nt, Staphylococcus aureus subsp. aureus MW2
ugaauguuuucuaaaucuaa

SEQ ID NO: 2086290 - RNA, 12 nt, Staphylococcus aureus subsp. aureus MW2
ugaauuaacaau

SEQ ID NO: 2086291 - RNA, 17 nt, Staphylococcus aureus subsp. aureus MW2
ugaauguuccucuauau

SEQ ID NO: 2086292 - RNA, 22 nt, Staphylococcus aureus subsp. aureus MW2
ugaauguuaagacauaugcagu

SEQ ID NO: 2086293 - RNA, 13 nt, Staphylococcus aureus subsp. aureus MW2
ugaauuaauagcu

SEQ ID NO: 2086294 - RNA, 14 nt, Staphylococcus aureus subsp. aureus MW2
ugaauuaagaaaag

SEQ ID NO: 2086295 - RNA, 18 nt, Staphylococcus aureus subsp. aureus MW2
ugaauuaagaaaaguuac

SEQ ID NO: 2086296 - RNA, 13 nt, Staphylococcus aureus subsp. aureus MW2
ugaaguuguuucu

SEQ ID NO: 2086297 - RNA, 22 nt, Staphylococcus aureus subsp. aureus MW2
ugaaguuuaaucguauuagcca

SEQ ID NO: 2086298 - RNA, 20 nt, Staphylococcus aureus subsp. aureus MW2
ugaaguuugaacaacaucuu

SEQ ID NO: 2086299 - RNA, 14 nt, Staphylococcus aureus subsp. aureus MW2
ugaauaaaauauau

SEQ ID NO: 2086300 - RNA, 14 nt, Staphylococcus aureus subsp. aureus MW2
ugaaguuguauaaa

SEQ ID NO: 2086301 - RNA, 21 nt, Staphylococcus aureus subsp. aureus MW2
ugaaguuguauaaaaauguau

SEQ ID NO: 2086302 - RNA, 14 nt, Staphylococcus aureus subsp. aureus MW2
ugaaguuacuauau

SEQ ID NO: 2086303 - RNA, 21 nt, Staphylococcus aureus subsp. aureus MW2
ugaaguaaugugcauugcuuu

SEQ ID NO: 2086304 - RNA, 22 nt, Staphylococcus aureus subsp. aureus MW2
ugaaguaggcugaaguugaagc

SEQ ID NO: 2086305 - RNA, 23 nt, Staphylococcus aureus subsp. aureus MW2
ugaagucuguuuagaagaaacuu

SEQ ID NO: 2086306 - RNA, 17 nt, Staphylococcus aureus subsp. aureus MW2
ugaagucuuucaacaaa

SEQ ID NO: 2086307 - RNA, 19 nt, Staphylococcus aureus subsp. aureus MW2
ugaagucuuucaacaaaau

SEQ ID NO: 2086308 - RNA, 20 nt, Staphylococcus aureus subsp. aureus MW2
ugaagucuuucaacaaaaug

SEQ ID NO: 2086309 - RNA, 17 nt, Staphylococcus aureus subsp. aureus MW2
ugaauacuuuauuugau

SEQ ID NO: 2086310 - RNA, 14 nt, Staphylococcus aureus subsp. aureus MW2
ugaauacuucuuua

SEQ ID NO: 2086311 - RNA, 14 nt, Staphylococcus aureus subsp. aureus MW2
ugaauaauauauuu

SEQ ID NO: 2086312 - RNA, 14 nt, Staphylococcus aureus subsp. aureus MW2
ugaauaauaaacuu

SEQ ID NO: 2086313 - RNA, 21 nt, Staphylococcus aureus subsp. aureus MW2
ugaauaauaaacuuaaaagag

SEQ ID NO: 2086314 - RNA, 15 nt, Staphylococcus aureus subsp. aureus MW2
ugaauaaauaacuuc

SEQ ID NO: 2086315 - RNA, 13 nt, Staphylococcus aureus subsp. aureus MW2
ugaauaaauaacu

SEQ ID NO: 2086316 - RNA, 21 nt, Staphylococcus aureus subsp. aureus MW2
ugaauaaauacaauguuauua

SEQ ID NO: 2086317 - RNA, 15 nt, Staphylococcus aureus subsp. aureus MW2
ugaauauuuuucaau

SEQ ID NO: 2086318 - RNA, 13 nt, Staphylococcus aureus subsp. aureus MW2
ugaauauaaaaaa

SEQ ID NO: 2086319 - RNA, 19 nt, Staphylococcus aureus subsp. aureus MW2
ugcugauaccuaagcugau

SEQ ID NO: 2086320 - RNA, 22 nt, Staphylococcus aureus subsp. aureus MW2
ugcugccaucaggcuuuauugu

SEQ ID NO: 2086321 - RNA, 23 nt, Staphylococcus aureus subsp. aureus MW2
ugcucuuuuucccaugcuucuau

SEQ ID NO: 2086322 - RNA, 17 nt, Staphylococcus aureus subsp. aureus MW2
ugcucuuuauauauaaa

SEQ ID NO: 2086323 - RNA, 16 nt, Staphylococcus aureus subsp. aureus MW2
ugcguugguauucauc

SEQ ID NO: 2086324 - RNA, 19 nt, Staphylococcus aureus subsp. aureus MW2
ugcguugguauucaucuuc

SEQ ID NO: 2086325 - RNA, 17 nt, Staphylococcus aureus subsp. aureus MW2
ugcucaucuacuuaaaa

SEQ ID NO: 2086326 - RNA, 23 nt, Staphylococcus aureus subsp. aureus MW2
ugcugccggugcagauaauugaa

SEQ ID NO: 2086327 - RNA, 14 nt, Staphylococcus aureus subsp. aureus MW2
ugcuggcuuaguaa

SEQ ID NO: 2086328 - RNA, 20 nt, Staphylococcus aureus subsp. aureus MW2
ugcuggcuuaguaaguugua

SEQ ID NO: 2086329 - RNA, 15 nt, Staphylococcus aureus subsp. aureus MW2
ugcugcuuuuccauu

SEQ ID NO: 2086330 - RNA, 19 nt, Staphylococcus aureus subsp. aureus MW2
ugcuguauauauauguaaa

SEQ ID NO: 2086331 - RNA, 13 nt, Staphylococcus aureus subsp. aureus MW2
ugcuguucuuuuu

SEQ ID NO: 2086332 - RNA, 16 nt, Staphylococcus aureus subsp. aureus MW2
ugcuguucuuuuuauu

SEQ ID NO: 2086333 - RNA, 14 nt, Staphylococcus aureus subsp. aureus MW2
ugcuguuacuucuc

SEQ ID NO: 2086334 - RNA, 13 nt, Staphylococcus aureus subsp. aureus MW2
ugcuucacuaaaa

SEQ ID NO: 2086335 - RNA, 14 nt, Staphylococcus aureus subsp. aureus MW2
ugcuucuuuccucu

SEQ ID NO: 2086336 - RNA, 15 nt, Staphylococcus aureus subsp. aureus MW2
ugcuucuuuuaagua

SEQ ID NO: 2086337 - RNA, 21 nt, Staphylococcus aureus subsp. aureus MW2
ugcuucaacuucaucuaaaug

SEQ ID NO: 2086338 - RNA, 22 nt, Staphylococcus aureus subsp. aureus MW2
ugcuucaaauguaacauuaaaa

SEQ ID NO: 2086339 - RNA, 19 nt, Staphylococcus aureus subsp. aureus MW2
ugcuuaguacacguguauu

SEQ ID NO: 2086340 - RNA, 15 nt, Staphylococcus aureus subsp. aureus MW2
ugcuuaucaacagcu

SEQ ID NO: 2086341 - RNA, 18 nt, Staphylococcus aureus subsp. aureus MW2
ugcuuaguacacguguau

SEQ ID NO: 2086342 - RNA, 14 nt, Staphylococcus aureus subsp. aureus MW2
ugcuuaguacacgu

SEQ ID NO: 2086343 - RNA, 19 nt, Staphylococcus aureus subsp. aureus MW2
ugcuuauuuuuguauucuu

SEQ ID NO: 2086344 - RNA, 14 nt, Staphylococcus aureus subsp. aureus MW2
ugcuuauuaaaauu

SEQ ID NO: 2086345 - RNA, 21 nt, Staphylococcus aureus subsp. aureus MW2
ugcuuaugaaugaaaucagca

SEQ ID NO: 2086346 - RNA, 17 nt, Staphylococcus aureus subsp. aureus MW2
ugcuuuuauuuuuaaug

SEQ ID NO: 2086347 - RNA, 15 nt, Staphylococcus aureus subsp. aureus MW2
ugcuuuuauagauuu

SEQ ID NO: 2086348 - RNA, 20 nt, Staphylococcus aureus subsp. aureus MW2
ugcuuuaauauaauuauuaa

SEQ ID NO: 2086349 - RNA, 13 nt, Staphylococcus aureus subsp. aureus MW2
ugcuuuaauauaa

SEQ ID NO: 2086350 - RNA, 17 nt, Staphylococcus aureus subsp. aureus MW2
ugcuuuagcucuuuuuu

SEQ ID NO: 2086351 - RNA, 22 nt, Staphylococcus aureus subsp. aureus MW2
ugcuuuagagauuguaagaauu

SEQ ID NO: 2086352 - RNA, 17 nt, Staphylococcus aureus subsp. aureus MW2
ugcuuuacuauauucaa

SEQ ID NO: 2086353 - RNA, 19 nt, Staphylococcus aureus subsp. aureus MW2
ugcuuuaucgaauucuucu

SEQ ID NO: 2086354 - RNA, 19 nt, Staphylococcus aureus subsp. aureus MW2
ugcuugauaagaagugcuu

SEQ ID NO: 2086355 - RNA, 14 nt, Staphylococcus aureus subsp. aureus MW2
ugcuuuaaauauug

SEQ ID NO: 2086356 - RNA, 14 nt, Staphylococcus aureus subsp. aureus MW2
ugcgccuucuuuuu

SEQ ID NO: 2086357 - RNA, 17 nt, Staphylococcus aureus subsp. aureus MW2
ugcgguuuaaucuauau

SEQ ID NO: 2086358 - RNA, 19 nt, Staphylococcus aureus subsp. aureus MW2
ugcguaagguauuucauug

SEQ ID NO: 2086359 - RNA, 15 nt, Staphylococcus aureus subsp. aureus MW2
ugcgugaauguuacu

SEQ ID NO: 2086360 - RNA, 16 nt, Staphylococcus aureus subsp. aureus MW2
ugcggucuaaaugcuc

SEQ ID NO: 2086361 - RNA, 15 nt, Staphylococcus aureus subsp. aureus MW2
ugcaucccgaaaguu

SEQ ID NO: 2086362 - RNA, 23 nt, Staphylococcus aureus subsp. aureus MW2
ugcauuacuacuuuauaaauauc

SEQ ID NO: 2086363 - RNA, 20 nt, Staphylococcus aureus subsp. aureus MW2
ugcauuacuaucuucaucau

SEQ ID NO: 2086364 - RNA, 12 nt, Staphylococcus aureus subsp. aureus MW2
ugcauuauuaua

SEQ ID NO: 2086365 - RNA, 15 nt, Staphylococcus aureus subsp. aureus MW2
ugcauguuuaaauau

SEQ ID NO: 2086366 - RNA, 19 nt, Staphylococcus aureus subsp. aureus MW2
ugcaugucuuaaauucuua

SEQ ID NO: 2086367 - RNA, 13 nt, Staphylococcus aureus subsp. aureus MW2
ugcaugugaaauu

SEQ ID NO: 2086368 - RNA, 15 nt, Staphylococcus aureus subsp. aureus MW2
ugcauguacaucuuu

SEQ ID NO: 2086369 - RNA, 24 nt, Staphylococcus aureus subsp. aureus MW2
ugcauguccugaauguucgaagau

SEQ ID NO: 2086370 - RNA, 13 nt, Staphylococcus aureus subsp. aureus MW2
ugcaugacagcaa

SEQ ID NO: 2086371 - RNA, 19 nt, Staphylococcus aureus subsp. aureus MW2
ugcaugagacuuauucaac

SEQ ID NO: 2086372 - RNA, 14 nt, Staphylococcus aureus subsp. aureus MW2
ugcaucuuuugguu

SEQ ID NO: 2086373 - RNA, 22 nt, Staphylococcus aureus subsp. aureus MW2
ugcaugaaaauuaaaaaaugcu

SEQ ID NO: 2086374 - RNA, 20 nt, Staphylococcus aureus subsp. aureus MW2
ugcaugaugaacuuaaugcu

SEQ ID NO: 2086375 - RNA, 19 nt, Staphylococcus aureus subsp. aureus MW2
ugcaugcgcaaaagcgcag

SEQ ID NO: 2086376 - RNA, 15 nt, Staphylococcus aureus subsp. aureus MW2
ugcaguuaaauuaaa

SEQ ID NO: 2086377 - RNA, 23 nt, Staphylococcus aureus subsp. aureus MW2
ugcagugacuagaggauagacaa

SEQ ID NO: 2086378 - RNA, 16 nt, Staphylococcus aureus subsp. aureus MW2
ugcacugcuaauauua

SEQ ID NO: 2086379 - RNA, 20 nt, Staphylococcus aureus subsp. aureus MW2
ugcauaaccaaguaauucuu

SEQ ID NO: 2086380 - RNA, 19 nt, Staphylococcus aureus subsp. aureus MW2
ugcauaauauauuaaaaau

SEQ ID NO: 2086381 - RNA, 14 nt, Staphylococcus aureus subsp. aureus MW2
ugcauaaucaauuu

SEQ ID NO: 2086382 - RNA, 17 nt, Staphylococcus aureus subsp. aureus MW2
ugcauacgaauuaaaau

SEQ ID NO: 2086383 - RNA, 19 nt, Staphylococcus aureus subsp. aureus MW2
ugcauacgaauuaaaauaa

SEQ ID NO: 2086384 - RNA, 15 nt, Staphylococcus aureus subsp. aureus MW2
ugcauagcuaaauaa

SEQ ID NO: 2086385 - RNA, 23 nt, Staphylococcus aureus subsp. aureus MW2
ugcauagguaaccuuaaauauag

SEQ ID NO: 2086386 - RNA, 16 nt, Staphylococcus aureus subsp. aureus MW2
ugcauauaaagucaua

SEQ ID NO: 2086387 - RNA, 16 nt, Staphylococcus aureus subsp. aureus MW2
ugcauauauugaggau

SEQ ID NO: 2086388 - RNA, 23 nt, Staphylococcus aureus subsp. aureus MW2
ugcauauguaauacaaaagaggc

SEQ ID NO: 2086389 - RNA, 16 nt, Staphylococcus aureus subsp. aureus MW2
ugccaaaaaguauuca

SEQ ID NO: 2086390 - RNA, 13 nt, Staphylococcus aureus subsp. aureus MW2
ugccaaaaacauu

SEQ ID NO: 2086391 - RNA, 15 nt, Staphylococcus aureus subsp. aureus MW2
ugccaaaaacauuaa

SEQ ID NO: 2086392 - RNA, 21 nt, Staphylococcus aureus subsp. aureus MW2
ugcauuuagaugauucuuauc

SEQ ID NO: 2086393 - RNA, 22 nt, Staphylococcus aureus subsp. aureus MW2
ugcauuuagaugauucuuauca

SEQ ID NO: 2086394 - RNA, 17 nt, Staphylococcus aureus subsp. aureus MW2
ugcauugucuguagaaa

SEQ ID NO: 2086395 - RNA, 16 nt, Staphylococcus aureus subsp. aureus MW2
ugcauuuagaugauuc

SEQ ID NO: 2086396 - RNA, 19 nt, Staphylococcus aureus subsp. aureus MW2
ugcauuuagaugauucuua

SEQ ID NO: 2086397 - RNA, 23 nt, Staphylococcus aureus subsp. aureus MW2
ugcauugcacuugucucaaauua

SEQ ID NO: 2086398 - RNA, 17 nt, Staphylococcus aureus subsp. aureus MW2
ugcauugccuguagaau

SEQ ID NO: 2086399 - RNA, 17 nt, Staphylococcus aureus subsp. aureus MW2
ugccaauggaaguuuuu

SEQ ID NO: 2086400 - RNA, 15 nt, Staphylococcus aureus subsp. aureus MW2
ugccaauuaauucuu

SEQ ID NO: 2086401 - RNA, 14 nt, Staphylococcus aureus subsp. aureus MW2
ugccaucuuuguaa

SEQ ID NO: 2086402 - RNA, 18 nt, Staphylococcus aureus subsp. aureus MW2
ugccaucaggcuuuauug

SEQ ID NO: 2086403 - RNA, 16 nt, Staphylococcus aureus subsp. aureus MW2
ugcccugcuguuuuau

SEQ ID NO: 2086404 - RNA, 20 nt, Staphylococcus aureus subsp. aureus MW2
ugcccucauaaaucaugaaa

SEQ ID NO: 2086405 - RNA, 20 nt, Staphylococcus aureus subsp. aureus MW2
ugccauguuggcaauuguuu

SEQ ID NO: 2086406 - RNA, 13 nt, Staphylococcus aureus subsp. aureus MW2
ugccauucauuaa

SEQ ID NO: 2086407 - RNA, 19 nt, Staphylococcus aureus subsp. aureus MW2
ugccauuguuauccaaaac

SEQ ID NO: 2086408 - RNA, 15 nt, Staphylococcus aureus subsp. aureus MW2
ugcccucauaaauca

SEQ ID NO: 2086409 - RNA, 17 nt, Staphylococcus aureus subsp. aureus MW2
ugccguuauuuucaaua

SEQ ID NO: 2086410 - RNA, 23 nt, Staphylococcus aureus subsp. aureus MW2
ugccguuugaagucuguuuagaa

SEQ ID NO: 2086411 - RNA, 21 nt, Staphylococcus aureus subsp. aureus MW2
ugccuaauuuguaaccccauu

SEQ ID NO: 2086412 - RNA, 14 nt, Staphylococcus aureus subsp. aureus MW2
uuacauuaugaaca

SEQ ID NO: 2086413 - RNA, 21 nt, Staphylococcus aureus subsp. aureus MW2
uuacauucuauacuuuuaauu

SEQ ID NO: 2086414 - RNA, 12 nt, Staphylococcus aureus subsp. aureus MW2
uuacauuacaua

SEQ ID NO: 2086415 - RNA, 22 nt, Staphylococcus aureus subsp. aureus MW2
uuacauugccuaagaacuuaau

SEQ ID NO: 2086416 - RNA, 14 nt, Staphylococcus aureus subsp. aureus MW2
uuacauuuaacauu

SEQ ID NO: 2086417 - RNA, 21 nt, Staphylococcus aureus subsp. aureus MW2
uuacaugcaccuuuacaacau

SEQ ID NO: 2086418 - RNA, 22 nt, Staphylococcus aureus subsp. aureus MW2
uuacaucuuuaagcucuuaauc

SEQ ID NO: 2086419 - RNA, 22 nt, Staphylococcus aureus subsp. aureus MW2
uuacaucuauccuuguucaccc

SEQ ID NO: 2086420 - RNA, 16 nt, Staphylococcus aureus subsp. aureus MW2
uuacauuuuaugucca

SEQ ID NO: 2086421 - RNA, 17 nt, Staphylococcus aureus subsp. aureus MW2
uuacaucgacaauuuuc

SEQ ID NO: 2086422 - RNA, 18 nt, Staphylococcus aureus subsp. aureus MW2
uuacauauacgacauuuu

SEQ ID NO: 2086423 - RNA, 15 nt, Staphylococcus aureus subsp. aureus MW2
uuacauauugcauuu

SEQ ID NO: 2086424 - RNA, 14 nt, Staphylococcus aureus subsp. aureus MW2
uuaauuuaucauua

SEQ ID NO: 2086425 - RNA, 15 nt, Staphylococcus aureus subsp. aureus MW2
uuaauuucaacauua

SEQ ID NO: 2086426 - RNA, 19 nt, Staphylococcus aureus subsp. aureus MW2
uuacaaaaucaccuuuuuu

SEQ ID NO: 2086427 - RNA, 16 nt, Staphylococcus aureus subsp. aureus MW2
uuaauuucacuuuaac

SEQ ID NO: 2086428 - RNA, 17 nt, Staphylococcus aureus subsp. aureus MW2
uuaauugguuucacauu

SEQ ID NO: 2086429 - RNA, 22 nt, Staphylococcus aureus subsp. aureus MW2
uuaauuguugagaaacuuuuuc

SEQ ID NO: 2086430 - RNA, 15 nt, Staphylococcus aureus subsp. aureus MW2
uuaauuguuuaauaa

SEQ ID NO: 2086431 - RNA, 18 nt, Staphylococcus aureus subsp. aureus MW2
uuaauuuaaaucuguacu

SEQ ID NO: 2086432 - RNA, 12 nt, Staphylococcus aureus subsp. aureus MW2
uuaauuuaaaaa

SEQ ID NO: 2086433 - RNA, 17 nt, Staphylococcus aureus subsp. aureus MW2
uuacaaaucaugacaua

SEQ ID NO: 2086434 - RNA, 16 nt, Staphylococcus aureus subsp. aureus MW2
uuacaagaacaugaua

SEQ ID NO: 2086435 - RNA, 17 nt, Staphylococcus aureus subsp. aureus MW2
uuacaaguuguucaauu

SEQ ID NO: 2086436 - RNA, 18 nt, Staphylococcus aureus subsp. aureus MW2
uuacaccugcaacacuag

SEQ ID NO: 2086437 - RNA, 23 nt, Staphylococcus aureus subsp. aureus MW2
uuacacuaaaaccuauuccuaau

SEQ ID NO: 2086438 - RNA, 21 nt, Staphylococcus aureus subsp. aureus MW2
uuaauucaggauggaaugaua

SEQ ID NO: 2086439 - RNA, 14 nt, Staphylococcus aureus subsp. aureus MW2
uuaauuauuucccu

SEQ ID NO: 2086440 - RNA, 15 nt, Staphylococcus aureus subsp. aureus MW2
uuaauuauuucccug

SEQ ID NO: 2086441 - RNA, 15 nt, Staphylococcus aureus subsp. aureus MW2
uuaauuauuuagauu

SEQ ID NO: 2086442 - RNA, 21 nt, Staphylococcus aureus subsp. aureus MW2
uuaauuauguauuuuuauuua

SEQ ID NO: 2086443 - RNA, 18 nt, Staphylococcus aureus subsp. aureus MW2
uuaaugucacauguacca

SEQ ID NO: 2086444 - RNA, 21 nt, Staphylococcus aureus subsp. aureus MW2
uuaauguauucuucuaauucu

SEQ ID NO: 2086445 - RNA, 18 nt, Staphylococcus aureus subsp. aureus MW2
uuaauguacuuuucuguc

SEQ ID NO: 2086446 - RNA, 12 nt, Staphylococcus aureus subsp. aureus MW2
uuaauuaucauu

SEQ ID NO: 2086447 - RNA, 18 nt, Staphylococcus aureus subsp. aureus MW2
uuaaucuucaucuaaaaa

SEQ ID NO: 2086448 - RNA, 17 nt, Staphylococcus aureus subsp. aureus MW2
uuaauagagaaaaaaua

SEQ ID NO: 2086449 - RNA, 14 nt, Staphylococcus aureus subsp. aureus MW2
uuaaucuguaugua

SEQ ID NO: 2086450 - RNA, 21 nt, Staphylococcus aureus subsp. aureus MW2
uuaaugacuaugcaaaugaaa

SEQ ID NO: 2086451 - RNA, 20 nt, Staphylococcus aureus subsp. aureus MW2
uuaaugacuucuuuauauuu

SEQ ID NO: 2086452 - RNA, 14 nt, Staphylococcus aureus subsp. aureus MW2
uuaaugaaguaaga

SEQ ID NO: 2086453 - RNA, 16 nt, Staphylococcus aureus subsp. aureus MW2
uuaauagaaagugcgg

SEQ ID NO: 2086454 - RNA, 22 nt, Staphylococcus aureus subsp. aureus MW2
uuaauacuaccguuuuuauaua

SEQ ID NO: 2086455 - RNA, 18 nt, Staphylococcus aureus subsp. aureus MW2
uuaauacuaccguuuuua

SEQ ID NO: 2086456 - RNA, 22 nt, Staphylococcus aureus subsp. aureus MW2
uuaauacuaauaacucuucuaa

SEQ ID NO: 2086457 - RNA, 19 nt, Staphylococcus aureus subsp. aureus MW2
uuaauacuaauuuuguaca

SEQ ID NO: 2086458 - RNA, 21 nt, Staphylococcus aureus subsp. aureus MW2
uuaauacuaauuuuguacaua

SEQ ID NO: 2086459 - RNA, 16 nt, Staphylococcus aureus subsp. aureus MW2
uuaauacguuuaauaa

SEQ ID NO: 2086460 - RNA, 18 nt, Staphylococcus aureus subsp. aureus MW2
uuacuaggaauauaaaac

SEQ ID NO: 2086461 - RNA, 15 nt, Staphylococcus aureus subsp. aureus MW2
uuacuaccuauuaau

SEQ ID NO: 2086462 - RNA, 16 nt, Staphylococcus aureus subsp. aureus MW2
uuacuacucauuauua

SEQ ID NO: 2086463 - RNA, 18 nt, Staphylococcus aureus subsp. aureus MW2
uuacucauauugaauacu

SEQ ID NO: 2086464 - RNA, 19 nt, Staphylococcus aureus subsp. aureus MW2
uuacucuacacucaaacaa

SEQ ID NO: 2086465 - RNA, 16 nt, Staphylococcus aureus subsp. aureus MW2
uuacucuuuuuaauau

SEQ ID NO: 2086466 - RNA, 16 nt, Staphylococcus aureus subsp. aureus MW2
uuacuuucgcuugcaa

SEQ ID NO: 2086467 - RNA, 14 nt, Staphylococcus aureus subsp. aureus MW2
uuacuguaguacua

SEQ ID NO: 2086468 - RNA, 15 nt, Staphylococcus aureus subsp. aureus MW2
uuacuguaaauauga

SEQ ID NO: 2086469 - RNA, 14 nt, Staphylococcus aureus subsp. aureus MW2
uuacugucaucuuu

SEQ ID NO: 2086470 - RNA, 19 nt, Staphylococcus aureus subsp. aureus MW2
uuagaaaaguaaguaaaau

SEQ ID NO: 2086471 - RNA, 13 nt, Staphylococcus aureus subsp. aureus MW2
uuacuuuuuuaau

SEQ ID NO: 2086472 - RNA, 16 nt, Staphylococcus aureus subsp. aureus MW2
uuacuuuuuuaaugua

SEQ ID NO: 2086473 - RNA, 20 nt, Staphylococcus aureus subsp. aureus MW2
uuagaagaugauuauucucu

SEQ ID NO: 2086474 - RNA, 22 nt, Staphylococcus aureus subsp. aureus MW2
uuaccaugaugagauaaaauca

SEQ ID NO: 2086475 - RNA, 20 nt, Staphylococcus aureus subsp. aureus MW2
uuacccacaucuuuuuaaaa

SEQ ID NO: 2086476 - RNA, 14 nt, Staphylococcus aureus subsp. aureus MW2
uuacgauaaacuaa

SEQ ID NO: 2086477 - RNA, 18 nt, Staphylococcus aureus subsp. aureus MW2
uuacgaucauaaauauuu

SEQ ID NO: 2086478 - RNA, 21 nt, Staphylococcus aureus subsp. aureus MW2
uuacgaucauaaauauuuucu

SEQ ID NO: 2086479 - RNA, 18 nt, Staphylococcus aureus subsp. aureus MW2
uuacgauugggcaacuuu

SEQ ID NO: 2086480 - RNA, 14 nt, Staphylococcus aureus subsp. aureus MW2
uuacgcauccuaau

SEQ ID NO: 2086481 - RNA, 19 nt, Staphylococcus aureus subsp. aureus MW2
uuacguucuaauaauuuaa

SEQ ID NO: 2086482 - RNA, 20 nt, Staphylococcus aureus subsp. aureus MW2
uuacguaucuuuacaacagu

SEQ ID NO: 2086483 - RNA, 15 nt, Staphylococcus aureus subsp. aureus MW2
uuacgcuuacuuaua

SEQ ID NO: 2086484 - RNA, 21 nt, Staphylococcus aureus subsp. aureus MW2
uuaaacauccaauuauguuua

SEQ ID NO: 2086485 - RNA, 22 nt, Staphylococcus aureus subsp. aureus MW2
uuaaacauuuuuagaaucaaaa

SEQ ID NO: 2086486 - RNA, 18 nt, Staphylococcus aureus subsp. aureus MW2
uuaaaccguauagucauu

SEQ ID NO: 2086487 - RNA, 14 nt, Staphylococcus aureus subsp. aureus MW2
uuaaaccuaaugau

SEQ ID NO: 2086488 - RNA, 14 nt, Staphylococcus aureus subsp. aureus MW2
uuaaacgcaauuaa

SEQ ID NO: 2086489 - RNA, 22 nt, Staphylococcus aureus subsp. aureus MW2
uuaaacauaacaugaccuaaua

SEQ ID NO: 2086490 - RNA, 13 nt, Staphylococcus aureus subsp. aureus MW2
uuaaacauaacau

SEQ ID NO: 2086491 - RNA, 19 nt, Staphylococcus aureus subsp. aureus MW2
uuaaacaugaacaaucaga

SEQ ID NO: 2086492 - RNA, 19 nt, Staphylococcus aureus subsp. aureus MW2
uuaaacaagcaucaugaaa

SEQ ID NO: 2086493 - RNA, 19 nt, Staphylococcus aureus subsp. aureus MW2
uuaaacaagccuuaaaaua

SEQ ID NO: 2086494 - RNA, 15 nt, Staphylococcus aureus subsp. aureus MW2
uuaaacaagcaucau

SEQ ID NO: 2086495 - RNA, 17 nt, Staphylococcus aureus subsp. aureus MW2
uuaaacaaauaaauguc

SEQ ID NO: 2086496 - RNA, 20 nt, Staphylococcus aureus subsp. aureus MW2
uuaaacaaaacuuaaaauau

SEQ ID NO: 2086497 - RNA, 24 nt, Staphylococcus aureus subsp. aureus MW2
uuaaaggaaaucaauccaucaaua

SEQ ID NO: 2086498 - RNA, 21 nt, Staphylococcus aureus subsp. aureus MW2
uuaaagcuuuucuugaaauaa

SEQ ID NO: 2086499 - RNA, 14 nt, Staphylococcus aureus subsp. aureus MW2
uuaaaggaaaucaa

SEQ ID NO: 2086500 - RNA, 17 nt, Staphylococcus aureus subsp. aureus MW2
uuaaagcuaucuucaga

SEQ ID NO: 2086501 - RNA, 13 nt, Staphylococcus aureus subsp. aureus MW2
uuaaaguaaaaua

SEQ ID NO: 2086502 - RNA, 17 nt, Staphylococcus aureus subsp. aureus MW2
uuaaaguagaaccuaua

SEQ ID NO: 2086503 - RNA, 13 nt, Staphylococcus aureus subsp. aureus MW2
uuaaaguaaccac

SEQ ID NO: 2086504 - RNA, 18 nt, Staphylococcus aureus subsp. aureus MW2
uuaaagaaaauuucagua

SEQ ID NO: 2086505 - RNA, 20 nt, Staphylococcus aureus subsp. aureus MW2
uuaaagaaaauaucugaaaa

SEQ ID NO: 2086506 - RNA, 22 nt, Staphylococcus aureus subsp. aureus MW2
uuaaagcuaauaaugccauuaa

SEQ ID NO: 2086507 - RNA, 18 nt, Staphylococcus aureus subsp. aureus MW2
uuaaagacagguuacuuu

SEQ ID NO: 2086508 - RNA, 15 nt, Staphylococcus aureus subsp. aureus MW2
uuaacaacaaauaua

SEQ ID NO: 2086509 - RNA, 16 nt, Staphylococcus aureus subsp. aureus MW2
uuaacaacaaauauaa

SEQ ID NO: 2086510 - RNA, 14 nt, Staphylococcus aureus subsp. aureus MW2
uuaacaacaaauau

SEQ ID NO: 2086511 - RNA, 15 nt, Staphylococcus aureus subsp. aureus MW2
uuaaauuuuuuaaua

SEQ ID NO: 2086512 - RNA, 16 nt, Staphylococcus aureus subsp. aureus MW2
uuaaauuuuuuaauau

SEQ ID NO: 2086513 - RNA, 22 nt, Staphylococcus aureus subsp. aureus MW2
uuaaauuucaaaauaaauauga

SEQ ID NO: 2086514 - RNA, 14 nt, Staphylococcus aureus subsp. aureus MW2
uuaaauuucugaac

SEQ ID NO: 2086515 - RNA, 18 nt, Staphylococcus aureus subsp. aureus MW2
uuaaauuucugaacauaa

SEQ ID NO: 2086516 - RNA, 13 nt, Staphylococcus aureus subsp. aureus MW2
uuaaauuuucauc

SEQ ID NO: 2086517 - RNA, 19 nt, Staphylococcus aureus subsp. aureus MW2
uuaaauuuucaucauaauc

SEQ ID NO: 2086518 - RNA, 14 nt, Staphylococcus aureus subsp. aureus MW2
uuaaauuuuaaguu

SEQ ID NO: 2086519 - RNA, 21 nt, Staphylococcus aureus subsp. aureus MW2
uuaaauuauauguuuuuauua

SEQ ID NO: 2086520 - RNA, 15 nt, Staphylococcus aureus subsp. aureus MW2
uuaaauuauauguuu

SEQ ID NO: 2086521 - RNA, 14 nt, Staphylococcus aureus subsp. aureus MW2
uuaaauucaucuug

SEQ ID NO: 2086522 - RNA, 15 nt, Staphylococcus aureus subsp. aureus MW2
uuaaauucauaacaa

SEQ ID NO: 2086523 - RNA, 18 nt, Staphylococcus aureus subsp. aureus MW2
uuaaauuggaaucccaau

SEQ ID NO: 2086524 - RNA, 12 nt, Staphylococcus aureus subsp. aureus MW2
uuaaauugaaau

SEQ ID NO: 2086525 - RNA, 21 nt, Staphylococcus aureus subsp. aureus MW2
uuaaauugcuugaaauuauua

SEQ ID NO: 2086526 - RNA, 14 nt, Staphylococcus aureus subsp. aureus MW2
uuaaauuuaaaaga

SEQ ID NO: 2086527 - RNA, 13 nt, Staphylococcus aureus subsp. aureus MW2
uuaaauuuaauuu

SEQ ID NO: 2086528 - RNA, 16 nt, Staphylococcus aureus subsp. aureus MW2
uuaaauuuaauuucga

SEQ ID NO: 2086529 - RNA, 13 nt, Staphylococcus aureus subsp. aureus MW2
uuaaauucuaaaa

SEQ ID NO: 2086530 - RNA, 19 nt, Staphylococcus aureus subsp. aureus MW2
uuaaauucggaaaauauca

SEQ ID NO: 2086531 - RNA, 18 nt, Staphylococcus aureus subsp. aureus MW2
uuaaauucuuauaaaaua

SEQ ID NO: 2086532 - RNA, 18 nt, Staphylococcus aureus subsp. aureus MW2
uuaaaugcuuuaaauauu

SEQ ID NO: 2086533 - RNA, 19 nt, Staphylococcus aureus subsp. aureus MW2
uuaaaugcuuuaaauauug

SEQ ID NO: 2086534 - RNA, 19 nt, Staphylococcus aureus subsp. aureus MW2
uuaaaucaacaucaucuuu

SEQ ID NO: 2086535 - RNA, 17 nt, Staphylococcus aureus subsp. aureus MW2
uuaaaucaaagaguaaa

SEQ ID NO: 2086536 - RNA, 23 nt, Staphylococcus aureus subsp. aureus MW2
uuaaaucaaaugguacaguuaau

SEQ ID NO: 2086537 - RNA, 20 nt, Staphylococcus aureus subsp. aureus MW2
uuaaaugcccaccauguaca

SEQ ID NO: 2086538 - RNA, 21 nt, Staphylococcus aureus subsp. aureus MW2
uuaaaugcccaccauguacau

SEQ ID NO: 2086539 - RNA, 14 nt, Staphylococcus aureus subsp. aureus MW2
uuaaaugcaauaca

SEQ ID NO: 2086540 - RNA, 16 nt, Staphylococcus aureus subsp. aureus MW2
uuaaaugauuuaauaa

SEQ ID NO: 2086541 - RNA, 19 nt, Staphylococcus aureus subsp. aureus MW2
uuaaauauuuaaccuuuaa

SEQ ID NO: 2086542 - RNA, 19 nt, Staphylococcus aureus subsp. aureus MW2
uuaaauauugauauaaaaa

SEQ ID NO: 2086543 - RNA, 13 nt, Staphylococcus aureus subsp. aureus MW2
uuaaauauugucu

SEQ ID NO: 2086544 - RNA, 15 nt, Staphylococcus aureus subsp. aureus MW2
uuaaauauucuuauc

SEQ ID NO: 2086545 - RNA, 21 nt, Staphylococcus aureus subsp. aureus MW2
uuaaauaugacgcgugaauua

SEQ ID NO: 2086546 - RNA, 11 nt, Staphylococcus aureus subsp. aureus MW2
uuaaauaucau

SEQ ID NO: 2086547 - RNA, 14 nt, Staphylococcus aureus subsp. aureus MW2
uuaaauaucaugca

SEQ ID NO: 2086548 - RNA, 23 nt, Staphylococcus aureus subsp. aureus MW2
uuaaauauaaagacgauuuauua

SEQ ID NO: 2086549 - RNA, 21 nt, Staphylococcus aureus subsp. aureus MW2
uuaaauacaauuucuucauuu

SEQ ID NO: 2086550 - RNA, 16 nt, Staphylococcus aureus subsp. aureus MW2
uuaaauacgccaaaua

SEQ ID NO: 2086551 - RNA, 20 nt, Staphylococcus aureus subsp. aureus MW2
uuaagcuuacgacauacuug

SEQ ID NO: 2086552 - RNA, 13 nt, Staphylococcus aureus subsp. aureus MW2
uuaagcuuuaauc

SEQ ID NO: 2086553 - RNA, 15 nt, Staphylococcus aureus subsp. aureus MW2
uuaagcuuucuaucu

SEQ ID NO: 2086554 - RNA, 19 nt, Staphylococcus aureus subsp. aureus MW2
uuaagcucuuaaucuauaa

SEQ ID NO: 2086555 - RNA, 13 nt, Staphylococcus aureus subsp. aureus MW2
uuaaguuuuucag

SEQ ID NO: 2086556 - RNA, 14 nt, Staphylococcus aureus subsp. aureus MW2
uuaauaaaauuacg

SEQ ID NO: 2086557 - RNA, 13 nt, Staphylococcus aureus subsp. aureus MW2
uuaauaaauuuaa

SEQ ID NO: 2086558 - RNA, 22 nt, Staphylococcus aureus subsp. aureus MW2
uuaauaaauuuaacguuauuca

SEQ ID NO: 2086559 - RNA, 20 nt, Staphylococcus aureus subsp. aureus MW2
uuaauaaauuguaugaauaa

SEQ ID NO: 2086560 - RNA, 21 nt, Staphylococcus aureus subsp. aureus MW2
uuaauaacauccccaaaaaua

SEQ ID NO: 2086561 - RNA, 14 nt, Staphylococcus aureus subsp. aureus MW2
uuaauaacagaguu

SEQ ID NO: 2086562 - RNA, 19 nt, Staphylococcus aureus subsp. aureus MW2
uuaauaaacgcuucauagu

SEQ ID NO: 2086563 - RNA, 12 nt, Staphylococcus aureus subsp. aureus MW2
uuaauaaaccua

SEQ ID NO: 2086564 - RNA, 20 nt, Staphylococcus aureus subsp. aureus MW2
uuaauaagcauuaauguuca

SEQ ID NO: 2086565 - RNA, 16 nt, Staphylococcus aureus subsp. aureus MW2
uuaauaagcuaauauu

SEQ ID NO: 2086566 - RNA, 16 nt, Staphylococcus aureus subsp. aureus MW2
uuaauaaccuuuaaaa

SEQ ID NO: 2086567 - RNA, 22 nt, Staphylococcus aureus subsp. aureus MW2
uuaauaacauccccaaaaauag

SEQ ID NO: 2086568 - RNA, 20 nt, Staphylococcus aureus subsp. aureus MW2
uuaauaacaaaauuaaauau

SEQ ID NO: 2086569 - RNA, 23 nt, Staphylococcus aureus subsp. aureus MW2
uuaauaaccuuuaaaacaucauu

SEQ ID NO: 2086570 - RNA, 16 nt, Staphylococcus aureus subsp. aureus MW2
uuaagaaaucaacaac

SEQ ID NO: 2086571 - RNA, 19 nt, Staphylococcus aureus subsp. aureus MW2
uuaagaaaucaacaacuuu

SEQ ID NO: 2086572 - RNA, 17 nt, Staphylococcus aureus subsp. aureus MW2
uuaacuuucccuacugc

SEQ ID NO: 2086573 - RNA, 13 nt, Staphylococcus aureus subsp. aureus MW2
uuaacuuuaauua

SEQ ID NO: 2086574 - RNA, 15 nt, Staphylococcus aureus subsp. aureus MW2
uuaacuuaaaauuua

SEQ ID NO: 2086575 - RNA, 20 nt, Staphylococcus aureus subsp. aureus MW2
uuaacucaccuuuaucauua

SEQ ID NO: 2086576 - RNA, 15 nt, Staphylococcus aureus subsp. aureus MW2
uuaagauuuuaacuu

SEQ ID NO: 2086577 - RNA, 12 nt, Staphylococcus aureus subsp. aureus MW2
uuaagcauuugu

SEQ ID NO: 2086578 - RNA, 22 nt, Staphylococcus aureus subsp. aureus MW2
uuaagccagcagguuucacaaa

SEQ ID NO: 2086579 - RNA, 16 nt, Staphylococcus aureus subsp. aureus MW2
uuaacccuucuccaaa

SEQ ID NO: 2086580 - RNA, 20 nt, Staphylococcus aureus subsp. aureus MW2
uuaaccaguauaauuuucug

SEQ ID NO: 2086581 - RNA, 18 nt, Staphylococcus aureus subsp. aureus MW2
uuaaccccuucaaaauuu

SEQ ID NO: 2086582 - RNA, 17 nt, Staphylococcus aureus subsp. aureus MW2
uuaaccauuuaaaaauu

SEQ ID NO: 2086583 - RNA, 20 nt, Staphylococcus aureus subsp. aureus MW2
uuaaccauuucuuuuuucaa

SEQ ID NO: 2086584 - RNA, 13 nt, Staphylococcus aureus subsp. aureus MW2
uuaacuauaacaa

SEQ ID NO: 2086585 - RNA, 15 nt, Staphylococcus aureus subsp. aureus MW2
uuaacuauaacaaua

SEQ ID NO: 2086586 - RNA, 15 nt, Staphylococcus aureus subsp. aureus MW2
uuaacuaauagacug

SEQ ID NO: 2086587 - RNA, 12 nt, Staphylococcus aureus subsp. aureus MW2
uuaacuaaacca

SEQ ID NO: 2086588 - RNA, 17 nt, Staphylococcus aureus subsp. aureus MW2
uuaacgcaaaaauacuc

SEQ ID NO: 2086589 - RNA, 14 nt, Staphylococcus aureus subsp. aureus MW2
uuaacgcaaaaaua

SEQ ID NO: 2086590 - RNA, 15 nt, Staphylococcus aureus subsp. aureus MW2
uuaacgauuaauaua

SEQ ID NO: 2086591 - RNA, 20 nt, Staphylococcus aureus subsp. aureus MW2
uuaacgcuuauacuauauaa

SEQ ID NO: 2086592 - RNA, 22 nt, Staphylococcus aureus subsp. aureus MW2
uuaacaucaugucgaaucaaag

SEQ ID NO: 2086593 - RNA, 12 nt, Staphylococcus aureus subsp. aureus MW2
uuaacaucauuu

SEQ ID NO: 2086594 - RNA, 19 nt, Staphylococcus aureus subsp. aureus MW2
uuaaccacuccuuaaacaa

SEQ ID NO: 2086595 - RNA, 16 nt, Staphylococcus aureus subsp. aureus MW2
uuaacauuuuuuucaa

SEQ ID NO: 2086596 - RNA, 20 nt, Staphylococcus aureus subsp. aureus MW2
uuaacauuuauuuuuucucu

SEQ ID NO: 2086597 - RNA, 18 nt, Staphylococcus aureus subsp. aureus MW2
uuaacauuugucauaaua

SEQ ID NO: 2086598 - RNA, 22 nt, Staphylococcus aureus subsp. aureus MW2
uuaacauuuacacgucuaauuu

SEQ ID NO: 2086599 - RNA, 14 nt, Staphylococcus aureus subsp. aureus MW2
uuaacaucugaauc

SEQ ID NO: 2086600 - RNA, 16 nt, Staphylococcus aureus subsp. aureus MW2
uuaacaucugaaucug

SEQ ID NO: 2086601 - RNA, 12 nt, Staphylococcus aureus subsp. aureus MW2
uuaacaacauga

SEQ ID NO: 2086602 - RNA, 15 nt, Staphylococcus aureus subsp. aureus MW2
uuaacaacuuuauua

SEQ ID NO: 2086603 - RNA, 16 nt, Staphylococcus aureus subsp. aureus MW2
uuaacaagauaacuag

SEQ ID NO: 2086604 - RNA, 15 nt, Staphylococcus aureus subsp. aureus MW2
uuaacaauauauaau

SEQ ID NO: 2086605 - RNA, 14 nt, Staphylococcus aureus subsp. aureus MW2
uuaacaauauuaaa

SEQ ID NO: 2086606 - RNA, 21 nt, Staphylococcus aureus subsp. aureus MW2
uuaacaauuuuaucugaaucu

SEQ ID NO: 2086607 - RNA, 14 nt, Staphylococcus aureus subsp. aureus MW2
uuaacaauuuuaau

SEQ ID NO: 2086608 - RNA, 20 nt, Staphylococcus aureus subsp. aureus MW2
uuaacaauuuuaauuuuuca

SEQ ID NO: 2086609 - RNA, 20 nt, Staphylococcus aureus subsp. aureus MW2
uuaacaauuuuaucugaauc

SEQ ID NO: 2086610 - RNA, 18 nt, Staphylococcus aureus subsp. aureus MW2
uuaacaauugauugcucu

SEQ ID NO: 2086611 - RNA, 21 nt, Staphylococcus aureus subsp. aureus MW2
uuaacaccagauaucauaaua

SEQ ID NO: 2086612 - RNA, 22 nt, Staphylococcus aureus subsp. aureus MW2
uuaacaauuuuaucugaaucug

SEQ ID NO: 2086613 - RNA, 21 nt, Staphylococcus aureus subsp. aureus MW2
uuauuuggaugguaaguauaa

SEQ ID NO: 2086614 - RNA, 18 nt, Staphylococcus aureus subsp. aureus MW2
uuauuugauaaugauagu

SEQ ID NO: 2086615 - RNA, 22 nt, Staphylococcus aureus subsp. aureus MW2
uuauuugaaaugauaagaauca

SEQ ID NO: 2086616 - RNA, 14 nt, Staphylococcus aureus subsp. aureus MW2
uuauuucugaaaac

SEQ ID NO: 2086617 - RNA, 14 nt, Staphylococcus aureus subsp. aureus MW2
uuauuugaaauaau

SEQ ID NO: 2086618 - RNA, 19 nt, Staphylococcus aureus subsp. aureus MW2
uuauuugauaaauaaaauu

SEQ ID NO: 2086619 - RNA, 20 nt, Staphylococcus aureus subsp. aureus MW2
uuauuucgccuuuuuuauuu

SEQ ID NO: 2086620 - RNA, 23 nt, Staphylococcus aureus subsp. aureus MW2
uuauuuccuguuacuuucacauu

SEQ ID NO: 2086621 - RNA, 20 nt, Staphylococcus aureus subsp. aureus MW2
uuauuuggguaacauuagca

SEQ ID NO: 2086622 - RNA, 18 nt, Staphylococcus aureus subsp. aureus MW2
uuauuuguuuaauuaucu

SEQ ID NO: 2086623 - RNA, 13 nt, Staphylococcus aureus subsp. aureus MW2
uuauuuuaaauuu

SEQ ID NO: 2086624 - RNA, 14 nt, Staphylococcus aureus subsp. aureus MW2
uuauuuuaaauuua

SEQ ID NO: 2086625 - RNA, 12 nt, Staphylococcus aureus subsp. aureus MW2
uuauuuuaaaau

SEQ ID NO: 2086626 - RNA, 13 nt, Staphylococcus aureus subsp. aureus MW2
uuauuuuaaaaua

SEQ ID NO: 2086627 - RNA, 21 nt, Staphylococcus aureus subsp. aureus MW2
uuauuuuaucaucuauucaaa

SEQ ID NO: 2086628 - RNA, 13 nt, Staphylococcus aureus subsp. aureus MW2
uuauuuuaucauc

SEQ ID NO: 2086629 - RNA, 13 nt, Staphylococcus aureus subsp. aureus MW2
uuauuuucaauaa

SEQ ID NO: 2086630 - RNA, 12 nt, Staphylococcus aureus subsp. aureus MW2
uuauuuucaaua

SEQ ID NO: 2086631 - RNA, 17 nt, Staphylococcus aureus subsp. aureus MW2
uuauuuucaauaaauuu

SEQ ID NO: 2086632 - RNA, 23 nt, Staphylococcus aureus subsp. aureus MW2
uuauuuucaauaaauuuuauaua

SEQ ID NO: 2086633 - RNA, 16 nt, Staphylococcus aureus subsp. aureus MW2
uuauuguaaccugacu

SEQ ID NO: 2086634 - RNA, 20 nt, Staphylococcus aureus subsp. aureus MW2
uuauugguuacuguaguacu

SEQ ID NO: 2086635 - RNA, 20 nt, Staphylococcus aureus subsp. aureus MW2
uuauuggguaauauuaguca

SEQ ID NO: 2086636 - RNA, 22 nt, Staphylococcus aureus subsp. aureus MW2
uuauugucaucauguucuaaug

SEQ ID NO: 2086637 - RNA, 17 nt, Staphylococcus aureus subsp. aureus MW2
uuauugcauuguauaug

SEQ ID NO: 2086638 - RNA, 16 nt, Staphylococcus aureus subsp. aureus MW2
uuauuuaaguucuucu

SEQ ID NO: 2086639 - RNA, 20 nt, Staphylococcus aureus subsp. aureus MW2
uuauuuaaucguaacauauc

SEQ ID NO: 2086640 - RNA, 14 nt, Staphylococcus aureus subsp. aureus MW2
uuauuuaaaaugcu

SEQ ID NO: 2086641 - RNA, 16 nt, Staphylococcus aureus subsp. aureus MW2
uuauuuaaaacuugua

SEQ ID NO: 2086642 - RNA, 13 nt, Staphylococcus aureus subsp. aureus MW2
uuauuuaaaaugc

SEQ ID NO: 2086643 - RNA, 17 nt, Staphylococcus aureus subsp. aureus MW2
uuauuuauaaacaauaa

SEQ ID NO: 2086644 - RNA, 20 nt, Staphylococcus aureus subsp. aureus MW2
uuauuauguuauaaauucua

SEQ ID NO: 2086645 - RNA, 20 nt, Staphylococcus aureus subsp. aureus MW2
uuauuaugaauuauuaauaa

SEQ ID NO: 2086646 - RNA, 13 nt, Staphylococcus aureus subsp. aureus MW2
uuauuauacauag

SEQ ID NO: 2086647 - RNA, 16 nt, Staphylococcus aureus subsp. aureus MW2
uuauuaugaauuauua

SEQ ID NO: 2086648 - RNA, 13 nt, Staphylococcus aureus subsp. aureus MW2
uuauuauccaagg

SEQ ID NO: 2086649 - RNA, 17 nt, Staphylococcus aureus subsp. aureus MW2
uuauuaucuuuaaauua

SEQ ID NO: 2086650 - RNA, 15 nt, Staphylococcus aureus subsp. aureus MW2
uuauuaucuuuguaa

SEQ ID NO: 2086651 - RNA, 15 nt, Staphylococcus aureus subsp. aureus MW2
uuauuagaaugaaac

SEQ ID NO: 2086652 - RNA, 12 nt, Staphylococcus aureus subsp. aureus MW2
uuauuauaaaau

SEQ ID NO: 2086653 - RNA, 15 nt, Staphylococcus aureus subsp. aureus MW2
uuauuaguauucaaa

SEQ ID NO: 2086654 - RNA, 22 nt, Staphylococcus aureus subsp. aureus MW2
uuauuaguauucaaaaaaauau

SEQ ID NO: 2086655 - RNA, 21 nt, Staphylococcus aureus subsp. aureus MW2
uuauuaaugaagcugugugaa

SEQ ID NO: 2086656 - RNA, 15 nt, Staphylococcus aureus subsp. aureus MW2
uuauuaaucguucca

SEQ ID NO: 2086657 - RNA, 18 nt, Staphylococcus aureus subsp. aureus MW2
uuauuaaucuguaaugca

SEQ ID NO: 2086658 - RNA, 22 nt, Staphylococcus aureus subsp. aureus MW2
uuauuaauuaaaaaauuccuag

SEQ ID NO: 2086659 - RNA, 23 nt, Staphylococcus aureus subsp. aureus MW2
uuauuacaaaauuuccacuuuga

SEQ ID NO: 2086660 - RNA, 18 nt, Staphylococcus aureus subsp. aureus MW2
uuauuacaaccaacaauu

SEQ ID NO: 2086661 - RNA, 20 nt, Staphylococcus aureus subsp. aureus MW2
uuauuacaaccaacaauugg

SEQ ID NO: 2086662 - RNA, 17 nt, Staphylococcus aureus subsp. aureus MW2
uuauuacaaucaaaaaa

SEQ ID NO: 2086663 - RNA, 21 nt, Staphylococcus aureus subsp. aureus MW2
uuauuaccauaaauuuauaua

SEQ ID NO: 2086664 - RNA, 18 nt, Staphylococcus aureus subsp. aureus MW2
uuauuacauaauuuaucu

SEQ ID NO: 2086665 - RNA, 23 nt, Staphylococcus aureus subsp. aureus MW2
uuauuacaucgacaauuuucgau

SEQ ID NO: 2086666 - RNA, 12 nt, Staphylococcus aureus subsp. aureus MW2
uuauuaacuuua

SEQ ID NO: 2086667 - RNA, 15 nt, Staphylococcus aureus subsp. aureus MW2
uuauucguuaacaau

SEQ ID NO: 2086668 - RNA, 14 nt, Staphylococcus aureus subsp. aureus MW2
uuauucuaauacaa

SEQ ID NO: 2086669 - RNA, 18 nt, Staphylococcus aureus subsp. aureus MW2
uuauucuaacuuuguaug

SEQ ID NO: 2086670 - RNA, 14 nt, Staphylococcus aureus subsp. aureus MW2
uuauucucuuuauu

SEQ ID NO: 2086671 - RNA, 14 nt, Staphylococcus aureus subsp. aureus MW2
uuauucuucacuuu

SEQ ID NO: 2086672 - RNA, 12 nt, Staphylococcus aureus subsp. aureus MW2
uuauucuuaauu

SEQ ID NO: 2086673 - RNA, 14 nt, Staphylococcus aureus subsp. aureus MW2
uuauucuuuaauua

SEQ ID NO: 2086674 - RNA, 22 nt, Staphylococcus aureus subsp. aureus MW2
uuauucuuuauauuugugaaug

SEQ ID NO: 2086675 - RNA, 19 nt, Staphylococcus aureus subsp. aureus MW2
uuauugaaguuuuccuaau

SEQ ID NO: 2086676 - RNA, 20 nt, Staphylococcus aureus subsp. aureus MW2
uuauugaaaagauaaacaag

SEQ ID NO: 2086677 - RNA, 13 nt, Staphylococcus aureus subsp. aureus MW2
uuauugaaacuaa

SEQ ID NO: 2086678 - RNA, 15 nt, Staphylococcus aureus subsp. aureus MW2
uuauugaaauuuggu

SEQ ID NO: 2086679 - RNA, 16 nt, Staphylococcus aureus subsp. aureus MW2
uuauugaaauuuggua

SEQ ID NO: 2086680 - RNA, 21 nt, Staphylococcus aureus subsp. aureus MW2
uuauugacauucacauuauuu

SEQ ID NO: 2086681 - RNA, 22 nt, Staphylococcus aureus subsp. aureus MW2
uuauugacauucacauuauuua

SEQ ID NO: 2086682 - RNA, 23 nt, Staphylococcus aureus subsp. aureus MW2
uuauugacauugcaaaagugguu

SEQ ID NO: 2086683 - RNA, 22 nt, Staphylococcus aureus subsp. aureus MW2
uuauugagaauauuuauuguuu

SEQ ID NO: 2086684 - RNA, 15 nt, Staphylococcus aureus subsp. aureus MW2
uuauugagaauauuu

SEQ ID NO: 2086685 - RNA, 18 nt, Staphylococcus aureus subsp. aureus MW2
uuauugauauuaauauau

SEQ ID NO: 2086686 - RNA, 16 nt, Staphylococcus aureus subsp. aureus MW2
uuauuauuuuguauuu

SEQ ID NO: 2086687 - RNA, 22 nt, Staphylococcus aureus subsp. aureus MW2
uuauuauugucaucauguucua

SEQ ID NO: 2086688 - RNA, 12 nt, Staphylococcus aureus subsp. aureus MW2
uuauuauuuauc

SEQ ID NO: 2086689 - RNA, 23 nt, Staphylococcus aureus subsp. aureus MW2
uuauuccgaacauguuucuagau

SEQ ID NO: 2086690 - RNA, 14 nt, Staphylococcus aureus subsp. aureus MW2
uuauuccacauuau

SEQ ID NO: 2086691 - RNA, 14 nt, Staphylococcus aureus subsp. aureus MW2
uuauuuuucucaua

SEQ ID NO: 2086692 - RNA, 10 nt, Staphylococcus aureus subsp. aureus MW2
uuauuuuuua

SEQ ID NO: 2086693 - RNA, 16 nt, Staphylococcus aureus subsp. aureus MW2
uuauuuuuauucaguu

SEQ ID NO: 2086694 - RNA, 16 nt, Staphylococcus aureus subsp. aureus MW2
uuauuuuuauagauaa

SEQ ID NO: 2086695 - RNA, 21 nt, Staphylococcus aureus subsp. aureus MW2
uuauuuucuuuggugaaagua

SEQ ID NO: 2086696 - RNA, 11 nt, Staphylococcus aureus subsp. aureus MW2
uuauuuuuaag

SEQ ID NO: 2086697 - RNA, 14 nt, Staphylococcus aureus subsp. aureus MW2
uuauuuuuaaauau

SEQ ID NO: 2086698 - RNA, 22 nt, Staphylococcus aureus subsp. aureus MW2
uucaaaaagucucauuaucacc

SEQ ID NO: 2086699 - RNA, 20 nt, Staphylococcus aureus subsp. aureus MW2
uucaaaaauuguuaaucccg

SEQ ID NO: 2086700 - RNA, 21 nt, Staphylococcus aureus subsp. aureus MW2
uucaaacuuuucaauauuagg

SEQ ID NO: 2086701 - RNA, 15 nt, Staphylococcus aureus subsp. aureus MW2
uucaaaguagacauu

SEQ ID NO: 2086702 - RNA, 18 nt, Staphylococcus aureus subsp. aureus MW2
uucaaagcgauaaaguau

SEQ ID NO: 2086703 - RNA, 19 nt, Staphylococcus aureus subsp. aureus MW2
uucaaaaugccaagaagac

SEQ ID NO: 2086704 - RNA, 14 nt, Staphylococcus aureus subsp. aureus MW2
uucaaaaucaaauu

SEQ ID NO: 2086705 - RNA, 18 nt, Staphylococcus aureus subsp. aureus MW2
uucaaaaucaauugaaaa

SEQ ID NO: 2086706 - RNA, 20 nt, Staphylococcus aureus subsp. aureus MW2
uucaaaacuagcaguaauau

SEQ ID NO: 2086707 - RNA, 19 nt, Staphylococcus aureus subsp. aureus MW2
uucaaauguaacauuaaaa

SEQ ID NO: 2086708 - RNA, 19 nt, Staphylococcus aureus subsp. aureus MW2
uucaaauguaguuaagaua

SEQ ID NO: 2086709 - RNA, 21 nt, Staphylococcus aureus subsp. aureus MW2
uucaaauguuuacugucaucu

SEQ ID NO: 2086710 - RNA, 13 nt, Staphylococcus aureus subsp. aureus MW2
uucaaauguugaa

SEQ ID NO: 2086711 - RNA, 21 nt, Staphylococcus aureus subsp. aureus MW2
uucaaauguugacuacucaau

SEQ ID NO: 2086712 - RNA, 15 nt, Staphylococcus aureus subsp. aureus MW2
uucaaauugguuuuc

SEQ ID NO: 2086713 - RNA, 15 nt, Staphylococcus aureus subsp. aureus MW2
uucaaauaauauaaa

SEQ ID NO: 2086714 - RNA, 21 nt, Staphylococcus aureus subsp. aureus MW2
uucaaauaaaucaaacuuuuc

SEQ ID NO: 2086715 - RNA, 19 nt, Staphylococcus aureus subsp. aureus MW2
uucaaauauaucuaauacu

SEQ ID NO: 2086716 - RNA, 22 nt, Staphylococcus aureus subsp. aureus MW2
uucaacacgacguucuucaauu

SEQ ID NO: 2086717 - RNA, 22 nt, Staphylococcus aureus subsp. aureus MW2
uucaacaauuucaaugucugca

SEQ ID NO: 2086718 - RNA, 17 nt, Staphylococcus aureus subsp. aureus MW2
uucaacagggguaaaac

SEQ ID NO: 2086719 - RNA, 18 nt, Staphylococcus aureus subsp. aureus MW2
uucaacauaacucaaaua

SEQ ID NO: 2086720 - RNA, 14 nt, Staphylococcus aureus subsp. aureus MW2
uucaaccaauuauu

SEQ ID NO: 2086721 - RNA, 15 nt, Staphylococcus aureus subsp. aureus MW2
uucaacauuacaugc

SEQ ID NO: 2086722 - RNA, 13 nt, Staphylococcus aureus subsp. aureus MW2
uucaacuacuuca

SEQ ID NO: 2086723 - RNA, 16 nt, Staphylococcus aureus subsp. aureus MW2
uucaacuaauaacuca

SEQ ID NO: 2086724 - RNA, 15 nt, Staphylococcus aureus subsp. aureus MW2
uucaacuacuucauc

SEQ ID NO: 2086725 - RNA, 23 nt, Staphylococcus aureus subsp. aureus MW2
uucaacuaguaaaucaaagauga

SEQ ID NO: 2086726 - RNA, 14 nt, Staphylococcus aureus subsp. aureus MW2
uucaagaccaaaua

SEQ ID NO: 2086727 - RNA, 19 nt, Staphylococcus aureus subsp. aureus MW2
uucaacuuuaguuguuagg

SEQ ID NO: 2086728 - RNA, 19 nt, Staphylococcus aureus subsp. aureus MW2
uucaacuuguuuccuacac

SEQ ID NO: 2086729 - RNA, 16 nt, Staphylococcus aureus subsp. aureus MW2
uucaagagaaccaccu

SEQ ID NO: 2086730 - RNA, 18 nt, Staphylococcus aureus subsp. aureus MW2
uuaucgaucgguauuuuc

SEQ ID NO: 2086731 - RNA, 21 nt, Staphylococcus aureus subsp. aureus MW2
uuaucuaacaaucguuuuaau

SEQ ID NO: 2086732 - RNA, 16 nt, Staphylococcus aureus subsp. aureus MW2
uuaucugaaaauauca

SEQ ID NO: 2086733 - RNA, 17 nt, Staphylococcus aureus subsp. aureus MW2
uuaucugaccaguauac

SEQ ID NO: 2086734 - RNA, 17 nt, Staphylococcus aureus subsp. aureus MW2
uuaucuauauaugaaga

SEQ ID NO: 2086735 - RNA, 22 nt, Staphylococcus aureus subsp. aureus MW2
uuaucuacaguuuuaugaauau

SEQ ID NO: 2086736 - RNA, 15 nt, Staphylococcus aureus subsp. aureus MW2
uuaucuguaauuaau

SEQ ID NO: 2086737 - RNA, 16 nt, Staphylococcus aureus subsp. aureus MW2
uuaucugcgaaaugca

SEQ ID NO: 2086738 - RNA, 23 nt, Staphylococcus aureus subsp. aureus MW2
uuaugccaacacguuuuaagcca

SEQ ID NO: 2086739 - RNA, 22 nt, Staphylococcus aureus subsp. aureus MW2
uuaugcucaucuacuuaaaaua

SEQ ID NO: 2086740 - RNA, 22 nt, Staphylococcus aureus subsp. aureus MW2
uuauggugcuaaaaaauuugca

SEQ ID NO: 2086741 - RNA, 15 nt, Staphylococcus aureus subsp. aureus MW2
uuaugucccaaugcu

SEQ ID NO: 2086742 - RNA, 19 nt, Staphylococcus aureus subsp. aureus MW2
uuauguauuuuuauuuaua

SEQ ID NO: 2086743 - RNA, 14 nt, Staphylococcus aureus subsp. aureus MW2
uuauguauaucuuu

SEQ ID NO: 2086744 - RNA, 18 nt, Staphylococcus aureus subsp. aureus MW2
uuauguaccaaauuuaua

SEQ ID NO: 2086745 - RNA, 17 nt, Staphylococcus aureus subsp. aureus MW2
uuauuaaaauuaaauaa

SEQ ID NO: 2086746 - RNA, 22 nt, Staphylococcus aureus subsp. aureus MW2
uuauguuuugaagggacaauga

SEQ ID NO: 2086747 - RNA, 13 nt, Staphylococcus aureus subsp. aureus MW2
uuauguuuaauuu

SEQ ID NO: 2086748 - RNA, 24 nt, Staphylococcus aureus subsp. aureus MW2
uuauguugacucuacuagaauaac

SEQ ID NO: 2086749 - RNA, 15 nt, Staphylococcus aureus subsp. aureus MW2
uuaugaaaacauuau

SEQ ID NO: 2086750 - RNA, 13 nt, Staphylococcus aureus subsp. aureus MW2
uuaucuuuaagua

SEQ ID NO: 2086751 - RNA, 20 nt, Staphylococcus aureus subsp. aureus MW2
uuaugacaaaguucugcaau

SEQ ID NO: 2086752 - RNA, 15 nt, Staphylococcus aureus subsp. aureus MW2
uuaugagcuuaauaa

SEQ ID NO: 2086753 - RNA, 18 nt, Staphylococcus aureus subsp. aureus MW2
uuaugacugcuuuuuauu

SEQ ID NO: 2086754 - RNA, 19 nt, Staphylococcus aureus subsp. aureus MW2
uuaugauugcuuauuuauu

SEQ ID NO: 2086755 - RNA, 14 nt, Staphylococcus aureus subsp. aureus MW2
uuaugaugucaugu

SEQ ID NO: 2086756 - RNA, 11 nt, Staphylococcus aureus subsp. aureus MW2
uuaugauauac

SEQ ID NO: 2086757 - RNA, 21 nt, Staphylococcus aureus subsp. aureus MW2
uuaugauauacgagcuuugcu

SEQ ID NO: 2086758 - RNA, 19 nt, Staphylococcus aureus subsp. aureus MW2
uuaugaucaauaagauuuu

SEQ ID NO: 2086759 - RNA, 18 nt, Staphylococcus aureus subsp. aureus MW2
uuaugccauucauuaagc

SEQ ID NO: 2086760 - RNA, 15 nt, Staphylococcus aureus subsp. aureus MW2
uuaugcauauguaau

SEQ ID NO: 2086761 - RNA, 19 nt, Staphylococcus aureus subsp. aureus MW2
uuaugcauauguaauacaa

SEQ ID NO: 2086762 - RNA, 12 nt, Staphylococcus aureus subsp. aureus MW2
uuaucauuauuc

SEQ ID NO: 2086763 - RNA, 21 nt, Staphylococcus aureus subsp. aureus MW2
uuaucaucgucuccaacuuua

SEQ ID NO: 2086764 - RNA, 14 nt, Staphylococcus aureus subsp. aureus MW2
uuaucaucuauuca

SEQ ID NO: 2086765 - RNA, 14 nt, Staphylococcus aureus subsp. aureus MW2
uuaucauuaaauug

SEQ ID NO: 2086766 - RNA, 18 nt, Staphylococcus aureus subsp. aureus MW2
uuauccaaaacauuuugu

SEQ ID NO: 2086767 - RNA, 22 nt, Staphylococcus aureus subsp. aureus MW2
uuauccaaaccaauuuuaacuu

SEQ ID NO: 2086768 - RNA, 13 nt, Staphylococcus aureus subsp. aureus MW2
uuaucauuauucg

SEQ ID NO: 2086769 - RNA, 20 nt, Staphylococcus aureus subsp. aureus MW2
uuaucauuuuuaauuuugac

SEQ ID NO: 2086770 - RNA, 20 nt, Staphylococcus aureus subsp. aureus MW2
uuaucaacgauuuugucuuu

SEQ ID NO: 2086771 - RNA, 19 nt, Staphylococcus aureus subsp. aureus MW2
uuaucaagagguaaaucug

SEQ ID NO: 2086772 - RNA, 21 nt, Staphylococcus aureus subsp. aureus MW2
uuauauagauugccauucaua

SEQ ID NO: 2086773 - RNA, 14 nt, Staphylococcus aureus subsp. aureus MW2
uuauauauaaaauc

SEQ ID NO: 2086774 - RNA, 18 nt, Staphylococcus aureus subsp. aureus MW2
uuauauauauuaaaguaa

SEQ ID NO: 2086775 - RNA, 14 nt, Staphylococcus aureus subsp. aureus MW2
uuauauaucacaua

SEQ ID NO: 2086776 - RNA, 15 nt, Staphylococcus aureus subsp. aureus MW2
uuaucaacaaauuua

SEQ ID NO: 2086777 - RNA, 13 nt, Staphylococcus aureus subsp. aureus MW2
uuaucaacaacaa

SEQ ID NO: 2086778 - RNA, 13 nt, Staphylococcus aureus subsp. aureus MW2
uuauaucaaaaaa

SEQ ID NO: 2086779 - RNA, 22 nt, Staphylococcus aureus subsp. aureus MW2
uuauaucaaaaaauauguuuaa

SEQ ID NO: 2086780 - RNA, 18 nt, Staphylococcus aureus subsp. aureus MW2
uuauagcaaauugauuaa

SEQ ID NO: 2086781 - RNA, 22 nt, Staphylococcus aureus subsp. aureus MW2
uuauagcaaauugauuaaauaa

SEQ ID NO: 2086782 - RNA, 17 nt, Staphylococcus aureus subsp. aureus MW2
uuauagcauuucuuuau

SEQ ID NO: 2086783 - RNA, 13 nt, Staphylococcus aureus subsp. aureus MW2
uuauauaauucuu

SEQ ID NO: 2086784 - RNA, 19 nt, Staphylococcus aureus subsp. aureus MW2
uuauacagugaaucuaaac

SEQ ID NO: 2086785 - RNA, 19 nt, Staphylococcus aureus subsp. aureus MW2
uuauacauguaacagugug

SEQ ID NO: 2086786 - RNA, 12 nt, Staphylococcus aureus subsp. aureus MW2
uuauacauguac

SEQ ID NO: 2086787 - RNA, 18 nt, Staphylococcus aureus subsp. aureus MW2
uuauaauaauauugaaag

SEQ ID NO: 2086788 - RNA, 17 nt, Staphylococcus aureus subsp. aureus MW2
uuauaauauuaaauugc

SEQ ID NO: 2086789 - RNA, 13 nt, Staphylococcus aureus subsp. aureus MW2
uuauaaguauuca

SEQ ID NO: 2086790 - RNA, 14 nt, Staphylococcus aureus subsp. aureus MW2
uuauaaguugcaua

SEQ ID NO: 2086791 - RNA, 20 nt, Staphylococcus aureus subsp. aureus MW2
uuauacacaaaguauuugaa

SEQ ID NO: 2086792 - RNA, 23 nt, Staphylococcus aureus subsp. aureus MW2
uuauaauuucaguaggacacaua

SEQ ID NO: 2086793 - RNA, 14 nt, Staphylococcus aureus subsp. aureus MW2
uuauaauuguaaug

SEQ ID NO: 2086794 - RNA, 12 nt, Staphylococcus aureus subsp. aureus MW2
uuauaaguacaa

SEQ ID NO: 2086795 - RNA, 17 nt, Staphylococcus aureus subsp. aureus MW2
uuauaaaaguguaaugu

SEQ ID NO: 2086796 - RNA, 21 nt, Staphylococcus aureus subsp. aureus MW2
uuauaaaaugaauaauuacua

SEQ ID NO: 2086797 - RNA, 23 nt, Staphylococcus aureus subsp. aureus MW2
uuauaaagauagaaugaauaauu

SEQ ID NO: 2086798 - RNA, 14 nt, Staphylococcus aureus subsp. aureus MW2
uuagaauucuaaau

SEQ ID NO: 2086799 - RNA, 19 nt, Staphylococcus aureus subsp. aureus MW2
uuagagccccuuacaacuu

SEQ ID NO: 2086800 - RNA, 15 nt, Staphylococcus aureus subsp. aureus MW2
uuagauaaaaaauac

SEQ ID NO: 2086801 - RNA, 21 nt, Staphylococcus aureus subsp. aureus MW2
uuauaaaaagauauaagaaaa

SEQ ID NO: 2086802 - RNA, 12 nt, Staphylococcus aureus subsp. aureus MW2
uguauuuaaaau

SEQ ID NO: 2086803 - RNA, 14 nt, Staphylococcus aureus subsp. aureus MW2
uguauuuaguauca

SEQ ID NO: 2086804 - RNA, 20 nt, Staphylococcus aureus subsp. aureus MW2
uguauuuauacuauaaauaa

SEQ ID NO: 2086805 - RNA, 13 nt, Staphylococcus aureus subsp. aureus MW2
ugucauaauccau

SEQ ID NO: 2086806 - RNA, 21 nt, Staphylococcus aureus subsp. aureus MW2
ugucaguuuugaagaauaaaa

SEQ ID NO: 2086807 - RNA, 19 nt, Staphylococcus aureus subsp. aureus MW2
ugucauaguauacauaauu

SEQ ID NO: 2086808 - RNA, 11 nt, Staphylococcus aureus subsp. aureus MW2
ugucauaccuu

SEQ ID NO: 2086809 - RNA, 20 nt, Staphylococcus aureus subsp. aureus MW2
uguaugauagaauacuaaaa

SEQ ID NO: 2086810 - RNA, 14 nt, Staphylococcus aureus subsp. aureus MW2
uguaugaagauuua

SEQ ID NO: 2086811 - RNA, 20 nt, Staphylococcus aureus subsp. aureus MW2
uguaugauaaccauuaugau

SEQ ID NO: 2086812 - RNA, 19 nt, Staphylococcus aureus subsp. aureus MW2
uguaugaaaggaguauuuu

SEQ ID NO: 2086813 - RNA, 16 nt, Staphylococcus aureus subsp. aureus MW2
uguauucugaaacuuu

SEQ ID NO: 2086814 - RNA, 16 nt, Staphylococcus aureus subsp. aureus MW2
uguaugcgagggcuuu

SEQ ID NO: 2086815 - RNA, 19 nt, Staphylococcus aureus subsp. aureus MW2
uguaugccgccuaauaaua

SEQ ID NO: 2086816 - RNA, 22 nt, Staphylococcus aureus subsp. aureus MW2
uguauggaaaguugguuuuauu

SEQ ID NO: 2086817 - RNA, 17 nt, Staphylococcus aureus subsp. aureus MW2
uguauucugaaacuuua

SEQ ID NO: 2086818 - RNA, 18 nt, Staphylococcus aureus subsp. aureus MW2
uguauucuucuaauucug

SEQ ID NO: 2086819 - RNA, 17 nt, Staphylococcus aureus subsp. aureus MW2
uguauuguuuguuuuua

SEQ ID NO: 2086820 - RNA, 23 nt, Staphylococcus aureus subsp. aureus MW2
uguauugagaaagacuauauaac

SEQ ID NO: 2086821 - RNA, 14 nt, Staphylococcus aureus subsp. aureus MW2
uguacacuuuugau

SEQ ID NO: 2086822 - RNA, 21 nt, Staphylococcus aureus subsp. aureus MW2
uguacacuaucguuuuuauua

SEQ ID NO: 2086823 - RNA, 14 nt, Staphylococcus aureus subsp. aureus MW2
uguacauaugugua

SEQ ID NO: 2086824 - RNA, 14 nt, Staphylococcus aureus subsp. aureus MW2
uguacauaaaaaua

SEQ ID NO: 2086825 - RNA, 20 nt, Staphylococcus aureus subsp. aureus MW2
uguaucuuugauaacuugua

SEQ ID NO: 2086826 - RNA, 18 nt, Staphylococcus aureus subsp. aureus MW2
ugucaucauguucuaaug

SEQ ID NO: 2086827 - RNA, 15 nt, Staphylococcus aureus subsp. aureus MW2
ugucaucauguucua

SEQ ID NO: 2086828 - RNA, 12 nt, Staphylococcus aureus subsp. aureus MW2
ugucaucgcuuu

SEQ ID NO: 2086829 - RNA, 16 nt, Staphylococcus aureus subsp. aureus MW2
ugucaucgcuuuaauu

SEQ ID NO: 2086830 - RNA, 20 nt, Staphylococcus aureus subsp. aureus MW2
ugucaugaauuuucaucauu

SEQ ID NO: 2086831 - RNA, 14 nt, Staphylococcus aureus subsp. aureus MW2
ugucaucuuuauac

SEQ ID NO: 2086832 - RNA, 15 nt, Staphylococcus aureus subsp. aureus MW2
ugucaugccuucauu

SEQ ID NO: 2086833 - RNA, 15 nt, Staphylococcus aureus subsp. aureus MW2
ugucauuucaaucau

SEQ ID NO: 2086834 - RNA, 18 nt, Staphylococcus aureus subsp. aureus MW2
uguccaaauaaauauaaa

SEQ ID NO: 2086835 - RNA, 17 nt, Staphylococcus aureus subsp. aureus MW2
ugucauucuucaucgca

SEQ ID NO: 2086836 - RNA, 20 nt, Staphylococcus aureus subsp. aureus MW2
ugucaugucuagauuucaaa

SEQ ID NO: 2086837 - RNA, 17 nt, Staphylococcus aureus subsp. aureus MW2
uguccacuauauccuuu

SEQ ID NO: 2086838 - RNA, 22 nt, Staphylococcus aureus subsp. aureus MW2
ugucccacucccaaaaagacag

SEQ ID NO: 2086839 - RNA, 13 nt, Staphylococcus aureus subsp. aureus MW2
uguccucuaaaac

SEQ ID NO: 2086840 - RNA, 18 nt, Staphylococcus aureus subsp. aureus MW2
uguccucuaaaacauguu

SEQ ID NO: 2086841 - RNA, 22 nt, Staphylococcus aureus subsp. aureus MW2
uguccucuaaaacauguugaua

SEQ ID NO: 2086842 - RNA, 16 nt, Staphylococcus aureus subsp. aureus MW2
uguccuagacucuaaa

SEQ ID NO: 2086843 - RNA, 22 nt, Staphylococcus aureus subsp. aureus MW2
uguccuaacgcuaauuuuacuc

SEQ ID NO: 2086844 - RNA, 21 nt, Staphylococcus aureus subsp. aureus MW2
uguccuaacgcuaauuuuacu

SEQ ID NO: 2086845 - RNA, 17 nt, Staphylococcus aureus subsp. aureus MW2
uguccguucgcaucuuu

SEQ ID NO: 2086846 - RNA, 14 nt, Staphylococcus aureus subsp. aureus MW2
uguccgauaucuuu

SEQ ID NO: 2086847 - RNA, 14 nt, Staphylococcus aureus subsp. aureus MW2
ugucgauauuucua

SEQ ID NO: 2086848 - RNA, 21 nt, Staphylococcus aureus subsp. aureus MW2
ugucgcaaauuuccacagcaa

SEQ ID NO: 2086849 - RNA, 22 nt, Staphylococcus aureus subsp. aureus MW2
ugucgaaucaaaguaucuuuug

SEQ ID NO: 2086850 - RNA, 23 nt, Staphylococcus aureus subsp. aureus MW2
ugucgaaaauagcuauuaaaaua

SEQ ID NO: 2086851 - RNA, 15 nt, Staphylococcus aureus subsp. aureus MW2
ugucguauucuucaa

SEQ ID NO: 2086852 - RNA, 22 nt, Staphylococcus aureus subsp. aureus MW2
ugucucagauucauaucuuuca

SEQ ID NO: 2086853 - RNA, 17 nt, Staphylococcus aureus subsp. aureus MW2
ugucucucuuucuuauu

SEQ ID NO: 2086854 - RNA, 16 nt, Staphylococcus aureus subsp. aureus MW2
ugucuagacuuauuug

SEQ ID NO: 2086855 - RNA, 19 nt, Staphylococcus aureus subsp. aureus MW2
ugucuaguucgauuuuuua

SEQ ID NO: 2086856 - RNA, 14 nt, Staphylococcus aureus subsp. aureus MW2
ugucuauuguaaaa

SEQ ID NO: 2086857 - RNA, 20 nt, Staphylococcus aureus subsp. aureus MW2
ugucuuaucaauuagccaau

SEQ ID NO: 2086858 - RNA, 19 nt, Staphylococcus aureus subsp. aureus MW2
ugucuuccaaucaacuuca

SEQ ID NO: 2086859 - RNA, 12 nt, Staphylococcus aureus subsp. aureus MW2
ugucuguagaaa

SEQ ID NO: 2086860 - RNA, 17 nt, Staphylococcus aureus subsp. aureus MW2
ugucuuuuguuaugaua

SEQ ID NO: 2086861 - RNA, 20 nt, Staphylococcus aureus subsp. aureus MW2
ugucuuuucauuuuuuagau

SEQ ID NO: 2086862 - RNA, 19 nt, Staphylococcus aureus subsp. aureus MW2
ugugaaaaagcuaauucuu

SEQ ID NO: 2086863 - RNA, 14 nt, Staphylococcus aureus subsp. aureus MW2
ugucuuuuuuaaag

SEQ ID NO: 2086864 - RNA, 20 nt, Staphylococcus aureus subsp. aureus MW2
ugucuuuuuuaaagaggcag

SEQ ID NO: 2086865 - RNA, 13 nt, Staphylococcus aureus subsp. aureus MW2
ugugacaauuuaa

SEQ ID NO: 2086866 - RNA, 13 nt, Staphylococcus aureus subsp. aureus MW2
ugugaaaauacca

SEQ ID NO: 2086867 - RNA, 15 nt, Staphylococcus aureus subsp. aureus MW2
ugugaauaaaauugu

SEQ ID NO: 2086868 - RNA, 18 nt, Staphylococcus aureus subsp. aureus MW2
ugugauauaugaaauauu

SEQ ID NO: 2086869 - RNA, 14 nt, Staphylococcus aureus subsp. aureus MW2
ugugauaauucuuc

SEQ ID NO: 2086870 - RNA, 15 nt, Staphylococcus aureus subsp. aureus MW2
ugugauacuuucuaa

SEQ ID NO: 2086871 - RNA, 19 nt, Staphylococcus aureus subsp. aureus MW2
ugugauuuguuacuucuaa

SEQ ID NO: 2086872 - RNA, 15 nt, Staphylococcus aureus subsp. aureus MW2
ugugauuuuuugaua

SEQ ID NO: 2086873 - RNA, 16 nt, Staphylococcus aureus subsp. aureus MW2
ugugauuaugcauaug

SEQ ID NO: 2086874 - RNA, 18 nt, Staphylococcus aureus subsp. aureus MW2
ugugauuuguuacuucua

SEQ ID NO: 2086875 - RNA, 15 nt, Staphylococcus aureus subsp. aureus MW2
ugugauuuguuacuu

SEQ ID NO: 2086876 - RNA, 18 nt, Staphylococcus aureus subsp. aureus MW2
ugugcaaguuggcggggc

SEQ ID NO: 2086877 - RNA, 13 nt, Staphylococcus aureus subsp. aureus MW2
ugugcuuaagaac

SEQ ID NO: 2086878 - RNA, 17 nt, Staphylococcus aureus subsp. aureus MW2
uguggauuuaauuuuua

SEQ ID NO: 2086879 - RNA, 23 nt, Staphylococcus aureus subsp. aureus MW2
ugugcuuuucgcuuuucuaauuu

SEQ ID NO: 2086880 - RNA, 15 nt, Staphylococcus aureus subsp. aureus MW2
uguggacaaacugau

SEQ ID NO: 2086881 - RNA, 21 nt, Staphylococcus aureus subsp. aureus MW2
uguggacaaacugauuuuuua

SEQ ID NO: 2086882 - RNA, 19 nt, Staphylococcus aureus subsp. aureus MW2
uguguaccuuuuuauugau

SEQ ID NO: 2086883 - RNA, 17 nt, Staphylococcus aureus subsp. aureus MW2
uguguuacacaugcauc

SEQ ID NO: 2086884 - RNA, 21 nt, Staphylococcus aureus subsp. aureus MW2
uguguaacauuacguucuaau

SEQ ID NO: 2086885 - RNA, 23 nt, Staphylococcus aureus subsp. aureus MW2
uguuacuaguuuguaauaauuaa

SEQ ID NO: 2086886 - RNA, 11 nt, Staphylococcus aureus subsp. aureus MW2
uguuacauuug

SEQ ID NO: 2086887 - RNA, 16 nt, Staphylococcus aureus subsp. aureus MW2
uguuacacuuuucuua

SEQ ID NO: 2086888 - RNA, 15 nt, Staphylococcus aureus subsp. aureus MW2
uguuacacuuuucuu

SEQ ID NO: 2086889 - RNA, 17 nt, Staphylococcus aureus subsp. aureus MW2
uguuacacaaauuaaaa

SEQ ID NO: 2086890 - RNA, 22 nt, Staphylococcus aureus subsp. aureus MW2
uguuacauauugcauuuagacu

SEQ ID NO: 2086891 - RNA, 18 nt, Staphylococcus aureus subsp. aureus MW2
uguuaauuucaacauuac

SEQ ID NO: 2086892 - RNA, 16 nt, Staphylococcus aureus subsp. aureus MW2
uguuaauuuaauaauu

SEQ ID NO: 2086893 - RNA, 16 nt, Staphylococcus aureus subsp. aureus MW2
uguuaauuuuuuauua

SEQ ID NO: 2086894 - RNA, 17 nt, Staphylococcus aureus subsp. aureus MW2
uguuaauuuuuuauuaa

SEQ ID NO: 2086895 - RNA, 20 nt, Staphylococcus aureus subsp. aureus MW2
uguguugaaacugaguucaa

SEQ ID NO: 2086896 - RNA, 19 nt, Staphylococcus aureus subsp. aureus MW2
uguguucggaauuugcaca

SEQ ID NO: 2086897 - RNA, 13 nt, Staphylococcus aureus subsp. aureus MW2
uguguugcaauug

SEQ ID NO: 2086898 - RNA, 20 nt, Staphylococcus aureus subsp. aureus MW2
uguuaaugcuucguaaucuu

SEQ ID NO: 2086899 - RNA, 20 nt, Staphylococcus aureus subsp. aureus MW2
uguuaaucaaaauucugacu

SEQ ID NO: 2086900 - RNA, 16 nt, Staphylococcus aureus subsp. aureus MW2
uguguuggggcccauc

SEQ ID NO: 2086901 - RNA, 20 nt, Staphylococcus aureus subsp. aureus MW2
uguuauauuguauuuuauuu

SEQ ID NO: 2086902 - RNA, 14 nt, Staphylococcus aureus subsp. aureus MW2
uguuauauuaugaa

SEQ ID NO: 2086903 - RNA, 16 nt, Staphylococcus aureus subsp. aureus MW2
uguuauauuaugaaca

SEQ ID NO: 2086904 - RNA, 19 nt, Staphylococcus aureus subsp. aureus MW2
uguuauauuaugaacauga

SEQ ID NO: 2086905 - RNA, 20 nt, Staphylococcus aureus subsp. aureus MW2
uguuauauuaugaacaugaa

SEQ ID NO: 2086906 - RNA, 11 nt, Staphylococcus aureus subsp. aureus MW2
uguuauaaaau

SEQ ID NO: 2086907 - RNA, 17 nt, Staphylococcus aureus subsp. aureus MW2
uguuauaacccuaauuc

SEQ ID NO: 2086908 - RNA, 20 nt, Staphylococcus aureus subsp. aureus MW2
uguuauaacccuaauucuuu

SEQ ID NO: 2086909 - RNA, 13 nt, Staphylococcus aureus subsp. aureus MW2
uguuagauuucaa

SEQ ID NO: 2086910 - RNA, 14 nt, Staphylococcus aureus subsp. aureus MW2
uguuagauuucaaa

SEQ ID NO: 2086911 - RNA, 19 nt, Staphylococcus aureus subsp. aureus MW2
uguuaggagagauguauaa

SEQ ID NO: 2086912 - RNA, 22 nt, Staphylococcus aureus subsp. aureus MW2
uguuaggagagauguauaaaac

SEQ ID NO: 2086913 - RNA, 16 nt, Staphylococcus aureus subsp. aureus MW2
uguuaggggcucuuau

SEQ ID NO: 2086914 - RNA, 22 nt, Staphylococcus aureus subsp. aureus MW2
uguucaaauaacgcaaugucuu

SEQ ID NO: 2086915 - RNA, 16 nt, Staphylococcus aureus subsp. aureus MW2
uguucuuaacaauauc

SEQ ID NO: 2086916 - RNA, 22 nt, Staphylococcus aureus subsp. aureus MW2
uguucuuaacaauaucaucuaa

SEQ ID NO: 2086917 - RNA, 22 nt, Staphylococcus aureus subsp. aureus MW2
uguucuugaaaacaauaaauuu

SEQ ID NO: 2086918 - RNA, 21 nt, Staphylococcus aureus subsp. aureus MW2
uguucuucugcauagcgcucu

SEQ ID NO: 2086919 - RNA, 19 nt, Staphylococcus aureus subsp. aureus MW2
uguugaaaaugacuaccug

SEQ ID NO: 2086920 - RNA, 22 nt, Staphylococcus aureus subsp. aureus MW2
uguugacauuugaccaaguaug

SEQ ID NO: 2086921 - RNA, 19 nt, Staphylococcus aureus subsp. aureus MW2
uguugacauuugaccaagu

SEQ ID NO: 2086922 - RNA, 22 nt, Staphylococcus aureus subsp. aureus MW2
uguugaggcguuucagaaguug

SEQ ID NO: 2086923 - RNA, 14 nt, Staphylococcus aureus subsp. aureus MW2
uguugagaaacuuu

SEQ ID NO: 2086924 - RNA, 19 nt, Staphylococcus aureus subsp. aureus MW2
uguugcccgcuuauugcau

SEQ ID NO: 2086925 - RNA, 20 nt, Staphylococcus aureus subsp. aureus MW2
uguugaucaugagauaaacg

SEQ ID NO: 2086926 - RNA, 16 nt, Staphylococcus aureus subsp. aureus MW2
uguucugcuuuuucuu

SEQ ID NO: 2086927 - RNA, 17 nt, Staphylococcus aureus subsp. aureus MW2
uguucgggaauuuuuua

SEQ ID NO: 2086928 - RNA, 15 nt, Staphylococcus aureus subsp. aureus MW2
uggugcccaaguuuc

SEQ ID NO: 2086929 - RNA, 14 nt, Staphylococcus aureus subsp. aureus MW2
uggugcuuuuuuaa

SEQ ID NO: 2086930 - RNA, 17 nt, Staphylococcus aureus subsp. aureus MW2
uggugcuauuuuugacu

SEQ ID NO: 2086931 - RNA, 17 nt, Staphylococcus aureus subsp. aureus MW2
uggugcuauuaauuuga

SEQ ID NO: 2086932 - RNA, 13 nt, Staphylococcus aureus subsp. aureus MW2
uggucuuuuaaua

SEQ ID NO: 2086933 - RNA, 15 nt, Staphylococcus aureus subsp. aureus MW2
uggucuuuuaauauu

SEQ ID NO: 2086934 - RNA, 13 nt, Staphylococcus aureus subsp. aureus MW2
uggucuuucuuag

SEQ ID NO: 2086935 - RNA, 15 nt, Staphylococcus aureus subsp. aureus MW2
ugguauuuuuuaaau

SEQ ID NO: 2086936 - RNA, 14 nt, Staphylococcus aureus subsp. aureus MW2
ugguauuuuuuaaa

SEQ ID NO: 2086937 - RNA, 14 nt, Staphylococcus aureus subsp. aureus MW2
ugguaggcauuuua

SEQ ID NO: 2086938 - RNA, 22 nt, Staphylococcus aureus subsp. aureus MW2
uggucaccuacagauaaagcuu

SEQ ID NO: 2086939 - RNA, 13 nt, Staphylococcus aureus subsp. aureus MW2
ugguagcauuuua

SEQ ID NO: 2086940 - RNA, 17 nt, Staphylococcus aureus subsp. aureus MW2
ugguagcauuuuagauu

SEQ ID NO: 2086941 - RNA, 20 nt, Staphylococcus aureus subsp. aureus MW2
ugguaacucuucaguacgaa

SEQ ID NO: 2086942 - RNA, 19 nt, Staphylococcus aureus subsp. aureus MW2
ugguaagcuuagaaacgaa

SEQ ID NO: 2086943 - RNA, 23 nt, Staphylococcus aureus subsp. aureus MW2
uggggugagggccccaacacaga

SEQ ID NO: 2086944 - RNA, 13 nt, Staphylococcus aureus subsp. aureus MW2
ugggguuuuauuu

SEQ ID NO: 2086945 - RNA, 13 nt, Staphylococcus aureus subsp. aureus MW2
uguaauucuugua

SEQ ID NO: 2086946 - RNA, 22 nt, Staphylococcus aureus subsp. aureus MW2
uguaauucuuguaaaucauagu

SEQ ID NO: 2086947 - RNA, 13 nt, Staphylococcus aureus subsp. aureus MW2
uguaauuaggauu

SEQ ID NO: 2086948 - RNA, 18 nt, Staphylococcus aureus subsp. aureus MW2
uguaauuauugcaucaua

SEQ ID NO: 2086949 - RNA, 20 nt, Staphylococcus aureus subsp. aureus MW2
uguaauuauugcaucauaau

SEQ ID NO: 2086950 - RNA, 21 nt, Staphylococcus aureus subsp. aureus MW2
uguaaugcuuaaaaacaauau

SEQ ID NO: 2086951 - RNA, 16 nt, Staphylococcus aureus subsp. aureus MW2
uguaaugcuucuucua

SEQ ID NO: 2086952 - RNA, 22 nt, Staphylococcus aureus subsp. aureus MW2
uguaaugaguaggcucuuaaug

SEQ ID NO: 2086953 - RNA, 18 nt, Staphylococcus aureus subsp. aureus MW2
uguaaugcacuaccauca

SEQ ID NO: 2086954 - RNA, 21 nt, Staphylococcus aureus subsp. aureus MW2
uguaaugcacuaccaucagua

SEQ ID NO: 2086955 - RNA, 19 nt, Staphylococcus aureus subsp. aureus MW2
uguaaucucguuuuuacau

SEQ ID NO: 2086956 - RNA, 23 nt, Staphylococcus aureus subsp. aureus MW2
uguaaucacuauuuguuguuaua

SEQ ID NO: 2086957 - RNA, 13 nt, Staphylococcus aureus subsp. aureus MW2
uguaaguuugguu

SEQ ID NO: 2086958 - RNA, 15 nt, Staphylococcus aureus subsp. aureus MW2
uguaauaugaaggcu

SEQ ID NO: 2086959 - RNA, 20 nt, Staphylococcus aureus subsp. aureus MW2
uguaagucgcucuagacauu

SEQ ID NO: 2086960 - RNA, 12 nt, Staphylococcus aureus subsp. aureus MW2
uguaaaaaauau

SEQ ID NO: 2086961 - RNA, 13 nt, Staphylococcus aureus subsp. aureus MW2
uguaaaaaauauc

SEQ ID NO: 2086962 - RNA, 23 nt, Staphylococcus aureus subsp. aureus MW2
uguaaaaaagcugauuucuauua

SEQ ID NO: 2086963 - RNA, 16 nt, Staphylococcus aureus subsp. aureus MW2
uguaaaaacguucaau

SEQ ID NO: 2086964 - RNA, 14 nt, Staphylococcus aureus subsp. aureus MW2
uguaaaugaaaugg

SEQ ID NO: 2086965 - RNA, 23 nt, Staphylococcus aureus subsp. aureus MW2
uguaaaugaaagcaccuaaaaua

SEQ ID NO: 2086966 - RNA, 14 nt, Staphylococcus aureus subsp. aureus MW2
uguaaauuacaaaa

SEQ ID NO: 2086967 - RNA, 17 nt, Staphylococcus aureus subsp. aureus MW2
ugguuuugauuaaacug

SEQ ID NO: 2086968 - RNA, 14 nt, Staphylococcus aureus subsp. aureus MW2
ugguuuuuaaaagu

SEQ ID NO: 2086969 - RNA, 22 nt, Staphylococcus aureus subsp. aureus MW2
uguaagcuaucguaaacaacau

SEQ ID NO: 2086970 - RNA, 13 nt, Staphylococcus aureus subsp. aureus MW2
uguaacaauauaa

SEQ ID NO: 2086971 - RNA, 22 nt, Staphylococcus aureus subsp. aureus MW2
uguaacauaaagcuguuuauug

SEQ ID NO: 2086972 - RNA, 20 nt, Staphylococcus aureus subsp. aureus MW2
uguaacaaaauacccugcuu

SEQ ID NO: 2086973 - RNA, 19 nt, Staphylococcus aureus subsp. aureus MW2
uguaaauugguauaacaau

SEQ ID NO: 2086974 - RNA, 20 nt, Staphylococcus aureus subsp. aureus MW2
ugguuugugauuuuuugaua

SEQ ID NO: 2086975 - RNA, 12 nt, Staphylococcus aureus subsp. aureus MW2
ugguuuuauuaa

SEQ ID NO: 2086976 - RNA, 23 nt, Staphylococcus aureus subsp. aureus MW2
ugguuuuauuugauuauucuuca

SEQ ID NO: 2086977 - RNA, 18 nt, Staphylococcus aureus subsp. aureus MW2
ugguuucauaaacugaau

SEQ ID NO: 2086978 - RNA, 21 nt, Staphylococcus aureus subsp. aureus MW2
ugguuucuuaacauaaaauga

SEQ ID NO: 2086979 - RNA, 14 nt, Staphylococcus aureus subsp. aureus MW2
ugguuguucuuuuu

SEQ ID NO: 2086980 - RNA, 11 nt, Staphylococcus aureus subsp. aureus MW2
ugguuuaaaaa

SEQ ID NO: 2086981 - RNA, 15 nt, Staphylococcus aureus subsp. aureus MW2
ugguuuaaugagcuu

SEQ ID NO: 2086982 - RNA, 22 nt, Staphylococcus aureus subsp. aureus MW2
ugguuuaauugcaaaugcucua

SEQ ID NO: 2086983 - RNA, 19 nt, Staphylococcus aureus subsp. aureus MW2
ugguuuaucagcuuuaaua

SEQ ID NO: 2086984 - RNA, 15 nt, Staphylococcus aureus subsp. aureus MW2
ugguugcuucuuauc

SEQ ID NO: 2086985 - RNA, 11 nt, Staphylococcus aureus subsp. aureus MW2
ugguucuucac

SEQ ID NO: 2086986 - RNA, 21 nt, Staphylococcus aureus subsp. aureus MW2
ugguucuucacuaaaaauaua

SEQ ID NO: 2086987 - RNA, 18 nt, Staphylococcus aureus subsp. aureus MW2
ugguucugauguuuuaua

SEQ ID NO: 2086988 - RNA, 19 nt, Staphylococcus aureus subsp. aureus MW2
ugguucugauguuuuauaa

SEQ ID NO: 2086989 - RNA, 19 nt, Staphylococcus aureus subsp. aureus MW2
ugguugauucgauaugaau

SEQ ID NO: 2086990 - RNA, 11 nt, Staphylococcus aureus subsp. aureus MW2
ugguucccaau

SEQ ID NO: 2086991 - RNA, 19 nt, Staphylococcus aureus subsp. aureus MW2
ugguucaucaaacaacauc

SEQ ID NO: 2086992 - RNA, 18 nt, Staphylococcus aureus subsp. aureus MW2
uggcggggcccaaacaua

SEQ ID NO: 2086993 - RNA, 18 nt, Staphylococcus aureus subsp. aureus MW2
uggaaaaggucaaaaaau

SEQ ID NO: 2086994 - RNA, 12 nt, Staphylococcus aureus subsp. aureus MW2
uggaaaaucccu

SEQ ID NO: 2086995 - RNA, 18 nt, Staphylococcus aureus subsp. aureus MW2
uggcuacuugaauaccuu

SEQ ID NO: 2086996 - RNA, 22 nt, Staphylococcus aureus subsp. aureus MW2
uggcuagucuuuaacuuuaauu

SEQ ID NO: 2086997 - RNA, 15 nt, Staphylococcus aureus subsp. aureus MW2
uggcucuuuuuauuu

SEQ ID NO: 2086998 - RNA, 16 nt, Staphylococcus aureus subsp. aureus MW2
uggcgugcuuuucaaa

SEQ ID NO: 2086999 - RNA, 18 nt, Staphylococcus aureus subsp. aureus MW2
ugggacgacgaaauaaau

SEQ ID NO: 2087000 - RNA, 14 nt, Staphylococcus aureus subsp. aureus MW2
ugggacuuuuuaua

SEQ ID NO: 2087001 - RNA, 17 nt, Staphylococcus aureus subsp. aureus MW2
ugggaauuguauuagca

SEQ ID NO: 2087002 - RNA, 16 nt, Staphylococcus aureus subsp. aureus MW2
ugggacauaaaucaau

SEQ ID NO: 2087003 - RNA, 17 nt, Staphylococcus aureus subsp. aureus MW2
ugggacauaaaucaaug

SEQ ID NO: 2087004 - RNA, 15 nt, Staphylococcus aureus subsp. aureus MW2
ugggccccaacaaag

SEQ ID NO: 2087005 - RNA, 16 nt, Staphylococcus aureus subsp. aureus MW2
ugggccccaacacaga

SEQ ID NO: 2087006 - RNA, 18 nt, Staphylococcus aureus subsp. aureus MW2
uggcuuguuaagcagcuu

SEQ ID NO: 2087007 - RNA, 15 nt, Staphylococcus aureus subsp. aureus MW2
uggcuuaaaucaaau

SEQ ID NO: 2087008 - RNA, 21 nt, Staphylococcus aureus subsp. aureus MW2
uucaguacgguuauuuaauaa

SEQ ID NO: 2087009 - RNA, 17 nt, Staphylococcus aureus subsp. aureus MW2
uucaguacgaacaacua

SEQ ID NO: 2087010 - RNA, 22 nt, Staphylococcus aureus subsp. aureus MW2
uucaguacgguuauuuaauaau

SEQ ID NO: 2087011 - RNA, 21 nt, Staphylococcus aureus subsp. aureus MW2
uucaguaacguacuguguaau

SEQ ID NO: 2087012 - RNA, 19 nt, Staphylococcus aureus subsp. aureus MW2
uucaguaacguacugugua

SEQ ID NO: 2087013 - RNA, 23 nt, Staphylococcus aureus subsp. aureus MW2
uucagggaaguuacguucuaaua

SEQ ID NO: 2087014 - RNA, 22 nt, Staphylococcus aureus subsp. aureus MW2
uucaggaucacgugguuucuuu

SEQ ID NO: 2087015 - RNA, 22 nt, Staphylococcus aureus subsp. aureus MW2
uucagcuaauucgucuacauau

SEQ ID NO: 2087016 - RNA, 14 nt, Staphylococcus aureus subsp. aureus MW2
uucauacgcuauug

SEQ ID NO: 2087017 - RNA, 19 nt, Staphylococcus aureus subsp. aureus MW2
uucauacguucaaucgcau

SEQ ID NO: 2087018 - RNA, 14 nt, Staphylococcus aureus subsp. aureus MW2
uucauaauuuguug

SEQ ID NO: 2087019 - RNA, 14 nt, Staphylococcus aureus subsp. aureus MW2
uucauaauuaauaa

SEQ ID NO: 2087020 - RNA, 16 nt, Staphylococcus aureus subsp. aureus MW2
uucauaaugaucaagu

SEQ ID NO: 2087021 - RNA, 17 nt, Staphylococcus aureus subsp. aureus MW2
uucauacacugcacauc

SEQ ID NO: 2087022 - RNA, 22 nt, Staphylococcus aureus subsp. aureus MW2
uucauacacugcacaucauaau

SEQ ID NO: 2087023 - RNA, 19 nt, Staphylococcus aureus subsp. aureus MW2
uucauacacuuuaacauaa

SEQ ID NO: 2087024 - RNA, 20 nt, Staphylococcus aureus subsp. aureus MW2
uucaucaaauccaaaaucuu

SEQ ID NO: 2087025 - RNA, 15 nt, Staphylococcus aureus subsp. aureus MW2
uucaucaaacaacau

SEQ ID NO: 2087026 - RNA, 22 nt, Staphylococcus aureus subsp. aureus MW2
uucauauuuagguaauacauca

SEQ ID NO: 2087027 - RNA, 20 nt, Staphylococcus aureus subsp. aureus MW2
uucauauauuuuguuaauaa

SEQ ID NO: 2087028 - RNA, 14 nt, Staphylococcus aureus subsp. aureus MW2
uucauaguuuaugu

SEQ ID NO: 2087029 - RNA, 13 nt, Staphylococcus aureus subsp. aureus MW2
uucauauuaacug

SEQ ID NO: 2087030 - RNA, 14 nt, Staphylococcus aureus subsp. aureus MW2
uucauaucuuucaa

SEQ ID NO: 2087031 - RNA, 17 nt, Staphylococcus aureus subsp. aureus MW2
uucaguucaaacagaaa

SEQ ID NO: 2087032 - RNA, 22 nt, Staphylococcus aureus subsp. aureus MW2
uucaguguagacuauaggucuu

SEQ ID NO: 2087033 - RNA, 14 nt, Staphylococcus aureus subsp. aureus MW2
uucauaagaaaaau

SEQ ID NO: 2087034 - RNA, 23 nt, Staphylococcus aureus subsp. aureus MW2
uucauaaauuguuuuacaugauu

SEQ ID NO: 2087035 - RNA, 21 nt, Staphylococcus aureus subsp. aureus MW2
uucauaacaacaucaaaaccc

SEQ ID NO: 2087036 - RNA, 19 nt, Staphylococcus aureus subsp. aureus MW2
uucauaaucucuuuacacc

SEQ ID NO: 2087037 - RNA, 14 nt, Staphylococcus aureus subsp. aureus MW2
uucauaaugaucaa

SEQ ID NO: 2087038 - RNA, 22 nt, Staphylococcus aureus subsp. aureus MW2
uucauaagucuuaacaaauuaa

SEQ ID NO: 2087039 - RNA, 16 nt, Staphylococcus aureus subsp. aureus MW2
uucaguuuuguauuca

SEQ ID NO: 2087040 - RNA, 12 nt, Staphylococcus aureus subsp. aureus MW2
uucauaaagcgg

SEQ ID NO: 2087041 - RNA, 16 nt, Staphylococcus aureus subsp. aureus MW2
uucauaaaauuuaaaa

SEQ ID NO: 2087042 - RNA, 19 nt, Staphylococcus aureus subsp. aureus MW2
uucauaaaauuuaaaacaa

SEQ ID NO: 2087043 - RNA, 14 nt, Staphylococcus aureus subsp. aureus MW2
uucaugaauaauua

SEQ ID NO: 2087044 - RNA, 14 nt, Staphylococcus aureus subsp. aureus MW2
uucaugaacagcau

SEQ ID NO: 2087045 - RNA, 21 nt, Staphylococcus aureus subsp. aureus MW2
uucaucuugcaaguauuuucu

SEQ ID NO: 2087046 - RNA, 13 nt, Staphylococcus aureus subsp. aureus MW2
uucaucuuaucaa

SEQ ID NO: 2087047 - RNA, 20 nt, Staphylococcus aureus subsp. aureus MW2
uucaucuucaaacagacuua

SEQ ID NO: 2087048 - RNA, 16 nt, Staphylococcus aureus subsp. aureus MW2
uucaucuucuucaaaa

SEQ ID NO: 2087049 - RNA, 18 nt, Staphylococcus aureus subsp. aureus MW2
uucaucguucauauauuu

SEQ ID NO: 2087050 - RNA, 22 nt, Staphylococcus aureus subsp. aureus MW2
uucaucugguauuuuaugacgu

SEQ ID NO: 2087051 - RNA, 19 nt, Staphylococcus aureus subsp. aureus MW2
uucaucucuuauaaguuca

SEQ ID NO: 2087052 - RNA, 14 nt, Staphylococcus aureus subsp. aureus MW2
uucauuguaaauuu

SEQ ID NO: 2087053 - RNA, 17 nt, Staphylococcus aureus subsp. aureus MW2
uucauugcguaagguau

SEQ ID NO: 2087054 - RNA, 23 nt, Staphylococcus aureus subsp. aureus MW2
uucauugaagaauauaaacuauu

SEQ ID NO: 2087055 - RNA, 17 nt, Staphylococcus aureus subsp. aureus MW2
uucauuuucaaauaacu

SEQ ID NO: 2087056 - RNA, 16 nt, Staphylococcus aureus subsp. aureus MW2
uucauuuuaaauuuaa

SEQ ID NO: 2087057 - RNA, 13 nt, Staphylococcus aureus subsp. aureus MW2
uucauguuuaaaa

SEQ ID NO: 2087058 - RNA, 21 nt, Staphylococcus aureus subsp. aureus MW2
uucauguuugauucuaaauaa

SEQ ID NO: 2087059 - RNA, 19 nt, Staphylococcus aureus subsp. aureus MW2
uucaugugucauaauccau

SEQ ID NO: 2087060 - RNA, 16 nt, Staphylococcus aureus subsp. aureus MW2
uucauuacaaacauaa

SEQ ID NO: 2087061 - RNA, 19 nt, Staphylococcus aureus subsp. aureus MW2
uucauuacaaacauaauca

SEQ ID NO: 2087062 - RNA, 23 nt, Staphylococcus aureus subsp. aureus MW2
uucauuacaaacauaaucauaau

SEQ ID NO: 2087063 - RNA, 13 nt, Staphylococcus aureus subsp. aureus MW2
uucauuaacauca

SEQ ID NO: 2087064 - RNA, 14 nt, Staphylococcus aureus subsp. aureus MW2
uucauuaauacaag

SEQ ID NO: 2087065 - RNA, 16 nt, Staphylococcus aureus subsp. aureus MW2
uucauuauauaauucu

SEQ ID NO: 2087066 - RNA, 22 nt, Staphylococcus aureus subsp. aureus MW2
uucauuauagucuuaaacauaa

SEQ ID NO: 2087067 - RNA, 18 nt, Staphylococcus aureus subsp. aureus MW2
uucauuagccaaaucuuu

SEQ ID NO: 2087068 - RNA, 15 nt, Staphylococcus aureus subsp. aureus MW2
uucauguccaucuuu

SEQ ID NO: 2087069 - RNA, 17 nt, Staphylococcus aureus subsp. aureus MW2
uucaugucguuuucuua

SEQ ID NO: 2087070 - RNA, 14 nt, Staphylococcus aureus subsp. aureus MW2
uucaagcuuaauaa

SEQ ID NO: 2087071 - RNA, 21 nt, Staphylococcus aureus subsp. aureus MW2
uucaaguauauccgcaucuuu

SEQ ID NO: 2087072 - RNA, 19 nt, Staphylococcus aureus subsp. aureus MW2
uucaauaaaaaugguauuc

SEQ ID NO: 2087073 - RNA, 15 nt, Staphylococcus aureus subsp. aureus MW2
uucaaguuuaaaaua

SEQ ID NO: 2087074 - RNA, 22 nt, Staphylococcus aureus subsp. aureus MW2
uucaagugccauuuuuaaauua

SEQ ID NO: 2087075 - RNA, 21 nt, Staphylococcus aureus subsp. aureus MW2
uucaauaguaguauuaucuuu

SEQ ID NO: 2087076 - RNA, 12 nt, Staphylococcus aureus subsp. aureus MW2
uucaauaauuca

SEQ ID NO: 2087077 - RNA, 18 nt, Staphylococcus aureus subsp. aureus MW2
uucaaugauuuuuaaaaa

SEQ ID NO: 2087078 - RNA, 16 nt, Staphylococcus aureus subsp. aureus MW2
uucaaugaauucauuu

SEQ ID NO: 2087079 - RNA, 19 nt, Staphylococcus aureus subsp. aureus MW2
uucaauguaauuuucacuu

SEQ ID NO: 2087080 - RNA, 18 nt, Staphylococcus aureus subsp. aureus MW2
uucaaugucuacuuugaa

SEQ ID NO: 2087081 - RNA, 22 nt, Staphylococcus aureus subsp. aureus MW2
uucaaugucugcaucagaucua

SEQ ID NO: 2087082 - RNA, 19 nt, Staphylococcus aureus subsp. aureus MW2
uucaaugauuuuuaaaaau

SEQ ID NO: 2087083 - RNA, 12 nt, Staphylococcus aureus subsp. aureus MW2
uucaaucauuca

SEQ ID NO: 2087084 - RNA, 15 nt, Staphylococcus aureus subsp. aureus MW2
uucaaucauuugugu

SEQ ID NO: 2087085 - RNA, 19 nt, Staphylococcus aureus subsp. aureus MW2
uucaaucaucaagacauuu

SEQ ID NO: 2087086 - RNA, 22 nt, Staphylococcus aureus subsp. aureus MW2
uucaaucgcauuuuguuucaac

SEQ ID NO: 2087087 - RNA, 14 nt, Staphylococcus aureus subsp. aureus MW2
uucaauauuaaaau

SEQ ID NO: 2087088 - RNA, 21 nt, Staphylococcus aureus subsp. aureus MW2
uucaauauuacuuuaucucau

SEQ ID NO: 2087089 - RNA, 13 nt, Staphylococcus aureus subsp. aureus MW2
uucaauuuauuaa

SEQ ID NO: 2087090 - RNA, 21 nt, Staphylococcus aureus subsp. aureus MW2
uucaauuuaauguauugagaa

SEQ ID NO: 2087091 - RNA, 17 nt, Staphylococcus aureus subsp. aureus MW2
uucaauuuggaaauauc

SEQ ID NO: 2087092 - RNA, 16 nt, Staphylococcus aureus subsp. aureus MW2
uucaauguucaauuca

SEQ ID NO: 2087093 - RNA, 19 nt, Staphylococcus aureus subsp. aureus MW2
uucaauuaaugcaucagua

SEQ ID NO: 2087094 - RNA, 16 nt, Staphylococcus aureus subsp. aureus MW2
uucaauuaaauguuua

SEQ ID NO: 2087095 - RNA, 16 nt, Staphylococcus aureus subsp. aureus MW2
uucaauugacauuaau

SEQ ID NO: 2087096 - RNA, 15 nt, Staphylococcus aureus subsp. aureus MW2
uucaauucuuacacc

SEQ ID NO: 2087097 - RNA, 21 nt, Staphylococcus aureus subsp. aureus MW2
uucaauucgcucacaugugaa

SEQ ID NO: 2087098 - RNA, 13 nt, Staphylococcus aureus subsp. aureus MW2
uucaauuuuacca

SEQ ID NO: 2087099 - RNA, 18 nt, Staphylococcus aureus subsp. aureus MW2
uucacauuuauccuuuaa

SEQ ID NO: 2087100 - RNA, 13 nt, Staphylococcus aureus subsp. aureus MW2
uucacauuuaucc

SEQ ID NO: 2087101 - RNA, 17 nt, Staphylococcus aureus subsp. aureus MW2
uucacauucuugaauaa

SEQ ID NO: 2087102 - RNA, 22 nt, Staphylococcus aureus subsp. aureus MW2
uucacaugaauuuuaauauauu

SEQ ID NO: 2087103 - RNA, 18 nt, Staphylococcus aureus subsp. aureus MW2
uucacaucuuuagcuauu

SEQ ID NO: 2087104 - RNA, 19 nt, Staphylococcus aureus subsp. aureus MW2
uucacaucuuuagcuauuu

SEQ ID NO: 2087105 - RNA, 23 nt, Staphylococcus aureus subsp. aureus MW2
uucacauagccucuuaaaauacc

SEQ ID NO: 2087106 - RNA, 12 nt, Staphylococcus aureus subsp. aureus MW2
uucaccaauuag

SEQ ID NO: 2087107 - RNA, 16 nt, Staphylococcus aureus subsp. aureus MW2
uucagauuuguauuuu

SEQ ID NO: 2087108 - RNA, 15 nt, Staphylococcus aureus subsp. aureus MW2
uucagcauuugcugu

SEQ ID NO: 2087109 - RNA, 22 nt, Staphylococcus aureus subsp. aureus MW2
uucagcaucuacuaaaucaaau

SEQ ID NO: 2087110 - RNA, 22 nt, Staphylococcus aureus subsp. aureus MW2
uucagcaccagaacaauucaau

SEQ ID NO: 2087111 - RNA, 16 nt, Staphylococcus aureus subsp. aureus MW2
uucacuuuuuauauca

SEQ ID NO: 2087112 - RNA, 13 nt, Staphylococcus aureus subsp. aureus MW2
uucacuuuaacuu

SEQ ID NO: 2087113 - RNA, 24 nt, Staphylococcus aureus subsp. aureus MW2
uucacgauuucuuuaugauaauaa

SEQ ID NO: 2087114 - RNA, 19 nt, Staphylococcus aureus subsp. aureus MW2
uucacgauuuuuaaaaugc

SEQ ID NO: 2087115 - RNA, 21 nt, Staphylococcus aureus subsp. aureus MW2
uucacuaaauucaauaaucuu

SEQ ID NO: 2087116 - RNA, 20 nt, Staphylococcus aureus subsp. aureus MW2
uucacuaaauucaauaaucu

SEQ ID NO: 2087117 - RNA, 20 nt, Staphylococcus aureus subsp. aureus MW2
uucacguaauugaguuguug

SEQ ID NO: 2087118 - RNA, 23 nt, Staphylococcus aureus subsp. aureus MW2
uucacuucgccaagccaucuuuc

SEQ ID NO: 2087119 - RNA, 12 nt, Staphylococcus aureus subsp. aureus MW2
uucacuguuuua

SEQ ID NO: 2087120 - RNA, 14 nt, Staphylococcus aureus subsp. aureus MW2
uucacucuguaaua

SEQ ID NO: 2087121 - RNA, 23 nt, Staphylococcus aureus subsp. aureus MW2
uuccacaacaaucacgauuaaug

SEQ ID NO: 2087122 - RNA, 18 nt, Staphylococcus aureus subsp. aureus MW2
uuccaaucaacuucauau

SEQ ID NO: 2087123 - RNA, 19 nt, Staphylococcus aureus subsp. aureus MW2
uucauuuuggcaaaagcuu

SEQ ID NO: 2087124 - RNA, 11 nt, Staphylococcus aureus subsp. aureus MW2
uuccaaaaauu

SEQ ID NO: 2087125 - RNA, 18 nt, Staphylococcus aureus subsp. aureus MW2
uuccaaagaaagcuaaua

SEQ ID NO: 2087126 - RNA, 15 nt, Staphylococcus aureus subsp. aureus MW2
uuccaagcaucauug

SEQ ID NO: 2087127 - RNA, 16 nt, Staphylococcus aureus subsp. aureus MW2
uuccaaguuaaugcac

SEQ ID NO: 2087128 - RNA, 18 nt, Staphylococcus aureus subsp. aureus MW2
uuccaaauugaaauuauc

SEQ ID NO: 2087129 - RNA, 21 nt, Staphylococcus aureus subsp. aureus MW2
uuccaaauuggaaaucaacuu

SEQ ID NO: 2087130 - RNA, 16 nt, Staphylococcus aureus subsp. aureus MW2
uuccaacaacuaagau

SEQ ID NO: 2087131 - RNA, 16 nt, Staphylococcus aureus subsp. aureus MW2
uuccaacacccauaua

SEQ ID NO: 2087132 - RNA, 17 nt, Staphylococcus aureus subsp. aureus MW2
uuccauaaauaaaaugc

SEQ ID NO: 2087133 - RNA, 19 nt, Staphylococcus aureus subsp. aureus MW2
uuccauaaauaaaaugcua

SEQ ID NO: 2087134 - RNA, 21 nt, Staphylococcus aureus subsp. aureus MW2
uuccaucauuuguguaaauga

SEQ ID NO: 2087135 - RNA, 22 nt, Staphylococcus aureus subsp. aureus MW2
uuccauuucgauaccuaaaaua

SEQ ID NO: 2087136 - RNA, 22 nt, Staphylococcus aureus subsp. aureus MW2
uuccauucaucuggagacgaac

SEQ ID NO: 2087137 - RNA, 12 nt, Staphylococcus aureus subsp. aureus MW2
uuccauuucaaa

SEQ ID NO: 2087138 - RNA, 23 nt, Staphylococcus aureus subsp. aureus MW2
uuccauuucaaaugccucugcaa

SEQ ID NO: 2087139 - RNA, 13 nt, Staphylococcus aureus subsp. aureus MW2
uuccaugaauaag

SEQ ID NO: 2087140 - RNA, 19 nt, Staphylococcus aureus subsp. aureus MW2
uucccauuuuuaaaauuau

SEQ ID NO: 2087141 - RNA, 22 nt, Staphylococcus aureus subsp. aureus MW2
uucccaucuuuuagguaauaau

SEQ ID NO: 2087142 - RNA, 22 nt, Staphylococcus aureus subsp. aureus MW2
uucccagucaugucccauaaca

SEQ ID NO: 2087143 - RNA, 12 nt, Staphylococcus aureus subsp. aureus MW2
uucccuacugcu

SEQ ID NO: 2087144 - RNA, 15 nt, Staphylococcus aureus subsp. aureus MW2
uucccuggaaaauga

SEQ ID NO: 2087145 - RNA, 17 nt, Staphylococcus aureus subsp. aureus MW2
uucccuggaaaaugauu

SEQ ID NO: 2087146 - RNA, 23 nt, Staphylococcus aureus subsp. aureus MW2
uuccgcacugccuuuuuguaauu

SEQ ID NO: 2087147 - RNA, 16 nt, Staphylococcus aureus subsp. aureus MW2
uuccgccagucaucau

SEQ ID NO: 2087148 - RNA, 17 nt, Staphylococcus aureus subsp. aureus MW2
uucgcaucauucccugc

SEQ ID NO: 2087149 - RNA, 23 nt, Staphylococcus aureus subsp. aureus MW2
uucgcaucuuuguuuucaaacuu

SEQ ID NO: 2087150 - RNA, 14 nt, Staphylococcus aureus subsp. aureus MW2
uucgccuuuuuuau

SEQ ID NO: 2087151 - RNA, 14 nt, Staphylococcus aureus subsp. aureus MW2
uucgccuucuaaua

SEQ ID NO: 2087152 - RNA, 14 nt, Staphylococcus aureus subsp. aureus MW2
uucgcuuuucuaau

SEQ ID NO: 2087153 - RNA, 16 nt, Staphylococcus aureus subsp. aureus MW2
uucgcuuuucuaauuu

SEQ ID NO: 2087154 - RNA, 13 nt, Staphylococcus aureus subsp. aureus MW2
uucgauucauaaa

SEQ ID NO: 2087155 - RNA, 15 nt, Staphylococcus aureus subsp. aureus MW2
uucgauucauaaaau

SEQ ID NO: 2087156 - RNA, 16 nt, Staphylococcus aureus subsp. aureus MW2
uucgauuauucuuaau

SEQ ID NO: 2087157 - RNA, 19 nt, Staphylococcus aureus subsp. aureus MW2
uucgauaccuaaaauaccc

SEQ ID NO: 2087158 - RNA, 20 nt, Staphylococcus aureus subsp. aureus MW2
uucgacuacaaguuuauaau

SEQ ID NO: 2087159 - RNA, 15 nt, Staphylococcus aureus subsp. aureus MW2
uucgacuaguuugga

SEQ ID NO: 2087160 - RNA, 23 nt, Staphylococcus aureus subsp. aureus MW2
uucgaacgauauuuuaaaaagua

SEQ ID NO: 2087161 - RNA, 17 nt, Staphylococcus aureus subsp. aureus MW2
uucgaagucauaugcau

SEQ ID NO: 2087162 - RNA, 23 nt, Staphylococcus aureus subsp. aureus MW2
uuccuuuagcaaaaauauuuaaa

SEQ ID NO: 2087163 - RNA, 19 nt, Staphylococcus aureus subsp. aureus MW2
uuccuuuagcaaaaauauu

SEQ ID NO: 2087164 - RNA, 14 nt, Staphylococcus aureus subsp. aureus MW2
uucgaaauagguau

SEQ ID NO: 2087165 - RNA, 22 nt, Staphylococcus aureus subsp. aureus MW2
uuccuuguuuuaaacuuauuaa

SEQ ID NO: 2087166 - RNA, 17 nt, Staphylococcus aureus subsp. aureus MW2
uuccuucagucuucaug

SEQ ID NO: 2087167 - RNA, 16 nt, Staphylococcus aureus subsp. aureus MW2
uuccuauuaggaucca

SEQ ID NO: 2087168 - RNA, 23 nt, Staphylococcus aureus subsp. aureus MW2
uuccuacacuguuuuauaaauga

SEQ ID NO: 2087169 - RNA, 18 nt, Staphylococcus aureus subsp. aureus MW2
uuccuaccccgugaaucu

SEQ ID NO: 2087170 - RNA, 22 nt, Staphylococcus aureus subsp. aureus MW2
uuccuagcuuuuaugucuaguu

SEQ ID NO: 2087171 - RNA, 22 nt, Staphylococcus aureus subsp. aureus MW2
uuccucuggaacuuuaauacca

SEQ ID NO: 2087172 - RNA, 22 nt, Staphylococcus aureus subsp. aureus MW2
uuccucuccuucggcucucgcu

SEQ ID NO: 2087173 - RNA, 17 nt, Staphylococcus aureus subsp. aureus MW2
uuccugaaacaaugauu

SEQ ID NO: 2087174 - RNA, 21 nt, Staphylococcus aureus subsp. aureus MW2
uugccuggcaacguucuacuc

SEQ ID NO: 2087175 - RNA, 21 nt, Staphylococcus aureus subsp. aureus MW2
uugccugguaacguucuacuc

SEQ ID NO: 2087176 - RNA, 13 nt, Staphylococcus aureus subsp. aureus MW2
uugccuguagaau

SEQ ID NO: 2087177 - RNA, 18 nt, Staphylococcus aureus subsp. aureus MW2
uugccuguagaauuucuu

SEQ ID NO: 2087178 - RNA, 22 nt, Staphylococcus aureus subsp. aureus MW2
uugcgauuucuucugcuaacuc

SEQ ID NO: 2087179 - RNA, 18 nt, Staphylococcus aureus subsp. aureus MW2
uugcuauauuaguauaau

SEQ ID NO: 2087180 - RNA, 18 nt, Staphylococcus aureus subsp. aureus MW2
uugcuagugcucuugcaa

SEQ ID NO: 2087181 - RNA, 19 nt, Staphylococcus aureus subsp. aureus MW2
uugcucgcgcucuucuuca

SEQ ID NO: 2087182 - RNA, 22 nt, Staphylococcus aureus subsp. aureus MW2
uugccuaaaguauuaucuaauu

SEQ ID NO: 2087183 - RNA, 20 nt, Staphylococcus aureus subsp. aureus MW2
uugccuauuuuuuuauguua

SEQ ID NO: 2087184 - RNA, 11 nt, Staphylococcus aureus subsp. aureus MW2
uugcauaacca

SEQ ID NO: 2087185 - RNA, 13 nt, Staphylococcus aureus subsp. aureus MW2
uugcauauaaaaa

SEQ ID NO: 2087186 - RNA, 16 nt, Staphylococcus aureus subsp. aureus MW2
uuggaagccuucaaua

SEQ ID NO: 2087187 - RNA, 16 nt, Staphylococcus aureus subsp. aureus MW2
uuggaaucccaaugcu

SEQ ID NO: 2087188 - RNA, 23 nt, Staphylococcus aureus subsp. aureus MW2
uuggaaucaucuuuuugaaauuu

SEQ ID NO: 2087189 - RNA, 23 nt, Staphylococcus aureus subsp. aureus MW2
uuggaugaacaaaauaacauguu

SEQ ID NO: 2087190 - RNA, 17 nt, Staphylococcus aureus subsp. aureus MW2
uuggauucaaaugacau

SEQ ID NO: 2087191 - RNA, 22 nt, Staphylococcus aureus subsp. aureus MW2
uuggauaugcguauauguauaa

SEQ ID NO: 2087192 - RNA, 23 nt, Staphylococcus aureus subsp. aureus MW2
uuggcaauuguuuaucuccuaaa

SEQ ID NO: 2087193 - RNA, 15 nt, Staphylococcus aureus subsp. aureus MW2
uuggauuuuaacaag

SEQ ID NO: 2087194 - RNA, 20 nt, Staphylococcus aureus subsp. aureus MW2
uuggauuuuuugguuucuau

SEQ ID NO: 2087195 - RNA, 17 nt, Staphylococcus aureus subsp. aureus MW2
uuggauuuuaacaagau

SEQ ID NO: 2087196 - RNA, 14 nt, Staphylococcus aureus subsp. aureus MW2
uuggaaaaucccug

SEQ ID NO: 2087197 - RNA, 15 nt, Staphylococcus aureus subsp. aureus MW2
uugcugcuuuuccau

SEQ ID NO: 2087198 - RNA, 18 nt, Staphylococcus aureus subsp. aureus MW2
uugcuucauuauauaauu

SEQ ID NO: 2087199 - RNA, 14 nt, Staphylococcus aureus subsp. aureus MW2
uugcuuauguuuuu

SEQ ID NO: 2087200 - RNA, 19 nt, Staphylococcus aureus subsp. aureus MW2
uugcuuauuuuuguauucu

SEQ ID NO: 2087201 - RNA, 12 nt, Staphylococcus aureus subsp. aureus MW2
uugcuguaaaua

SEQ ID NO: 2087202 - RNA, 23 nt, Staphylococcus aureus subsp. aureus MW2
uugcugggcuaccgauugucaau

SEQ ID NO: 2087203 - RNA, 16 nt, Staphylococcus aureus subsp. aureus MW2
uuggcuugaaguuguu

SEQ ID NO: 2087204 - RNA, 17 nt, Staphylococcus aureus subsp. aureus MW2
uuggggaugggccccaa

SEQ ID NO: 2087205 - RNA, 23 nt, Staphylococcus aureus subsp. aureus MW2
uuggggaugggccccaacacaga

SEQ ID NO: 2087206 - RNA, 14 nt, Staphylococcus aureus subsp. aureus MW2
uugggguauagaaa

SEQ ID NO: 2087207 - RNA, 17 nt, Staphylococcus aureus subsp. aureus MW2
uugggguauagaaaaag

SEQ ID NO: 2087208 - RNA, 19 nt, Staphylococcus aureus subsp. aureus MW2
uuggcucuuuuuauuuaua

SEQ ID NO: 2087209 - RNA, 18 nt, Staphylococcus aureus subsp. aureus MW2
uugguuuggauaaaauga

SEQ ID NO: 2087210 - RNA, 23 nt, Staphylococcus aureus subsp. aureus MW2
uuguaaaagugaauaauugagaa

SEQ ID NO: 2087211 - RNA, 19 nt, Staphylococcus aureus subsp. aureus MW2
uugguugaaugaacaugua

SEQ ID NO: 2087212 - RNA, 19 nt, Staphylococcus aureus subsp. aureus MW2
uuggguaagguuuuacaau

SEQ ID NO: 2087213 - RNA, 14 nt, Staphylococcus aureus subsp. aureus MW2
uuuaacaaaauaua

SEQ ID NO: 2087214 - RNA, 14 nt, Staphylococcus aureus subsp. aureus MW2
uuuaacaacacuac

SEQ ID NO: 2087215 - RNA, 17 nt, Staphylococcus aureus subsp. aureus MW2
uuuaacuucuuuuguuu

SEQ ID NO: 2087216 - RNA, 17 nt, Staphylococcus aureus subsp. aureus MW2
uuuaacuugauuuucua

SEQ ID NO: 2087217 - RNA, 15 nt, Staphylococcus aureus subsp. aureus MW2
uuuaagaucaauauc

SEQ ID NO: 2087218 - RNA, 14 nt, Staphylococcus aureus subsp. aureus MW2
uuuaagaucaauau

SEQ ID NO: 2087219 - RNA, 18 nt, Staphylococcus aureus subsp. aureus MW2
uuuaagaagucgaauuca

SEQ ID NO: 2087220 - RNA, 18 nt, Staphylococcus aureus subsp. aureus MW2
uuuaagacuauaaugaau

SEQ ID NO: 2087221 - RNA, 18 nt, Staphylococcus aureus subsp. aureus MW2
uuuaaauuacaauuaauu

SEQ ID NO: 2087222 - RNA, 15 nt, Staphylococcus aureus subsp. aureus MW2
uuuaaauuuucauca

SEQ ID NO: 2087223 - RNA, 17 nt, Staphylococcus aureus subsp. aureus MW2
uuuaaaugcuuucaaau

SEQ ID NO: 2087224 - RNA, 22 nt, Staphylococcus aureus subsp. aureus MW2
uuuaaauuaaaauaauuaaacu

SEQ ID NO: 2087225 - RNA, 14 nt, Staphylococcus aureus subsp. aureus MW2
uuuaaauuaacuuu

SEQ ID NO: 2087226 - RNA, 18 nt, Staphylococcus aureus subsp. aureus MW2
uuuaaauaaaauuguuga

SEQ ID NO: 2087227 - RNA, 16 nt, Staphylococcus aureus subsp. aureus MW2
uuuaaaggcauaauaa

SEQ ID NO: 2087228 - RNA, 23 nt, Staphylococcus aureus subsp. aureus MW2
uuuaaaaaugauagauucaaaau

SEQ ID NO: 2087229 - RNA, 13 nt, Staphylococcus aureus subsp. aureus MW2
uuuaaaaaguuaa

SEQ ID NO: 2087230 - RNA, 12 nt, Staphylococcus aureus subsp. aureus MW2
uuuaaaaauaca

SEQ ID NO: 2087231 - RNA, 11 nt, Staphylococcus aureus subsp. aureus MW2
uuuaaaaaacu

SEQ ID NO: 2087232 - RNA, 16 nt, Staphylococcus aureus subsp. aureus MW2
uuuaaaaauucauaau

SEQ ID NO: 2087233 - RNA, 11 nt, Staphylococcus aureus subsp. aureus MW2
uuuaaaaugcu

SEQ ID NO: 2087234 - RNA, 18 nt, Staphylococcus aureus subsp. aureus MW2
uuuaaaaaauuuaaauaa

SEQ ID NO: 2087235 - RNA, 12 nt, Staphylococcus aureus subsp. aureus MW2
uuuaaaaaacaa

SEQ ID NO: 2087236 - RNA, 23 nt, Staphylococcus aureus subsp. aureus MW2
uuuaaaaaacauaccugcauauu

SEQ ID NO: 2087237 - RNA, 15 nt, Staphylococcus aureus subsp. aureus MW2
uuuaaagaaaauuuc

SEQ ID NO: 2087238 - RNA, 17 nt, Staphylococcus aureus subsp. aureus MW2
uuuaaacuucguaaaug

SEQ ID NO: 2087239 - RNA, 13 nt, Staphylococcus aureus subsp. aureus MW2
uuuaaacucauaa

SEQ ID NO: 2087240 - RNA, 15 nt, Staphylococcus aureus subsp. aureus MW2
uuuaaacucauaauu

SEQ ID NO: 2087241 - RNA, 19 nt, Staphylococcus aureus subsp. aureus MW2
uuuaaacucauaauuuucu

SEQ ID NO: 2087242 - RNA, 22 nt, Staphylococcus aureus subsp. aureus MW2
uuuaaacucauaauuuucuauu

SEQ ID NO: 2087243 - RNA, 21 nt, Staphylococcus aureus subsp. aureus MW2
uuuaaacguacauuuuuauga

SEQ ID NO: 2087244 - RNA, 18 nt, Staphylococcus aureus subsp. aureus MW2
uuuaaacauccaauuaug

SEQ ID NO: 2087245 - RNA, 13 nt, Staphylococcus aureus subsp. aureus MW2
uuuaaaauuauca

SEQ ID NO: 2087246 - RNA, 14 nt, Staphylococcus aureus subsp. aureus MW2
uuuaaacaaaaaua

SEQ ID NO: 2087247 - RNA, 18 nt, Staphylococcus aureus subsp. aureus MW2
uuuaaacaagaaaacuaa

SEQ ID NO: 2087248 - RNA, 20 nt, Staphylococcus aureus subsp. aureus MW2
uuuaaguaauucauuugcuu

SEQ ID NO: 2087249 - RNA, 13 nt, Staphylococcus aureus subsp. aureus MW2
uuuaauauaaauu

SEQ ID NO: 2087250 - RNA, 12 nt, Staphylococcus aureus subsp. aureus MW2
uuuaauauauuu

SEQ ID NO: 2087251 - RNA, 20 nt, Staphylococcus aureus subsp. aureus MW2
uuuaauaucuaauucuguuu

SEQ ID NO: 2087252 - RNA, 13 nt, Staphylococcus aureus subsp. aureus MW2
uuuaagcugcucg

SEQ ID NO: 2087253 - RNA, 19 nt, Staphylococcus aureus subsp. aureus MW2
uuuaaucguaacauaucag

SEQ ID NO: 2087254 - RNA, 13 nt, Staphylococcus aureus subsp. aureus MW2
uuuaaucuauaua

SEQ ID NO: 2087255 - RNA, 18 nt, Staphylococcus aureus subsp. aureus MW2
uuuaaucuuauucgcacc

SEQ ID NO: 2087256 - RNA, 20 nt, Staphylococcus aureus subsp. aureus MW2
uuuaaugauuuuucaucaau

SEQ ID NO: 2087257 - RNA, 13 nt, Staphylococcus aureus subsp. aureus MW2
uuuaaucauuguu

SEQ ID NO: 2087258 - RNA, 20 nt, Staphylococcus aureus subsp. aureus MW2
uuuaaucauuguuuuaaauu

SEQ ID NO: 2087259 - RNA, 21 nt, Staphylococcus aureus subsp. aureus MW2
uuuaauauugaaaugagcuua

SEQ ID NO: 2087260 - RNA, 19 nt, Staphylococcus aureus subsp. aureus MW2
uuuaauauugaauaaaaaa

SEQ ID NO: 2087261 - RNA, 21 nt, Staphylococcus aureus subsp. aureus MW2
uuuaauauuguuauacauaua

SEQ ID NO: 2087262 - RNA, 19 nt, Staphylococcus aureus subsp. aureus MW2
uuuaauagcuuguuuauuu

SEQ ID NO: 2087263 - RNA, 15 nt, Staphylococcus aureus subsp. aureus MW2
uuuaauauuuucuua

SEQ ID NO: 2087264 - RNA, 14 nt, Staphylococcus aureus subsp. aureus MW2
uuuaauauuuuuuu

SEQ ID NO: 2087265 - RNA, 16 nt, Staphylococcus aureus subsp. aureus MW2
uuuaaugucuaaaaau

SEQ ID NO: 2087266 - RNA, 12 nt, Staphylococcus aureus subsp. aureus MW2
uuuaauguguaa

SEQ ID NO: 2087267 - RNA, 14 nt, Staphylococcus aureus subsp. aureus MW2
uuuaaugcuuuaaa

SEQ ID NO: 2087268 - RNA, 21 nt, Staphylococcus aureus subsp. aureus MW2
uuuaaugggcgauaaaaguug

SEQ ID NO: 2087269 - RNA, 14 nt, Staphylococcus aureus subsp. aureus MW2
uuuaauguuucaaa

SEQ ID NO: 2087270 - RNA, 21 nt, Staphylococcus aureus subsp. aureus MW2
uuuacaaaaugaugaaaauca

SEQ ID NO: 2087271 - RNA, 14 nt, Staphylococcus aureus subsp. aureus MW2
uuuacaauuuuugg

SEQ ID NO: 2087272 - RNA, 20 nt, Staphylococcus aureus subsp. aureus MW2
uuuacaauaugauuaauaaa

SEQ ID NO: 2087273 - RNA, 22 nt, Staphylococcus aureus subsp. aureus MW2
uuuaaugggcgugccauuaaaa

SEQ ID NO: 2087274 - RNA, 17 nt, Staphylococcus aureus subsp. aureus MW2
uuuacaaacuucacauu

SEQ ID NO: 2087275 - RNA, 22 nt, Staphylococcus aureus subsp. aureus MW2
uuuacaagaacaugauacugaa

SEQ ID NO: 2087276 - RNA, 20 nt, Staphylococcus aureus subsp. aureus MW2
uuuacauuuaacauuucaau

SEQ ID NO: 2087277 - RNA, 23 nt, Staphylococcus aureus subsp. aureus MW2
uuuacauggcuuagguuuaauuu

SEQ ID NO: 2087278 - RNA, 14 nt, Staphylococcus aureus subsp. aureus MW2
uuuaccacuuauaa

SEQ ID NO: 2087279 - RNA, 21 nt, Staphylococcus aureus subsp. aureus MW2
uuguaaauauuuuuuaaaaug

SEQ ID NO: 2087280 - RNA, 15 nt, Staphylococcus aureus subsp. aureus MW2
uuguaaauaaaacua

SEQ ID NO: 2087281 - RNA, 20 nt, Staphylococcus aureus subsp. aureus MW2
uuguaaauaaaacuaucuac

SEQ ID NO: 2087282 - RNA, 22 nt, Staphylococcus aureus subsp. aureus MW2
uuguaaaauuuucguguuaaua

SEQ ID NO: 2087283 - RNA, 21 nt, Staphylococcus aureus subsp. aureus MW2
uuguaacaagcuuuuuucaau

SEQ ID NO: 2087284 - RNA, 15 nt, Staphylococcus aureus subsp. aureus MW2
uuguauuuaaaauca

SEQ ID NO: 2087285 - RNA, 19 nt, Staphylococcus aureus subsp. aureus MW2
uuguauugacaucuucgua

SEQ ID NO: 2087286 - RNA, 17 nt, Staphylococcus aureus subsp. aureus MW2
uuguauuuuauuuauuu

SEQ ID NO: 2087287 - RNA, 13 nt, Staphylococcus aureus subsp. aureus MW2
uuguauuuuucaa

SEQ ID NO: 2087288 - RNA, 15 nt, Staphylococcus aureus subsp. aureus MW2
uuguauuuuucaaau

SEQ ID NO: 2087289 - RNA, 14 nt, Staphylococcus aureus subsp. aureus MW2
uuguauuuuucaaa

SEQ ID NO: 2087290 - RNA, 19 nt, Staphylococcus aureus subsp. aureus MW2
uugucaauuuaaagucuuc

SEQ ID NO: 2087291 - RNA, 13 nt, Staphylococcus aureus subsp. aureus MW2
uugucuuuuauau

SEQ ID NO: 2087292 - RNA, 13 nt, Staphylococcus aureus subsp. aureus MW2
uugucuuugaaug

SEQ ID NO: 2087293 - RNA, 20 nt, Staphylococcus aureus subsp. aureus MW2
uugucuucauuaacaucaug

SEQ ID NO: 2087294 - RNA, 13 nt, Staphylococcus aureus subsp. aureus MW2
uugucuucucaac

SEQ ID NO: 2087295 - RNA, 13 nt, Staphylococcus aureus subsp. aureus MW2
uugucuguagaaa

SEQ ID NO: 2087296 - RNA, 15 nt, Staphylococcus aureus subsp. aureus MW2
uuguuauaucuaauu

SEQ ID NO: 2087297 - RNA, 19 nt, Staphylococcus aureus subsp. aureus MW2
uuguuaucguucaauguua

SEQ ID NO: 2087298 - RNA, 13 nt, Staphylococcus aureus subsp. aureus MW2
uuguguuauguau

SEQ ID NO: 2087299 - RNA, 13 nt, Staphylococcus aureus subsp. aureus MW2
uuguguugaauca

SEQ ID NO: 2087300 - RNA, 23 nt, Staphylococcus aureus subsp. aureus MW2
uugugguuguuaauguauuaauu

SEQ ID NO: 2087301 - RNA, 20 nt, Staphylococcus aureus subsp. aureus MW2
uugugggcguucugcuaauc

SEQ ID NO: 2087302 - RNA, 15 nt, Staphylococcus aureus subsp. aureus MW2
uugugaguucauaau

SEQ ID NO: 2087303 - RNA, 18 nt, Staphylococcus aureus subsp. aureus MW2
uugugauaauucuucaac

SEQ ID NO: 2087304 - RNA, 18 nt, Staphylococcus aureus subsp. aureus MW2
uugugaauuuauuuugua

SEQ ID NO: 2087305 - RNA, 21 nt, Staphylococcus aureus subsp. aureus MW2
uugugacgcggguaauauuuu

SEQ ID NO: 2087306 - RNA, 14 nt, Staphylococcus aureus subsp. aureus MW2
uuguuucuaaugcu

SEQ ID NO: 2087307 - RNA, 16 nt, Staphylococcus aureus subsp. aureus MW2
uuguucaacuaaauuu

SEQ ID NO: 2087308 - RNA, 16 nt, Staphylococcus aureus subsp. aureus MW2
uuguuauugaaugaag

SEQ ID NO: 2087309 - RNA, 19 nt, Staphylococcus aureus subsp. aureus MW2
uuguugaauaauuaauguu

SEQ ID NO: 2087310 - RNA, 16 nt, Staphylococcus aureus subsp. aureus MW2
uuguugauaguaaucu

SEQ ID NO: 2087311 - RNA, 13 nt, Staphylococcus aureus subsp. aureus MW2
uuguugauuuaaa

SEQ ID NO: 2087312 - RNA, 18 nt, Staphylococcus aureus subsp. aureus MW2
uuguugauuuaaaauauu

SEQ ID NO: 2087313 - RNA, 14 nt, Staphylococcus aureus subsp. aureus MW2
uuguugcaaugauu

SEQ ID NO: 2087314 - RNA, 20 nt, Staphylococcus aureus subsp. aureus MW2
uugaauggcucguuuuuuua

SEQ ID NO: 2087315 - RNA, 18 nt, Staphylococcus aureus subsp. aureus MW2
uugaaugaaccuuuacuc

SEQ ID NO: 2087316 - RNA, 18 nt, Staphylococcus aureus subsp. aureus MW2
uugaaugguauaauuccu

SEQ ID NO: 2087317 - RNA, 23 nt, Staphylococcus aureus subsp. aureus MW2
uugaaugauauuaacuguaccau

SEQ ID NO: 2087318 - RNA, 18 nt, Staphylococcus aureus subsp. aureus MW2
uugaagaauguuucauau

SEQ ID NO: 2087319 - RNA, 18 nt, Staphylococcus aureus subsp. aureus MW2
uugaagaccuucuaaaau

SEQ ID NO: 2087320 - RNA, 17 nt, Staphylococcus aureus subsp. aureus MW2
uugaaugguauaauucc

SEQ ID NO: 2087321 - RNA, 14 nt, Staphylococcus aureus subsp. aureus MW2
uugaauguuucucc

SEQ ID NO: 2087322 - RNA, 23 nt, Staphylococcus aureus subsp. aureus MW2
uugaauugacuuacauuuuaaua

SEQ ID NO: 2087323 - RNA, 17 nt, Staphylococcus aureus subsp. aureus MW2
uugaauugacuuacauu

SEQ ID NO: 2087324 - RNA, 13 nt, Staphylococcus aureus subsp. aureus MW2
uugaauuuaaaaa

SEQ ID NO: 2087325 - RNA, 19 nt, Staphylococcus aureus subsp. aureus MW2
uugaagaauaaaaaaguug

SEQ ID NO: 2087326 - RNA, 15 nt, Staphylococcus aureus subsp. aureus MW2
uugaagaauaaaaaa

SEQ ID NO: 2087327 - RNA, 19 nt, Staphylococcus aureus subsp. aureus MW2
uugaacuuuaguauauuca

SEQ ID NO: 2087328 - RNA, 13 nt, Staphylococcus aureus subsp. aureus MW2
uugaacuucuuuu

SEQ ID NO: 2087329 - RNA, 13 nt, Staphylococcus aureus subsp. aureus MW2
uugaccuucaguu

SEQ ID NO: 2087330 - RNA, 13 nt, Staphylococcus aureus subsp. aureus MW2
uugacaauacaaa

SEQ ID NO: 2087331 - RNA, 19 nt, Staphylococcus aureus subsp. aureus MW2
uugacaaguugcugaauaa

SEQ ID NO: 2087332 - RNA, 13 nt, Staphylococcus aureus subsp. aureus MW2
uugaauuuuauua

SEQ ID NO: 2087333 - RNA, 13 nt, Staphylococcus aureus subsp. aureus MW2
uugaauuuuauuu

SEQ ID NO: 2087334 - RNA, 16 nt, Staphylococcus aureus subsp. aureus MW2
uugaauuuuauuaggu

SEQ ID NO: 2087335 - RNA, 23 nt, Staphylococcus aureus subsp. aureus MW2
uugagaaaaagguuaauauuaaa

SEQ ID NO: 2087336 - RNA, 20 nt, Staphylococcus aureus subsp. aureus MW2
uugaaacugaguucaauuaa

SEQ ID NO: 2087337 - RNA, 21 nt, Staphylococcus aureus subsp. aureus MW2
uugaaaggaauguuuaaaaaa

SEQ ID NO: 2087338 - RNA, 23 nt, Staphylococcus aureus subsp. aureus MW2
uugaacauauuauaaaaguguaa

SEQ ID NO: 2087339 - RNA, 17 nt, Staphylococcus aureus subsp. aureus MW2
uugaacauauuauaaaa

SEQ ID NO: 2087340 - RNA, 15 nt, Staphylococcus aureus subsp. aureus MW2
uucuuuuuuaauaag

SEQ ID NO: 2087341 - RNA, 17 nt, Staphylococcus aureus subsp. aureus MW2
uucuuuuuuuguuacca

SEQ ID NO: 2087342 - RNA, 15 nt, Staphylococcus aureus subsp. aureus MW2
uucuuuuucaucuuu

SEQ ID NO: 2087343 - RNA, 15 nt, Staphylococcus aureus subsp. aureus MW2
uucuuuuucuauaca

SEQ ID NO: 2087344 - RNA, 17 nt, Staphylococcus aureus subsp. aureus MW2
uucuuuuaaguuaucaa

SEQ ID NO: 2087345 - RNA, 15 nt, Staphylococcus aureus subsp. aureus MW2
uucuuugucaucuuu

SEQ ID NO: 2087346 - RNA, 17 nt, Staphylococcus aureus subsp. aureus MW2
uucuuuguguuugcuuu

SEQ ID NO: 2087347 - RNA, 11 nt, Staphylococcus aureus subsp. aureus MW2
uugauauguuu

SEQ ID NO: 2087348 - RNA, 17 nt, Staphylococcus aureus subsp. aureus MW2
uugauaugguuagaaaa

SEQ ID NO: 2087349 - RNA, 18 nt, Staphylococcus aureus subsp. aureus MW2
uugauaugguuagaaaaa

SEQ ID NO: 2087350 - RNA, 22 nt, Staphylococcus aureus subsp. aureus MW2
uugauaugguuagaaaaaaauc

SEQ ID NO: 2087351 - RNA, 15 nt, Staphylococcus aureus subsp. aureus MW2
uugauaagaagugcu

SEQ ID NO: 2087352 - RNA, 13 nt, Staphylococcus aureus subsp. aureus MW2
uugauaaaauaau

SEQ ID NO: 2087353 - RNA, 14 nt, Staphylococcus aureus subsp. aureus MW2
uugauaaaauaaau

SEQ ID NO: 2087354 - RNA, 16 nt, Staphylococcus aureus subsp. aureus MW2
uugauaaaauaaauaa

SEQ ID NO: 2087355 - RNA, 21 nt, Staphylococcus aureus subsp. aureus MW2
uugauaaaaaaugaauguuaa

SEQ ID NO: 2087356 - RNA, 19 nt, Staphylococcus aureus subsp. aureus MW2
uugauaaaaaaugaauguu

SEQ ID NO: 2087357 - RNA, 17 nt, Staphylococcus aureus subsp. aureus MW2
uugaucaaaaauguuau

SEQ ID NO: 2087358 - RNA, 20 nt, Staphylococcus aureus subsp. aureus MW2
uugauauguuuccucuuuaa

SEQ ID NO: 2087359 - RNA, 13 nt, Staphylococcus aureus subsp. aureus MW2
uugauauuucaaa

SEQ ID NO: 2087360 - RNA, 24 nt, Staphylococcus aureus subsp. aureus MW2
uugaucuaaaguacucaaguaauc

SEQ ID NO: 2087361 - RNA, 19 nt, Staphylococcus aureus subsp. aureus MW2
uugaguaugguugauuaca

SEQ ID NO: 2087362 - RNA, 20 nt, Staphylococcus aureus subsp. aureus MW2
uugaguacuaaucaauacua

SEQ ID NO: 2087363 - RNA, 21 nt, Staphylococcus aureus subsp. aureus MW2
uugaguacuaaucaauacuaa

SEQ ID NO: 2087364 - RNA, 14 nt, Staphylococcus aureus subsp. aureus MW2
uugagaauauuaag

SEQ ID NO: 2087365 - RNA, 14 nt, Staphylococcus aureus subsp. aureus MW2
uugagacaaaaaau

SEQ ID NO: 2087366 - RNA, 14 nt, Staphylococcus aureus subsp. aureus MW2
uugagaaaauuaau

SEQ ID NO: 2087367 - RNA, 19 nt, Staphylococcus aureus subsp. aureus MW2
uugagccaaaaauaaacca

SEQ ID NO: 2087368 - RNA, 13 nt, Staphylococcus aureus subsp. aureus MW2
uugauugaauaug

SEQ ID NO: 2087369 - RNA, 16 nt, Staphylococcus aureus subsp. aureus MW2
uugauuguaauaauaa

SEQ ID NO: 2087370 - RNA, 17 nt, Staphylococcus aureus subsp. aureus MW2
uugauuguauuuuucaa

SEQ ID NO: 2087371 - RNA, 15 nt, Staphylococcus aureus subsp. aureus MW2
uugauuuaaaauauu

SEQ ID NO: 2087372 - RNA, 16 nt, Staphylococcus aureus subsp. aureus MW2
uugauuuaacaaccuc

SEQ ID NO: 2087373 - RNA, 18 nt, Staphylococcus aureus subsp. aureus MW2
uugauuuagcauacauua

SEQ ID NO: 2087374 - RNA, 17 nt, Staphylococcus aureus subsp. aureus MW2
uugauuuaacugggcaa

SEQ ID NO: 2087375 - RNA, 15 nt, Staphylococcus aureus subsp. aureus MW2
uugauuuacgugcau

SEQ ID NO: 2087376 - RNA, 18 nt, Staphylococcus aureus subsp. aureus MW2
uugauucuagugaaauac

SEQ ID NO: 2087377 - RNA, 15 nt, Staphylococcus aureus subsp. aureus MW2
uugauucuacagcgu

SEQ ID NO: 2087378 - RNA, 13 nt, Staphylococcus aureus subsp. aureus MW2
uugauucuaaaua

SEQ ID NO: 2087379 - RNA, 20 nt, Staphylococcus aureus subsp. aureus MW2
uugauucuucaccaguuugu

SEQ ID NO: 2087380 - RNA, 16 nt, Staphylococcus aureus subsp. aureus MW2
uugaucugauuucacu

SEQ ID NO: 2087381 - RNA, 12 nt, Staphylococcus aureus subsp. aureus MW2
uugaugaauaaa

SEQ ID NO: 2087382 - RNA, 16 nt, Staphylococcus aureus subsp. aureus MW2
uugcaaucguauguaa

SEQ ID NO: 2087383 - RNA, 18 nt, Staphylococcus aureus subsp. aureus MW2
uugcaauaauucaucuug

SEQ ID NO: 2087384 - RNA, 19 nt, Staphylococcus aureus subsp. aureus MW2
uugcaaugcauauugugcc

SEQ ID NO: 2087385 - RNA, 19 nt, Staphylococcus aureus subsp. aureus MW2
uugcaauuuuuuauguauu

SEQ ID NO: 2087386 - RNA, 19 nt, Staphylococcus aureus subsp. aureus MW2
uugauuuggguaauguuuu

SEQ ID NO: 2087387 - RNA, 19 nt, Staphylococcus aureus subsp. aureus MW2
uucugggaacgcuguuuuu

SEQ ID NO: 2087388 - RNA, 15 nt, Staphylococcus aureus subsp. aureus MW2
uucugauuauguuca

SEQ ID NO: 2087389 - RNA, 14 nt, Staphylococcus aureus subsp. aureus MW2
uucugauguuuuau

SEQ ID NO: 2087390 - RNA, 19 nt, Staphylococcus aureus subsp. aureus MW2
uucucuaacuuuaccaaua

SEQ ID NO: 2087391 - RNA, 23 nt, Staphylococcus aureus subsp. aureus MW2
uucugaaaugauacauuauuaaa

SEQ ID NO: 2087392 - RNA, 21 nt, Staphylococcus aureus subsp. aureus MW2
uucugaaaugauacauuauua

SEQ ID NO: 2087393 - RNA, 20 nt, Staphylococcus aureus subsp. aureus MW2
uucugaaacuuuaauacuac

SEQ ID NO: 2087394 - RNA, 23 nt, Staphylococcus aureus subsp. aureus MW2
uucugaauuuaggaaugaauaaa

SEQ ID NO: 2087395 - RNA, 14 nt, Staphylococcus aureus subsp. aureus MW2
uucuucacuaaaaa

SEQ ID NO: 2087396 - RNA, 20 nt, Staphylococcus aureus subsp. aureus MW2
uucuucacugcuguuuuuau

SEQ ID NO: 2087397 - RNA, 18 nt, Staphylococcus aureus subsp. aureus MW2
uucuucacugcuguuuuu

SEQ ID NO: 2087398 - RNA, 17 nt, Staphylococcus aureus subsp. aureus MW2
uucuucagguguuuuac

SEQ ID NO: 2087399 - RNA, 16 nt, Staphylococcus aureus subsp. aureus MW2
uucuucaguaagcgca

SEQ ID NO: 2087400 - RNA, 15 nt, Staphylococcus aureus subsp. aureus MW2
uucuucaucuuuuau

SEQ ID NO: 2087401 - RNA, 14 nt, Staphylococcus aureus subsp. aureus MW2
uucuugauuguaaa

SEQ ID NO: 2087402 - RNA, 12 nt, Staphylococcus aureus subsp. aureus MW2
uucuugaauaaa

SEQ ID NO: 2087403 - RNA, 23 nt, Staphylococcus aureus subsp. aureus MW2
uucuugaaauaaacauaucauca

SEQ ID NO: 2087404 - RNA, 12 nt, Staphylococcus aureus subsp. aureus MW2
uucuuauuugaa

SEQ ID NO: 2087405 - RNA, 22 nt, Staphylococcus aureus subsp. aureus MW2
uucuucaaaaaauaauagcaaa

SEQ ID NO: 2087406 - RNA, 19 nt, Staphylococcus aureus subsp. aureus MW2
uucuucaaccauuuguucu

SEQ ID NO: 2087407 - RNA, 23 nt, Staphylococcus aureus subsp. aureus MW2
uucuucaccaguuugugguaaug

SEQ ID NO: 2087408 - RNA, 18 nt, Staphylococcus aureus subsp. aureus MW2
uucuuaauugaaaauaau

SEQ ID NO: 2087409 - RNA, 19 nt, Staphylococcus aureus subsp. aureus MW2
uucuuaauuauuuauuguu

SEQ ID NO: 2087410 - RNA, 19 nt, Staphylococcus aureus subsp. aureus MW2
uucuuaauuuaaaaauagu

SEQ ID NO: 2087411 - RNA, 13 nt, Staphylococcus aureus subsp. aureus MW2
uucuauacuuuua

SEQ ID NO: 2087412 - RNA, 20 nt, Staphylococcus aureus subsp. aureus MW2
uucuauacauuccaaaguac

SEQ ID NO: 2087413 - RNA, 17 nt, Staphylococcus aureus subsp. aureus MW2
uucucauuaaccuuaca

SEQ ID NO: 2087414 - RNA, 16 nt, Staphylococcus aureus subsp. aureus MW2
uucuauacaaugaauu

SEQ ID NO: 2087415 - RNA, 16 nt, Staphylococcus aureus subsp. aureus MW2
uucuauacuuuuaauu

SEQ ID NO: 2087416 - RNA, 12 nt, Staphylococcus aureus subsp. aureus MW2
uucucaguugcc

SEQ ID NO: 2087417 - RNA, 13 nt, Staphylococcus aureus subsp. aureus MW2
uucucauuauaau

SEQ ID NO: 2087418 - RNA, 13 nt, Staphylococcus aureus subsp. aureus MW2
uucucauugaaau

SEQ ID NO: 2087419 - RNA, 21 nt, Staphylococcus aureus subsp. aureus MW2
uucuccuucaauguucaauuc

SEQ ID NO: 2087420 - RNA, 14 nt, Staphylococcus aureus subsp. aureus MW2
uucuagugaaauac

SEQ ID NO: 2087421 - RNA, 12 nt, Staphylococcus aureus subsp. aureus MW2
uucuagguaaua

SEQ ID NO: 2087422 - RNA, 20 nt, Staphylococcus aureus subsp. aureus MW2
uucuaaugcuaauuuaacug

SEQ ID NO: 2087423 - RNA, 16 nt, Staphylococcus aureus subsp. aureus MW2
uucuaaugcuaauuua

SEQ ID NO: 2087424 - RNA, 17 nt, Staphylococcus aureus subsp. aureus MW2
uucuaaugcuaauuuaa

SEQ ID NO: 2087425 - RNA, 19 nt, Staphylococcus aureus subsp. aureus MW2
uucuaaugcugcuucuuca

SEQ ID NO: 2087426 - RNA, 16 nt, Staphylococcus aureus subsp. aureus MW2
uucguaacauuuaaaa

SEQ ID NO: 2087427 - RNA, 19 nt, Staphylococcus aureus subsp. aureus MW2
uucguacaucguugccauu

SEQ ID NO: 2087428 - RNA, 23 nt, Staphylococcus aureus subsp. aureus MW2
uucguacuaguucgauucaugaa

SEQ ID NO: 2087429 - RNA, 17 nt, Staphylococcus aureus subsp. aureus MW2
uucguaauguguuaaua

SEQ ID NO: 2087430 - RNA, 16 nt, Staphylococcus aureus subsp. aureus MW2
uucggaugagaaaugu

SEQ ID NO: 2087431 - RNA, 13 nt, Staphylococcus aureus subsp. aureus MW2
uucuaaccacuuc

SEQ ID NO: 2087432 - RNA, 16 nt, Staphylococcus aureus subsp. aureus MW2
uucguuaacucuaucu

SEQ ID NO: 2087433 - RNA, 15 nt, Staphylococcus aureus subsp. aureus MW2
uucguguuaauaacc

SEQ ID NO: 2087434 - RNA, 15 nt, Staphylococcus aureus subsp. aureus MW2
uucguguuccaauuu

SEQ ID NO: 2087435 - RNA, 18 nt, Staphylococcus aureus subsp. aureus MW2
gagucauucaaucaucaa

SEQ ID NO: 2087436 - RNA, 21 nt, Staphylococcus aureus subsp. aureus MW2
gaguauccugauuuaauguua

SEQ ID NO: 2087437 - RNA, 22 nt, Staphylococcus aureus subsp. aureus MW2
gaauuucuuuucgaaauucuuu

SEQ ID NO: 2087438 - RNA, 14 nt, Staphylococcus aureus subsp. aureus MW2
gaguuaauccucau

SEQ ID NO: 2087439 - RNA, 14 nt, Staphylococcus aureus subsp. aureus MW2
gaguuaauaaaauu

SEQ ID NO: 2087440 - RNA, 22 nt, Staphylococcus aureus subsp. aureus MW2
gaguuaccuuugccaacaccau

SEQ ID NO: 2087441 - RNA, 16 nt, Staphylococcus aureus subsp. aureus MW2
gaguucaauuaaauua

SEQ ID NO: 2087442 - RNA, 14 nt, Staphylococcus aureus subsp. aureus MW2
gauaaaaaauacua

SEQ ID NO: 2087443 - RNA, 12 nt, Staphylococcus aureus subsp. aureus MW2
gauaaaaaauga

SEQ ID NO: 2087444 - RNA, 13 nt, Staphylococcus aureus subsp. aureus MW2
gauaaaaaaugaa

SEQ ID NO: 2087445 - RNA, 19 nt, Staphylococcus aureus subsp. aureus MW2
gauaaaaccaccuaccauu

SEQ ID NO: 2087446 - RNA, 19 nt, Staphylococcus aureus subsp. aureus MW2
gauaaaaauuuaugucuua

SEQ ID NO: 2087447 - RNA, 21 nt, Staphylococcus aureus subsp. aureus MW2
gauaaaacaaaaccaaaauac

SEQ ID NO: 2087448 - RNA, 20 nt, Staphylococcus aureus subsp. aureus MW2
gauaaaaguuguauucugaa

SEQ ID NO: 2087449 - RNA, 19 nt, Staphylococcus aureus subsp. aureus MW2
gauacgcuuuuuaaaaaau

SEQ ID NO: 2087450 - RNA, 13 nt, Staphylococcus aureus subsp. aureus MW2
gauacuuuuaaaa

SEQ ID NO: 2087451 - RNA, 14 nt, Staphylococcus aureus subsp. aureus MW2
gauacuuugaaaga

SEQ ID NO: 2087452 - RNA, 15 nt, Staphylococcus aureus subsp. aureus MW2
gauacauucuauuaa

SEQ ID NO: 2087453 - RNA, 19 nt, Staphylococcus aureus subsp. aureus MW2
gauaccuuuuucuaccaau

SEQ ID NO: 2087454 - RNA, 14 nt, Staphylococcus aureus subsp. aureus MW2
gauacauaaaucua

SEQ ID NO: 2087455 - RNA, 23 nt, Staphylococcus aureus subsp. aureus MW2
gauacauauucucugcuucuaaa

SEQ ID NO: 2087456 - RNA, 23 nt, Staphylococcus aureus subsp. aureus MW2
gauaauuaaaauaagauauauaa

SEQ ID NO: 2087457 - RNA, 15 nt, Staphylococcus aureus subsp. aureus MW2
gauaaugcaccugug

SEQ ID NO: 2087458 - RNA, 23 nt, Staphylococcus aureus subsp. aureus MW2
gauaauuucuucuucuguaauau

SEQ ID NO: 2087459 - RNA, 15 nt, Staphylococcus aureus subsp. aureus MW2
gauaauuuuuaacag

SEQ ID NO: 2087460 - RNA, 19 nt, Staphylococcus aureus subsp. aureus MW2
gauaauuaauuaaaagccc

SEQ ID NO: 2087461 - RNA, 20 nt, Staphylococcus aureus subsp. aureus MW2
gauaaauaaacucaccaagu

SEQ ID NO: 2087462 - RNA, 17 nt, Staphylococcus aureus subsp. aureus MW2
gauaacgagugaaaaua

SEQ ID NO: 2087463 - RNA, 17 nt, Staphylococcus aureus subsp. aureus MW2
gaucauuaguguagaaa

SEQ ID NO: 2087464 - RNA, 21 nt, Staphylococcus aureus subsp. aureus MW2
gauagcaccguaacauaugua

SEQ ID NO: 2087465 - RNA, 19 nt, Staphylococcus aureus subsp. aureus MW2
gauaucuuuuaauucuuaa

SEQ ID NO: 2087466 - RNA, 21 nt, Staphylococcus aureus subsp. aureus MW2
gauaucuuaaucuaaaaauag

SEQ ID NO: 2087467 - RNA, 17 nt, Staphylococcus aureus subsp. aureus MW2
gauaucuggauuaacug

SEQ ID NO: 2087468 - RNA, 19 nt, Staphylococcus aureus subsp. aureus MW2
gauaucuuaaucuaaaaau

SEQ ID NO: 2087469 - RNA, 15 nt, Staphylococcus aureus subsp. aureus MW2
gauaucugaaguaga

SEQ ID NO: 2087470 - RNA, 17 nt, Staphylococcus aureus subsp. aureus MW2
gauaucugaaguagauu

SEQ ID NO: 2087471 - RNA, 19 nt, Staphylococcus aureus subsp. aureus MW2
gauaugaauggcauuuaau

SEQ ID NO: 2087472 - RNA, 16 nt, Staphylococcus aureus subsp. aureus MW2
gauauugaucugauuu

SEQ ID NO: 2087473 - RNA, 17 nt, Staphylococcus aureus subsp. aureus MW2
gauauuaggugacuuau

SEQ ID NO: 2087474 - RNA, 16 nt, Staphylococcus aureus subsp. aureus MW2
gauauuaggcuuaaau

SEQ ID NO: 2087475 - RNA, 13 nt, Staphylococcus aureus subsp. aureus MW2
gauauguuuauau

SEQ ID NO: 2087476 - RNA, 15 nt, Staphylococcus aureus subsp. aureus MW2
gauauuaauauauuu

SEQ ID NO: 2087477 - RNA, 16 nt, Staphylococcus aureus subsp. aureus MW2
gauauugucuucucaa

SEQ ID NO: 2087478 - RNA, 19 nt, Staphylococcus aureus subsp. aureus MW2
gaucgcccauacuaaauaa

SEQ ID NO: 2087479 - RNA, 13 nt, Staphylococcus aureus subsp. aureus MW2
gaucgguauuuuc

SEQ ID NO: 2087480 - RNA, 23 nt, Staphylococcus aureus subsp. aureus MW2
gaugacuuugucuuuaaugaaag

SEQ ID NO: 2087481 - RNA, 13 nt, Staphylococcus aureus subsp. aureus MW2
gaugagaaauguu

SEQ ID NO: 2087482 - RNA, 14 nt, Staphylococcus aureus subsp. aureus MW2
gaugacuguagaaa

SEQ ID NO: 2087483 - RNA, 16 nt, Staphylococcus aureus subsp. aureus MW2
gaugagauaaaaucau

SEQ ID NO: 2087484 - RNA, 14 nt, Staphylococcus aureus subsp. aureus MW2
gauggaaaaguuuu

SEQ ID NO: 2087485 - RNA, 20 nt, Staphylococcus aureus subsp. aureus MW2
gauggcaacuaaaauuugua

SEQ ID NO: 2087486 - RNA, 16 nt, Staphylococcus aureus subsp. aureus MW2
gaugucagacgaauca

SEQ ID NO: 2087487 - RNA, 13 nt, Staphylococcus aureus subsp. aureus MW2
gauguaauucugu

SEQ ID NO: 2087488 - RNA, 14 nt, Staphylococcus aureus subsp. aureus MW2
gaugguuaucacuu

SEQ ID NO: 2087489 - RNA, 13 nt, Staphylococcus aureus subsp. aureus MW2
gauggucuuuuaa

SEQ ID NO: 2087490 - RNA, 18 nt, Staphylococcus aureus subsp. aureus MW2
gaugucaugucuagauuu

SEQ ID NO: 2087491 - RNA, 13 nt, Staphylococcus aureus subsp. aureus MW2
gaugucauguauu

SEQ ID NO: 2087492 - RNA, 13 nt, Staphylococcus aureus subsp. aureus MW2
gauuaaaaguguu

SEQ ID NO: 2087493 - RNA, 20 nt, Staphylococcus aureus subsp. aureus MW2
gauuaaaauccgcuuuauuu

SEQ ID NO: 2087494 - RNA, 17 nt, Staphylococcus aureus subsp. aureus MW2
gauuaaaagcaucuuua

SEQ ID NO: 2087495 - RNA, 12 nt, Staphylococcus aureus subsp. aureus MW2
gauuaacauuau

SEQ ID NO: 2087496 - RNA, 18 nt, Staphylococcus aureus subsp. aureus MW2
gauuauauuuuucuucag

SEQ ID NO: 2087497 - RNA, 15 nt, Staphylococcus aureus subsp. aureus MW2
gauuaucuaacucau

SEQ ID NO: 2087498 - RNA, 17 nt, Staphylococcus aureus subsp. aureus MW2
gauuauguaauucuagc

SEQ ID NO: 2087499 - RNA, 15 nt, Staphylococcus aureus subsp. aureus MW2
gauuaccguuaaaaa

SEQ ID NO: 2087500 - RNA, 20 nt, Staphylococcus aureus subsp. aureus MW2
gauuaauaguuuuauaagaa

SEQ ID NO: 2087501 - RNA, 17 nt, Staphylococcus aureus subsp. aureus MW2
gauuaauauaagucuau

SEQ ID NO: 2087502 - RNA, 19 nt, Staphylococcus aureus subsp. aureus MW2
gauuauuuagauaaaaaau

SEQ ID NO: 2087503 - RNA, 21 nt, Staphylococcus aureus subsp. aureus MW2
gauuauuuagauaaaaaauac

SEQ ID NO: 2087504 - RNA, 13 nt, Staphylococcus aureus subsp. aureus MW2
gauuauucuucau

SEQ ID NO: 2087505 - RNA, 20 nt, Staphylococcus aureus subsp. aureus MW2
gauuauuaugccuuugauuu

SEQ ID NO: 2087506 - RNA, 18 nt, Staphylococcus aureus subsp. aureus MW2
gauuauuccacauuaucu

SEQ ID NO: 2087507 - RNA, 15 nt, Staphylococcus aureus subsp. aureus MW2
gauuauuaccauaua

SEQ ID NO: 2087508 - RNA, 21 nt, Staphylococcus aureus subsp. aureus MW2
gauuauguucagaacuacaau

SEQ ID NO: 2087509 - RNA, 14 nt, Staphylococcus aureus subsp. aureus MW2
gauugaaaaaauaa

SEQ ID NO: 2087510 - RNA, 16 nt, Staphylococcus aureus subsp. aureus MW2
gauucuuaucuuuaau

SEQ ID NO: 2087511 - RNA, 16 nt, Staphylococcus aureus subsp. aureus MW2
gauuuaaguuuauaau

SEQ ID NO: 2087512 - RNA, 22 nt, Staphylococcus aureus subsp. aureus MW2
gauuuaaguugauacuugaucu

SEQ ID NO: 2087513 - RNA, 15 nt, Staphylococcus aureus subsp. aureus MW2
gauuuauuaacucau

SEQ ID NO: 2087514 - RNA, 14 nt, Staphylococcus aureus subsp. aureus MW2
gauuuaaaugcuuc

SEQ ID NO: 2087515 - RNA, 15 nt, Staphylococcus aureus subsp. aureus MW2
gauuguuaauacaac

SEQ ID NO: 2087516 - RNA, 23 nt, Staphylococcus aureus subsp. aureus MW2
gauuguuaauucguguuugcaua

SEQ ID NO: 2087517 - RNA, 16 nt, Staphylococcus aureus subsp. aureus MW2
gauugaguugaaaaua

SEQ ID NO: 2087518 - RNA, 13 nt, Staphylococcus aureus subsp. aureus MW2
gauuugauaaaaa

SEQ ID NO: 2087519 - RNA, 15 nt, Staphylococcus aureus subsp. aureus MW2
gauuugauaaaaaau

SEQ ID NO: 2087520 - RNA, 14 nt, Staphylococcus aureus subsp. aureus MW2
gauuuuacuugaau

SEQ ID NO: 2087521 - RNA, 23 nt, Staphylococcus aureus subsp. aureus MW2
gauuuuaggcaagguaaugguua

SEQ ID NO: 2087522 - RNA, 15 nt, Staphylococcus aureus subsp. aureus MW2
gauuuuaacaagaua

SEQ ID NO: 2087523 - RNA, 12 nt, Staphylococcus aureus subsp. aureus MW2
gauuuuaauuau

SEQ ID NO: 2087524 - RNA, 16 nt, Staphylococcus aureus subsp. aureus MW2
gauuuauuaacucaug

SEQ ID NO: 2087525 - RNA, 16 nt, Staphylococcus aureus subsp. aureus MW2
gauuucaguucaucau

SEQ ID NO: 2087526 - RNA, 16 nt, Staphylococcus aureus subsp. aureus MW2
gauuucauaauguuaa

SEQ ID NO: 2087527 - RNA, 15 nt, Staphylococcus aureus subsp. aureus MW2
gauuucaguucauca

SEQ ID NO: 2087528 - RNA, 20 nt, Staphylococcus aureus subsp. aureus MW2
gauuucuucgcauuguuucu

SEQ ID NO: 2087529 - RNA, 14 nt, Staphylococcus aureus subsp. aureus MW2
gauuucuucugcua

SEQ ID NO: 2087530 - RNA, 18 nt, Staphylococcus aureus subsp. aureus MW2
gcaaaaauauuuaaacua

SEQ ID NO: 2087531 - RNA, 18 nt, Staphylococcus aureus subsp. aureus MW2
gauuuuuacaaagugauu

SEQ ID NO: 2087532 - RNA, 16 nt, Staphylococcus aureus subsp. aureus MW2
gauuuuucauauuuuu

SEQ ID NO: 2087533 - RNA, 11 nt, Staphylococcus aureus subsp. aureus MW2
gcaaaaucaac

SEQ ID NO: 2087534 - RNA, 19 nt, Staphylococcus aureus subsp. aureus MW2
gcaaaaucaacuuuaauca

SEQ ID NO: 2087535 - RNA, 20 nt, Staphylococcus aureus subsp. aureus MW2
gcaaaaucaacuuuaaucaa

SEQ ID NO: 2087536 - RNA, 15 nt, Staphylococcus aureus subsp. aureus MW2
gcaaacacaguacaa

SEQ ID NO: 2087537 - RNA, 18 nt, Staphylococcus aureus subsp. aureus MW2
gcaaacacaguacaaaua

SEQ ID NO: 2087538 - RNA, 19 nt, Staphylococcus aureus subsp. aureus MW2
gcaaaauuauguaaaaaau

SEQ ID NO: 2087539 - RNA, 12 nt, Staphylococcus aureus subsp. aureus MW2
gcaaagaaaaac

SEQ ID NO: 2087540 - RNA, 14 nt, Staphylococcus aureus subsp. aureus MW2
gcaaagaaaaacau

SEQ ID NO: 2087541 - RNA, 13 nt, Staphylococcus aureus subsp. aureus MW2
gcaaagacucaau

SEQ ID NO: 2087542 - RNA, 19 nt, Staphylococcus aureus subsp. aureus MW2
gcaaauauuauuaaaucaa

SEQ ID NO: 2087543 - RNA, 13 nt, Staphylococcus aureus subsp. aureus MW2
gcaaauauuucug

SEQ ID NO: 2087544 - RNA, 11 nt, Staphylococcus aureus subsp. aureus MW2
gcaaauacuuc

SEQ ID NO: 2087545 - RNA, 15 nt, Staphylococcus aureus subsp. aureus MW2
gcaaauauuauuaaa

SEQ ID NO: 2087546 - RNA, 17 nt, Staphylococcus aureus subsp. aureus MW2
gcaaauuaucauuaaau

SEQ ID NO: 2087547 - RNA, 21 nt, Staphylococcus aureus subsp. aureus MW2
gcaaaugccucuuuugaguau

SEQ ID NO: 2087548 - RNA, 17 nt, Staphylococcus aureus subsp. aureus MW2
gcaaauuaguaugacuu

SEQ ID NO: 2087549 - RNA, 18 nt, Staphylococcus aureus subsp. aureus MW2
gcaaauuaguaugacuua

SEQ ID NO: 2087550 - RNA, 21 nt, Staphylococcus aureus subsp. aureus MW2
gcaaaggcgcgccaugugccu

SEQ ID NO: 2087551 - RNA, 19 nt, Staphylococcus aureus subsp. aureus MW2
gcagauguugguucaucaa

SEQ ID NO: 2087552 - RNA, 15 nt, Staphylococcus aureus subsp. aureus MW2
gcagauugauauaaa

SEQ ID NO: 2087553 - RNA, 13 nt, Staphylococcus aureus subsp. aureus MW2
gcagcaucauaau

SEQ ID NO: 2087554 - RNA, 13 nt, Staphylococcus aureus subsp. aureus MW2
gcagcuuuauaau

SEQ ID NO: 2087555 - RNA, 22 nt, Staphylococcus aureus subsp. aureus MW2
gcagugcuaauuuugagacaaa

SEQ ID NO: 2087556 - RNA, 14 nt, Staphylococcus aureus subsp. aureus MW2
gcauaaaaaaagaa

SEQ ID NO: 2087557 - RNA, 16 nt, Staphylococcus aureus subsp. aureus MW2
gcauaauauauuaaaa

SEQ ID NO: 2087558 - RNA, 17 nt, Staphylococcus aureus subsp. aureus MW2
gcauaauauauuaaaaa

SEQ ID NO: 2087559 - RNA, 21 nt, Staphylococcus aureus subsp. aureus MW2
gcauaauauauuaaaaaucaa

SEQ ID NO: 2087560 - RNA, 14 nt, Staphylococcus aureus subsp. aureus MW2
gcauauauauagau

SEQ ID NO: 2087561 - RNA, 19 nt, Staphylococcus aureus subsp. aureus MW2
gcauauaaagucauacuua

SEQ ID NO: 2087562 - RNA, 22 nt, Staphylococcus aureus subsp. aureus MW2
gcauauaaagucauacuuauga

SEQ ID NO: 2087563 - RNA, 13 nt, Staphylococcus aureus subsp. aureus MW2
gcauacguaaaug

SEQ ID NO: 2087564 - RNA, 18 nt, Staphylococcus aureus subsp. aureus MW2
gcauacgaauuaaaauaa

SEQ ID NO: 2087565 - RNA, 19 nt, Staphylococcus aureus subsp. aureus MW2
gcauaauuugugguaugac

SEQ ID NO: 2087566 - RNA, 19 nt, Staphylococcus aureus subsp. aureus MW2
gcauaauuaggauuaacau

SEQ ID NO: 2087567 - RNA, 12 nt, Staphylococcus aureus subsp. aureus MW2
gcaguauauauc

SEQ ID NO: 2087568 - RNA, 22 nt, Staphylococcus aureus subsp. aureus MW2
gcaguaguugacugaacgaaaa

SEQ ID NO: 2087569 - RNA, 18 nt, Staphylococcus aureus subsp. aureus MW2
gcaguaucucaaauauua

SEQ ID NO: 2087570 - RNA, 22 nt, Staphylococcus aureus subsp. aureus MW2
gcaguaguugacuguaaaacaa

SEQ ID NO: 2087571 - RNA, 15 nt, Staphylococcus aureus subsp. aureus MW2
gcaucacaaaauugu

SEQ ID NO: 2087572 - RNA, 18 nt, Staphylococcus aureus subsp. aureus MW2
gcauaucuuuaucauuau

SEQ ID NO: 2087573 - RNA, 16 nt, Staphylococcus aureus subsp. aureus MW2
gcauauguaauacaaa

SEQ ID NO: 2087574 - RNA, 19 nt, Staphylococcus aureus subsp. aureus MW2
gcauauguaauacaaaaga

SEQ ID NO: 2087575 - RNA, 15 nt, Staphylococcus aureus subsp. aureus MW2
gcauauuaauauguu

SEQ ID NO: 2087576 - RNA, 19 nt, Staphylococcus aureus subsp. aureus MW2
gcaucaaaaauaaaaaugc

SEQ ID NO: 2087577 - RNA, 14 nt, Staphylococcus aureus subsp. aureus MW2
gcauauucacgaua

SEQ ID NO: 2087578 - RNA, 14 nt, Staphylococcus aureus subsp. aureus MW2
gcauauucaucaua

SEQ ID NO: 2087579 - RNA, 16 nt, Staphylococcus aureus subsp. aureus MW2
gcauauucaucauaua

SEQ ID NO: 2087580 - RNA, 12 nt, Staphylococcus aureus subsp. aureus MW2
gcauccuuaaua

SEQ ID NO: 2087581 - RNA, 19 nt, Staphylococcus aureus subsp. aureus MW2
gcaauugaaucaaauacau

SEQ ID NO: 2087582 - RNA, 19 nt, Staphylococcus aureus subsp. aureus MW2
gcaauuaaccuugauuuaa

SEQ ID NO: 2087583 - RNA, 20 nt, Staphylococcus aureus subsp. aureus MW2
gcaauuaaccuugauuuaau

SEQ ID NO: 2087584 - RNA, 21 nt, Staphylococcus aureus subsp. aureus MW2
gcaauuaaagucaauuuaaau

SEQ ID NO: 2087585 - RNA, 17 nt, Staphylococcus aureus subsp. aureus MW2
gcaauggcuaaugacuu

SEQ ID NO: 2087586 - RNA, 16 nt, Staphylococcus aureus subsp. aureus MW2
gcacaucauugauaga

SEQ ID NO: 2087587 - RNA, 13 nt, Staphylococcus aureus subsp. aureus MW2
gcacauaaaucaa

SEQ ID NO: 2087588 - RNA, 19 nt, Staphylococcus aureus subsp. aureus MW2
gcacaucagauauaaguag

SEQ ID NO: 2087589 - RNA, 14 nt, Staphylococcus aureus subsp. aureus MW2
gcacaucagcacag

SEQ ID NO: 2087590 - RNA, 18 nt, Staphylococcus aureus subsp. aureus MW2
gcaaauugauuaaauaaa

SEQ ID NO: 2087591 - RNA, 14 nt, Staphylococcus aureus subsp. aureus MW2
gcaacuuguauugu

SEQ ID NO: 2087592 - RNA, 22 nt, Staphylococcus aureus subsp. aureus MW2
gcaacuuguauuguuuguagaa

SEQ ID NO: 2087593 - RNA, 22 nt, Staphylococcus aureus subsp. aureus MW2
gcaagucucauaucuauuuuuc

SEQ ID NO: 2087594 - RNA, 23 nt, Staphylococcus aureus subsp. aureus MW2
gcaagugccguccauuuccauga

SEQ ID NO: 2087595 - RNA, 19 nt, Staphylococcus aureus subsp. aureus MW2
gcaaguguaucgcccauac

SEQ ID NO: 2087596 - RNA, 16 nt, Staphylococcus aureus subsp. aureus MW2
gcaagugcuucaacuu

SEQ ID NO: 2087597 - RNA, 14 nt, Staphylococcus aureus subsp. aureus MW2
gcaauagcaccaua

SEQ ID NO: 2087598 - RNA, 21 nt, Staphylococcus aureus subsp. aureus MW2
gcaaguuauaucauaacuuaa

SEQ ID NO: 2087599 - RNA, 18 nt, Staphylococcus aureus subsp. aureus MW2
gcaaucguugaaaaauau

SEQ ID NO: 2087600 - RNA, 19 nt, Staphylococcus aureus subsp. aureus MW2
gcaaugcgaguugggguga

SEQ ID NO: 2087601 - RNA, 14 nt, Staphylococcus aureus subsp. aureus MW2
gcacgagaaauguc

SEQ ID NO: 2087602 - RNA, 15 nt, Staphylococcus aureus subsp. aureus MW2
gcacgagacaauaau

SEQ ID NO: 2087603 - RNA, 16 nt, Staphylococcus aureus subsp. aureus MW2
gcacgagacaauaaug

SEQ ID NO: 2087604 - RNA, 13 nt, Staphylococcus aureus subsp. aureus MW2
gcacgacuuucua

SEQ ID NO: 2087605 - RNA, 21 nt, Staphylococcus aureus subsp. aureus MW2
gcaccuuuauuaccagcuuuc

SEQ ID NO: 2087606 - RNA, 21 nt, Staphylococcus aureus subsp. aureus MW2
gcaccgucaaacuuaaaacua

SEQ ID NO: 2087607 - RNA, 18 nt, Staphylococcus aureus subsp. aureus MW2
gcaccucuuuuguuuagu

SEQ ID NO: 2087608 - RNA, 21 nt, Staphylococcus aureus subsp. aureus MW2
gcaccgauuuggucagcgaca

SEQ ID NO: 2087609 - RNA, 13 nt, Staphylococcus aureus subsp. aureus MW2
gcacuaucuuuug

SEQ ID NO: 2087610 - RNA, 17 nt, Staphylococcus aureus subsp. aureus MW2
gcacuaauauuuaaaaa

SEQ ID NO: 2087611 - RNA, 21 nt, Staphylococcus aureus subsp. aureus MW2
gcacuauaaaauucaccaacu

SEQ ID NO: 2087612 - RNA, 15 nt, Staphylococcus aureus subsp. aureus MW2
gcacugagcaacaaa

SEQ ID NO: 2087613 - RNA, 14 nt, Staphylococcus aureus subsp. aureus MW2
gcacugagcaacaa

SEQ ID NO: 2087614 - RNA, 20 nt, Staphylococcus aureus subsp. aureus MW2
gcacucgguucauaaugauc

SEQ ID NO: 2087615 - RNA, 21 nt, Staphylococcus aureus subsp. aureus MW2
gcccuagguuuauauaucaca

SEQ ID NO: 2087616 - RNA, 21 nt, Staphylococcus aureus subsp. aureus MW2
gccgagauuauuauguggaaa

SEQ ID NO: 2087617 - RNA, 15 nt, Staphylococcus aureus subsp. aureus MW2
gccgugaaagaaaaa

SEQ ID NO: 2087618 - RNA, 22 nt, Staphylococcus aureus subsp. aureus MW2
gccgugaaagaaaaaacuuuuc

SEQ ID NO: 2087619 - RNA, 18 nt, Staphylococcus aureus subsp. aureus MW2
gcaucuccgaaggccaug

SEQ ID NO: 2087620 - RNA, 15 nt, Staphylococcus aureus subsp. aureus MW2
gcaugacuguaagua

SEQ ID NO: 2087621 - RNA, 15 nt, Staphylococcus aureus subsp. aureus MW2
gcaugccagaugcaa

SEQ ID NO: 2087622 - RNA, 16 nt, Staphylococcus aureus subsp. aureus MW2
gcaucuuuaccauaua

SEQ ID NO: 2087623 - RNA, 14 nt, Staphylococcus aureus subsp. aureus MW2
gcaugacagcaaau

SEQ ID NO: 2087624 - RNA, 17 nt, Staphylococcus aureus subsp. aureus MW2
gcaugacagcaaauuuu

SEQ ID NO: 2087625 - RNA, 19 nt, Staphylococcus aureus subsp. aureus MW2
gcaugaaucgcauuuaaau

SEQ ID NO: 2087626 - RNA, 20 nt, Staphylococcus aureus subsp. aureus MW2
gcaugaagugggauaugaau

SEQ ID NO: 2087627 - RNA, 18 nt, Staphylococcus aureus subsp. aureus MW2
gcauuaagaugauugucu

SEQ ID NO: 2087628 - RNA, 13 nt, Staphylococcus aureus subsp. aureus MW2
gcauuaauguuca

SEQ ID NO: 2087629 - RNA, 17 nt, Staphylococcus aureus subsp. aureus MW2
gcauuaaguucaucaug

SEQ ID NO: 2087630 - RNA, 18 nt, Staphylococcus aureus subsp. aureus MW2
gcauuacuacuuuauaaa

SEQ ID NO: 2087631 - RNA, 15 nt, Staphylococcus aureus subsp. aureus MW2
gcauuacuacaaacu

SEQ ID NO: 2087632 - RNA, 20 nt, Staphylococcus aureus subsp. aureus MW2
gcauguuauauuaugaacau

SEQ ID NO: 2087633 - RNA, 16 nt, Staphylococcus aureus subsp. aureus MW2
gcauuauuauuucauu

SEQ ID NO: 2087634 - RNA, 20 nt, Staphylococcus aureus subsp. aureus MW2
gcauuauuauuucauuagaa

SEQ ID NO: 2087635 - RNA, 14 nt, Staphylococcus aureus subsp. aureus MW2
gcauuauuauaaua

SEQ ID NO: 2087636 - RNA, 21 nt, Staphylococcus aureus subsp. aureus MW2
gcauuauagaugacuguagaa

SEQ ID NO: 2087637 - RNA, 21 nt, Staphylococcus aureus subsp. aureus MW2
gcauuauuauuucauuagaaa

SEQ ID NO: 2087638 - RNA, 15 nt, Staphylococcus aureus subsp. aureus MW2
gcauucuuccaacac

SEQ ID NO: 2087639 - RNA, 18 nt, Staphylococcus aureus subsp. aureus MW2
gcauuuaaauauaaccua

SEQ ID NO: 2087640 - RNA, 18 nt, Staphylococcus aureus subsp. aureus MW2
gccaaaggcaaaauguau

SEQ ID NO: 2087641 - RNA, 21 nt, Staphylococcus aureus subsp. aureus MW2
gccaaacaaccugugauaaaa

SEQ ID NO: 2087642 - RNA, 18 nt, Staphylococcus aureus subsp. aureus MW2
gcauuuuuucauuauuaa

SEQ ID NO: 2087643 - RNA, 15 nt, Staphylococcus aureus subsp. aureus MW2
gcauuuuaaauaaaa

SEQ ID NO: 2087644 - RNA, 17 nt, Staphylococcus aureus subsp. aureus MW2
gccaacuaaaucaccau

SEQ ID NO: 2087645 - RNA, 16 nt, Staphylococcus aureus subsp. aureus MW2
gccaacaccauuauag

SEQ ID NO: 2087646 - RNA, 14 nt, Staphylococcus aureus subsp. aureus MW2
gccaauaaaauguc

SEQ ID NO: 2087647 - RNA, 13 nt, Staphylococcus aureus subsp. aureus MW2
gccaauuaaaauu

SEQ ID NO: 2087648 - RNA, 12 nt, Staphylococcus aureus subsp. aureus MW2
gccaauuaauaa

SEQ ID NO: 2087649 - RNA, 17 nt, Staphylococcus aureus subsp. aureus MW2
gccacaacauguuugga

SEQ ID NO: 2087650 - RNA, 14 nt, Staphylococcus aureus subsp. aureus MW2
gccacacaucaaca

SEQ ID NO: 2087651 - RNA, 14 nt, Staphylococcus aureus subsp. aureus MW2
gccaggugauugac

SEQ ID NO: 2087652 - RNA, 22 nt, Staphylococcus aureus subsp. aureus MW2
gccaucuuuuuuagcugaacca

SEQ ID NO: 2087653 - RNA, 11 nt, Staphylococcus aureus subsp. aureus MW2
gccaucuuuuu

SEQ ID NO: 2087654 - RNA, 15 nt, Staphylococcus aureus subsp. aureus MW2
gccaucuuaccuuua

SEQ ID NO: 2087655 - RNA, 15 nt, Staphylococcus aureus subsp. aureus MW2
gccauuaaaauuacg

SEQ ID NO: 2087656 - RNA, 16 nt, Staphylococcus aureus subsp. aureus MW2
gccaucaauuucugua

SEQ ID NO: 2087657 - RNA, 20 nt, Staphylococcus aureus subsp. aureus MW2
gccauuuuuauuuaacacuu

SEQ ID NO: 2087658 - RNA, 23 nt, Staphylococcus aureus subsp. aureus MW2
gccauuuuuauuuaacacuucag

SEQ ID NO: 2087659 - RNA, 16 nt, Staphylococcus aureus subsp. aureus MW2
gccauuuguaacaaua

SEQ ID NO: 2087660 - RNA, 14 nt, Staphylococcus aureus subsp. aureus MW2
gcccaaacauagag

SEQ ID NO: 2087661 - RNA, 12 nt, Staphylococcus aureus subsp. aureus MW2
gcuagaaguucu

SEQ ID NO: 2087662 - RNA, 14 nt, Staphylococcus aureus subsp. aureus MW2
gcuagaaguucuua

SEQ ID NO: 2087663 - RNA, 18 nt, Staphylococcus aureus subsp. aureus MW2
gcuagaaguucuuaugca

SEQ ID NO: 2087664 - RNA, 11 nt, Staphylococcus aureus subsp. aureus MW2
gcuauaaaagu

SEQ ID NO: 2087665 - RNA, 20 nt, Staphylococcus aureus subsp. aureus MW2
gcuauaaaaguacuuuaaaa

SEQ ID NO: 2087666 - RNA, 19 nt, Staphylococcus aureus subsp. aureus MW2
gcuauaagaacuaaugguu

SEQ ID NO: 2087667 - RNA, 15 nt, Staphylococcus aureus subsp. aureus MW2
gcuaguucagcuucu

SEQ ID NO: 2087668 - RNA, 18 nt, Staphylococcus aureus subsp. aureus MW2
gcuauaaucuaucuugug

SEQ ID NO: 2087669 - RNA, 20 nt, Staphylococcus aureus subsp. aureus MW2
gcuauauuuuuguauuuaug

SEQ ID NO: 2087670 - RNA, 17 nt, Staphylococcus aureus subsp. aureus MW2
gcuaucaacgauugaau

SEQ ID NO: 2087671 - RNA, 18 nt, Staphylococcus aureus subsp. aureus MW2
gcuauauaauuuauaaaa

SEQ ID NO: 2087672 - RNA, 19 nt, Staphylococcus aureus subsp. aureus MW2
gcuauuccuaguucuaugu

SEQ ID NO: 2087673 - RNA, 13 nt, Staphylococcus aureus subsp. aureus MW2
gcuauuaaaauag

SEQ ID NO: 2087674 - RNA, 15 nt, Staphylococcus aureus subsp. aureus MW2
gcuccccaauuucuc

SEQ ID NO: 2087675 - RNA, 20 nt, Staphylococcus aureus subsp. aureus MW2
gcugaaucgaguuugaaaua

SEQ ID NO: 2087676 - RNA, 14 nt, Staphylococcus aureus subsp. aureus MW2
gcucuaugcuuuua

SEQ ID NO: 2087677 - RNA, 23 nt, Staphylococcus aureus subsp. aureus MW2
gcucguuuuuuuagcuauagaaa

SEQ ID NO: 2087678 - RNA, 20 nt, Staphylococcus aureus subsp. aureus MW2
gcucuaaacuucuauuaaua

SEQ ID NO: 2087679 - RNA, 20 nt, Staphylococcus aureus subsp. aureus MW2
gcucguuaaaucacauauga

SEQ ID NO: 2087680 - RNA, 20 nt, Staphylococcus aureus subsp. aureus MW2
gcucuuaauguacuuuucug

SEQ ID NO: 2087681 - RNA, 13 nt, Staphylococcus aureus subsp. aureus MW2
gcucuuaaaucac

SEQ ID NO: 2087682 - RNA, 22 nt, Staphylococcus aureus subsp. aureus MW2
gcucuuauaaagacaccuucaa

SEQ ID NO: 2087683 - RNA, 22 nt, Staphylococcus aureus subsp. aureus MW2
gcucuuaauguacuuuucuguc

SEQ ID NO: 2087684 - RNA, 22 nt, Staphylococcus aureus subsp. aureus MW2
gcucuggauuuuucuuauaaaa

SEQ ID NO: 2087685 - RNA, 22 nt, Staphylococcus aureus subsp. aureus MW2
gcucugaagaagacauucccca

SEQ ID NO: 2087686 - RNA, 18 nt, Staphylococcus aureus subsp. aureus MW2
gcugaaacuaaguuuaau

SEQ ID NO: 2087687 - RNA, 17 nt, Staphylococcus aureus subsp. aureus MW2
gcucuuuucuuguuucg

SEQ ID NO: 2087688 - RNA, 16 nt, Staphylococcus aureus subsp. aureus MW2
gcucuuuuuauuuaua

SEQ ID NO: 2087689 - RNA, 18 nt, Staphylococcus aureus subsp. aureus MW2
gcucuuuaucaccauaaa

SEQ ID NO: 2087690 - RNA, 13 nt, Staphylococcus aureus subsp. aureus MW2
gcucuugcuaaag

SEQ ID NO: 2087691 - RNA, 19 nt, Staphylococcus aureus subsp. aureus MW2
gcucuugcuaaaguguagc

SEQ ID NO: 2087692 - RNA, 16 nt, Staphylococcus aureus subsp. aureus MW2
gcucuucuucuucagg

SEQ ID NO: 2087693 - RNA, 20 nt, Staphylococcus aureus subsp. aureus MW2
gcguuuaaucacaucuuuuu

SEQ ID NO: 2087694 - RNA, 11 nt, Staphylococcus aureus subsp. aureus MW2
gcguauuuuuu

SEQ ID NO: 2087695 - RNA, 13 nt, Staphylococcus aureus subsp. aureus MW2
gcguauuuuaaug

SEQ ID NO: 2087696 - RNA, 19 nt, Staphylococcus aureus subsp. aureus MW2
gcggguaauauuuuuguug

SEQ ID NO: 2087697 - RNA, 14 nt, Staphylococcus aureus subsp. aureus MW2
gcggaaagucagca

SEQ ID NO: 2087698 - RNA, 14 nt, Staphylococcus aureus subsp. aureus MW2
gcggaaagucagcu

SEQ ID NO: 2087699 - RNA, 21 nt, Staphylococcus aureus subsp. aureus MW2
gcgcuuuuuaauuuguauuua

SEQ ID NO: 2087700 - RNA, 15 nt, Staphylococcus aureus subsp. aureus MW2
gcggauaguguugcg

SEQ ID NO: 2087701 - RNA, 19 nt, Staphylococcus aureus subsp. aureus MW2
gcggauuaucuaacucaua

SEQ ID NO: 2087702 - RNA, 16 nt, Staphylococcus aureus subsp. aureus MW2
gccuaaaaauaaaauc

SEQ ID NO: 2087703 - RNA, 16 nt, Staphylococcus aureus subsp. aureus MW2
gccuaaauauuuaccu

SEQ ID NO: 2087704 - RNA, 21 nt, Staphylococcus aureus subsp. aureus MW2
gcgaaacuuagugucacauua

SEQ ID NO: 2087705 - RNA, 19 nt, Staphylococcus aureus subsp. aureus MW2
gcgaacagcugcuucucuu

SEQ ID NO: 2087706 - RNA, 22 nt, Staphylococcus aureus subsp. aureus MW2
gcgaagaccuccucuuuuauuu

SEQ ID NO: 2087707 - RNA, 19 nt, Staphylococcus aureus subsp. aureus MW2
gcgacauguccauaauauc

SEQ ID NO: 2087708 - RNA, 21 nt, Staphylococcus aureus subsp. aureus MW2
gcgauaagcaugauaaaaaua

SEQ ID NO: 2087709 - RNA, 14 nt, Staphylococcus aureus subsp. aureus MW2
gcgccauaaucauu

SEQ ID NO: 2087710 - RNA, 18 nt, Staphylococcus aureus subsp. aureus MW2
gcugcaaucguugaaaaa

SEQ ID NO: 2087711 - RNA, 12 nt, Staphylococcus aureus subsp. aureus MW2
gcugauuucuau

SEQ ID NO: 2087712 - RNA, 17 nt, Staphylococcus aureus subsp. aureus MW2
gcugauucaaaaauugu

SEQ ID NO: 2087713 - RNA, 22 nt, Staphylococcus aureus subsp. aureus MW2
gcugguugcuucuuaucaacaa

SEQ ID NO: 2087714 - RNA, 12 nt, Staphylococcus aureus subsp. aureus MW2
gcugucauaccu

SEQ ID NO: 2087715 - RNA, 20 nt, Staphylococcus aureus subsp. aureus MW2
gcuguuuuuauuauaauaga

SEQ ID NO: 2087716 - RNA, 18 nt, Staphylococcus aureus subsp. aureus MW2
gcuguucuuuuuauuuac

SEQ ID NO: 2087717 - RNA, 20 nt, Staphylococcus aureus subsp. aureus MW2
gcuguucuuuuuauuuacuc

SEQ ID NO: 2087718 - RNA, 20 nt, Staphylococcus aureus subsp. aureus MW2
gcuguuaauaaaucauuagu

SEQ ID NO: 2087719 - RNA, 18 nt, Staphylococcus aureus subsp. aureus MW2
gcuguguaucaucauaau

SEQ ID NO: 2087720 - RNA, 18 nt, Staphylococcus aureus subsp. aureus MW2
gcuuauacuauauaauaa

SEQ ID NO: 2087721 - RNA, 15 nt, Staphylococcus aureus subsp. aureus MW2
gcuuaguaaguugua

SEQ ID NO: 2087722 - RNA, 12 nt, Staphylococcus aureus subsp. aureus MW2
gcuuaucauuac

SEQ ID NO: 2087723 - RNA, 13 nt, Staphylococcus aureus subsp. aureus MW2
gcuuauugaaaag

SEQ ID NO: 2087724 - RNA, 18 nt, Staphylococcus aureus subsp. aureus MW2
gcuuauucugaaaaauau

SEQ ID NO: 2087725 - RNA, 16 nt, Staphylococcus aureus subsp. aureus MW2
gcuuaauuuuauuauu

SEQ ID NO: 2087726 - RNA, 11 nt, Staphylococcus aureus subsp. aureus MW2
gcuuacaauaa

SEQ ID NO: 2087727 - RNA, 17 nt, Staphylococcus aureus subsp. aureus MW2
gcuuacaauaaugugca

SEQ ID NO: 2087728 - RNA, 13 nt, Staphylococcus aureus subsp. aureus MW2
gcuuaauuuaugu

SEQ ID NO: 2087729 - RNA, 14 nt, Staphylococcus aureus subsp. aureus MW2
gcuuaauucuucau

SEQ ID NO: 2087730 - RNA, 13 nt, Staphylococcus aureus subsp. aureus MW2
gcuuaauuugaca

SEQ ID NO: 2087731 - RNA, 18 nt, Staphylococcus aureus subsp. aureus MW2
gcuuacauuaugaacaga

SEQ ID NO: 2087732 - RNA, 16 nt, Staphylococcus aureus subsp. aureus MW2
gcuuaagaaauuuuuu

SEQ ID NO: 2087733 - RNA, 19 nt, Staphylococcus aureus subsp. aureus MW2
gcuuaauggcgugcuuuuc

SEQ ID NO: 2087734 - RNA, 13 nt, Staphylococcus aureus subsp. aureus MW2
gcuuaauagaggu

SEQ ID NO: 2087735 - RNA, 19 nt, Staphylococcus aureus subsp. aureus MW2
gcuguuuuuauuugaaaua

SEQ ID NO: 2087736 - RNA, 12 nt, Staphylococcus aureus subsp. aureus MW2
gcuuaaaucaaa

SEQ ID NO: 2087737 - RNA, 21 nt, Staphylococcus aureus subsp. aureus MW2
gcuuccaauuuaaaaugauuc

SEQ ID NO: 2087738 - RNA, 21 nt, Staphylococcus aureus subsp. aureus MW2
gcuuccaccgcugcucuucuc

SEQ ID NO: 2087739 - RNA, 22 nt, Staphylococcus aureus subsp. aureus MW2
gcuuccaccgcugcucuucucu

SEQ ID NO: 2087740 - RNA, 23 nt, Staphylococcus aureus subsp. aureus MW2
gcuuccaccgcugcucuucucuu

SEQ ID NO: 2087741 - RNA, 21 nt, Staphylococcus aureus subsp. aureus MW2
gcuuauugaaaagauaaacaa

SEQ ID NO: 2087742 - RNA, 15 nt, Staphylococcus aureus subsp. aureus MW2
gcuucaaaagcgaaa

SEQ ID NO: 2087743 - RNA, 17 nt, Staphylococcus aureus subsp. aureus MW2
gcuuauuuuuguauucu

SEQ ID NO: 2087744 - RNA, 17 nt, Staphylococcus aureus subsp. aureus MW2
gcuucaacuucaucuaa

SEQ ID NO: 2087745 - RNA, 18 nt, Staphylococcus aureus subsp. aureus MW2
gcuucaacuucaucuaaa

SEQ ID NO: 2087746 - RNA, 20 nt, Staphylococcus aureus subsp. aureus MW2
gcuucaacuucaucuaaaug

SEQ ID NO: 2087747 - RNA, 16 nt, Staphylococcus aureus subsp. aureus MW2
gcuucugguucuucaa

SEQ ID NO: 2087748 - RNA, 19 nt, Staphylococcus aureus subsp. aureus MW2
gcuucuuaucaacaacaag

SEQ ID NO: 2087749 - RNA, 16 nt, Staphylococcus aureus subsp. aureus MW2
gcuugaaguuguuucu

SEQ ID NO: 2087750 - RNA, 17 nt, Staphylococcus aureus subsp. aureus MW2
gcuucuuucuaaaauaa

SEQ ID NO: 2087751 - RNA, 23 nt, Staphylococcus aureus subsp. aureus MW2
gcuucuuuguuggggccccgcca

SEQ ID NO: 2087752 - RNA, 19 nt, Staphylococcus aureus subsp. aureus MW2
gcuucuauguuggggcccc

SEQ ID NO: 2087753 - RNA, 21 nt, Staphylococcus aureus subsp. aureus MW2
gcuucucuuugaacgaaagag

SEQ ID NO: 2087754 - RNA, 19 nt, Staphylococcus aureus subsp. aureus MW2
gcuucgucacguaaaauau

SEQ ID NO: 2087755 - RNA, 18 nt, Staphylococcus aureus subsp. aureus MW2
gcuucgcuagaaccugcu

SEQ ID NO: 2087756 - RNA, 20 nt, Staphylococcus aureus subsp. aureus MW2
gcuugccuacuuuuuuggca

SEQ ID NO: 2087757 - RNA, 15 nt, Staphylococcus aureus subsp. aureus MW2
gcuugcuucuuuccu

SEQ ID NO: 2087758 - RNA, 16 nt, Staphylococcus aureus subsp. aureus MW2
gcuugcuuacaauaau

SEQ ID NO: 2087759 - RNA, 14 nt, Staphylococcus aureus subsp. aureus MW2
gcuuggacauauac

SEQ ID NO: 2087760 - RNA, 21 nt, Staphylococcus aureus subsp. aureus MW2
gcuuguaacaagcuuuucauu

SEQ ID NO: 2087761 - RNA, 22 nt, Staphylococcus aureus subsp. aureus MW2
gcuuguacaaaaaauuguaagu

SEQ ID NO: 2087762 - RNA, 16 nt, Staphylococcus aureus subsp. aureus MW2
gcuuguccucuaaaac

SEQ ID NO: 2087763 - RNA, 19 nt, Staphylococcus aureus subsp. aureus MW2
gcuuguucaacuaaauuuu

SEQ ID NO: 2087764 - RNA, 18 nt, Staphylococcus aureus subsp. aureus MW2
gcuuuaacuugauuuucu

SEQ ID NO: 2087765 - RNA, 22 nt, Staphylococcus aureus subsp. aureus MW2
gcuuuaaaggcauuguguauga

SEQ ID NO: 2087766 - RNA, 12 nt, Staphylococcus aureus subsp. aureus MW2
gcuuuaaacauu

SEQ ID NO: 2087767 - RNA, 17 nt, Staphylococcus aureus subsp. aureus MW2
gcuuuaaacauugacua

SEQ ID NO: 2087768 - RNA, 20 nt, Staphylococcus aureus subsp. aureus MW2
gcuuuagucgguguuuucuu

SEQ ID NO: 2087769 - RNA, 16 nt, Staphylococcus aureus subsp. aureus MW2
gcuuuagcaauugaau

SEQ ID NO: 2087770 - RNA, 19 nt, Staphylococcus aureus subsp. aureus MW2
gcuuuagucgguguuuucu

SEQ ID NO: 2087771 - RNA, 19 nt, Staphylococcus aureus subsp. aureus MW2
gcuuuacguucugauucau

SEQ ID NO: 2087772 - RNA, 13 nt, Staphylococcus aureus subsp. aureus MW2
gcuuuaauuaaag

SEQ ID NO: 2087773 - RNA, 18 nt, Staphylococcus aureus subsp. aureus MW2
gcuuuuucaaaaucuuua

SEQ ID NO: 2087774 - RNA, 14 nt, Staphylococcus aureus subsp. aureus MW2
gcuuuuuauuuuua

SEQ ID NO: 2087775 - RNA, 15 nt, Staphylococcus aureus subsp. aureus MW2
gcuuuuucaaauaau

SEQ ID NO: 2087776 - RNA, 18 nt, Staphylococcus aureus subsp. aureus MW2
gcuuuuucaaauaauaua

SEQ ID NO: 2087777 - RNA, 14 nt, Staphylococcus aureus subsp. aureus MW2
gcuuuuucacgauu

SEQ ID NO: 2087778 - RNA, 17 nt, Staphylococcus aureus subsp. aureus MW2
gcuuuuucuuuuguuuu

SEQ ID NO: 2087779 - RNA, 14 nt, Staphylococcus aureus subsp. aureus MW2
gcuuuuucuuaauu

SEQ ID NO: 2087780 - RNA, 13 nt, Staphylococcus aureus subsp. aureus MW2
gcuuuuuaaaaaa

SEQ ID NO: 2087781 - RNA, 15 nt, Staphylococcus aureus subsp. aureus MW2
gcuuuucuaauuuuu

SEQ ID NO: 2087782 - RNA, 17 nt, Staphylococcus aureus subsp. aureus MW2
gcuuuucuaauuuuucu

SEQ ID NO: 2087783 - RNA, 18 nt, Staphylococcus aureus subsp. aureus MW2
gcuuuucuaauuuuucuu

SEQ ID NO: 2087784 - RNA, 14 nt, Staphylococcus aureus subsp. aureus MW2
gcuuuuauuuauau

SEQ ID NO: 2087785 - RNA, 20 nt, Staphylococcus aureus subsp. aureus MW2
gcuuuuauuuauauuauuac

SEQ ID NO: 2087786 - RNA, 13 nt, Staphylococcus aureus subsp. aureus MW2
gcuuuuauuuuua

SEQ ID NO: 2087787 - RNA, 15 nt, Staphylococcus aureus subsp. aureus MW2
gcuuuguuuuuagua

SEQ ID NO: 2087788 - RNA, 22 nt, Staphylococcus aureus subsp. aureus MW2
gcuuuuaauuaauuaucauaaa

SEQ ID NO: 2087789 - RNA, 17 nt, Staphylococcus aureus subsp. aureus MW2
gcuuuggauuucuuuuu

SEQ ID NO: 2087790 - RNA, 20 nt, Staphylococcus aureus subsp. aureus MW2
gcuuugucacgauagauuua

SEQ ID NO: 2087791 - RNA, 23 nt, Staphylococcus aureus subsp. aureus MW2
gcuuugucacgauagauuuauca

SEQ ID NO: 2087792 - RNA, 18 nt, Staphylococcus aureus subsp. aureus MW2
gcuuuaucaacaaauuuu

SEQ ID NO: 2087793 - RNA, 23 nt, Staphylococcus aureus subsp. aureus MW2
gcuuuauuuucuuguguauuuuu

SEQ ID NO: 2087794 - RNA, 13 nt, Staphylococcus aureus subsp. aureus MW2
gcuuugauuucau

SEQ ID NO: 2087795 - RNA, 17 nt, Staphylococcus aureus subsp. aureus MW2
gcuuugauuucauuugu

SEQ ID NO: 2087796 - RNA, 22 nt, Staphylococcus aureus subsp. aureus MW2
ggaaaauuauuugauauuucau

SEQ ID NO: 2087797 - RNA, 17 nt, Staphylococcus aureus subsp. aureus MW2
ggaaaauauauuauaaa

SEQ ID NO: 2087798 - RNA, 22 nt, Staphylococcus aureus subsp. aureus MW2
ggaaaauauauuauaaaaauag

SEQ ID NO: 2087799 - RNA, 21 nt, Staphylococcus aureus subsp. aureus MW2
ggaaaauaucacuaauauauu

SEQ ID NO: 2087800 - RNA, 21 nt, Staphylococcus aureus subsp. aureus MW2
gcuuuuuucaauucuagucaa

SEQ ID NO: 2087801 - RNA, 15 nt, Staphylococcus aureus subsp. aureus MW2
gcuuuuuuaagauaa

SEQ ID NO: 2087802 - RNA, 21 nt, Staphylococcus aureus subsp. aureus MW2
gcuuuuuuaaauuuaauuucg

SEQ ID NO: 2087803 - RNA, 14 nt, Staphylococcus aureus subsp. aureus MW2
gcuuuuuuuauaag

SEQ ID NO: 2087804 - RNA, 15 nt, Staphylococcus aureus subsp. aureus MW2
ggaaauaaaaaauaa

SEQ ID NO: 2087805 - RNA, 17 nt, Staphylococcus aureus subsp. aureus MW2
ggaaaguaauaaguaau

SEQ ID NO: 2087806 - RNA, 13 nt, Staphylococcus aureus subsp. aureus MW2
ggaaagucagcau

SEQ ID NO: 2087807 - RNA, 19 nt, Staphylococcus aureus subsp. aureus MW2
ggaaagucagcauacaaua

SEQ ID NO: 2087808 - RNA, 20 nt, Staphylococcus aureus subsp. aureus MW2
ggaaagucagcauacaauaa

SEQ ID NO: 2087809 - RNA, 21 nt, Staphylococcus aureus subsp. aureus MW2
ggaaagucagcauacaauaau

SEQ ID NO: 2087810 - RNA, 16 nt, Staphylococcus aureus subsp. aureus MW2
ggaaagucagcuuaca

SEQ ID NO: 2087811 - RNA, 20 nt, Staphylococcus aureus subsp. aureus MW2
ggaaagucagcuuacaauaa

SEQ ID NO: 2087812 - RNA, 16 nt, Staphylococcus aureus subsp. aureus MW2
ggaaaucaguaauauc

SEQ ID NO: 2087813 - RNA, 16 nt, Staphylococcus aureus subsp. aureus MW2
ggaaauaucuuacugc

SEQ ID NO: 2087814 - RNA, 13 nt, Staphylococcus aureus subsp. aureus MW2
ggaaauaugaaaa

SEQ ID NO: 2087815 - RNA, 15 nt, Staphylococcus aureus subsp. aureus MW2
ggaaauaugaaaaga

SEQ ID NO: 2087816 - RNA, 16 nt, Staphylococcus aureus subsp. aureus MW2
ggaaauaugaaaagag

SEQ ID NO: 2087817 - RNA, 17 nt, Staphylococcus aureus subsp. aureus MW2
ggaaauauuccuuacua

SEQ ID NO: 2087818 - RNA, 15 nt, Staphylococcus aureus subsp. aureus MW2
ggaaauuuauuauaa

SEQ ID NO: 2087819 - RNA, 22 nt, Staphylococcus aureus subsp. aureus MW2
ggaaauuuauuauaaaauagaa

SEQ ID NO: 2087820 - RNA, 19 nt, Staphylococcus aureus subsp. aureus MW2
ggaaccacgguucaccauu

SEQ ID NO: 2087821 - RNA, 15 nt, Staphylococcus aureus subsp. aureus MW2
ggaagaccauuuuau

SEQ ID NO: 2087822 - RNA, 15 nt, Staphylococcus aureus subsp. aureus MW2
ggaagcauauuucua

SEQ ID NO: 2087823 - RNA, 12 nt, Staphylococcus aureus subsp. aureus MW2
ggaagaacagca

SEQ ID NO: 2087824 - RNA, 18 nt, Staphylococcus aureus subsp. aureus MW2
ggaacuacuacauuauua

SEQ ID NO: 2087825 - RNA, 19 nt, Staphylococcus aureus subsp. aureus MW2
ggaauauuaacaccagaua

SEQ ID NO: 2087826 - RNA, 20 nt, Staphylococcus aureus subsp. aureus MW2
ggaauauacaauaguauaaa

SEQ ID NO: 2087827 - RNA, 23 nt, Staphylococcus aureus subsp. aureus MW2
ggaaucagggacaaaaauucuuu

SEQ ID NO: 2087828 - RNA, 18 nt, Staphylococcus aureus subsp. aureus MW2
ggaauccaauuucucuau

SEQ ID NO: 2087829 - RNA, 21 nt, Staphylococcus aureus subsp. aureus MW2
ggaauuguuaauuucaacauu

SEQ ID NO: 2087830 - RNA, 23 nt, Staphylococcus aureus subsp. aureus MW2
ggaauguuccuccaccaccugca

SEQ ID NO: 2087831 - RNA, 13 nt, Staphylococcus aureus subsp. aureus MW2
ggaauuaauaaug

SEQ ID NO: 2087832 - RNA, 18 nt, Staphylococcus aureus subsp. aureus MW2
ggacuaacgucauuauau

SEQ ID NO: 2087833 - RNA, 21 nt, Staphylococcus aureus subsp. aureus MW2
ggauaaucacaauacgaaacc

SEQ ID NO: 2087834 - RNA, 23 nt, Staphylococcus aureus subsp. aureus MW2
ggagccaauuucuacagacaaug

SEQ ID NO: 2087835 - RNA, 15 nt, Staphylococcus aureus subsp. aureus MW2
ggagcauuucauuag

SEQ ID NO: 2087836 - RNA, 20 nt, Staphylococcus aureus subsp. aureus MW2
ggauaauuuuuaacagcgug

SEQ ID NO: 2087837 - RNA, 14 nt, Staphylococcus aureus subsp. aureus MW2
ggauaauuuuauug

SEQ ID NO: 2087838 - RNA, 16 nt, Staphylococcus aureus subsp. aureus MW2
ggauaaugguuucaaa

SEQ ID NO: 2087839 - RNA, 13 nt, Staphylococcus aureus subsp. aureus MW2
ggauaucuuuguu

SEQ ID NO: 2087840 - RNA, 18 nt, Staphylococcus aureus subsp. aureus MW2
ggauaucugaaguagauu

SEQ ID NO: 2087841 - RNA, 15 nt, Staphylococcus aureus subsp. aureus MW2
ggaugaacaaaauaa

SEQ ID NO: 2087842 - RNA, 20 nt, Staphylococcus aureus subsp. aureus MW2
ggaugggccccaacacagag

SEQ ID NO: 2087843 - RNA, 22 nt, Staphylococcus aureus subsp. aureus MW2
ggcagcuaaaaaguauacuaaa

SEQ ID NO: 2087844 - RNA, 19 nt, Staphylococcus aureus subsp. aureus MW2
ggcauaauacacauugcaa

SEQ ID NO: 2087845 - RNA, 15 nt, Staphylococcus aureus subsp. aureus MW2
ggcacauaaaucaau

SEQ ID NO: 2087846 - RNA, 13 nt, Staphylococcus aureus subsp. aureus MW2
ggcacgcauugaa

SEQ ID NO: 2087847 - RNA, 16 nt, Staphylococcus aureus subsp. aureus MW2
uaaugacaaauuauca

SEQ ID NO: 2087848 - RNA, 13 nt, Staphylococcus aureus subsp. aureus MW2
uaaugaacaaggg

SEQ ID NO: 2087849 - RNA, 18 nt, Staphylococcus aureus subsp. aureus MW2
uaaugagcccguuaaaaa

SEQ ID NO: 2087850 - RNA, 20 nt, Staphylococcus aureus subsp. aureus MW2
uaaugauacaaacccauaua

SEQ ID NO: 2087851 - RNA, 14 nt, Staphylococcus aureus subsp. aureus MW2
uaaugaucaucuau

SEQ ID NO: 2087852 - RNA, 20 nt, Staphylococcus aureus subsp. aureus MW2
uaaugauauauuacaucauu

SEQ ID NO: 2087853 - RNA, 22 nt, Staphylococcus aureus subsp. aureus MW2
uaaugacuucuuuauauuuauc

SEQ ID NO: 2087854 - RNA, 12 nt, Staphylococcus aureus subsp. aureus MW2
uaaugagaguaa

SEQ ID NO: 2087855 - RNA, 22 nt, Staphylococcus aureus subsp. aureus MW2
uaaugcaacuaaguugacuaua

SEQ ID NO: 2087856 - RNA, 15 nt, Staphylococcus aureus subsp. aureus MW2
uaaugcauuauuaua

SEQ ID NO: 2087857 - RNA, 13 nt, Staphylococcus aureus subsp. aureus MW2
uaaugauuuugcu

SEQ ID NO: 2087858 - RNA, 16 nt, Staphylococcus aureus subsp. aureus MW2
uaaugauugucuuaua

SEQ ID NO: 2087859 - RNA, 11 nt, Staphylococcus aureus subsp. aureus MW2
uaaugauucac

SEQ ID NO: 2087860 - RNA, 19 nt, Staphylococcus aureus subsp. aureus MW2
uaaugauuuuuauuauugu

SEQ ID NO: 2087861 - RNA, 22 nt, Staphylococcus aureus subsp. aureus MW2
uaaugauuuuuauuauugucau

SEQ ID NO: 2087862 - RNA, 20 nt, Staphylococcus aureus subsp. aureus MW2
uaaugauuuaauuuguuaua

SEQ ID NO: 2087863 - RNA, 14 nt, Staphylococcus aureus subsp. aureus MW2
uaaugauugucuua

SEQ ID NO: 2087864 - RNA, 14 nt, Staphylococcus aureus subsp. aureus MW2
uaaugauuuuucau

SEQ ID NO: 2087865 - RNA, 14 nt, Staphylococcus aureus subsp. aureus MW2
uaaugauuaaaaau

SEQ ID NO: 2087866 - RNA, 14 nt, Staphylococcus aureus subsp. aureus MW2
uaaugaugcgaugg

SEQ ID NO: 2087867 - RNA, 21 nt, Staphylococcus aureus subsp. aureus MW2
uaaugccuuuaccgugaauau

SEQ ID NO: 2087868 - RNA, 16 nt, Staphylococcus aureus subsp. aureus MW2
uaaugguauugauuau

SEQ ID NO: 2087869 - RNA, 14 nt, Staphylococcus aureus subsp. aureus MW2
uaaugcuaauuuaa

SEQ ID NO: 2087870 - RNA, 13 nt, Staphylococcus aureus subsp. aureus MW2
uaauuaauaauuu

SEQ ID NO: 2087871 - RNA, 15 nt, Staphylococcus aureus subsp. aureus MW2
uaauuaauaauuuaa

SEQ ID NO: 2087872 - RNA, 15 nt, Staphylococcus aureus subsp. aureus MW2
uaauuaaacauuuag

SEQ ID NO: 2087873 - RNA, 17 nt, Staphylococcus aureus subsp. aureus MW2
uaauuaaacauuuagau

SEQ ID NO: 2087874 - RNA, 23 nt, Staphylococcus aureus subsp. aureus MW2
uaauuaauuacuuucauuguaaa

SEQ ID NO: 2087875 - RNA, 13 nt, Staphylococcus aureus subsp. aureus MW2
uaauuaauuaaaa

SEQ ID NO: 2087876 - RNA, 21 nt, Staphylococcus aureus subsp. aureus MW2
uaauguuuccugauauuucaa

SEQ ID NO: 2087877 - RNA, 23 nt, Staphylococcus aureus subsp. aureus MW2
uaauguuuccugauauuucaacu

SEQ ID NO: 2087878 - RNA, 21 nt, Staphylococcus aureus subsp. aureus MW2
uaauguuugaagaccuucuaa

SEQ ID NO: 2087879 - RNA, 17 nt, Staphylococcus aureus subsp. aureus MW2
uaauuaaaaaauuccua

SEQ ID NO: 2087880 - RNA, 16 nt, Staphylococcus aureus subsp. aureus MW2
uaauuaccuuuccauu

SEQ ID NO: 2087881 - RNA, 14 nt, Staphylococcus aureus subsp. aureus MW2
uaauuacauguugg

SEQ ID NO: 2087882 - RNA, 18 nt, Staphylococcus aureus subsp. aureus MW2
uaauuaucauaaauauaa

SEQ ID NO: 2087883 - RNA, 16 nt, Staphylococcus aureus subsp. aureus MW2
uaauuaucuucaucau

SEQ ID NO: 2087884 - RNA, 16 nt, Staphylococcus aureus subsp. aureus MW2
uaauuauuccuucauu

SEQ ID NO: 2087885 - RNA, 23 nt, Staphylococcus aureus subsp. aureus MW2
uaauuauuccuucauugaagaau

SEQ ID NO: 2087886 - RNA, 21 nt, Staphylococcus aureus subsp. aureus MW2
uaauucaaugauuuuuaaaaa

SEQ ID NO: 2087887 - RNA, 20 nt, Staphylococcus aureus subsp. aureus MW2
uaauucaccaucauauucaa

SEQ ID NO: 2087888 - RNA, 13 nt, Staphylococcus aureus subsp. aureus MW2
uaauuauuuagau

SEQ ID NO: 2087889 - RNA, 15 nt, Staphylococcus aureus subsp. aureus MW2
uaauucauaaaugcu

SEQ ID NO: 2087890 - RNA, 15 nt, Staphylococcus aureus subsp. aureus MW2
uaauauaaaaacaaa

SEQ ID NO: 2087891 - RNA, 16 nt, Staphylococcus aureus subsp. aureus MW2
uaauauaaauuuugaa

SEQ ID NO: 2087892 - RNA, 17 nt, Staphylococcus aureus subsp. aureus MW2
uaauauaauuaaacauu

SEQ ID NO: 2087893 - RNA, 15 nt, Staphylococcus aureus subsp. aureus MW2
uaauauaauuauuaa

SEQ ID NO: 2087894 - RNA, 14 nt, Staphylococcus aureus subsp. aureus MW2
uaauauaauuaauu

SEQ ID NO: 2087895 - RNA, 14 nt, Staphylococcus aureus subsp. aureus MW2
uaauauauuacuaa

SEQ ID NO: 2087896 - RNA, 14 nt, Staphylococcus aureus subsp. aureus MW2
uaauauauuaaaaa

SEQ ID NO: 2087897 - RNA, 15 nt, Staphylococcus aureus subsp. aureus MW2
uaauauauuaaaaau

SEQ ID NO: 2087898 - RNA, 17 nt, Staphylococcus aureus subsp. aureus MW2
uaauauauccugccaau

SEQ ID NO: 2087899 - RNA, 14 nt, Staphylococcus aureus subsp. aureus MW2
uaauauauaaaagu

SEQ ID NO: 2087900 - RNA, 14 nt, Staphylococcus aureus subsp. aureus MW2
uaauauauuuauuu

SEQ ID NO: 2087901 - RNA, 14 nt, Staphylococcus aureus subsp. aureus MW2
uaauauauuuagau

SEQ ID NO: 2087902 - RNA, 21 nt, Staphylococcus aureus subsp. aureus MW2
uaauaucauauucaaaauaac

SEQ ID NO: 2087903 - RNA, 16 nt, Staphylococcus aureus subsp. aureus MW2
uaauaucaguagcaua

SEQ ID NO: 2087904 - RNA, 21 nt, Staphylococcus aureus subsp. aureus MW2
uaauaucaguagcauauugau

SEQ ID NO: 2087905 - RNA, 15 nt, Staphylococcus aureus subsp. aureus MW2
uaauaucuaaagauu

SEQ ID NO: 2087906 - RNA, 20 nt, Staphylococcus aureus subsp. aureus MW2
uaacguugcagagaauauag

SEQ ID NO: 2087907 - RNA, 16 nt, Staphylococcus aureus subsp. aureus MW2
uaacguugcagagaau

SEQ ID NO: 2087908 - RNA, 15 nt, Staphylococcus aureus subsp. aureus MW2
uaauagcgucaaguu

SEQ ID NO: 2087909 - RNA, 15 nt, Staphylococcus aureus subsp. aureus MW2
uaauaggcuagauaa

SEQ ID NO: 2087910 - RNA, 20 nt, Staphylococcus aureus subsp. aureus MW2
uaauagguucuucuuucaua

SEQ ID NO: 2087911 - RNA, 21 nt, Staphylococcus aureus subsp. aureus MW2
uaauaggauaugcuaaacacu

SEQ ID NO: 2087912 - RNA, 19 nt, Staphylococcus aureus subsp. aureus MW2
uaauauaaaaacaaaagaa

SEQ ID NO: 2087913 - RNA, 17 nt, Staphylococcus aureus subsp. aureus MW2
uaacgcuuuaaaucauu

SEQ ID NO: 2087914 - RNA, 20 nt, Staphylococcus aureus subsp. aureus MW2
uaacgucaacagcauaaaua

SEQ ID NO: 2087915 - RNA, 15 nt, Staphylococcus aureus subsp. aureus MW2
uaacguuaauauaau

SEQ ID NO: 2087916 - RNA, 14 nt, Staphylococcus aureus subsp. aureus MW2
uaacguuauucauu

SEQ ID NO: 2087917 - RNA, 13 nt, Staphylococcus aureus subsp. aureus MW2
uaacgucauucuu

SEQ ID NO: 2087918 - RNA, 19 nt, Staphylococcus aureus subsp. aureus MW2
uaauauuuauuuuaaauuu

SEQ ID NO: 2087919 - RNA, 17 nt, Staphylococcus aureus subsp. aureus MW2
uaauauuggacuuugcu

SEQ ID NO: 2087920 - RNA, 12 nt, Staphylococcus aureus subsp. aureus MW2
uaauauuuaaaa

SEQ ID NO: 2087921 - RNA, 18 nt, Staphylococcus aureus subsp. aureus MW2
uaauauuuaaaaaacaaa

SEQ ID NO: 2087922 - RNA, 21 nt, Staphylococcus aureus subsp. aureus MW2
uaauauugagacuauuauaau

SEQ ID NO: 2087923 - RNA, 16 nt, Staphylococcus aureus subsp. aureus MW2
uaauaugaacaaaaau

SEQ ID NO: 2087924 - RNA, 16 nt, Staphylococcus aureus subsp. aureus MW2
uaauaugaauuuagau

SEQ ID NO: 2087925 - RNA, 17 nt, Staphylococcus aureus subsp. aureus MW2
uaauauuauucuuuaua

SEQ ID NO: 2087926 - RNA, 21 nt, Staphylococcus aureus subsp. aureus MW2
uaauaucuuacuacuuaauua

SEQ ID NO: 2087927 - RNA, 13 nt, Staphylococcus aureus subsp. aureus MW2
uaauauugaauaa

SEQ ID NO: 2087928 - RNA, 17 nt, Staphylococcus aureus subsp. aureus MW2
uaauauugaaagauauu

SEQ ID NO: 2087929 - RNA, 17 nt, Staphylococcus aureus subsp. aureus MW2
uaaucacauuaauugga

SEQ ID NO: 2087930 - RNA, 15 nt, Staphylococcus aureus subsp. aureus MW2
uaaucagaaaagcag

SEQ ID NO: 2087931 - RNA, 16 nt, Staphylococcus aureus subsp. aureus MW2
uaaucacuucugaaaa

SEQ ID NO: 2087932 - RNA, 15 nt, Staphylococcus aureus subsp. aureus MW2
uaauccuuuuuuagg

SEQ ID NO: 2087933 - RNA, 23 nt, Staphylococcus aureus subsp. aureus MW2
uaauccgucuuuuuuuaugaaaa

SEQ ID NO: 2087934 - RNA, 20 nt, Staphylococcus aureus subsp. aureus MW2
uaaucccuucaacaguaauu

SEQ ID NO: 2087935 - RNA, 18 nt, Staphylococcus aureus subsp. aureus MW2
uaauccuauacguacugc

SEQ ID NO: 2087936 - RNA, 14 nt, Staphylococcus aureus subsp. aureus MW2
uaaucauuguguau

SEQ ID NO: 2087937 - RNA, 15 nt, Staphylococcus aureus subsp. aureus MW2
uaaucauuguuuuaa

SEQ ID NO: 2087938 - RNA, 17 nt, Staphylococcus aureus subsp. aureus MW2
uaaucauuguuuuaaau

SEQ ID NO: 2087939 - RNA, 19 nt, Staphylococcus aureus subsp. aureus MW2
uaaucaugaaguugguuua

SEQ ID NO: 2087940 - RNA, 17 nt, Staphylococcus aureus subsp. aureus MW2
uaaucauguaaugcuua

SEQ ID NO: 2087941 - RNA, 14 nt, Staphylococcus aureus subsp. aureus MW2
uaaucauuuuuuca

SEQ ID NO: 2087942 - RNA, 23 nt, Staphylococcus aureus subsp. aureus MW2
uacaacugaaucuccuugcucau

SEQ ID NO: 2087943 - RNA, 23 nt, Staphylococcus aureus subsp. aureus MW2
uacaacuuuaguuguuaggggcu

SEQ ID NO: 2087944 - RNA, 22 nt, Staphylococcus aureus subsp. aureus MW2
uacaaagcacaccuaauucaua

SEQ ID NO: 2087945 - RNA, 23 nt, Staphylococcus aureus subsp. aureus MW2
uacaagucuaguucgaacacaca

SEQ ID NO: 2087946 - RNA, 19 nt, Staphylococcus aureus subsp. aureus MW2
uacaauuauggauaaaauu

SEQ ID NO: 2087947 - RNA, 23 nt, Staphylococcus aureus subsp. aureus MW2
uacaauuaauuacuguaaauaug

SEQ ID NO: 2087948 - RNA, 13 nt, Staphylococcus aureus subsp. aureus MW2
uacaauuaauuac

SEQ ID NO: 2087949 - RNA, 17 nt, Staphylococcus aureus subsp. aureus MW2
uacaauuaaagugaaua

SEQ ID NO: 2087950 - RNA, 17 nt, Staphylococcus aureus subsp. aureus MW2
uacaauuauaaaugauu

SEQ ID NO: 2087951 - RNA, 19 nt, Staphylococcus aureus subsp. aureus MW2
uacaauuuagguuaauuaa

SEQ ID NO: 2087952 - RNA, 20 nt, Staphylococcus aureus subsp. aureus MW2
uacaauuuagguuaauuaaa

SEQ ID NO: 2087953 - RNA, 23 nt, Staphylococcus aureus subsp. aureus MW2
uacaauuuagguuaauuaaacaa

SEQ ID NO: 2087954 - RNA, 18 nt, Staphylococcus aureus subsp. aureus MW2
uacaauucauaagaaaaa

SEQ ID NO: 2087955 - RNA, 15 nt, Staphylococcus aureus subsp. aureus MW2
uacaccuacaaauau

SEQ ID NO: 2087956 - RNA, 15 nt, Staphylococcus aureus subsp. aureus MW2
uacaccacuuaggau

SEQ ID NO: 2087957 - RNA, 13 nt, Staphylococcus aureus subsp. aureus MW2
uacagcauauaau

SEQ ID NO: 2087958 - RNA, 17 nt, Staphylococcus aureus subsp. aureus MW2
uacacuguuuuauaaau

SEQ ID NO: 2087959 - RNA, 16 nt, Staphylococcus aureus subsp. aureus MW2
uacacuuaauauauuc

SEQ ID NO: 2087960 - RNA, 14 nt, Staphylococcus aureus subsp. aureus MW2
uacacgcauuacuu

SEQ ID NO: 2087961 - RNA, 23 nt, Staphylococcus aureus subsp. aureus MW2
uacacguaacgcaguugaaaaag

SEQ ID NO: 2087962 - RNA, 20 nt, Staphylococcus aureus subsp. aureus MW2
uacacgaguguuaucacaua

SEQ ID NO: 2087963 - RNA, 22 nt, Staphylococcus aureus subsp. aureus MW2
uacacugcacaucauaauaaau

SEQ ID NO: 2087964 - RNA, 17 nt, Staphylococcus aureus subsp. aureus MW2
uacacuaucguuuuuau

SEQ ID NO: 2087965 - RNA, 22 nt, Staphylococcus aureus subsp. aureus MW2
uacagcgugauucaucuauuau

SEQ ID NO: 2087966 - RNA, 23 nt, Staphylococcus aureus subsp. aureus MW2
uacagcguauuuuaaugauuuuu

SEQ ID NO: 2087967 - RNA, 16 nt, Staphylococcus aureus subsp. aureus MW2
uacaguuucuauauuu

SEQ ID NO: 2087968 - RNA, 14 nt, Staphylococcus aureus subsp. aureus MW2
uacauaaaaauaag

SEQ ID NO: 2087969 - RNA, 22 nt, Staphylococcus aureus subsp. aureus MW2
uacaguguuauauuggcgggcc

SEQ ID NO: 2087970 - RNA, 19 nt, Staphylococcus aureus subsp. aureus MW2
uacagguuuuaaaauuaaa

SEQ ID NO: 2087971 - RNA, 15 nt, Staphylococcus aureus subsp. aureus MW2
uacagguuuaauaaa

SEQ ID NO: 2087972 - RNA, 21 nt, Staphylococcus aureus subsp. aureus MW2
uacagguuuaauaaauuuaac

SEQ ID NO: 2087973 - RNA, 17 nt, Staphylococcus aureus subsp. aureus MW2
uacaguaauauucaacu

SEQ ID NO: 2087974 - RNA, 15 nt, Staphylococcus aureus subsp. aureus MW2
uacaguaauauucaa

SEQ ID NO: 2087975 - RNA, 20 nt, Staphylococcus aureus subsp. aureus MW2
uaauuuaaaugauuucacuu

SEQ ID NO: 2087976 - RNA, 23 nt, Staphylococcus aureus subsp. aureus MW2
uaauuuaacaacuguucuaaaau

SEQ ID NO: 2087977 - RNA, 15 nt, Staphylococcus aureus subsp. aureus MW2
uaauuuaauaauuaa

SEQ ID NO: 2087978 - RNA, 13 nt, Staphylococcus aureus subsp. aureus MW2
uaauuuaauaauu

SEQ ID NO: 2087979 - RNA, 22 nt, Staphylococcus aureus subsp. aureus MW2
uaauuuaguuauaauuucuguu

SEQ ID NO: 2087980 - RNA, 15 nt, Staphylococcus aureus subsp. aureus MW2
uaauuuaguuuuaau

SEQ ID NO: 2087981 - RNA, 17 nt, Staphylococcus aureus subsp. aureus MW2
uaauuuauaaacaauua

SEQ ID NO: 2087982 - RNA, 14 nt, Staphylococcus aureus subsp. aureus MW2
uaauuuaucauuau

SEQ ID NO: 2087983 - RNA, 13 nt, Staphylococcus aureus subsp. aureus MW2
uaauuuauaauuu

SEQ ID NO: 2087984 - RNA, 14 nt, Staphylococcus aureus subsp. aureus MW2
uaauuuaaagcauc

SEQ ID NO: 2087985 - RNA, 21 nt, Staphylococcus aureus subsp. aureus MW2
uaauucuaagucucuugucau

SEQ ID NO: 2087986 - RNA, 22 nt, Staphylococcus aureus subsp. aureus MW2
uaauucuagagauaacuagaau

SEQ ID NO: 2087987 - RNA, 22 nt, Staphylococcus aureus subsp. aureus MW2
uaauucgccaucuuuuuuagcu

SEQ ID NO: 2087988 - RNA, 19 nt, Staphylococcus aureus subsp. aureus MW2
uaauucguaauuuaugauu

SEQ ID NO: 2087989 - RNA, 13 nt, Staphylococcus aureus subsp. aureus MW2
uaauuucuucuuc

SEQ ID NO: 2087990 - RNA, 22 nt, Staphylococcus aureus subsp. aureus MW2
uaauuucuugauggauauucaa

SEQ ID NO: 2087991 - RNA, 17 nt, Staphylococcus aureus subsp. aureus MW2
uaauuucugguaaaaaa

SEQ ID NO: 2087992 - RNA, 16 nt, Staphylococcus aureus subsp. aureus MW2
uaauuucucuauucua

SEQ ID NO: 2087993 - RNA, 21 nt, Staphylococcus aureus subsp. aureus MW2
uaauuucugguaaaaaaauaa

SEQ ID NO: 2087994 - RNA, 16 nt, Staphylococcus aureus subsp. aureus MW2
uaauuugacaaucuaa

SEQ ID NO: 2087995 - RNA, 15 nt, Staphylococcus aureus subsp. aureus MW2
uaauuugauaaaugc

SEQ ID NO: 2087996 - RNA, 16 nt, Staphylococcus aureus subsp. aureus MW2
uaauuuccaauaucuu

SEQ ID NO: 2087997 - RNA, 17 nt, Staphylococcus aureus subsp. aureus MW2
uaauuuccaauaucuuc

SEQ ID NO: 2087998 - RNA, 13 nt, Staphylococcus aureus subsp. aureus MW2
uacaaaacauauu

SEQ ID NO: 2087999 - RNA, 14 nt, Staphylococcus aureus subsp. aureus MW2
uacaaaauaaugau

SEQ ID NO: 2088000 - RNA, 20 nt, Staphylococcus aureus subsp. aureus MW2
uacaaaauaaugauacuaau

SEQ ID NO: 2088001 - RNA, 17 nt, Staphylococcus aureus subsp. aureus MW2
uacaaacaaugcaaguu

SEQ ID NO: 2088002 - RNA, 19 nt, Staphylococcus aureus subsp. aureus MW2
uacaaaaaauuaucucacc

SEQ ID NO: 2088003 - RNA, 14 nt, Staphylococcus aureus subsp. aureus MW2
uaauuuuucuucuu

SEQ ID NO: 2088004 - RNA, 12 nt, Staphylococcus aureus subsp. aureus MW2
uaauuuuucuuu

SEQ ID NO: 2088005 - RNA, 13 nt, Staphylococcus aureus subsp. aureus MW2
uaauuuuucuuua

SEQ ID NO: 2088006 - RNA, 22 nt, Staphylococcus aureus subsp. aureus MW2
uaauuuuucuuuaagcuuucua

SEQ ID NO: 2088007 - RNA, 13 nt, Staphylococcus aureus subsp. aureus MW2
uaauuuuuugaca

SEQ ID NO: 2088008 - RNA, 20 nt, Staphylococcus aureus subsp. aureus MW2
uaauuuuuuauuaagacuga

SEQ ID NO: 2088009 - RNA, 16 nt, Staphylococcus aureus subsp. aureus MW2
uaauuuugacauaaaa

SEQ ID NO: 2088010 - RNA, 19 nt, Staphylococcus aureus subsp. aureus MW2
uaauuuugugaauuuauuu

SEQ ID NO: 2088011 - RNA, 23 nt, Staphylococcus aureus subsp. aureus MW2
uaauuuucuugccaucaauuucu

SEQ ID NO: 2088012 - RNA, 15 nt, Staphylococcus aureus subsp. aureus MW2
uaauuuucuaaagau

SEQ ID NO: 2088013 - RNA, 13 nt, Staphylococcus aureus subsp. aureus MW2
uaauuuuuaaauc

SEQ ID NO: 2088014 - RNA, 18 nt, Staphylococcus aureus subsp. aureus MW2
uaauuuuuauucuguaac

SEQ ID NO: 2088015 - RNA, 12 nt, Staphylococcus aureus subsp. aureus MW2
uaauuuuucauu

SEQ ID NO: 2088016 - RNA, 13 nt, Staphylococcus aureus subsp. aureus MW2
uaauuuguauaau

SEQ ID NO: 2088017 - RNA, 15 nt, Staphylococcus aureus subsp. aureus MW2
uaauuuguauaauuu

SEQ ID NO: 2088018 - RNA, 17 nt, Staphylococcus aureus subsp. aureus MW2
uaauuuuaaaaauaaaa

SEQ ID NO: 2088019 - RNA, 23 nt, Staphylococcus aureus subsp. aureus MW2
uacgaaguuuaaaugugcaauua

SEQ ID NO: 2088020 - RNA, 19 nt, Staphylococcus aureus subsp. aureus MW2
uacgaaguuuaaaugugca

SEQ ID NO: 2088021 - RNA, 20 nt, Staphylococcus aureus subsp. aureus MW2
uacgaaguuuaaaugugcaa

SEQ ID NO: 2088022 - RNA, 13 nt, Staphylococcus aureus subsp. aureus MW2
uacgaauacuaaa

SEQ ID NO: 2088023 - RNA, 17 nt, Staphylococcus aureus subsp. aureus MW2
uacgaucauaaauauuu

SEQ ID NO: 2088024 - RNA, 15 nt, Staphylococcus aureus subsp. aureus MW2
uacgauaaauaguga

SEQ ID NO: 2088025 - RNA, 19 nt, Staphylococcus aureus subsp. aureus MW2
uacgaucaaaaucaugcuc

SEQ ID NO: 2088026 - RNA, 12 nt, Staphylococcus aureus subsp. aureus MW2
uaccuuuccauu

SEQ ID NO: 2088027 - RNA, 18 nt, Staphylococcus aureus subsp. aureus MW2
uaccuuucaaauauaucu

SEQ ID NO: 2088028 - RNA, 14 nt, Staphylococcus aureus subsp. aureus MW2
uaccuuuaauaucu

SEQ ID NO: 2088029 - RNA, 16 nt, Staphylococcus aureus subsp. aureus MW2
uaccuuuaauaauauu

SEQ ID NO: 2088030 - RNA, 13 nt, Staphylococcus aureus subsp. aureus MW2
uaccuuuaauaau

SEQ ID NO: 2088031 - RNA, 20 nt, Staphylococcus aureus subsp. aureus MW2
uaccuuuuucuaaaccaaca

SEQ ID NO: 2088032 - RNA, 22 nt, Staphylococcus aureus subsp. aureus MW2
uaccuuuuuauugauauuaaua

SEQ ID NO: 2088033 - RNA, 19 nt, Staphylococcus aureus subsp. aureus MW2
uaccuaauaggauuuccua

SEQ ID NO: 2088034 - RNA, 22 nt, Staphylococcus aureus subsp. aureus MW2
uaccuacaauaagaacuugcuu

SEQ ID NO: 2088035 - RNA, 21 nt, Staphylococcus aureus subsp. aureus MW2
uaccuacagaauggauaccua

SEQ ID NO: 2088036 - RNA, 14 nt, Staphylococcus aureus subsp. aureus MW2
uaccuauaaacaua

SEQ ID NO: 2088037 - RNA, 17 nt, Staphylococcus aureus subsp. aureus MW2
uaccuauuugauuaaau

SEQ ID NO: 2088038 - RNA, 21 nt, Staphylococcus aureus subsp. aureus MW2
uaccuauuugauuaaauuaaa

SEQ ID NO: 2088039 - RNA, 19 nt, Staphylococcus aureus subsp. aureus MW2
uaccuaagcugauuaaaau

SEQ ID NO: 2088040 - RNA, 19 nt, Staphylococcus aureus subsp. aureus MW2
uaccguauuuuaauauuga

SEQ ID NO: 2088041 - RNA, 18 nt, Staphylococcus aureus subsp. aureus MW2
uaccguauuuuaauauug

SEQ ID NO: 2088042 - RNA, 16 nt, Staphylococcus aureus subsp. aureus MW2
uaccuucaucuuuuuu

SEQ ID NO: 2088043 - RNA, 19 nt, Staphylococcus aureus subsp. aureus MW2
uacgcgcuucaucaaugga

SEQ ID NO: 2088044 - RNA, 17 nt, Staphylococcus aureus subsp. aureus MW2
uacguaucuuuacaaca

SEQ ID NO: 2088045 - RNA, 14 nt, Staphylococcus aureus subsp. aureus MW2
uacgucauaaaaua

SEQ ID NO: 2088046 - RNA, 15 nt, Staphylococcus aureus subsp. aureus MW2
uaccagguuauagaa

SEQ ID NO: 2088047 - RNA, 22 nt, Staphylococcus aureus subsp. aureus MW2
uaccacuugaauacuuuuuaac

SEQ ID NO: 2088048 - RNA, 19 nt, Staphylococcus aureus subsp. aureus MW2
uaccacuugaauacuuuuu

SEQ ID NO: 2088049 - RNA, 17 nt, Staphylococcus aureus subsp. aureus MW2
uacauaaaucuaauacu

SEQ ID NO: 2088050 - RNA, 13 nt, Staphylococcus aureus subsp. aureus MW2
uacauaaaucuaa

SEQ ID NO: 2088051 - RNA, 12 nt, Staphylococcus aureus subsp. aureus MW2
uacauaaaucua

SEQ ID NO: 2088052 - RNA, 20 nt, Staphylococcus aureus subsp. aureus MW2
uacauaaagcuuugacauau

SEQ ID NO: 2088053 - RNA, 20 nt, Staphylococcus aureus subsp. aureus MW2
uacauaauuuaucaauuucu

SEQ ID NO: 2088054 - RNA, 19 nt, Staphylococcus aureus subsp. aureus MW2
uacccuccuauuaauauau

SEQ ID NO: 2088055 - RNA, 18 nt, Staphylococcus aureus subsp. aureus MW2
uacccaauauuaauccac

SEQ ID NO: 2088056 - RNA, 14 nt, Staphylococcus aureus subsp. aureus MW2
uacccaccuuucuu

SEQ ID NO: 2088057 - RNA, 15 nt, Staphylococcus aureus subsp. aureus MW2
uacccaccuuucuuu

SEQ ID NO: 2088058 - RNA, 22 nt, Staphylococcus aureus subsp. aureus MW2
uaccccuguugaauauacuaaa

SEQ ID NO: 2088059 - RNA, 23 nt, Staphylococcus aureus subsp. aureus MW2
uacuauuaaaggaaaucaaucca

SEQ ID NO: 2088060 - RNA, 19 nt, Staphylococcus aureus subsp. aureus MW2
uacuauuaaaggaaaucaa

SEQ ID NO: 2088061 - RNA, 13 nt, Staphylococcus aureus subsp. aureus MW2
uacuauuaaauaa

SEQ ID NO: 2088062 - RNA, 16 nt, Staphylococcus aureus subsp. aureus MW2
uacuauugauauucua

SEQ ID NO: 2088063 - RNA, 20 nt, Staphylococcus aureus subsp. aureus MW2
uacuauugauauucuaaaaa

SEQ ID NO: 2088064 - RNA, 18 nt, Staphylococcus aureus subsp. aureus MW2
uacguuuagugaaaauac

SEQ ID NO: 2088065 - RNA, 14 nt, Staphylococcus aureus subsp. aureus MW2
uacguuuauaucuu

SEQ ID NO: 2088066 - RNA, 17 nt, Staphylococcus aureus subsp. aureus MW2
uacuaaaccucaacauu

SEQ ID NO: 2088067 - RNA, 16 nt, Staphylococcus aureus subsp. aureus MW2
uacuaaaauaucaaaa

SEQ ID NO: 2088068 - RNA, 17 nt, Staphylococcus aureus subsp. aureus MW2
uacuaaaauaucaaaau

SEQ ID NO: 2088069 - RNA, 21 nt, Staphylococcus aureus subsp. aureus MW2
uacuaaaaguguuaugaauua

SEQ ID NO: 2088070 - RNA, 22 nt, Staphylococcus aureus subsp. aureus MW2
uacuaaaaggacucauacaugu

SEQ ID NO: 2088071 - RNA, 21 nt, Staphylococcus aureus subsp. aureus MW2
uacucuaaaaaaggaagaaca

SEQ ID NO: 2088072 - RNA, 18 nt, Staphylococcus aureus subsp. aureus MW2
uacucauuuagcucuacu

SEQ ID NO: 2088073 - RNA, 20 nt, Staphylococcus aureus subsp. aureus MW2
uacucauguaacguaaaaau

SEQ ID NO: 2088074 - RNA, 18 nt, Staphylococcus aureus subsp. aureus MW2
uacugcuucaaucgucac

SEQ ID NO: 2088075 - RNA, 23 nt, Staphylococcus aureus subsp. aureus MW2
uacugcucuuuauauauaaaauc

SEQ ID NO: 2088076 - RNA, 21 nt, Staphylococcus aureus subsp. aureus MW2
uacugcugcuucggcaccuuu

SEQ ID NO: 2088077 - RNA, 14 nt, Staphylococcus aureus subsp. aureus MW2
uacugauauauacu

SEQ ID NO: 2088078 - RNA, 19 nt, Staphylococcus aureus subsp. aureus MW2
uacugaugaacauaccugc

SEQ ID NO: 2088079 - RNA, 21 nt, Staphylococcus aureus subsp. aureus MW2
uacugcagcaucauaaucuuu

SEQ ID NO: 2088080 - RNA, 19 nt, Staphylococcus aureus subsp. aureus MW2
uacucugaaaagccuacuu

SEQ ID NO: 2088081 - RNA, 12 nt, Staphylococcus aureus subsp. aureus MW2
uacucugaaaag

SEQ ID NO: 2088082 - RNA, 17 nt, Staphylococcus aureus subsp. aureus MW2
uacucuaaaacgauuaa

SEQ ID NO: 2088083 - RNA, 20 nt, Staphylococcus aureus subsp. aureus MW2
uacucuaaaggaaagccauu

SEQ ID NO: 2088084 - RNA, 16 nt, Staphylococcus aureus subsp. aureus MW2
uacucuuuuuaauauu

SEQ ID NO: 2088085 - RNA, 21 nt, Staphylococcus aureus subsp. aureus MW2
uacugaaacaugagcucaucu

SEQ ID NO: 2088086 - RNA, 17 nt, Staphylococcus aureus subsp. aureus MW2
uacuuguaauuaauaca

SEQ ID NO: 2088087 - RNA, 15 nt, Staphylococcus aureus subsp. aureus MW2
uacuuguaauuaaua

SEQ ID NO: 2088088 - RNA, 16 nt, Staphylococcus aureus subsp. aureus MW2
uacuugucguauucuu

SEQ ID NO: 2088089 - RNA, 17 nt, Staphylococcus aureus subsp. aureus MW2
uacuuuacauuucucgu

SEQ ID NO: 2088090 - RNA, 14 nt, Staphylococcus aureus subsp. aureus MW2
uacuuuauaaauau

SEQ ID NO: 2088091 - RNA, 19 nt, Staphylococcus aureus subsp. aureus MW2
uacuugaauaccuuuuauu

SEQ ID NO: 2088092 - RNA, 16 nt, Staphylococcus aureus subsp. aureus MW2
uacuucuuuggucuaa

SEQ ID NO: 2088093 - RNA, 23 nt, Staphylococcus aureus subsp. aureus MW2
uacuugaaaauagccauaucaua

SEQ ID NO: 2088094 - RNA, 22 nt, Staphylococcus aureus subsp. aureus MW2
uacuugccuauuuuuuuauguu

SEQ ID NO: 2088095 - RNA, 23 nt, Staphylococcus aureus subsp. aureus MW2
uacuuggaaaauacuauacugau

SEQ ID NO: 2088096 - RNA, 15 nt, Staphylococcus aureus subsp. aureus MW2
uacuucucaauuuag

SEQ ID NO: 2088097 - RNA, 16 nt, Staphylococcus aureus subsp. aureus MW2
uacuucuuuaaucgcu

SEQ ID NO: 2088098 - RNA, 19 nt, Staphylococcus aureus subsp. aureus MW2
uacuucuaacgcaacugaa

SEQ ID NO: 2088099 - RNA, 12 nt, Staphylococcus aureus subsp. aureus MW2
uagaaaaaaauc

SEQ ID NO: 2088100 - RNA, 14 nt, Staphylococcus aureus subsp. aureus MW2
uacuuuuucagaau

SEQ ID NO: 2088101 - RNA, 15 nt, Staphylococcus aureus subsp. aureus MW2
uacuuuuucaucuuu

SEQ ID NO: 2088102 - RNA, 13 nt, Staphylococcus aureus subsp. aureus MW2
uacuuuucaacuu

SEQ ID NO: 2088103 - RNA, 18 nt, Staphylococcus aureus subsp. aureus MW2
uacuuuucugucuguaaa

SEQ ID NO: 2088104 - RNA, 22 nt, Staphylococcus aureus subsp. aureus MW2
uacuuuggcagacguaucauca

SEQ ID NO: 2088105 - RNA, 19 nt, Staphylococcus aureus subsp. aureus MW2
uacuuuggacuuuaaaguu

SEQ ID NO: 2088106 - RNA, 18 nt, Staphylococcus aureus subsp. aureus MW2
uacuuuggacuuuaaagu

SEQ ID NO: 2088107 - RNA, 18 nt, Staphylococcus aureus subsp. aureus MW2
uacuuuggaaauuuauua

SEQ ID NO: 2088108 - RNA, 15 nt, Staphylococcus aureus subsp. aureus MW2
uacuuuguaauucuu

SEQ ID NO: 2088109 - RNA, 18 nt, Staphylococcus aureus subsp. aureus MW2
uacuuuguaauucuugua

SEQ ID NO: 2088110 - RNA, 18 nt, Staphylococcus aureus subsp. aureus MW2
uacuuuguucugcuuuuu

SEQ ID NO: 2088111 - RNA, 12 nt, Staphylococcus aureus subsp. aureus MW2
uacuuuuaaaau

SEQ ID NO: 2088112 - RNA, 17 nt, Staphylococcus aureus subsp. aureus MW2
uacuuucaccauuuacu

SEQ ID NO: 2088113 - RNA, 20 nt, Staphylococcus aureus subsp. aureus MW2
uacuuucagucguuaaaaua

SEQ ID NO: 2088114 - RNA, 17 nt, Staphylococcus aureus subsp. aureus MW2
uacuuucacauuuucaa

SEQ ID NO: 2088115 - RNA, 14 nt, Staphylococcus aureus subsp. aureus MW2
uacuucaauaacaa

SEQ ID NO: 2088116 - RNA, 14 nt, Staphylococcus aureus subsp. aureus MW2
uacuucauaaguca

SEQ ID NO: 2088117 - RNA, 17 nt, Staphylococcus aureus subsp. aureus MW2
uacuuauuucuuuucau

SEQ ID NO: 2088118 - RNA, 15 nt, Staphylococcus aureus subsp. aureus MW2
uacuuaaaauaagua

SEQ ID NO: 2088119 - RNA, 14 nt, Staphylococcus aureus subsp. aureus MW2
uacuuaauuuaaau

SEQ ID NO: 2088120 - RNA, 21 nt, Staphylococcus aureus subsp. aureus MW2
uacuuaauuuaaaucuguacu

SEQ ID NO: 2088121 - RNA, 15 nt, Staphylococcus aureus subsp. aureus MW2
uacuuaauuaauaau

SEQ ID NO: 2088122 - RNA, 21 nt, Staphylococcus aureus subsp. aureus MW2
uacuuaaaccguauagucauu

SEQ ID NO: 2088123 - RNA, 18 nt, Staphylococcus aureus subsp. aureus MW2
uacuuacgccaaucacaa

SEQ ID NO: 2088124 - RNA, 20 nt, Staphylococcus aureus subsp. aureus MW2
uacuuacgaauagaaaauaa

SEQ ID NO: 2088125 - RNA, 15 nt, Staphylococcus aureus subsp. aureus MW2
uacuuauucaaaugu

SEQ ID NO: 2088126 - RNA, 23 nt, Staphylococcus aureus subsp. aureus MW2
uacuuauucaaauguuuacuguc

SEQ ID NO: 2088127 - RNA, 22 nt, Staphylococcus aureus subsp. aureus MW2
uacuuacuuuucuaaacaacuu

SEQ ID NO: 2088128 - RNA, 15 nt, Staphylococcus aureus subsp. aureus MW2
uacugugaaaauacc

SEQ ID NO: 2088129 - RNA, 20 nt, Staphylococcus aureus subsp. aureus MW2
uacugcuuuuuuaaauuuaa

SEQ ID NO: 2088130 - RNA, 16 nt, Staphylococcus aureus subsp. aureus MW2
uacugguuaguaaaau

SEQ ID NO: 2088131 - RNA, 21 nt, Staphylococcus aureus subsp. aureus MW2
uaugaugaauuguuguacaug

SEQ ID NO: 2088132 - RNA, 19 nt, Staphylococcus aureus subsp. aureus MW2
uaugauauauguaacauaa

SEQ ID NO: 2088133 - RNA, 14 nt, Staphylococcus aureus subsp. aureus MW2
uaugaugcuucuaa

SEQ ID NO: 2088134 - RNA, 23 nt, Staphylococcus aureus subsp. aureus MW2
uaugauucuaacggcguuuguuu

SEQ ID NO: 2088135 - RNA, 12 nt, Staphylococcus aureus subsp. aureus MW2
uaugauugaaug

SEQ ID NO: 2088136 - RNA, 19 nt, Staphylococcus aureus subsp. aureus MW2
uaugauuaauaaaguaauc

SEQ ID NO: 2088137 - RNA, 17 nt, Staphylococcus aureus subsp. aureus MW2
uaugauguuaaaaaaua

SEQ ID NO: 2088138 - RNA, 16 nt, Staphylococcus aureus subsp. aureus MW2
uaugauguuaaaaaau

SEQ ID NO: 2088139 - RNA, 18 nt, Staphylococcus aureus subsp. aureus MW2
uaugauuugauauuucaa

SEQ ID NO: 2088140 - RNA, 19 nt, Staphylococcus aureus subsp. aureus MW2
uaugauuugauauuucaaa

SEQ ID NO: 2088141 - RNA, 17 nt, Staphylococcus aureus subsp. aureus MW2
uaugauuuaaaauauaa

SEQ ID NO: 2088142 - RNA, 23 nt, Staphylococcus aureus subsp. aureus MW2
uaugauuugccccgccauucaua

SEQ ID NO: 2088143 - RNA, 16 nt, Staphylococcus aureus subsp. aureus MW2
uaugcauagcucuugc

SEQ ID NO: 2088144 - RNA, 15 nt, Staphylococcus aureus subsp. aureus MW2
uaugcauauguaaua

SEQ ID NO: 2088145 - RNA, 21 nt, Staphylococcus aureus subsp. aureus MW2
uaugcauauguaauacaaaag

SEQ ID NO: 2088146 - RNA, 20 nt, Staphylococcus aureus subsp. aureus MW2
uaugcagguauguucaucag

SEQ ID NO: 2088147 - RNA, 19 nt, Staphylococcus aureus subsp. aureus MW2
uaugacugcaaauacgagu

SEQ ID NO: 2088148 - RNA, 15 nt, Staphylococcus aureus subsp. aureus MW2
uaugagagauagaaa

SEQ ID NO: 2088149 - RNA, 16 nt, Staphylococcus aureus subsp. aureus MW2
uaugagagauagaaag

SEQ ID NO: 2088150 - RNA, 22 nt, Staphylococcus aureus subsp. aureus MW2
uaugauaaccauuaugauuaau

SEQ ID NO: 2088151 - RNA, 22 nt, Staphylococcus aureus subsp. aureus MW2
uaugauaaccaaaccauuaaua

SEQ ID NO: 2088152 - RNA, 18 nt, Staphylococcus aureus subsp. aureus MW2
uaugauagaauacuaaaa

SEQ ID NO: 2088153 - RNA, 19 nt, Staphylococcus aureus subsp. aureus MW2
uaugauacgcuuuuuaaaa

SEQ ID NO: 2088154 - RNA, 21 nt, Staphylococcus aureus subsp. aureus MW2
uaugauacgcuuuuuaaaaaa

SEQ ID NO: 2088155 - RNA, 15 nt, Staphylococcus aureus subsp. aureus MW2
uaugauaauaagaau

SEQ ID NO: 2088156 - RNA, 15 nt, Staphylococcus aureus subsp. aureus MW2
uaugauccuuuaaug

SEQ ID NO: 2088157 - RNA, 22 nt, Staphylococcus aureus subsp. aureus MW2
uaugauagaauacuaaaagugu

SEQ ID NO: 2088158 - RNA, 20 nt, Staphylococcus aureus subsp. aureus MW2
uaugauagugcuuuuuauuu

SEQ ID NO: 2088159 - RNA, 14 nt, Staphylococcus aureus subsp. aureus MW2
uaugaccuuuaugu

SEQ ID NO: 2088160 - RNA, 22 nt, Staphylococcus aureus subsp. aureus MW2
uaugacuaacgaaaaagauggu

SEQ ID NO: 2088161 - RNA, 13 nt, Staphylococcus aureus subsp. aureus MW2
uaugacaaauuaa

SEQ ID NO: 2088162 - RNA, 18 nt, Staphylococcus aureus subsp. aureus MW2
uaugacaacauaacaaag

SEQ ID NO: 2088163 - RNA, 18 nt, Staphylococcus aureus subsp. aureus MW2
uaucuucuuuuaauauuu

SEQ ID NO: 2088164 - RNA, 14 nt, Staphylococcus aureus subsp. aureus MW2
uaucugcucuuuau

SEQ ID NO: 2088165 - RNA, 11 nt, Staphylococcus aureus subsp. aureus MW2
uaucuuuaauu

SEQ ID NO: 2088166 - RNA, 15 nt, Staphylococcus aureus subsp. aureus MW2
uaucuuguucuucuu

SEQ ID NO: 2088167 - RNA, 19 nt, Staphylococcus aureus subsp. aureus MW2
uaucuugucauuugaacau

SEQ ID NO: 2088168 - RNA, 14 nt, Staphylococcus aureus subsp. aureus MW2
uaucuuuagacaua

SEQ ID NO: 2088169 - RNA, 14 nt, Staphylococcus aureus subsp. aureus MW2
uaucuuucauaauu

SEQ ID NO: 2088170 - RNA, 18 nt, Staphylococcus aureus subsp. aureus MW2
uaugaaaccuuugguuca

SEQ ID NO: 2088171 - RNA, 19 nt, Staphylococcus aureus subsp. aureus MW2
uaugaaaagagauuuuuuu

SEQ ID NO: 2088172 - RNA, 23 nt, Staphylococcus aureus subsp. aureus MW2
uaugaaacuggauaaauaaagau

SEQ ID NO: 2088173 - RNA, 22 nt, Staphylococcus aureus subsp. aureus MW2
uaugaaauguucccuucaaagu

SEQ ID NO: 2088174 - RNA, 14 nt, Staphylococcus aureus subsp. aureus MW2
uaugaaauaacaau

SEQ ID NO: 2088175 - RNA, 12 nt, Staphylococcus aureus subsp. aureus MW2
uaucuuuucauc

SEQ ID NO: 2088176 - RNA, 17 nt, Staphylococcus aureus subsp. aureus MW2
uaucuuuuaauguuuua

SEQ ID NO: 2088177 - RNA, 14 nt, Staphylococcus aureus subsp. aureus MW2
uaucuuuugcuucg

SEQ ID NO: 2088178 - RNA, 13 nt, Staphylococcus aureus subsp. aureus MW2
uaucuuuuuuaug

SEQ ID NO: 2088179 - RNA, 12 nt, Staphylococcus aureus subsp. aureus MW2
uaugaaaagaau

SEQ ID NO: 2088180 - RNA, 17 nt, Staphylococcus aureus subsp. aureus MW2
uaugaauggcauuuaau

SEQ ID NO: 2088181 - RNA, 22 nt, Staphylococcus aureus subsp. aureus MW2
uaugaauggcauuuaauacuaa

SEQ ID NO: 2088182 - RNA, 22 nt, Staphylococcus aureus subsp. aureus MW2
uaugaauggcaaucuauauaaa

SEQ ID NO: 2088183 - RNA, 22 nt, Staphylococcus aureus subsp. aureus MW2
uaugaauccugugacucaauga

SEQ ID NO: 2088184 - RNA, 23 nt, Staphylococcus aureus subsp. aureus MW2
uaugaaucgaagcccuuugauuu

SEQ ID NO: 2088185 - RNA, 13 nt, Staphylococcus aureus subsp. aureus MW2
uaugaaugaaauc

SEQ ID NO: 2088186 - RNA, 16 nt, Staphylococcus aureus subsp. aureus MW2
uaugaauaaugcaauu

SEQ ID NO: 2088187 - RNA, 19 nt, Staphylococcus aureus subsp. aureus MW2
uaugaauaaauuguaauau

SEQ ID NO: 2088188 - RNA, 15 nt, Staphylococcus aureus subsp. aureus MW2
uaugaauaaccaucu

SEQ ID NO: 2088189 - RNA, 13 nt, Staphylococcus aureus subsp. aureus MW2
uaugaacucacaa

SEQ ID NO: 2088190 - RNA, 16 nt, Staphylococcus aureus subsp. aureus MW2
uaugaagggaaaaaau

SEQ ID NO: 2088191 - RNA, 19 nt, Staphylococcus aureus subsp. aureus MW2
uauguauaguguuaauguu

SEQ ID NO: 2088192 - RNA, 12 nt, Staphylococcus aureus subsp. aureus MW2
uauguauuaaau

SEQ ID NO: 2088193 - RNA, 22 nt, Staphylococcus aureus subsp. aureus MW2
uaugucuagacuuauuugaaug

SEQ ID NO: 2088194 - RNA, 16 nt, Staphylococcus aureus subsp. aureus MW2
uaugucucucuuucuu

SEQ ID NO: 2088195 - RNA, 21 nt, Staphylococcus aureus subsp. aureus MW2
uaugucccaaugcugaauaaa

SEQ ID NO: 2088196 - RNA, 22 nt, Staphylococcus aureus subsp. aureus MW2
uaugucauucuaguagcuagaa

SEQ ID NO: 2088197 - RNA, 18 nt, Staphylococcus aureus subsp. aureus MW2
uaugucaucuucaauucu

SEQ ID NO: 2088198 - RNA, 17 nt, Staphylococcus aureus subsp. aureus MW2
uaugucauauacuauau

SEQ ID NO: 2088199 - RNA, 23 nt, Staphylococcus aureus subsp. aureus MW2
uauguaacaauuuagcaaauauu

SEQ ID NO: 2088200 - RNA, 15 nt, Staphylococcus aureus subsp. aureus MW2
uauguaacaaaugcg

SEQ ID NO: 2088201 - RNA, 16 nt, Staphylococcus aureus subsp. aureus MW2
uauguagaauuucuuu

SEQ ID NO: 2088202 - RNA, 16 nt, Staphylococcus aureus subsp. aureus MW2
uauguaccaaauuuau

SEQ ID NO: 2088203 - RNA, 20 nt, Staphylococcus aureus subsp. aureus MW2
uauguaccaaauuuauaauu

SEQ ID NO: 2088204 - RNA, 15 nt, Staphylococcus aureus subsp. aureus MW2
uauguagaauuucuu

SEQ ID NO: 2088205 - RNA, 21 nt, Staphylococcus aureus subsp. aureus MW2
uaugguuuaccuaguuuuacu

SEQ ID NO: 2088206 - RNA, 16 nt, Staphylococcus aureus subsp. aureus MW2
uaugguuagaaaaaaa

SEQ ID NO: 2088207 - RNA, 21 nt, Staphylococcus aureus subsp. aureus MW2
uauggucuugaguacuaauca

SEQ ID NO: 2088208 - RNA, 23 nt, Staphylococcus aureus subsp. aureus MW2
uauguuguuucuaaugcucauua

SEQ ID NO: 2088209 - RNA, 21 nt, Staphylococcus aureus subsp. aureus MW2
uauguugaaagugacacugua

SEQ ID NO: 2088210 - RNA, 21 nt, Staphylococcus aureus subsp. aureus MW2
uauguugucauaccaaauaaa

SEQ ID NO: 2088211 - RNA, 21 nt, Staphylococcus aureus subsp. aureus MW2
uauguuccauggaauaaauuu

SEQ ID NO: 2088212 - RNA, 20 nt, Staphylococcus aureus subsp. aureus MW2
uauguuuuaucaauauuagu

SEQ ID NO: 2088213 - RNA, 15 nt, Staphylococcus aureus subsp. aureus MW2
uauguuuuauuuucu

SEQ ID NO: 2088214 - RNA, 17 nt, Staphylococcus aureus subsp. aureus MW2
uauguuuggauaucuuu

SEQ ID NO: 2088215 - RNA, 17 nt, Staphylococcus aureus subsp. aureus MW2
uauuaaaagguugaaau

SEQ ID NO: 2088216 - RNA, 17 nt, Staphylococcus aureus subsp. aureus MW2
uauuaaaauaaaccacg

SEQ ID NO: 2088217 - RNA, 15 nt, Staphylococcus aureus subsp. aureus MW2
uauguguuucuagcu

SEQ ID NO: 2088218 - RNA, 20 nt, Staphylococcus aureus subsp. aureus MW2
uauguguugugauauauagu

SEQ ID NO: 2088219 - RNA, 17 nt, Staphylococcus aureus subsp. aureus MW2
uauguuauaauuaagug

SEQ ID NO: 2088220 - RNA, 17 nt, Staphylococcus aureus subsp. aureus MW2
uauguucagaaauuuaa

SEQ ID NO: 2088221 - RNA, 20 nt, Staphylococcus aureus subsp. aureus MW2
uauggagcuacccuauuuua

SEQ ID NO: 2088222 - RNA, 16 nt, Staphylococcus aureus subsp. aureus MW2
uauggauaaaauuuaa

SEQ ID NO: 2088223 - RNA, 22 nt, Staphylococcus aureus subsp. aureus MW2
uaugcugaaacuaaguuuaaug

SEQ ID NO: 2088224 - RNA, 23 nt, Staphylococcus aureus subsp. aureus MW2
uaugcugcaagucucauaucuau

SEQ ID NO: 2088225 - RNA, 17 nt, Staphylococcus aureus subsp. aureus MW2
uaugcuguguaucauca

SEQ ID NO: 2088226 - RNA, 16 nt, Staphylococcus aureus subsp. aureus MW2
uaugcuuuuaauagug

SEQ ID NO: 2088227 - RNA, 16 nt, Staphylococcus aureus subsp. aureus MW2
uaugcuuuuauagauu

SEQ ID NO: 2088228 - RNA, 14 nt, Staphylococcus aureus subsp. aureus MW2
uauggaaauggugg

SEQ ID NO: 2088229 - RNA, 15 nt, Staphylococcus aureus subsp. aureus MW2
uaugccauucauuaa

SEQ ID NO: 2088230 - RNA, 18 nt, Staphylococcus aureus subsp. aureus MW2
uaugccgccuaauaauaa

SEQ ID NO: 2088231 - RNA, 18 nt, Staphylococcus aureus subsp. aureus MW2
uaugccaaauaacguuaa

SEQ ID NO: 2088232 - RNA, 19 nt, Staphylococcus aureus subsp. aureus MW2
uauaaguuuguuuguaaaa

SEQ ID NO: 2088233 - RNA, 18 nt, Staphylococcus aureus subsp. aureus MW2
uauaaucuaucuugugcu

SEQ ID NO: 2088234 - RNA, 18 nt, Staphylococcus aureus subsp. aureus MW2
uauaaugguucuaaaaua

SEQ ID NO: 2088235 - RNA, 23 nt, Staphylococcus aureus subsp. aureus MW2
uauaaugccuaauuuguaacccc

SEQ ID NO: 2088236 - RNA, 21 nt, Staphylococcus aureus subsp. aureus MW2
uauaauggacgguauuuucaa

SEQ ID NO: 2088237 - RNA, 17 nt, Staphylococcus aureus subsp. aureus MW2
uauaaugaauaaauaau

SEQ ID NO: 2088238 - RNA, 21 nt, Staphylococcus aureus subsp. aureus MW2
uauaaugauugucuuauaaga

SEQ ID NO: 2088239 - RNA, 15 nt, Staphylococcus aureus subsp. aureus MW2
uauaaugauuuaauu

SEQ ID NO: 2088240 - RNA, 16 nt, Staphylococcus aureus subsp. aureus MW2
uauaaugauuuaauuu

SEQ ID NO: 2088241 - RNA, 18 nt, Staphylococcus aureus subsp. aureus MW2
uauaguaauagcuauauu

SEQ ID NO: 2088242 - RNA, 14 nt, Staphylococcus aureus subsp. aureus MW2
uauagucaucuguu

SEQ ID NO: 2088243 - RNA, 13 nt, Staphylococcus aureus subsp. aureus MW2
uauagucauucau

SEQ ID NO: 2088244 - RNA, 22 nt, Staphylococcus aureus subsp. aureus MW2
uauagugcuuguuuauuacaua

SEQ ID NO: 2088245 - RNA, 19 nt, Staphylococcus aureus subsp. aureus MW2
uauauccaguuaauuauuu

SEQ ID NO: 2088246 - RNA, 17 nt, Staphylococcus aureus subsp. aureus MW2
uauaugauaaauauugu

SEQ ID NO: 2088247 - RNA, 14 nt, Staphylococcus aureus subsp. aureus MW2
uauauauugucuuu

SEQ ID NO: 2088248 - RNA, 18 nt, Staphylococcus aureus subsp. aureus MW2
uauauauuuaaaucaaua

SEQ ID NO: 2088249 - RNA, 20 nt, Staphylococcus aureus subsp. aureus MW2
uauauauucguuacaaauga

SEQ ID NO: 2088250 - RNA, 14 nt, Staphylococcus aureus subsp. aureus MW2
uauauauuuugcaa

SEQ ID NO: 2088251 - RNA, 19 nt, Staphylococcus aureus subsp. aureus MW2
uauaucaaauacauuucaa

SEQ ID NO: 2088252 - RNA, 14 nt, Staphylococcus aureus subsp. aureus MW2
uauauaaaaacugu

SEQ ID NO: 2088253 - RNA, 16 nt, Staphylococcus aureus subsp. aureus MW2
uauaguuggcaauccu

SEQ ID NO: 2088254 - RNA, 16 nt, Staphylococcus aureus subsp. aureus MW2
uauauaauuuauaaaa

SEQ ID NO: 2088255 - RNA, 18 nt, Staphylococcus aureus subsp. aureus MW2
uauauaauuuauaaaaag

SEQ ID NO: 2088256 - RNA, 20 nt, Staphylococcus aureus subsp. aureus MW2
uauauaacaaguacaauaau

SEQ ID NO: 2088257 - RNA, 21 nt, Staphylococcus aureus subsp. aureus MW2
uauauaaccauaguaacaaaa

SEQ ID NO: 2088258 - RNA, 11 nt, Staphylococcus aureus subsp. aureus MW2
uauauaaauua

SEQ ID NO: 2088259 - RNA, 17 nt, Staphylococcus aureus subsp. aureus MW2
uaucacuuuucaugaug

SEQ ID NO: 2088260 - RNA, 15 nt, Staphylococcus aureus subsp. aureus MW2
uaucacuaucagcuu

SEQ ID NO: 2088261 - RNA, 20 nt, Staphylococcus aureus subsp. aureus MW2
uaucacuaauauauuuagau

SEQ ID NO: 2088262 - RNA, 19 nt, Staphylococcus aureus subsp. aureus MW2
uaucaagaacuuuaaaaau

SEQ ID NO: 2088263 - RNA, 15 nt, Staphylococcus aureus subsp. aureus MW2
uaucaacauauuuau

SEQ ID NO: 2088264 - RNA, 17 nt, Staphylococcus aureus subsp. aureus MW2
uaucaacagcuucaaaa

SEQ ID NO: 2088265 - RNA, 16 nt, Staphylococcus aureus subsp. aureus MW2
uaucaacauaauauuu

SEQ ID NO: 2088266 - RNA, 18 nt, Staphylococcus aureus subsp. aureus MW2
uaucaaauuaccauucau

SEQ ID NO: 2088267 - RNA, 14 nt, Staphylococcus aureus subsp. aureus MW2
uaucaacaaauuuu

SEQ ID NO: 2088268 - RNA, 21 nt, Staphylococcus aureus subsp. aureus MW2
uaucaacaaauuuucugguca

SEQ ID NO: 2088269 - RNA, 22 nt, Staphylococcus aureus subsp. aureus MW2
uaucaaauagcccuuuauacaa

SEQ ID NO: 2088270 - RNA, 11 nt, Staphylococcus aureus subsp. aureus MW2
uauauuuuuau

SEQ ID NO: 2088271 - RNA, 13 nt, Staphylococcus aureus subsp. aureus MW2
uauauuugugaau

SEQ ID NO: 2088272 - RNA, 17 nt, Staphylococcus aureus subsp. aureus MW2
uauauguguguugcuuu

SEQ ID NO: 2088273 - RNA, 19 nt, Staphylococcus aureus subsp. aureus MW2
uauauuuuauuuaaaaaua

SEQ ID NO: 2088274 - RNA, 18 nt, Staphylococcus aureus subsp. aureus MW2
uauauuuuauuuaaaaau

SEQ ID NO: 2088275 - RNA, 15 nt, Staphylococcus aureus subsp. aureus MW2
uaucaaaauauaaaa

SEQ ID NO: 2088276 - RNA, 16 nt, Staphylococcus aureus subsp. aureus MW2
uaucaaaauauaaaau

SEQ ID NO: 2088277 - RNA, 17 nt, Staphylococcus aureus subsp. aureus MW2
uaucaaaauauaaaauc

SEQ ID NO: 2088278 - RNA, 10 nt, Staphylococcus aureus subsp. aureus MW2
uauauuuuuu

SEQ ID NO: 2088279 - RNA, 23 nt, Staphylococcus aureus subsp. aureus MW2
uauauuuuuuguacauuauuaau

SEQ ID NO: 2088280 - RNA, 15 nt, Staphylococcus aureus subsp. aureus MW2
uaucaaaaaaacaaa

SEQ ID NO: 2088281 - RNA, 23 nt, Staphylococcus aureus subsp. aureus MW2
uaucaaaaaaacaaaaaauaauu

SEQ ID NO: 2088282 - RNA, 22 nt, Staphylococcus aureus subsp. aureus MW2
uaucaaaaaauauguuuaaugu

SEQ ID NO: 2088283 - RNA, 18 nt, Staphylococcus aureus subsp. aureus MW2
uauauuuaugauaauuaa

SEQ ID NO: 2088284 - RNA, 20 nt, Staphylococcus aureus subsp. aureus MW2
uauauguauaacaauauuaa

SEQ ID NO: 2088285 - RNA, 23 nt, Staphylococcus aureus subsp. aureus MW2
uauauguaggggagucuuauuuu

SEQ ID NO: 2088286 - RNA, 16 nt, Staphylococcus aureus subsp. aureus MW2
uauauuuauuuuugau

SEQ ID NO: 2088287 - RNA, 17 nt, Staphylococcus aureus subsp. aureus MW2
uauauuuauuuuugaua

SEQ ID NO: 2088288 - RNA, 21 nt, Staphylococcus aureus subsp. aureus MW2
uauauggagcuacccuauuuu

SEQ ID NO: 2088289 - RNA, 16 nt, Staphylococcus aureus subsp. aureus MW2
uauauguaauuagagu

SEQ ID NO: 2088290 - RNA, 22 nt, Staphylococcus aureus subsp. aureus MW2
uauauguaauuagaguagaaag

SEQ ID NO: 2088291 - RNA, 14 nt, Staphylococcus aureus subsp. aureus MW2
uauauggaauacua

SEQ ID NO: 2088292 - RNA, 17 nt, Staphylococcus aureus subsp. aureus MW2
uauaugauguucaauau

SEQ ID NO: 2088293 - RNA, 20 nt, Staphylococcus aureus subsp. aureus MW2
uauccauuaugauguagaug

SEQ ID NO: 2088294 - RNA, 20 nt, Staphylococcus aureus subsp. aureus MW2
uauccauucaauguuuaauu

SEQ ID NO: 2088295 - RNA, 19 nt, Staphylococcus aureus subsp. aureus MW2
uauccaaggauguuauaaa

SEQ ID NO: 2088296 - RNA, 23 nt, Staphylococcus aureus subsp. aureus MW2
uaucauuuggcguucaacauuac

SEQ ID NO: 2088297 - RNA, 23 nt, Staphylococcus aureus subsp. aureus MW2
uaucauuuaaaauauuuuuucug

SEQ ID NO: 2088298 - RNA, 22 nt, Staphylococcus aureus subsp. aureus MW2
uaucauuuuuaauuuugacaua

SEQ ID NO: 2088299 - RNA, 21 nt, Staphylococcus aureus subsp. aureus MW2
uaucauuguguccauaaauau

SEQ ID NO: 2088300 - RNA, 16 nt, Staphylococcus aureus subsp. aureus MW2
uaucauuuaaaauauu

SEQ ID NO: 2088301 - RNA, 17 nt, Staphylococcus aureus subsp. aureus MW2
uaucauuuaaaauauuu

SEQ ID NO: 2088302 - RNA, 18 nt, Staphylococcus aureus subsp. aureus MW2
uaucacuuauuauuuugu

SEQ ID NO: 2088303 - RNA, 23 nt, Staphylococcus aureus subsp. aureus MW2
uaucuccgcuacaauuauaugua

SEQ ID NO: 2088304 - RNA, 14 nt, Staphylococcus aureus subsp. aureus MW2
uaucuccaauauuu

SEQ ID NO: 2088305 - RNA, 19 nt, Staphylococcus aureus subsp. aureus MW2
uaucuauucaaauauaaau

SEQ ID NO: 2088306 - RNA, 19 nt, Staphylococcus aureus subsp. aureus MW2
uaucuauuuuacucuuuuu

SEQ ID NO: 2088307 - RNA, 15 nt, Staphylococcus aureus subsp. aureus MW2
uaucguuuauugaua

SEQ ID NO: 2088308 - RNA, 22 nt, Staphylococcus aureus subsp. aureus MW2
uaucgucgauuucauuaauuuu

SEQ ID NO: 2088309 - RNA, 14 nt, Staphylococcus aureus subsp. aureus MW2
uauccugauuuaau

SEQ ID NO: 2088310 - RNA, 13 nt, Staphylococcus aureus subsp. aureus MW2
uauccugauuuaa

SEQ ID NO: 2088311 - RNA, 17 nt, Staphylococcus aureus subsp. aureus MW2
uauccucaguauuuaau

SEQ ID NO: 2088312 - RNA, 18 nt, Staphylococcus aureus subsp. aureus MW2
uaucgccuggugcaggca

SEQ ID NO: 2088313 - RNA, 18 nt, Staphylococcus aureus subsp. aureus MW2
uaucgccuaaaaauaaaa

SEQ ID NO: 2088314 - RNA, 23 nt, Staphylococcus aureus subsp. aureus MW2
uaucgcgcaucaaaaaugagcau

SEQ ID NO: 2088315 - RNA, 21 nt, Staphylococcus aureus subsp. aureus MW2
uaucgcuuuugaaguuggucc

SEQ ID NO: 2088316 - RNA, 20 nt, Staphylococcus aureus subsp. aureus MW2
uaguugacuguaaaacaaug

SEQ ID NO: 2088317 - RNA, 20 nt, Staphylococcus aureus subsp. aureus MW2
uaguugaaauguuuauaaua

SEQ ID NO: 2088318 - RNA, 21 nt, Staphylococcus aureus subsp. aureus MW2
uaguugccccuagcaaaaaua

SEQ ID NO: 2088319 - RNA, 17 nt, Staphylococcus aureus subsp. aureus MW2
uagugcaaguaauuuaa

SEQ ID NO: 2088320 - RNA, 22 nt, Staphylococcus aureus subsp. aureus MW2
uagugcucuugcaauagcaaca

SEQ ID NO: 2088321 - RNA, 19 nt, Staphylococcus aureus subsp. aureus MW2
uauaaaaaccaguuugauu

SEQ ID NO: 2088322 - RNA, 21 nt, Staphylococcus aureus subsp. aureus MW2
uauaaaaaccaguuugauuaa

SEQ ID NO: 2088323 - RNA, 14 nt, Staphylococcus aureus subsp. aureus MW2
uaguuuagguugau

SEQ ID NO: 2088324 - RNA, 23 nt, Staphylococcus aureus subsp. aureus MW2
uaguuuacggggugcuuuuuaug

SEQ ID NO: 2088325 - RNA, 18 nt, Staphylococcus aureus subsp. aureus MW2
uaguuguuuauuauagaa

SEQ ID NO: 2088326 - RNA, 20 nt, Staphylococcus aureus subsp. aureus MW2
uauaaaacgauaagaauuaa

SEQ ID NO: 2088327 - RNA, 22 nt, Staphylococcus aureus subsp. aureus MW2
uauaaaagcaauucguaacaca

SEQ ID NO: 2088328 - RNA, 14 nt, Staphylococcus aureus subsp. aureus MW2
uauaaaaagaauau

SEQ ID NO: 2088329 - RNA, 20 nt, Staphylococcus aureus subsp. aureus MW2
uauaaaaauguauuaaauau

SEQ ID NO: 2088330 - RNA, 22 nt, Staphylococcus aureus subsp. aureus MW2
uauaaacgucacuuuauuaaau

SEQ ID NO: 2088331 - RNA, 14 nt, Staphylococcus aureus subsp. aureus MW2
uauaaacuauuaaa

SEQ ID NO: 2088332 - RNA, 17 nt, Staphylococcus aureus subsp. aureus MW2
uauaaacgucacuuuau

SEQ ID NO: 2088333 - RNA, 15 nt, Staphylococcus aureus subsp. aureus MW2
uauaaaaucauuaau

SEQ ID NO: 2088334 - RNA, 14 nt, Staphylococcus aureus subsp. aureus MW2
uauaaaagucagcg

SEQ ID NO: 2088335 - RNA, 10 nt, Staphylococcus aureus subsp. aureus MW2
uauaaagaau

SEQ ID NO: 2088336 - RNA, 18 nt, Staphylococcus aureus subsp. aureus MW2
uauaaaggaauagcuaca

SEQ ID NO: 2088337 - RNA, 22 nt, Staphylococcus aureus subsp. aureus MW2
uauaaaggaauagcuacaauua

SEQ ID NO: 2088338 - RNA, 15 nt, Staphylococcus aureus subsp. aureus MW2
uauaaauuuugaauu

SEQ ID NO: 2088339 - RNA, 21 nt, Staphylococcus aureus subsp. aureus MW2
uauaaaguugacaauacaaau

SEQ ID NO: 2088340 - RNA, 20 nt, Staphylococcus aureus subsp. aureus MW2
uauaacacuucguauugaau

SEQ ID NO: 2088341 - RNA, 16 nt, Staphylococcus aureus subsp. aureus MW2
uauaacaccaauuaaa

SEQ ID NO: 2088342 - RNA, 16 nt, Staphylococcus aureus subsp. aureus MW2
uauaacauucuucaaa

SEQ ID NO: 2088343 - RNA, 12 nt, Staphylococcus aureus subsp. aureus MW2
uauaacauuaaa

SEQ ID NO: 2088344 - RNA, 20 nt, Staphylococcus aureus subsp. aureus MW2
uauaacugcauguacaucuu

SEQ ID NO: 2088345 - RNA, 18 nt, Staphylococcus aureus subsp. aureus MW2
uauaacugauaauacugu

SEQ ID NO: 2088346 - RNA, 15 nt, Staphylococcus aureus subsp. aureus MW2
uauaacgauagauuu

SEQ ID NO: 2088347 - RNA, 14 nt, Staphylococcus aureus subsp. aureus MW2
uauaacauuaaaau

SEQ ID NO: 2088348 - RNA, 21 nt, Staphylococcus aureus subsp. aureus MW2
uauaacccuaauguguggauu

SEQ ID NO: 2088349 - RNA, 13 nt, Staphylococcus aureus subsp. aureus MW2
uauaaccauaaug

SEQ ID NO: 2088350 - RNA, 22 nt, Staphylococcus aureus subsp. aureus MW2
uauaaccauaguaacaaaauga

SEQ ID NO: 2088351 - RNA, 15 nt, Staphylococcus aureus subsp. aureus MW2
uauaaccuauuaaau

SEQ ID NO: 2088352 - RNA, 17 nt, Staphylococcus aureus subsp. aureus MW2
uauaaccuauuaaaucu

SEQ ID NO: 2088353 - RNA, 22 nt, Staphylococcus aureus subsp. aureus MW2
uauaaccuuaauuauuuucucg

SEQ ID NO: 2088354 - RNA, 17 nt, Staphylococcus aureus subsp. aureus MW2
uauaaccuuguucuuua

SEQ ID NO: 2088355 - RNA, 24 nt, Staphylococcus aureus subsp. aureus MW2
uauaaccuuguucuuuacuccaaa

SEQ ID NO: 2088356 - RNA, 21 nt, Staphylococcus aureus subsp. aureus MW2
uauaaccgugaugaugugcaa

SEQ ID NO: 2088357 - RNA, 18 nt, Staphylococcus aureus subsp. aureus MW2
uauaacccuaaugugugg

SEQ ID NO: 2088358 - RNA, 18 nt, Staphylococcus aureus subsp. aureus MW2
uauaacuuuaaaaauuaa

SEQ ID NO: 2088359 - RNA, 16 nt, Staphylococcus aureus subsp. aureus MW2
uauaacuuuaaaaauu

SEQ ID NO: 2088360 - RNA, 16 nt, Staphylococcus aureus subsp. aureus MW2
uauaagauucauauuu

SEQ ID NO: 2088361 - RNA, 21 nt, Staphylococcus aureus subsp. aureus MW2
uauaagauaguuugagaaaau

SEQ ID NO: 2088362 - RNA, 13 nt, Staphylococcus aureus subsp. aureus MW2
uauaagcaaagac

SEQ ID NO: 2088363 - RNA, 15 nt, Staphylococcus aureus subsp. aureus MW2
uauaagccuuuucaa

SEQ ID NO: 2088364 - RNA, 17 nt, Staphylococcus aureus subsp. aureus MW2
uauaaguauuuugaauu

SEQ ID NO: 2088365 - RNA, 15 nt, Staphylococcus aureus subsp. aureus MW2
uauaaguacaaauaa

SEQ ID NO: 2088366 - RNA, 18 nt, Staphylococcus aureus subsp. aureus MW2
uauaaguauuuuaggguu

SEQ ID NO: 2088367 - RNA, 23 nt, Staphylococcus aureus subsp. aureus MW2
uauaaguagugauuuuuuacauu

SEQ ID NO: 2088368 - RNA, 23 nt, Staphylococcus aureus subsp. aureus MW2
uauaaguaagcguaauauuuaag

SEQ ID NO: 2088369 - RNA, 19 nt, Staphylococcus aureus subsp. aureus MW2
uauaaguaaucauaauaau

SEQ ID NO: 2088370 - RNA, 19 nt, Staphylococcus aureus subsp. aureus MW2
uauaaguuugguucaguag

SEQ ID NO: 2088371 - RNA, 19 nt, Staphylococcus aureus subsp. aureus MW2
uauaaguugcauauaaaaa

SEQ ID NO: 2088372 - RNA, 14 nt, Staphylococcus aureus subsp. aureus MW2
uauaaguuaaaauu

SEQ ID NO: 2088373 - RNA, 18 nt, Staphylococcus aureus subsp. aureus MW2
uauaaguuaaaaauguaa

SEQ ID NO: 2088374 - RNA, 22 nt, Staphylococcus aureus subsp. aureus MW2
uaguacuuugauaucuacagag

SEQ ID NO: 2088375 - RNA, 20 nt, Staphylococcus aureus subsp. aureus MW2
uaguacuuugauaucuacag

SEQ ID NO: 2088376 - RNA, 13 nt, Staphylococcus aureus subsp. aureus MW2
uaguacuuaauac

SEQ ID NO: 2088377 - RNA, 18 nt, Staphylococcus aureus subsp. aureus MW2
uaguacuuaauacuaauu

SEQ ID NO: 2088378 - RNA, 14 nt, Staphylococcus aureus subsp. aureus MW2
uaguagcuagaaca

SEQ ID NO: 2088379 - RNA, 22 nt, Staphylococcus aureus subsp. aureus MW2
uaguauuucaucauuaguuuuu

SEQ ID NO: 2088380 - RNA, 15 nt, Staphylococcus aureus subsp. aureus MW2
uaguauuucaucauu

SEQ ID NO: 2088381 - RNA, 21 nt, Staphylococcus aureus subsp. aureus MW2
uaguauuuuuugccaucaauu

SEQ ID NO: 2088382 - RNA, 18 nt, Staphylococcus aureus subsp. aureus MW2
uaguauuaacgcuuauac

SEQ ID NO: 2088383 - RNA, 17 nt, Staphylococcus aureus subsp. aureus MW2
uaguauuaucuuucaua

SEQ ID NO: 2088384 - RNA, 19 nt, Staphylococcus aureus subsp. aureus MW2
uaguauucaaaaaaauauu

SEQ ID NO: 2088385 - RNA, 13 nt, Staphylococcus aureus subsp. aureus MW2
uaguauguuuuau

SEQ ID NO: 2088386 - RNA, 15 nt, Staphylococcus aureus subsp. aureus MW2
uaguauggaauaaau

SEQ ID NO: 2088387 - RNA, 21 nt, Staphylococcus aureus subsp. aureus MW2
uagucauugaaaauauuuuau

SEQ ID NO: 2088388 - RNA, 16 nt, Staphylococcus aureus subsp. aureus MW2
uagucauuacaaauca

SEQ ID NO: 2088389 - RNA, 14 nt, Staphylococcus aureus subsp. aureus MW2
uagucauaauuuag

SEQ ID NO: 2088390 - RNA, 16 nt, Staphylococcus aureus subsp. aureus MW2
uagucauaauuuagaa

SEQ ID NO: 2088391 - RNA, 17 nt, Staphylococcus aureus subsp. aureus MW2
uagucaggggccccaac

SEQ ID NO: 2088392 - RNA, 18 nt, Staphylococcus aureus subsp. aureus MW2
uagucaggggccccaaca

SEQ ID NO: 2088393 - RNA, 13 nt, Staphylococcus aureus subsp. aureus MW2
uagucauaacgau

SEQ ID NO: 2088394 - RNA, 21 nt, Staphylococcus aureus subsp. aureus MW2
uagucgaagaagauuaugaaa

SEQ ID NO: 2088395 - RNA, 16 nt, Staphylococcus aureus subsp. aureus MW2
uagugauuuuuuacau

SEQ ID NO: 2088396 - RNA, 18 nt, Staphylococcus aureus subsp. aureus MW2
uagguuuauuucugaaaa

SEQ ID NO: 2088397 - RNA, 14 nt, Staphylococcus aureus subsp. aureus MW2
uagguuuaauguuu

SEQ ID NO: 2088398 - RNA, 16 nt, Staphylococcus aureus subsp. aureus MW2
uagguuuaauuuuaaa

SEQ ID NO: 2088399 - RNA, 16 nt, Staphylococcus aureus subsp. aureus MW2
uagguugauuucugcu

SEQ ID NO: 2088400 - RNA, 20 nt, Staphylococcus aureus subsp. aureus MW2
uagguuauuauaaaauaaau

SEQ ID NO: 2088401 - RNA, 12 nt, Staphylococcus aureus subsp. aureus MW2
uagguuagaauu

SEQ ID NO: 2088402 - RNA, 17 nt, Staphylococcus aureus subsp. aureus MW2
uagguggagauuuaaca

SEQ ID NO: 2088403 - RNA, 15 nt, Staphylococcus aureus subsp. aureus MW2
uaggugauuauauau

SEQ ID NO: 2088404 - RNA, 21 nt, Staphylococcus aureus subsp. aureus MW2
uaggcucuuaauguacuuuuc

SEQ ID NO: 2088405 - RNA, 14 nt, Staphylococcus aureus subsp. aureus MW2
uaggcugaaguuga

SEQ ID NO: 2088406 - RNA, 17 nt, Staphylococcus aureus subsp. aureus MW2
uaguaaauaauuuaaau

SEQ ID NO: 2088407 - RNA, 19 nt, Staphylococcus aureus subsp. aureus MW2
uaguaaauaauuuaaauua

SEQ ID NO: 2088408 - RNA, 22 nt, Staphylococcus aureus subsp. aureus MW2
uaguaaauaauuuaaauuaaaa

SEQ ID NO: 2088409 - RNA, 16 nt, Staphylococcus aureus subsp. aureus MW2
uaguaauaagacaaua

SEQ ID NO: 2088410 - RNA, 20 nt, Staphylococcus aureus subsp. aureus MW2
uaguaacgucugguuuaaug

SEQ ID NO: 2088411 - RNA, 17 nt, Staphylococcus aureus subsp. aureus MW2
uaguaagguuugaacuc

SEQ ID NO: 2088412 - RNA, 19 nt, Staphylococcus aureus subsp. aureus MW2
uaguaauaacaucuaaauu

SEQ ID NO: 2088413 - RNA, 20 nt, Staphylococcus aureus subsp. aureus MW2
uaguaauaacaucuaaauuu

SEQ ID NO: 2088414 - RNA, 23 nt, Staphylococcus aureus subsp. aureus MW2
uaguaauucuucaucuucuucaa

SEQ ID NO: 2088415 - RNA, 17 nt, Staphylococcus aureus subsp. aureus MW2
uaguaauuuuuaaaucu

SEQ ID NO: 2088416 - RNA, 19 nt, Staphylococcus aureus subsp. aureus MW2
uaguacaccucuaaguuca

SEQ ID NO: 2088417 - RNA, 18 nt, Staphylococcus aureus subsp. aureus MW2
uaguaccaagcuucauua

SEQ ID NO: 2088418 - RNA, 19 nt, Staphylococcus aureus subsp. aureus MW2
uaguaaugacuaacuuucu

SEQ ID NO: 2088419 - RNA, 16 nt, Staphylococcus aureus subsp. aureus MW2
uaguaccaugcucuuu

SEQ ID NO: 2088420 - RNA, 15 nt, Staphylococcus aureus subsp. aureus MW2
uagcguaauuauuau

SEQ ID NO: 2088421 - RNA, 22 nt, Staphylococcus aureus subsp. aureus MW2
uagcguaauuauuauaauaaau

SEQ ID NO: 2088422 - RNA, 18 nt, Staphylococcus aureus subsp. aureus MW2
uagcuaaugcauuauuau

SEQ ID NO: 2088423 - RNA, 22 nt, Staphylococcus aureus subsp. aureus MW2
uagcuaaugcauuauuauaaua

SEQ ID NO: 2088424 - RNA, 14 nt, Staphylococcus aureus subsp. aureus MW2
uagcuaauucacuu

SEQ ID NO: 2088425 - RNA, 12 nt, Staphylococcus aureus subsp. aureus MW2
uagcuaaugcaa

SEQ ID NO: 2088426 - RNA, 18 nt, Staphylococcus aureus subsp. aureus MW2
uagcuaaugcaacuaaaa

SEQ ID NO: 2088427 - RNA, 15 nt, Staphylococcus aureus subsp. aureus MW2
uagcgucaaguuuuc

SEQ ID NO: 2088428 - RNA, 22 nt, Staphylococcus aureus subsp. aureus MW2
uagcgcucuggauuuuucuuau

SEQ ID NO: 2088429 - RNA, 16 nt, Staphylococcus aureus subsp. aureus MW2
uaggcuagauaauaau

SEQ ID NO: 2088430 - RNA, 18 nt, Staphylococcus aureus subsp. aureus MW2
uaggauuuccggaacaau

SEQ ID NO: 2088431 - RNA, 23 nt, Staphylococcus aureus subsp. aureus MW2
uaggauucgauugguuuaaaaag

SEQ ID NO: 2088432 - RNA, 15 nt, Staphylococcus aureus subsp. aureus MW2
uagcuauuaaaauag

SEQ ID NO: 2088433 - RNA, 20 nt, Staphylococcus aureus subsp. aureus MW2
uagcucaaaacaauuuaaaa

SEQ ID NO: 2088434 - RNA, 18 nt, Staphylococcus aureus subsp. aureus MW2
uagcuauauuuuuguauu

SEQ ID NO: 2088435 - RNA, 16 nt, Staphylococcus aureus subsp. aureus MW2
uaggaauuuuuuuaau

SEQ ID NO: 2088436 - RNA, 23 nt, Staphylococcus aureus subsp. aureus MW2
uaggaauuguuaauuucaacauu

SEQ ID NO: 2088437 - RNA, 15 nt, Staphylococcus aureus subsp. aureus MW2
uagcuuauuuagaaa

SEQ ID NO: 2088438 - RNA, 19 nt, Staphylococcus aureus subsp. aureus MW2
uagcaagaauagauugauu

SEQ ID NO: 2088439 - RNA, 20 nt, Staphylococcus aureus subsp. aureus MW2
uagcaacugaucauuuucau

SEQ ID NO: 2088440 - RNA, 22 nt, Staphylococcus aureus subsp. aureus MW2
uagcaaauauuauuaaaucaaa

SEQ ID NO: 2088441 - RNA, 17 nt, Staphylococcus aureus subsp. aureus MW2
uagcaaauauuauuaaa

SEQ ID NO: 2088442 - RNA, 20 nt, Staphylococcus aureus subsp. aureus MW2
uagcaaccauauuuuuagaa

SEQ ID NO: 2088443 - RNA, 22 nt, Staphylococcus aureus subsp. aureus MW2
uagcaaccauauuuuuagaaaa

SEQ ID NO: 2088444 - RNA, 14 nt, Staphylococcus aureus subsp. aureus MW2
uagcaaaaauacuu

SEQ ID NO: 2088445 - RNA, 21 nt, Staphylococcus aureus subsp. aureus MW2
uagcaaaauuauguaaaaaau

SEQ ID NO: 2088446 - RNA, 19 nt, Staphylococcus aureus subsp. aureus MW2
uagcauguuauauuaugaa

SEQ ID NO: 2088447 - RNA, 18 nt, Staphylococcus aureus subsp. aureus MW2
uagcaugauaaaguaugu

SEQ ID NO: 2088448 - RNA, 15 nt, Staphylococcus aureus subsp. aureus MW2
uagcauugccccauc

SEQ ID NO: 2088449 - RNA, 13 nt, Staphylococcus aureus subsp. aureus MW2
uagccauuucaau

SEQ ID NO: 2088450 - RNA, 22 nt, Staphylococcus aureus subsp. aureus MW2
uagauuuuguauuagcaucuga

SEQ ID NO: 2088451 - RNA, 19 nt, Staphylococcus aureus subsp. aureus MW2
uagauuuuguauuagcauc

SEQ ID NO: 2088452 - RNA, 19 nt, Staphylococcus aureus subsp. aureus MW2
uagauuuuauauaaaaaga

SEQ ID NO: 2088453 - RNA, 17 nt, Staphylococcus aureus subsp. aureus MW2
uagauuuuauauaaaaa

SEQ ID NO: 2088454 - RNA, 14 nt, Staphylococcus aureus subsp. aureus MW2
uagauuuuauaaaa

SEQ ID NO: 2088455 - RNA, 16 nt, Staphylococcus aureus subsp. aureus MW2
uagauuuuauaaaaag

SEQ ID NO: 2088456 - RNA, 12 nt, Staphylococcus aureus subsp. aureus MW2
uagauuuuaaac

SEQ ID NO: 2088457 - RNA, 13 nt, Staphylococcus aureus subsp. aureus MW2
uagauuuaaaaug

SEQ ID NO: 2088458 - RNA, 13 nt, Staphylococcus aureus subsp. aureus MW2
uagauuuaggaga

SEQ ID NO: 2088459 - RNA, 17 nt, Staphylococcus aureus subsp. aureus MW2
uagauuuaggagagcca

SEQ ID NO: 2088460 - RNA, 18 nt, Staphylococcus aureus subsp. aureus MW2
uagauuguauguuauagc

SEQ ID NO: 2088461 - RNA, 23 nt, Staphylococcus aureus subsp. aureus MW2
uagauuguauuuaauaaguuaau

SEQ ID NO: 2088462 - RNA, 16 nt, Staphylococcus aureus subsp. aureus MW2
uagauugauuguauuu

SEQ ID NO: 2088463 - RNA, 18 nt, Staphylococcus aureus subsp. aureus MW2
uagauugcgguaauugaa

SEQ ID NO: 2088464 - RNA, 17 nt, Staphylococcus aureus subsp. aureus MW2
uagauucuuuucugaau

SEQ ID NO: 2088465 - RNA, 13 nt, Staphylococcus aureus subsp. aureus MW2
uagauugaaaaaa

SEQ ID NO: 2088466 - RNA, 15 nt, Staphylococcus aureus subsp. aureus MW2
uagaaaaauuucaaa

SEQ ID NO: 2088467 - RNA, 19 nt, Staphylococcus aureus subsp. aureus MW2
uagaaaaagcaggcaagcu

SEQ ID NO: 2088468 - RNA, 19 nt, Staphylococcus aureus subsp. aureus MW2
uagaaaaauuucaaaaaua

SEQ ID NO: 2088469 - RNA, 19 nt, Staphylococcus aureus subsp. aureus MW2
uagaaaaguaaguaaaaua

SEQ ID NO: 2088470 - RNA, 22 nt, Staphylococcus aureus subsp. aureus MW2
uagaaaauaugacgaucuucau

SEQ ID NO: 2088471 - RNA, 18 nt, Staphylococcus aureus subsp. aureus MW2
uagaaaaggcucauuugu

SEQ ID NO: 2088472 - RNA, 11 nt, Staphylococcus aureus subsp. aureus MW2
uagaugaaaug

SEQ ID NO: 2088473 - RNA, 18 nt, Staphylococcus aureus subsp. aureus MW2
uagaugaaugccuaauuu

SEQ ID NO: 2088474 - RNA, 23 nt, Staphylococcus aureus subsp. aureus MW2
uagaugaaauuguguugaaucaa

SEQ ID NO: 2088475 - RNA, 21 nt, Staphylococcus aureus subsp. aureus MW2
uagaugaaugccuaauuuugu

SEQ ID NO: 2088476 - RNA, 15 nt, Staphylococcus aureus subsp. aureus MW2
uagaugaaaauuuaa

SEQ ID NO: 2088477 - RNA, 23 nt, Staphylococcus aureus subsp. aureus MW2
uagaugauuagugucacaaagaa

SEQ ID NO: 2088478 - RNA, 15 nt, Staphylococcus aureus subsp. aureus MW2
uagaugcauaaaaaa

SEQ ID NO: 2088479 - RNA, 18 nt, Staphylococcus aureus subsp. aureus MW2
uagaugcauaaaaaaaga

SEQ ID NO: 2088480 - RNA, 21 nt, Staphylococcus aureus subsp. aureus MW2
uagaugauauuuaacgaaaau

SEQ ID NO: 2088481 - RNA, 18 nt, Staphylococcus aureus subsp. aureus MW2
uagaugcuugaccuucag

SEQ ID NO: 2088482 - RNA, 21 nt, Staphylococcus aureus subsp. aureus MW2
ucagcaccgccugaaauagcu

SEQ ID NO: 2088483 - RNA, 15 nt, Staphylococcus aureus subsp. aureus MW2
ucagauuuuauuaaa

SEQ ID NO: 2088484 - RNA, 20 nt, Staphylococcus aureus subsp. aureus MW2
ucagcauugggacauaaaau

SEQ ID NO: 2088485 - RNA, 14 nt, Staphylococcus aureus subsp. aureus MW2
ucagcauuuaaguu

SEQ ID NO: 2088486 - RNA, 16 nt, Staphylococcus aureus subsp. aureus MW2
ucagccauaauaucuu

SEQ ID NO: 2088487 - RNA, 15 nt, Staphylococcus aureus subsp. aureus MW2
ucagaugauuuaauu

SEQ ID NO: 2088488 - RNA, 23 nt, Staphylococcus aureus subsp. aureus MW2
ucagauucauaucuuucaauuaa

SEQ ID NO: 2088489 - RNA, 20 nt, Staphylococcus aureus subsp. aureus MW2
ucagcaaaaagcccuauuau

SEQ ID NO: 2088490 - RNA, 17 nt, Staphylococcus aureus subsp. aureus MW2
ucagaaugaacuucucu

SEQ ID NO: 2088491 - RNA, 19 nt, Staphylococcus aureus subsp. aureus MW2
ucagaaugaacuucucuua

SEQ ID NO: 2088492 - RNA, 23 nt, Staphylococcus aureus subsp. aureus MW2
ucagacacgacguuuuuuuaugu

SEQ ID NO: 2088493 - RNA, 19 nt, Staphylococcus aureus subsp. aureus MW2
ucagaaguuguuuagaaaa

SEQ ID NO: 2088494 - RNA, 16 nt, Staphylococcus aureus subsp. aureus MW2
ucagaaucaaguaauu

SEQ ID NO: 2088495 - RNA, 12 nt, Staphylococcus aureus subsp. aureus MW2
ucacgcuaacau

SEQ ID NO: 2088496 - RNA, 17 nt, Staphylococcus aureus subsp. aureus MW2
ucacgauuaauaaaauu

SEQ ID NO: 2088497 - RNA, 18 nt, Staphylococcus aureus subsp. aureus MW2
ucacgauuuuuaaaaugc

SEQ ID NO: 2088498 - RNA, 20 nt, Staphylococcus aureus subsp. aureus MW2
ucacgauuuuuaaaaugcuu

SEQ ID NO: 2088499 - RNA, 15 nt, Staphylococcus aureus subsp. aureus MW2
ucaccuuuuuuaacu

SEQ ID NO: 2088500 - RNA, 16 nt, Staphylococcus aureus subsp. aureus MW2
ucaccuuuuuuaacuu

SEQ ID NO: 2088501 - RNA, 14 nt, Staphylococcus aureus subsp. aureus MW2
ucacgaauaucuua

SEQ ID NO: 2088502 - RNA, 21 nt, Staphylococcus aureus subsp. aureus MW2
ucaccuuuuuuaacuuuaaca

SEQ ID NO: 2088503 - RNA, 15 nt, Staphylococcus aureus subsp. aureus MW2
ucacgauaauguaua

SEQ ID NO: 2088504 - RNA, 13 nt, Staphylococcus aureus subsp. aureus MW2
ucacuaaaaauau

SEQ ID NO: 2088505 - RNA, 20 nt, Staphylococcus aureus subsp. aureus MW2
ucacuaaaaaucuauauaac

SEQ ID NO: 2088506 - RNA, 18 nt, Staphylococcus aureus subsp. aureus MW2
ucacuaaaguaaauaaca

SEQ ID NO: 2088507 - RNA, 16 nt, Staphylococcus aureus subsp. aureus MW2
ucacuaaaguaaauaa

SEQ ID NO: 2088508 - RNA, 12 nt, Staphylococcus aureus subsp. aureus MW2
ucacuaauauau

SEQ ID NO: 2088509 - RNA, 20 nt, Staphylococcus aureus subsp. aureus MW2
ucacuaaucauuuuuucaau

SEQ ID NO: 2088510 - RNA, 20 nt, Staphylococcus aureus subsp. aureus MW2
ucacgugguuucuuuaauug

SEQ ID NO: 2088511 - RNA, 15 nt, Staphylococcus aureus subsp. aureus MW2
ucacguuuuucuuua

SEQ ID NO: 2088512 - RNA, 20 nt, Staphylococcus aureus subsp. aureus MW2
ucacguuuuucuuuaaacgc

SEQ ID NO: 2088513 - RNA, 18 nt, Staphylococcus aureus subsp. aureus MW2
ucacguugugcaauaccu

SEQ ID NO: 2088514 - RNA, 14 nt, Staphylococcus aureus subsp. aureus MW2
ucacguaaugaauc

SEQ ID NO: 2088515 - RNA, 17 nt, Staphylococcus aureus subsp. aureus MW2
ucacguaaugaaucaau

SEQ ID NO: 2088516 - RNA, 15 nt, Staphylococcus aureus subsp. aureus MW2
ucacuagcuaaugca

SEQ ID NO: 2088517 - RNA, 16 nt, Staphylococcus aureus subsp. aureus MW2
ucacuaggauguucau

SEQ ID NO: 2088518 - RNA, 16 nt, Staphylococcus aureus subsp. aureus MW2
ucacuaguguauacaa

SEQ ID NO: 2088519 - RNA, 15 nt, Staphylococcus aureus subsp. aureus MW2
ucacuacauuaaaaa

SEQ ID NO: 2088520 - RNA, 19 nt, Staphylococcus aureus subsp. aureus MW2
ucacucuuuaaaucaaaga

SEQ ID NO: 2088521 - RNA, 15 nt, Staphylococcus aureus subsp. aureus MW2
ucacuugguacaccu

SEQ ID NO: 2088522 - RNA, 15 nt, Staphylococcus aureus subsp. aureus MW2
ucacuuguccuaagu

SEQ ID NO: 2088523 - RNA, 18 nt, Staphylococcus aureus subsp. aureus MW2
ucacuuuaacuucuuuug

SEQ ID NO: 2088524 - RNA, 15 nt, Staphylococcus aureus subsp. aureus MW2
ucacuuuaacuucuu

SEQ ID NO: 2088525 - RNA, 20 nt, Staphylococcus aureus subsp. aureus MW2
ucacuuggauucaaaugaca

SEQ ID NO: 2088526 - RNA, 21 nt, Staphylococcus aureus subsp. aureus MW2
ucacuuuuuaaacguacauuu

SEQ ID NO: 2088527 - RNA, 17 nt, Staphylococcus aureus subsp. aureus MW2
ucacuuuauuaaauaac

SEQ ID NO: 2088528 - RNA, 14 nt, Staphylococcus aureus subsp. aureus MW2
ucacuucugaaaau

SEQ ID NO: 2088529 - RNA, 22 nt, Staphylococcus aureus subsp. aureus MW2
ucacuguuaaagauguugaaaa

SEQ ID NO: 2088530 - RNA, 16 nt, Staphylococcus aureus subsp. aureus MW2
ucacuguuuuauuaug

SEQ ID NO: 2088531 - RNA, 12 nt, Staphylococcus aureus subsp. aureus MW2
ucacuuaauaaa

SEQ ID NO: 2088532 - RNA, 19 nt, Staphylococcus aureus subsp. aureus MW2
ucacuuaauaaauaauuuc

SEQ ID NO: 2088533 - RNA, 19 nt, Staphylococcus aureus subsp. aureus MW2
ucacuuauagaaugauuaa

SEQ ID NO: 2088534 - RNA, 16 nt, Staphylococcus aureus subsp. aureus MW2
ucacuuauuauuuugu

SEQ ID NO: 2088535 - RNA, 18 nt, Staphylococcus aureus subsp. aureus MW2
ucacugcaacacaggccg

SEQ ID NO: 2088536 - RNA, 22 nt, Staphylococcus aureus subsp. aureus MW2
ucacugcaaacacaguacaaau

SEQ ID NO: 2088537 - RNA, 15 nt, Staphylococcus aureus subsp. aureus MW2
ucacuguagauucaa

SEQ ID NO: 2088538 - RNA, 20 nt, Staphylococcus aureus subsp. aureus MW2
ucacuggguguuuuuuucuu

SEQ ID NO: 2088539 - RNA, 23 nt, Staphylococcus aureus subsp. aureus MW2
ucacuggguguuuuuuucuuaug

SEQ ID NO: 2088540 - RNA, 13 nt, Staphylococcus aureus subsp. aureus MW2
ucacuguuuuauu

SEQ ID NO: 2088541 - RNA, 23 nt, Staphylococcus aureus subsp. aureus MW2
ucaaucaacgagucauaaauaua

SEQ ID NO: 2088542 - RNA, 13 nt, Staphylococcus aureus subsp. aureus MW2
ucaauauuuaaau

SEQ ID NO: 2088543 - RNA, 12 nt, Staphylococcus aureus subsp. aureus MW2
ucaauauuaaaa

SEQ ID NO: 2088544 - RNA, 24 nt, Staphylococcus aureus subsp. aureus MW2
ucaauaucuucuucuaaccacuuc

SEQ ID NO: 2088545 - RNA, 23 nt, Staphylococcus aureus subsp. aureus MW2
ucaauaucuguagcgauaccuuu

SEQ ID NO: 2088546 - RNA, 14 nt, Staphylococcus aureus subsp. aureus MW2
ucaauaucauucau

SEQ ID NO: 2088547 - RNA, 17 nt, Staphylococcus aureus subsp. aureus MW2
ucaauaguuuauaauuu

SEQ ID NO: 2088548 - RNA, 14 nt, Staphylococcus aureus subsp. aureus MW2
ucaauacaaaacau

SEQ ID NO: 2088549 - RNA, 14 nt, Staphylococcus aureus subsp. aureus MW2
ucaauaccaacugu

SEQ ID NO: 2088550 - RNA, 15 nt, Staphylococcus aureus subsp. aureus MW2
ucaauacuugaaaga

SEQ ID NO: 2088551 - RNA, 16 nt, Staphylococcus aureus subsp. aureus MW2
ucaauaacuauaauca

SEQ ID NO: 2088552 - RNA, 14 nt, Staphylococcus aureus subsp. aureus MW2
ucaagcuuaauaag

SEQ ID NO: 2088553 - RNA, 23 nt, Staphylococcus aureus subsp. aureus MW2
ucaagcgcaugcuugaacuuuua

SEQ ID NO: 2088554 - RNA, 16 nt, Staphylococcus aureus subsp. aureus MW2
ucaaguaaauguuuug

SEQ ID NO: 2088555 - RNA, 20 nt, Staphylococcus aureus subsp. aureus MW2
ucaaguucaccguaaucuuu

SEQ ID NO: 2088556 - RNA, 19 nt, Staphylococcus aureus subsp. aureus MW2
ucaaguucaccguaaucuu

SEQ ID NO: 2088557 - RNA, 13 nt, Staphylococcus aureus subsp. aureus MW2
ucaaguuuaaaau

SEQ ID NO: 2088558 - RNA, 16 nt, Staphylococcus aureus subsp. aureus MW2
ucaaguaaucauuuuu

SEQ ID NO: 2088559 - RNA, 18 nt, Staphylococcus aureus subsp. aureus MW2
ucaagucugcauuaauuu

SEQ ID NO: 2088560 - RNA, 12 nt, Staphylococcus aureus subsp. aureus MW2
ucaauaaauugu

SEQ ID NO: 2088561 - RNA, 11 nt, Staphylococcus aureus subsp. aureus MW2
ucaauaaauug

SEQ ID NO: 2088562 - RNA, 17 nt, Staphylococcus aureus subsp. aureus MW2
ucaauaaauuguuuacu

SEQ ID NO: 2088563 - RNA, 13 nt, Staphylococcus aureus subsp. aureus MW2
ucaaguuuugguc

SEQ ID NO: 2088564 - RNA, 15 nt, Staphylococcus aureus subsp. aureus MW2
ucaauaaaaauugaa

SEQ ID NO: 2088565 - RNA, 20 nt, Staphylococcus aureus subsp. aureus MW2
ucaauaaaaauugaauuaug

SEQ ID NO: 2088566 - RNA, 16 nt, Staphylococcus aureus subsp. aureus MW2
ucaauguaagcaacau

SEQ ID NO: 2088567 - RNA, 17 nt, Staphylococcus aureus subsp. aureus MW2
ucaauguaagcaacaua

SEQ ID NO: 2088568 - RNA, 16 nt, Staphylococcus aureus subsp. aureus MW2
ucaaugugagauauaa

SEQ ID NO: 2088569 - RNA, 23 nt, Staphylococcus aureus subsp. aureus MW2
ucaauguucuaggcuccuaaaug

SEQ ID NO: 2088570 - RNA, 15 nt, Staphylococcus aureus subsp. aureus MW2
ucaauguuauuaaac

SEQ ID NO: 2088571 - RNA, 14 nt, Staphylococcus aureus subsp. aureus MW2
ucaaugcuuucauc

SEQ ID NO: 2088572 - RNA, 18 nt, Staphylococcus aureus subsp. aureus MW2
ucaaugacuuaacaucuu

SEQ ID NO: 2088573 - RNA, 19 nt, Staphylococcus aureus subsp. aureus MW2
ucaaugacuuaacaucuuu

SEQ ID NO: 2088574 - RNA, 19 nt, Staphylococcus aureus subsp. aureus MW2
ucaaugacugagaaaaaua

SEQ ID NO: 2088575 - RNA, 13 nt, Staphylococcus aureus subsp. aureus MW2
ucaaugacaucua

SEQ ID NO: 2088576 - RNA, 14 nt, Staphylococcus aureus subsp. aureus MW2
ucaaugcauauucu

SEQ ID NO: 2088577 - RNA, 15 nt, Staphylococcus aureus subsp. aureus MW2
ucaaugcauauucua

SEQ ID NO: 2088578 - RNA, 19 nt, Staphylococcus aureus subsp. aureus MW2
ucaaugauuugauaauauu

SEQ ID NO: 2088579 - RNA, 20 nt, Staphylococcus aureus subsp. aureus MW2
ucaaugauuugauaauauua

SEQ ID NO: 2088580 - RNA, 21 nt, Staphylococcus aureus subsp. aureus MW2
ucaauccaauuaaauauuuaa

SEQ ID NO: 2088581 - RNA, 14 nt, Staphylococcus aureus subsp. aureus MW2
ucaauccaauuaaa

SEQ ID NO: 2088582 - RNA, 16 nt, Staphylococcus aureus subsp. aureus MW2
ucaauccuaaauuaua

SEQ ID NO: 2088583 - RNA, 15 nt, Staphylococcus aureus subsp. aureus MW2
ucaaucgcauuuugu

SEQ ID NO: 2088584 - RNA, 21 nt, Staphylococcus aureus subsp. aureus MW2
ucaaucgcaucuguuaacuga

SEQ ID NO: 2088585 - RNA, 23 nt, Staphylococcus aureus subsp. aureus MW2
ucaauccaagcaaucuuaguaca

SEQ ID NO: 2088586 - RNA, 13 nt, Staphylococcus aureus subsp. aureus MW2
ucacaaagaaauu

SEQ ID NO: 2088587 - RNA, 21 nt, Staphylococcus aureus subsp. aureus MW2
ucaauuuuuucaugauuuacu

SEQ ID NO: 2088588 - RNA, 18 nt, Staphylococcus aureus subsp. aureus MW2
ucaauuuggaaauaucuu

SEQ ID NO: 2088589 - RNA, 19 nt, Staphylococcus aureus subsp. aureus MW2
ucaauuuuaccagcaugaa

SEQ ID NO: 2088590 - RNA, 18 nt, Staphylococcus aureus subsp. aureus MW2
ucaauuuaguauaaauaa

SEQ ID NO: 2088591 - RNA, 12 nt, Staphylococcus aureus subsp. aureus MW2
ucaauuuaagug

SEQ ID NO: 2088592 - RNA, 22 nt, Staphylococcus aureus subsp. aureus MW2
ucaauuucaccuuguaaauuga

SEQ ID NO: 2088593 - RNA, 14 nt, Staphylococcus aureus subsp. aureus MW2
ucaauuucauuuuu

SEQ ID NO: 2088594 - RNA, 16 nt, Staphylococcus aureus subsp. aureus MW2
ucaauuucauuugaaa

SEQ ID NO: 2088595 - RNA, 14 nt, Staphylococcus aureus subsp. aureus MW2
ucaauuucuguaau

SEQ ID NO: 2088596 - RNA, 20 nt, Staphylococcus aureus subsp. aureus MW2
ucaauuuaaauaaguuacuc

SEQ ID NO: 2088597 - RNA, 13 nt, Staphylococcus aureus subsp. aureus MW2
ucaauuuaauuaa

SEQ ID NO: 2088598 - RNA, 12 nt, Staphylococcus aureus subsp. aureus MW2
ucaauuuaaaua

SEQ ID NO: 2088599 - RNA, 15 nt, Staphylococcus aureus subsp. aureus MW2
ucaauugcacuuacu

SEQ ID NO: 2088600 - RNA, 22 nt, Staphylococcus aureus subsp. aureus MW2
ucaauugcaugucuuaaauucu

SEQ ID NO: 2088601 - RNA, 15 nt, Staphylococcus aureus subsp. aureus MW2
ucaauucgcucacau

SEQ ID NO: 2088602 - RNA, 16 nt, Staphylococcus aureus subsp. aureus MW2
ucaauguuuaauuuuc

SEQ ID NO: 2088603 - RNA, 20 nt, Staphylococcus aureus subsp. aureus MW2
ucaauguuuaauuuucuaaa

SEQ ID NO: 2088604 - RNA, 14 nt, Staphylococcus aureus subsp. aureus MW2
ucaauguuuaauuu

SEQ ID NO: 2088605 - RNA, 15 nt, Staphylococcus aureus subsp. aureus MW2
ucaauuaaugauuca

SEQ ID NO: 2088606 - RNA, 21 nt, Staphylococcus aureus subsp. aureus MW2
ucaauucacgagcugcuucaa

SEQ ID NO: 2088607 - RNA, 20 nt, Staphylococcus aureus subsp. aureus MW2
ucaauuaauuuaaaugcuua

SEQ ID NO: 2088608 - RNA, 15 nt, Staphylococcus aureus subsp. aureus MW2
ucaauuagaaaauuu

SEQ ID NO: 2088609 - RNA, 22 nt, Staphylococcus aureus subsp. aureus MW2
ucaccguaugauggaaucauuu

SEQ ID NO: 2088610 - RNA, 20 nt, Staphylococcus aureus subsp. aureus MW2
ucaccuaaaugauuaauaac

SEQ ID NO: 2088611 - RNA, 20 nt, Staphylococcus aureus subsp. aureus MW2
ucaccguaaucuuuuaacuu

SEQ ID NO: 2088612 - RNA, 17 nt, Staphylococcus aureus subsp. aureus MW2
ucaccauacuaaaacau

SEQ ID NO: 2088613 - RNA, 17 nt, Staphylococcus aureus subsp. aureus MW2
ucaccaucauauucaac

SEQ ID NO: 2088614 - RNA, 13 nt, Staphylococcus aureus subsp. aureus MW2
ucaccaucuuuaa

SEQ ID NO: 2088615 - RNA, 20 nt, Staphylococcus aureus subsp. aureus MW2
ucaccauuuuuuacaacguc

SEQ ID NO: 2088616 - RNA, 16 nt, Staphylococcus aureus subsp. aureus MW2
ucaccauuuacuucau

SEQ ID NO: 2088617 - RNA, 20 nt, Staphylococcus aureus subsp. aureus MW2
ucaccagguuuuuuauuuuc

SEQ ID NO: 2088618 - RNA, 13 nt, Staphylococcus aureus subsp. aureus MW2
ucaccauaaaaau

SEQ ID NO: 2088619 - RNA, 17 nt, Staphylococcus aureus subsp. aureus MW2
ucaccaacuuuuuuaac

SEQ ID NO: 2088620 - RNA, 20 nt, Staphylococcus aureus subsp. aureus MW2
ucacauucuugaauaaauuu

SEQ ID NO: 2088621 - RNA, 18 nt, Staphylococcus aureus subsp. aureus MW2
ucacauugccuaaagacu

SEQ ID NO: 2088622 - RNA, 15 nt, Staphylococcus aureus subsp. aureus MW2
ucacauuaaguuaaa

SEQ ID NO: 2088623 - RNA, 18 nt, Staphylococcus aureus subsp. aureus MW2
ucacauuaaguuaaacgu

SEQ ID NO: 2088624 - RNA, 16 nt, Staphylococcus aureus subsp. aureus MW2
ucacaugugaaauaau

SEQ ID NO: 2088625 - RNA, 22 nt, Staphylococcus aureus subsp. aureus MW2
ucacauguaccacauuuuccuu

SEQ ID NO: 2088626 - RNA, 22 nt, Staphylococcus aureus subsp. aureus MW2
ucacaugaauuuuaauauauuu

SEQ ID NO: 2088627 - RNA, 14 nt, Staphylococcus aureus subsp. aureus MW2
ucacaguguaauca

SEQ ID NO: 2088628 - RNA, 22 nt, Staphylococcus aureus subsp. aureus MW2
ucacaucacguugugcaauacc

SEQ ID NO: 2088629 - RNA, 23 nt, Staphylococcus aureus subsp. aureus MW2
ucacauagccucuuaaaauaccu

SEQ ID NO: 2088630 - RNA, 22 nt, Staphylococcus aureus subsp. aureus MW2
ucacauacauuuugaaacaucu

SEQ ID NO: 2088631 - RNA, 24 nt, Staphylococcus aureus subsp. aureus MW2
ucacauacauuuugaaacaucuaa

SEQ ID NO: 2088632 - RNA, 13 nt, Staphylococcus aureus subsp. aureus MW2
ucacauacauuuu

SEQ ID NO: 2088633 - RNA, 14 nt, Staphylococcus aureus subsp. aureus MW2
ucacagcaauaaua

SEQ ID NO: 2088634 - RNA, 17 nt, Staphylococcus aureus subsp. aureus MW2
ucacaacggcauaauac

SEQ ID NO: 2088635 - RNA, 12 nt, Staphylococcus aureus subsp. aureus MW2
ucacaacagugc

SEQ ID NO: 2088636 - RNA, 14 nt, Staphylococcus aureus subsp. aureus MW2
ucacaauauaacau

SEQ ID NO: 2088637 - RNA, 13 nt, Staphylococcus aureus subsp. aureus MW2
ucacaaugaccau

SEQ ID NO: 2088638 - RNA, 22 nt, Staphylococcus aureus subsp. aureus MW2
ucacaauacgaaaccaaaaaua

SEQ ID NO: 2088639 - RNA, 16 nt, Staphylococcus aureus subsp. aureus MW2
ucacaaucauagauau

SEQ ID NO: 2088640 - RNA, 21 nt, Staphylococcus aureus subsp. aureus MW2
ucacaaugaccauugucaugc

SEQ ID NO: 2088641 - RNA, 21 nt, Staphylococcus aureus subsp. aureus MW2
uauucagucaguaaaaauaca

SEQ ID NO: 2088642 - RNA, 23 nt, Staphylococcus aureus subsp. aureus MW2
uauucauguucuuguaauccuag

SEQ ID NO: 2088643 - RNA, 14 nt, Staphylococcus aureus subsp. aureus MW2
uauuccuaguucua

SEQ ID NO: 2088644 - RNA, 14 nt, Staphylococcus aureus subsp. aureus MW2
uauuccuauuacua

SEQ ID NO: 2088645 - RNA, 14 nt, Staphylococcus aureus subsp. aureus MW2
uauuccauuucaaa

SEQ ID NO: 2088646 - RNA, 24 nt, Staphylococcus aureus subsp. aureus MW2
uauucccaccggacaauguagaua

SEQ ID NO: 2088647 - RNA, 21 nt, Staphylococcus aureus subsp. aureus MW2
uauucaacagggguaaaacuu

SEQ ID NO: 2088648 - RNA, 23 nt, Staphylococcus aureus subsp. aureus MW2
uauucaacuaauuuaaagcauca

SEQ ID NO: 2088649 - RNA, 14 nt, Staphylococcus aureus subsp. aureus MW2
uauuauuuuacuuu

SEQ ID NO: 2088650 - RNA, 18 nt, Staphylococcus aureus subsp. aureus MW2
uauuauuuugcuuuaauu

SEQ ID NO: 2088651 - RNA, 19 nt, Staphylococcus aureus subsp. aureus MW2
uauuauuuuguauuuuuca

SEQ ID NO: 2088652 - RNA, 12 nt, Staphylococcus aureus subsp. aureus MW2
uauucaaaauaa

SEQ ID NO: 2088653 - RNA, 16 nt, Staphylococcus aureus subsp. aureus MW2
uauucaaaguuuucau

SEQ ID NO: 2088654 - RNA, 21 nt, Staphylococcus aureus subsp. aureus MW2
uauucaaauguuuacugucau

SEQ ID NO: 2088655 - RNA, 18 nt, Staphylococcus aureus subsp. aureus MW2
uauucaaaaaaauauuua

SEQ ID NO: 2088656 - RNA, 23 nt, Staphylococcus aureus subsp. aureus MW2
uauucaaaggacgucuuuuuaga

SEQ ID NO: 2088657 - RNA, 17 nt, Staphylococcus aureus subsp. aureus MW2
uauucuguaacguuacu

SEQ ID NO: 2088658 - RNA, 16 nt, Staphylococcus aureus subsp. aureus MW2
uauugaaauaauauaa

SEQ ID NO: 2088659 - RNA, 16 nt, Staphylococcus aureus subsp. aureus MW2
uauugaaaugagcuua

SEQ ID NO: 2088660 - RNA, 20 nt, Staphylococcus aureus subsp. aureus MW2
uauucuuggcguauuuuuug

SEQ ID NO: 2088661 - RNA, 15 nt, Staphylococcus aureus subsp. aureus MW2
uauugaaaagauaaa

SEQ ID NO: 2088662 - RNA, 18 nt, Staphylococcus aureus subsp. aureus MW2
uauugaaacuaauaauuu

SEQ ID NO: 2088663 - RNA, 13 nt, Staphylococcus aureus subsp. aureus MW2
uauugaaagauau

SEQ ID NO: 2088664 - RNA, 18 nt, Staphylococcus aureus subsp. aureus MW2
uauugaaaucgauacuaa

SEQ ID NO: 2088665 - RNA, 18 nt, Staphylococcus aureus subsp. aureus MW2
uauugaaaguguaugcau

SEQ ID NO: 2088666 - RNA, 22 nt, Staphylococcus aureus subsp. aureus MW2
uauucuaaaaaauuaaaaauuu

SEQ ID NO: 2088667 - RNA, 16 nt, Staphylococcus aureus subsp. aureus MW2
uauucguuucuuuauu

SEQ ID NO: 2088668 - RNA, 12 nt, Staphylococcus aureus subsp. aureus MW2
uauucggcaaaa

SEQ ID NO: 2088669 - RNA, 18 nt, Staphylococcus aureus subsp. aureus MW2
uauucugaaaaauauuua

SEQ ID NO: 2088670 - RNA, 19 nt, Staphylococcus aureus subsp. aureus MW2
uauucugaaaaauauuuaa

SEQ ID NO: 2088671 - RNA, 20 nt, Staphylococcus aureus subsp. aureus MW2
uauucugaaaaauauuuaaa

SEQ ID NO: 2088672 - RNA, 22 nt, Staphylococcus aureus subsp. aureus MW2
uauuaauuccucccuuuacuuu

SEQ ID NO: 2088673 - RNA, 17 nt, Staphylococcus aureus subsp. aureus MW2
uauuaauuugauaaaug

SEQ ID NO: 2088674 - RNA, 14 nt, Staphylococcus aureus subsp. aureus MW2
uauuacaaucaaaa

SEQ ID NO: 2088675 - RNA, 18 nt, Staphylococcus aureus subsp. aureus MW2
uauuacaaccaacaauug

SEQ ID NO: 2088676 - RNA, 13 nt, Staphylococcus aureus subsp. aureus MW2
uauuacaaaauuu

SEQ ID NO: 2088677 - RNA, 20 nt, Staphylococcus aureus subsp. aureus MW2
uauuaauuacgucauaaaau

SEQ ID NO: 2088678 - RNA, 13 nt, Staphylococcus aureus subsp. aureus MW2
uauuaauugaaau

SEQ ID NO: 2088679 - RNA, 23 nt, Staphylococcus aureus subsp. aureus MW2
uauuaauugaaaugauaaaaauc

SEQ ID NO: 2088680 - RNA, 11 nt, Staphylococcus aureus subsp. aureus MW2
uauuaauuuaa

SEQ ID NO: 2088681 - RNA, 12 nt, Staphylococcus aureus subsp. aureus MW2
uauuaauuuaaa

SEQ ID NO: 2088682 - RNA, 21 nt, Staphylococcus aureus subsp. aureus MW2
uauuaauuauuugauagaaau

SEQ ID NO: 2088683 - RNA, 17 nt, Staphylococcus aureus subsp. aureus MW2
uauuacuaaccuauuaa

SEQ ID NO: 2088684 - RNA, 15 nt, Staphylococcus aureus subsp. aureus MW2
uauuacuauaaaaaa

SEQ ID NO: 2088685 - RNA, 22 nt, Staphylococcus aureus subsp. aureus MW2
uauuaccuuugcuaaauauuau

SEQ ID NO: 2088686 - RNA, 13 nt, Staphylococcus aureus subsp. aureus MW2
uauuacauaauuu

SEQ ID NO: 2088687 - RNA, 13 nt, Staphylococcus aureus subsp. aureus MW2
uauuaacuuuaau

SEQ ID NO: 2088688 - RNA, 19 nt, Staphylococcus aureus subsp. aureus MW2
uauuaacuuuaauauaagu

SEQ ID NO: 2088689 - RNA, 24 nt, Staphylococcus aureus subsp. aureus MW2
uauuaaggggguaauacuauauga

SEQ ID NO: 2088690 - RNA, 16 nt, Staphylococcus aureus subsp. aureus MW2
uauuaaguauaucuuu

SEQ ID NO: 2088691 - RNA, 12 nt, Staphylococcus aureus subsp. aureus MW2
uauuaauaaagu

SEQ ID NO: 2088692 - RNA, 17 nt, Staphylococcus aureus subsp. aureus MW2
uauuaaucaaauauuuu

SEQ ID NO: 2088693 - RNA, 16 nt, Staphylococcus aureus subsp. aureus MW2
uauuaauauugagacu

SEQ ID NO: 2088694 - RNA, 15 nt, Staphylococcus aureus subsp. aureus MW2
uauuaauauuugauu

SEQ ID NO: 2088695 - RNA, 14 nt, Staphylococcus aureus subsp. aureus MW2
uauuaauauuuuuu

SEQ ID NO: 2088696 - RNA, 22 nt, Staphylococcus aureus subsp. aureus MW2
uauuaauauuuuuugauauuug

SEQ ID NO: 2088697 - RNA, 15 nt, Staphylococcus aureus subsp. aureus MW2
uauuaauagcaccau

SEQ ID NO: 2088698 - RNA, 18 nt, Staphylococcus aureus subsp. aureus MW2
uauuaaacauuuuugauu

SEQ ID NO: 2088699 - RNA, 22 nt, Staphylococcus aureus subsp. aureus MW2
uauuaaacauuuuugauuuuaa

SEQ ID NO: 2088700 - RNA, 19 nt, Staphylococcus aureus subsp. aureus MW2
uauuaaaauuaaauaauga

SEQ ID NO: 2088701 - RNA, 18 nt, Staphylococcus aureus subsp. aureus MW2
uauuaaacgcaauuaacc

SEQ ID NO: 2088702 - RNA, 16 nt, Staphylococcus aureus subsp. aureus MW2
uauuaaauuuacaaaa

SEQ ID NO: 2088703 - RNA, 21 nt, Staphylococcus aureus subsp. aureus MW2
uauuaaauuuacaaaaacuau

SEQ ID NO: 2088704 - RNA, 18 nt, Staphylococcus aureus subsp. aureus MW2
uauuaaaucguauauuaa

SEQ ID NO: 2088705 - RNA, 12 nt, Staphylococcus aureus subsp. aureus MW2
uauuaaaggaaa

SEQ ID NO: 2088706 - RNA, 19 nt, Staphylococcus aureus subsp. aureus MW2
uauuaacaaaagugaaugu

SEQ ID NO: 2088707 - RNA, 12 nt, Staphylococcus aureus subsp. aureus MW2
uauuaaccaaca

SEQ ID NO: 2088708 - RNA, 14 nt, Staphylococcus aureus subsp. aureus MW2
uauuauauauauuc

SEQ ID NO: 2088709 - RNA, 17 nt, Staphylococcus aureus subsp. aureus MW2
uauuauauugaauugaa

SEQ ID NO: 2088710 - RNA, 17 nt, Staphylococcus aureus subsp. aureus MW2
uauuauauggcuuuacu

SEQ ID NO: 2088711 - RNA, 19 nt, Staphylococcus aureus subsp. aureus MW2
uauuaucaaagaaauguau

SEQ ID NO: 2088712 - RNA, 16 nt, Staphylococcus aureus subsp. aureus MW2
uauuaugaauuauuaa

SEQ ID NO: 2088713 - RNA, 22 nt, Staphylococcus aureus subsp. aureus MW2
uauuaugauugcuuauuuauuu

SEQ ID NO: 2088714 - RNA, 21 nt, Staphylococcus aureus subsp. aureus MW2
uauuaugaacaugaaauuaau

SEQ ID NO: 2088715 - RNA, 20 nt, Staphylococcus aureus subsp. aureus MW2
uauuaucuauccauuugguu

SEQ ID NO: 2088716 - RNA, 16 nt, Staphylococcus aureus subsp. aureus MW2
uauuaugcugaaacua

SEQ ID NO: 2088717 - RNA, 15 nt, Staphylococcus aureus subsp. aureus MW2
uauuauguuauaaau

SEQ ID NO: 2088718 - RNA, 18 nt, Staphylococcus aureus subsp. aureus MW2
uauuauuauaauuuuguu

SEQ ID NO: 2088719 - RNA, 16 nt, Staphylococcus aureus subsp. aureus MW2
uauuauguguauauua

SEQ ID NO: 2088720 - RNA, 18 nt, Staphylococcus aureus subsp. aureus MW2
uauuauuaccauaaauuu

SEQ ID NO: 2088721 - RNA, 18 nt, Staphylococcus aureus subsp. aureus MW2
uauuauucauaauauauu

SEQ ID NO: 2088722 - RNA, 15 nt, Staphylococcus aureus subsp. aureus MW2
uauuauuauguuaua

SEQ ID NO: 2088723 - RNA, 17 nt, Staphylococcus aureus subsp. aureus MW2
uauuauucauaauauau

SEQ ID NO: 2088724 - RNA, 19 nt, Staphylococcus aureus subsp. aureus MW2
uauuauuauaauuuuguuu

SEQ ID NO: 2088725 - RNA, 14 nt, Staphylococcus aureus subsp. aureus MW2
uauuauuaugugua

SEQ ID NO: 2088726 - RNA, 14 nt, Staphylococcus aureus subsp. aureus MW2
uauuauuauguuaa

SEQ ID NO: 2088727 - RNA, 22 nt, Staphylococcus aureus subsp. aureus MW2
uauuauugaaaucgauacuaau

SEQ ID NO: 2088728 - RNA, 12 nt, Staphylococcus aureus subsp. aureus MW2
uauuauugaaau

SEQ ID NO: 2088729 - RNA, 14 nt, Staphylococcus aureus subsp. aureus MW2
uauuauugcuguga

SEQ ID NO: 2088730 - RNA, 23 nt, Staphylococcus aureus subsp. aureus MW2
uauuaggccaacguuuugaccaa

SEQ ID NO: 2088731 - RNA, 14 nt, Staphylococcus aureus subsp. aureus MW2
uauuagauauauuu

SEQ ID NO: 2088732 - RNA, 17 nt, Staphylococcus aureus subsp. aureus MW2
uauuagaucacuauuuu

SEQ ID NO: 2088733 - RNA, 17 nt, Staphylococcus aureus subsp. aureus MW2
uauuauaauagagaaac

SEQ ID NO: 2088734 - RNA, 18 nt, Staphylococcus aureus subsp. aureus MW2
uauuauaauaaauagacu

SEQ ID NO: 2088735 - RNA, 15 nt, Staphylococcus aureus subsp. aureus MW2
uauuauaauuuuguu

SEQ ID NO: 2088736 - RNA, 19 nt, Staphylococcus aureus subsp. aureus MW2
uauuauaauuguucauugg

SEQ ID NO: 2088737 - RNA, 11 nt, Staphylococcus aureus subsp. aureus MW2
uauuauagaac

SEQ ID NO: 2088738 - RNA, 12 nt, Staphylococcus aureus subsp. aureus MW2
uauuauaaaaua

SEQ ID NO: 2088739 - RNA, 13 nt, Staphylococcus aureus subsp. aureus MW2
uauuauaaaaaua

SEQ ID NO: 2088740 - RNA, 14 nt, Staphylococcus aureus subsp. aureus MW2
uauuauaaaaauag

SEQ ID NO: 2088741 - RNA, 22 nt, Staphylococcus aureus subsp. aureus MW2
uauuaggugaaaccauacuaau

SEQ ID NO: 2088742 - RNA, 14 nt, Staphylococcus aureus subsp. aureus MW2
uauuuaucuuuaga

SEQ ID NO: 2088743 - RNA, 18 nt, Staphylococcus aureus subsp. aureus MW2
uauuuaucucuuucuuca

SEQ ID NO: 2088744 - RNA, 21 nt, Staphylococcus aureus subsp. aureus MW2
uauuuauguucgauuauucuu

SEQ ID NO: 2088745 - RNA, 20 nt, Staphylococcus aureus subsp. aureus MW2
uauuuaugauaauuaauuaa

SEQ ID NO: 2088746 - RNA, 22 nt, Staphylococcus aureus subsp. aureus MW2
uauuuaugauaauuaauuaaaa

SEQ ID NO: 2088747 - RNA, 12 nt, Staphylococcus aureus subsp. aureus MW2
uauuuaucuuua

SEQ ID NO: 2088748 - RNA, 11 nt, Staphylococcus aureus subsp. aureus MW2
uauuuauucag

SEQ ID NO: 2088749 - RNA, 17 nt, Staphylococcus aureus subsp. aureus MW2
uauuuauacuauaaaua

SEQ ID NO: 2088750 - RNA, 12 nt, Staphylococcus aureus subsp. aureus MW2
uauuuauaauuu

SEQ ID NO: 2088751 - RNA, 18 nt, Staphylococcus aureus subsp. aureus MW2
uauuuauaacuuuaaaaa

SEQ ID NO: 2088752 - RNA, 18 nt, Staphylococcus aureus subsp. aureus MW2
uauuuauaaaauaaaaug

SEQ ID NO: 2088753 - RNA, 14 nt, Staphylococcus aureus subsp. aureus MW2
uauuuauauuaaau

SEQ ID NO: 2088754 - RNA, 15 nt, Staphylococcus aureus subsp. aureus MW2
uauuuaucauacuuc

SEQ ID NO: 2088755 - RNA, 16 nt, Staphylococcus aureus subsp. aureus MW2
uauuuauacuaaauug

SEQ ID NO: 2088756 - RNA, 14 nt, Staphylococcus aureus subsp. aureus MW2
uauuucaauaauaa

SEQ ID NO: 2088757 - RNA, 20 nt, Staphylococcus aureus subsp. aureus MW2
uauuucacacagcuucauua

SEQ ID NO: 2088758 - RNA, 18 nt, Staphylococcus aureus subsp. aureus MW2
uauuuauugcgauagaaa

SEQ ID NO: 2088759 - RNA, 14 nt, Staphylococcus aureus subsp. aureus MW2
uauuuauuuuaaau

SEQ ID NO: 2088760 - RNA, 16 nt, Staphylococcus aureus subsp. aureus MW2
uauuucuaaauuauuu

SEQ ID NO: 2088761 - RNA, 22 nt, Staphylococcus aureus subsp. aureus MW2
uauuucugaaaacuuaauagaa

SEQ ID NO: 2088762 - RNA, 13 nt, Staphylococcus aureus subsp. aureus MW2
uauuucuaaauua

SEQ ID NO: 2088763 - RNA, 16 nt, Staphylococcus aureus subsp. aureus MW2
uauuuccguuuuagaa

SEQ ID NO: 2088764 - RNA, 21 nt, Staphylococcus aureus subsp. aureus MW2
uauuucgccuuuuuuauuuuu

SEQ ID NO: 2088765 - RNA, 16 nt, Staphylococcus aureus subsp. aureus MW2
uauuucccuaugaaau

SEQ ID NO: 2088766 - RNA, 15 nt, Staphylococcus aureus subsp. aureus MW2
uauuucauauuuaau

SEQ ID NO: 2088767 - RNA, 14 nt, Staphylococcus aureus subsp. aureus MW2
uauuucauuugacu

SEQ ID NO: 2088768 - RNA, 21 nt, Staphylococcus aureus subsp. aureus MW2
uauuucacucuacaauccuau

SEQ ID NO: 2088769 - RNA, 14 nt, Staphylococcus aureus subsp. aureus MW2
uauuucagcuuauu

SEQ ID NO: 2088770 - RNA, 23 nt, Staphylococcus aureus subsp. aureus MW2
uauuuuaaacguaucauuuaaaa

SEQ ID NO: 2088771 - RNA, 13 nt, Staphylococcus aureus subsp. aureus MW2
uauuuuaaacaug

SEQ ID NO: 2088772 - RNA, 21 nt, Staphylococcus aureus subsp. aureus MW2
uauuuuaaaccguuauauauu

SEQ ID NO: 2088773 - RNA, 12 nt, Staphylococcus aureus subsp. aureus MW2
uauuuuaaacau

SEQ ID NO: 2088774 - RNA, 17 nt, Staphylococcus aureus subsp. aureus MW2
uauuuguuguuauauaa

SEQ ID NO: 2088775 - RNA, 15 nt, Staphylococcus aureus subsp. aureus MW2
uauuuguaauuucag

SEQ ID NO: 2088776 - RNA, 22 nt, Staphylococcus aureus subsp. aureus MW2
uauuuguguuuuuauuaaucug

SEQ ID NO: 2088777 - RNA, 14 nt, Staphylococcus aureus subsp. aureus MW2
uauuuuauuauaau

SEQ ID NO: 2088778 - RNA, 20 nt, Staphylococcus aureus subsp. aureus MW2
uauuuuauaagaauuuaaaa

SEQ ID NO: 2088779 - RNA, 14 nt, Staphylococcus aureus subsp. aureus MW2
uauuuuauaagaau

SEQ ID NO: 2088780 - RNA, 22 nt, Staphylococcus aureus subsp. aureus MW2
uauuuuagcucuuguucaagua

SEQ ID NO: 2088781 - RNA, 16 nt, Staphylococcus aureus subsp. aureus MW2
uauuuuaguacuuaau

SEQ ID NO: 2088782 - RNA, 18 nt, Staphylococcus aureus subsp. aureus MW2
uauuuuaauauugaaaug

SEQ ID NO: 2088783 - RNA, 22 nt, Staphylococcus aureus subsp. aureus MW2
uauuuuaaugggcgauaaaagu

SEQ ID NO: 2088784 - RNA, 13 nt, Staphylococcus aureus subsp. aureus MW2
uauuuuaauauuu

SEQ ID NO: 2088785 - RNA, 18 nt, Staphylococcus aureus subsp. aureus MW2
uauuuuaaauuuuuuaau

SEQ ID NO: 2088786 - RNA, 18 nt, Staphylococcus aureus subsp. aureus MW2
uauuuuacgcuuuuucuu

SEQ ID NO: 2088787 - RNA, 14 nt, Staphylococcus aureus subsp. aureus MW2
uauuugcccgacuu

SEQ ID NO: 2088788 - RNA, 18 nt, Staphylococcus aureus subsp. aureus MW2
uauuugauuauucuucau

SEQ ID NO: 2088789 - RNA, 20 nt, Staphylococcus aureus subsp. aureus MW2
uauuugauccauauauguaa

SEQ ID NO: 2088790 - RNA, 16 nt, Staphylococcus aureus subsp. aureus MW2
uauuugauuauguaaa

SEQ ID NO: 2088791 - RNA, 16 nt, Staphylococcus aureus subsp. aureus MW2
uauuugauuauucgua

SEQ ID NO: 2088792 - RNA, 22 nt, Staphylococcus aureus subsp. aureus MW2
uauuugaaagcauuuaaauaua

SEQ ID NO: 2088793 - RNA, 21 nt, Staphylococcus aureus subsp. aureus MW2
uauuucuuuuugucauuaauc

SEQ ID NO: 2088794 - RNA, 16 nt, Staphylococcus aureus subsp. aureus MW2
uauuugaaugcaaauc

SEQ ID NO: 2088795 - RNA, 20 nt, Staphylococcus aureus subsp. aureus MW2
uauuugaaguauuuuccuuc

SEQ ID NO: 2088796 - RNA, 22 nt, Staphylococcus aureus subsp. aureus MW2
uauuugaaugcaaaucaaauac

SEQ ID NO: 2088797 - RNA, 22 nt, Staphylococcus aureus subsp. aureus MW2
uauuucugaaaugauacauuau

SEQ ID NO: 2088798 - RNA, 18 nt, Staphylococcus aureus subsp. aureus MW2
uauuucuuucgaaaacag

SEQ ID NO: 2088799 - RNA, 21 nt, Staphylococcus aureus subsp. aureus MW2
uauuuagcaucuuuaccauau

SEQ ID NO: 2088800 - RNA, 17 nt, Staphylococcus aureus subsp. aureus MW2
uauuuaggaguauccug

SEQ ID NO: 2088801 - RNA, 16 nt, Staphylococcus aureus subsp. aureus MW2
uauuuaccuucuucua

SEQ ID NO: 2088802 - RNA, 20 nt, Staphylococcus aureus subsp. aureus MW2
uauuuaaugugcauauugag

SEQ ID NO: 2088803 - RNA, 16 nt, Staphylococcus aureus subsp. aureus MW2
uauuuaauuuugauau

SEQ ID NO: 2088804 - RNA, 16 nt, Staphylococcus aureus subsp. aureus MW2
uauuuaauuauuccuu

SEQ ID NO: 2088805 - RNA, 14 nt, Staphylococcus aureus subsp. aureus MW2
uauuuaauuuuaau

SEQ ID NO: 2088806 - RNA, 22 nt, Staphylococcus aureus subsp. aureus MW2
uauuuacauugccacuuuugug

SEQ ID NO: 2088807 - RNA, 18 nt, Staphylococcus aureus subsp. aureus MW2
uauuuaccgucuuaugau

SEQ ID NO: 2088808 - RNA, 14 nt, Staphylococcus aureus subsp. aureus MW2
uauuguauuuuaau

SEQ ID NO: 2088809 - RNA, 15 nt, Staphylococcus aureus subsp. aureus MW2
uauugucaucauguu

SEQ ID NO: 2088810 - RNA, 13 nt, Staphylococcus aureus subsp. aureus MW2
uauugucaucaug

SEQ ID NO: 2088811 - RNA, 18 nt, Staphylococcus aureus subsp. aureus MW2
uauuguauuuuauuuauu

SEQ ID NO: 2088812 - RNA, 23 nt, Staphylococcus aureus subsp. aureus MW2
uauugucaaaccccguaggcaua

SEQ ID NO: 2088813 - RNA, 22 nt, Staphylococcus aureus subsp. aureus MW2
uauugugguaaagggggcucuc

SEQ ID NO: 2088814 - RNA, 16 nt, Staphylococcus aureus subsp. aureus MW2
uauuuaaauuggaauc

SEQ ID NO: 2088815 - RNA, 18 nt, Staphylococcus aureus subsp. aureus MW2
uauuuaacgaaaauuaag

SEQ ID NO: 2088816 - RNA, 21 nt, Staphylococcus aureus subsp. aureus MW2
uauuuaaacucucuaaaaagc

SEQ ID NO: 2088817 - RNA, 14 nt, Staphylococcus aureus subsp. aureus MW2
uauuuaaaugcuuu

SEQ ID NO: 2088818 - RNA, 18 nt, Staphylococcus aureus subsp. aureus MW2
uauuuaaaucaauauucu

SEQ ID NO: 2088819 - RNA, 18 nt, Staphylococcus aureus subsp. aureus MW2
uauuuaaaacuuguaaau

SEQ ID NO: 2088820 - RNA, 14 nt, Staphylococcus aureus subsp. aureus MW2
uauuuaaaaaacaa

SEQ ID NO: 2088821 - RNA, 22 nt, Staphylococcus aureus subsp. aureus MW2
uauuggaauacucuuuaaucua

SEQ ID NO: 2088822 - RNA, 16 nt, Staphylococcus aureus subsp. aureus MW2
uauuggucauuacuaa

SEQ ID NO: 2088823 - RNA, 16 nt, Staphylococcus aureus subsp. aureus MW2
uauuggguaauauuag

SEQ ID NO: 2088824 - RNA, 18 nt, Staphylococcus aureus subsp. aureus MW2
uauuggucauuacuaaaa

SEQ ID NO: 2088825 - RNA, 13 nt, Staphylococcus aureus subsp. aureus MW2
uauugguugaaau

SEQ ID NO: 2088826 - RNA, 17 nt, Staphylococcus aureus subsp. aureus MW2
uauugguugaaauuaau

SEQ ID NO: 2088827 - RNA, 24 nt, Staphylococcus aureus subsp. aureus MW2
uauugccuaacguguuugagauau

SEQ ID NO: 2088828 - RNA, 17 nt, Staphylococcus aureus subsp. aureus MW2
uauugcauuguauaugu

SEQ ID NO: 2088829 - RNA, 21 nt, Staphylococcus aureus subsp. aureus MW2
uauugauuugauucauuacau

SEQ ID NO: 2088830 - RNA, 14 nt, Staphylococcus aureus subsp. aureus MW2
uauugcaaaaauaa

SEQ ID NO: 2088831 - RNA, 15 nt, Staphylococcus aureus subsp. aureus MW2
uauugcaaaaauaau

SEQ ID NO: 2088832 - RNA, 23 nt, Staphylococcus aureus subsp. aureus MW2
uauugcaaaaauaauaugaauuu

SEQ ID NO: 2088833 - RNA, 22 nt, Staphylococcus aureus subsp. aureus MW2
uauugauucuagugaaauaccu

SEQ ID NO: 2088834 - RNA, 19 nt, Staphylococcus aureus subsp. aureus MW2
uauugauauucuaaaaaau

SEQ ID NO: 2088835 - RNA, 23 nt, Staphylococcus aureus subsp. aureus MW2
uauugaucugauuucacuucuaa

SEQ ID NO: 2088836 - RNA, 13 nt, Staphylococcus aureus subsp. aureus MW2
uauugauauucua

SEQ ID NO: 2088837 - RNA, 14 nt, Staphylococcus aureus subsp. aureus MW2
uauugauauucuaa

SEQ ID NO: 2088838 - RNA, 15 nt, Staphylococcus aureus subsp. aureus MW2
uauugauauucuaaa

SEQ ID NO: 2088839 - RNA, 13 nt, Staphylococcus aureus subsp. aureus MW2
uauugauauuaau

SEQ ID NO: 2088840 - RNA, 15 nt, Staphylococcus aureus subsp. aureus MW2
uauugauauuaauau

SEQ ID NO: 2088841 - RNA, 14 nt, Staphylococcus aureus subsp. aureus MW2
uauugagaauauuu

SEQ ID NO: 2088842 - RNA, 18 nt, Staphylococcus aureus subsp. aureus MW2
uauugacccccuguaucu

SEQ ID NO: 2088843 - RNA, 13 nt, Staphylococcus aureus subsp. aureus MW2
ucaagaauauaaa

SEQ ID NO: 2088844 - RNA, 19 nt, Staphylococcus aureus subsp. aureus MW2
ucaagaaugugaacaucua

SEQ ID NO: 2088845 - RNA, 20 nt, Staphylococcus aureus subsp. aureus MW2
ucaagacucccuuuuuaaaa

SEQ ID NO: 2088846 - RNA, 22 nt, Staphylococcus aureus subsp. aureus MW2
ucaagacucccuuuuuaaaaua

SEQ ID NO: 2088847 - RNA, 15 nt, Staphylococcus aureus subsp. aureus MW2
ucaagaacuuuaaaa

SEQ ID NO: 2088848 - RNA, 16 nt, Staphylococcus aureus subsp. aureus MW2
ucaacuuuuuuaacuu

SEQ ID NO: 2088849 - RNA, 18 nt, Staphylococcus aureus subsp. aureus MW2
ucaacuuuuuuaacuuua

SEQ ID NO: 2088850 - RNA, 17 nt, Staphylococcus aureus subsp. aureus MW2
ucaacuuuuuaauaaua

SEQ ID NO: 2088851 - RNA, 16 nt, Staphylococcus aureus subsp. aureus MW2
ucaacuuuuuaauaau

SEQ ID NO: 2088852 - RNA, 17 nt, Staphylococcus aureus subsp. aureus MW2
ucaacuuuaaucaaaaa

SEQ ID NO: 2088853 - RNA, 19 nt, Staphylococcus aureus subsp. aureus MW2
ucaacuuuaaucaaaaaga

SEQ ID NO: 2088854 - RNA, 20 nt, Staphylococcus aureus subsp. aureus MW2
ucaacuuucucuaaagguac

SEQ ID NO: 2088855 - RNA, 16 nt, Staphylococcus aureus subsp. aureus MW2
ucaacuuuaguuguua

SEQ ID NO: 2088856 - RNA, 15 nt, Staphylococcus aureus subsp. aureus MW2
ucaacuuuaguuguu

SEQ ID NO: 2088857 - RNA, 17 nt, Staphylococcus aureus subsp. aureus MW2
ucaacuuauuauuuauc

SEQ ID NO: 2088858 - RNA, 19 nt, Staphylococcus aureus subsp. aureus MW2
ucaagauauccauuaugau

SEQ ID NO: 2088859 - RNA, 23 nt, Staphylococcus aureus subsp. aureus MW2
ucaagauguuugcaacauauuuu

SEQ ID NO: 2088860 - RNA, 18 nt, Staphylococcus aureus subsp. aureus MW2
ucaagcaucauuuuucgu

SEQ ID NO: 2088861 - RNA, 15 nt, Staphylococcus aureus subsp. aureus MW2
ucaacgccauauuua

SEQ ID NO: 2088862 - RNA, 23 nt, Staphylococcus aureus subsp. aureus MW2
ucaaccuguucuuuauuuaaagg

SEQ ID NO: 2088863 - RNA, 21 nt, Staphylococcus aureus subsp. aureus MW2
ucaaccuguucuuuauuuaaa

SEQ ID NO: 2088864 - RNA, 17 nt, Staphylococcus aureus subsp. aureus MW2
ucaaccuguucuuuauu

SEQ ID NO: 2088865 - RNA, 22 nt, Staphylococcus aureus subsp. aureus MW2
ucaaccuuugcuaaaucaagac

SEQ ID NO: 2088866 - RNA, 14 nt, Staphylococcus aureus subsp. aureus MW2
ucaacuaauuuaaa

SEQ ID NO: 2088867 - RNA, 21 nt, Staphylococcus aureus subsp. aureus MW2
ucaacuaauuuaaagcaucau

SEQ ID NO: 2088868 - RNA, 17 nt, Staphylococcus aureus subsp. aureus MW2
ucaacuaauaacucagu

SEQ ID NO: 2088869 - RNA, 19 nt, Staphylococcus aureus subsp. aureus MW2
ucaacguauauaaguuaaa

SEQ ID NO: 2088870 - RNA, 13 nt, Staphylococcus aureus subsp. aureus MW2
ucaacuacuucau

SEQ ID NO: 2088871 - RNA, 17 nt, Staphylococcus aureus subsp. aureus MW2
ucaacugcuucacgauu

SEQ ID NO: 2088872 - RNA, 22 nt, Staphylococcus aureus subsp. aureus MW2
ucaaaugacauuuuaaaucuaa

SEQ ID NO: 2088873 - RNA, 20 nt, Staphylococcus aureus subsp. aureus MW2
ucaaauuaauuaaaccaaua

SEQ ID NO: 2088874 - RNA, 21 nt, Staphylococcus aureus subsp. aureus MW2
ucaaauguaacauuaaaaaua

SEQ ID NO: 2088875 - RNA, 19 nt, Staphylococcus aureus subsp. aureus MW2
ucaaaugguacaguuaauu

SEQ ID NO: 2088876 - RNA, 17 nt, Staphylococcus aureus subsp. aureus MW2
ucaaauguaacauuaaa

SEQ ID NO: 2088877 - RNA, 13 nt, Staphylococcus aureus subsp. aureus MW2
ucaaauauaucua

SEQ ID NO: 2088878 - RNA, 17 nt, Staphylococcus aureus subsp. aureus MW2
ucaaauauuaauuuaua

SEQ ID NO: 2088879 - RNA, 19 nt, Staphylococcus aureus subsp. aureus MW2
ucaaauuggacuuaugggu

SEQ ID NO: 2088880 - RNA, 16 nt, Staphylococcus aureus subsp. aureus MW2
ucaaauugaacuucuu

SEQ ID NO: 2088881 - RNA, 21 nt, Staphylococcus aureus subsp. aureus MW2
ucaaauugcguuguuucauua

SEQ ID NO: 2088882 - RNA, 19 nt, Staphylococcus aureus subsp. aureus MW2
ucaaauucucaauuaauuu

SEQ ID NO: 2088883 - RNA, 19 nt, Staphylococcus aureus subsp. aureus MW2
ucaaauucgacucaaacaa

SEQ ID NO: 2088884 - RNA, 16 nt, Staphylococcus aureus subsp. aureus MW2
ucaaauuacuuauuca

SEQ ID NO: 2088885 - RNA, 13 nt, Staphylococcus aureus subsp. aureus MW2
ucaaauuagauaa

SEQ ID NO: 2088886 - RNA, 15 nt, Staphylococcus aureus subsp. aureus MW2
ucaaauuagauaaaa

SEQ ID NO: 2088887 - RNA, 21 nt, Staphylococcus aureus subsp. aureus MW2
ucaaauuagauaaaacaaaac

SEQ ID NO: 2088888 - RNA, 18 nt, Staphylococcus aureus subsp. aureus MW2
ucaaauuauaauuguaau

SEQ ID NO: 2088889 - RNA, 21 nt, Staphylococcus aureus subsp. aureus MW2
ucaaauuauaauuguaaugcu

SEQ ID NO: 2088890 - RNA, 20 nt, Staphylococcus aureus subsp. aureus MW2
ucaaauucaacgucaucaaa

SEQ ID NO: 2088891 - RNA, 13 nt, Staphylococcus aureus subsp. aureus MW2
ucaaauuuuucga

SEQ ID NO: 2088892 - RNA, 18 nt, Staphylococcus aureus subsp. aureus MW2
ucaacaaauuuaacuuuc

SEQ ID NO: 2088893 - RNA, 18 nt, Staphylococcus aureus subsp. aureus MW2
ucaacaacgacuuucacu

SEQ ID NO: 2088894 - RNA, 19 nt, Staphylococcus aureus subsp. aureus MW2
ucaacaacgacuuucacua

SEQ ID NO: 2088895 - RNA, 18 nt, Staphylococcus aureus subsp. aureus MW2
ucaacaacugcgacaugu

SEQ ID NO: 2088896 - RNA, 18 nt, Staphylococcus aureus subsp. aureus MW2
ucaacagggguaaaacuu

SEQ ID NO: 2088897 - RNA, 15 nt, Staphylococcus aureus subsp. aureus MW2
ucaacaauuucaaug

SEQ ID NO: 2088898 - RNA, 22 nt, Staphylococcus aureus subsp. aureus MW2
ucaacacacacaguuuauaaua

SEQ ID NO: 2088899 - RNA, 20 nt, Staphylococcus aureus subsp. aureus MW2
ucaacacgacguucuucaau

SEQ ID NO: 2088900 - RNA, 22 nt, Staphylococcus aureus subsp. aureus MW2
ucaacacgacguucuucaauua

SEQ ID NO: 2088901 - RNA, 16 nt, Staphylococcus aureus subsp. aureus MW2
ucaacacgauagucau

SEQ ID NO: 2088902 - RNA, 17 nt, Staphylococcus aureus subsp. aureus MW2
ucaacccaucauguaca

SEQ ID NO: 2088903 - RNA, 18 nt, Staphylococcus aureus subsp. aureus MW2
ucaacauuaauaaauaau

SEQ ID NO: 2088904 - RNA, 18 nt, Staphylococcus aureus subsp. aureus MW2
ucaacauuacuaauugau

SEQ ID NO: 2088905 - RNA, 17 nt, Staphylococcus aureus subsp. aureus MW2
ucaacaucaucuuuaau

SEQ ID NO: 2088906 - RNA, 20 nt, Staphylococcus aureus subsp. aureus MW2
ucaacauguuccgcuacaaa

SEQ ID NO: 2088907 - RNA, 16 nt, Staphylococcus aureus subsp. aureus MW2
ucaacaguuuuaaaga

SEQ ID NO: 2088908 - RNA, 14 nt, Staphylococcus aureus subsp. aureus MW2
ucaacaguuucuug

SEQ ID NO: 2088909 - RNA, 13 nt, Staphylococcus aureus subsp. aureus MW2
ucaacaucaucuu

SEQ ID NO: 2088910 - RNA, 16 nt, Staphylococcus aureus subsp. aureus MW2
ucaacaucaugaacuu

SEQ ID NO: 2088911 - RNA, 21 nt, Staphylococcus aureus subsp. aureus MW2
ucaaaguaucuuuugcaccuu

SEQ ID NO: 2088912 - RNA, 21 nt, Staphylococcus aureus subsp. aureus MW2
ucaaagucucuaguaucugau

SEQ ID NO: 2088913 - RNA, 17 nt, Staphylococcus aureus subsp. aureus MW2
ucaaaguagacauugaa

SEQ ID NO: 2088914 - RNA, 14 nt, Staphylococcus aureus subsp. aureus MW2
ucaaaguagacauu

SEQ ID NO: 2088915 - RNA, 16 nt, Staphylococcus aureus subsp. aureus MW2
ucaaaguagacauuga

SEQ ID NO: 2088916 - RNA, 22 nt, Staphylococcus aureus subsp. aureus MW2
ucaaagguuuacuauuaaagga

SEQ ID NO: 2088917 - RNA, 20 nt, Staphylococcus aureus subsp. aureus MW2
ucaaagcugucaacuugucu

SEQ ID NO: 2088918 - RNA, 16 nt, Staphylococcus aureus subsp. aureus MW2
ucaaauaauauaaaac

SEQ ID NO: 2088919 - RNA, 14 nt, Staphylococcus aureus subsp. aureus MW2
ucaaauaaugaaua

SEQ ID NO: 2088920 - RNA, 17 nt, Staphylococcus aureus subsp. aureus MW2
ucaaauacauuucaaaa

SEQ ID NO: 2088921 - RNA, 21 nt, Staphylococcus aureus subsp. aureus MW2
ucaaaguuuucaggaauuguu

SEQ ID NO: 2088922 - RNA, 21 nt, Staphylococcus aureus subsp. aureus MW2
ucaaacuuaaaacuauaaccu

SEQ ID NO: 2088923 - RNA, 14 nt, Staphylococcus aureus subsp. aureus MW2
ucaaacuuaucgcc

SEQ ID NO: 2088924 - RNA, 15 nt, Staphylococcus aureus subsp. aureus MW2
ucaaacuuaaaacua

SEQ ID NO: 2088925 - RNA, 16 nt, Staphylococcus aureus subsp. aureus MW2
ucaaacuuaaaacuau

SEQ ID NO: 2088926 - RNA, 14 nt, Staphylococcus aureus subsp. aureus MW2
ucaaacuuaaaacu

SEQ ID NO: 2088927 - RNA, 15 nt, Staphylococcus aureus subsp. aureus MW2
ucaaacuuuucaaua

SEQ ID NO: 2088928 - RNA, 17 nt, Staphylococcus aureus subsp. aureus MW2
ucaaagaguaaaguuaa

SEQ ID NO: 2088929 - RNA, 21 nt, Staphylococcus aureus subsp. aureus MW2
ucaaacggcacuaauauuuaa

SEQ ID NO: 2088930 - RNA, 22 nt, Staphylococcus aureus subsp. aureus MW2
ucaaacggcacuaauauuuaaa

SEQ ID NO: 2088931 - RNA, 23 nt, Staphylococcus aureus subsp. aureus MW2
ucaaacgaaggucuacuaaauaa

SEQ ID NO: 2088932 - RNA, 18 nt, Staphylococcus aureus subsp. aureus MW2
ucaaacgauuuucaaaac

SEQ ID NO: 2088933 - RNA, 19 nt, Staphylococcus aureus subsp. aureus MW2
ucaaacaguccuuauuaua

SEQ ID NO: 2088934 - RNA, 11 nt, Staphylococcus aureus subsp. aureus MW2
ucaaacaacau

SEQ ID NO: 2088935 - RNA, 23 nt, Staphylococcus aureus subsp. aureus MW2
ucaaacaaaucuuuuaaauuuag

SEQ ID NO: 2088936 - RNA, 18 nt, Staphylococcus aureus subsp. aureus MW2
ucaaaauguuuaacaaua

SEQ ID NO: 2088937 - RNA, 13 nt, Staphylococcus aureus subsp. aureus MW2
ucaaaauguuuaa

SEQ ID NO: 2088938 - RNA, 21 nt, Staphylococcus aureus subsp. aureus MW2
ucaaaaugguuauauaaacaa

SEQ ID NO: 2088939 - RNA, 22 nt, Staphylococcus aureus subsp. aureus MW2
ucaaaaugccggucaaagcgaa

SEQ ID NO: 2088940 - RNA, 19 nt, Staphylococcus aureus subsp. aureus MW2
ucaaaaucggauuaacauu

SEQ ID NO: 2088941 - RNA, 17 nt, Staphylococcus aureus subsp. aureus MW2
ucaaaaucuuacauuga

SEQ ID NO: 2088942 - RNA, 19 nt, Staphylococcus aureus subsp. aureus MW2
uauuuucaauaaauuuuau

SEQ ID NO: 2088943 - RNA, 22 nt, Staphylococcus aureus subsp. aureus MW2
uauuuuauuuaaaaauagccuu

SEQ ID NO: 2088944 - RNA, 14 nt, Staphylococcus aureus subsp. aureus MW2
uauuuuauuuaaaa

SEQ ID NO: 2088945 - RNA, 21 nt, Staphylococcus aureus subsp. aureus MW2
uauuuucaauaaauuuuauau

SEQ ID NO: 2088946 - RNA, 18 nt, Staphylococcus aureus subsp. aureus MW2
uauuuucaauauuugaua

SEQ ID NO: 2088947 - RNA, 17 nt, Staphylococcus aureus subsp. aureus MW2
uauuuucaauuagaaaa

SEQ ID NO: 2088948 - RNA, 15 nt, Staphylococcus aureus subsp. aureus MW2
uauuuucauuuuagu

SEQ ID NO: 2088949 - RNA, 13 nt, Staphylococcus aureus subsp. aureus MW2
uauuuucauuuua

SEQ ID NO: 2088950 - RNA, 17 nt, Staphylococcus aureus subsp. aureus MW2
uauuuugcgcuucuagu

SEQ ID NO: 2088951 - RNA, 13 nt, Staphylococcus aureus subsp. aureus MW2
uauuuugcaauaa

SEQ ID NO: 2088952 - RNA, 21 nt, Staphylococcus aureus subsp. aureus MW2
uauuuugcuugcuuacaauaa

SEQ ID NO: 2088953 - RNA, 21 nt, Staphylococcus aureus subsp. aureus MW2
uauuuugggaauuguauuaau

SEQ ID NO: 2088954 - RNA, 21 nt, Staphylococcus aureus subsp. aureus MW2
uauuuucuuguguauuuuuau

SEQ ID NO: 2088955 - RNA, 18 nt, Staphylococcus aureus subsp. aureus MW2
uauuuucugccauaaaca

SEQ ID NO: 2088956 - RNA, 17 nt, Staphylococcus aureus subsp. aureus MW2
uauuuucugcuguaugg

SEQ ID NO: 2088957 - RNA, 13 nt, Staphylococcus aureus subsp. aureus MW2
uauuuuuuaaaau

SEQ ID NO: 2088958 - RNA, 15 nt, Staphylococcus aureus subsp. aureus MW2
uauuuuuuaaaauga

SEQ ID NO: 2088959 - RNA, 21 nt, Staphylococcus aureus subsp. aureus MW2
uauuuuuuaaaaugauagcua

SEQ ID NO: 2088960 - RNA, 19 nt, Staphylococcus aureus subsp. aureus MW2
uauuuuuugagcacuuaau

SEQ ID NO: 2088961 - RNA, 15 nt, Staphylococcus aureus subsp. aureus MW2
uauuuuuuauggucu

SEQ ID NO: 2088962 - RNA, 20 nt, Staphylococcus aureus subsp. aureus MW2
uauuuuuugauauuugaucc

SEQ ID NO: 2088963 - RNA, 13 nt, Staphylococcus aureus subsp. aureus MW2
uauuuuuucucua

SEQ ID NO: 2088964 - RNA, 23 nt, Staphylococcus aureus subsp. aureus MW2
uauuuuuuauguuuuaauuucuu

SEQ ID NO: 2088965 - RNA, 19 nt, Staphylococcus aureus subsp. aureus MW2
uauuuuguuuuaaaaaaca

SEQ ID NO: 2088966 - RNA, 16 nt, Staphylococcus aureus subsp. aureus MW2
uauuuuuaagcugcuc

SEQ ID NO: 2088967 - RNA, 14 nt, Staphylococcus aureus subsp. aureus MW2
uauuuuuacauauu

SEQ ID NO: 2088968 - RNA, 13 nt, Staphylococcus aureus subsp. aureus MW2
uauuuuuauagau

SEQ ID NO: 2088969 - RNA, 14 nt, Staphylococcus aureus subsp. aureus MW2
ucaaaacaauuuaa

SEQ ID NO: 2088970 - RNA, 17 nt, Staphylococcus aureus subsp. aureus MW2
ucaaaaccgcuauaaaa

SEQ ID NO: 2088971 - RNA, 12 nt, Staphylococcus aureus subsp. aureus MW2
ucaaaaauuguu

SEQ ID NO: 2088972 - RNA, 18 nt, Staphylococcus aureus subsp. aureus MW2
ucaaaaauuguuaauaca

SEQ ID NO: 2088973 - RNA, 16 nt, Staphylococcus aureus subsp. aureus MW2
ucaaaacaauuuaaaa

SEQ ID NO: 2088974 - RNA, 17 nt, Staphylococcus aureus subsp. aureus MW2
uauuuuuuuauguuaua

SEQ ID NO: 2088975 - RNA, 15 nt, Staphylococcus aureus subsp. aureus MW2
uauuuuuuucaagau

SEQ ID NO: 2088976 - RNA, 14 nt, Staphylococcus aureus subsp. aureus MW2
uauuuuuuuacuuu

SEQ ID NO: 2088977 - RNA, 16 nt, Staphylococcus aureus subsp. aureus MW2
uauuuuuuuauaauuu

SEQ ID NO: 2088978 - RNA, 12 nt, Staphylococcus aureus subsp. aureus MW2
uauuuuuuucuu

SEQ ID NO: 2088979 - RNA, 14 nt, Staphylococcus aureus subsp. aureus MW2
uauuuuuuucuuca

SEQ ID NO: 2088980 - RNA, 18 nt, Staphylococcus aureus subsp. aureus MW2
ucaaaaaaacaaaaaaua

SEQ ID NO: 2088981 - RNA, 13 nt, Staphylococcus aureus subsp. aureus MW2
ucaaaaaauaaua

SEQ ID NO: 2088982 - RNA, 23 nt, Staphylococcus aureus subsp. aureus MW2
ucaaaaauagcguaauuauuaua

SEQ ID NO: 2088983 - RNA, 11 nt, Staphylococcus aureus subsp. aureus MW2
ucaaaaaggaa

SEQ ID NO: 2088984 - RNA, 14 nt, Staphylococcus aureus subsp. aureus MW2
ucaaaaaauuaauc

SEQ ID NO: 2088985 - RNA, 19 nt, Staphylococcus aureus subsp. aureus MW2
guuucauauggugaacugu

SEQ ID NO: 2088986 - RNA, 22 nt, Staphylococcus aureus subsp. aureus MW2
guuucauacacuuuaacauaac

SEQ ID NO: 2088987 - RNA, 19 nt, Staphylococcus aureus subsp. aureus MW2
guuucauaugcaucaacag

SEQ ID NO: 2088988 - RNA, 17 nt, Staphylococcus aureus subsp. aureus MW2
guuucuaaauucuuuuu

SEQ ID NO: 2088989 - RNA, 21 nt, Staphylococcus aureus subsp. aureus MW2
guuucuaaauucuuuuuguuc

SEQ ID NO: 2088990 - RNA, 13 nt, Staphylococcus aureus subsp. aureus MW2
guuucgucagauu

SEQ ID NO: 2088991 - RNA, 14 nt, Staphylococcus aureus subsp. aureus MW2
guuuccaauccauu

SEQ ID NO: 2088992 - RNA, 20 nt, Staphylococcus aureus subsp. aureus MW2
guuucaaucgcauuuuguuu

SEQ ID NO: 2088993 - RNA, 22 nt, Staphylococcus aureus subsp. aureus MW2
guuucaauucaauugcuaaauc

SEQ ID NO: 2088994 - RNA, 15 nt, Staphylococcus aureus subsp. aureus MW2
guuucaacuuuugau

SEQ ID NO: 2088995 - RNA, 21 nt, Staphylococcus aureus subsp. aureus MW2
guuucaagcguuucuugaucu

SEQ ID NO: 2088996 - RNA, 16 nt, Staphylococcus aureus subsp. aureus MW2
guuucacauugucuac

SEQ ID NO: 2088997 - RNA, 15 nt, Staphylococcus aureus subsp. aureus MW2
guuucacaaauucuu

SEQ ID NO: 2088998 - RNA, 19 nt, Staphylococcus aureus subsp. aureus MW2
guuucacaaauucuuuuac

SEQ ID NO: 2088999 - RNA, 15 nt, Staphylococcus aureus subsp. aureus MW2
guuucacguaaugaa

SEQ ID NO: 2089000 - RNA, 15 nt, Staphylococcus aureus subsp. aureus MW2
guuuauuuagaauaa

SEQ ID NO: 2089001 - RNA, 14 nt, Staphylococcus aureus subsp. aureus MW2
guuuagauagcucu

SEQ ID NO: 2089002 - RNA, 17 nt, Staphylococcus aureus subsp. aureus MW2
guuguucccauuuuuaa

SEQ ID NO: 2089003 - RNA, 17 nt, Staphylococcus aureus subsp. aureus MW2
guuguggcaugcugaau

SEQ ID NO: 2089004 - RNA, 15 nt, Staphylococcus aureus subsp. aureus MW2
guugugauauauagu

SEQ ID NO: 2089005 - RNA, 15 nt, Staphylococcus aureus subsp. aureus MW2
guuuacuauacuuug

SEQ ID NO: 2089006 - RNA, 13 nt, Staphylococcus aureus subsp. aureus MW2
guuuacguucuuc

SEQ ID NO: 2089007 - RNA, 14 nt, Staphylococcus aureus subsp. aureus MW2
guuuacguucuuca

SEQ ID NO: 2089008 - RNA, 17 nt, Staphylococcus aureus subsp. aureus MW2
guuuacuauuaaaggaa

SEQ ID NO: 2089009 - RNA, 19 nt, Staphylococcus aureus subsp. aureus MW2
guuuaaucgcauuguuaaa

SEQ ID NO: 2089010 - RNA, 13 nt, Staphylococcus aureus subsp. aureus MW2
guuuaauugcaaa

SEQ ID NO: 2089011 - RNA, 15 nt, Staphylococcus aureus subsp. aureus MW2
guuuaauaaugguuc

SEQ ID NO: 2089012 - RNA, 20 nt, Staphylococcus aureus subsp. aureus MW2
guucuucaugucguuuucuu

SEQ ID NO: 2089013 - RNA, 13 nt, Staphylococcus aureus subsp. aureus MW2
guugucuuuacau

SEQ ID NO: 2089014 - RNA, 14 nt, Staphylococcus aureus subsp. aureus MW2
guucugcuuuuucu

SEQ ID NO: 2089015 - RNA, 17 nt, Staphylococcus aureus subsp. aureus MW2
guuucuuccgcacugcc

SEQ ID NO: 2089016 - RNA, 16 nt, Staphylococcus aureus subsp. aureus MW2
guuucuucaauugucu

SEQ ID NO: 2089017 - RNA, 15 nt, Staphylococcus aureus subsp. aureus MW2
guuucuuguucuaaa

SEQ ID NO: 2089018 - RNA, 15 nt, Staphylococcus aureus subsp. aureus MW2
guuuggauaaaauga

SEQ ID NO: 2089019 - RNA, 14 nt, Staphylococcus aureus subsp. aureus MW2
guuuggcauaauaa

SEQ ID NO: 2089020 - RNA, 15 nt, Staphylococcus aureus subsp. aureus MW2
guuugguauuauucu

SEQ ID NO: 2089021 - RNA, 22 nt, Staphylococcus aureus subsp. aureus MW2
guuuggucaccuacagauaaag

SEQ ID NO: 2089022 - RNA, 21 nt, Staphylococcus aureus subsp. aureus MW2
guuuguaagacaacaaaucga

SEQ ID NO: 2089023 - RNA, 19 nt, Staphylococcus aureus subsp. aureus MW2
guuuguuacauauugcauu

SEQ ID NO: 2089024 - RNA, 14 nt, Staphylococcus aureus subsp. aureus MW2
guuuguuuucuuuc

SEQ ID NO: 2089025 - RNA, 21 nt, Staphylococcus aureus subsp. aureus MW2
guuugugguaaugauuuugcu

SEQ ID NO: 2089026 - RNA, 16 nt, Staphylococcus aureus subsp. aureus MW2
guuuucuaauuguuuu

SEQ ID NO: 2089027 - RNA, 16 nt, Staphylococcus aureus subsp. aureus MW2
guuuucauuuuuucaa

SEQ ID NO: 2089028 - RNA, 23 nt, Staphylococcus aureus subsp. aureus MW2
guuuucaugugucauaauccauu

SEQ ID NO: 2089029 - RNA, 17 nt, Staphylococcus aureus subsp. aureus MW2
guuuucagccacuguca

SEQ ID NO: 2089030 - RNA, 15 nt, Staphylococcus aureus subsp. aureus MW2
guuuuauuuauaaac

SEQ ID NO: 2089031 - RNA, 13 nt, Staphylococcus aureus subsp. aureus MW2
guuuucaacauaa

SEQ ID NO: 2089032 - RNA, 20 nt, Staphylococcus aureus subsp. aureus MW2
guuuuauuuuugucaucaug

SEQ ID NO: 2089033 - RNA, 17 nt, Staphylococcus aureus subsp. aureus MW2
guuuucacuguuuuauc

SEQ ID NO: 2089034 - RNA, 20 nt, Staphylococcus aureus subsp. aureus MW2
guuuucacuguuuuaucuac

SEQ ID NO: 2089035 - RNA, 20 nt, Staphylococcus aureus subsp. aureus MW2
guuuuaauuucacuuuaacu

SEQ ID NO: 2089036 - RNA, 19 nt, Staphylococcus aureus subsp. aureus MW2
guuuuauucgauaauauaa

SEQ ID NO: 2089037 - RNA, 23 nt, Staphylococcus aureus subsp. aureus MW2
guuuuauguugacucuacuagaa

SEQ ID NO: 2089038 - RNA, 18 nt, Staphylococcus aureus subsp. aureus MW2
guuuuauuaaugaagcug

SEQ ID NO: 2089039 - RNA, 23 nt, Staphylococcus aureus subsp. aureus MW2
guuuuauauuuauuuuauaauaa

SEQ ID NO: 2089040 - RNA, 18 nt, Staphylococcus aureus subsp. aureus MW2
uaaaaccuuacccaaaaa

SEQ ID NO: 2089041 - RNA, 21 nt, Staphylococcus aureus subsp. aureus MW2
uaaaacauucccuuaauaaua

SEQ ID NO: 2089042 - RNA, 14 nt, Staphylococcus aureus subsp. aureus MW2
uaaaacauguugau

SEQ ID NO: 2089043 - RNA, 22 nt, Staphylococcus aureus subsp. aureus MW2
uaaaacauguugauaaaaagga

SEQ ID NO: 2089044 - RNA, 21 nt, Staphylococcus aureus subsp. aureus MW2
uaaaacuuguuguuauuuauu

SEQ ID NO: 2089045 - RNA, 13 nt, Staphylococcus aureus subsp. aureus MW2
uaaaagaaaaauu

SEQ ID NO: 2089046 - RNA, 13 nt, Staphylococcus aureus subsp. aureus MW2
uaaaacuuacauu

SEQ ID NO: 2089047 - RNA, 15 nt, Staphylococcus aureus subsp. aureus MW2
uaaaacgauuaauag

SEQ ID NO: 2089048 - RNA, 13 nt, Staphylococcus aureus subsp. aureus MW2
uaaaaaauuuaaa

SEQ ID NO: 2089049 - RNA, 21 nt, Staphylococcus aureus subsp. aureus MW2
uaaaaaauuccuagcuuuuau

SEQ ID NO: 2089050 - RNA, 19 nt, Staphylococcus aureus subsp. aureus MW2
uaaaaacaauauugacuuu

SEQ ID NO: 2089051 - RNA, 18 nt, Staphylococcus aureus subsp. aureus MW2
uaaaaaauuuaaauaaua

SEQ ID NO: 2089052 - RNA, 21 nt, Staphylococcus aureus subsp. aureus MW2
uaaaaacagcaguaagacagc

SEQ ID NO: 2089053 - RNA, 21 nt, Staphylococcus aureus subsp. aureus MW2
uaaaaauaguucuuuaaauua

SEQ ID NO: 2089054 - RNA, 14 nt, Staphylococcus aureus subsp. aureus MW2
uaaaacagcaaaua

SEQ ID NO: 2089055 - RNA, 20 nt, Staphylococcus aureus subsp. aureus MW2
uaaaacagaauuucaucaaa

SEQ ID NO: 2089056 - RNA, 21 nt, Staphylococcus aureus subsp. aureus MW2
uaaaacagaauuucaucaaau

SEQ ID NO: 2089057 - RNA, 19 nt, Staphylococcus aureus subsp. aureus MW2
uaaaaaucuacauaugaaa

SEQ ID NO: 2089058 - RNA, 20 nt, Staphylococcus aureus subsp. aureus MW2
uaaaaauccuaugaauaaau

SEQ ID NO: 2089059 - RNA, 19 nt, Staphylococcus aureus subsp. aureus MW2
uaaaaaucaaagaggcuuu

SEQ ID NO: 2089060 - RNA, 14 nt, Staphylococcus aureus subsp. aureus MW2
uaaaaaucaaagag

SEQ ID NO: 2089061 - RNA, 19 nt, Staphylococcus aureus subsp. aureus MW2
uaaaauaaaguuugggcau

SEQ ID NO: 2089062 - RNA, 16 nt, Staphylococcus aureus subsp. aureus MW2
uaaaauaccaaauaug

SEQ ID NO: 2089063 - RNA, 19 nt, Staphylococcus aureus subsp. aureus MW2
uaaaauaccaaauaugacu

SEQ ID NO: 2089064 - RNA, 12 nt, Staphylococcus aureus subsp. aureus MW2
uaaaauaaaaug

SEQ ID NO: 2089065 - RNA, 14 nt, Staphylococcus aureus subsp. aureus MW2
uaaaauaaaccacg

SEQ ID NO: 2089066 - RNA, 18 nt, Staphylococcus aureus subsp. aureus MW2
uaaaauaaaccacgcaca

SEQ ID NO: 2089067 - RNA, 16 nt, Staphylococcus aureus subsp. aureus MW2
uaaaauaaaaaaugca

SEQ ID NO: 2089068 - RNA, 17 nt, Staphylococcus aureus subsp. aureus MW2
uaaaauagaguagacgu

SEQ ID NO: 2089069 - RNA, 19 nt, Staphylococcus aureus subsp. aureus MW2
uaaaauagaaaaauuucaa

SEQ ID NO: 2089070 - RNA, 13 nt, Staphylococcus aureus subsp. aureus MW2
uaaaauagaaaaa

SEQ ID NO: 2089071 - RNA, 21 nt, Staphylococcus aureus subsp. aureus MW2
uaaaauacgguacagauagga

SEQ ID NO: 2089072 - RNA, 23 nt, Staphylococcus aureus subsp. aureus MW2
uaaaauacgacaccaacauauuu

SEQ ID NO: 2089073 - RNA, 15 nt, Staphylococcus aureus subsp. aureus MW2
uaaaaucaacuuuuc

SEQ ID NO: 2089074 - RNA, 23 nt, Staphylococcus aureus subsp. aureus MW2
uaaaaucauuaauaauuaaacaa

SEQ ID NO: 2089075 - RNA, 20 nt, Staphylococcus aureus subsp. aureus MW2
uaaaaucauuaauaauuaaa

SEQ ID NO: 2089076 - RNA, 19 nt, Staphylococcus aureus subsp. aureus MW2
uaaaaucauaugucuuaac

SEQ ID NO: 2089077 - RNA, 15 nt, Staphylococcus aureus subsp. aureus MW2
uaaaaguuguauucu

SEQ ID NO: 2089078 - RNA, 17 nt, Staphylococcus aureus subsp. aureus MW2
uaaaaguacuuuaaaau

SEQ ID NO: 2089079 - RNA, 22 nt, Staphylococcus aureus subsp. aureus MW2
uaaaaggggcuuuuaauuaauu

SEQ ID NO: 2089080 - RNA, 22 nt, Staphylococcus aureus subsp. aureus MW2
uaaaagucagcgauaauuguug

SEQ ID NO: 2089081 - RNA, 22 nt, Staphylococcus aureus subsp. aureus MW2
uaaaaguggccuuuuaaacaaa

SEQ ID NO: 2089082 - RNA, 20 nt, Staphylococcus aureus subsp. aureus MW2
uaaaagccccuuuuaaauuc

SEQ ID NO: 2089083 - RNA, 22 nt, Staphylococcus aureus subsp. aureus MW2
uaaaagccccuuuuaaauucuu

SEQ ID NO: 2089084 - RNA, 23 nt, Staphylococcus aureus subsp. aureus MW2
uaaaagccccuuuuaaauucuua

SEQ ID NO: 2089085 - RNA, 16 nt, Staphylococcus aureus subsp. aureus MW2
uaaaaggggaaaucau

SEQ ID NO: 2089086 - RNA, 21 nt, Staphylococcus aureus subsp. aureus MW2
uaaaaggugugggcuuuauua

SEQ ID NO: 2089087 - RNA, 14 nt, Staphylococcus aureus subsp. aureus MW2
uaaaagcaacaaau

SEQ ID NO: 2089088 - RNA, 21 nt, Staphylococcus aureus subsp. aureus MW2
guuuuuugauuaguaaauaua

SEQ ID NO: 2089089 - RNA, 18 nt, Staphylococcus aureus subsp. aureus MW2
guuuuuugauuaguaaau

SEQ ID NO: 2089090 - RNA, 12 nt, Staphylococcus aureus subsp. aureus MW2
guuuuuuuaaau

SEQ ID NO: 2089091 - RNA, 22 nt, Staphylococcus aureus subsp. aureus MW2
guuuuuuuagcuauagaaauga

SEQ ID NO: 2089092 - RNA, 21 nt, Staphylococcus aureus subsp. aureus MW2
guuuuuuagauuugaaauuua

SEQ ID NO: 2089093 - RNA, 14 nt, Staphylococcus aureus subsp. aureus MW2
uaaaaaaauaaugc

SEQ ID NO: 2089094 - RNA, 19 nt, Staphylococcus aureus subsp. aureus MW2
uaaaaaaguugauuaaaag

SEQ ID NO: 2089095 - RNA, 23 nt, Staphylococcus aureus subsp. aureus MW2
uaaaaaauccggaacauuaaaag

SEQ ID NO: 2089096 - RNA, 15 nt, Staphylococcus aureus subsp. aureus MW2
uaaaaaaauuaaaau

SEQ ID NO: 2089097 - RNA, 13 nt, Staphylococcus aureus subsp. aureus MW2
uaaaaaacaaaaa

SEQ ID NO: 2089098 - RNA, 17 nt, Staphylococcus aureus subsp. aureus MW2
uaaaaaacaauaaaauu

SEQ ID NO: 2089099 - RNA, 22 nt, Staphylococcus aureus subsp. aureus MW2
guuuugguuguucuuuuuguug

SEQ ID NO: 2089100 - RNA, 13 nt, Staphylococcus aureus subsp. aureus MW2
guuuuguauucag

SEQ ID NO: 2089101 - RNA, 16 nt, Staphylococcus aureus subsp. aureus MW2
guuuuguguauuuauu

SEQ ID NO: 2089102 - RNA, 12 nt, Staphylococcus aureus subsp. aureus MW2
guuuugagagau

SEQ ID NO: 2089103 - RNA, 20 nt, Staphylococcus aureus subsp. aureus MW2
guuuugagagauuauuuaaa

SEQ ID NO: 2089104 - RNA, 15 nt, Staphylococcus aureus subsp. aureus MW2
guuuugaagaauaaa

SEQ ID NO: 2089105 - RNA, 18 nt, Staphylococcus aureus subsp. aureus MW2
guuuuuguggaaaauuga

SEQ ID NO: 2089106 - RNA, 18 nt, Staphylococcus aureus subsp. aureus MW2
guuuuugaauuuucguuc

SEQ ID NO: 2089107 - RNA, 13 nt, Staphylococcus aureus subsp. aureus MW2
guuuuguuuugcu

SEQ ID NO: 2089108 - RNA, 12 nt, Staphylococcus aureus subsp. aureus MW2
guuuuuacuaua

SEQ ID NO: 2089109 - RNA, 21 nt, Staphylococcus aureus subsp. aureus MW2
guuuuuagguuauauuuaaau

SEQ ID NO: 2089110 - RNA, 14 nt, Staphylococcus aureus subsp. aureus MW2
guuuuuauauuauu

SEQ ID NO: 2089111 - RNA, 21 nt, Staphylococcus aureus subsp. aureus MW2
uaacccuaaagcuaaugcaag

SEQ ID NO: 2089112 - RNA, 21 nt, Staphylococcus aureus subsp. aureus MW2
uaaccauuaugauuaauccua

SEQ ID NO: 2089113 - RNA, 14 nt, Staphylococcus aureus subsp. aureus MW2
uaaccccuucaaaa

SEQ ID NO: 2089114 - RNA, 13 nt, Staphylococcus aureus subsp. aureus MW2
uaaccauuaugau

SEQ ID NO: 2089115 - RNA, 14 nt, Staphylococcus aureus subsp. aureus MW2
uaaccauuaugauu

SEQ ID NO: 2089116 - RNA, 12 nt, Staphylococcus aureus subsp. aureus MW2
uaaccauaguaa

SEQ ID NO: 2089117 - RNA, 16 nt, Staphylococcus aureus subsp. aureus MW2
uaaccaucauaaaugu

SEQ ID NO: 2089118 - RNA, 14 nt, Staphylococcus aureus subsp. aureus MW2
uaacauuugucaua

SEQ ID NO: 2089119 - RNA, 12 nt, Staphylococcus aureus subsp. aureus MW2
uaacauuuugaa

SEQ ID NO: 2089120 - RNA, 21 nt, Staphylococcus aureus subsp. aureus MW2
uaacauuagcauuaaauucca

SEQ ID NO: 2089121 - RNA, 18 nt, Staphylococcus aureus subsp. aureus MW2
uaacauucuucaaaaaau

SEQ ID NO: 2089122 - RNA, 14 nt, Staphylococcus aureus subsp. aureus MW2
uaacauuuaaaaaa

SEQ ID NO: 2089123 - RNA, 13 nt, Staphylococcus aureus subsp. aureus MW2
uaacauuagcaug

SEQ ID NO: 2089124 - RNA, 16 nt, Staphylococcus aureus subsp. aureus MW2
uaacauucuucaaaaa

SEQ ID NO: 2089125 - RNA, 15 nt, Staphylococcus aureus subsp. aureus MW2
uaacauuuaaaaaau

SEQ ID NO: 2089126 - RNA, 21 nt, Staphylococcus aureus subsp. aureus MW2
uaacauuuauuuuuucucuau

SEQ ID NO: 2089127 - RNA, 13 nt, Staphylococcus aureus subsp. aureus MW2
uaacaucuuuuuc

SEQ ID NO: 2089128 - RNA, 21 nt, Staphylococcus aureus subsp. aureus MW2
uaacaucuucauguaugaagu

SEQ ID NO: 2089129 - RNA, 18 nt, Staphylococcus aureus subsp. aureus MW2
uaacaucuucauguauga

SEQ ID NO: 2089130 - RNA, 23 nt, Staphylococcus aureus subsp. aureus MW2
uaacauguauuuaguaucauaau

SEQ ID NO: 2089131 - RNA, 17 nt, Staphylococcus aureus subsp. aureus MW2
uaacauguuuguggcac

SEQ ID NO: 2089132 - RNA, 23 nt, Staphylococcus aureus subsp. aureus MW2
uaacauguuuguggcaccucuuu

SEQ ID NO: 2089133 - RNA, 23 nt, Staphylococcus aureus subsp. aureus MW2
uaacaugggguuuuauuuuugga

SEQ ID NO: 2089134 - RNA, 20 nt, Staphylococcus aureus subsp. aureus MW2
uaacacccgucccauaaaag

SEQ ID NO: 2089135 - RNA, 13 nt, Staphylococcus aureus subsp. aureus MW2
uaacaccauaaca

SEQ ID NO: 2089136 - RNA, 18 nt, Staphylococcus aureus subsp. aureus MW2
uaacagacuuuguuaaaa

SEQ ID NO: 2089137 - RNA, 16 nt, Staphylococcus aureus subsp. aureus MW2
uaacagaguugucauu

SEQ ID NO: 2089138 - RNA, 20 nt, Staphylococcus aureus subsp. aureus MW2
uaacgaugguugcuucacug

SEQ ID NO: 2089139 - RNA, 21 nt, Staphylococcus aureus subsp. aureus MW2
uaacgcucaugaguuucucau

SEQ ID NO: 2089140 - RNA, 18 nt, Staphylococcus aureus subsp. aureus MW2
uaacgaguccauuuucuu

SEQ ID NO: 2089141 - RNA, 23 nt, Staphylococcus aureus subsp. aureus MW2
uaacgaguuuucaguauguaaaa

SEQ ID NO: 2089142 - RNA, 22 nt, Staphylococcus aureus subsp. aureus MW2
uaacgaaaaagaugguuuuguu

SEQ ID NO: 2089143 - RNA, 21 nt, Staphylococcus aureus subsp. aureus MW2
uaaccuaauucgccaucuuuu

SEQ ID NO: 2089144 - RNA, 20 nt, Staphylococcus aureus subsp. aureus MW2
uaaccuaaagauaauauuaa

SEQ ID NO: 2089145 - RNA, 16 nt, Staphylococcus aureus subsp. aureus MW2
uaaccuauuaaaucug

SEQ ID NO: 2089146 - RNA, 19 nt, Staphylococcus aureus subsp. aureus MW2
uaaccuuuaaaacaucauu

SEQ ID NO: 2089147 - RNA, 19 nt, Staphylococcus aureus subsp. aureus MW2
uaaccgcuucuuuuaaguu

SEQ ID NO: 2089148 - RNA, 21 nt, Staphylococcus aureus subsp. aureus MW2
uaaccgcuucuuuuaaguuau

SEQ ID NO: 2089149 - RNA, 14 nt, Staphylococcus aureus subsp. aureus MW2
uaaccgaaauauug

SEQ ID NO: 2089150 - RNA, 14 nt, Staphylococcus aureus subsp. aureus MW2
uaaauuuaaaauaa

SEQ ID NO: 2089151 - RNA, 16 nt, Staphylococcus aureus subsp. aureus MW2
uaaauuuaaaauaaua

SEQ ID NO: 2089152 - RNA, 15 nt, Staphylococcus aureus subsp. aureus MW2
uaaauuuaaaagaaa

SEQ ID NO: 2089153 - RNA, 18 nt, Staphylococcus aureus subsp. aureus MW2
uaaauuuacaaaaacuau

SEQ ID NO: 2089154 - RNA, 18 nt, Staphylococcus aureus subsp. aureus MW2
uaaauuuaacguuauuca

SEQ ID NO: 2089155 - RNA, 18 nt, Staphylococcus aureus subsp. aureus MW2
uaaauuguuuacuauacu

SEQ ID NO: 2089156 - RNA, 19 nt, Staphylococcus aureus subsp. aureus MW2
uaaauuguuuacuauacuu

SEQ ID NO: 2089157 - RNA, 20 nt, Staphylococcus aureus subsp. aureus MW2
uaaauuguuuacuauacuuu

SEQ ID NO: 2089158 - RNA, 20 nt, Staphylococcus aureus subsp. aureus MW2
uaaauuguaauauauuaaua

SEQ ID NO: 2089159 - RNA, 17 nt, Staphylococcus aureus subsp. aureus MW2
uaaauugguucuauaau

SEQ ID NO: 2089160 - RNA, 19 nt, Staphylococcus aureus subsp. aureus MW2
uaaauucggaaaauaucac

SEQ ID NO: 2089161 - RNA, 14 nt, Staphylococcus aureus subsp. aureus MW2
uaaauucuaucuau

SEQ ID NO: 2089162 - RNA, 18 nt, Staphylococcus aureus subsp. aureus MW2
uaaauucuuauaaaauaa

SEQ ID NO: 2089163 - RNA, 13 nt, Staphylococcus aureus subsp. aureus MW2
uaaauugagaagu

SEQ ID NO: 2089164 - RNA, 19 nt, Staphylococcus aureus subsp. aureus MW2
uaaauucuuauaaaauaaa

SEQ ID NO: 2089165 - RNA, 20 nt, Staphylococcus aureus subsp. aureus MW2
uaaauucuuuucaagaaauu

SEQ ID NO: 2089166 - RNA, 14 nt, Staphylococcus aureus subsp. aureus MW2
uaaauuaaaucgau

SEQ ID NO: 2089167 - RNA, 12 nt, Staphylococcus aureus subsp. aureus MW2
uaaauuaauaug

SEQ ID NO: 2089168 - RNA, 19 nt, Staphylococcus aureus subsp. aureus MW2
uaaauuacaaaaguaugau

SEQ ID NO: 2089169 - RNA, 15 nt, Staphylococcus aureus subsp. aureus MW2
uaaauuacaauuaau

SEQ ID NO: 2089170 - RNA, 16 nt, Staphylococcus aureus subsp. aureus MW2
uaaauuaguuaauaac

SEQ ID NO: 2089171 - RNA, 13 nt, Staphylococcus aureus subsp. aureus MW2
uaaauuacuauau

SEQ ID NO: 2089172 - RNA, 15 nt, Staphylococcus aureus subsp. aureus MW2
uaaauuacuauauuu

SEQ ID NO: 2089173 - RNA, 18 nt, Staphylococcus aureus subsp. aureus MW2
uaaauuagaugaaaugga

SEQ ID NO: 2089174 - RNA, 16 nt, Staphylococcus aureus subsp. aureus MW2
uaaauucaauaaucuu

SEQ ID NO: 2089175 - RNA, 15 nt, Staphylococcus aureus subsp. aureus MW2
uaaauuauuuauuca

SEQ ID NO: 2089176 - RNA, 14 nt, Staphylococcus aureus subsp. aureus MW2
uaaauucaucuguu

SEQ ID NO: 2089177 - RNA, 18 nt, Staphylococcus aureus subsp. aureus MW2
uaaauucaaaucuggcac

SEQ ID NO: 2089178 - RNA, 14 nt, Staphylococcus aureus subsp. aureus MW2
uaaauucaccaguu

SEQ ID NO: 2089179 - RNA, 18 nt, Staphylococcus aureus subsp. aureus MW2
uaaauuccauguauucuu

SEQ ID NO: 2089180 - RNA, 19 nt, Staphylococcus aureus subsp. aureus MW2
uaaauuccauguauucuua

SEQ ID NO: 2089181 - RNA, 21 nt, Staphylococcus aureus subsp. aureus MW2
uaaauuccauguauucuuaga

SEQ ID NO: 2089182 - RNA, 23 nt, Staphylococcus aureus subsp. aureus MW2
uaacaaacauuaaucuauauaaa

SEQ ID NO: 2089183 - RNA, 13 nt, Staphylococcus aureus subsp. aureus MW2
uaacaaacauuaa

SEQ ID NO: 2089184 - RNA, 13 nt, Staphylococcus aureus subsp. aureus MW2
uaacaaugcgauu

SEQ ID NO: 2089185 - RNA, 15 nt, Staphylococcus aureus subsp. aureus MW2
uaacaaugaaccauc

SEQ ID NO: 2089186 - RNA, 15 nt, Staphylococcus aureus subsp. aureus MW2
uaacacaugcuucau

SEQ ID NO: 2089187 - RNA, 16 nt, Staphylococcus aureus subsp. aureus MW2
uaacaauuuauuaaaa

SEQ ID NO: 2089188 - RNA, 17 nt, Staphylococcus aureus subsp. aureus MW2
uaacaauuuuaaaucuu

SEQ ID NO: 2089189 - RNA, 22 nt, Staphylococcus aureus subsp. aureus MW2
uaacaauuuuaauuuuucauua

SEQ ID NO: 2089190 - RNA, 15 nt, Staphylococcus aureus subsp. aureus MW2
uaacaauuuuaucug

SEQ ID NO: 2089191 - RNA, 14 nt, Staphylococcus aureus subsp. aureus MW2
uaaauuucuucaua

SEQ ID NO: 2089192 - RNA, 22 nt, Staphylococcus aureus subsp. aureus MW2
uaaauuucuucauaguucaaau

SEQ ID NO: 2089193 - RNA, 17 nt, Staphylococcus aureus subsp. aureus MW2
uaaauuucugaacauaa

SEQ ID NO: 2089194 - RNA, 15 nt, Staphylococcus aureus subsp. aureus MW2
uaaauuuauuuuuaa

SEQ ID NO: 2089195 - RNA, 13 nt, Staphylococcus aureus subsp. aureus MW2
uaaauuuauauau

SEQ ID NO: 2089196 - RNA, 17 nt, Staphylococcus aureus subsp. aureus MW2
uaaauuuauuuuuaauu

SEQ ID NO: 2089197 - RNA, 16 nt, Staphylococcus aureus subsp. aureus MW2
uaaauuuauuuuuaau

SEQ ID NO: 2089198 - RNA, 11 nt, Staphylococcus aureus subsp. aureus MW2
uaaauuucaaa

SEQ ID NO: 2089199 - RNA, 13 nt, Staphylococcus aureus subsp. aureus MW2
uaaauuucaaaua

SEQ ID NO: 2089200 - RNA, 18 nt, Staphylococcus aureus subsp. aureus MW2
uaaauuuuaucuaaacau

SEQ ID NO: 2089201 - RNA, 17 nt, Staphylococcus aureus subsp. aureus MW2
uaaauuuuauauauccu

SEQ ID NO: 2089202 - RNA, 18 nt, Staphylococcus aureus subsp. aureus MW2
uaaauuuuauauauccug

SEQ ID NO: 2089203 - RNA, 17 nt, Staphylococcus aureus subsp. aureus MW2
uaaauuuugaauuacag

SEQ ID NO: 2089204 - RNA, 15 nt, Staphylococcus aureus subsp. aureus MW2
uaaauuuugagaaaa

SEQ ID NO: 2089205 - RNA, 16 nt, Staphylococcus aureus subsp. aureus MW2
uaaauuuugagaaaau

SEQ ID NO: 2089206 - RNA, 23 nt, Staphylococcus aureus subsp. aureus MW2
uaaauuuugagaaaauaucauuu

SEQ ID NO: 2089207 - RNA, 17 nt, Staphylococcus aureus subsp. aureus MW2
uaaauuuugcgaaaaua

SEQ ID NO: 2089208 - RNA, 12 nt, Staphylococcus aureus subsp. aureus MW2
uaaauuuucauc

SEQ ID NO: 2089209 - RNA, 23 nt, Staphylococcus aureus subsp. aureus MW2
uaaauuuugcgaaaauaucauuu

SEQ ID NO: 2089210 - RNA, 15 nt, Staphylococcus aureus subsp. aureus MW2
uaaacgcaaauuaaa

SEQ ID NO: 2089211 - RNA, 17 nt, Staphylococcus aureus subsp. aureus MW2
uaaacguacauuuuuau

SEQ ID NO: 2089212 - RNA, 19 nt, Staphylococcus aureus subsp. aureus MW2
uaaacgucacuuuauuaaa

SEQ ID NO: 2089213 - RNA, 18 nt, Staphylococcus aureus subsp. aureus MW2
uaaacguugcaccuauuu

SEQ ID NO: 2089214 - RNA, 22 nt, Staphylococcus aureus subsp. aureus MW2
uaaaccucuaaauaaaauuaaa

SEQ ID NO: 2089215 - RNA, 18 nt, Staphylococcus aureus subsp. aureus MW2
uaaaccucuaaauaaaau

SEQ ID NO: 2089216 - RNA, 11 nt, Staphylococcus aureus subsp. aureus MW2
uaaaccuguua

SEQ ID NO: 2089217 - RNA, 14 nt, Staphylococcus aureus subsp. aureus MW2
uaaaccucaacauu

SEQ ID NO: 2089218 - RNA, 16 nt, Staphylococcus aureus subsp. aureus MW2
uaaaccuacaauauag

SEQ ID NO: 2089219 - RNA, 15 nt, Staphylococcus aureus subsp. aureus MW2
uaaaccuuaauaaug

SEQ ID NO: 2089220 - RNA, 18 nt, Staphylococcus aureus subsp. aureus MW2
uaaacgacaugaaaguug

SEQ ID NO: 2089221 - RNA, 15 nt, Staphylococcus aureus subsp. aureus MW2
uaaaaugauaucuau

SEQ ID NO: 2089222 - RNA, 20 nt, Staphylococcus aureus subsp. aureus MW2
uaaaaugauagcuaaacauu

SEQ ID NO: 2089223 - RNA, 13 nt, Staphylococcus aureus subsp. aureus MW2
uaaacauuuagau

SEQ ID NO: 2089224 - RNA, 20 nt, Staphylococcus aureus subsp. aureus MW2
uaaacauuuuugauuuuaau

SEQ ID NO: 2089225 - RNA, 13 nt, Staphylococcus aureus subsp. aureus MW2
uaaaaucucauaa

SEQ ID NO: 2089226 - RNA, 17 nt, Staphylococcus aureus subsp. aureus MW2
uaaaaucucauaauaau

SEQ ID NO: 2089227 - RNA, 21 nt, Staphylococcus aureus subsp. aureus MW2
uaaaaucuugaugauauucau

SEQ ID NO: 2089228 - RNA, 22 nt, Staphylococcus aureus subsp. aureus MW2
uaaaaucuugaugauauucaua

SEQ ID NO: 2089229 - RNA, 21 nt, Staphylococcus aureus subsp. aureus MW2
uaaaaugaauaauuacuaaaa

SEQ ID NO: 2089230 - RNA, 16 nt, Staphylococcus aureus subsp. aureus MW2
uaaaccuaaugauaau

SEQ ID NO: 2089231 - RNA, 17 nt, Staphylococcus aureus subsp. aureus MW2
uaaaccggcacuuauuu

SEQ ID NO: 2089232 - RNA, 21 nt, Staphylococcus aureus subsp. aureus MW2
uaaaccaaaucggaauaaaau

SEQ ID NO: 2089233 - RNA, 22 nt, Staphylococcus aureus subsp. aureus MW2
uaaaccaaaucggaauaaaaua

SEQ ID NO: 2089234 - RNA, 15 nt, Staphylococcus aureus subsp. aureus MW2
uaaaccaaugauugu

SEQ ID NO: 2089235 - RNA, 18 nt, Staphylococcus aureus subsp. aureus MW2
uaaaccaacuuucucaag

SEQ ID NO: 2089236 - RNA, 15 nt, Staphylococcus aureus subsp. aureus MW2
uaaagagcaauuaaa

SEQ ID NO: 2089237 - RNA, 22 nt, Staphylococcus aureus subsp. aureus MW2
uaaagguaccacuguauuuacu

SEQ ID NO: 2089238 - RNA, 22 nt, Staphylococcus aureus subsp. aureus MW2
uaaagccugcaacccauguggu

SEQ ID NO: 2089239 - RNA, 15 nt, Staphylococcus aureus subsp. aureus MW2
uaaacuucuuuucuu

SEQ ID NO: 2089240 - RNA, 15 nt, Staphylococcus aureus subsp. aureus MW2
uaaacuuuaugaaaa

SEQ ID NO: 2089241 - RNA, 13 nt, Staphylococcus aureus subsp. aureus MW2
uaaagaauuaagu

SEQ ID NO: 2089242 - RNA, 22 nt, Staphylococcus aureus subsp. aureus MW2
uaaagaauuucgaaaagaaauu

SEQ ID NO: 2089243 - RNA, 23 nt, Staphylococcus aureus subsp. aureus MW2
uaaagacaccuucaauaucugua

SEQ ID NO: 2089244 - RNA, 15 nt, Staphylococcus aureus subsp. aureus MW2
uaaaguuuauuuaug

SEQ ID NO: 2089245 - RNA, 23 nt, Staphylococcus aureus subsp. aureus MW2
uaaaguugacaauacaaaucgau

SEQ ID NO: 2089246 - RNA, 17 nt, Staphylococcus aureus subsp. aureus MW2
uaaaguacuuacaaaua

SEQ ID NO: 2089247 - RNA, 22 nt, Staphylococcus aureus subsp. aureus MW2
uaaaguaaagggaggaauuaau

SEQ ID NO: 2089248 - RNA, 23 nt, Staphylococcus aureus subsp. aureus MW2
uaaaguaaagggaggaauuaaua

SEQ ID NO: 2089249 - RNA, 15 nt, Staphylococcus aureus subsp. aureus MW2
uaaaguaaaauauac

SEQ ID NO: 2089250 - RNA, 19 nt, Staphylococcus aureus subsp. aureus MW2
uaaaggucuauauauauuu

SEQ ID NO: 2089251 - RNA, 23 nt, Staphylococcus aureus subsp. aureus MW2
uaaauaaaaguuaccuacuacau

SEQ ID NO: 2089252 - RNA, 18 nt, Staphylococcus aureus subsp. aureus MW2
uaaauaaaaggcauucuu

SEQ ID NO: 2089253 - RNA, 15 nt, Staphylococcus aureus subsp. aureus MW2
uaaauaaaaauuaua

SEQ ID NO: 2089254 - RNA, 14 nt, Staphylococcus aureus subsp. aureus MW2
uaaauaaaaauuau

SEQ ID NO: 2089255 - RNA, 19 nt, Staphylococcus aureus subsp. aureus MW2
uaaauaaaaauacauaauu

SEQ ID NO: 2089256 - RNA, 14 nt, Staphylococcus aureus subsp. aureus MW2
uaaauaaaauuaaa

SEQ ID NO: 2089257 - RNA, 13 nt, Staphylococcus aureus subsp. aureus MW2
uaaauaaaaugcu

SEQ ID NO: 2089258 - RNA, 14 nt, Staphylococcus aureus subsp. aureus MW2
uaaauaaaaugcua

SEQ ID NO: 2089259 - RNA, 14 nt, Staphylococcus aureus subsp. aureus MW2
uaaauaaaaugcau

SEQ ID NO: 2089260 - RNA, 15 nt, Staphylococcus aureus subsp. aureus MW2
uaaauaaaauuaaaa

SEQ ID NO: 2089261 - RNA, 14 nt, Staphylococcus aureus subsp. aureus MW2
uaaauaaaauuguu

SEQ ID NO: 2089262 - RNA, 22 nt, Staphylococcus aureus subsp. aureus MW2
uaaauaaaauuuuuuucauaau

SEQ ID NO: 2089263 - RNA, 17 nt, Staphylococcus aureus subsp. aureus MW2
uaaauaucaauaauucg

SEQ ID NO: 2089264 - RNA, 18 nt, Staphylococcus aureus subsp. aureus MW2
uaaauaucauaaaugcau

SEQ ID NO: 2089265 - RNA, 17 nt, Staphylococcus aureus subsp. aureus MW2
uaaauauaguaauaaaa

SEQ ID NO: 2089266 - RNA, 18 nt, Staphylococcus aureus subsp. aureus MW2
uaaauagauaauauauag

SEQ ID NO: 2089267 - RNA, 21 nt, Staphylococcus aureus subsp. aureus MW2
uaaauagaagaaaagaacauu

SEQ ID NO: 2089268 - RNA, 16 nt, Staphylococcus aureus subsp. aureus MW2
uaaauacaauguuauu

SEQ ID NO: 2089269 - RNA, 22 nt, Staphylococcus aureus subsp. aureus MW2
uaaauacaaagccuuaauauca

SEQ ID NO: 2089270 - RNA, 19 nt, Staphylococcus aureus subsp. aureus MW2
uaaauacaauuucuucauu

SEQ ID NO: 2089271 - RNA, 17 nt, Staphylococcus aureus subsp. aureus MW2
uaaauacaaaaauauag

SEQ ID NO: 2089272 - RNA, 16 nt, Staphylococcus aureus subsp. aureus MW2
uaaauaauuuaaauua

SEQ ID NO: 2089273 - RNA, 17 nt, Staphylococcus aureus subsp. aureus MW2
uaaauaauuuaaauuaa

SEQ ID NO: 2089274 - RNA, 18 nt, Staphylococcus aureus subsp. aureus MW2
uaaauaauuuaaauuaaa

SEQ ID NO: 2089275 - RNA, 20 nt, Staphylococcus aureus subsp. aureus MW2
uaaauaauuuaaauuaaaau

SEQ ID NO: 2089276 - RNA, 13 nt, Staphylococcus aureus subsp. aureus MW2
uaaauaaaugacu

SEQ ID NO: 2089277 - RNA, 16 nt, Staphylococcus aureus subsp. aureus MW2
uaaauaaauucucuaa

SEQ ID NO: 2089278 - RNA, 18 nt, Staphylococcus aureus subsp. aureus MW2
uaaauaaugcauggaaaa

SEQ ID NO: 2089279 - RNA, 21 nt, Staphylococcus aureus subsp. aureus MW2
uaaaugcuuaauuuguuuuaa

SEQ ID NO: 2089280 - RNA, 15 nt, Staphylococcus aureus subsp. aureus MW2
uaaaugcuaaaagua

SEQ ID NO: 2089281 - RNA, 16 nt, Staphylococcus aureus subsp. aureus MW2
uaaaugcuuuaaauau

SEQ ID NO: 2089282 - RNA, 22 nt, Staphylococcus aureus subsp. aureus MW2
uaaauguugacucguuauucaa

SEQ ID NO: 2089283 - RNA, 22 nt, Staphylococcus aureus subsp. aureus MW2
uaaauguuuuguguauuuauuu

SEQ ID NO: 2089284 - RNA, 16 nt, Staphylococcus aureus subsp. aureus MW2
uaaauguuuauaucuu

SEQ ID NO: 2089285 - RNA, 14 nt, Staphylococcus aureus subsp. aureus MW2
uaaaugguuuucuu

SEQ ID NO: 2089286 - RNA, 22 nt, Staphylococcus aureus subsp. aureus MW2
uaaaugguuuucuuuuucuaua

SEQ ID NO: 2089287 - RNA, 17 nt, Staphylococcus aureus subsp. aureus MW2
uaaaugaauuauuuaaa

SEQ ID NO: 2089288 - RNA, 20 nt, Staphylococcus aureus subsp. aureus MW2
uaaaucuuuuacuaaaugaa

SEQ ID NO: 2089289 - RNA, 18 nt, Staphylococcus aureus subsp. aureus MW2
uaaaugaaagcaccuaaa

SEQ ID NO: 2089290 - RNA, 21 nt, Staphylococcus aureus subsp. aureus MW2
uaaaugaaagcaccuaaaaua

SEQ ID NO: 2089291 - RNA, 22 nt, Staphylococcus aureus subsp. aureus MW2
uaaaucuuuauaaaauuguaau

SEQ ID NO: 2089292 - RNA, 22 nt, Staphylococcus aureus subsp. aureus MW2
uaaaugacauggaaaauauauu

SEQ ID NO: 2089293 - RNA, 18 nt, Staphylococcus aureus subsp. aureus MW2
uaaaugcgguuaaugacu

SEQ ID NO: 2089294 - RNA, 18 nt, Staphylococcus aureus subsp. aureus MW2
uaaaugacugaauuaaua

SEQ ID NO: 2089295 - RNA, 19 nt, Staphylococcus aureus subsp. aureus MW2
uaaauaugauguuaaaaaa

SEQ ID NO: 2089296 - RNA, 22 nt, Staphylococcus aureus subsp. aureus MW2
uaaauaugacgcgugaauuaaa

SEQ ID NO: 2089297 - RNA, 20 nt, Staphylococcus aureus subsp. aureus MW2
uaaauaucuuaguauguuca

SEQ ID NO: 2089298 - RNA, 19 nt, Staphylococcus aureus subsp. aureus MW2
uaaauaucgacaaauuaaa

SEQ ID NO: 2089299 - RNA, 16 nt, Staphylococcus aureus subsp. aureus MW2
uaaauauuaaauucau

SEQ ID NO: 2089300 - RNA, 15 nt, Staphylococcus aureus subsp. aureus MW2
uaaauauuuuuuaaa

SEQ ID NO: 2089301 - RNA, 16 nt, Staphylococcus aureus subsp. aureus MW2
uaaauauuuuuuaaaa

SEQ ID NO: 2089302 - RNA, 15 nt, Staphylococcus aureus subsp. aureus MW2
uaaauauuuuuuaau

SEQ ID NO: 2089303 - RNA, 21 nt, Staphylococcus aureus subsp. aureus MW2
uaaaucaaagaugacuuggcc

SEQ ID NO: 2089304 - RNA, 14 nt, Staphylococcus aureus subsp. aureus MW2
uaaaucaacuuaaa

SEQ ID NO: 2089305 - RNA, 13 nt, Staphylococcus aureus subsp. aureus MW2
uaaaucaagaaau

SEQ ID NO: 2089306 - RNA, 16 nt, Staphylococcus aureus subsp. aureus MW2
uaaaucuauacuuuau

SEQ ID NO: 2089307 - RNA, 17 nt, Staphylococcus aureus subsp. aureus MW2
uaaaucuauacuuuauc

SEQ ID NO: 2089308 - RNA, 21 nt, Staphylococcus aureus subsp. aureus MW2
uaaaucuauacuuuaucuauu

SEQ ID NO: 2089309 - RNA, 16 nt, Staphylococcus aureus subsp. aureus MW2
uaaaucuaucuauuca

SEQ ID NO: 2089310 - RNA, 23 nt, Staphylococcus aureus subsp. aureus MW2
uaaaucuuguuggauuuuaacaa

SEQ ID NO: 2089311 - RNA, 20 nt, Staphylococcus aureus subsp. aureus MW2
uaaaucuguacuucuaauuu

SEQ ID NO: 2089312 - RNA, 19 nt, Staphylococcus aureus subsp. aureus MW2
uaaaucuguuuaaauuuaa

SEQ ID NO: 2089313 - RNA, 16 nt, Staphylococcus aureus subsp. aureus MW2
uaaaucuguuuaaauu

SEQ ID NO: 2089314 - RNA, 18 nt, Staphylococcus aureus subsp. aureus MW2
gucugcauuaauuucaug

SEQ ID NO: 2089315 - RNA, 20 nt, Staphylococcus aureus subsp. aureus MW2
gucugaugucgaaaauagcu

SEQ ID NO: 2089316 - RNA, 14 nt, Staphylococcus aureus subsp. aureus MW2
gucucgaugcuaau

SEQ ID NO: 2089317 - RNA, 15 nt, Staphylococcus aureus subsp. aureus MW2
gucuggaacaauaau

SEQ ID NO: 2089318 - RNA, 23 nt, Staphylococcus aureus subsp. aureus MW2
gucuguaaauuaucuaaagaaau

SEQ ID NO: 2089319 - RNA, 19 nt, Staphylococcus aureus subsp. aureus MW2
gucuuccaaucaacuucau

SEQ ID NO: 2089320 - RNA, 15 nt, Staphylococcus aureus subsp. aureus MW2
gucuucauuaacauc

SEQ ID NO: 2089321 - RNA, 11 nt, Staphylococcus aureus subsp. aureus MW2
gucuuaaacau

SEQ ID NO: 2089322 - RNA, 13 nt, Staphylococcus aureus subsp. aureus MW2
gucuuaauucauu

SEQ ID NO: 2089323 - RNA, 22 nt, Staphylococcus aureus subsp. aureus MW2
gucuuaauucauuccaaacaca

SEQ ID NO: 2089324 - RNA, 21 nt, Staphylococcus aureus subsp. aureus MW2
gugaaaauuuauucaaaucau

SEQ ID NO: 2089325 - RNA, 11 nt, Staphylococcus aureus subsp. aureus MW2
gugaaagaaaa

SEQ ID NO: 2089326 - RNA, 14 nt, Staphylococcus aureus subsp. aureus MW2
gucuuuuugauuaa

SEQ ID NO: 2089327 - RNA, 15 nt, Staphylococcus aureus subsp. aureus MW2
gucuuguaaacuucu

SEQ ID NO: 2089328 - RNA, 18 nt, Staphylococcus aureus subsp. aureus MW2
gucuuuaauuuauuuauu

SEQ ID NO: 2089329 - RNA, 13 nt, Staphylococcus aureus subsp. aureus MW2
gucuuucuaaguu

SEQ ID NO: 2089330 - RNA, 14 nt, Staphylococcus aureus subsp. aureus MW2
gucuucucuaucag

SEQ ID NO: 2089331 - RNA, 14 nt, Staphylococcus aureus subsp. aureus MW2
gucuugugauaauu

SEQ ID NO: 2089332 - RNA, 16 nt, Staphylococcus aureus subsp. aureus MW2
gucuugugauaauucu

SEQ ID NO: 2089333 - RNA, 16 nt, Staphylococcus aureus subsp. aureus MW2
gucuugcaauaccucc

SEQ ID NO: 2089334 - RNA, 15 nt, Staphylococcus aureus subsp. aureus MW2
gucuugaguacuaau

SEQ ID NO: 2089335 - RNA, 22 nt, Staphylococcus aureus subsp. aureus MW2
gucuugaguacuaaucaauacu

SEQ ID NO: 2089336 - RNA, 14 nt, Staphylococcus aureus subsp. aureus MW2
gucuugaguacuaa

SEQ ID NO: 2089337 - RNA, 21 nt, Staphylococcus aureus subsp. aureus MW2
gugaaaguauuagauauauuu

SEQ ID NO: 2089338 - RNA, 23 nt, Staphylococcus aureus subsp. aureus MW2
gugaaaguacuuggaaaauacua

SEQ ID NO: 2089339 - RNA, 22 nt, Staphylococcus aureus subsp. aureus MW2
gugaaauugcgugcguuuaaca

SEQ ID NO: 2089340 - RNA, 13 nt, Staphylococcus aureus subsp. aureus MW2
gugacaaacauuu

SEQ ID NO: 2089341 - RNA, 20 nt, Staphylococcus aureus subsp. aureus MW2
gugaaucuuauuuuguuuua

SEQ ID NO: 2089342 - RNA, 19 nt, Staphylococcus aureus subsp. aureus MW2
gugaauuuucagcaucuac

SEQ ID NO: 2089343 - RNA, 16 nt, Staphylococcus aureus subsp. aureus MW2
gugaaucuaaacuaua

SEQ ID NO: 2089344 - RNA, 15 nt, Staphylococcus aureus subsp. aureus MW2
gugagggccccaaca

SEQ ID NO: 2089345 - RNA, 12 nt, Staphylococcus aureus subsp. aureus MW2
gugauaucuugc

SEQ ID NO: 2089346 - RNA, 19 nt, Staphylococcus aureus subsp. aureus MW2
gugauauaugaaauauuua

SEQ ID NO: 2089347 - RNA, 17 nt, Staphylococcus aureus subsp. aureus MW2
gugauaauguacaugua

SEQ ID NO: 2089348 - RNA, 15 nt, Staphylococcus aureus subsp. aureus MW2
gugauaauuaaaaua

SEQ ID NO: 2089349 - RNA, 16 nt, Staphylococcus aureus subsp. aureus MW2
gugauaaauaaugcau

SEQ ID NO: 2089350 - RNA, 17 nt, Staphylococcus aureus subsp. aureus MW2
gugauaaauagaaacag

SEQ ID NO: 2089351 - RNA, 20 nt, Staphylococcus aureus subsp. aureus MW2
gugaguuaccauauuuuuua

SEQ ID NO: 2089352 - RNA, 11 nt, Staphylococcus aureus subsp. aureus MW2
gugauaaaaau

SEQ ID NO: 2089353 - RNA, 21 nt, Staphylococcus aureus subsp. aureus MW2
gugaccaauagaauucauuaa

SEQ ID NO: 2089354 - RNA, 21 nt, Staphylococcus aureus subsp. aureus MW2
gugacaucguugcuuuuauuu

SEQ ID NO: 2089355 - RNA, 22 nt, Staphylococcus aureus subsp. aureus MW2
gugccggcuuuuucuuuuguuu

SEQ ID NO: 2089356 - RNA, 15 nt, Staphylococcus aureus subsp. aureus MW2
gugccucauccuuuu

SEQ ID NO: 2089357 - RNA, 17 nt, Staphylococcus aureus subsp. aureus MW2
gugcaggauaacguuca

SEQ ID NO: 2089358 - RNA, 14 nt, Staphylococcus aureus subsp. aureus MW2
gugcaucuuuuggu

SEQ ID NO: 2089359 - RNA, 16 nt, Staphylococcus aureus subsp. aureus MW2
gugcaugaugaacuua

SEQ ID NO: 2089360 - RNA, 16 nt, Staphylococcus aureus subsp. aureus MW2
gugauuuuuaauaauu

SEQ ID NO: 2089361 - RNA, 19 nt, Staphylococcus aureus subsp. aureus MW2
gugauuuggaauacuuuuc

SEQ ID NO: 2089362 - RNA, 17 nt, Staphylococcus aureus subsp. aureus MW2
gugauuuguuacuucua

SEQ ID NO: 2089363 - RNA, 17 nt, Staphylococcus aureus subsp. aureus MW2
gugcaacaaaagugcca

SEQ ID NO: 2089364 - RNA, 21 nt, Staphylococcus aureus subsp. aureus MW2
guucaauaguaccaugcucuu

SEQ ID NO: 2089365 - RNA, 18 nt, Staphylococcus aureus subsp. aureus MW2
guucaacuaaauuuucua

SEQ ID NO: 2089366 - RNA, 12 nt, Staphylococcus aureus subsp. aureus MW2
guucaaguauau

SEQ ID NO: 2089367 - RNA, 14 nt, Staphylococcus aureus subsp. aureus MW2
guuaugguguguug

SEQ ID NO: 2089368 - RNA, 17 nt, Staphylococcus aureus subsp. aureus MW2
guuaugguguguuggug

SEQ ID NO: 2089369 - RNA, 17 nt, Staphylococcus aureus subsp. aureus MW2
guuauuaucguaaaaaa

SEQ ID NO: 2089370 - RNA, 17 nt, Staphylococcus aureus subsp. aureus MW2
guuauuaaaauuaaaua

SEQ ID NO: 2089371 - RNA, 17 nt, Staphylococcus aureus subsp. aureus MW2
guuaugugcuaaucuau

SEQ ID NO: 2089372 - RNA, 22 nt, Staphylococcus aureus subsp. aureus MW2
guuauauuggcgggccccaaca

SEQ ID NO: 2089373 - RNA, 22 nt, Staphylococcus aureus subsp. aureus MW2
guuauauuguauuuuauuuauu

SEQ ID NO: 2089374 - RNA, 16 nt, Staphylococcus aureus subsp. aureus MW2
guuauaaauucuaucu

SEQ ID NO: 2089375 - RNA, 13 nt, Staphylococcus aureus subsp. aureus MW2
guuauaaaaugaa

SEQ ID NO: 2089376 - RNA, 14 nt, Staphylococcus aureus subsp. aureus MW2
guuauaccauauuu

SEQ ID NO: 2089377 - RNA, 13 nt, Staphylococcus aureus subsp. aureus MW2
guuacauuugaag

SEQ ID NO: 2089378 - RNA, 19 nt, Staphylococcus aureus subsp. aureus MW2
guuaccaaaauuugaaaua

SEQ ID NO: 2089379 - RNA, 15 nt, Staphylococcus aureus subsp. aureus MW2
guuacccuuuuucaa

SEQ ID NO: 2089380 - RNA, 21 nt, Staphylococcus aureus subsp. aureus MW2
guuaguauaaacguccaaaca

SEQ ID NO: 2089381 - RNA, 16 nt, Staphylococcus aureus subsp. aureus MW2
guuagcuauauuuuuu

SEQ ID NO: 2089382 - RNA, 16 nt, Staphylococcus aureus subsp. aureus MW2
guucacccaagcaugu

SEQ ID NO: 2089383 - RNA, 17 nt, Staphylococcus aureus subsp. aureus MW2
guucacaugaauuuuaa

SEQ ID NO: 2089384 - RNA, 15 nt, Staphylococcus aureus subsp. aureus MW2
guucaucuaaaauua

SEQ ID NO: 2089385 - RNA, 19 nt, Staphylococcus aureus subsp. aureus MW2
guucuccgaucaugccuuc

SEQ ID NO: 2089386 - RNA, 17 nt, Staphylococcus aureus subsp. aureus MW2
guucucguguaaaaugc

SEQ ID NO: 2089387 - RNA, 14 nt, Staphylococcus aureus subsp. aureus MW2
guguccuaauaagu

SEQ ID NO: 2089388 - RNA, 19 nt, Staphylococcus aureus subsp. aureus MW2
gugucuaacgcuguuucaa

SEQ ID NO: 2089389 - RNA, 18 nt, Staphylococcus aureus subsp. aureus MW2
guguggauuuaauuuuua

SEQ ID NO: 2089390 - RNA, 14 nt, Staphylococcus aureus subsp. aureus MW2
guguaugauagaau

SEQ ID NO: 2089391 - RNA, 13 nt, Staphylococcus aureus subsp. aureus MW2
guguauacaaggc

SEQ ID NO: 2089392 - RNA, 15 nt, Staphylococcus aureus subsp. aureus MW2
guguagccaaauaaa

SEQ ID NO: 2089393 - RNA, 16 nt, Staphylococcus aureus subsp. aureus MW2
gugucauaauccauuc

SEQ ID NO: 2089394 - RNA, 22 nt, Staphylococcus aureus subsp. aureus MW2
guguauuugaaagcauuuaaau

SEQ ID NO: 2089395 - RNA, 15 nt, Staphylococcus aureus subsp. aureus MW2
guguuaugaauuaga

SEQ ID NO: 2089396 - RNA, 11 nt, Staphylococcus aureus subsp. aureus MW2
guuaaaaagac

SEQ ID NO: 2089397 - RNA, 14 nt, Staphylococcus aureus subsp. aureus MW2
guuaaaaaauaugu

SEQ ID NO: 2089398 - RNA, 16 nt, Staphylococcus aureus subsp. aureus MW2
guuaaaaaauauguau

SEQ ID NO: 2089399 - RNA, 16 nt, Staphylococcus aureus subsp. aureus MW2
guuaaaaccuuuucaa

SEQ ID NO: 2089400 - RNA, 14 nt, Staphylococcus aureus subsp. aureus MW2
guuaaauucuaaaa

SEQ ID NO: 2089401 - RNA, 14 nt, Staphylococcus aureus subsp. aureus MW2
guuaacaucuucau

SEQ ID NO: 2089402 - RNA, 19 nt, Staphylococcus aureus subsp. aureus MW2
guuaacauuugucauaaua

SEQ ID NO: 2089403 - RNA, 21 nt, Staphylococcus aureus subsp. aureus MW2
guuaacauuugucauaauaga

SEQ ID NO: 2089404 - RNA, 15 nt, Staphylococcus aureus subsp. aureus MW2
guuaacgauauugcu

SEQ ID NO: 2089405 - RNA, 23 nt, Staphylococcus aureus subsp. aureus MW2
guuaauccgauuuugauauaaaa

SEQ ID NO: 2089406 - RNA, 13 nt, Staphylococcus aureus subsp. aureus MW2
guuaaucauacau

SEQ ID NO: 2089407 - RNA, 17 nt, Staphylococcus aureus subsp. aureus MW2
guggacguugaucuuug

SEQ ID NO: 2089408 - RNA, 22 nt, Staphylococcus aureus subsp. aureus MW2
guggcaccucuuuuguuuagua

SEQ ID NO: 2089409 - RNA, 20 nt, Staphylococcus aureus subsp. aureus MW2
guggaaaucucggcauuuuu

SEQ ID NO: 2089410 - RNA, 14 nt, Staphylococcus aureus subsp. aureus MW2
gugcuuuaaaggca

SEQ ID NO: 2089411 - RNA, 19 nt, Staphylococcus aureus subsp. aureus MW2
gugggcuccaaacauagag

SEQ ID NO: 2089412 - RNA, 21 nt, Staphylococcus aureus subsp. aureus MW2
guaaucagguuuaaacaguuu

SEQ ID NO: 2089413 - RNA, 21 nt, Staphylococcus aureus subsp. aureus MW2
guaauacuauaugaaaagaga

SEQ ID NO: 2089414 - RNA, 22 nt, Staphylococcus aureus subsp. aureus MW2
guaaucacuauuuguuguuaua

SEQ ID NO: 2089415 - RNA, 20 nt, Staphylococcus aureus subsp. aureus MW2
guaauccauucccuuuucau

SEQ ID NO: 2089416 - RNA, 15 nt, Staphylococcus aureus subsp. aureus MW2
guaauaauaucaccu

SEQ ID NO: 2089417 - RNA, 16 nt, Staphylococcus aureus subsp. aureus MW2
guaauaauauaaauaa

SEQ ID NO: 2089418 - RNA, 19 nt, Staphylococcus aureus subsp. aureus MW2
guaauaauucagaugaaua

SEQ ID NO: 2089419 - RNA, 19 nt, Staphylococcus aureus subsp. aureus MW2
guaauaccuuuacuuucau

SEQ ID NO: 2089420 - RNA, 19 nt, Staphylococcus aureus subsp. aureus MW2
guaauacaucaucaaguuc

SEQ ID NO: 2089421 - RNA, 16 nt, Staphylococcus aureus subsp. aureus MW2
guaauaaguaauaauu

SEQ ID NO: 2089422 - RNA, 15 nt, Staphylococcus aureus subsp. aureus MW2
guaauucuuguaaau

SEQ ID NO: 2089423 - RNA, 11 nt, Staphylococcus aureus subsp. aureus MW2
guaauuguaau

SEQ ID NO: 2089424 - RNA, 23 nt, Staphylococcus aureus subsp. aureus MW2
guaauuauuuuucucaacaguuu

SEQ ID NO: 2089425 - RNA, 16 nt, Staphylococcus aureus subsp. aureus MW2
guaauucauuugcuuu

SEQ ID NO: 2089426 - RNA, 13 nt, Staphylococcus aureus subsp. aureus MW2
guaauuauuuuuc

SEQ ID NO: 2089427 - RNA, 16 nt, Staphylococcus aureus subsp. aureus MW2
guaaugauuuugcuuu

SEQ ID NO: 2089428 - RNA, 12 nt, Staphylococcus aureus subsp. aureus MW2
guaaugauuuug

SEQ ID NO: 2089429 - RNA, 23 nt, Staphylococcus aureus subsp. aureus MW2
guaaucauuauagcagguggcau

SEQ ID NO: 2089430 - RNA, 21 nt, Staphylococcus aureus subsp. aureus MW2
guacaauaauaccuucaauug

SEQ ID NO: 2089431 - RNA, 14 nt, Staphylococcus aureus subsp. aureus MW2
guacaaauaauaca

SEQ ID NO: 2089432 - RNA, 11 nt, Staphylococcus aureus subsp. aureus MW2
guacaaauaac

SEQ ID NO: 2089433 - RNA, 12 nt, Staphylococcus aureus subsp. aureus MW2
guacaaauaaua

SEQ ID NO: 2089434 - RNA, 17 nt, Staphylococcus aureus subsp. aureus MW2
guaauuuuuaaaucuac

SEQ ID NO: 2089435 - RNA, 19 nt, Staphylococcus aureus subsp. aureus MW2
guacaguaauauucaacuu

SEQ ID NO: 2089436 - RNA, 18 nt, Staphylococcus aureus subsp. aureus MW2
guacauaaauagugaaau

SEQ ID NO: 2089437 - RNA, 17 nt, Staphylococcus aureus subsp. aureus MW2
guacauaaaugcuaaaa

SEQ ID NO: 2089438 - RNA, 14 nt, Staphylococcus aureus subsp. aureus MW2
guacagauaagaau

SEQ ID NO: 2089439 - RNA, 15 nt, Staphylococcus aureus subsp. aureus MW2
guacuuucaaauaau

SEQ ID NO: 2089440 - RNA, 23 nt, Staphylococcus aureus subsp. aureus MW2
guagaaaauagcuguuugauauu

SEQ ID NO: 2089441 - RNA, 14 nt, Staphylococcus aureus subsp. aureus MW2
guacgauucaauuu

SEQ ID NO: 2089442 - RNA, 22 nt, Staphylococcus aureus subsp. aureus MW2
guacgcaauuuaauauuauaag

SEQ ID NO: 2089443 - RNA, 19 nt, Staphylococcus aureus subsp. aureus MW2
guacgcaauuuaauauuau

SEQ ID NO: 2089444 - RNA, 15 nt, Staphylococcus aureus subsp. aureus MW2
guacgaggaccaucu

SEQ ID NO: 2089445 - RNA, 21 nt, Staphylococcus aureus subsp. aureus MW2
guaccacucauaaucaagucu

SEQ ID NO: 2089446 - RNA, 17 nt, Staphylococcus aureus subsp. aureus MW2
guacauauguuguuucu

SEQ ID NO: 2089447 - RNA, 15 nt, Staphylococcus aureus subsp. aureus MW2
guaccaauuagcaug

SEQ ID NO: 2089448 - RNA, 15 nt, Staphylococcus aureus subsp. aureus MW2
guagaaacacaagga

SEQ ID NO: 2089449 - RNA, 14 nt, Staphylococcus aureus subsp. aureus MW2
guagcaaugacgac

SEQ ID NO: 2089450 - RNA, 14 nt, Staphylococcus aureus subsp. aureus MW2
guagccaaauaaau

SEQ ID NO: 2089451 - RNA, 18 nt, Staphylococcus aureus subsp. aureus MW2
guagcuugaauaauauau

SEQ ID NO: 2089452 - RNA, 14 nt, Staphylococcus aureus subsp. aureus MW2
guagcuugaauaau

SEQ ID NO: 2089453 - RNA, 22 nt, Staphylococcus aureus subsp. aureus MW2
guagcuuaacguugcagagaau

SEQ ID NO: 2089454 - RNA, 19 nt, Staphylococcus aureus subsp. aureus MW2
guaucaacauuaauaaaua

SEQ ID NO: 2089455 - RNA, 16 nt, Staphylococcus aureus subsp. aureus MW2
guaucaacauuaauaa

SEQ ID NO: 2089456 - RNA, 17 nt, Staphylococcus aureus subsp. aureus MW2
guauagauuuuauaaaa

SEQ ID NO: 2089457 - RNA, 20 nt, Staphylococcus aureus subsp. aureus MW2
guaucauuguguccauaaau

SEQ ID NO: 2089458 - RNA, 16 nt, Staphylococcus aureus subsp. aureus MW2
guaucaucaaaauuua

SEQ ID NO: 2089459 - RNA, 21 nt, Staphylococcus aureus subsp. aureus MW2
guaucacuaggauguucauca

SEQ ID NO: 2089460 - RNA, 20 nt, Staphylococcus aureus subsp. aureus MW2
guauccccauuuauguguug

SEQ ID NO: 2089461 - RNA, 20 nt, Staphylococcus aureus subsp. aureus MW2
guaucccaaccaugcuuuuu

SEQ ID NO: 2089462 - RNA, 21 nt, Staphylococcus aureus subsp. aureus MW2
guauccuguguaaaauaaauc

SEQ ID NO: 2089463 - RNA, 16 nt, Staphylococcus aureus subsp. aureus MW2
guauccucaguauuua

SEQ ID NO: 2089464 - RNA, 22 nt, Staphylococcus aureus subsp. aureus MW2
guauuacacgcauuacuuuaga

SEQ ID NO: 2089465 - RNA, 15 nt, Staphylococcus aureus subsp. aureus MW2
guauuaaacauugcu

SEQ ID NO: 2089466 - RNA, 20 nt, Staphylococcus aureus subsp. aureus MW2
guauuaaauuucaaauauaa

SEQ ID NO: 2089467 - RNA, 21 nt, Staphylococcus aureus subsp. aureus MW2
guauguaagcagacuaaaagu

SEQ ID NO: 2089468 - RNA, 15 nt, Staphylococcus aureus subsp. aureus MW2
guauguaucuuucuu

SEQ ID NO: 2089469 - RNA, 18 nt, Staphylococcus aureus subsp. aureus MW2
guauggaauaaaugguuu

SEQ ID NO: 2089470 - RNA, 13 nt, Staphylococcus aureus subsp. aureus MW2
guauggaauaaau

SEQ ID NO: 2089471 - RNA, 22 nt, Staphylococcus aureus subsp. aureus MW2
guaugcuuguacaaaaaauugu

SEQ ID NO: 2089472 - RNA, 19 nt, Staphylococcus aureus subsp. aureus MW2
guaugcccucauaaaucau

SEQ ID NO: 2089473 - RNA, 23 nt, Staphylococcus aureus subsp. aureus MW2
guaucuaguguucucauuauaau

SEQ ID NO: 2089474 - RNA, 15 nt, Staphylococcus aureus subsp. aureus MW2
guauccuuuauaaau

SEQ ID NO: 2089475 - RNA, 20 nt, Staphylococcus aureus subsp. aureus MW2
guaucgauaguucuauauaa

SEQ ID NO: 2089476 - RNA, 17 nt, Staphylococcus aureus subsp. aureus MW2
guaucgccaaucuauug

SEQ ID NO: 2089477 - RNA, 21 nt, Staphylococcus aureus subsp. aureus MW2
guaugauagaauacuaaaagu

SEQ ID NO: 2089478 - RNA, 19 nt, Staphylococcus aureus subsp. aureus MW2
guaugauagaauacuaaaa

SEQ ID NO: 2089479 - RNA, 15 nt, Staphylococcus aureus subsp. aureus MW2
guaucuuucuuuccg

SEQ ID NO: 2089480 - RNA, 20 nt, Staphylococcus aureus subsp. aureus MW2
guaucucugaaaaacuucuu

SEQ ID NO: 2089481 - RNA, 22 nt, Staphylococcus aureus subsp. aureus MW2
guaucucugaaaaacuucuuaa

SEQ ID NO: 2089482 - RNA, 23 nt, Staphylococcus aureus subsp. aureus MW2
gucaaacggcacuaauauuuaaa

SEQ ID NO: 2089483 - RNA, 16 nt, Staphylococcus aureus subsp. aureus MW2
gucaauauuguaggga

SEQ ID NO: 2089484 - RNA, 13 nt, Staphylococcus aureus subsp. aureus MW2
guauugaaauaau

SEQ ID NO: 2089485 - RNA, 19 nt, Staphylococcus aureus subsp. aureus MW2
guauucuuggcguauuuuu

SEQ ID NO: 2089486 - RNA, 12 nt, Staphylococcus aureus subsp. aureus MW2
guauugauucaa

SEQ ID NO: 2089487 - RNA, 19 nt, Staphylococcus aureus subsp. aureus MW2
guauucuauuuuucaauuc

SEQ ID NO: 2089488 - RNA, 16 nt, Staphylococcus aureus subsp. aureus MW2
guauucgcuuacauua

SEQ ID NO: 2089489 - RNA, 22 nt, Staphylococcus aureus subsp. aureus MW2
guauuaugauugcuuauuuauu

SEQ ID NO: 2089490 - RNA, 13 nt, Staphylococcus aureus subsp. aureus MW2
guauuauuauaau

SEQ ID NO: 2089491 - RNA, 17 nt, Staphylococcus aureus subsp. aureus MW2
guauuauuauaauuuug

SEQ ID NO: 2089492 - RNA, 13 nt, Staphylococcus aureus subsp. aureus MW2
guauuaucuuuca

SEQ ID NO: 2089493 - RNA, 23 nt, Staphylococcus aureus subsp. aureus MW2
guauuauuauaauuuuguuucac

SEQ ID NO: 2089494 - RNA, 19 nt, Staphylococcus aureus subsp. aureus MW2
guauuauucucucauuugu

SEQ ID NO: 2089495 - RNA, 16 nt, Staphylococcus aureus subsp. aureus MW2
guauuacuugaaaaua

SEQ ID NO: 2089496 - RNA, 17 nt, Staphylococcus aureus subsp. aureus MW2
guauuagaacuucucuu

SEQ ID NO: 2089497 - RNA, 19 nt, Staphylococcus aureus subsp. aureus MW2
guauuagccaauaaaaugu

SEQ ID NO: 2089498 - RNA, 16 nt, Staphylococcus aureus subsp. aureus MW2
guauuaggaaugacau

SEQ ID NO: 2089499 - RNA, 21 nt, Staphylococcus aureus subsp. aureus MW2
guauucagucaguaaaaauac

SEQ ID NO: 2089500 - RNA, 18 nt, Staphylococcus aureus subsp. aureus MW2
guauuuauacuauaaaua

SEQ ID NO: 2089501 - RNA, 16 nt, Staphylococcus aureus subsp. aureus MW2
guauuuaccuucuucu

SEQ ID NO: 2089502 - RNA, 20 nt, Staphylococcus aureus subsp. aureus MW2
guauuuuaaugauuuuucau

SEQ ID NO: 2089503 - RNA, 22 nt, Staphylococcus aureus subsp. aureus MW2
guauuuucugcuguauggaaag

SEQ ID NO: 2089504 - RNA, 14 nt, Staphylococcus aureus subsp. aureus MW2
guauuuuuaagcug

SEQ ID NO: 2089505 - RNA, 15 nt, Staphylococcus aureus subsp. aureus MW2
guccacagaugcauc

SEQ ID NO: 2089506 - RNA, 18 nt, Staphylococcus aureus subsp. aureus MW2
gucaugucuagauuucaa

SEQ ID NO: 2089507 - RNA, 13 nt, Staphylococcus aureus subsp. aureus MW2
guccaauaaauuu

SEQ ID NO: 2089508 - RNA, 11 nt, Staphylococcus aureus subsp. aureus MW2
gucaucaacac

SEQ ID NO: 2089509 - RNA, 14 nt, Staphylococcus aureus subsp. aureus MW2
gucaucaacacaca

SEQ ID NO: 2089510 - RNA, 18 nt, Staphylococcus aureus subsp. aureus MW2
gucauauguuuuauaaua

SEQ ID NO: 2089511 - RNA, 20 nt, Staphylococcus aureus subsp. aureus MW2
gucauauacuauaugucuua

SEQ ID NO: 2089512 - RNA, 22 nt, Staphylococcus aureus subsp. aureus MW2
gucaucaucaugauuacuaaua

SEQ ID NO: 2089513 - RNA, 19 nt, Staphylococcus aureus subsp. aureus MW2
gucaucaugauuauuucgc

SEQ ID NO: 2089514 - RNA, 15 nt, Staphylococcus aureus subsp. aureus MW2
gucauccaaagaaac

SEQ ID NO: 2089515 - RNA, 14 nt, Staphylococcus aureus subsp. aureus MW2
guccagcuaauaac

SEQ ID NO: 2089516 - RNA, 12 nt, Staphylococcus aureus subsp. aureus MW2
gucgaauuuuuu

SEQ ID NO: 2089517 - RNA, 19 nt, Staphylococcus aureus subsp. aureus MW2
gucgaagaagauuaugaaa

SEQ ID NO: 2089518 - RNA, 22 nt, Staphylococcus aureus subsp. aureus MW2
gucgaaaauagcuauuaaaaua

SEQ ID NO: 2089519 - RNA, 17 nt, Staphylococcus aureus subsp. aureus MW2
guccauuuccaugaaua

SEQ ID NO: 2089520 - RNA, 15 nt, Staphylococcus aureus subsp. aureus MW2
gucccaccccaacuu

SEQ ID NO: 2089521 - RNA, 18 nt, Staphylococcus aureus subsp. aureus MW2
gucccaccccaacuugca

SEQ ID NO: 2089522 - RNA, 14 nt, Staphylococcus aureus subsp. aureus MW2
gucgguucaucuaa

SEQ ID NO: 2089523 - RNA, 14 nt, Staphylococcus aureus subsp. aureus MW2
gucucauuaucacc

SEQ ID NO: 2089524 - RNA, 15 nt, Staphylococcus aureus subsp. aureus MW2
gucuccaauacuuuu

SEQ ID NO: 2089525 - RNA, 15 nt, Staphylococcus aureus subsp. aureus MW2
gucuccauuauaaag

SEQ ID NO: 2089526 - RNA, 18 nt, Staphylococcus aureus subsp. aureus MW2
gucucacuuaauaaauaa

SEQ ID NO: 2089527 - RNA, 21 nt, Staphylococcus aureus subsp. aureus MW2
gucuaucuccgcuacaauuau

SEQ ID NO: 2089528 - RNA, 14 nt, Staphylococcus aureus subsp. aureus MW2
gucuauuauguacc

SEQ ID NO: 2089529 - RNA, 12 nt, Staphylococcus aureus subsp. aureus MW2
gucuaaaaaugu

SEQ ID NO: 2089530 - RNA, 24 nt, Staphylococcus aureus subsp. aureus MW2
gucuaaaaaugucguauauguaau

SEQ ID NO: 2089531 - RNA, 17 nt, Staphylococcus aureus subsp. aureus MW2
gucuaaagcuuauuaaa

SEQ ID NO: 2089532 - RNA, 21 nt, Staphylococcus aureus subsp. aureus MW2
gucguuuaccgucuuuugcaa

SEQ ID NO: 2089533 - RNA, 19 nt, Staphylococcus aureus subsp. aureus MW2
gucuaucgccuaaaaauaa

SEQ ID NO: 2089534 - RNA, 14 nt, Staphylococcus aureus subsp. aureus MW2
gucuacgaucaaaa

SEQ ID NO: 2089535 - RNA, 16 nt, Staphylococcus aureus subsp. aureus MW2
gucuaauguuggaaaa

SEQ ID NO: 2089536 - RNA, 19 nt, Staphylococcus aureus subsp. aureus MW2
gucuaaucgacuuuuacaa

SEQ ID NO: 2089537 - RNA, 13 nt, Staphylococcus aureus subsp. aureus MW2
gucggggccccaa

SEQ ID NO: 2089538 - RNA, 19 nt, Staphylococcus aureus subsp. aureus MW2
gucggggccccaacacaga

SEQ ID NO: 2089539 - RNA, 20 nt, Staphylococcus aureus subsp. aureus MW2
gucggggccccaacacagag

SEQ ID NO: 2089540 - RNA, 22 nt, Staphylococcus aureus subsp. aureus MW2
gucggggccccaacacagagaa

SEQ ID NO: 2089541 - RNA, 21 nt, Staphylococcus aureus subsp. aureus MW2
gucgcuaaagaccuuucuuga

SEQ ID NO: 2089542 - RNA, 14 nt, Staphylococcus aureus subsp. aureus MW2
ggcuuuguuuuuca

SEQ ID NO: 2089543 - RNA, 22 nt, Staphylococcus aureus subsp. aureus MW2
ggcuuuuuauaccaauaauuac

SEQ ID NO: 2089544 - RNA, 17 nt, Staphylococcus aureus subsp. aureus MW2
ggcuuaugcauagcucu

SEQ ID NO: 2089545 - RNA, 16 nt, Staphylococcus aureus subsp. aureus MW2
ggcuucauguucuuaa

SEQ ID NO: 2089546 - RNA, 11 nt, Staphylococcus aureus subsp. aureus MW2
ggguaauacua

SEQ ID NO: 2089547 - RNA, 12 nt, Staphylococcus aureus subsp. aureus MW2
ggguaauguuuu

SEQ ID NO: 2089548 - RNA, 20 nt, Staphylococcus aureus subsp. aureus MW2
gggcuagagcguuuugcuuu

SEQ ID NO: 2089549 - RNA, 21 nt, Staphylococcus aureus subsp. aureus MW2
gggcuauuugauacaacuaua

SEQ ID NO: 2089550 - RNA, 15 nt, Staphylococcus aureus subsp. aureus MW2
ggggaugggccccaa

SEQ ID NO: 2089551 - RNA, 23 nt, Staphylococcus aureus subsp. aureus MW2
gggcuguuuuuuaaugcuuuaaa

SEQ ID NO: 2089552 - RNA, 23 nt, Staphylococcus aureus subsp. aureus MW2
ggggccccaacauagaagcuggc

SEQ ID NO: 2089553 - RNA, 23 nt, Staphylococcus aureus subsp. aureus MW2
ggggccccaacaaagaagcuggc

SEQ ID NO: 2089554 - RNA, 12 nt, Staphylococcus aureus subsp. aureus MW2
ggggccccgcca

SEQ ID NO: 2089555 - RNA, 18 nt, Staphylococcus aureus subsp. aureus MW2
gguauccuucucaucauu

SEQ ID NO: 2089556 - RNA, 17 nt, Staphylococcus aureus subsp. aureus MW2
gguauagauuuuauaaa

SEQ ID NO: 2089557 - RNA, 21 nt, Staphylococcus aureus subsp. aureus MW2
gguccaaaucgugauaucuug

SEQ ID NO: 2089558 - RNA, 22 nt, Staphylococcus aureus subsp. aureus MW2
ggucauuuaaacaacugaguca

SEQ ID NO: 2089559 - RNA, 14 nt, Staphylococcus aureus subsp. aureus MW2
ggucacuuuuaauc

SEQ ID NO: 2089560 - RNA, 13 nt, Staphylococcus aureus subsp. aureus MW2
ggugagggcccca

SEQ ID NO: 2089561 - RNA, 13 nt, Staphylococcus aureus subsp. aureus MW2
ggucugcuguauc

SEQ ID NO: 2089562 - RNA, 11 nt, Staphylococcus aureus subsp. aureus MW2
gguuugagaau

SEQ ID NO: 2089563 - RNA, 18 nt, Staphylococcus aureus subsp. aureus MW2
gguuuuauuuuuggauuc

SEQ ID NO: 2089564 - RNA, 21 nt, Staphylococcus aureus subsp. aureus MW2
gguuuaucagcuuuaauaaua

SEQ ID NO: 2089565 - RNA, 21 nt, Staphylococcus aureus subsp. aureus MW2
guaaaacauucccuuaauaau

SEQ ID NO: 2089566 - RNA, 20 nt, Staphylococcus aureus subsp. aureus MW2
guaaaaccaaaucguuucau

SEQ ID NO: 2089567 - RNA, 23 nt, Staphylococcus aureus subsp. aureus MW2
guaaaacaaauuacacccuuuaa

SEQ ID NO: 2089568 - RNA, 20 nt, Staphylococcus aureus subsp. aureus MW2
guaaaaagugguuaauaaca

SEQ ID NO: 2089569 - RNA, 21 nt, Staphylococcus aureus subsp. aureus MW2
guaaaaagugguuaauaacag

SEQ ID NO: 2089570 - RNA, 14 nt, Staphylococcus aureus subsp. aureus MW2
guaaaaauuaacaa

SEQ ID NO: 2089571 - RNA, 21 nt, Staphylococcus aureus subsp. aureus MW2
gguuuaaacaguuuaauucgu

SEQ ID NO: 2089572 - RNA, 19 nt, Staphylococcus aureus subsp. aureus MW2
gguuguuuuucaucauuaa

SEQ ID NO: 2089573 - RNA, 18 nt, Staphylococcus aureus subsp. aureus MW2
gguucccaauucggauua

SEQ ID NO: 2089574 - RNA, 15 nt, Staphylococcus aureus subsp. aureus MW2
gguucaucuaaaauu

SEQ ID NO: 2089575 - RNA, 11 nt, Staphylococcus aureus subsp. aureus MW2
gguucaaaucc

SEQ ID NO: 2089576 - RNA, 17 nt, Staphylococcus aureus subsp. aureus MW2
gguguugaaaaguaauu

SEQ ID NO: 2089577 - RNA, 15 nt, Staphylococcus aureus subsp. aureus MW2
gguuaccaucuuuaa

SEQ ID NO: 2089578 - RNA, 13 nt, Staphylococcus aureus subsp. aureus MW2
gguuagaaaaaaa

SEQ ID NO: 2089579 - RNA, 14 nt, Staphylococcus aureus subsp. aureus MW2
gguuagaaaaaaau

SEQ ID NO: 2089580 - RNA, 12 nt, Staphylococcus aureus subsp. aureus MW2
ggugucaauaaa

SEQ ID NO: 2089581 - RNA, 22 nt, Staphylococcus aureus subsp. aureus MW2
cuccaagauuaugacaacauaa

SEQ ID NO: 2089582 - RNA, 15 nt, Staphylococcus aureus subsp. aureus MW2
cuccaaucaucauua

SEQ ID NO: 2089583 - RNA, 19 nt, Staphylococcus aureus subsp. aureus MW2
cuccaauacuuuuuauaua

SEQ ID NO: 2089584 - RNA, 12 nt, Staphylococcus aureus subsp. aureus MW2
cuccaaacauag

SEQ ID NO: 2089585 - RNA, 20 nt, Staphylococcus aureus subsp. aureus MW2
cuccaagauuaugacaacau

SEQ ID NO: 2089586 - RNA, 17 nt, Staphylococcus aureus subsp. aureus MW2
cuccaacucuaacagcu

SEQ ID NO: 2089587 - RNA, 23 nt, Staphylococcus aureus subsp. aureus MW2
cucauuuuuuuaauuauuucccu

SEQ ID NO: 2089588 - RNA, 14 nt, Staphylococcus aureus subsp. aureus MW2
cucauuuuuuuaau

SEQ ID NO: 2089589 - RNA, 20 nt, Staphylococcus aureus subsp. aureus MW2
cucauuuuuuuaauuauuuc

SEQ ID NO: 2089590 - RNA, 20 nt, Staphylococcus aureus subsp. aureus MW2
cucauuuuuauaaauuuugg

SEQ ID NO: 2089591 - RNA, 14 nt, Staphylococcus aureus subsp. aureus MW2
cucauguuucagua

SEQ ID NO: 2089592 - RNA, 16 nt, Staphylococcus aureus subsp. aureus MW2
cucauuaaccuuacau

SEQ ID NO: 2089593 - RNA, 13 nt, Staphylococcus aureus subsp. aureus MW2
cucauuaauaaau

SEQ ID NO: 2089594 - RNA, 13 nt, Staphylococcus aureus subsp. aureus MW2
cucauuauuguug

SEQ ID NO: 2089595 - RNA, 15 nt, Staphylococcus aureus subsp. aureus MW2
cucauuaauuuuucg

SEQ ID NO: 2089596 - RNA, 14 nt, Staphylococcus aureus subsp. aureus MW2
cucccauccccuuu

SEQ ID NO: 2089597 - RNA, 16 nt, Staphylococcus aureus subsp. aureus MW2
cuccauuagcuaauuc

SEQ ID NO: 2089598 - RNA, 17 nt, Staphylococcus aureus subsp. aureus MW2
cuccauuauaaagccug

SEQ ID NO: 2089599 - RNA, 14 nt, Staphylococcus aureus subsp. aureus MW2
cuccccaacuuaau

SEQ ID NO: 2089600 - RNA, 17 nt, Staphylococcus aureus subsp. aureus MW2
cuccuaaagcugcaauu

SEQ ID NO: 2089601 - RNA, 18 nt, Staphylococcus aureus subsp. aureus MW2
cuccuaaagcugcaauua

SEQ ID NO: 2089602 - RNA, 19 nt, Staphylococcus aureus subsp. aureus MW2
cuccguauuuaccuucuuc

SEQ ID NO: 2089603 - RNA, 15 nt, Staphylococcus aureus subsp. aureus MW2
cuccgaucaugccuu

SEQ ID NO: 2089604 - RNA, 14 nt, Staphylococcus aureus subsp. aureus MW2
cucuaaaggaaagc

SEQ ID NO: 2089605 - RNA, 15 nt, Staphylococcus aureus subsp. aureus MW2
cucuaaaacuuuuuc

SEQ ID NO: 2089606 - RNA, 20 nt, Staphylococcus aureus subsp. aureus MW2
cucuaacuuuaccaauauca

SEQ ID NO: 2089607 - RNA, 18 nt, Staphylococcus aureus subsp. aureus MW2
cucuaacuuuaccaauau

SEQ ID NO: 2089608 - RNA, 22 nt, Staphylococcus aureus subsp. aureus MW2
cucuaauucaaugauuuuuaaa

SEQ ID NO: 2089609 - RNA, 16 nt, Staphylococcus aureus subsp. aureus MW2
cucuaaauaaaauuaa

SEQ ID NO: 2089610 - RNA, 14 nt, Staphylococcus aureus subsp. aureus MW2
cucgugaaaagcag

SEQ ID NO: 2089611 - RNA, 19 nt, Staphylococcus aureus subsp. aureus MW2
cucgguacuucgcccuucc

SEQ ID NO: 2089612 - RNA, 18 nt, Staphylococcus aureus subsp. aureus MW2
cuauuuuacucuuuuuaa

SEQ ID NO: 2089613 - RNA, 21 nt, Staphylococcus aureus subsp. aureus MW2
cuauuuuccaucacauaacua

SEQ ID NO: 2089614 - RNA, 22 nt, Staphylococcus aureus subsp. aureus MW2
cuauuugcugaaugaagcauuu

SEQ ID NO: 2089615 - RNA, 19 nt, Staphylococcus aureus subsp. aureus MW2
cuauuuuuuauguuuuaau

SEQ ID NO: 2089616 - RNA, 13 nt, Staphylococcus aureus subsp. aureus MW2
cuauuuuuuuaau

SEQ ID NO: 2089617 - RNA, 20 nt, Staphylococcus aureus subsp. aureus MW2
cucaaaacaauuuaaaaagc

SEQ ID NO: 2089618 - RNA, 21 nt, Staphylococcus aureus subsp. aureus MW2
cuauuguauucgcuuacauua

SEQ ID NO: 2089619 - RNA, 17 nt, Staphylococcus aureus subsp. aureus MW2
cuauuucacucuacaau

SEQ ID NO: 2089620 - RNA, 14 nt, Staphylococcus aureus subsp. aureus MW2
cuauuuauaacacu

SEQ ID NO: 2089621 - RNA, 16 nt, Staphylococcus aureus subsp. aureus MW2
cuauuuaaaauuauug

SEQ ID NO: 2089622 - RNA, 21 nt, Staphylococcus aureus subsp. aureus MW2
cuauugauauucuaaaaaauu

SEQ ID NO: 2089623 - RNA, 17 nt, Staphylococcus aureus subsp. aureus MW2
cuauugauauucuaaaa

SEQ ID NO: 2089624 - RNA, 17 nt, Staphylococcus aureus subsp. aureus MW2
cuauuggucauuacuaa

SEQ ID NO: 2089625 - RNA, 23 nt, Staphylococcus aureus subsp. aureus MW2
cuauucguuugaauuauuuaauu

SEQ ID NO: 2089626 - RNA, 22 nt, Staphylococcus aureus subsp. aureus MW2
cuaucuccgcuacaauuauaug

SEQ ID NO: 2089627 - RNA, 12 nt, Staphylococcus aureus subsp. aureus MW2
cuaucuauuuua

SEQ ID NO: 2089628 - RNA, 14 nt, Staphylococcus aureus subsp. aureus MW2
cuaucuauuuuacu

SEQ ID NO: 2089629 - RNA, 15 nt, Staphylococcus aureus subsp. aureus MW2
cuaucuuauauuuau

SEQ ID NO: 2089630 - RNA, 15 nt, Staphylococcus aureus subsp. aureus MW2
cuaucuuguucuucu

SEQ ID NO: 2089631 - RNA, 18 nt, Staphylococcus aureus subsp. aureus MW2
cuaucuuguucuucuuua

SEQ ID NO: 2089632 - RNA, 19 nt, Staphylococcus aureus subsp. aureus MW2
cuaugaacgaaucuauaac

SEQ ID NO: 2089633 - RNA, 23 nt, Staphylococcus aureus subsp. aureus MW2
cuaugaaauuggaauagauguug

SEQ ID NO: 2089634 - RNA, 23 nt, Staphylococcus aureus subsp. aureus MW2
cuaugaauuuagcaucaaaaaua

SEQ ID NO: 2089635 - RNA, 19 nt, Staphylococcus aureus subsp. aureus MW2
cuauggcgcaauuuuuaac

SEQ ID NO: 2089636 - RNA, 16 nt, Staphylococcus aureus subsp. aureus MW2
cuauggcacaaaugaa

SEQ ID NO: 2089637 - RNA, 22 nt, Staphylococcus aureus subsp. aureus MW2
cuauuaggauccaauuuauaau

SEQ ID NO: 2089638 - RNA, 21 nt, Staphylococcus aureus subsp. aureus MW2
cuauuagggggcauauuaaua

SEQ ID NO: 2089639 - RNA, 21 nt, Staphylococcus aureus subsp. aureus MW2
cuauuauguaccaaauuuaua

SEQ ID NO: 2089640 - RNA, 14 nt, Staphylococcus aureus subsp. aureus MW2
cuauucaaauauaa

SEQ ID NO: 2089641 - RNA, 17 nt, Staphylococcus aureus subsp. aureus MW2
cucaaacuaucuuauau

SEQ ID NO: 2089642 - RNA, 22 nt, Staphylococcus aureus subsp. aureus MW2
cucaaacuaucuuauauuuaug

SEQ ID NO: 2089643 - RNA, 14 nt, Staphylococcus aureus subsp. aureus MW2
cucaaaacaauuua

SEQ ID NO: 2089644 - RNA, 19 nt, Staphylococcus aureus subsp. aureus MW2
cucaaagguuuacuauuaa

SEQ ID NO: 2089645 - RNA, 12 nt, Staphylococcus aureus subsp. aureus MW2
cucaaauauuaa

SEQ ID NO: 2089646 - RNA, 22 nt, Staphylococcus aureus subsp. aureus MW2
cucaauuaauuuagucauuaca

SEQ ID NO: 2089647 - RNA, 19 nt, Staphylococcus aureus subsp. aureus MW2
cucaauuuaguauaaauaa

SEQ ID NO: 2089648 - RNA, 14 nt, Staphylococcus aureus subsp. aureus MW2
cuaguucagcuucu

SEQ ID NO: 2089649 - RNA, 21 nt, Staphylococcus aureus subsp. aureus MW2
cuaguucuaaguguugaccau

SEQ ID NO: 2089650 - RNA, 23 nt, Staphylococcus aureus subsp. aureus MW2
cuaguuacaaugcgguauugcau

SEQ ID NO: 2089651 - RNA, 18 nt, Staphylococcus aureus subsp. aureus MW2
cuaguguucucauuauaa

SEQ ID NO: 2089652 - RNA, 18 nt, Staphylococcus aureus subsp. aureus MW2
cuagucaggggccccaac

SEQ ID NO: 2089653 - RNA, 21 nt, Staphylococcus aureus subsp. aureus MW2
cuaguauccuuuauaaauaaa

SEQ ID NO: 2089654 - RNA, 17 nt, Staphylococcus aureus subsp. aureus MW2
cuagugcauuuagauga

SEQ ID NO: 2089655 - RNA, 18 nt, Staphylococcus aureus subsp. aureus MW2
cuagugcauuuagaugau

SEQ ID NO: 2089656 - RNA, 18 nt, Staphylococcus aureus subsp. aureus MW2
cuaggaauauaaaacugu

SEQ ID NO: 2089657 - RNA, 17 nt, Staphylococcus aureus subsp. aureus MW2
cuaggaaauaaaaaaua

SEQ ID NO: 2089658 - RNA, 18 nt, Staphylococcus aureus subsp. aureus MW2
cuaguacgaaaugcauug

SEQ ID NO: 2089659 - RNA, 16 nt, Staphylococcus aureus subsp. aureus MW2
cuaguaauucuucauc

SEQ ID NO: 2089660 - RNA, 21 nt, Staphylococcus aureus subsp. aureus MW2
cuauaaauacgucaucuuuau

SEQ ID NO: 2089661 - RNA, 13 nt, Staphylococcus aureus subsp. aureus MW2
cuauaaauuauuu

SEQ ID NO: 2089662 - RNA, 17 nt, Staphylococcus aureus subsp. aureus MW2
cuauaaauacuuuugca

SEQ ID NO: 2089663 - RNA, 18 nt, Staphylococcus aureus subsp. aureus MW2
cuauaacgauagauuuuu

SEQ ID NO: 2089664 - RNA, 18 nt, Staphylococcus aureus subsp. aureus MW2
cuauacugaugaaaacuu

SEQ ID NO: 2089665 - RNA, 14 nt, Staphylococcus aureus subsp. aureus MW2
cuauacuuuuaauu

SEQ ID NO: 2089666 - RNA, 12 nt, Staphylococcus aureus subsp. aureus MW2
cuaguuguuuua

SEQ ID NO: 2089667 - RNA, 13 nt, Staphylococcus aureus subsp. aureus MW2
cuaguucuaugua

SEQ ID NO: 2089668 - RNA, 11 nt, Staphylococcus aureus subsp. aureus MW2
cuauaaacaua

SEQ ID NO: 2089669 - RNA, 15 nt, Staphylococcus aureus subsp. aureus MW2
cuauaaaauuuugaa

SEQ ID NO: 2089670 - RNA, 17 nt, Staphylococcus aureus subsp. aureus MW2
cuauaaaaguacuuuaa

SEQ ID NO: 2089671 - RNA, 23 nt, Staphylococcus aureus subsp. aureus MW2
cuauaaaaucaucguauuucaua

SEQ ID NO: 2089672 - RNA, 14 nt, Staphylococcus aureus subsp. aureus MW2
cuauaaaauucacc

SEQ ID NO: 2089673 - RNA, 16 nt, Staphylococcus aureus subsp. aureus MW2
cuauaaaauucaccaa

SEQ ID NO: 2089674 - RNA, 13 nt, Staphylococcus aureus subsp. aureus MW2
cuacuaaauaacu

SEQ ID NO: 2089675 - RNA, 16 nt, Staphylococcus aureus subsp. aureus MW2
cuagaaguucuuaugc

SEQ ID NO: 2089676 - RNA, 18 nt, Staphylococcus aureus subsp. aureus MW2
cuagacaaucaucuuaau

SEQ ID NO: 2089677 - RNA, 19 nt, Staphylococcus aureus subsp. aureus MW2
cuagacauuacauuuagua

SEQ ID NO: 2089678 - RNA, 18 nt, Staphylococcus aureus subsp. aureus MW2
cuagaaaguaaugcuuua

SEQ ID NO: 2089679 - RNA, 22 nt, Staphylococcus aureus subsp. aureus MW2
cuagcaugcuuugagcaauaau

SEQ ID NO: 2089680 - RNA, 18 nt, Staphylococcus aureus subsp. aureus MW2
cuagacucuaaaauguuc

SEQ ID NO: 2089681 - RNA, 17 nt, Staphylococcus aureus subsp. aureus MW2
cuagagauaacuagaau

SEQ ID NO: 2089682 - RNA, 14 nt, Staphylococcus aureus subsp. aureus MW2
cuacacuuaauaua

SEQ ID NO: 2089683 - RNA, 14 nt, Staphylococcus aureus subsp. aureus MW2
cuacacuguuuuau

SEQ ID NO: 2089684 - RNA, 15 nt, Staphylococcus aureus subsp. aureus MW2
cuacacggucccaag

SEQ ID NO: 2089685 - RNA, 17 nt, Staphylococcus aureus subsp. aureus MW2
cuacagacaaugcaagu

SEQ ID NO: 2089686 - RNA, 23 nt, Staphylococcus aureus subsp. aureus MW2
cuacagaauggauaccuaaagcu

SEQ ID NO: 2089687 - RNA, 15 nt, Staphylococcus aureus subsp. aureus MW2
cuacagagaaucaau

SEQ ID NO: 2089688 - RNA, 13 nt, Staphylococcus aureus subsp. aureus MW2
cuacaauccuaug

SEQ ID NO: 2089689 - RNA, 22 nt, Staphylococcus aureus subsp. aureus MW2
cuacaaucauaccggcaaauaa

SEQ ID NO: 2089690 - RNA, 16 nt, Staphylococcus aureus subsp. aureus MW2
cuacaauauagaaaau

SEQ ID NO: 2089691 - RNA, 21 nt, Staphylococcus aureus subsp. aureus MW2
cuacaauuauaaaugauuaaa

SEQ ID NO: 2089692 - RNA, 20 nt, Staphylococcus aureus subsp. aureus MW2
cuacaauucauaagaaaaau

SEQ ID NO: 2089693 - RNA, 22 nt, Staphylococcus aureus subsp. aureus MW2
cuacaauccuauggcgcaauuu

SEQ ID NO: 2089694 - RNA, 19 nt, Staphylococcus aureus subsp. aureus MW2
cuacauaauuuaucaauuu

SEQ ID NO: 2089695 - RNA, 12 nt, Staphylococcus aureus subsp. aureus MW2
cuacauauacaa

SEQ ID NO: 2089696 - RNA, 19 nt, Staphylococcus aureus subsp. aureus MW2
cuacauauacaaauuuaua

SEQ ID NO: 2089697 - RNA, 15 nt, Staphylococcus aureus subsp. aureus MW2
cuacauauuggcuug

SEQ ID NO: 2089698 - RNA, 16 nt, Staphylococcus aureus subsp. aureus MW2
cuacauuaaagaaaau

SEQ ID NO: 2089699 - RNA, 14 nt, Staphylococcus aureus subsp. aureus MW2
cuacauuaaaaaua

SEQ ID NO: 2089700 - RNA, 14 nt, Staphylococcus aureus subsp. aureus MW2
cuacauuaauuuau

SEQ ID NO: 2089701 - RNA, 15 nt, Staphylococcus aureus subsp. aureus MW2
cuacauuaauuuauc

SEQ ID NO: 2089702 - RNA, 18 nt, Staphylococcus aureus subsp. aureus MW2
cuacagauuuuaaaaauu

SEQ ID NO: 2089703 - RNA, 20 nt, Staphylococcus aureus subsp. aureus MW2
cuacagauuuuaaaaauuca

SEQ ID NO: 2089704 - RNA, 21 nt, Staphylococcus aureus subsp. aureus MW2
cuaccuacuuguucaauacuu

SEQ ID NO: 2089705 - RNA, 20 nt, Staphylococcus aureus subsp. aureus MW2
cuaccuauuugauuaaauua

SEQ ID NO: 2089706 - RNA, 20 nt, Staphylococcus aureus subsp. aureus MW2
cuaccuguuggcuuuaaagg

SEQ ID NO: 2089707 - RNA, 18 nt, Staphylococcus aureus subsp. aureus MW2
cuacccuugcaaauauau

SEQ ID NO: 2089708 - RNA, 14 nt, Staphylococcus aureus subsp. aureus MW2
cuacccuauuuuac

SEQ ID NO: 2089709 - RNA, 14 nt, Staphylococcus aureus subsp. aureus MW2
cuaccgcuaaaauu

SEQ ID NO: 2089710 - RNA, 14 nt, Staphylococcus aureus subsp. aureus MW2
cuaccaauaauucc

SEQ ID NO: 2089711 - RNA, 21 nt, Staphylococcus aureus subsp. aureus MW2
cguacguuuagugaaaauacc

SEQ ID NO: 2089712 - RNA, 15 nt, Staphylococcus aureus subsp. aureus MW2
cguaaugauauuacc

SEQ ID NO: 2089713 - RNA, 18 nt, Staphylococcus aureus subsp. aureus MW2
cguacaaagguaauagaa

SEQ ID NO: 2089714 - RNA, 18 nt, Staphylococcus aureus subsp. aureus MW2
cguaguaaccuaauucua

SEQ ID NO: 2089715 - RNA, 15 nt, Staphylococcus aureus subsp. aureus MW2
cguaucuuuacaaca

SEQ ID NO: 2089716 - RNA, 14 nt, Staphylococcus aureus subsp. aureus MW2
cguauuuuuuuaua

SEQ ID NO: 2089717 - RNA, 15 nt, Staphylococcus aureus subsp. aureus MW2
cguauuuaccuucuu

SEQ ID NO: 2089718 - RNA, 14 nt, Staphylococcus aureus subsp. aureus MW2
cgucacuuuauuaa

SEQ ID NO: 2089719 - RNA, 13 nt, Staphylococcus aureus subsp. aureus MW2
cgugauuuuucau

SEQ ID NO: 2089720 - RNA, 15 nt, Staphylococcus aureus subsp. aureus MW2
cgugauuuggaauac

SEQ ID NO: 2089721 - RNA, 18 nt, Staphylococcus aureus subsp. aureus MW2
cgugagggacgucaucau

SEQ ID NO: 2089722 - RNA, 20 nt, Staphylococcus aureus subsp. aureus MW2
cgugagggacgucaucaugg

SEQ ID NO: 2089723 - RNA, 22 nt, Staphylococcus aureus subsp. aureus MW2
cgugaauucgaugacuuuuuaa

SEQ ID NO: 2089724 - RNA, 14 nt, Staphylococcus aureus subsp. aureus MW2
cuaaccuauuaaaa

SEQ ID NO: 2089725 - RNA, 14 nt, Staphylococcus aureus subsp. aureus MW2
cuaacucaccugca

SEQ ID NO: 2089726 - RNA, 18 nt, Staphylococcus aureus subsp. aureus MW2
cuaaaccucuaaauaaaa

SEQ ID NO: 2089727 - RNA, 18 nt, Staphylococcus aureus subsp. aureus MW2
cuaaaccuuuuuuaaguu

SEQ ID NO: 2089728 - RNA, 20 nt, Staphylococcus aureus subsp. aureus MW2
cuaaacgauaaauuaaugua

SEQ ID NO: 2089729 - RNA, 16 nt, Staphylococcus aureus subsp. aureus MW2
cuaaacgaucaacugc

SEQ ID NO: 2089730 - RNA, 19 nt, Staphylococcus aureus subsp. aureus MW2
cuaaccaucauaaauguua

SEQ ID NO: 2089731 - RNA, 21 nt, Staphylococcus aureus subsp. aureus MW2
cuaacaauuugaggauacaua

SEQ ID NO: 2089732 - RNA, 15 nt, Staphylococcus aureus subsp. aureus MW2
cuaaguuaugacuaa

SEQ ID NO: 2089733 - RNA, 14 nt, Staphylococcus aureus subsp. aureus MW2
cuaaguuaaaaccu

SEQ ID NO: 2089734 - RNA, 17 nt, Staphylococcus aureus subsp. aureus MW2
cuaagcaucguaaaaaa

SEQ ID NO: 2089735 - RNA, 21 nt, Staphylococcus aureus subsp. aureus MW2
cuaagcaucguaaaaaacaaa

SEQ ID NO: 2089736 - RNA, 18 nt, Staphylococcus aureus subsp. aureus MW2
cuaagcugauuaaaauau

SEQ ID NO: 2089737 - RNA, 22 nt, Staphylococcus aureus subsp. aureus MW2
cuaacuuuaugggauguauuuu

SEQ ID NO: 2089738 - RNA, 21 nt, Staphylococcus aureus subsp. aureus MW2
cuaauuuaaaugauuucacuu

SEQ ID NO: 2089739 - RNA, 20 nt, Staphylococcus aureus subsp. aureus MW2
cuaauuuaguaucuauacaa

SEQ ID NO: 2089740 - RNA, 13 nt, Staphylococcus aureus subsp. aureus MW2
cuaauugcacauu

SEQ ID NO: 2089741 - RNA, 23 nt, Staphylococcus aureus subsp. aureus MW2
cuaauucguuuugcuaaccauca

SEQ ID NO: 2089742 - RNA, 19 nt, Staphylococcus aureus subsp. aureus MW2
cuaauucgccaucuuuuuu

SEQ ID NO: 2089743 - RNA, 23 nt, Staphylococcus aureus subsp. aureus MW2
cuaauugaaggccauuuuuauuu

SEQ ID NO: 2089744 - RNA, 21 nt, Staphylococcus aureus subsp. aureus MW2
cuaauugaaggccauuuuuau

SEQ ID NO: 2089745 - RNA, 15 nt, Staphylococcus aureus subsp. aureus MW2
cuaauucuguuucaa

SEQ ID NO: 2089746 - RNA, 15 nt, Staphylococcus aureus subsp. aureus MW2
cuaauucuuuaauaa

SEQ ID NO: 2089747 - RNA, 16 nt, Staphylococcus aureus subsp. aureus MW2
cuaauucuuuaauaaa

SEQ ID NO: 2089748 - RNA, 15 nt, Staphylococcus aureus subsp. aureus MW2
cuaauucauucaaua

SEQ ID NO: 2089749 - RNA, 12 nt, Staphylococcus aureus subsp. aureus MW2
cuaauuauucau

SEQ ID NO: 2089750 - RNA, 20 nt, Staphylococcus aureus subsp. aureus MW2
cuaauguaauuauugcauca

SEQ ID NO: 2089751 - RNA, 18 nt, Staphylococcus aureus subsp. aureus MW2
cuaaugguuucauaaacu

SEQ ID NO: 2089752 - RNA, 20 nt, Staphylococcus aureus subsp. aureus MW2
cuaauuuugagacaaaaaau

SEQ ID NO: 2089753 - RNA, 20 nt, Staphylococcus aureus subsp. aureus MW2
cuaauuuuguacauaaaaau

SEQ ID NO: 2089754 - RNA, 21 nt, Staphylococcus aureus subsp. aureus MW2
cuaauuuuguacauaaaaaua

SEQ ID NO: 2089755 - RNA, 14 nt, Staphylococcus aureus subsp. aureus MW2
cuaauuuuucuuua

SEQ ID NO: 2089756 - RNA, 21 nt, Staphylococcus aureus subsp. aureus MW2
cuaauuuuuccaacuucuuuu

SEQ ID NO: 2089757 - RNA, 18 nt, Staphylococcus aureus subsp. aureus MW2
cuaauuugcaaaaucaac

SEQ ID NO: 2089758 - RNA, 22 nt, Staphylococcus aureus subsp. aureus MW2
cuaauuuuaaucauuguuuuaa

SEQ ID NO: 2089759 - RNA, 14 nt, Staphylococcus aureus subsp. aureus MW2
cuaauuuguaaccc

SEQ ID NO: 2089760 - RNA, 19 nt, Staphylococcus aureus subsp. aureus MW2
cuaauuuauaaacaauuac

SEQ ID NO: 2089761 - RNA, 23 nt, Staphylococcus aureus subsp. aureus MW2
cuacaacuucuucuccguauuua

SEQ ID NO: 2089762 - RNA, 16 nt, Staphylococcus aureus subsp. aureus MW2
cuaauaacucuucuaa

SEQ ID NO: 2089763 - RNA, 14 nt, Staphylococcus aureus subsp. aureus MW2
cuaauaauaaaaua

SEQ ID NO: 2089764 - RNA, 12 nt, Staphylococcus aureus subsp. aureus MW2
cuaauaauuuaa

SEQ ID NO: 2089765 - RNA, 19 nt, Staphylococcus aureus subsp. aureus MW2
cuaauaauuuguaauuccu

SEQ ID NO: 2089766 - RNA, 22 nt, Staphylococcus aureus subsp. aureus MW2
cuaauacacuugcuaaaacuaa

SEQ ID NO: 2089767 - RNA, 23 nt, Staphylococcus aureus subsp. aureus MW2
cuaauacacuugcuaaaacuaau

SEQ ID NO: 2089768 - RNA, 18 nt, Staphylococcus aureus subsp. aureus MW2
cuaauacuuucacuuuuu

SEQ ID NO: 2089769 - RNA, 22 nt, Staphylococcus aureus subsp. aureus MW2
cuaauacuuucacuuuuuauau

SEQ ID NO: 2089770 - RNA, 15 nt, Staphylococcus aureus subsp. aureus MW2
cuaauagcauuugua

SEQ ID NO: 2089771 - RNA, 20 nt, Staphylococcus aureus subsp. aureus MW2
cuaauagcuauauuuaaaau

SEQ ID NO: 2089772 - RNA, 15 nt, Staphylococcus aureus subsp. aureus MW2
cuaauaugauugguu

SEQ ID NO: 2089773 - RNA, 21 nt, Staphylococcus aureus subsp. aureus MW2
cuaauaugucuagacuuauuu

SEQ ID NO: 2089774 - RNA, 13 nt, Staphylococcus aureus subsp. aureus MW2
cuaauaugucuag

SEQ ID NO: 2089775 - RNA, 18 nt, Staphylococcus aureus subsp. aureus MW2
cuaauauuagauaucuua

SEQ ID NO: 2089776 - RNA, 18 nt, Staphylococcus aureus subsp. aureus MW2
cuaauauuuauuuuaaau

SEQ ID NO: 2089777 - RNA, 16 nt, Staphylococcus aureus subsp. aureus MW2
cuaaucagauauuagg

SEQ ID NO: 2089778 - RNA, 12 nt, Staphylococcus aureus subsp. aureus MW2
cuaaucaauacu

SEQ ID NO: 2089779 - RNA, 15 nt, Staphylococcus aureus subsp. aureus MW2
cuaauauuuaaaaaa

SEQ ID NO: 2089780 - RNA, 19 nt, Staphylococcus aureus subsp. aureus MW2
cuaauauuuaaaaaacaaa

SEQ ID NO: 2089781 - RNA, 22 nt, Staphylococcus aureus subsp. aureus MW2
cuaaugagcccguuaaaaagac

SEQ ID NO: 2089782 - RNA, 18 nt, Staphylococcus aureus subsp. aureus MW2
cuaaugcuaauuuaacug

SEQ ID NO: 2089783 - RNA, 15 nt, Staphylococcus aureus subsp. aureus MW2
cuaaugcuaauuuaa

SEQ ID NO: 2089784 - RNA, 13 nt, Staphylococcus aureus subsp. aureus MW2
cuaaucuaaauuc

SEQ ID NO: 2089785 - RNA, 14 nt, Staphylococcus aureus subsp. aureus MW2
cuaaucucagauuu

SEQ ID NO: 2089786 - RNA, 11 nt, Staphylococcus aureus subsp. aureus MW2
cuaaucuauuu

SEQ ID NO: 2089787 - RNA, 22 nt, Staphylococcus aureus subsp. aureus MW2
cuaaucguguauuauugaaacu

SEQ ID NO: 2089788 - RNA, 17 nt, Staphylococcus aureus subsp. aureus MW2
cuaaucguguauuauug

SEQ ID NO: 2089789 - RNA, 16 nt, Staphylococcus aureus subsp. aureus MW2
cuaaucauuuuuucaa

SEQ ID NO: 2089790 - RNA, 18 nt, Staphylococcus aureus subsp. aureus MW2
cguugcaccuauuuuuug

SEQ ID NO: 2089791 - RNA, 20 nt, Staphylococcus aureus subsp. aureus MW2
cguugauuuagcauacauua

SEQ ID NO: 2089792 - RNA, 17 nt, Staphylococcus aureus subsp. aureus MW2
cguugauuaacauuacg

SEQ ID NO: 2089793 - RNA, 23 nt, Staphylococcus aureus subsp. aureus MW2
cguuguucauaaucauaauaaga

SEQ ID NO: 2089794 - RNA, 17 nt, Staphylococcus aureus subsp. aureus MW2
cguuuuuuuaaauacau

SEQ ID NO: 2089795 - RNA, 14 nt, Staphylococcus aureus subsp. aureus MW2
cguuuuuaaauaau

SEQ ID NO: 2089796 - RNA, 14 nt, Staphylococcus aureus subsp. aureus MW2
cguuuuauauuuau

SEQ ID NO: 2089797 - RNA, 19 nt, Staphylococcus aureus subsp. aureus MW2
cguuuuauuaaugaagcug

SEQ ID NO: 2089798 - RNA, 20 nt, Staphylococcus aureus subsp. aureus MW2
cguuuuagcuagacauucgu

SEQ ID NO: 2089799 - RNA, 15 nt, Staphylococcus aureus subsp. aureus MW2
cguuuuagacauaaa

SEQ ID NO: 2089800 - RNA, 15 nt, Staphylococcus aureus subsp. aureus MW2
cuaaaaaaauuaaaa

SEQ ID NO: 2089801 - RNA, 13 nt, Staphylococcus aureus subsp. aureus MW2
cuaaaaaauuugc

SEQ ID NO: 2089802 - RNA, 13 nt, Staphylococcus aureus subsp. aureus MW2
cuaaaaacauaaa

SEQ ID NO: 2089803 - RNA, 17 nt, Staphylococcus aureus subsp. aureus MW2
cuaaaacggaaauaacc

SEQ ID NO: 2089804 - RNA, 21 nt, Staphylococcus aureus subsp. aureus MW2
cuaaaacggaaauaaccacca

SEQ ID NO: 2089805 - RNA, 14 nt, Staphylococcus aureus subsp. aureus MW2
cuaaaauuuccuca

SEQ ID NO: 2089806 - RNA, 17 nt, Staphylococcus aureus subsp. aureus MW2
cuaaaauucuuucagcu

SEQ ID NO: 2089807 - RNA, 16 nt, Staphylococcus aureus subsp. aureus MW2
cuaaaauucuuucagc

SEQ ID NO: 2089808 - RNA, 17 nt, Staphylococcus aureus subsp. aureus MW2
cuaaaaguuucccaagc

SEQ ID NO: 2089809 - RNA, 21 nt, Staphylococcus aureus subsp. aureus MW2
cuaaaaguggccuuuuaaaca

SEQ ID NO: 2089810 - RNA, 17 nt, Staphylococcus aureus subsp. aureus MW2
cguuaauaauuuguuuu

SEQ ID NO: 2089811 - RNA, 11 nt, Staphylococcus aureus subsp. aureus MW2
cguuacauuua

SEQ ID NO: 2089812 - RNA, 22 nt, Staphylococcus aureus subsp. aureus MW2
cguuaguacggcugcuuuaacu

SEQ ID NO: 2089813 - RNA, 22 nt, Staphylococcus aureus subsp. aureus MW2
cguuaguauaaacguccaaaca

SEQ ID NO: 2089814 - RNA, 18 nt, Staphylococcus aureus subsp. aureus MW2
cguuacggcuucgugcua

SEQ ID NO: 2089815 - RNA, 19 nt, Staphylococcus aureus subsp. aureus MW2
cguuauaaguacaaauaau

SEQ ID NO: 2089816 - RNA, 13 nt, Staphylococcus aureus subsp. aureus MW2
cguuauucauuug

SEQ ID NO: 2089817 - RNA, 20 nt, Staphylococcus aureus subsp. aureus MW2
cguuaucuuuaaguaauuca

SEQ ID NO: 2089818 - RNA, 13 nt, Staphylococcus aureus subsp. aureus MW2
cguucauauauuu

SEQ ID NO: 2089819 - RNA, 19 nt, Staphylococcus aureus subsp. aureus MW2
cugaauuaauauccaaaau

SEQ ID NO: 2089820 - RNA, 18 nt, Staphylococcus aureus subsp. aureus MW2
cugaauuaauauccaaaa

SEQ ID NO: 2089821 - RNA, 23 nt, Staphylococcus aureus subsp. aureus MW2
cugaauguucgaagauuuuuuuc

SEQ ID NO: 2089822 - RNA, 17 nt, Staphylococcus aureus subsp. aureus MW2
cugaaugcuaauacuaa

SEQ ID NO: 2089823 - RNA, 16 nt, Staphylococcus aureus subsp. aureus MW2
cugaaugcucaucuuc

SEQ ID NO: 2089824 - RNA, 18 nt, Staphylococcus aureus subsp. aureus MW2
cugaaucugcuaauuuau

SEQ ID NO: 2089825 - RNA, 20 nt, Staphylococcus aureus subsp. aureus MW2
cugaaucugcuaauuuauaa

SEQ ID NO: 2089826 - RNA, 16 nt, Staphylococcus aureus subsp. aureus MW2
cugacaaaccaauuuu

SEQ ID NO: 2089827 - RNA, 17 nt, Staphylococcus aureus subsp. aureus MW2
cugaugugacaaaguuu

SEQ ID NO: 2089828 - RNA, 16 nt, Staphylococcus aureus subsp. aureus MW2
cugauuaauuauugag

SEQ ID NO: 2089829 - RNA, 23 nt, Staphylococcus aureus subsp. aureus MW2
cugaugcuagcuuucuuuuucau

SEQ ID NO: 2089830 - RNA, 22 nt, Staphylococcus aureus subsp. aureus MW2
cugauguaccacucauaaucaa

SEQ ID NO: 2089831 - RNA, 16 nt, Staphylococcus aureus subsp. aureus MW2
cugaugaacauaccug

SEQ ID NO: 2089832 - RNA, 19 nt, Staphylococcus aureus subsp. aureus MW2
cugacuuuuaaaaaacaua

SEQ ID NO: 2089833 - RNA, 20 nt, Staphylococcus aureus subsp. aureus MW2
cugacuuuccgccagcuucu

SEQ ID NO: 2089834 - RNA, 20 nt, Staphylococcus aureus subsp. aureus MW2
cugauaacaaccuauuaauu

SEQ ID NO: 2089835 - RNA, 14 nt, Staphylococcus aureus subsp. aureus MW2
cugauuuuuuauca

SEQ ID NO: 2089836 - RNA, 13 nt, Staphylococcus aureus subsp. aureus MW2
cugcaccaagaaa

SEQ ID NO: 2089837 - RNA, 20 nt, Staphylococcus aureus subsp. aureus MW2
cugcaccuaacgcuaaugau

SEQ ID NO: 2089838 - RNA, 22 nt, Staphylococcus aureus subsp. aureus MW2
cugcagaguaaccuuucgcagc

SEQ ID NO: 2089839 - RNA, 20 nt, Staphylococcus aureus subsp. aureus MW2
cugccauuaaacgaaugauu

SEQ ID NO: 2089840 - RNA, 13 nt, Staphylococcus aureus subsp. aureus MW2
cugcaucagaucu

SEQ ID NO: 2089841 - RNA, 17 nt, Staphylococcus aureus subsp. aureus MW2
cugcuaguucagcuucu

SEQ ID NO: 2089842 - RNA, 20 nt, Staphylococcus aureus subsp. aureus MW2
cugcuaauuuuuucaucauu

SEQ ID NO: 2089843 - RNA, 14 nt, Staphylococcus aureus subsp. aureus MW2
cugcuaauuuuuuc

SEQ ID NO: 2089844 - RNA, 18 nt, Staphylococcus aureus subsp. aureus MW2
cugcuagacaaucaucuu

SEQ ID NO: 2089845 - RNA, 23 nt, Staphylococcus aureus subsp. aureus MW2
aaacuauaauaaagauuauaucu

SEQ ID NO: 2089846 - RNA, 20 nt, Staphylococcus aureus subsp. aureus MW2
cugcuguucucuauuuauaa

SEQ ID NO: 2089847 - RNA, 14 nt, Staphylococcus aureus subsp. aureus MW2
cugcuucugcugua

SEQ ID NO: 2089848 - RNA, 21 nt, Staphylococcus aureus subsp. aureus MW2
cugcuucuucagguguuuuac

SEQ ID NO: 2089849 - RNA, 18 nt, Staphylococcus aureus subsp. aureus MW2
cugcuucuacccuugcaa

SEQ ID NO: 2089850 - RNA, 13 nt, Staphylococcus aureus subsp. aureus MW2
cugcuuuaaggaa

SEQ ID NO: 2089851 - RNA, 22 nt, Staphylococcus aureus subsp. aureus MW2
aaacucguaaauuuuaucuaaa

SEQ ID NO: 2089852 - RNA, 20 nt, Staphylococcus aureus subsp. aureus MW2
cuggcguuaaagcuuuucuu

SEQ ID NO: 2089853 - RNA, 23 nt, Staphylococcus aureus subsp. aureus MW2
aaacucauccauugaucuuuuau

SEQ ID NO: 2089854 - RNA, 12 nt, Staphylococcus aureus subsp. aureus MW2
cuggcggaaagu

SEQ ID NO: 2089855 - RNA, 14 nt, Staphylococcus aureus subsp. aureus MW2
cuggcggaaaguca

SEQ ID NO: 2089856 - RNA, 16 nt, Staphylococcus aureus subsp. aureus MW2
cuggcggaaagucagg

SEQ ID NO: 2089857 - RNA, 17 nt, Staphylococcus aureus subsp. aureus MW2
cuguucucuauuuauaa

SEQ ID NO: 2089858 - RNA, 23 nt, Staphylococcus aureus subsp. aureus MW2
cuguucuaaaauuaaccauuucu

SEQ ID NO: 2089859 - RNA, 21 nt, Staphylococcus aureus subsp. aureus MW2
cuguucuuucgucuuguaaac

SEQ ID NO: 2089860 - RNA, 15 nt, Staphylococcus aureus subsp. aureus MW2
cuguuccaaauucau

SEQ ID NO: 2089861 - RNA, 16 nt, Staphylococcus aureus subsp. aureus MW2
cuguuacacuuuucuu

SEQ ID NO: 2089862 - RNA, 15 nt, Staphylococcus aureus subsp. aureus MW2
cuguuaauguuccaa

SEQ ID NO: 2089863 - RNA, 16 nt, Staphylococcus aureus subsp. aureus MW2
cuguuaaacucauaca

SEQ ID NO: 2089864 - RNA, 15 nt, Staphylococcus aureus subsp. aureus MW2
cuguguuggggcccc

SEQ ID NO: 2089865 - RNA, 14 nt, Staphylococcus aureus subsp. aureus MW2
cugugugcuguucu

SEQ ID NO: 2089866 - RNA, 16 nt, Staphylococcus aureus subsp. aureus MW2
cuguuaauaaaucauu

SEQ ID NO: 2089867 - RNA, 13 nt, Staphylococcus aureus subsp. aureus MW2
cuguguaucauca

SEQ ID NO: 2089868 - RNA, 17 nt, Staphylococcus aureus subsp. aureus MW2
cuguguaaaauaaauca

SEQ ID NO: 2089869 - RNA, 21 nt, Staphylococcus aureus subsp. aureus MW2
cuguuggaauaccuuuuucua

SEQ ID NO: 2089870 - RNA, 16 nt, Staphylococcus aureus subsp. aureus MW2
cuguugcauuaagugc

SEQ ID NO: 2089871 - RNA, 13 nt, Staphylococcus aureus subsp. aureus MW2
cuguuugcuuuau

SEQ ID NO: 2089872 - RNA, 13 nt, Staphylococcus aureus subsp. aureus MW2
cuguuuucauuug

SEQ ID NO: 2089873 - RNA, 15 nt, Staphylococcus aureus subsp. aureus MW2
cuguuuucauuuguu

SEQ ID NO: 2089874 - RNA, 13 nt, Staphylococcus aureus subsp. aureus MW2
aaacuguaucaac

SEQ ID NO: 2089875 - RNA, 17 nt, Staphylococcus aureus subsp. aureus MW2
aaacugugcaugacgau

SEQ ID NO: 2089876 - RNA, 13 nt, Staphylococcus aureus subsp. aureus MW2
cuuaaacaaauaa

SEQ ID NO: 2089877 - RNA, 18 nt, Staphylococcus aureus subsp. aureus MW2
cuuaaacaaauaaauguc

SEQ ID NO: 2089878 - RNA, 18 nt, Staphylococcus aureus subsp. aureus MW2
cuuaaaauuuaaauauug

SEQ ID NO: 2089879 - RNA, 21 nt, Staphylococcus aureus subsp. aureus MW2
cuuaaaauuuaaauauugaag

SEQ ID NO: 2089880 - RNA, 14 nt, Staphylococcus aureus subsp. aureus MW2
cuuaaaauuuaaau

SEQ ID NO: 2089881 - RNA, 17 nt, Staphylococcus aureus subsp. aureus MW2
cuuaaaaugauuguuuu

SEQ ID NO: 2089882 - RNA, 18 nt, Staphylococcus aureus subsp. aureus MW2
cuuaaaauaaguauuuuu

SEQ ID NO: 2089883 - RNA, 22 nt, Staphylococcus aureus subsp. aureus MW2
cuuaaaagacauccacagaauu

SEQ ID NO: 2089884 - RNA, 21 nt, Staphylococcus aureus subsp. aureus MW2
cuuaaaagagaauauaaaaua

SEQ ID NO: 2089885 - RNA, 22 nt, Staphylococcus aureus subsp. aureus MW2
cuuaaaagagaauauaaaauaa

SEQ ID NO: 2089886 - RNA, 19 nt, Staphylococcus aureus subsp. aureus MW2
cuuaguuugacaucuauuu

SEQ ID NO: 2089887 - RNA, 13 nt, Staphylococcus aureus subsp. aureus MW2
cuuauaaaauaaa

SEQ ID NO: 2089888 - RNA, 17 nt, Staphylococcus aureus subsp. aureus MW2
cuuaguuugacaucuau

SEQ ID NO: 2089889 - RNA, 14 nt, Staphylococcus aureus subsp. aureus MW2
cuuagaauuuacaa

SEQ ID NO: 2089890 - RNA, 17 nt, Staphylococcus aureus subsp. aureus MW2
cuuagaccccuaauuaa

SEQ ID NO: 2089891 - RNA, 20 nt, Staphylococcus aureus subsp. aureus MW2
cuuauacacuuacaaauauu

SEQ ID NO: 2089892 - RNA, 13 nt, Staphylococcus aureus subsp. aureus MW2
cuuauaaagacac

SEQ ID NO: 2089893 - RNA, 15 nt, Staphylococcus aureus subsp. aureus MW2
cuuauaacauucuuc

SEQ ID NO: 2089894 - RNA, 14 nt, Staphylococcus aureus subsp. aureus MW2
cuuauaacauucuu

SEQ ID NO: 2089895 - RNA, 16 nt, Staphylococcus aureus subsp. aureus MW2
cuuauaaguacauuuu

SEQ ID NO: 2089896 - RNA, 18 nt, Staphylococcus aureus subsp. aureus MW2
cuuaucauuucaaauaag

SEQ ID NO: 2089897 - RNA, 20 nt, Staphylococcus aureus subsp. aureus MW2
cuuauagaaugauuaaaauu

SEQ ID NO: 2089898 - RNA, 18 nt, Staphylococcus aureus subsp. aureus MW2
cuuauagauuuuucagcu

SEQ ID NO: 2089899 - RNA, 16 nt, Staphylococcus aureus subsp. aureus MW2
cuuaugauagugcuuu

SEQ ID NO: 2089900 - RNA, 13 nt, Staphylococcus aureus subsp. aureus MW2
cuuaugacugcuu

SEQ ID NO: 2089901 - RNA, 14 nt, Staphylococcus aureus subsp. aureus MW2
cuuaugagcaaagc

SEQ ID NO: 2089902 - RNA, 13 nt, Staphylococcus aureus subsp. aureus MW2
cuuauuauuuugu

SEQ ID NO: 2089903 - RNA, 11 nt, Staphylococcus aureus subsp. aureus MW2
cuuauuauuua

SEQ ID NO: 2089904 - RNA, 20 nt, Staphylococcus aureus subsp. aureus MW2
cuuauuauuuuguauuuuuc

SEQ ID NO: 2089905 - RNA, 11 nt, Staphylococcus aureus subsp. aureus MW2
cuuauuaacuu

SEQ ID NO: 2089906 - RNA, 14 nt, Staphylococcus aureus subsp. aureus MW2
cuuaucugauuguu

SEQ ID NO: 2089907 - RNA, 14 nt, Staphylococcus aureus subsp. aureus MW2
cuuacaauaaagac

SEQ ID NO: 2089908 - RNA, 15 nt, Staphylococcus aureus subsp. aureus MW2
cuuacaacuuuaguu

SEQ ID NO: 2089909 - RNA, 15 nt, Staphylococcus aureus subsp. aureus MW2
cuuacaauaaagaca

SEQ ID NO: 2089910 - RNA, 13 nt, Staphylococcus aureus subsp. aureus MW2
cuuacaauaaugu

SEQ ID NO: 2089911 - RNA, 14 nt, Staphylococcus aureus subsp. aureus MW2
cuuaauuuuauuau

SEQ ID NO: 2089912 - RNA, 17 nt, Staphylococcus aureus subsp. aureus MW2
cuuacagacaaacauua

SEQ ID NO: 2089913 - RNA, 21 nt, Staphylococcus aureus subsp. aureus MW2
cuuaagcuuuaaucauagcau

SEQ ID NO: 2089914 - RNA, 21 nt, Staphylococcus aureus subsp. aureus MW2
cuuaaguaagauuuaaacauc

SEQ ID NO: 2089915 - RNA, 16 nt, Staphylococcus aureus subsp. aureus MW2
cuuaauaagcugaaau

SEQ ID NO: 2089916 - RNA, 17 nt, Staphylococcus aureus subsp. aureus MW2
cuuaauaagcugaaaua

SEQ ID NO: 2089917 - RNA, 19 nt, Staphylococcus aureus subsp. aureus MW2
cuuaauaauuaauaagcau

SEQ ID NO: 2089918 - RNA, 20 nt, Staphylococcus aureus subsp. aureus MW2
cuuaauugaaaauaaucuua

SEQ ID NO: 2089919 - RNA, 14 nt, Staphylococcus aureus subsp. aureus MW2
cuuaauucuucauc

SEQ ID NO: 2089920 - RNA, 18 nt, Staphylococcus aureus subsp. aureus MW2
cuuaauucuucaucaaua

SEQ ID NO: 2089921 - RNA, 22 nt, Staphylococcus aureus subsp. aureus MW2
cuuaauagagguauaauuaaau

SEQ ID NO: 2089922 - RNA, 18 nt, Staphylococcus aureus subsp. aureus MW2
cuuaauacgauaauaacu

SEQ ID NO: 2089923 - RNA, 14 nt, Staphylococcus aureus subsp. aureus MW2
cuuaauacuaauuu

SEQ ID NO: 2089924 - RNA, 17 nt, Staphylococcus aureus subsp. aureus MW2
cuuaauuuguuuuaaau

SEQ ID NO: 2089925 - RNA, 13 nt, Staphylococcus aureus subsp. aureus MW2
cuuaauuuaaauc

SEQ ID NO: 2089926 - RNA, 23 nt, Staphylococcus aureus subsp. aureus MW2
cuuaauuuaaaucuguacuucua

SEQ ID NO: 2089927 - RNA, 19 nt, Staphylococcus aureus subsp. aureus MW2
cuucagccauaauaucuuu

SEQ ID NO: 2089928 - RNA, 16 nt, Staphylococcus aureus subsp. aureus MW2
cuucaucgcaauguca

SEQ ID NO: 2089929 - RNA, 17 nt, Staphylococcus aureus subsp. aureus MW2
cuucaucuaaaaagucu

SEQ ID NO: 2089930 - RNA, 12 nt, Staphylococcus aureus subsp. aureus MW2
cuucaucuuuuu

SEQ ID NO: 2089931 - RNA, 22 nt, Staphylococcus aureus subsp. aureus MW2
cuucaucuuuuuuaucauguga

SEQ ID NO: 2089932 - RNA, 18 nt, Staphylococcus aureus subsp. aureus MW2
cuucaugucguuuucuua

SEQ ID NO: 2089933 - RNA, 21 nt, Staphylococcus aureus subsp. aureus MW2
cuucauuacaaacauaaucau

SEQ ID NO: 2089934 - RNA, 17 nt, Staphylococcus aureus subsp. aureus MW2
cuuauucgcaccacugg

SEQ ID NO: 2089935 - RNA, 17 nt, Staphylococcus aureus subsp. aureus MW2
cuuauugaaaagauaaa

SEQ ID NO: 2089936 - RNA, 20 nt, Staphylococcus aureus subsp. aureus MW2
cuucaaagcaucuaaucccc

SEQ ID NO: 2089937 - RNA, 16 nt, Staphylococcus aureus subsp. aureus MW2
cuuauugcauuguaua

SEQ ID NO: 2089938 - RNA, 22 nt, Staphylococcus aureus subsp. aureus MW2
cuucaauuuaauguauugagaa

SEQ ID NO: 2089939 - RNA, 21 nt, Staphylococcus aureus subsp. aureus MW2
cuucaauuuuaccagcaugaa

SEQ ID NO: 2089940 - RNA, 18 nt, Staphylococcus aureus subsp. aureus MW2
cuucacucuuuuagaauc

SEQ ID NO: 2089941 - RNA, 21 nt, Staphylococcus aureus subsp. aureus MW2
cuuccaaucaacuucauauaa

SEQ ID NO: 2089942 - RNA, 22 nt, Staphylococcus aureus subsp. aureus MW2
aaacuuagaacaguuagaaaca

SEQ ID NO: 2089943 - RNA, 17 nt, Staphylococcus aureus subsp. aureus MW2
aaacuuacauuacauau

SEQ ID NO: 2089944 - RNA, 14 nt, Staphylococcus aureus subsp. aureus MW2
cuuccaauuuaaaa

SEQ ID NO: 2089945 - RNA, 16 nt, Staphylococcus aureus subsp. aureus MW2
cuuccaucacaucaua

SEQ ID NO: 2089946 - RNA, 19 nt, Staphylococcus aureus subsp. aureus MW2
cuucccagucaugucccau

SEQ ID NO: 2089947 - RNA, 23 nt, Staphylococcus aureus subsp. aureus MW2
cuuccuuuuuuuaugucuuuuuu

SEQ ID NO: 2089948 - RNA, 14 nt, Staphylococcus aureus subsp. aureus MW2
cuuccgcacugccu

SEQ ID NO: 2089949 - RNA, 15 nt, Staphylococcus aureus subsp. aureus MW2
cugguugauaaauaa

SEQ ID NO: 2089950 - RNA, 21 nt, Staphylococcus aureus subsp. aureus MW2
cuguaacauaaacaauaacug

SEQ ID NO: 2089951 - RNA, 17 nt, Staphylococcus aureus subsp. aureus MW2
cuguaaauuaucuaaag

SEQ ID NO: 2089952 - RNA, 19 nt, Staphylococcus aureus subsp. aureus MW2
cuguaccaucacuaaagua

SEQ ID NO: 2089953 - RNA, 20 nt, Staphylococcus aureus subsp. aureus MW2
cuguaccguauuuuaauauu

SEQ ID NO: 2089954 - RNA, 21 nt, Staphylococcus aureus subsp. aureus MW2
cuguaccguuuuuuauaaauc

SEQ ID NO: 2089955 - RNA, 12 nt, Staphylococcus aureus subsp. aureus MW2
cuguaccugcua

SEQ ID NO: 2089956 - RNA, 19 nt, Staphylococcus aureus subsp. aureus MW2
cugguaacguucuacucua

SEQ ID NO: 2089957 - RNA, 17 nt, Staphylococcus aureus subsp. aureus MW2
cugggcuuucuuuuuug

SEQ ID NO: 2089958 - RNA, 23 nt, Staphylococcus aureus subsp. aureus MW2
cuguggcucgaaaauaaaacaaa

SEQ ID NO: 2089959 - RNA, 21 nt, Staphylococcus aureus subsp. aureus MW2
cuguggacaaacugauuuuuu

SEQ ID NO: 2089960 - RNA, 22 nt, Staphylococcus aureus subsp. aureus MW2
cuguggacaaacugauuuuuua

SEQ ID NO: 2089961 - RNA, 14 nt, Staphylococcus aureus subsp. aureus MW2
cugugaauaaaauu

SEQ ID NO: 2089962 - RNA, 23 nt, Staphylococcus aureus subsp. aureus MW2
cugugaauaaaauugugccauuu

SEQ ID NO: 2089963 - RNA, 16 nt, Staphylococcus aureus subsp. aureus MW2
cugucuaaaaacauaa

SEQ ID NO: 2089964 - RNA, 16 nt, Staphylococcus aureus subsp. aureus MW2
cugucucauuaaugua

SEQ ID NO: 2089965 - RNA, 15 nt, Staphylococcus aureus subsp. aureus MW2
cugucgcucauccuc

SEQ ID NO: 2089966 - RNA, 22 nt, Staphylococcus aureus subsp. aureus MW2
aaacugaguucaauuaaauuau

SEQ ID NO: 2089967 - RNA, 14 nt, Staphylococcus aureus subsp. aureus MW2
aaacugcaauaauu

SEQ ID NO: 2089968 - RNA, 18 nt, Staphylococcus aureus subsp. aureus MW2
cugucaccuucuauauug

SEQ ID NO: 2089969 - RNA, 10 nt, Staphylococcus aureus subsp. aureus MW2
aaacucucua

SEQ ID NO: 2089970 - RNA, 11 nt, Staphylococcus aureus subsp. aureus MW2
aaacucuuaua

SEQ ID NO: 2089971 - RNA, 12 nt, Staphylococcus aureus subsp. aureus MW2
cuguauuuacua

SEQ ID NO: 2089972 - RNA, 20 nt, Staphylococcus aureus subsp. aureus MW2
cuguaugccgccuaauaaua

SEQ ID NO: 2089973 - RNA, 17 nt, Staphylococcus aureus subsp. aureus MW2
cuguaugacaggcgugu

SEQ ID NO: 2089974 - RNA, 22 nt, Staphylococcus aureus subsp. aureus MW2
cuguauauggcgauaacaagaa

SEQ ID NO: 2089975 - RNA, 23 nt, Staphylococcus aureus subsp. aureus MW2
cuguagacaauuguaguaaugaa

SEQ ID NO: 2089976 - RNA, 18 nt, Staphylococcus aureus subsp. aureus MW2
cuguacguuuuaaauaaa

SEQ ID NO: 2089977 - RNA, 18 nt, Staphylococcus aureus subsp. aureus MW2
cuguagcgauaccuuuaa

SEQ ID NO: 2089978 - RNA, 17 nt, Staphylococcus aureus subsp. aureus MW2
cuguaguacuauaguca

SEQ ID NO: 2089979 - RNA, 20 nt, Staphylococcus aureus subsp. aureus MW2
gaacuuuuauuuuuuauaaa

SEQ ID NO: 2089980 - RNA, 15 nt, Staphylococcus aureus subsp. aureus MW2
gaacuuuaauaccag

SEQ ID NO: 2089981 - RNA, 16 nt, Staphylococcus aureus subsp. aureus MW2
gaacuugcuuuguucu

SEQ ID NO: 2089982 - RNA, 17 nt, Staphylococcus aureus subsp. aureus MW2
gaacuuauaagucugau

SEQ ID NO: 2089983 - RNA, 23 nt, Staphylococcus aureus subsp. aureus MW2
gaacuuauaagucugauuugaua

SEQ ID NO: 2089984 - RNA, 22 nt, Staphylococcus aureus subsp. aureus MW2
aaagaggcgccacaacauguuu

SEQ ID NO: 2089985 - RNA, 20 nt, Staphylococcus aureus subsp. aureus MW2
aaagaggcgccacaacaugu

SEQ ID NO: 2089986 - RNA, 17 nt, Staphylococcus aureus subsp. aureus MW2
aaagaggcuuuaaaauu

SEQ ID NO: 2089987 - RNA, 19 nt, Staphylococcus aureus subsp. aureus MW2
aaagagguacuagaauuaa

SEQ ID NO: 2089988 - RNA, 16 nt, Staphylococcus aureus subsp. aureus MW2
aaagagguacuagaau

SEQ ID NO: 2089989 - RNA, 14 nt, Staphylococcus aureus subsp. aureus MW2
aaagaguuaauaaa

SEQ ID NO: 2089990 - RNA, 23 nt, Staphylococcus aureus subsp. aureus MW2
gaagcaauuaaguauagugacau

SEQ ID NO: 2089991 - RNA, 14 nt, Staphylococcus aureus subsp. aureus MW2
gaagcacagaaaau

SEQ ID NO: 2089992 - RNA, 15 nt, Staphylococcus aureus subsp. aureus MW2
gaagcggguugaagc

SEQ ID NO: 2089993 - RNA, 22 nt, Staphylococcus aureus subsp. aureus MW2
gaaggccauuuuuauuuaacac

SEQ ID NO: 2089994 - RNA, 20 nt, Staphylococcus aureus subsp. aureus MW2
gaaggacaggaauaaauuuu

SEQ ID NO: 2089995 - RNA, 16 nt, Staphylococcus aureus subsp. aureus MW2
gaagucuuucaacaaa

SEQ ID NO: 2089996 - RNA, 22 nt, Staphylococcus aureus subsp. aureus MW2
gaagucuugugauaauucuuca

SEQ ID NO: 2089997 - RNA, 18 nt, Staphylococcus aureus subsp. aureus MW2
gaaguagauugauauccc

SEQ ID NO: 2089998 - RNA, 14 nt, Staphylococcus aureus subsp. aureus MW2
gaauaaaaaaacac

SEQ ID NO: 2089999 - RNA, 13 nt, Staphylococcus aureus subsp. aureus MW2
gaauaauauauuu

SEQ ID NO: 2090000 - RNA, 15 nt, Staphylococcus aureus subsp. aureus MW2
gaauaacgucauaug

SEQ ID NO: 2090001 - RNA, 21 nt, Staphylococcus aureus subsp. aureus MW2
gaauaauaaacuuaaaagaga

SEQ ID NO: 2090002 - RNA, 19 nt, Staphylococcus aureus subsp. aureus MW2
gaauaacuguuuaucauga

SEQ ID NO: 2090003 - RNA, 20 nt, Staphylococcus aureus subsp. aureus MW2
gaauagacauuguuaaacua

SEQ ID NO: 2090004 - RNA, 18 nt, Staphylococcus aureus subsp. aureus MW2
aaagauuauuauuacaau

SEQ ID NO: 2090005 - RNA, 12 nt, Staphylococcus aureus subsp. aureus MW2
aaagauuauuau

SEQ ID NO: 2090006 - RNA, 19 nt, Staphylococcus aureus subsp. aureus MW2
aaagauuucaguucaucau

SEQ ID NO: 2090007 - RNA, 13 nt, Staphylococcus aureus subsp. aureus MW2
gaaucaacaauau

SEQ ID NO: 2090008 - RNA, 22 nt, Staphylococcus aureus subsp. aureus MW2
gaaucaacaauauaaaagcacu

SEQ ID NO: 2090009 - RNA, 23 nt, Staphylococcus aureus subsp. aureus MW2
gaauauuuauuguuuuuaaaauc

SEQ ID NO: 2090010 - RNA, 23 nt, Staphylococcus aureus subsp. aureus MW2
gaauagugagcguauuauuauug

SEQ ID NO: 2090011 - RNA, 23 nt, Staphylococcus aureus subsp. aureus MW2
gaauauuucccuaugaaauaacu

SEQ ID NO: 2090012 - RNA, 23 nt, Staphylococcus aureus subsp. aureus MW2
gaauauuugcuuuuuguguaucu

SEQ ID NO: 2090013 - RNA, 14 nt, Staphylococcus aureus subsp. aureus MW2
gaaucccauaauga

SEQ ID NO: 2090014 - RNA, 18 nt, Staphylococcus aureus subsp. aureus MW2
gaaucauuuucuugauuu

SEQ ID NO: 2090015 - RNA, 10 nt, Staphylococcus aureus subsp. aureus MW2
gaaucaguau

SEQ ID NO: 2090016 - RNA, 17 nt, Staphylococcus aureus subsp. aureus MW2
gaaucagggacaaaaau

SEQ ID NO: 2090017 - RNA, 18 nt, Staphylococcus aureus subsp. aureus MW2
gaaucaauugcauacgua

SEQ ID NO: 2090018 - RNA, 12 nt, Staphylococcus aureus subsp. aureus MW2
gaaucacauuaa

SEQ ID NO: 2090019 - RNA, 23 nt, Staphylococcus aureus subsp. aureus MW2
gaaucacaguuauauauuacuua

SEQ ID NO: 2090020 - RNA, 18 nt, Staphylococcus aureus subsp. aureus MW2
gaaucuugcauaaccaag

SEQ ID NO: 2090021 - RNA, 19 nt, Staphylococcus aureus subsp. aureus MW2
gaaucuugcauaaccaagu

SEQ ID NO: 2090022 - RNA, 16 nt, Staphylococcus aureus subsp. aureus MW2
gaaucuuggaaguauc

SEQ ID NO: 2090023 - RNA, 21 nt, Staphylococcus aureus subsp. aureus MW2
gaaucgaagcccuuugauuua

SEQ ID NO: 2090024 - RNA, 15 nt, Staphylococcus aureus subsp. aureus MW2
gaauguauuuuucau

SEQ ID NO: 2090025 - RNA, 15 nt, Staphylococcus aureus subsp. aureus MW2
gaauuaacaacaaau

SEQ ID NO: 2090026 - RNA, 13 nt, Staphylococcus aureus subsp. aureus MW2
gaauuaauaauga

SEQ ID NO: 2090027 - RNA, 19 nt, Staphylococcus aureus subsp. aureus MW2
gaauuacgcauccuaaugu

SEQ ID NO: 2090028 - RNA, 14 nt, Staphylococcus aureus subsp. aureus MW2
gaauuagaucuaug

SEQ ID NO: 2090029 - RNA, 17 nt, Staphylococcus aureus subsp. aureus MW2
gaauuagaucuaugguu

SEQ ID NO: 2090030 - RNA, 17 nt, Staphylococcus aureus subsp. aureus MW2
gaauuaagaaaaguuac

SEQ ID NO: 2090031 - RNA, 20 nt, Staphylococcus aureus subsp. aureus MW2
gaauugauguugaugcaacc

SEQ ID NO: 2090032 - RNA, 13 nt, Staphylococcus aureus subsp. aureus MW2
gaauuauuauucu

SEQ ID NO: 2090033 - RNA, 17 nt, Staphylococcus aureus subsp. aureus MW2
gaauuauuuaaaaugcu

SEQ ID NO: 2090034 - RNA, 18 nt, Staphylococcus aureus subsp. aureus MW2
gaauuaugaucaauaaga

SEQ ID NO: 2090035 - RNA, 15 nt, Staphylococcus aureus subsp. aureus MW2
gaauuauuuaaaaug

SEQ ID NO: 2090036 - RNA, 16 nt, Staphylococcus aureus subsp. aureus MW2
gaauuaguacuugaaa

SEQ ID NO: 2090037 - RNA, 20 nt, Staphylococcus aureus subsp. aureus MW2
gaauuuacuccuuacaauaa

SEQ ID NO: 2090038 - RNA, 23 nt, Staphylococcus aureus subsp. aureus MW2
gaauuuacuccuuacaauaaaga

SEQ ID NO: 2090039 - RNA, 23 nt, Staphylococcus aureus subsp. aureus MW2
gaauuuagaugcauaaaaaaaga

SEQ ID NO: 2090040 - RNA, 18 nt, Staphylococcus aureus subsp. aureus MW2
gaauuuagcaucaaaaau

SEQ ID NO: 2090041 - RNA, 20 nt, Staphylococcus aureus subsp. aureus MW2
gaauuguuagauaaucucau

SEQ ID NO: 2090042 - RNA, 20 nt, Staphylococcus aureus subsp. aureus MW2
gaauuguauuaaucaaauau

SEQ ID NO: 2090043 - RNA, 20 nt, Staphylococcus aureus subsp. aureus MW2
gaauuuauugacauucacau

SEQ ID NO: 2090044 - RNA, 12 nt, Staphylococcus aureus subsp. aureus MW2
gaauuucaaaaa

SEQ ID NO: 2090045 - RNA, 19 nt, Staphylococcus aureus subsp. aureus MW2
gacaacauaacaaagaacc

SEQ ID NO: 2090046 - RNA, 12 nt, Staphylococcus aureus subsp. aureus MW2
gacaauuauaau

SEQ ID NO: 2090047 - RNA, 22 nt, Staphylococcus aureus subsp. aureus MW2
gacaauaacagcuacaaauaau

SEQ ID NO: 2090048 - RNA, 18 nt, Staphylococcus aureus subsp. aureus MW2
gacaccaacauauuuuaa

SEQ ID NO: 2090049 - RNA, 16 nt, Staphylococcus aureus subsp. aureus MW2
gacuagaggauagaca

SEQ ID NO: 2090050 - RNA, 20 nt, Staphylococcus aureus subsp. aureus MW2
gacuaguguaccuuguuuca

SEQ ID NO: 2090051 - RNA, 16 nt, Staphylococcus aureus subsp. aureus MW2
gacuaguuuggagaau

SEQ ID NO: 2090052 - RNA, 11 nt, Staphylococcus aureus subsp. aureus MW2
gacuauuuuug

SEQ ID NO: 2090053 - RNA, 14 nt, Staphylococcus aureus subsp. aureus MW2
gacuauuuuugaaa

SEQ ID NO: 2090054 - RNA, 19 nt, Staphylococcus aureus subsp. aureus MW2
gacuauguuguuuaaauuu

SEQ ID NO: 2090055 - RNA, 16 nt, Staphylococcus aureus subsp. aureus MW2
gacuaugaaacuggau

SEQ ID NO: 2090056 - RNA, 14 nt, Staphylococcus aureus subsp. aureus MW2
gacuauauaacaca

SEQ ID NO: 2090057 - RNA, 15 nt, Staphylococcus aureus subsp. aureus MW2
gacgucaaucaaugu

SEQ ID NO: 2090058 - RNA, 14 nt, Staphylococcus aureus subsp. aureus MW2
gacuaauaauuguc

SEQ ID NO: 2090059 - RNA, 15 nt, Staphylococcus aureus subsp. aureus MW2
gacuaacuuucuaau

SEQ ID NO: 2090060 - RNA, 19 nt, Staphylococcus aureus subsp. aureus MW2
gacuaaaaguggccuuuua

SEQ ID NO: 2090061 - RNA, 14 nt, Staphylococcus aureus subsp. aureus MW2
gacguaauuaauag

SEQ ID NO: 2090062 - RNA, 18 nt, Staphylococcus aureus subsp. aureus MW2
gacggcuacaauuuucuc

SEQ ID NO: 2090063 - RNA, 19 nt, Staphylococcus aureus subsp. aureus MW2
gacgaaacacacuaaaagc

SEQ ID NO: 2090064 - RNA, 21 nt, Staphylococcus aureus subsp. aureus MW2
gaccauugucaugccuucauu

SEQ ID NO: 2090065 - RNA, 17 nt, Staphylococcus aureus subsp. aureus MW2
gaccaccuuuaucugua

SEQ ID NO: 2090066 - RNA, 17 nt, Staphylococcus aureus subsp. aureus MW2
gacauguccauaauauc

SEQ ID NO: 2090067 - RNA, 15 nt, Staphylococcus aureus subsp. aureus MW2
gacauuucaucaaua

SEQ ID NO: 2090068 - RNA, 17 nt, Staphylococcus aureus subsp. aureus MW2
gacagcaucaccaauuu

SEQ ID NO: 2090069 - RNA, 20 nt, Staphylococcus aureus subsp. aureus MW2
gaaaguaauaaguaauaauu

SEQ ID NO: 2090070 - RNA, 23 nt, Staphylococcus aureus subsp. aureus MW2
gaaaguaauaaguaauaauuuau

SEQ ID NO: 2090071 - RNA, 13 nt, Staphylococcus aureus subsp. aureus MW2
gaaauaaauuuug

SEQ ID NO: 2090072 - RNA, 20 nt, Staphylococcus aureus subsp. aureus MW2
gaaaguauuagauauauuug

SEQ ID NO: 2090073 - RNA, 20 nt, Staphylococcus aureus subsp. aureus MW2
gaaagucagcauacaauaau

SEQ ID NO: 2090074 - RNA, 15 nt, Staphylococcus aureus subsp. aureus MW2
gaaauaaacauauca

SEQ ID NO: 2090075 - RNA, 16 nt, Staphylococcus aureus subsp. aureus MW2
gaaauaaacauaucau

SEQ ID NO: 2090076 - RNA, 13 nt, Staphylococcus aureus subsp. aureus MW2
gaaauauuuaucu

SEQ ID NO: 2090077 - RNA, 19 nt, Staphylococcus aureus subsp. aureus MW2
gaaauaccuccugauugcu

SEQ ID NO: 2090078 - RNA, 16 nt, Staphylococcus aureus subsp. aureus MW2
gaaauaccuccugauu

SEQ ID NO: 2090079 - RNA, 22 nt, Staphylococcus aureus subsp. aureus MW2
gaaauacuugaauguaagaagu

SEQ ID NO: 2090080 - RNA, 22 nt, Staphylococcus aureus subsp. aureus MW2
gaaaaugacgauacguauauag

SEQ ID NO: 2090081 - RNA, 18 nt, Staphylococcus aureus subsp. aureus MW2
gaaaaugacuaccuguug

SEQ ID NO: 2090082 - RNA, 19 nt, Staphylococcus aureus subsp. aureus MW2
gaaacgucuuaauucuucu

SEQ ID NO: 2090083 - RNA, 14 nt, Staphylococcus aureus subsp. aureus MW2
gaaacuuaaauauu

SEQ ID NO: 2090084 - RNA, 13 nt, Staphylococcus aureus subsp. aureus MW2
gaaacugaaguug

SEQ ID NO: 2090085 - RNA, 17 nt, Staphylococcus aureus subsp. aureus MW2
gaaagaugauauauuca

SEQ ID NO: 2090086 - RNA, 16 nt, Staphylococcus aureus subsp. aureus MW2
gaaagcaccuaaaaua

SEQ ID NO: 2090087 - RNA, 18 nt, Staphylococcus aureus subsp. aureus MW2
gaaagcaccuaaaauaga

SEQ ID NO: 2090088 - RNA, 21 nt, Staphylococcus aureus subsp. aureus MW2
gaaauucuacaggcaaugcaa

SEQ ID NO: 2090089 - RNA, 18 nt, Staphylococcus aureus subsp. aureus MW2
aaagagauuuuuuugaaa

SEQ ID NO: 2090090 - RNA, 23 nt, Staphylococcus aureus subsp. aureus MW2
gaaauucuacaggcaaugcaagu

SEQ ID NO: 2090091 - RNA, 14 nt, Staphylococcus aureus subsp. aureus MW2
gaaauucucugugu

SEQ ID NO: 2090092 - RNA, 20 nt, Staphylococcus aureus subsp. aureus MW2
gaaauucucuguguuggggc

SEQ ID NO: 2090093 - RNA, 21 nt, Staphylococcus aureus subsp. aureus MW2
gaaaugauacauuauuaaaua

SEQ ID NO: 2090094 - RNA, 21 nt, Staphylococcus aureus subsp. aureus MW2
aaagagaaaagcuagaaguuc

SEQ ID NO: 2090095 - RNA, 22 nt, Staphylococcus aureus subsp. aureus MW2
aaagagauacugguuaguaaaa

SEQ ID NO: 2090096 - RNA, 19 nt, Staphylococcus aureus subsp. aureus MW2
aaagagaauauaaaauaau

SEQ ID NO: 2090097 - RNA, 15 nt, Staphylococcus aureus subsp. aureus MW2
gaaaucgccuuguuu

SEQ ID NO: 2090098 - RNA, 17 nt, Staphylococcus aureus subsp. aureus MW2
gaacagcugcuucucuu

SEQ ID NO: 2090099 - RNA, 15 nt, Staphylococcus aureus subsp. aureus MW2
gaacaaaauaacaug

SEQ ID NO: 2090100 - RNA, 16 nt, Staphylococcus aureus subsp. aureus MW2
gaacaagucuugcaau

SEQ ID NO: 2090101 - RNA, 19 nt, Staphylococcus aureus subsp. aureus MW2
gaacaauaccgccuacugu

SEQ ID NO: 2090102 - RNA, 13 nt, Staphylococcus aureus subsp. aureus MW2
gaacaauaauaug

SEQ ID NO: 2090103 - RNA, 22 nt, Staphylococcus aureus subsp. aureus MW2
gaacaaucggaagcauauuucu

SEQ ID NO: 2090104 - RNA, 21 nt, Staphylococcus aureus subsp. aureus MW2
gaacgauauuuuaaaaaguaa

SEQ ID NO: 2090105 - RNA, 22 nt, Staphylococcus aureus subsp. aureus MW2
gaacuacaauucauaagaaaaa

SEQ ID NO: 2090106 - RNA, 17 nt, Staphylococcus aureus subsp. aureus MW2
gaacuagacaagaugcu

SEQ ID NO: 2090107 - RNA, 18 nt, Staphylococcus aureus subsp. aureus MW2
gaacuaguacgaaaugca

SEQ ID NO: 2090108 - RNA, 20 nt, Staphylococcus aureus subsp. aureus MW2
gaacugccaauauaacauuu

SEQ ID NO: 2090109 - RNA, 13 nt, Staphylococcus aureus subsp. aureus MW2
gaacaucaucuau

SEQ ID NO: 2090110 - RNA, 14 nt, Staphylococcus aureus subsp. aureus MW2
gaacaucaucuaug

SEQ ID NO: 2090111 - RNA, 17 nt, Staphylococcus aureus subsp. aureus MW2
gaacauagucugcuauu

SEQ ID NO: 2090112 - RNA, 15 nt, Staphylococcus aureus subsp. aureus MW2
gaacauguuucuaga

SEQ ID NO: 2090113 - RNA, 14 nt, Staphylococcus aureus subsp. aureus MW2
gaacauuaaaagga

SEQ ID NO: 2090114 - RNA, 17 nt, Staphylococcus aureus subsp. aureus MW2
gaaccauacucuaacuu

SEQ ID NO: 2090115 - RNA, 15 nt, Staphylococcus aureus subsp. aureus MW2
gaacccaggugcauc

SEQ ID NO: 2090116 - RNA, 17 nt, Staphylococcus aureus subsp. aureus MW2
gaacccuguuaagcuac

SEQ ID NO: 2090117 - RNA, 21 nt, Staphylococcus aureus subsp. aureus MW2
gaaccguauaaugccuaauuu

SEQ ID NO: 2090118 - RNA, 17 nt, Staphylococcus aureus subsp. aureus MW2
gaaccuauauuaagcau

SEQ ID NO: 2090119 - RNA, 15 nt, Staphylococcus aureus subsp. aureus MW2
gaacgaaagagaaaa

SEQ ID NO: 2090120 - RNA, 16 nt, Staphylococcus aureus subsp. aureus MW2
gaacgaaagagaaaag

SEQ ID NO: 2090121 - RNA, 18 nt, Staphylococcus aureus subsp. aureus MW2
gaacgaaagagaaaagcu

SEQ ID NO: 2090122 - RNA, 15 nt, Staphylococcus aureus subsp. aureus MW2
gaacgagagagaaaa

SEQ ID NO: 2090123 - RNA, 18 nt, Staphylococcus aureus subsp. aureus MW2
gaacgagagagaaaagcu

SEQ ID NO: 2090124 - RNA, 17 nt, Staphylococcus aureus subsp. aureus MW2
cuuuugcaccuucaagu

SEQ ID NO: 2090125 - RNA, 19 nt, Staphylococcus aureus subsp. aureus MW2
aaagacugacuaauaaaac

SEQ ID NO: 2090126 - RNA, 19 nt, Staphylococcus aureus subsp. aureus MW2
aaagacuagccauaccuua

SEQ ID NO: 2090127 - RNA, 16 nt, Staphylococcus aureus subsp. aureus MW2
aaagacgcuuucuauu

SEQ ID NO: 2090128 - RNA, 18 nt, Staphylococcus aureus subsp. aureus MW2
aaagacguuuuuuuauaa

SEQ ID NO: 2090129 - RNA, 15 nt, Staphylococcus aureus subsp. aureus MW2
cuuuucuaauuuuuc

SEQ ID NO: 2090130 - RNA, 19 nt, Staphylococcus aureus subsp. aureus MW2
cuuuucuaauuuuucuuua

SEQ ID NO: 2090131 - RNA, 12 nt, Staphylococcus aureus subsp. aureus MW2
cuuuucgcuuuu

SEQ ID NO: 2090132 - RNA, 14 nt, Staphylococcus aureus subsp. aureus MW2
cuuuucgcuuuucu

SEQ ID NO: 2090133 - RNA, 21 nt, Staphylococcus aureus subsp. aureus MW2
aaagaccguauuuuuuuauaa

SEQ ID NO: 2090134 - RNA, 23 nt, Staphylococcus aureus subsp. aureus MW2
aaagacggugaccuuauauuuua

SEQ ID NO: 2090135 - RNA, 22 nt, Staphylococcus aureus subsp. aureus MW2
aaagacgauuuauuaguuuuua

SEQ ID NO: 2090136 - RNA, 17 nt, Staphylococcus aureus subsp. aureus MW2
cuuuucaaacauauuca

SEQ ID NO: 2090137 - RNA, 18 nt, Staphylococcus aureus subsp. aureus MW2
cuuuucaaacauauucau

SEQ ID NO: 2090138 - RNA, 18 nt, Staphylococcus aureus subsp. aureus MW2
cuuuucgaaauucucugu

SEQ ID NO: 2090139 - RNA, 17 nt, Staphylococcus aureus subsp. aureus MW2
cuuuucgaaauucuuua

SEQ ID NO: 2090140 - RNA, 14 nt, Staphylococcus aureus subsp. aureus MW2
cuuuucauuuuuua

SEQ ID NO: 2090141 - RNA, 23 nt, Staphylococcus aureus subsp. aureus MW2
cuuuuauuaaagaaacaugauug

SEQ ID NO: 2090142 - RNA, 16 nt, Staphylococcus aureus subsp. aureus MW2
cuuuuauuauuuuaug

SEQ ID NO: 2090143 - RNA, 14 nt, Staphylococcus aureus subsp. aureus MW2
cuuuuauuuuuaau

SEQ ID NO: 2090144 - RNA, 18 nt, Staphylococcus aureus subsp. aureus MW2
cuuuuauuuuuaauguua

SEQ ID NO: 2090145 - RNA, 14 nt, Staphylococcus aureus subsp. aureus MW2
cuuuuacuaaauga

SEQ ID NO: 2090146 - RNA, 14 nt, Staphylococcus aureus subsp. aureus MW2
cuuuuagaauucua

SEQ ID NO: 2090147 - RNA, 21 nt, Staphylococcus aureus subsp. aureus MW2
cuuuuaaaaucguugcagauu

SEQ ID NO: 2090148 - RNA, 17 nt, Staphylococcus aureus subsp. aureus MW2
cuuuuaaaccguguucu

SEQ ID NO: 2090149 - RNA, 15 nt, Staphylococcus aureus subsp. aureus MW2
cuuuuaaaucauuaa

SEQ ID NO: 2090150 - RNA, 21 nt, Staphylococcus aureus subsp. aureus MW2
cuuuuaacugcgccaguuucu

SEQ ID NO: 2090151 - RNA, 17 nt, Staphylococcus aureus subsp. aureus MW2
gaaaaagcuaauucuua

SEQ ID NO: 2090152 - RNA, 15 nt, Staphylococcus aureus subsp. aureus MW2
gaaaaaacuuuucau

SEQ ID NO: 2090153 - RNA, 15 nt, Staphylococcus aureus subsp. aureus MW2
gaaaaaaauuuucau

SEQ ID NO: 2090154 - RNA, 20 nt, Staphylococcus aureus subsp. aureus MW2
cuuuuuuauuuuauaagaau

SEQ ID NO: 2090155 - RNA, 22 nt, Staphylococcus aureus subsp. aureus MW2
cuuuuugaaauuucgacaucua

SEQ ID NO: 2090156 - RNA, 15 nt, Staphylococcus aureus subsp. aureus MW2
cuuuuuguguaucug

SEQ ID NO: 2090157 - RNA, 20 nt, Staphylococcus aureus subsp. aureus MW2
cuuuuugacucaaaaucuua

SEQ ID NO: 2090158 - RNA, 21 nt, Staphylococcus aureus subsp. aureus MW2
cuuuuugacauauuuuuuaaa

SEQ ID NO: 2090159 - RNA, 22 nt, Staphylococcus aureus subsp. aureus MW2
cuuuuugacauauuuuuuaaau

SEQ ID NO: 2090160 - RNA, 14 nt, Staphylococcus aureus subsp. aureus MW2
cuuuuuuaacuuua

SEQ ID NO: 2090161 - RNA, 17 nt, Staphylococcus aureus subsp. aureus MW2
cuuuuuuaagcuuauca

SEQ ID NO: 2090162 - RNA, 14 nt, Staphylococcus aureus subsp. aureus MW2
cuuuuuuaaauuua

SEQ ID NO: 2090163 - RNA, 17 nt, Staphylococcus aureus subsp. aureus MW2
cuuuuucuucuacauau

SEQ ID NO: 2090164 - RNA, 14 nt, Staphylococcus aureus subsp. aureus MW2
cuuuuucuauacaa

SEQ ID NO: 2090165 - RNA, 19 nt, Staphylococcus aureus subsp. aureus MW2
cuuuuucuauacaaugaau

SEQ ID NO: 2090166 - RNA, 13 nt, Staphylococcus aureus subsp. aureus MW2
cuuuuguuucaaa

SEQ ID NO: 2090167 - RNA, 12 nt, Staphylococcus aureus subsp. aureus MW2
cuuuuuaaaaua

SEQ ID NO: 2090168 - RNA, 22 nt, Staphylococcus aureus subsp. aureus MW2
cuuuuucgauuaauucuucuuc

SEQ ID NO: 2090169 - RNA, 18 nt, Staphylococcus aureus subsp. aureus MW2
cuuuuguuuucacuguuu

SEQ ID NO: 2090170 - RNA, 15 nt, Staphylococcus aureus subsp. aureus MW2
cuuuuguuuuaccau

SEQ ID NO: 2090171 - RNA, 17 nt, Staphylococcus aureus subsp. aureus MW2
gaaaacuucaauaaugu

SEQ ID NO: 2090172 - RNA, 23 nt, Staphylococcus aureus subsp. aureus MW2
gaaaagagggaccuuacuacuca

SEQ ID NO: 2090173 - RNA, 20 nt, Staphylococcus aureus subsp. aureus MW2
gaaaauaaucgaacagaaaa

SEQ ID NO: 2090174 - RNA, 21 nt, Staphylococcus aureus subsp. aureus MW2
gaaaauaaucgaacagaaaau

SEQ ID NO: 2090175 - RNA, 17 nt, Staphylococcus aureus subsp. aureus MW2
gaaaauacuauacugau

SEQ ID NO: 2090176 - RNA, 23 nt, Staphylococcus aureus subsp. aureus MW2
gaaaacagguuaucacaacagua

SEQ ID NO: 2090177 - RNA, 11 nt, Staphylococcus aureus subsp. aureus MW2
gaaaacaauaa

SEQ ID NO: 2090178 - RNA, 14 nt, Staphylococcus aureus subsp. aureus MW2
gaaaacagguggaa

SEQ ID NO: 2090179 - RNA, 14 nt, Staphylococcus aureus subsp. aureus MW2
cuuuacgauaaaua

SEQ ID NO: 2090180 - RNA, 14 nt, Staphylococcus aureus subsp. aureus MW2
cuuuagaaagugau

SEQ ID NO: 2090181 - RNA, 12 nt, Staphylococcus aureus subsp. aureus MW2
cuuuaauaucua

SEQ ID NO: 2090182 - RNA, 16 nt, Staphylococcus aureus subsp. aureus MW2
cuuuaauaucuaauuc

SEQ ID NO: 2090183 - RNA, 21 nt, Staphylococcus aureus subsp. aureus MW2
cuuuaauacuaccguuuuuau

SEQ ID NO: 2090184 - RNA, 18 nt, Staphylococcus aureus subsp. aureus MW2
cuuuaaucauagcauuaa

SEQ ID NO: 2090185 - RNA, 22 nt, Staphylococcus aureus subsp. aureus MW2
cuuuaauaaccuuuaaaacauc

SEQ ID NO: 2090186 - RNA, 21 nt, Staphylococcus aureus subsp. aureus MW2
cuuuaaaucuuguucuaauug

SEQ ID NO: 2090187 - RNA, 14 nt, Staphylococcus aureus subsp. aureus MW2
cuuuaaauuauaua

SEQ ID NO: 2090188 - RNA, 16 nt, Staphylococcus aureus subsp. aureus MW2
cuuuaaaucuuguucu

SEQ ID NO: 2090189 - RNA, 20 nt, Staphylococcus aureus subsp. aureus MW2
cuuuauuuacaauguuaucu

SEQ ID NO: 2090190 - RNA, 19 nt, Staphylococcus aureus subsp. aureus MW2
cuuucaaugcauauucuau

SEQ ID NO: 2090191 - RNA, 18 nt, Staphylococcus aureus subsp. aureus MW2
cuuucaauaauaaaucac

SEQ ID NO: 2090192 - RNA, 15 nt, Staphylococcus aureus subsp. aureus MW2
cuuucaauuaauuua

SEQ ID NO: 2090193 - RNA, 20 nt, Staphylococcus aureus subsp. aureus MW2
cuuucauaaauuguuuuaca

SEQ ID NO: 2090194 - RNA, 21 nt, Staphylococcus aureus subsp. aureus MW2
cuuucaggcuuuguuuuucac

SEQ ID NO: 2090195 - RNA, 18 nt, Staphylococcus aureus subsp. aureus MW2
cuuucagucguuaaaaua

SEQ ID NO: 2090196 - RNA, 19 nt, Staphylococcus aureus subsp. aureus MW2
cuuucagucguuaaaauac

SEQ ID NO: 2090197 - RNA, 23 nt, Staphylococcus aureus subsp. aureus MW2
cuuucagucguuaaaauaccaaa

SEQ ID NO: 2090198 - RNA, 12 nt, Staphylococcus aureus subsp. aureus MW2
cuuuauaugaag

SEQ ID NO: 2090199 - RNA, 22 nt, Staphylococcus aureus subsp. aureus MW2
cuuuagcauauucgcuuaaaaa

SEQ ID NO: 2090200 - RNA, 22 nt, Staphylococcus aureus subsp. aureus MW2
cuuuagcaaaaauauuuaaacu

SEQ ID NO: 2090201 - RNA, 21 nt, Staphylococcus aureus subsp. aureus MW2
cuuuagaaagugauucccaaa

SEQ ID NO: 2090202 - RNA, 17 nt, Staphylococcus aureus subsp. aureus MW2
cuuuauuaaaaauccuc

SEQ ID NO: 2090203 - RNA, 16 nt, Staphylococcus aureus subsp. aureus MW2
cuuuauuaaauaacuc

SEQ ID NO: 2090204 - RNA, 16 nt, Staphylococcus aureus subsp. aureus MW2
cuuuauuauuuaaucu

SEQ ID NO: 2090205 - RNA, 16 nt, Staphylococcus aureus subsp. aureus MW2
cuuugcuaaauauuau

SEQ ID NO: 2090206 - RNA, 20 nt, Staphylococcus aureus subsp. aureus MW2
cuuugcuaaauauuauaaaa

SEQ ID NO: 2090207 - RNA, 21 nt, Staphylococcus aureus subsp. aureus MW2
cuuugcuaaauauuauaaaaa

SEQ ID NO: 2090208 - RNA, 14 nt, Staphylococcus aureus subsp. aureus MW2
cuuugcuaaaucaa

SEQ ID NO: 2090209 - RNA, 17 nt, Staphylococcus aureus subsp. aureus MW2
cuuugauuucauuugug

SEQ ID NO: 2090210 - RNA, 19 nt, Staphylococcus aureus subsp. aureus MW2
cuuugcaauuuuuuaugua

SEQ ID NO: 2090211 - RNA, 22 nt, Staphylococcus aureus subsp. aureus MW2
cuuugacguuuugguuguucuu

SEQ ID NO: 2090212 - RNA, 21 nt, Staphylococcus aureus subsp. aureus MW2
cuuugauguucacuaaaugug

SEQ ID NO: 2090213 - RNA, 19 nt, Staphylococcus aureus subsp. aureus MW2
cuuugucacgauagauuua

SEQ ID NO: 2090214 - RNA, 23 nt, Staphylococcus aureus subsp. aureus MW2
cuuuguauggaaauggugguuac

SEQ ID NO: 2090215 - RNA, 18 nt, Staphylococcus aureus subsp. aureus MW2
cuuuguagccuucaacua

SEQ ID NO: 2090216 - RNA, 18 nt, Staphylococcus aureus subsp. aureus MW2
cuuugcuguccaucguca

SEQ ID NO: 2090217 - RNA, 16 nt, Staphylococcus aureus subsp. aureus MW2
cuuuguuuuuaguaau

SEQ ID NO: 2090218 - RNA, 12 nt, Staphylococcus aureus subsp. aureus MW2
cuuuuaaaaaac

SEQ ID NO: 2090219 - RNA, 12 nt, Staphylococcus aureus subsp. aureus MW2
cuuucuauuuau

SEQ ID NO: 2090220 - RNA, 23 nt, Staphylococcus aureus subsp. aureus MW2
cuuucucaaauuagauaaaacaa

SEQ ID NO: 2090221 - RNA, 18 nt, Staphylococcus aureus subsp. aureus MW2
cuuucucaucuauuuaau

SEQ ID NO: 2090222 - RNA, 23 nt, Staphylococcus aureus subsp. aureus MW2
cuuucucuaaagguaccacugua

SEQ ID NO: 2090223 - RNA, 17 nt, Staphylococcus aureus subsp. aureus MW2
cuuucuuuuucaucuuu

SEQ ID NO: 2090224 - RNA, 17 nt, Staphylococcus aureus subsp. aureus MW2
cuuugaaaaauugcuca

SEQ ID NO: 2090225 - RNA, 22 nt, Staphylococcus aureus subsp. aureus MW2
cuuucuugaugaauuaaacuga

SEQ ID NO: 2090226 - RNA, 23 nt, Staphylococcus aureus subsp. aureus MW2
cuuucguuucuuuuauaucgcuu

SEQ ID NO: 2090227 - RNA, 18 nt, Staphylococcus aureus subsp. aureus MW2
cuuuccgccagucaucau

SEQ ID NO: 2090228 - RNA, 21 nt, Staphylococcus aureus subsp. aureus MW2
cuuuccgccagucaucaucau

SEQ ID NO: 2090229 - RNA, 21 nt, Staphylococcus aureus subsp. aureus MW2
gauaugaauaaccaucuucuu

SEQ ID NO: 2090230 - RNA, 12 nt, Staphylococcus aureus subsp. aureus MW2
gauaucuuuuaa

SEQ ID NO: 2090231 - RNA, 16 nt, Staphylococcus aureus subsp. aureus MW2
gauauacgacaaucac

SEQ ID NO: 2090232 - RNA, 23 nt, Staphylococcus aureus subsp. aureus MW2
gauauauaacuauggucaucaau

SEQ ID NO: 2090233 - RNA, 13 nt, Staphylococcus aureus subsp. aureus MW2
gauagugaauaau

SEQ ID NO: 2090234 - RNA, 14 nt, Staphylococcus aureus subsp. aureus MW2
gauagugaauaaug

SEQ ID NO: 2090235 - RNA, 19 nt, Staphylococcus aureus subsp. aureus MW2
gauagauucugauacagaa

SEQ ID NO: 2090236 - RNA, 14 nt, Staphylococcus aureus subsp. aureus MW2
gauagaugaaaaug

SEQ ID NO: 2090237 - RNA, 13 nt, Staphylococcus aureus subsp. aureus MW2
gauaagaaaauac

SEQ ID NO: 2090238 - RNA, 21 nt, Staphylococcus aureus subsp. aureus MW2
gauaacuguaacgugaggccc

SEQ ID NO: 2090239 - RNA, 19 nt, Staphylococcus aureus subsp. aureus MW2
gauagaauacuaaaagugu

SEQ ID NO: 2090240 - RNA, 20 nt, Staphylococcus aureus subsp. aureus MW2
gauagaauacuaaaaguguu

SEQ ID NO: 2090241 - RNA, 13 nt, Staphylococcus aureus subsp. aureus MW2
gauagaaaaaguu

SEQ ID NO: 2090242 - RNA, 14 nt, Staphylococcus aureus subsp. aureus MW2
gauacgcuuuuuaa

SEQ ID NO: 2090243 - RNA, 15 nt, Staphylococcus aureus subsp. aureus MW2
gauacugccauaugu

SEQ ID NO: 2090244 - RNA, 20 nt, Staphylococcus aureus subsp. aureus MW2
gauauuaauugaaaaaccaa

SEQ ID NO: 2090245 - RNA, 20 nt, Staphylococcus aureus subsp. aureus MW2
gauauguuuggauaucuuug

SEQ ID NO: 2090246 - RNA, 13 nt, Staphylococcus aureus subsp. aureus MW2
gauauuacauaua

SEQ ID NO: 2090247 - RNA, 22 nt, Staphylococcus aureus subsp. aureus MW2
gauauuaauugaaaaaccaagu

SEQ ID NO: 2090248 - RNA, 19 nt, Staphylococcus aureus subsp. aureus MW2
gauaugguuagaaaaaaau

SEQ ID NO: 2090249 - RNA, 21 nt, Staphylococcus aureus subsp. aureus MW2
gaucacuuacugugaaaauac

SEQ ID NO: 2090250 - RNA, 15 nt, Staphylococcus aureus subsp. aureus MW2
gaucacguuuuucuu

SEQ ID NO: 2090251 - RNA, 17 nt, Staphylococcus aureus subsp. aureus MW2
gaucaugccuucaugaa

SEQ ID NO: 2090252 - RNA, 14 nt, Staphylococcus aureus subsp. aureus MW2
gaucaucguauaga

SEQ ID NO: 2090253 - RNA, 22 nt, Staphylococcus aureus subsp. aureus MW2
gaucgaacugauggaaaaguuu

SEQ ID NO: 2090254 - RNA, 15 nt, Staphylococcus aureus subsp. aureus MW2
gauccaauuuauaau

SEQ ID NO: 2090255 - RNA, 18 nt, Staphylococcus aureus subsp. aureus MW2
gauccaccguuaaaauau

SEQ ID NO: 2090256 - RNA, 13 nt, Staphylococcus aureus subsp. aureus MW2
gaucuaaaaccau

SEQ ID NO: 2090257 - RNA, 17 nt, Staphylococcus aureus subsp. aureus MW2
gaggcgccacaacaugu

SEQ ID NO: 2090258 - RNA, 15 nt, Staphylococcus aureus subsp. aureus MW2
gauaaaaguuguauu

SEQ ID NO: 2090259 - RNA, 21 nt, Staphylococcus aureus subsp. aureus MW2
gauaaacaagccaagauaaau

SEQ ID NO: 2090260 - RNA, 14 nt, Staphylococcus aureus subsp. aureus MW2
gauaacuauuuaau

SEQ ID NO: 2090261 - RNA, 23 nt, Staphylococcus aureus subsp. aureus MW2
gaguguaugcauauaagauaauu

SEQ ID NO: 2090262 - RNA, 16 nt, Staphylococcus aureus subsp. aureus MW2
gaguauuuuugcguua

SEQ ID NO: 2090263 - RNA, 20 nt, Staphylococcus aureus subsp. aureus MW2
gagucaaagucauuuagaua

SEQ ID NO: 2090264 - RNA, 15 nt, Staphylococcus aureus subsp. aureus MW2
gagcggaaauaugau

SEQ ID NO: 2090265 - RNA, 20 nt, Staphylococcus aureus subsp. aureus MW2
gagcgaccgugguucaaaaa

SEQ ID NO: 2090266 - RNA, 20 nt, Staphylococcus aureus subsp. aureus MW2
gagccaauuucuacagacaa

SEQ ID NO: 2090267 - RNA, 17 nt, Staphylococcus aureus subsp. aureus MW2
aaagcaccuaaaauaga

SEQ ID NO: 2090268 - RNA, 22 nt, Staphylococcus aureus subsp. aureus MW2
aaagcaccuaaaauagaaaaau

SEQ ID NO: 2090269 - RNA, 14 nt, Staphylococcus aureus subsp. aureus MW2
gacucacuucuuaa

SEQ ID NO: 2090270 - RNA, 15 nt, Staphylococcus aureus subsp. aureus MW2
gacucaaacaauaaa

SEQ ID NO: 2090271 - RNA, 19 nt, Staphylococcus aureus subsp. aureus MW2
gagauuggcaauuuggaca

SEQ ID NO: 2090272 - RNA, 18 nt, Staphylococcus aureus subsp. aureus MW2
gagauucucgguuuuuuc

SEQ ID NO: 2090273 - RNA, 21 nt, Staphylococcus aureus subsp. aureus MW2
gagauuauuuuuuuaaaucua

SEQ ID NO: 2090274 - RNA, 16 nt, Staphylococcus aureus subsp. aureus MW2
gaugaucaauuaacac

SEQ ID NO: 2090275 - RNA, 18 nt, Staphylococcus aureus subsp. aureus MW2
gaugacuguagaaaacau

SEQ ID NO: 2090276 - RNA, 22 nt, Staphylococcus aureus subsp. aureus MW2
gaugaaaacuuaaaaaugaaau

SEQ ID NO: 2090277 - RNA, 12 nt, Staphylococcus aureus subsp. aureus MW2
gaugaaaaagau

SEQ ID NO: 2090278 - RNA, 17 nt, Staphylococcus aureus subsp. aureus MW2
gaugaaaaucuuuaacu

SEQ ID NO: 2090279 - RNA, 19 nt, Staphylococcus aureus subsp. aureus MW2
gaugaaaaucuuuaacucu

SEQ ID NO: 2090280 - RNA, 18 nt, Staphylococcus aureus subsp. aureus MW2
gaucuugcuuaucuaugu

SEQ ID NO: 2090281 - RNA, 18 nt, Staphylococcus aureus subsp. aureus MW2
gaucuucccaucuuuuag

SEQ ID NO: 2090282 - RNA, 14 nt, Staphylococcus aureus subsp. aureus MW2
gaugaauuaaacug

SEQ ID NO: 2090283 - RNA, 14 nt, Staphylococcus aureus subsp. aureus MW2
gaugaauuguaaaa

SEQ ID NO: 2090284 - RNA, 16 nt, Staphylococcus aureus subsp. aureus MW2
gaugaaugauugcauu

SEQ ID NO: 2090285 - RNA, 19 nt, Staphylococcus aureus subsp. aureus MW2
gaugacaaaaauaaaaccg

SEQ ID NO: 2090286 - RNA, 14 nt, Staphylococcus aureus subsp. aureus MW2
gaugaauaaauaga

SEQ ID NO: 2090287 - RNA, 14 nt, Staphylococcus aureus subsp. aureus MW2
gaugaaccaaaaaa

SEQ ID NO: 2090288 - RNA, 23 nt, Staphylococcus aureus subsp. aureus MW2
gaugaacaaaauaacauguuugu

SEQ ID NO: 2090289 - RNA, 19 nt, Staphylococcus aureus subsp. aureus MW2
gaugauuuauuaacucaug

SEQ ID NO: 2090290 - RNA, 13 nt, Staphylococcus aureus subsp. aureus MW2
gaugauucuuauc

SEQ ID NO: 2090291 - RNA, 18 nt, Staphylococcus aureus subsp. aureus MW2
gaugcuuuaauuaaaguu

SEQ ID NO: 2090292 - RNA, 16 nt, Staphylococcus aureus subsp. aureus MW2
gaugcuugaauguuug

SEQ ID NO: 2090293 - RNA, 12 nt, Staphylococcus aureus subsp. aureus MW2
gauggaaucauu

SEQ ID NO: 2090294 - RNA, 18 nt, Staphylococcus aureus subsp. aureus MW2
gaugggccccaacacaga

SEQ ID NO: 2090295 - RNA, 21 nt, Staphylococcus aureus subsp. aureus MW2
gaugggccccaacacagagaa

SEQ ID NO: 2090296 - RNA, 16 nt, Staphylococcus aureus subsp. aureus MW2
gaugguacuaaaguug

SEQ ID NO: 2090297 - RNA, 17 nt, Staphylococcus aureus subsp. aureus MW2
gauguaccacucauaau

SEQ ID NO: 2090298 - RNA, 16 nt, Staphylococcus aureus subsp. aureus MW2
gaugucacauaugacu

SEQ ID NO: 2090299 - RNA, 13 nt, Staphylococcus aureus subsp. aureus MW2
gaugguugcuuca

SEQ ID NO: 2090300 - RNA, 13 nt, Staphylococcus aureus subsp. aureus MW2
gaugguuuuguuu

SEQ ID NO: 2090301 - RNA, 18 nt, Staphylococcus aureus subsp. aureus MW2
gauuaauucuucuucagu

SEQ ID NO: 2090302 - RNA, 17 nt, Staphylococcus aureus subsp. aureus MW2
gauuaccaaguaaugau

SEQ ID NO: 2090303 - RNA, 17 nt, Staphylococcus aureus subsp. aureus MW2
gauuacauucuauacuu

SEQ ID NO: 2090304 - RNA, 23 nt, Staphylococcus aureus subsp. aureus MW2
gauuacagcguacuaaagaauga

SEQ ID NO: 2090305 - RNA, 16 nt, Staphylococcus aureus subsp. aureus MW2
gauuauaaugauuguc

SEQ ID NO: 2090306 - RNA, 16 nt, Staphylococcus aureus subsp. aureus MW2
gauuauagguauaaga

SEQ ID NO: 2090307 - RNA, 14 nt, Staphylococcus aureus subsp. aureus MW2
gauuauauuuuucu

SEQ ID NO: 2090308 - RNA, 20 nt, Staphylococcus aureus subsp. aureus MW2
gauuaugacaacauaacaaa

SEQ ID NO: 2090309 - RNA, 22 nt, Staphylococcus aureus subsp. aureus MW2
gauuaucuguaauuaauccauc

SEQ ID NO: 2090310 - RNA, 22 nt, Staphylococcus aureus subsp. aureus MW2
gauuaucugacauuguugcuaa

SEQ ID NO: 2090311 - RNA, 22 nt, Staphylococcus aureus subsp. aureus MW2
gauuauucuucauuuauaacau

SEQ ID NO: 2090312 - RNA, 12 nt, Staphylococcus aureus subsp. aureus MW2
gauuauucuuca

SEQ ID NO: 2090313 - RNA, 22 nt, Staphylococcus aureus subsp. aureus MW2
gauuauuuaaaacuuguaaauu

SEQ ID NO: 2090314 - RNA, 20 nt, Staphylococcus aureus subsp. aureus MW2
gauuauuuaaaacuuguaaa

SEQ ID NO: 2090315 - RNA, 18 nt, Staphylococcus aureus subsp. aureus MW2
gauuauugguugaaauua

SEQ ID NO: 2090316 - RNA, 22 nt, Staphylococcus aureus subsp. aureus MW2
gauucaaauaaaucaaacuuuu

SEQ ID NO: 2090317 - RNA, 15 nt, Staphylococcus aureus subsp. aureus MW2
gauucaaaaauuguu

SEQ ID NO: 2090318 - RNA, 16 nt, Staphylococcus aureus subsp. aureus MW2
gauucaaaaauuguua

SEQ ID NO: 2090319 - RNA, 14 nt, Staphylococcus aureus subsp. aureus MW2
gaugugacaaauac

SEQ ID NO: 2090320 - RNA, 21 nt, Staphylococcus aureus subsp. aureus MW2
gaugugccuuucuaauauuuu

SEQ ID NO: 2090321 - RNA, 17 nt, Staphylococcus aureus subsp. aureus MW2
gauguuucaaaauaauu

SEQ ID NO: 2090322 - RNA, 13 nt, Staphylococcus aureus subsp. aureus MW2
gauguuuuauaag

SEQ ID NO: 2090323 - RNA, 12 nt, Staphylococcus aureus subsp. aureus MW2
gauuaaaagugu

SEQ ID NO: 2090324 - RNA, 16 nt, Staphylococcus aureus subsp. aureus MW2
gauguucacuaaaugu

SEQ ID NO: 2090325 - RNA, 16 nt, Staphylococcus aureus subsp. aureus MW2
gauguugguucaucaa

SEQ ID NO: 2090326 - RNA, 20 nt, Staphylococcus aureus subsp. aureus MW2
gauuaaaguguuucaacaua

SEQ ID NO: 2090327 - RNA, 20 nt, Staphylococcus aureus subsp. aureus MW2
gauuaaauucuuuucaagaa

SEQ ID NO: 2090328 - RNA, 17 nt, Staphylococcus aureus subsp. aureus MW2
gauuaaaauaugacaca

SEQ ID NO: 2090329 - RNA, 11 nt, Staphylococcus aureus subsp. aureus MW2
gauuaaacugc

SEQ ID NO: 2090330 - RNA, 21 nt, Staphylococcus aureus subsp. aureus MW2
gauugacuaaguuuguuuucu

SEQ ID NO: 2090331 - RNA, 12 nt, Staphylococcus aureus subsp. aureus MW2
gauugaaaaaau

SEQ ID NO: 2090332 - RNA, 13 nt, Staphylococcus aureus subsp. aureus MW2
gauugaaugaagc

SEQ ID NO: 2090333 - RNA, 16 nt, Staphylococcus aureus subsp. aureus MW2
gauucuauagcacuga

SEQ ID NO: 2090334 - RNA, 18 nt, Staphylococcus aureus subsp. aureus MW2
gauucuuaucuuuaauca

SEQ ID NO: 2090335 - RNA, 22 nt, Staphylococcus aureus subsp. aureus MW2
gauuggaaaguuucuccaccug

SEQ ID NO: 2090336 - RNA, 14 nt, Staphylococcus aureus subsp. aureus MW2
gauugguaaaucua

SEQ ID NO: 2090337 - RNA, 22 nt, Staphylococcus aureus subsp. aureus MW2
gauugauauaaauuaucagaau

SEQ ID NO: 2090338 - RNA, 23 nt, Staphylococcus aureus subsp. aureus MW2
gauugauaugguuagaaaaaaau

SEQ ID NO: 2090339 - RNA, 21 nt, Staphylococcus aureus subsp. aureus MW2
gauugcacguuugaaugaacc

SEQ ID NO: 2090340 - RNA, 18 nt, Staphylococcus aureus subsp. aureus MW2
gauuccuguaacaagaac

SEQ ID NO: 2090341 - RNA, 14 nt, Staphylococcus aureus subsp. aureus MW2
gauucggaaaauau

SEQ ID NO: 2090342 - RNA, 22 nt, Staphylococcus aureus subsp. aureus MW2
gauucuaacggcguuuguuucu

SEQ ID NO: 2090343 - RNA, 15 nt, Staphylococcus aureus subsp. aureus MW2
gauucauauuuaucg

SEQ ID NO: 2090344 - RNA, 18 nt, Staphylococcus aureus subsp. aureus MW2
gauuccaucucauacuau

SEQ ID NO: 2090345 - RNA, 13 nt, Staphylococcus aureus subsp. aureus MW2
gauucaaaugaca

SEQ ID NO: 2090346 - RNA, 16 nt, Staphylococcus aureus subsp. aureus MW2
gauucaacuuguuucc

SEQ ID NO: 2090347 - RNA, 15 nt, Staphylococcus aureus subsp. aureus MW2
gauucaccuaauaau

SEQ ID NO: 2090348 - RNA, 18 nt, Staphylococcus aureus subsp. aureus MW2
gauucaccaauuaggauu

SEQ ID NO: 2090349 - RNA, 15 nt, Staphylococcus aureus subsp. aureus MW2
gauucaccagguuuu

SEQ ID NO: 2090350 - RNA, 15 nt, Staphylococcus aureus subsp. aureus MW2
gauugucuuauaaga

SEQ ID NO: 2090351 - RNA, 12 nt, Staphylococcus aureus subsp. aureus MW2
gauuguaaauaa

SEQ ID NO: 2090352 - RNA, 14 nt, Staphylococcus aureus subsp. aureus MW2
gauuguaaauaaaa

SEQ ID NO: 2090353 - RNA, 17 nt, Staphylococcus aureus subsp. aureus MW2
gauuguaauaauaaucu

SEQ ID NO: 2090354 - RNA, 24 nt, Staphylococcus aureus subsp. aureus MW2
gauuguaauaauaaucuuuaacau

SEQ ID NO: 2090355 - RNA, 16 nt, Staphylococcus aureus subsp. aureus MW2
gauuguuucaccagcu

SEQ ID NO: 2090356 - RNA, 23 nt, Staphylococcus aureus subsp. aureus MW2
gauuguuucaccagcuuguaaau

SEQ ID NO: 2090357 - RNA, 19 nt, Staphylococcus aureus subsp. aureus MW2
gauuguccagcucuuaaau

SEQ ID NO: 2090358 - RNA, 22 nt, Staphylococcus aureus subsp. aureus MW2
gauuuaaaaaaauuaauguuuu

SEQ ID NO: 2090359 - RNA, 21 nt, Staphylococcus aureus subsp. aureus MW2
gauuuaaaauauaaauuucuu

SEQ ID NO: 2090360 - RNA, 21 nt, Staphylococcus aureus subsp. aureus MW2
gauuuaccucuugauaaaaua

SEQ ID NO: 2090361 - RNA, 20 nt, Staphylococcus aureus subsp. aureus MW2
gauuucccacgugccucauc

SEQ ID NO: 2090362 - RNA, 15 nt, Staphylococcus aureus subsp. aureus MW2
gauuuauaaauguuu

SEQ ID NO: 2090363 - RNA, 14 nt, Staphylococcus aureus subsp. aureus MW2
gauuuauauuuuuu

SEQ ID NO: 2090364 - RNA, 15 nt, Staphylococcus aureus subsp. aureus MW2
gauuucacuucuaaa

SEQ ID NO: 2090365 - RNA, 23 nt, Staphylococcus aureus subsp. aureus MW2
gauuugccaaaaguuauauaaau

SEQ ID NO: 2090366 - RNA, 14 nt, Staphylococcus aureus subsp. aureus MW2
gauuugaaauuuau

SEQ ID NO: 2090367 - RNA, 12 nt, Staphylococcus aureus subsp. aureus MW2
gauuucuuauuu

SEQ ID NO: 2090368 - RNA, 15 nt, Staphylococcus aureus subsp. aureus MW2
gauuucuaucaaaua

SEQ ID NO: 2090369 - RNA, 20 nt, Staphylococcus aureus subsp. aureus MW2
gauuuuaauaaauuagccau

SEQ ID NO: 2090370 - RNA, 19 nt, Staphylococcus aureus subsp. aureus MW2
gauuuuagugcgcuuauuu

SEQ ID NO: 2090371 - RNA, 17 nt, Staphylococcus aureus subsp. aureus MW2
gauuuuaaagaaaaguu

SEQ ID NO: 2090372 - RNA, 16 nt, Staphylococcus aureus subsp. aureus MW2
gauuuucaaaaccuuc

SEQ ID NO: 2090373 - RNA, 20 nt, Staphylococcus aureus subsp. aureus MW2
gauuuucuaaagcuugauca

SEQ ID NO: 2090374 - RNA, 13 nt, Staphylococcus aureus subsp. aureus MW2
gauuuuuaaaaug

SEQ ID NO: 2090375 - RNA, 22 nt, Staphylococcus aureus subsp. aureus MW2
gauuuugcugccaaaaaguauu

SEQ ID NO: 2090376 - RNA, 16 nt, Staphylococcus aureus subsp. aureus MW2
gauuuuggaugaagcg

SEQ ID NO: 2090377 - RNA, 13 nt, Staphylococcus aureus subsp. aureus MW2
gauuuuucuuaua

SEQ ID NO: 2090378 - RNA, 18 nt, Staphylococcus aureus subsp. aureus MW2
gauuuuuuggauuccauc

SEQ ID NO: 2090379 - RNA, 15 nt, Staphylococcus aureus subsp. aureus MW2
gauuuuuugguuucu

SEQ ID NO: 2090380 - RNA, 13 nt, Staphylococcus aureus subsp. aureus MW2
gcaaaaauacuuu

SEQ ID NO: 2090381 - RNA, 18 nt, Staphylococcus aureus subsp. aureus MW2
gcaaaaauaauaugaauu

SEQ ID NO: 2090382 - RNA, 21 nt, Staphylococcus aureus subsp. aureus MW2
gcaaaagugguuguucccauu

SEQ ID NO: 2090383 - RNA, 19 nt, Staphylococcus aureus subsp. aureus MW2
gcaaaauacgauuuguuca

SEQ ID NO: 2090384 - RNA, 20 nt, Staphylococcus aureus subsp. aureus MW2
gcaaaauuuugcaaaaaaau

SEQ ID NO: 2090385 - RNA, 16 nt, Staphylococcus aureus subsp. aureus MW2
gcaaaacgcauuucau

SEQ ID NO: 2090386 - RNA, 22 nt, Staphylococcus aureus subsp. aureus MW2
gcaaaacgcauuucauguguca

SEQ ID NO: 2090387 - RNA, 18 nt, Staphylococcus aureus subsp. aureus MW2
gcaaagacucaauuucau

SEQ ID NO: 2090388 - RNA, 16 nt, Staphylococcus aureus subsp. aureus MW2
gcaaacuugauucaau

SEQ ID NO: 2090389 - RNA, 16 nt, Staphylococcus aureus subsp. aureus MW2
gcaaauauuauuaaau

SEQ ID NO: 2090390 - RNA, 13 nt, Staphylococcus aureus subsp. aureus MW2
gcaaaucaaacaa

SEQ ID NO: 2090391 - RNA, 16 nt, Staphylococcus aureus subsp. aureus MW2
gcaaauagcgauuuua

SEQ ID NO: 2090392 - RNA, 13 nt, Staphylococcus aureus subsp. aureus MW2
gcaaauauaucau

SEQ ID NO: 2090393 - RNA, 17 nt, Staphylococcus aureus subsp. aureus MW2
gcaaauaaaaucauaac

SEQ ID NO: 2090394 - RNA, 19 nt, Staphylococcus aureus subsp. aureus MW2
gcaaagucauuaaauguac

SEQ ID NO: 2090395 - RNA, 18 nt, Staphylococcus aureus subsp. aureus MW2
gcaaaugguccaacugga

SEQ ID NO: 2090396 - RNA, 17 nt, Staphylococcus aureus subsp. aureus MW2
gcaaauuggaaaaauaa

SEQ ID NO: 2090397 - RNA, 13 nt, Staphylococcus aureus subsp. aureus MW2
gcaaauuggaaaa

SEQ ID NO: 2090398 - RNA, 17 nt, Staphylococcus aureus subsp. aureus MW2
gcaaauugauuaaauaa

SEQ ID NO: 2090399 - RNA, 14 nt, Staphylococcus aureus subsp. aureus MW2
gcaaauuaucauua

SEQ ID NO: 2090400 - RNA, 13 nt, Staphylococcus aureus subsp. aureus MW2
gcaaauuaucauu

SEQ ID NO: 2090401 - RNA, 20 nt, Staphylococcus aureus subsp. aureus MW2
gcaaauuaguaugacuuacc

SEQ ID NO: 2090402 - RNA, 16 nt, Staphylococcus aureus subsp. aureus MW2
gcaacaaaagauguug

SEQ ID NO: 2090403 - RNA, 19 nt, Staphylococcus aureus subsp. aureus MW2
gcaaauuuccacagcaauu

SEQ ID NO: 2090404 - RNA, 12 nt, Staphylococcus aureus subsp. aureus MW2
gcaacauauuuu

SEQ ID NO: 2090405 - RNA, 13 nt, Staphylococcus aureus subsp. aureus MW2
gcaacaauuugca

SEQ ID NO: 2090406 - RNA, 21 nt, Staphylococcus aureus subsp. aureus MW2
gcaacacucggaaacauguua

SEQ ID NO: 2090407 - RNA, 17 nt, Staphylococcus aureus subsp. aureus MW2
gcccauucaguuuugua

SEQ ID NO: 2090408 - RNA, 19 nt, Staphylococcus aureus subsp. aureus MW2
gccccuuacaacuuuaguu

SEQ ID NO: 2090409 - RNA, 18 nt, Staphylococcus aureus subsp. aureus MW2
gcccauccccaacuugca

SEQ ID NO: 2090410 - RNA, 15 nt, Staphylococcus aureus subsp. aureus MW2
gcccagaauguguug

SEQ ID NO: 2090411 - RNA, 15 nt, Staphylococcus aureus subsp. aureus MW2
gcccaaacauagaga

SEQ ID NO: 2090412 - RNA, 15 nt, Staphylococcus aureus subsp. aureus MW2
gccauauguauuaua

SEQ ID NO: 2090413 - RNA, 12 nt, Staphylococcus aureus subsp. aureus MW2
gccauauuuauu

SEQ ID NO: 2090414 - RNA, 18 nt, Staphylococcus aureus subsp. aureus MW2
gccauaucauauuacuuc

SEQ ID NO: 2090415 - RNA, 14 nt, Staphylococcus aureus subsp. aureus MW2
gccgagauuauuau

SEQ ID NO: 2090416 - RNA, 15 nt, Staphylococcus aureus subsp. aureus MW2
aaagcugauuuuuca

SEQ ID NO: 2090417 - RNA, 16 nt, Staphylococcus aureus subsp. aureus MW2
aaagcugauuucuauu

SEQ ID NO: 2090418 - RNA, 22 nt, Staphylococcus aureus subsp. aureus MW2
aaagcucggcacucaauuuaag

SEQ ID NO: 2090419 - RNA, 15 nt, Staphylococcus aureus subsp. aureus MW2
gccgcuucauugaug

SEQ ID NO: 2090420 - RNA, 19 nt, Staphylococcus aureus subsp. aureus MW2
gccaaauacuaguaauaau

SEQ ID NO: 2090421 - RNA, 20 nt, Staphylococcus aureus subsp. aureus MW2
gccaaauacuaguaauaaua

SEQ ID NO: 2090422 - RNA, 12 nt, Staphylococcus aureus subsp. aureus MW2
gccacuuuugug

SEQ ID NO: 2090423 - RNA, 21 nt, Staphylococcus aureus subsp. aureus MW2
gccagcuucuuuguuggggcc

SEQ ID NO: 2090424 - RNA, 22 nt, Staphylococcus aureus subsp. aureus MW2
gccagcuucuuuguuggggccc

SEQ ID NO: 2090425 - RNA, 20 nt, Staphylococcus aureus subsp. aureus MW2
gccagcuucuauguuggggc

SEQ ID NO: 2090426 - RNA, 21 nt, Staphylococcus aureus subsp. aureus MW2
gccagcuucuauguuggggcc

SEQ ID NO: 2090427 - RNA, 22 nt, Staphylococcus aureus subsp. aureus MW2
gccagcuucuauguuggggccc

SEQ ID NO: 2090428 - RNA, 17 nt, Staphylococcus aureus subsp. aureus MW2
gcauuuguaaacaguau

SEQ ID NO: 2090429 - RNA, 22 nt, Staphylococcus aureus subsp. aureus MW2
gcauuuaaauauaaaccagcug

SEQ ID NO: 2090430 - RNA, 20 nt, Staphylococcus aureus subsp. aureus MW2
gcauuuaaauauaaccuaaa

SEQ ID NO: 2090431 - RNA, 14 nt, Staphylococcus aureus subsp. aureus MW2
gcauugcuuuuguu

SEQ ID NO: 2090432 - RNA, 20 nt, Staphylococcus aureus subsp. aureus MW2
gcauugcuuuuguuaauauu

SEQ ID NO: 2090433 - RNA, 15 nt, Staphylococcus aureus subsp. aureus MW2
gcauucaguuaaugu

SEQ ID NO: 2090434 - RNA, 19 nt, Staphylococcus aureus subsp. aureus MW2
gcaucuucaauauuuaaau

SEQ ID NO: 2090435 - RNA, 13 nt, Staphylococcus aureus subsp. aureus MW2
gcauuaaugauuc

SEQ ID NO: 2090436 - RNA, 13 nt, Staphylococcus aureus subsp. aureus MW2
gcauuaauuucau

SEQ ID NO: 2090437 - RNA, 17 nt, Staphylococcus aureus subsp. aureus MW2
gcauuaauguucaauuu

SEQ ID NO: 2090438 - RNA, 17 nt, Staphylococcus aureus subsp. aureus MW2
gcauguccugaauguuc

SEQ ID NO: 2090439 - RNA, 16 nt, Staphylococcus aureus subsp. aureus MW2
gcaugcuucucaauuu

SEQ ID NO: 2090440 - RNA, 18 nt, Staphylococcus aureus subsp. aureus MW2
gcauaagauugcuuuuuc

SEQ ID NO: 2090441 - RNA, 16 nt, Staphylococcus aureus subsp. aureus MW2
gcauaucuuuaucauu

SEQ ID NO: 2090442 - RNA, 23 nt, Staphylococcus aureus subsp. aureus MW2
gcauauucgcuuaaaaacgcuuu

SEQ ID NO: 2090443 - RNA, 15 nt, Staphylococcus aureus subsp. aureus MW2
gcauauucugcaccu

SEQ ID NO: 2090444 - RNA, 18 nt, Staphylococcus aureus subsp. aureus MW2
gcauaucgauaaauguau

SEQ ID NO: 2090445 - RNA, 13 nt, Staphylococcus aureus subsp. aureus MW2
gcaucaaaaauga

SEQ ID NO: 2090446 - RNA, 16 nt, Staphylococcus aureus subsp. aureus MW2
gcaucaacagauacuu

SEQ ID NO: 2090447 - RNA, 22 nt, Staphylococcus aureus subsp. aureus MW2
gcaucaguauuaggauuuacuc

SEQ ID NO: 2090448 - RNA, 16 nt, Staphylococcus aureus subsp. aureus MW2
gcaucuacuaaaucaa

SEQ ID NO: 2090449 - RNA, 17 nt, Staphylococcus aureus subsp. aureus MW2
gcaucuacuaaaucaaa

SEQ ID NO: 2090450 - RNA, 13 nt, Staphylococcus aureus subsp. aureus MW2
gcagcuucuuuaa

SEQ ID NO: 2090451 - RNA, 15 nt, Staphylococcus aureus subsp. aureus MW2
gcagcuaaaaaguau

SEQ ID NO: 2090452 - RNA, 14 nt, Staphylococcus aureus subsp. aureus MW2
gcaguuaauaagaa

SEQ ID NO: 2090453 - RNA, 17 nt, Staphylococcus aureus subsp. aureus MW2
gcaguucugaaacauuu

SEQ ID NO: 2090454 - RNA, 18 nt, Staphylococcus aureus subsp. aureus MW2
gcaguucugaaacauuua

SEQ ID NO: 2090455 - RNA, 23 nt, Staphylococcus aureus subsp. aureus MW2
gcauaaaaaaagaacuacgcauu

SEQ ID NO: 2090456 - RNA, 14 nt, Staphylococcus aureus subsp. aureus MW2
gcaguugaaaaaga

SEQ ID NO: 2090457 - RNA, 19 nt, Staphylococcus aureus subsp. aureus MW2
gcaguauauaucaaauaca

SEQ ID NO: 2090458 - RNA, 15 nt, Staphylococcus aureus subsp. aureus MW2
gcaguauauaucaaa

SEQ ID NO: 2090459 - RNA, 19 nt, Staphylococcus aureus subsp. aureus MW2
gcaguaagauauuuccaaa

SEQ ID NO: 2090460 - RNA, 12 nt, Staphylococcus aureus subsp. aureus MW2
gcaguaaaacca

SEQ ID NO: 2090461 - RNA, 17 nt, Staphylococcus aureus subsp. aureus MW2
gcgcuuuuuuuuauaag

SEQ ID NO: 2090462 - RNA, 13 nt, Staphylococcus aureus subsp. aureus MW2
gcggaaauaugau

SEQ ID NO: 2090463 - RNA, 23 nt, Staphylococcus aureus subsp. aureus MW2
gcgcucuggauuuuucuuauaaa

SEQ ID NO: 2090464 - RNA, 15 nt, Staphylococcus aureus subsp. aureus MW2
gcgccauaaucauua

SEQ ID NO: 2090465 - RNA, 23 nt, Staphylococcus aureus subsp. aureus MW2
gcgacguuuaaaugcccaccaug

SEQ ID NO: 2090466 - RNA, 15 nt, Staphylococcus aureus subsp. aureus MW2
gcgauaaaaguugua

SEQ ID NO: 2090467 - RNA, 13 nt, Staphylococcus aureus subsp. aureus MW2
gcgauaaaguaug

SEQ ID NO: 2090468 - RNA, 15 nt, Staphylococcus aureus subsp. aureus MW2
gcgcagcaaaugcuu

SEQ ID NO: 2090469 - RNA, 18 nt, Staphylococcus aureus subsp. aureus MW2
gccguauuucaaauguaa

SEQ ID NO: 2090470 - RNA, 16 nt, Staphylococcus aureus subsp. aureus MW2
gccguccauuuccaug

SEQ ID NO: 2090471 - RNA, 17 nt, Staphylococcus aureus subsp. aureus MW2
gccuaauaauaaaauag

SEQ ID NO: 2090472 - RNA, 19 nt, Staphylococcus aureus subsp. aureus MW2
gccuaauaauaaaauagcu

SEQ ID NO: 2090473 - RNA, 20 nt, Staphylococcus aureus subsp. aureus MW2
gccuacuguuucacguaaug

SEQ ID NO: 2090474 - RNA, 14 nt, Staphylococcus aureus subsp. aureus MW2
gccuacuuuuucaa

SEQ ID NO: 2090475 - RNA, 14 nt, Staphylococcus aureus subsp. aureus MW2
gccguuauuuucaa

SEQ ID NO: 2090476 - RNA, 16 nt, Staphylococcus aureus subsp. aureus MW2
gccuauccauucaaau

SEQ ID NO: 2090477 - RNA, 18 nt, Staphylococcus aureus subsp. aureus MW2
gccuuaacuucauaauau

SEQ ID NO: 2090478 - RNA, 16 nt, Staphylococcus aureus subsp. aureus MW2
gccuguuugacacauu

SEQ ID NO: 2090479 - RNA, 15 nt, Staphylococcus aureus subsp. aureus MW2
gcgaaaguaucuaug

SEQ ID NO: 2090480 - RNA, 16 nt, Staphylococcus aureus subsp. aureus MW2
gcgaaaugcauuacua

SEQ ID NO: 2090481 - RNA, 16 nt, Staphylococcus aureus subsp. aureus MW2
gcgaaaucaguuugaa

SEQ ID NO: 2090482 - RNA, 14 nt, Staphylococcus aureus subsp. aureus MW2
gcgaacguuauuuu

SEQ ID NO: 2090483 - RNA, 20 nt, Staphylococcus aureus subsp. aureus MW2
gccuuuccauuguugauaaa

SEQ ID NO: 2090484 - RNA, 14 nt, Staphylococcus aureus subsp. aureus MW2
gccuuuuaaacaaa

SEQ ID NO: 2090485 - RNA, 19 nt, Staphylococcus aureus subsp. aureus MW2
gccuuuuaaacaaauaaaa

SEQ ID NO: 2090486 - RNA, 19 nt, Staphylococcus aureus subsp. aureus MW2
gccuugauuuuuugaaaug

SEQ ID NO: 2090487 - RNA, 17 nt, Staphylococcus aureus subsp. aureus MW2
aaauaccgucuucucua

SEQ ID NO: 2090488 - RNA, 15 nt, Staphylococcus aureus subsp. aureus MW2
aaauaccugcaauga

SEQ ID NO: 2090489 - RNA, 19 nt, Staphylococcus aureus subsp. aureus MW2
aaauacgacaccaacauau

SEQ ID NO: 2090490 - RNA, 15 nt, Staphylococcus aureus subsp. aureus MW2
aaauacgcaaaccaa

SEQ ID NO: 2090491 - RNA, 16 nt, Staphylococcus aureus subsp. aureus MW2
aaauacgaguguuggu

SEQ ID NO: 2090492 - RNA, 21 nt, Staphylococcus aureus subsp. aureus MW2
aaauacuuuuugaugauuuac

SEQ ID NO: 2090493 - RNA, 15 nt, Staphylococcus aureus subsp. aureus MW2
aaauagaaaaaacaa

SEQ ID NO: 2090494 - RNA, 17 nt, Staphylococcus aureus subsp. aureus MW2
aaauagaaacagcagua

SEQ ID NO: 2090495 - RNA, 22 nt, Staphylococcus aureus subsp. aureus MW2
aaauacuuguuuaccuaaaucu

SEQ ID NO: 2090496 - RNA, 14 nt, Staphylococcus aureus subsp. aureus MW2
aaauacuuuugcau

SEQ ID NO: 2090497 - RNA, 22 nt, Staphylococcus aureus subsp. aureus MW2
aaauacuuuugcaucacagaua

SEQ ID NO: 2090498 - RNA, 18 nt, Staphylococcus aureus subsp. aureus MW2
aaauaccaacugcaaaua

SEQ ID NO: 2090499 - RNA, 21 nt, Staphylococcus aureus subsp. aureus MW2
aaauaccaacugcaaauacac

SEQ ID NO: 2090500 - RNA, 22 nt, Staphylococcus aureus subsp. aureus MW2
aaauaccaacugcaaauacacc

SEQ ID NO: 2090501 - RNA, 17 nt, Staphylococcus aureus subsp. aureus MW2
aaauaccaaauaugacu

SEQ ID NO: 2090502 - RNA, 14 nt, Staphylococcus aureus subsp. aureus MW2
aaauacauaauuaa

SEQ ID NO: 2090503 - RNA, 16 nt, Staphylococcus aureus subsp. aureus MW2
aaauacaucggaauuc

SEQ ID NO: 2090504 - RNA, 13 nt, Staphylococcus aureus subsp. aureus MW2
aaauaauuaugaa

SEQ ID NO: 2090505 - RNA, 21 nt, Staphylococcus aureus subsp. aureus MW2
aaauaauuuaaaggcauaaua

SEQ ID NO: 2090506 - RNA, 22 nt, Staphylococcus aureus subsp. aureus MW2
aaauaauuuaaaggcauaauaa

SEQ ID NO: 2090507 - RNA, 13 nt, Staphylococcus aureus subsp. aureus MW2
aaauaauuuaaau

SEQ ID NO: 2090508 - RNA, 19 nt, Staphylococcus aureus subsp. aureus MW2
aaauaauuuaaauuaaaau

SEQ ID NO: 2090509 - RNA, 22 nt, Staphylococcus aureus subsp. aureus MW2
aaauaauuuaaauuaaaauaau

SEQ ID NO: 2090510 - RNA, 12 nt, Staphylococcus aureus subsp. aureus MW2
aaauaauuuaau

SEQ ID NO: 2090511 - RNA, 17 nt, Staphylococcus aureus subsp. aureus MW2
aaauaauuuaauuuuuu

SEQ ID NO: 2090512 - RNA, 17 nt, Staphylococcus aureus subsp. aureus MW2
aaauaauuuagaaauau

SEQ ID NO: 2090513 - RNA, 19 nt, Staphylococcus aureus subsp. aureus MW2
aaauacaaagccuuaauau

SEQ ID NO: 2090514 - RNA, 22 nt, Staphylococcus aureus subsp. aureus MW2
aaauaaucucuucaauuuauuu

SEQ ID NO: 2090515 - RNA, 16 nt, Staphylococcus aureus subsp. aureus MW2
aaauaaucucuucaau

SEQ ID NO: 2090516 - RNA, 18 nt, Staphylococcus aureus subsp. aureus MW2
aaauaaugauacuaauaa

SEQ ID NO: 2090517 - RNA, 18 nt, Staphylococcus aureus subsp. aureus MW2
aaauaaugcuuauuaaaa

SEQ ID NO: 2090518 - RNA, 17 nt, Staphylococcus aureus subsp. aureus MW2
aaauaaucgaacagaaa

SEQ ID NO: 2090519 - RNA, 22 nt, Staphylococcus aureus subsp. aureus MW2
aaauaauaacccgaacacaaaa

SEQ ID NO: 2090520 - RNA, 16 nt, Staphylococcus aureus subsp. aureus MW2
aaauaagugauaaaua

SEQ ID NO: 2090521 - RNA, 18 nt, Staphylococcus aureus subsp. aureus MW2
aaauaaguguuguuuuau

SEQ ID NO: 2090522 - RNA, 14 nt, Staphylococcus aureus subsp. aureus MW2
ggccuuuaaugauu

SEQ ID NO: 2090523 - RNA, 19 nt, Staphylococcus aureus subsp. aureus MW2
ggccuuuuaaacaaauaaa

SEQ ID NO: 2090524 - RNA, 22 nt, Staphylococcus aureus subsp. aureus MW2
ggccuuuuaaacaaauaaaaaa

SEQ ID NO: 2090525 - RNA, 13 nt, Staphylococcus aureus subsp. aureus MW2
ggccuuuuuauug

SEQ ID NO: 2090526 - RNA, 13 nt, Staphylococcus aureus subsp. aureus MW2
ggcgacauuugua

SEQ ID NO: 2090527 - RNA, 21 nt, Staphylococcus aureus subsp. aureus MW2
aaauaacguuaauauaauuaa

SEQ ID NO: 2090528 - RNA, 20 nt, Staphylococcus aureus subsp. aureus MW2
aaauaacuucguuuuaauaa

SEQ ID NO: 2090529 - RNA, 21 nt, Staphylococcus aureus subsp. aureus MW2
aaauaaauuuugcgaaaauau

SEQ ID NO: 2090530 - RNA, 20 nt, Staphylococcus aureus subsp. aureus MW2
aaauaaccgcacuuucuauu

SEQ ID NO: 2090531 - RNA, 17 nt, Staphylococcus aureus subsp. aureus MW2
aaauaacgauaccuuua

SEQ ID NO: 2090532 - RNA, 17 nt, Staphylococcus aureus subsp. aureus MW2
ggcuugguuauuuucaa

SEQ ID NO: 2090533 - RNA, 18 nt, Staphylococcus aureus subsp. aureus MW2
ggcuucuuucuaaaauaa

SEQ ID NO: 2090534 - RNA, 19 nt, Staphylococcus aureus subsp. aureus MW2
ggcuuaauuaauaaaaaaa

SEQ ID NO: 2090535 - RNA, 22 nt, Staphylococcus aureus subsp. aureus MW2
gggauuuuuucguuuuaauaau

SEQ ID NO: 2090536 - RNA, 22 nt, Staphylococcus aureus subsp. aureus MW2
gggaugggccccaacacagaga

SEQ ID NO: 2090537 - RNA, 13 nt, Staphylococcus aureus subsp. aureus MW2
gggcagaucauaa

SEQ ID NO: 2090538 - RNA, 15 nt, Staphylococcus aureus subsp. aureus MW2
gggaaggacaggaau

SEQ ID NO: 2090539 - RNA, 21 nt, Staphylococcus aureus subsp. aureus MW2
ggcuuuuuuauuuuauaagaa

SEQ ID NO: 2090540 - RNA, 19 nt, Staphylococcus aureus subsp. aureus MW2
ggcuuuuuuuauggugugg

SEQ ID NO: 2090541 - RNA, 19 nt, Staphylococcus aureus subsp. aureus MW2
ggcuuuuuguuuugaaugu

SEQ ID NO: 2090542 - RNA, 11 nt, Staphylococcus aureus subsp. aureus MW2
ggcuuuuucac

SEQ ID NO: 2090543 - RNA, 11 nt, Staphylococcus aureus subsp. aureus MW2
ggcuuuaaaau

SEQ ID NO: 2090544 - RNA, 13 nt, Staphylococcus aureus subsp. aureus MW2
ggcuuguuaagca

SEQ ID NO: 2090545 - RNA, 21 nt, Staphylococcus aureus subsp. aureus MW2
ggcuuuguuuucugucccaag

SEQ ID NO: 2090546 - RNA, 21 nt, Staphylococcus aureus subsp. aureus MW2
gggaauacagcuagcaagaau

SEQ ID NO: 2090547 - RNA, 14 nt, Staphylococcus aureus subsp. aureus MW2
gggacagaaaacaa

SEQ ID NO: 2090548 - RNA, 15 nt, Staphylococcus aureus subsp. aureus MW2
gggagaaaucaguua

SEQ ID NO: 2090549 - RNA, 23 nt, Staphylococcus aureus subsp. aureus MW2
ggggccccaacacagaagcuggc

SEQ ID NO: 2090550 - RNA, 19 nt, Staphylococcus aureus subsp. aureus MW2
ggggccccaacacagagaa

SEQ ID NO: 2090551 - RNA, 19 nt, Staphylococcus aureus subsp. aureus MW2
ggggcccaaacauagagaa

SEQ ID NO: 2090552 - RNA, 15 nt, Staphylococcus aureus subsp. aureus MW2
ggggccccaacacag

SEQ ID NO: 2090553 - RNA, 20 nt, Staphylococcus aureus subsp. aureus MW2
ggggaugggccccaacacag

SEQ ID NO: 2090554 - RNA, 17 nt, Staphylococcus aureus subsp. aureus MW2
gggccccaacacagaga

SEQ ID NO: 2090555 - RNA, 21 nt, Staphylococcus aureus subsp. aureus MW2
gggccccaacauagaagcugg

SEQ ID NO: 2090556 - RNA, 13 nt, Staphylococcus aureus subsp. aureus MW2
gggccccaacaca

SEQ ID NO: 2090557 - RNA, 21 nt, Staphylococcus aureus subsp. aureus MW2
gggccccaacacagaagcuga

SEQ ID NO: 2090558 - RNA, 15 nt, Staphylococcus aureus subsp. aureus MW2
gggccccaacacaga

SEQ ID NO: 2090559 - RNA, 14 nt, Staphylococcus aureus subsp. aureus MW2
gggcccaaacauag

SEQ ID NO: 2090560 - RNA, 19 nt, Staphylococcus aureus subsp. aureus MW2
gggcauugagauuggaagg

SEQ ID NO: 2090561 - RNA, 15 nt, Staphylococcus aureus subsp. aureus MW2
gggcuccaaacauag

SEQ ID NO: 2090562 - RNA, 13 nt, Staphylococcus aureus subsp. aureus MW2
gggcguucugcua

SEQ ID NO: 2090563 - RNA, 11 nt, Staphylococcus aureus subsp. aureus MW2
gguaaaaaguu

SEQ ID NO: 2090564 - RNA, 18 nt, Staphylococcus aureus subsp. aureus MW2
gguaaaaaugaaccauuu

SEQ ID NO: 2090565 - RNA, 19 nt, Staphylococcus aureus subsp. aureus MW2
gguaagacgccgaaaagag

SEQ ID NO: 2090566 - RNA, 21 nt, Staphylococcus aureus subsp. aureus MW2
gguaauacuauaugaaaagag

SEQ ID NO: 2090567 - RNA, 14 nt, Staphylococcus aureus subsp. aureus MW2
gguaauuuaacauu

SEQ ID NO: 2090568 - RNA, 15 nt, Staphylococcus aureus subsp. aureus MW2
gggugugggccccaa

SEQ ID NO: 2090569 - RNA, 22 nt, Staphylococcus aureus subsp. aureus MW2
gguacaccuacaaauauuucua

SEQ ID NO: 2090570 - RNA, 19 nt, Staphylococcus aureus subsp. aureus MW2
gguacacuucaacauauaa

SEQ ID NO: 2090571 - RNA, 21 nt, Staphylococcus aureus subsp. aureus MW2
gguacauaaauagugaaauua

SEQ ID NO: 2090572 - RNA, 22 nt, Staphylococcus aureus subsp. aureus MW2
gguaccuuuuuauuaucuuuaa

SEQ ID NO: 2090573 - RNA, 15 nt, Staphylococcus aureus subsp. aureus MW2
gguacgaagugcaac

SEQ ID NO: 2090574 - RNA, 19 nt, Staphylococcus aureus subsp. aureus MW2
gguaguuagguaaaaauua

SEQ ID NO: 2090575 - RNA, 16 nt, Staphylococcus aureus subsp. aureus MW2
gguaguuaauauaauu

SEQ ID NO: 2090576 - RNA, 20 nt, Staphylococcus aureus subsp. aureus MW2
gguaucuaaaugugaaagac

SEQ ID NO: 2090577 - RNA, 18 nt, Staphylococcus aureus subsp. aureus MW2
gguauuagaacuucucuu

SEQ ID NO: 2090578 - RNA, 18 nt, Staphylococcus aureus subsp. aureus MW2
gguaugauuuuugaacca

SEQ ID NO: 2090579 - RNA, 17 nt, Staphylococcus aureus subsp. aureus MW2
ggucaacuguaguggaa

SEQ ID NO: 2090580 - RNA, 18 nt, Staphylococcus aureus subsp. aureus MW2
ggucgugacggaaucuug

SEQ ID NO: 2090581 - RNA, 18 nt, Staphylococcus aureus subsp. aureus MW2
ggucuuuuaauuaaaagu

SEQ ID NO: 2090582 - RNA, 16 nt, Staphylococcus aureus subsp. aureus MW2
ggucuccaauacuuuu

SEQ ID NO: 2090583 - RNA, 16 nt, Staphylococcus aureus subsp. aureus MW2
ggaacaccaauauaaa

SEQ ID NO: 2090584 - RNA, 22 nt, Staphylococcus aureus subsp. aureus MW2
ggaacuacuacauuauuacuga

SEQ ID NO: 2090585 - RNA, 15 nt, Staphylococcus aureus subsp. aureus MW2
ggaauaacuuuuuaa

SEQ ID NO: 2090586 - RNA, 21 nt, Staphylococcus aureus subsp. aureus MW2
ggaaguuacguucuaauacuu

SEQ ID NO: 2090587 - RNA, 16 nt, Staphylococcus aureus subsp. aureus MW2
ggaauaccuuuuucua

SEQ ID NO: 2090588 - RNA, 18 nt, Staphylococcus aureus subsp. aureus MW2
ggaaugguauagauuuua

SEQ ID NO: 2090589 - RNA, 12 nt, Staphylococcus aureus subsp. aureus MW2
ggaauuaauaau

SEQ ID NO: 2090590 - RNA, 10 nt, Staphylococcus aureus subsp. aureus MW2
ggacaaguuu

SEQ ID NO: 2090591 - RNA, 20 nt, Staphylococcus aureus subsp. aureus MW2
ggaauuuuuaugcauuauag

SEQ ID NO: 2090592 - RNA, 21 nt, Staphylococcus aureus subsp. aureus MW2
ggaauuucaaacgcaccuggc

SEQ ID NO: 2090593 - RNA, 22 nt, Staphylococcus aureus subsp. aureus MW2
ggaauuaauuauaggaauuuuu

SEQ ID NO: 2090594 - RNA, 19 nt, Staphylococcus aureus subsp. aureus MW2
ggacaacuaauaacaaaua

SEQ ID NO: 2090595 - RNA, 18 nt, Staphylococcus aureus subsp. aureus MW2
aaaggcucauuuguuaaa

SEQ ID NO: 2090596 - RNA, 15 nt, Staphylococcus aureus subsp. aureus MW2
aaaggcucauuuguu

SEQ ID NO: 2090597 - RNA, 19 nt, Staphylococcus aureus subsp. aureus MW2
aaaggcuagcuaaaauuug

SEQ ID NO: 2090598 - RNA, 16 nt, Staphylococcus aureus subsp. aureus MW2
ggacgacgaaauaauu

SEQ ID NO: 2090599 - RNA, 17 nt, Staphylococcus aureus subsp. aureus MW2
ggagcacuaucuuuugc

SEQ ID NO: 2090600 - RNA, 19 nt, Staphylococcus aureus subsp. aureus MW2
aaagguauucaaauaaaca

SEQ ID NO: 2090601 - RNA, 23 nt, Staphylococcus aureus subsp. aureus MW2
aaaggucuauauauauuuaaauc

SEQ ID NO: 2090602 - RNA, 23 nt, Staphylococcus aureus subsp. aureus MW2
aaaggucuauguacaaucauuag

SEQ ID NO: 2090603 - RNA, 18 nt, Staphylococcus aureus subsp. aureus MW2
aaagguaacuuuuuaacu

SEQ ID NO: 2090604 - RNA, 21 nt, Staphylococcus aureus subsp. aureus MW2
aaaggguuauuaacuuuaaua

SEQ ID NO: 2090605 - RNA, 21 nt, Staphylococcus aureus subsp. aureus MW2
aaaggucaaaaaauuaaucaa

SEQ ID NO: 2090606 - RNA, 13 nt, Staphylococcus aureus subsp. aureus MW2
ggauaaaaauuua

SEQ ID NO: 2090607 - RNA, 15 nt, Staphylococcus aureus subsp. aureus MW2
ggauaaaaaugaaaa

SEQ ID NO: 2090608 - RNA, 15 nt, Staphylococcus aureus subsp. aureus MW2
ggaucuuucaaagua

SEQ ID NO: 2090609 - RNA, 10 nt, Staphylococcus aureus subsp. aureus MW2
ggaugaagcg

SEQ ID NO: 2090610 - RNA, 17 nt, Staphylococcus aureus subsp. aureus MW2
ggaugaguuuaaaaaua

SEQ ID NO: 2090611 - RNA, 22 nt, Staphylococcus aureus subsp. aureus MW2
ggaugggccccaacacagagaa

SEQ ID NO: 2090612 - RNA, 16 nt, Staphylococcus aureus subsp. aureus MW2
aaaguaaguaaaauaa

SEQ ID NO: 2090613 - RNA, 13 nt, Staphylococcus aureus subsp. aureus MW2
aaaguaaguaaaa

SEQ ID NO: 2090614 - RNA, 22 nt, Staphylococcus aureus subsp. aureus MW2
aaaguaauaauggcaauuaaaa

SEQ ID NO: 2090615 - RNA, 22 nt, Staphylococcus aureus subsp. aureus MW2
aaaguaauaugagugaaaguuu

SEQ ID NO: 2090616 - RNA, 13 nt, Staphylococcus aureus subsp. aureus MW2
aaaguaaucaguu

SEQ ID NO: 2090617 - RNA, 17 nt, Staphylococcus aureus subsp. aureus MW2
aaaguaauuaaauacuu

SEQ ID NO: 2090618 - RNA, 23 nt, Staphylococcus aureus subsp. aureus MW2
aaaguacaaguugaucaaaaaug

SEQ ID NO: 2090619 - RNA, 19 nt, Staphylococcus aureus subsp. aureus MW2
aaaguaccgguuuuucaua

SEQ ID NO: 2090620 - RNA, 22 nt, Staphylococcus aureus subsp. aureus MW2
ggauguuauaaaaugaauaauu

SEQ ID NO: 2090621 - RNA, 15 nt, Staphylococcus aureus subsp. aureus MW2
aaaguacuuacaaau

SEQ ID NO: 2090622 - RNA, 12 nt, Staphylococcus aureus subsp. aureus MW2
aaaguacucaag

SEQ ID NO: 2090623 - RNA, 13 nt, Staphylococcus aureus subsp. aureus MW2
ggauucaaaugac

SEQ ID NO: 2090624 - RNA, 16 nt, Staphylococcus aureus subsp. aureus MW2
ggauucgauugguuua

SEQ ID NO: 2090625 - RNA, 17 nt, Staphylococcus aureus subsp. aureus MW2
ggcaacacucggaaaca

SEQ ID NO: 2090626 - RNA, 13 nt, Staphylococcus aureus subsp. aureus MW2
ggccccaacacag

SEQ ID NO: 2090627 - RNA, 16 nt, Staphylococcus aureus subsp. aureus MW2
ggccccaacacagaga

SEQ ID NO: 2090628 - RNA, 13 nt, Staphylococcus aureus subsp. aureus MW2
ggccaugagcucu

SEQ ID NO: 2090629 - RNA, 20 nt, Staphylococcus aureus subsp. aureus MW2
aaagugaguauaaguuuguu

SEQ ID NO: 2090630 - RNA, 21 nt, Staphylococcus aureus subsp. aureus MW2
aaagucuguugguuuaucagc

SEQ ID NO: 2090631 - RNA, 13 nt, Staphylococcus aureus subsp. aureus MW2
aaagucgaaggcu

SEQ ID NO: 2090632 - RNA, 17 nt, Staphylococcus aureus subsp. aureus MW2
aaaguaguugaaauguu

SEQ ID NO: 2090633 - RNA, 15 nt, Staphylococcus aureus subsp. aureus MW2
ggcaggaaugauaua

SEQ ID NO: 2090634 - RNA, 16 nt, Staphylococcus aureus subsp. aureus MW2
aaagucaauuuaaaua

SEQ ID NO: 2090635 - RNA, 12 nt, Staphylococcus aureus subsp. aureus MW2
aaagucaaagag

SEQ ID NO: 2090636 - RNA, 18 nt, Staphylococcus aureus subsp. aureus MW2
aaagucacaguguaauca

SEQ ID NO: 2090637 - RNA, 18 nt, Staphylococcus aureus subsp. aureus MW2
aaagucagguuacaauaa

SEQ ID NO: 2090638 - RNA, 21 nt, Staphylococcus aureus subsp. aureus MW2
aaagucagcuuacaauaaugu

SEQ ID NO: 2090639 - RNA, 18 nt, Staphylococcus aureus subsp. aureus MW2
aaagucagcauacaauaa

SEQ ID NO: 2090640 - RNA, 20 nt, Staphylococcus aureus subsp. aureus MW2
aaagucagcauacaauaaug

SEQ ID NO: 2090641 - RNA, 21 nt, Staphylococcus aureus subsp. aureus MW2
aaagucagcauacaauaaugu

SEQ ID NO: 2090642 - RNA, 20 nt, Staphylococcus aureus subsp. aureus MW2
aaagucauacuuaugagcaa

SEQ ID NO: 2090643 - RNA, 21 nt, Staphylococcus aureus subsp. aureus MW2
aaaguauuagauauauuugaa

SEQ ID NO: 2090644 - RNA, 18 nt, Staphylococcus aureus subsp. aureus MW2
ggcauuaggaaaacuuca

SEQ ID NO: 2090645 - RNA, 15 nt, Staphylococcus aureus subsp. aureus MW2
aaaggauauugaaaa

SEQ ID NO: 2090646 - RNA, 19 nt, Staphylococcus aureus subsp. aureus MW2
aaaggauauugaaaacacg

SEQ ID NO: 2090647 - RNA, 18 nt, Staphylococcus aureus subsp. aureus MW2
aaaggaugugacaaauac

SEQ ID NO: 2090648 - RNA, 23 nt, Staphylococcus aureus subsp. aureus MW2
aaaggacgucuuuuuagauugua

SEQ ID NO: 2090649 - RNA, 19 nt, Staphylococcus aureus subsp. aureus MW2
aaaggaauguuuaaaaaac

SEQ ID NO: 2090650 - RNA, 20 nt, Staphylococcus aureus subsp. aureus MW2
aaaggaauguuuaaaaaacu

SEQ ID NO: 2090651 - RNA, 21 nt, Staphylococcus aureus subsp. aureus MW2
gcugucacuaauggauaugau

SEQ ID NO: 2090652 - RNA, 13 nt, Staphylococcus aureus subsp. aureus MW2
gcuguuugauauu

SEQ ID NO: 2090653 - RNA, 14 nt, Staphylococcus aureus subsp. aureus MW2
gcuguuuuauucaa

SEQ ID NO: 2090654 - RNA, 20 nt, Staphylococcus aureus subsp. aureus MW2
gcuuaauuugacaaucuaaa

SEQ ID NO: 2090655 - RNA, 19 nt, Staphylococcus aureus subsp. aureus MW2
gcuuaauuuguuuuaaaua

SEQ ID NO: 2090656 - RNA, 20 nt, Staphylococcus aureus subsp. aureus MW2
gcuuacaauaaugugcaagu

SEQ ID NO: 2090657 - RNA, 18 nt, Staphylococcus aureus subsp. aureus MW2
gcuuaagaaauuuuuucu

SEQ ID NO: 2090658 - RNA, 22 nt, Staphylococcus aureus subsp. aureus MW2
gcuuaaguaagauuuaaacauc

SEQ ID NO: 2090659 - RNA, 19 nt, Staphylococcus aureus subsp. aureus MW2
gcuuaauaagcugaaauaa

SEQ ID NO: 2090660 - RNA, 16 nt, Staphylococcus aureus subsp. aureus MW2
gcuuaauaauuaauaa

SEQ ID NO: 2090661 - RNA, 14 nt, Staphylococcus aureus subsp. aureus MW2
gcuuaaaucaaaug

SEQ ID NO: 2090662 - RNA, 21 nt, Staphylococcus aureus subsp. aureus MW2
gcuguguacguuucaauguau

SEQ ID NO: 2090663 - RNA, 17 nt, Staphylococcus aureus subsp. aureus MW2
gcuguuacacuuuucuu

SEQ ID NO: 2090664 - RNA, 17 nt, Staphylococcus aureus subsp. aureus MW2
gcuguccacuauauccu

SEQ ID NO: 2090665 - RNA, 15 nt, Staphylococcus aureus subsp. aureus MW2
gcugucauaccuuuu

SEQ ID NO: 2090666 - RNA, 15 nt, Staphylococcus aureus subsp. aureus MW2
gcuucaaauguaaca

SEQ ID NO: 2090667 - RNA, 17 nt, Staphylococcus aureus subsp. aureus MW2
gcuuauugaaaagauaa

SEQ ID NO: 2090668 - RNA, 17 nt, Staphylococcus aureus subsp. aureus MW2
gcuuauucugaaaaaua

SEQ ID NO: 2090669 - RNA, 14 nt, Staphylococcus aureus subsp. aureus MW2
gcuuauuaaaauua

SEQ ID NO: 2090670 - RNA, 23 nt, Staphylococcus aureus subsp. aureus MW2
gcuucacuaaaaaucuauauaac

SEQ ID NO: 2090671 - RNA, 22 nt, Staphylococcus aureus subsp. aureus MW2
gcuucagccauaauaucuuuua

SEQ ID NO: 2090672 - RNA, 21 nt, Staphylococcus aureus subsp. aureus MW2
gcuuagcgcaggcgcuccuac

SEQ ID NO: 2090673 - RNA, 22 nt, Staphylococcus aureus subsp. aureus MW2
gcuuagcgcaggcgcuccuacu

SEQ ID NO: 2090674 - RNA, 19 nt, Staphylococcus aureus subsp. aureus MW2
gcuuagggcuuuguuuucu

SEQ ID NO: 2090675 - RNA, 17 nt, Staphylococcus aureus subsp. aureus MW2
gcuuaucaacagcuuca

SEQ ID NO: 2090676 - RNA, 13 nt, Staphylococcus aureus subsp. aureus MW2
gcuuagauaaauu

SEQ ID NO: 2090677 - RNA, 21 nt, Staphylococcus aureus subsp. aureus MW2
gcuucauuauauaauucuuca

SEQ ID NO: 2090678 - RNA, 22 nt, Staphylococcus aureus subsp. aureus MW2
gcuucauuaguugcauaaucaa

SEQ ID NO: 2090679 - RNA, 18 nt, Staphylococcus aureus subsp. aureus MW2
gcuuccaauuuaaaauga

SEQ ID NO: 2090680 - RNA, 18 nt, Staphylococcus aureus subsp. aureus MW2
gcuucauagucacuuuua

SEQ ID NO: 2090681 - RNA, 21 nt, Staphylococcus aureus subsp. aureus MW2
gcuucaucaguuguguaauaa

SEQ ID NO: 2090682 - RNA, 22 nt, Staphylococcus aureus subsp. aureus MW2
gcuucauauuuagguaauacau

SEQ ID NO: 2090683 - RNA, 14 nt, Staphylococcus aureus subsp. aureus MW2
gcuucggcaccuuu

SEQ ID NO: 2090684 - RNA, 22 nt, Staphylococcus aureus subsp. aureus MW2
gcuucggcaccuuuauuaccag

SEQ ID NO: 2090685 - RNA, 13 nt, Staphylococcus aureus subsp. aureus MW2
gcuucuuaaauca

SEQ ID NO: 2090686 - RNA, 14 nt, Staphylococcus aureus subsp. aureus MW2
gcuucucuuugaac

SEQ ID NO: 2090687 - RNA, 23 nt, Staphylococcus aureus subsp. aureus MW2
gcuucuauguuggggccccgcca

SEQ ID NO: 2090688 - RNA, 19 nt, Staphylococcus aureus subsp. aureus MW2
gcuucuuuguuggggcccc

SEQ ID NO: 2090689 - RNA, 20 nt, Staphylococcus aureus subsp. aureus MW2
gcuugaccuucaguuucuac

SEQ ID NO: 2090690 - RNA, 17 nt, Staphylococcus aureus subsp. aureus MW2
gcuugcggauacauauu

SEQ ID NO: 2090691 - RNA, 15 nt, Staphylococcus aureus subsp. aureus MW2
aaaggcauucuucca

SEQ ID NO: 2090692 - RNA, 16 nt, Staphylococcus aureus subsp. aureus MW2
gcuugggcugacauuu

SEQ ID NO: 2090693 - RNA, 15 nt, Staphylococcus aureus subsp. aureus MW2
gcuuguaaaauuuuc

SEQ ID NO: 2090694 - RNA, 17 nt, Staphylococcus aureus subsp. aureus MW2
gcuugugugaaauuaga

SEQ ID NO: 2090695 - RNA, 15 nt, Staphylococcus aureus subsp. aureus MW2
gcuugugugaaauua

SEQ ID NO: 2090696 - RNA, 14 nt, Staphylococcus aureus subsp. aureus MW2
gcuuucaucuuuuu

SEQ ID NO: 2090697 - RNA, 13 nt, Staphylococcus aureus subsp. aureus MW2
gcuuuaauauaau

SEQ ID NO: 2090698 - RNA, 14 nt, Staphylococcus aureus subsp. aureus MW2
gcuuguucaauacu

SEQ ID NO: 2090699 - RNA, 14 nt, Staphylococcus aureus subsp. aureus MW2
gcuuuaaaauuuuu

SEQ ID NO: 2090700 - RNA, 23 nt, Staphylococcus aureus subsp. aureus MW2
gcuuuacucuuugcaauuuuuua

SEQ ID NO: 2090701 - RNA, 16 nt, Staphylococcus aureus subsp. aureus MW2
gcuuuagcucuuuuuu

SEQ ID NO: 2090702 - RNA, 20 nt, Staphylococcus aureus subsp. aureus MW2
gcuuuaguaguguauucauu

SEQ ID NO: 2090703 - RNA, 16 nt, Staphylococcus aureus subsp. aureus MW2
gcucauaugucuguuc

SEQ ID NO: 2090704 - RNA, 23 nt, Staphylococcus aureus subsp. aureus MW2
gcggucaauuuuaccauguuuua

SEQ ID NO: 2090705 - RNA, 16 nt, Staphylococcus aureus subsp. aureus MW2
gcucaucuacuuaaaa

SEQ ID NO: 2090706 - RNA, 13 nt, Staphylococcus aureus subsp. aureus MW2
gcuccuacuccau

SEQ ID NO: 2090707 - RNA, 13 nt, Staphylococcus aureus subsp. aureus MW2
gcuccuacuuuuc

SEQ ID NO: 2090708 - RNA, 15 nt, Staphylococcus aureus subsp. aureus MW2
gcuccuccaaagcua

SEQ ID NO: 2090709 - RNA, 22 nt, Staphylococcus aureus subsp. aureus MW2
gcucuaauucaaugauuuuuaa

SEQ ID NO: 2090710 - RNA, 21 nt, Staphylococcus aureus subsp. aureus MW2
gcucuaauucaaugauuuuua

SEQ ID NO: 2090711 - RNA, 18 nt, Staphylococcus aureus subsp. aureus MW2
gcucuaauucaaugauuu

SEQ ID NO: 2090712 - RNA, 17 nt, Staphylococcus aureus subsp. aureus MW2
gcugcuguacaauuucg

SEQ ID NO: 2090713 - RNA, 15 nt, Staphylococcus aureus subsp. aureus MW2
gcugcuguacaauuu

SEQ ID NO: 2090714 - RNA, 23 nt, Staphylococcus aureus subsp. aureus MW2
gcugaacguaaguuuaguucaaa

SEQ ID NO: 2090715 - RNA, 14 nt, Staphylococcus aureus subsp. aureus MW2
gcugaacuuucuuu

SEQ ID NO: 2090716 - RNA, 21 nt, Staphylococcus aureus subsp. aureus MW2
gcugaaguuugaacaacaucu

SEQ ID NO: 2090717 - RNA, 22 nt, Staphylococcus aureus subsp. aureus MW2
gcugaaugugcgaacuugcuuu

SEQ ID NO: 2090718 - RNA, 16 nt, Staphylococcus aureus subsp. aureus MW2
uaaacuuaaaagagaa

SEQ ID NO: 2090719 - RNA, 17 nt, Staphylococcus aureus subsp. aureus MW2
uaaacuuaaaagagaau

SEQ ID NO: 2090720 - RNA, 19 nt, Staphylococcus aureus subsp. aureus MW2
uaaacuuauuaauuaauag

SEQ ID NO: 2090721 - RNA, 16 nt, Staphylococcus aureus subsp. aureus MW2
uaaagaauuaaguagu

SEQ ID NO: 2090722 - RNA, 15 nt, Staphylococcus aureus subsp. aureus MW2
uaaagaauuaaguag

SEQ ID NO: 2090723 - RNA, 21 nt, Staphylococcus aureus subsp. aureus MW2
uaaagaaugauuuauaaaaaa

SEQ ID NO: 2090724 - RNA, 19 nt, Staphylococcus aureus subsp. aureus MW2
uaaagaaugauuuauaaaa

SEQ ID NO: 2090725 - RNA, 13 nt, Staphylococcus aureus subsp. aureus MW2
uaaagaaugauuu

SEQ ID NO: 2090726 - RNA, 20 nt, Staphylococcus aureus subsp. aureus MW2
uaaagaauuucgaaaagaaa

SEQ ID NO: 2090727 - RNA, 13 nt, Staphylococcus aureus subsp. aureus MW2
uaaagauaauauu

SEQ ID NO: 2090728 - RNA, 16 nt, Staphylococcus aureus subsp. aureus MW2
uaaagauaauauuaaa

SEQ ID NO: 2090729 - RNA, 17 nt, Staphylococcus aureus subsp. aureus MW2
uaaagauagaaugaaua

SEQ ID NO: 2090730 - RNA, 14 nt, Staphylococcus aureus subsp. aureus MW2
uaaacuaguaauag

SEQ ID NO: 2090731 - RNA, 13 nt, Staphylococcus aureus subsp. aureus MW2
uaaacuauuaaau

SEQ ID NO: 2090732 - RNA, 16 nt, Staphylococcus aureus subsp. aureus MW2
uaaacuauuaaaucau

SEQ ID NO: 2090733 - RNA, 16 nt, Staphylococcus aureus subsp. aureus MW2
uaaacuauaauaauug

SEQ ID NO: 2090734 - RNA, 19 nt, Staphylococcus aureus subsp. aureus MW2
uaaacuaguaauagaauag

SEQ ID NO: 2090735 - RNA, 20 nt, Staphylococcus aureus subsp. aureus MW2
uaaacuagaaaacauaaaua

SEQ ID NO: 2090736 - RNA, 20 nt, Staphylococcus aureus subsp. aureus MW2
uaaaccguauagucauuaca

SEQ ID NO: 2090737 - RNA, 22 nt, Staphylococcus aureus subsp. aureus MW2
uaaaccuacuaauauauuaauu

SEQ ID NO: 2090738 - RNA, 21 nt, Staphylococcus aureus subsp. aureus MW2
uaaacgcgcuucguugauuaa

SEQ ID NO: 2090739 - RNA, 18 nt, Staphylococcus aureus subsp. aureus MW2
uaaacacuuuaguauuau

SEQ ID NO: 2090740 - RNA, 17 nt, Staphylococcus aureus subsp. aureus MW2
uaaacacuauaaaagcc

SEQ ID NO: 2090741 - RNA, 20 nt, Staphylococcus aureus subsp. aureus MW2
uaaaccgcacuucuauauua

SEQ ID NO: 2090742 - RNA, 18 nt, Staphylococcus aureus subsp. aureus MW2
uaaaccagcuaaaccauc

SEQ ID NO: 2090743 - RNA, 21 nt, Staphylococcus aureus subsp. aureus MW2
uaaaccgauuguuucaccagc

SEQ ID NO: 2090744 - RNA, 23 nt, Staphylococcus aureus subsp. aureus MW2
uaaaccaaucaauaguuuauaau

SEQ ID NO: 2090745 - RNA, 11 nt, Staphylococcus aureus subsp. aureus MW2
uaaacauuuuu

SEQ ID NO: 2090746 - RNA, 14 nt, Staphylococcus aureus subsp. aureus MW2
uaaacauuuagauu

SEQ ID NO: 2090747 - RNA, 20 nt, Staphylococcus aureus subsp. aureus MW2
guuuuuauuauaauagagaa

SEQ ID NO: 2090748 - RNA, 17 nt, Staphylococcus aureus subsp. aureus MW2
guuuuggucaaguaaau

SEQ ID NO: 2090749 - RNA, 14 nt, Staphylococcus aureus subsp. aureus MW2
guuuugguacauaa

SEQ ID NO: 2090750 - RNA, 15 nt, Staphylococcus aureus subsp. aureus MW2
guuuugguacauaaa

SEQ ID NO: 2090751 - RNA, 20 nt, Staphylococcus aureus subsp. aureus MW2
guuuuucaucauuaaaauca

SEQ ID NO: 2090752 - RNA, 15 nt, Staphylococcus aureus subsp. aureus MW2
uaaacaaauaaaaaa

SEQ ID NO: 2090753 - RNA, 13 nt, Staphylococcus aureus subsp. aureus MW2
uaaacaaauaaau

SEQ ID NO: 2090754 - RNA, 22 nt, Staphylococcus aureus subsp. aureus MW2
uaaacaacaucgauuuaucauu

SEQ ID NO: 2090755 - RNA, 15 nt, Staphylococcus aureus subsp. aureus MW2
uaaacaaauaaaugu

SEQ ID NO: 2090756 - RNA, 17 nt, Staphylococcus aureus subsp. aureus MW2
uaaacaaauaaaugucc

SEQ ID NO: 2090757 - RNA, 21 nt, Staphylococcus aureus subsp. aureus MW2
uaaacaacugcaauagcuaua

SEQ ID NO: 2090758 - RNA, 23 nt, Staphylococcus aureus subsp. aureus MW2
uaaacaacugagucaaagucauu

SEQ ID NO: 2090759 - RNA, 16 nt, Staphylococcus aureus subsp. aureus MW2
uaaagcuuauuaaauc

SEQ ID NO: 2090760 - RNA, 16 nt, Staphylococcus aureus subsp. aureus MW2
uaaaggaaaucaaucc

SEQ ID NO: 2090761 - RNA, 15 nt, Staphylococcus aureus subsp. aureus MW2
uaaagcugcaauuau

SEQ ID NO: 2090762 - RNA, 19 nt, Staphylococcus aureus subsp. aureus MW2
uaaagcugacaaaccaauu

SEQ ID NO: 2090763 - RNA, 17 nt, Staphylococcus aureus subsp. aureus MW2
uaaagauguugaaaagu

SEQ ID NO: 2090764 - RNA, 13 nt, Staphylococcus aureus subsp. aureus MW2
uaaagauugauau

SEQ ID NO: 2090765 - RNA, 19 nt, Staphylococcus aureus subsp. aureus MW2
uaaagaucguuuucaacau

SEQ ID NO: 2090766 - RNA, 14 nt, Staphylococcus aureus subsp. aureus MW2
uaaagacaccuuca

SEQ ID NO: 2090767 - RNA, 22 nt, Staphylococcus aureus subsp. aureus MW2
uaaaggaauagcuacaauuaaa

SEQ ID NO: 2090768 - RNA, 18 nt, Staphylococcus aureus subsp. aureus MW2
uaaaguacuuacaaauau

SEQ ID NO: 2090769 - RNA, 16 nt, Staphylococcus aureus subsp. aureus MW2
uaaaguacucaaguaa

SEQ ID NO: 2090770 - RNA, 23 nt, Staphylococcus aureus subsp. aureus MW2
uaaagucuucaucuuuaaagaaa

SEQ ID NO: 2090771 - RNA, 17 nt, Staphylococcus aureus subsp. aureus MW2
uaaaguauguugucaua

SEQ ID NO: 2090772 - RNA, 21 nt, Staphylococcus aureus subsp. aureus MW2
uaaaguauaagguugaagaag

SEQ ID NO: 2090773 - RNA, 16 nt, Staphylococcus aureus subsp. aureus MW2
uaaagucaauuuaaau

SEQ ID NO: 2090774 - RNA, 16 nt, Staphylococcus aureus subsp. aureus MW2
uaaaguguaaauuuga

SEQ ID NO: 2090775 - RNA, 14 nt, Staphylococcus aureus subsp. aureus MW2
uaaaguuaaagacu

SEQ ID NO: 2090776 - RNA, 16 nt, Staphylococcus aureus subsp. aureus MW2
uaaaguguuucaacau

SEQ ID NO: 2090777 - RNA, 14 nt, Staphylococcus aureus subsp. aureus MW2
uaaaguugauuuug

SEQ ID NO: 2090778 - RNA, 23 nt, Staphylococcus aureus subsp. aureus MW2
uaaaguuuauuuauguucgauua

SEQ ID NO: 2090779 - RNA, 22 nt, Staphylococcus aureus subsp. aureus MW2
uaaauauaauagaaauaaucac

SEQ ID NO: 2090780 - RNA, 19 nt, Staphylococcus aureus subsp. aureus MW2
uaaauauaauagaaauaau

SEQ ID NO: 2090781 - RNA, 13 nt, Staphylococcus aureus subsp. aureus MW2
uaaauauaaaaua

SEQ ID NO: 2090782 - RNA, 20 nt, Staphylococcus aureus subsp. aureus MW2
uaaauauaaaccagcugauu

SEQ ID NO: 2090783 - RNA, 18 nt, Staphylococcus aureus subsp. aureus MW2
uaaauaguuuuucauauu

SEQ ID NO: 2090784 - RNA, 15 nt, Staphylococcus aureus subsp. aureus MW2
uaaauauaguaauaa

SEQ ID NO: 2090785 - RNA, 19 nt, Staphylococcus aureus subsp. aureus MW2
uaaauauacuuuuauagaa

SEQ ID NO: 2090786 - RNA, 16 nt, Staphylococcus aureus subsp. aureus MW2
uaaauauacuucuauu

SEQ ID NO: 2090787 - RNA, 17 nt, Staphylococcus aureus subsp. aureus MW2
uaaauauacuucuauua

SEQ ID NO: 2090788 - RNA, 19 nt, Staphylococcus aureus subsp. aureus MW2
uaaauauacuucuauuaaa

SEQ ID NO: 2090789 - RNA, 20 nt, Staphylococcus aureus subsp. aureus MW2
uaaauaguuuuucauauuca

SEQ ID NO: 2090790 - RNA, 17 nt, Staphylococcus aureus subsp. aureus MW2
uaaauaagugauaaaua

SEQ ID NO: 2090791 - RNA, 20 nt, Staphylococcus aureus subsp. aureus MW2
uaaauaaaaauuauauaaau

SEQ ID NO: 2090792 - RNA, 21 nt, Staphylococcus aureus subsp. aureus MW2
uaaauaaccgcacuuucuauu

SEQ ID NO: 2090793 - RNA, 21 nt, Staphylococcus aureus subsp. aureus MW2
uaaauaacuucguuuuaauaa

SEQ ID NO: 2090794 - RNA, 22 nt, Staphylococcus aureus subsp. aureus MW2
uaaauaugauagccaauauaac

SEQ ID NO: 2090795 - RNA, 21 nt, Staphylococcus aureus subsp. aureus MW2
uaaauaugacgcgugaauuaa

SEQ ID NO: 2090796 - RNA, 15 nt, Staphylococcus aureus subsp. aureus MW2
uaaauauuauaaaaa

SEQ ID NO: 2090797 - RNA, 13 nt, Staphylococcus aureus subsp. aureus MW2
uaaauauauauua

SEQ ID NO: 2090798 - RNA, 16 nt, Staphylococcus aureus subsp. aureus MW2
uaaauaucauaaaugc

SEQ ID NO: 2090799 - RNA, 21 nt, Staphylococcus aureus subsp. aureus MW2
uaaauaucauaccguacaaag

SEQ ID NO: 2090800 - RNA, 12 nt, Staphylococcus aureus subsp. aureus MW2
uaaauaucaauu

SEQ ID NO: 2090801 - RNA, 17 nt, Staphylococcus aureus subsp. aureus MW2
uaaaucaugaaauuaaa

SEQ ID NO: 2090802 - RNA, 19 nt, Staphylococcus aureus subsp. aureus MW2
uaaaucaugaaauuaaaaa

SEQ ID NO: 2090803 - RNA, 21 nt, Staphylococcus aureus subsp. aureus MW2
uaaaucaugaaauuaaaaaca

SEQ ID NO: 2090804 - RNA, 16 nt, Staphylococcus aureus subsp. aureus MW2
uaaaucauuucguuca

SEQ ID NO: 2090805 - RNA, 14 nt, Staphylococcus aureus subsp. aureus MW2
uaaaucauucuuua

SEQ ID NO: 2090806 - RNA, 12 nt, Staphylococcus aureus subsp. aureus MW2
uaaaucaucauu

SEQ ID NO: 2090807 - RNA, 22 nt, Staphylococcus aureus subsp. aureus MW2
uaaaucaucuucaguuaguuuu

SEQ ID NO: 2090808 - RNA, 16 nt, Staphylococcus aureus subsp. aureus MW2
uaaaucauacgagaaa

SEQ ID NO: 2090809 - RNA, 21 nt, Staphylococcus aureus subsp. aureus MW2
uaacacucagauuuuauuaaa

SEQ ID NO: 2090810 - RNA, 14 nt, Staphylococcus aureus subsp. aureus MW2
uaacagacuuuguu

SEQ ID NO: 2090811 - RNA, 17 nt, Staphylococcus aureus subsp. aureus MW2
uaacagacuuuguuaaa

SEQ ID NO: 2090812 - RNA, 20 nt, Staphylococcus aureus subsp. aureus MW2
uaacagacuuuguuaaaaaa

SEQ ID NO: 2090813 - RNA, 20 nt, Staphylococcus aureus subsp. aureus MW2
uaacauccugcuuauuaauu

SEQ ID NO: 2090814 - RNA, 15 nt, Staphylococcus aureus subsp. aureus MW2
uaacaucugaaucug

SEQ ID NO: 2090815 - RNA, 14 nt, Staphylococcus aureus subsp. aureus MW2
uaacaucuaaauuu

SEQ ID NO: 2090816 - RNA, 13 nt, Staphylococcus aureus subsp. aureus MW2
uaaccacaucauu

SEQ ID NO: 2090817 - RNA, 21 nt, Staphylococcus aureus subsp. aureus MW2
uaacauguauuuaguaucaua

SEQ ID NO: 2090818 - RNA, 23 nt, Staphylococcus aureus subsp. aureus MW2
uaacaucuguagguuuaauguuu

SEQ ID NO: 2090819 - RNA, 14 nt, Staphylococcus aureus subsp. aureus MW2
uaacaucuuuuuca

SEQ ID NO: 2090820 - RNA, 19 nt, Staphylococcus aureus subsp. aureus MW2
uaacaugaccuaauauauu

SEQ ID NO: 2090821 - RNA, 19 nt, Staphylococcus aureus subsp. aureus MW2
uaaccaguauaauuuucug

SEQ ID NO: 2090822 - RNA, 19 nt, Staphylococcus aureus subsp. aureus MW2
uaaccacuccuuaaacaaa

SEQ ID NO: 2090823 - RNA, 20 nt, Staphylococcus aureus subsp. aureus MW2
uaacccuaaagcuaaugcaa

SEQ ID NO: 2090824 - RNA, 13 nt, Staphylococcus aureus subsp. aureus MW2
uaaccccuucaaa

SEQ ID NO: 2090825 - RNA, 21 nt, Staphylococcus aureus subsp. aureus MW2
uaaccccuucaaaauuuugac

SEQ ID NO: 2090826 - RNA, 16 nt, Staphylococcus aureus subsp. aureus MW2
uaaccccuccuggugc

SEQ ID NO: 2090827 - RNA, 15 nt, Staphylococcus aureus subsp. aureus MW2
uaaccccuccuggug

SEQ ID NO: 2090828 - RNA, 17 nt, Staphylococcus aureus subsp. aureus MW2
uaaccauaguaacaaaa

SEQ ID NO: 2090829 - RNA, 18 nt, Staphylococcus aureus subsp. aureus MW2
uaaccauaguaacaaaau

SEQ ID NO: 2090830 - RNA, 16 nt, Staphylococcus aureus subsp. aureus MW2
uaacguacaauguauu

SEQ ID NO: 2090831 - RNA, 14 nt, Staphylococcus aureus subsp. aureus MW2
uaacgguuaauaag

SEQ ID NO: 2090832 - RNA, 19 nt, Staphylococcus aureus subsp. aureus MW2
uaacgguuaauaagcuaau

SEQ ID NO: 2090833 - RNA, 16 nt, Staphylococcus aureus subsp. aureus MW2
uaacgcuuuaaaucau

SEQ ID NO: 2090834 - RNA, 20 nt, Staphylococcus aureus subsp. aureus MW2
uaacgcuuauacuauauaau

SEQ ID NO: 2090835 - RNA, 17 nt, Staphylococcus aureus subsp. aureus MW2
uaacgcaguugaaaaag

SEQ ID NO: 2090836 - RNA, 15 nt, Staphylococcus aureus subsp. aureus MW2
uaaccgaaauauugu

SEQ ID NO: 2090837 - RNA, 17 nt, Staphylococcus aureus subsp. aureus MW2
uaacaaagauuauugaa

SEQ ID NO: 2090838 - RNA, 18 nt, Staphylococcus aureus subsp. aureus MW2
uaacaaagauuauugaaa

SEQ ID NO: 2090839 - RNA, 19 nt, Staphylococcus aureus subsp. aureus MW2
uaacaacuguucuaaaauu

SEQ ID NO: 2090840 - RNA, 21 nt, Staphylococcus aureus subsp. aureus MW2
uaacaacuguucuaaaauuaa

SEQ ID NO: 2090841 - RNA, 15 nt, Staphylococcus aureus subsp. aureus MW2
uaacaaaaugauugg

SEQ ID NO: 2090842 - RNA, 16 nt, Staphylococcus aureus subsp. aureus MW2
uaacaaaaugauuggu

SEQ ID NO: 2090843 - RNA, 14 nt, Staphylococcus aureus subsp. aureus MW2
uaaauuuucaucau

SEQ ID NO: 2090844 - RNA, 23 nt, Staphylococcus aureus subsp. aureus MW2
uaaauugacucaaagauauacuu

SEQ ID NO: 2090845 - RNA, 15 nt, Staphylococcus aureus subsp. aureus MW2
uaaauuuuguauaac

SEQ ID NO: 2090846 - RNA, 21 nt, Staphylococcus aureus subsp. aureus MW2
uaaauuuugagaaaauaucau

SEQ ID NO: 2090847 - RNA, 22 nt, Staphylococcus aureus subsp. aureus MW2
uaaauugaguuuuuuaaaauaa

SEQ ID NO: 2090848 - RNA, 14 nt, Staphylococcus aureus subsp. aureus MW2
uaaauuuuuaagaa

SEQ ID NO: 2090849 - RNA, 23 nt, Staphylococcus aureus subsp. aureus MW2
uaaauuuuuauccaagucuaaau

SEQ ID NO: 2090850 - RNA, 19 nt, Staphylococcus aureus subsp. aureus MW2
uaacaccaauuaaaucgau

SEQ ID NO: 2090851 - RNA, 22 nt, Staphylococcus aureus subsp. aureus MW2
uaacacaucaugacauuaauca

SEQ ID NO: 2090852 - RNA, 21 nt, Staphylococcus aureus subsp. aureus MW2
uaacacauucuuauuugaaau

SEQ ID NO: 2090853 - RNA, 15 nt, Staphylococcus aureus subsp. aureus MW2
uaacaauuuuaauuu

SEQ ID NO: 2090854 - RNA, 14 nt, Staphylococcus aureus subsp. aureus MW2
uaacacaugcuuca

SEQ ID NO: 2090855 - RNA, 17 nt, Staphylococcus aureus subsp. aureus MW2
uaacaccaauugaauau

SEQ ID NO: 2090856 - RNA, 16 nt, Staphylococcus aureus subsp. aureus MW2
uaacaaguauaaaugc

SEQ ID NO: 2090857 - RNA, 14 nt, Staphylococcus aureus subsp. aureus MW2
uaacaagugaugaa

SEQ ID NO: 2090858 - RNA, 16 nt, Staphylococcus aureus subsp. aureus MW2
uaacaagugaugaaaa

SEQ ID NO: 2090859 - RNA, 16 nt, Staphylococcus aureus subsp. aureus MW2
uaacaaguucauuuca

SEQ ID NO: 2090860 - RNA, 17 nt, Staphylococcus aureus subsp. aureus MW2
uaacaaguucauuucaa

SEQ ID NO: 2090861 - RNA, 18 nt, Staphylococcus aureus subsp. aureus MW2
uaacaauuuuaucugaau

SEQ ID NO: 2090862 - RNA, 21 nt, Staphylococcus aureus subsp. aureus MW2
uaacaauuuuaucugaaucug

SEQ ID NO: 2090863 - RNA, 22 nt, Staphylococcus aureus subsp. aureus MW2
uaacaauuuauuaaaacgaagu

SEQ ID NO: 2090864 - RNA, 13 nt, Staphylococcus aureus subsp. aureus MW2
uaacaauuuuaaa

SEQ ID NO: 2090865 - RNA, 17 nt, Staphylococcus aureus subsp. aureus MW2
uaacaauuuauuaaaac

SEQ ID NO: 2090866 - RNA, 15 nt, Staphylococcus aureus subsp. aureus MW2
uaacaauuuauuaaa

SEQ ID NO: 2090867 - RNA, 22 nt, Staphylococcus aureus subsp. aureus MW2
uaaaugcuuaauuuguuuuaaa

SEQ ID NO: 2090868 - RNA, 21 nt, Staphylococcus aureus subsp. aureus MW2
uaaaugcuucugguucuucaa

SEQ ID NO: 2090869 - RNA, 13 nt, Staphylococcus aureus subsp. aureus MW2
uaaauguuauauu

SEQ ID NO: 2090870 - RNA, 13 nt, Staphylococcus aureus subsp. aureus MW2
uaaauguuauuaa

SEQ ID NO: 2090871 - RNA, 19 nt, Staphylococcus aureus subsp. aureus MW2
uaaaugcuuucaaauacac

SEQ ID NO: 2090872 - RNA, 20 nt, Staphylococcus aureus subsp. aureus MW2
uaaaugcuuucaaauacaca

SEQ ID NO: 2090873 - RNA, 20 nt, Staphylococcus aureus subsp. aureus MW2
uaaaucgugcuguuaucaug

SEQ ID NO: 2090874 - RNA, 14 nt, Staphylococcus aureus subsp. aureus MW2
uaaauccuuuggac

SEQ ID NO: 2090875 - RNA, 23 nt, Staphylococcus aureus subsp. aureus MW2
uaaauccaaugaugaauuguaaa

SEQ ID NO: 2090876 - RNA, 13 nt, Staphylococcus aureus subsp. aureus MW2
uaaauuaauauga

SEQ ID NO: 2090877 - RNA, 16 nt, Staphylococcus aureus subsp. aureus MW2
uaaauguuauugcuua

SEQ ID NO: 2090878 - RNA, 13 nt, Staphylococcus aureus subsp. aureus MW2
uaaauuaaaugca

SEQ ID NO: 2090879 - RNA, 17 nt, Staphylococcus aureus subsp. aureus MW2
uaaauuaaaugcauaau

SEQ ID NO: 2090880 - RNA, 19 nt, Staphylococcus aureus subsp. aureus MW2
uaaauuaaguacuauuaaa

SEQ ID NO: 2090881 - RNA, 16 nt, Staphylococcus aureus subsp. aureus MW2
uaaauucuaaaacgga

SEQ ID NO: 2090882 - RNA, 13 nt, Staphylococcus aureus subsp. aureus MW2
uaaauucaucuua

SEQ ID NO: 2090883 - RNA, 14 nt, Staphylococcus aureus subsp. aureus MW2
uaaguuugaaucau

SEQ ID NO: 2090884 - RNA, 19 nt, Staphylococcus aureus subsp. aureus MW2
uaauaaaauucuauaaccu

SEQ ID NO: 2090885 - RNA, 19 nt, Staphylococcus aureus subsp. aureus MW2
uaauaaaacugcaauaauu

SEQ ID NO: 2090886 - RNA, 16 nt, Staphylococcus aureus subsp. aureus MW2
uaauaaaacuugugau

SEQ ID NO: 2090887 - RNA, 19 nt, Staphylococcus aureus subsp. aureus MW2
uaauaaagcugauuuuuca

SEQ ID NO: 2090888 - RNA, 14 nt, Staphylococcus aureus subsp. aureus MW2
uaauaaacuuaaaa

SEQ ID NO: 2090889 - RNA, 16 nt, Staphylococcus aureus subsp. aureus MW2
uaauaaacuuaaaaga

SEQ ID NO: 2090890 - RNA, 22 nt, Staphylococcus aureus subsp. aureus MW2
uaauaaauaggaugaaaaagau

SEQ ID NO: 2090891 - RNA, 15 nt, Staphylococcus aureus subsp. aureus MW2
uaauaaauuuaacgu

SEQ ID NO: 2090892 - RNA, 11 nt, Staphylococcus aureus subsp. aureus MW2
uaauaaauugu

SEQ ID NO: 2090893 - RNA, 22 nt, Staphylococcus aureus subsp. aureus MW2
uaauaaauuguuaucguucaau

SEQ ID NO: 2090894 - RNA, 23 nt, Staphylococcus aureus subsp. aureus MW2
uaauaaauuagccauuucaauug

SEQ ID NO: 2090895 - RNA, 14 nt, Staphylococcus aureus subsp. aureus MW2
uaauaacaucuaaa

SEQ ID NO: 2090896 - RNA, 20 nt, Staphylococcus aureus subsp. aureus MW2
uaauaacauccccaaaaaua

SEQ ID NO: 2090897 - RNA, 12 nt, Staphylococcus aureus subsp. aureus MW2
uaauaacaaaau

SEQ ID NO: 2090898 - RNA, 12 nt, Staphylococcus aureus subsp. aureus MW2
uaaguuauuaca

SEQ ID NO: 2090899 - RNA, 20 nt, Staphylococcus aureus subsp. aureus MW2
uaaguuucgcugcuacacca

SEQ ID NO: 2090900 - RNA, 17 nt, Staphylococcus aureus subsp. aureus MW2
uaaguuguugauuuaaa

SEQ ID NO: 2090901 - RNA, 15 nt, Staphylococcus aureus subsp. aureus MW2
uaaguuaaaaaugua

SEQ ID NO: 2090902 - RNA, 16 nt, Staphylococcus aureus subsp. aureus MW2
uaaguacgaggaccau

SEQ ID NO: 2090903 - RNA, 14 nt, Staphylococcus aureus subsp. aureus MW2
uaaguagaagcaaa

SEQ ID NO: 2090904 - RNA, 12 nt, Staphylococcus aureus subsp. aureus MW2
uaaguaauucau

SEQ ID NO: 2090905 - RNA, 20 nt, Staphylococcus aureus subsp. aureus MW2
uaaguauaaugaugugccuc

SEQ ID NO: 2090906 - RNA, 20 nt, Staphylococcus aureus subsp. aureus MW2
uaaguauaauuaaacuaaua

SEQ ID NO: 2090907 - RNA, 18 nt, Staphylococcus aureus subsp. aureus MW2
uaaguaguucaauaaauu

SEQ ID NO: 2090908 - RNA, 12 nt, Staphylococcus aureus subsp. aureus MW2
uaaguauucaua

SEQ ID NO: 2090909 - RNA, 21 nt, Staphylococcus aureus subsp. aureus MW2
uaagucgcucuagacauuaca

SEQ ID NO: 2090910 - RNA, 19 nt, Staphylococcus aureus subsp. aureus MW2
uaagucuuaacaaauuaaa

SEQ ID NO: 2090911 - RNA, 20 nt, Staphylococcus aureus subsp. aureus MW2
uaaguaaaauaaaaaaugca

SEQ ID NO: 2090912 - RNA, 18 nt, Staphylococcus aureus subsp. aureus MW2
uaaguaagauuuaaacau

SEQ ID NO: 2090913 - RNA, 19 nt, Staphylococcus aureus subsp. aureus MW2
uaaguaagcguaauauuua

SEQ ID NO: 2090914 - RNA, 16 nt, Staphylococcus aureus subsp. aureus MW2
uaaguaauaauauaaa

SEQ ID NO: 2090915 - RNA, 20 nt, Staphylococcus aureus subsp. aureus MW2
uaaguaauaauauaaauaaa

SEQ ID NO: 2090916 - RNA, 23 nt, Staphylococcus aureus subsp. aureus MW2
uaagguauuucauugauaagucu

SEQ ID NO: 2090917 - RNA, 17 nt, Staphylococcus aureus subsp. aureus MW2
uaagcauuaauguucaa

SEQ ID NO: 2090918 - RNA, 23 nt, Staphylococcus aureus subsp. aureus MW2
uaagcgcaauggccauuugauuu

SEQ ID NO: 2090919 - RNA, 14 nt, Staphylococcus aureus subsp. aureus MW2
uaagccuguuugac

SEQ ID NO: 2090920 - RNA, 12 nt, Staphylococcus aureus subsp. aureus MW2
uaagcaaagaca

SEQ ID NO: 2090921 - RNA, 16 nt, Staphylococcus aureus subsp. aureus MW2
uaagcaugauaaaaau

SEQ ID NO: 2090922 - RNA, 15 nt, Staphylococcus aureus subsp. aureus MW2
uaagcaguuaauaag

SEQ ID NO: 2090923 - RNA, 15 nt, Staphylococcus aureus subsp. aureus MW2
uaagcuuuguuugac

SEQ ID NO: 2090924 - RNA, 17 nt, Staphylococcus aureus subsp. aureus MW2
uaaggcugauucaaaaa

SEQ ID NO: 2090925 - RNA, 23 nt, Staphylococcus aureus subsp. aureus MW2
uaagcucuuaaucuauaaauuau

SEQ ID NO: 2090926 - RNA, 19 nt, Staphylococcus aureus subsp. aureus MW2
uaagcuuacgacauacuug

SEQ ID NO: 2090927 - RNA, 19 nt, Staphylococcus aureus subsp. aureus MW2
uaagcuuagaaacgaaauu

SEQ ID NO: 2090928 - RNA, 13 nt, Staphylococcus aureus subsp. aureus MW2
uaagcuuaucaac

SEQ ID NO: 2090929 - RNA, 21 nt, Staphylococcus aureus subsp. aureus MW2
uaagcuuaucaacgauuuugu

SEQ ID NO: 2090930 - RNA, 16 nt, Staphylococcus aureus subsp. aureus MW2
uaagcguuuaaucaca

SEQ ID NO: 2090931 - RNA, 23 nt, Staphylococcus aureus subsp. aureus MW2
uaagaaaaauguguuaaaauaua

SEQ ID NO: 2090932 - RNA, 20 nt, Staphylococcus aureus subsp. aureus MW2
uaagaaugcaccaacaauag

SEQ ID NO: 2090933 - RNA, 22 nt, Staphylococcus aureus subsp. aureus MW2
uaagaauauuuaaguuuccuau

SEQ ID NO: 2090934 - RNA, 13 nt, Staphylococcus aureus subsp. aureus MW2
uaagaauuuaaaa

SEQ ID NO: 2090935 - RNA, 13 nt, Staphylococcus aureus subsp. aureus MW2
uaagaauuaacaa

SEQ ID NO: 2090936 - RNA, 14 nt, Staphylococcus aureus subsp. aureus MW2
uaagaagcuuucug

SEQ ID NO: 2090937 - RNA, 15 nt, Staphylococcus aureus subsp. aureus MW2
uaagaaguuaaacga

SEQ ID NO: 2090938 - RNA, 23 nt, Staphylococcus aureus subsp. aureus MW2
uaagaaguuaaacgacaugaaag

SEQ ID NO: 2090939 - RNA, 16 nt, Staphylococcus aureus subsp. aureus MW2
uaacuuucagcaccag

SEQ ID NO: 2090940 - RNA, 18 nt, Staphylococcus aureus subsp. aureus MW2
uaacuuucagcaccagaa

SEQ ID NO: 2090941 - RNA, 18 nt, Staphylococcus aureus subsp. aureus MW2
uaacuuuaccaauaucau

SEQ ID NO: 2090942 - RNA, 13 nt, Staphylococcus aureus subsp. aureus MW2
uaacuuuaaaaau

SEQ ID NO: 2090943 - RNA, 14 nt, Staphylococcus aureus subsp. aureus MW2
uaacuuuaccaaua

SEQ ID NO: 2090944 - RNA, 19 nt, Staphylococcus aureus subsp. aureus MW2
uaacuugauauuauauaaa

SEQ ID NO: 2090945 - RNA, 15 nt, Staphylococcus aureus subsp. aureus MW2
uaacuugauuuucua

SEQ ID NO: 2090946 - RNA, 17 nt, Staphylococcus aureus subsp. aureus MW2
uaacuucugguucuuca

SEQ ID NO: 2090947 - RNA, 17 nt, Staphylococcus aureus subsp. aureus MW2
uaacuuguaauauaaca

SEQ ID NO: 2090948 - RNA, 15 nt, Staphylococcus aureus subsp. aureus MW2
uaacuugucuuuuuu

SEQ ID NO: 2090949 - RNA, 16 nt, Staphylococcus aureus subsp. aureus MW2
uaacuuguuuauucag

SEQ ID NO: 2090950 - RNA, 16 nt, Staphylococcus aureus subsp. aureus MW2
uaacuuuuuaaaggac

SEQ ID NO: 2090951 - RNA, 13 nt, Staphylococcus aureus subsp. aureus MW2
uaacuuuuuaaua

SEQ ID NO: 2090952 - RNA, 22 nt, Staphylococcus aureus subsp. aureus MW2
uaacuuucuaauuguuucauug

SEQ ID NO: 2090953 - RNA, 15 nt, Staphylococcus aureus subsp. aureus MW2
uaacuuugucuguau

SEQ ID NO: 2090954 - RNA, 21 nt, Staphylococcus aureus subsp. aureus MW2
uaacuuugucuguauuauuau

SEQ ID NO: 2090955 - RNA, 14 nt, Staphylococcus aureus subsp. aureus MW2
uaagagauuuucuu

SEQ ID NO: 2090956 - RNA, 16 nt, Staphylococcus aureus subsp. aureus MW2
uaagacauaugcagug

SEQ ID NO: 2090957 - RNA, 22 nt, Staphylococcus aureus subsp. aureus MW2
uaagacagcuucucauugaaau

SEQ ID NO: 2090958 - RNA, 15 nt, Staphylococcus aureus subsp. aureus MW2
uaagaauuaacaaca

SEQ ID NO: 2090959 - RNA, 23 nt, Staphylococcus aureus subsp. aureus MW2
uaagaccacaucgauaucuaagu

SEQ ID NO: 2090960 - RNA, 24 nt, Staphylococcus aureus subsp. aureus MW2
uaagacugccauucuuuuucucaa

SEQ ID NO: 2090961 - RNA, 23 nt, Staphylococcus aureus subsp. aureus MW2
uaagauaauguguaccuuuuuau

SEQ ID NO: 2090962 - RNA, 18 nt, Staphylococcus aureus subsp. aureus MW2
uaagauaacgagugaaaa

SEQ ID NO: 2090963 - RNA, 18 nt, Staphylococcus aureus subsp. aureus MW2
uaagauagauaaaucaag

SEQ ID NO: 2090964 - RNA, 19 nt, Staphylococcus aureus subsp. aureus MW2
uaagauaguuugagaaaau

SEQ ID NO: 2090965 - RNA, 23 nt, Staphylococcus aureus subsp. aureus MW2
uaagauaguuugagaaaauuaau

SEQ ID NO: 2090966 - RNA, 16 nt, Staphylococcus aureus subsp. aureus MW2
uaagauauuuaguaca

SEQ ID NO: 2090967 - RNA, 13 nt, Staphylococcus aureus subsp. aureus MW2
uaagauauuucca

SEQ ID NO: 2090968 - RNA, 22 nt, Staphylococcus aureus subsp. aureus MW2
uaagauguauaugaauuuuaua

SEQ ID NO: 2090969 - RNA, 15 nt, Staphylococcus aureus subsp. aureus MW2
uaagauuagcuauga

SEQ ID NO: 2090970 - RNA, 14 nt, Staphylococcus aureus subsp. aureus MW2
uaagaucaauauca

SEQ ID NO: 2090971 - RNA, 19 nt, Staphylococcus aureus subsp. aureus MW2
uaagaugacugaaccaauc

SEQ ID NO: 2090972 - RNA, 13 nt, Staphylococcus aureus subsp. aureus MW2
uaacugauaaaag

SEQ ID NO: 2090973 - RNA, 17 nt, Staphylococcus aureus subsp. aureus MW2
uaacugaauuaaagcau

SEQ ID NO: 2090974 - RNA, 15 nt, Staphylococcus aureus subsp. aureus MW2
uaacugaccuaacaa

SEQ ID NO: 2090975 - RNA, 21 nt, Staphylococcus aureus subsp. aureus MW2
uaacugccauauagauauuag

SEQ ID NO: 2090976 - RNA, 14 nt, Staphylococcus aureus subsp. aureus MW2
uaacugauaauacu

SEQ ID NO: 2090977 - RNA, 19 nt, Staphylococcus aureus subsp. aureus MW2
uaacugcuaauuuuuucau

SEQ ID NO: 2090978 - RNA, 13 nt, Staphylococcus aureus subsp. aureus MW2
uaacuuaccauga

SEQ ID NO: 2090979 - RNA, 21 nt, Staphylococcus aureus subsp. aureus MW2
uaacuuaaaauuuaaauauug

SEQ ID NO: 2090980 - RNA, 22 nt, Staphylococcus aureus subsp. aureus MW2
uaacuuagaccccuaauuaaaa

SEQ ID NO: 2090981 - RNA, 16 nt, Staphylococcus aureus subsp. aureus MW2
uaacuucauaauauau

SEQ ID NO: 2090982 - RNA, 16 nt, Staphylococcus aureus subsp. aureus MW2
uaacuucguuuuaaua

SEQ ID NO: 2090983 - RNA, 22 nt, Staphylococcus aureus subsp. aureus MW2
uaacugcuuuggaguuucuuca

SEQ ID NO: 2090984 - RNA, 14 nt, Staphylococcus aureus subsp. aureus MW2
uaacugggauauag

SEQ ID NO: 2090985 - RNA, 23 nt, Staphylococcus aureus subsp. aureus MW2
uaacugguugauaaauaaacuca

SEQ ID NO: 2090986 - RNA, 16 nt, Staphylococcus aureus subsp. aureus MW2
uaacuguucuuucguc

SEQ ID NO: 2090987 - RNA, 16 nt, Staphylococcus aureus subsp. aureus MW2
uaacuguuuauccaua

SEQ ID NO: 2090988 - RNA, 12 nt, Staphylococcus aureus subsp. aureus MW2
uaacuguuugau

SEQ ID NO: 2090989 - RNA, 20 nt, Staphylococcus aureus subsp. aureus MW2
uaacuguuuuaaauuaacuu

SEQ ID NO: 2090990 - RNA, 17 nt, Staphylococcus aureus subsp. aureus MW2
uaacuguagcuccuaaa

SEQ ID NO: 2090991 - RNA, 14 nt, Staphylococcus aureus subsp. aureus MW2
uaacuguaaaacau

SEQ ID NO: 2090992 - RNA, 13 nt, Staphylococcus aureus subsp. aureus MW2
uaacuguucuuuc

SEQ ID NO: 2090993 - RNA, 19 nt, Staphylococcus aureus subsp. aureus MW2
uaacgugaggcccauaaau

SEQ ID NO: 2090994 - RNA, 15 nt, Staphylococcus aureus subsp. aureus MW2
uaacguucuguuuug

SEQ ID NO: 2090995 - RNA, 17 nt, Staphylococcus aureus subsp. aureus MW2
uaacuagaaugauuaaa

SEQ ID NO: 2090996 - RNA, 15 nt, Staphylococcus aureus subsp. aureus MW2
uaacuacacuuaaua

SEQ ID NO: 2090997 - RNA, 21 nt, Staphylococcus aureus subsp. aureus MW2
uaacguuucuuuguauaccua

SEQ ID NO: 2090998 - RNA, 23 nt, Staphylococcus aureus subsp. aureus MW2
uaacuaaaaugucuuugaaaaau

SEQ ID NO: 2090999 - RNA, 14 nt, Staphylococcus aureus subsp. aureus MW2
uaacuaaaaugucu

SEQ ID NO: 2091000 - RNA, 13 nt, Staphylococcus aureus subsp. aureus MW2
uaacuaaaauguc

SEQ ID NO: 2091001 - RNA, 17 nt, Staphylococcus aureus subsp. aureus MW2
uaacucuucuaaguuau

SEQ ID NO: 2091002 - RNA, 22 nt, Staphylococcus aureus subsp. aureus MW2
uaacucuucuaaguuauuacaa

SEQ ID NO: 2091003 - RNA, 20 nt, Staphylococcus aureus subsp. aureus MW2
uaacucugaucuaaaaccau

SEQ ID NO: 2091004 - RNA, 19 nt, Staphylococcus aureus subsp. aureus MW2
uaacucuaucaaauuacuu

SEQ ID NO: 2091005 - RNA, 16 nt, Staphylococcus aureus subsp. aureus MW2
uaacucuaaauauaau

SEQ ID NO: 2091006 - RNA, 20 nt, Staphylococcus aureus subsp. aureus MW2
uaacucuaaauauaauagaa

SEQ ID NO: 2091007 - RNA, 17 nt, Staphylococcus aureus subsp. aureus MW2
uaacuaugaaugcugug

SEQ ID NO: 2091008 - RNA, 17 nt, Staphylococcus aureus subsp. aureus MW2
uaacuagcaaaugcacu

SEQ ID NO: 2091009 - RNA, 23 nt, Staphylococcus aureus subsp. aureus MW2
uaacuaguauccuuuauaaauaa

SEQ ID NO: 2091010 - RNA, 22 nt, Staphylococcus aureus subsp. aureus MW2
uaacucaaauaucuaaacaauu

SEQ ID NO: 2091011 - RNA, 12 nt, Staphylococcus aureus subsp. aureus MW2
uaacuauuuaau

SEQ ID NO: 2091012 - RNA, 13 nt, Staphylococcus aureus subsp. aureus MW2
uaacuauuuaauu

SEQ ID NO: 2091013 - RNA, 14 nt, Staphylococcus aureus subsp. aureus MW2
uaacucaagugauu

SEQ ID NO: 2091014 - RNA, 13 nt, Staphylococcus aureus subsp. aureus MW2
uaacucaguaaau

SEQ ID NO: 2091015 - RNA, 14 nt, Staphylococcus aureus subsp. aureus MW2
uaauagaaauaauc

SEQ ID NO: 2091016 - RNA, 13 nt, Staphylococcus aureus subsp. aureus MW2
uaauagaaauaau

SEQ ID NO: 2091017 - RNA, 21 nt, Staphylococcus aureus subsp. aureus MW2
uaauacuguuuaaauaaaauu

SEQ ID NO: 2091018 - RNA, 22 nt, Staphylococcus aureus subsp. aureus MW2
uaauacuucauauccuucauua

SEQ ID NO: 2091019 - RNA, 16 nt, Staphylococcus aureus subsp. aureus MW2
uaauagauaauggauu

SEQ ID NO: 2091020 - RNA, 17 nt, Staphylococcus aureus subsp. aureus MW2
uaauagcaaaauuaugu

SEQ ID NO: 2091021 - RNA, 17 nt, Staphylococcus aureus subsp. aureus MW2
uaauagcaccauacuuc

SEQ ID NO: 2091022 - RNA, 21 nt, Staphylococcus aureus subsp. aureus MW2
uaauagagaaaaaauaaaugu

SEQ ID NO: 2091023 - RNA, 17 nt, Staphylococcus aureus subsp. aureus MW2
uaauaccuuuacuuuca

SEQ ID NO: 2091024 - RNA, 21 nt, Staphylococcus aureus subsp. aureus MW2
uaauacuaauaacucuucuaa

SEQ ID NO: 2091025 - RNA, 22 nt, Staphylococcus aureus subsp. aureus MW2
uaauacuaauuuuguacauaaa

SEQ ID NO: 2091026 - RNA, 20 nt, Staphylococcus aureus subsp. aureus MW2
uaauacuguuuaaauaaaau

SEQ ID NO: 2091027 - RNA, 16 nt, Staphylococcus aureus subsp. aureus MW2
uaauacuguuuaaaua

SEQ ID NO: 2091028 - RNA, 15 nt, Staphylococcus aureus subsp. aureus MW2
uaauauaaguauaau

SEQ ID NO: 2091029 - RNA, 12 nt, Staphylococcus aureus subsp. aureus MW2
uaauauaauacc

SEQ ID NO: 2091030 - RNA, 13 nt, Staphylococcus aureus subsp. aureus MW2
uaauauaauuaaa

SEQ ID NO: 2091031 - RNA, 14 nt, Staphylococcus aureus subsp. aureus MW2
uaauauaauuauua

SEQ ID NO: 2091032 - RNA, 19 nt, Staphylococcus aureus subsp. aureus MW2
uaauauacgagacauuucu

SEQ ID NO: 2091033 - RNA, 20 nt, Staphylococcus aureus subsp. aureus MW2
uaauauaaaaacaaaagaaa

SEQ ID NO: 2091034 - RNA, 12 nt, Staphylococcus aureus subsp. aureus MW2
uaauauaaaaac

SEQ ID NO: 2091035 - RNA, 14 nt, Staphylococcus aureus subsp. aureus MW2
uaauauaaaauaaa

SEQ ID NO: 2091036 - RNA, 14 nt, Staphylococcus aureus subsp. aureus MW2
uaauaguuuuaaua

SEQ ID NO: 2091037 - RNA, 15 nt, Staphylococcus aureus subsp. aureus MW2
uaauaguuuuaauau

SEQ ID NO: 2091038 - RNA, 21 nt, Staphylococcus aureus subsp. aureus MW2
uaauagguuaguaauauauua

SEQ ID NO: 2091039 - RNA, 19 nt, Staphylococcus aureus subsp. aureus MW2
uaauaggcuagauaauaau

SEQ ID NO: 2091040 - RNA, 21 nt, Staphylococcus aureus subsp. aureus MW2
uaauagguuauuugauaauga

SEQ ID NO: 2091041 - RNA, 16 nt, Staphylococcus aureus subsp. aureus MW2
uaauaguaaugaugug

SEQ ID NO: 2091042 - RNA, 18 nt, Staphylococcus aureus subsp. aureus MW2
uaauaguagccuagauac

SEQ ID NO: 2091043 - RNA, 15 nt, Staphylococcus aureus subsp. aureus MW2
uaauaguguuauauu

SEQ ID NO: 2091044 - RNA, 17 nt, Staphylococcus aureus subsp. aureus MW2
uaauaguguuauauugu

SEQ ID NO: 2091045 - RNA, 16 nt, Staphylococcus aureus subsp. aureus MW2
uaauagcuuguuuauu

SEQ ID NO: 2091046 - RNA, 14 nt, Staphylococcus aureus subsp. aureus MW2
uaauagcuauauuu

SEQ ID NO: 2091047 - RNA, 18 nt, Staphylococcus aureus subsp. aureus MW2
uaauaauuggaaucaucu

SEQ ID NO: 2091048 - RNA, 19 nt, Staphylococcus aureus subsp. aureus MW2
uaauaauuggaaucaucuu

SEQ ID NO: 2091049 - RNA, 15 nt, Staphylococcus aureus subsp. aureus MW2
uaauaauuuaacuaa

SEQ ID NO: 2091050 - RNA, 19 nt, Staphylococcus aureus subsp. aureus MW2
uaauaauuuaacuaaucaa

SEQ ID NO: 2091051 - RNA, 12 nt, Staphylococcus aureus subsp. aureus MW2
uaauaauuuaca

SEQ ID NO: 2091052 - RNA, 14 nt, Staphylococcus aureus subsp. aureus MW2
uaauaauuguccau

SEQ ID NO: 2091053 - RNA, 21 nt, Staphylococcus aureus subsp. aureus MW2
uaauaauuugguuaacauccu

SEQ ID NO: 2091054 - RNA, 12 nt, Staphylococcus aureus subsp. aureus MW2
uaauaauuuaac

SEQ ID NO: 2091055 - RNA, 20 nt, Staphylococcus aureus subsp. aureus MW2
uaauaauuagucauugaaaa

SEQ ID NO: 2091056 - RNA, 18 nt, Staphylococcus aureus subsp. aureus MW2
uaauaauucauaaaugcu

SEQ ID NO: 2091057 - RNA, 14 nt, Staphylococcus aureus subsp. aureus MW2
uaauaauuaaacaa

SEQ ID NO: 2091058 - RNA, 15 nt, Staphylococcus aureus subsp. aureus MW2
uaauaauuaaacaaa

SEQ ID NO: 2091059 - RNA, 20 nt, Staphylococcus aureus subsp. aureus MW2
uaauaaugcgauuacagugu

SEQ ID NO: 2091060 - RNA, 18 nt, Staphylococcus aureus subsp. aureus MW2
uaauaaugggaauuguau

SEQ ID NO: 2091061 - RNA, 21 nt, Staphylococcus aureus subsp. aureus MW2
uaauaaugguucucugucaaa

SEQ ID NO: 2091062 - RNA, 16 nt, Staphylococcus aureus subsp. aureus MW2
uaauaauguaucauuu

SEQ ID NO: 2091063 - RNA, 18 nt, Staphylococcus aureus subsp. aureus MW2
uaauacaugacauucauu

SEQ ID NO: 2091064 - RNA, 16 nt, Staphylococcus aureus subsp. aureus MW2
uaauacaucuaauaaa

SEQ ID NO: 2091065 - RNA, 19 nt, Staphylococcus aureus subsp. aureus MW2
uaauaccaauuuuuagcau

SEQ ID NO: 2091066 - RNA, 14 nt, Staphylococcus aureus subsp. aureus MW2
uaauaccaucaucg

SEQ ID NO: 2091067 - RNA, 19 nt, Staphylococcus aureus subsp. aureus MW2
uaauacaagucuuuacucu

SEQ ID NO: 2091068 - RNA, 20 nt, Staphylococcus aureus subsp. aureus MW2
uaauacacuugcuaaaacua

SEQ ID NO: 2091069 - RNA, 17 nt, Staphylococcus aureus subsp. aureus MW2
uaauaaucuuuaacauu

SEQ ID NO: 2091070 - RNA, 18 nt, Staphylococcus aureus subsp. aureus MW2
uaauaaucuuuaacauuu

SEQ ID NO: 2091071 - RNA, 16 nt, Staphylococcus aureus subsp. aureus MW2
uaauaaugaauucuau

SEQ ID NO: 2091072 - RNA, 13 nt, Staphylococcus aureus subsp. aureus MW2
uaauaaugcaugu

SEQ ID NO: 2091073 - RNA, 14 nt, Staphylococcus aureus subsp. aureus MW2
uaauaaucuuuaac

SEQ ID NO: 2091074 - RNA, 16 nt, Staphylococcus aureus subsp. aureus MW2
uaauaaguaauaauuu

SEQ ID NO: 2091075 - RNA, 15 nt, Staphylococcus aureus subsp. aureus MW2
uaauaauaggcuaga

SEQ ID NO: 2091076 - RNA, 16 nt, Staphylococcus aureus subsp. aureus MW2
uaauaauacauucauu

SEQ ID NO: 2091077 - RNA, 18 nt, Staphylococcus aureus subsp. aureus MW2
uaauaauacauucauuaa

SEQ ID NO: 2091078 - RNA, 20 nt, Staphylococcus aureus subsp. aureus MW2
uaauaacccgaacacaaaaa

SEQ ID NO: 2091079 - RNA, 18 nt, Staphylococcus aureus subsp. aureus MW2
uaauaaccauguaaaauu

SEQ ID NO: 2091080 - RNA, 17 nt, Staphylococcus aureus subsp. aureus MW2
uaauaacgcauauaagc

SEQ ID NO: 2091081 - RNA, 19 nt, Staphylococcus aureus subsp. aureus MW2
uaauaacgcugcaccuaac

SEQ ID NO: 2091082 - RNA, 15 nt, Staphylococcus aureus subsp. aureus MW2
uaauaacucuucuaa

SEQ ID NO: 2091083 - RNA, 19 nt, Staphylococcus aureus subsp. aureus MW2
uaauaacucaguaaauuua

SEQ ID NO: 2091084 - RNA, 22 nt, Staphylococcus aureus subsp. aureus MW2
uaauaagcuaauauuuauuuua

SEQ ID NO: 2091085 - RNA, 12 nt, Staphylococcus aureus subsp. aureus MW2
uaaucauaaaaa

SEQ ID NO: 2091086 - RNA, 15 nt, Staphylococcus aureus subsp. aureus MW2
uaaucaguuuccgca

SEQ ID NO: 2091087 - RNA, 14 nt, Staphylococcus aureus subsp. aureus MW2
uaaucaguuacucu

SEQ ID NO: 2091088 - RNA, 17 nt, Staphylococcus aureus subsp. aureus MW2
uaaucauacauaugcua

SEQ ID NO: 2091089 - RNA, 21 nt, Staphylococcus aureus subsp. aureus MW2
uaaucagcuauaaaaguacuu

SEQ ID NO: 2091090 - RNA, 22 nt, Staphylococcus aureus subsp. aureus MW2
uaaucacuuggcgacauuugua

SEQ ID NO: 2091091 - RNA, 21 nt, Staphylococcus aureus subsp. aureus MW2
uaaucacuucugaaaauaacc

SEQ ID NO: 2091092 - RNA, 14 nt, Staphylococcus aureus subsp. aureus MW2
uaaucacauuaauu

SEQ ID NO: 2091093 - RNA, 19 nt, Staphylococcus aureus subsp. aureus MW2
uaaucaauguucuaggcuc

SEQ ID NO: 2091094 - RNA, 18 nt, Staphylococcus aureus subsp. aureus MW2
uaaucaagcaaugcaugc

SEQ ID NO: 2091095 - RNA, 16 nt, Staphylococcus aureus subsp. aureus MW2
uaauccccgaagcaca

SEQ ID NO: 2091096 - RNA, 23 nt, Staphylococcus aureus subsp. aureus MW2
uaauccgagucauacucaucaga

SEQ ID NO: 2091097 - RNA, 21 nt, Staphylococcus aureus subsp. aureus MW2
uaaucccguuauaucuuuuuu

SEQ ID NO: 2091098 - RNA, 19 nt, Staphylococcus aureus subsp. aureus MW2
uaauccaguaaucaaagau

SEQ ID NO: 2091099 - RNA, 14 nt, Staphylococcus aureus subsp. aureus MW2
uaaucauuguuuua

SEQ ID NO: 2091100 - RNA, 20 nt, Staphylococcus aureus subsp. aureus MW2
uaaucauuguuuuaaauuuu

SEQ ID NO: 2091101 - RNA, 15 nt, Staphylococcus aureus subsp. aureus MW2
uaaucauuuuuucaa

SEQ ID NO: 2091102 - RNA, 21 nt, Staphylococcus aureus subsp. aureus MW2
uaaucauguaaugcuuaaaaa

SEQ ID NO: 2091103 - RNA, 15 nt, Staphylococcus aureus subsp. aureus MW2
uaauauuuuggcuua

SEQ ID NO: 2091104 - RNA, 12 nt, Staphylococcus aureus subsp. aureus MW2
uaauauuuucau

SEQ ID NO: 2091105 - RNA, 11 nt, Staphylococcus aureus subsp. aureus MW2
uaauauuuuuu

SEQ ID NO: 2091106 - RNA, 15 nt, Staphylococcus aureus subsp. aureus MW2
uaauauuuucuuaga

SEQ ID NO: 2091107 - RNA, 16 nt, Staphylococcus aureus subsp. aureus MW2
uaauauuuucuuagaa

SEQ ID NO: 2091108 - RNA, 14 nt, Staphylococcus aureus subsp. aureus MW2
uaauauuuuuugau

SEQ ID NO: 2091109 - RNA, 15 nt, Staphylococcus aureus subsp. aureus MW2
uaauauuuuuuucaa

SEQ ID NO: 2091110 - RNA, 15 nt, Staphylococcus aureus subsp. aureus MW2
uaaucaagcaaugca

SEQ ID NO: 2091111 - RNA, 15 nt, Staphylococcus aureus subsp. aureus MW2
uaaucaaauuaguca

SEQ ID NO: 2091112 - RNA, 18 nt, Staphylococcus aureus subsp. aureus MW2
uaauauuugauaacaaaa

SEQ ID NO: 2091113 - RNA, 18 nt, Staphylococcus aureus subsp. aureus MW2
uaauauuugauuauucgu

SEQ ID NO: 2091114 - RNA, 11 nt, Staphylococcus aureus subsp. aureus MW2
uaauauuugcu

SEQ ID NO: 2091115 - RNA, 18 nt, Staphylococcus aureus subsp. aureus MW2
uaauauuucuuaccauuu

SEQ ID NO: 2091116 - RNA, 17 nt, Staphylococcus aureus subsp. aureus MW2
uaauauuucuuaccauu

SEQ ID NO: 2091117 - RNA, 19 nt, Staphylococcus aureus subsp. aureus MW2
uaauauuuaagaaguuaaa

SEQ ID NO: 2091118 - RNA, 16 nt, Staphylococcus aureus subsp. aureus MW2
uaauauuuauuuuaaa

SEQ ID NO: 2091119 - RNA, 17 nt, Staphylococcus aureus subsp. aureus MW2
uaauauuuauuuuaaau

SEQ ID NO: 2091120 - RNA, 13 nt, Staphylococcus aureus subsp. aureus MW2
uaauauuuaaaaa

SEQ ID NO: 2091121 - RNA, 14 nt, Staphylococcus aureus subsp. aureus MW2
uaauauuuaaaaaa

SEQ ID NO: 2091122 - RNA, 15 nt, Staphylococcus aureus subsp. aureus MW2
uaauauuuaaaaaac

SEQ ID NO: 2091123 - RNA, 16 nt, Staphylococcus aureus subsp. aureus MW2
uaauauuuaaaaaaca

SEQ ID NO: 2091124 - RNA, 20 nt, Staphylococcus aureus subsp. aureus MW2
uaauauugagacuauuauaa

SEQ ID NO: 2091125 - RNA, 16 nt, Staphylococcus aureus subsp. aureus MW2
uaauauugguuauaua

SEQ ID NO: 2091126 - RNA, 23 nt, Staphylococcus aureus subsp. aureus MW2
uaauauugguuauauauugucuu

SEQ ID NO: 2091127 - RNA, 17 nt, Staphylococcus aureus subsp. aureus MW2
uaauauugaauaaaaaa

SEQ ID NO: 2091128 - RNA, 14 nt, Staphylococcus aureus subsp. aureus MW2
uaauauucaacuug

SEQ ID NO: 2091129 - RNA, 14 nt, Staphylococcus aureus subsp. aureus MW2
uaauauugaaagau

SEQ ID NO: 2091130 - RNA, 17 nt, Staphylococcus aureus subsp. aureus MW2
uaauauugaaaugagcu

SEQ ID NO: 2091131 - RNA, 12 nt, Staphylococcus aureus subsp. aureus MW2
uaauauuauaag

SEQ ID NO: 2091132 - RNA, 13 nt, Staphylococcus aureus subsp. aureus MW2
uaauauucaacuu

SEQ ID NO: 2091133 - RNA, 17 nt, Staphylococcus aureus subsp. aureus MW2
uaauaucauauucaaaa

SEQ ID NO: 2091134 - RNA, 16 nt, Staphylococcus aureus subsp. aureus MW2
uaauaucaauaaugcu

SEQ ID NO: 2091135 - RNA, 19 nt, Staphylococcus aureus subsp. aureus MW2
uaauaucaguagcauauug

SEQ ID NO: 2091136 - RNA, 15 nt, Staphylococcus aureus subsp. aureus MW2
uaauauauaaaaguc

SEQ ID NO: 2091137 - RNA, 13 nt, Staphylococcus aureus subsp. aureus MW2
uaauauauuaaaa

SEQ ID NO: 2091138 - RNA, 16 nt, Staphylococcus aureus subsp. aureus MW2
uaauauauuaaaaauc

SEQ ID NO: 2091139 - RNA, 18 nt, Staphylococcus aureus subsp. aureus MW2
uaauauauuaaaaaucaa

SEQ ID NO: 2091140 - RNA, 21 nt, Staphylococcus aureus subsp. aureus MW2
uaauauauuaaaaaucaaaau

SEQ ID NO: 2091141 - RNA, 13 nt, Staphylococcus aureus subsp. aureus MW2
uaauauauuaaua

SEQ ID NO: 2091142 - RNA, 13 nt, Staphylococcus aureus subsp. aureus MW2
uaauauauuaauu

SEQ ID NO: 2091143 - RNA, 19 nt, Staphylococcus aureus subsp. aureus MW2
uaauaucuuacuacuuaau

SEQ ID NO: 2091144 - RNA, 14 nt, Staphylococcus aureus subsp. aureus MW2
uaauaucuucuuua

SEQ ID NO: 2091145 - RNA, 15 nt, Staphylococcus aureus subsp. aureus MW2
uaauaucuuuuaaug

SEQ ID NO: 2091146 - RNA, 17 nt, Staphylococcus aureus subsp. aureus MW2
uaauaugaaggcuuuuu

SEQ ID NO: 2091147 - RNA, 24 nt, Staphylococcus aureus subsp. aureus MW2
uaauaucgacuuuucuaucaaaaa

SEQ ID NO: 2091148 - RNA, 17 nt, Staphylococcus aureus subsp. aureus MW2
uaauaugcuauguaaau

SEQ ID NO: 2091149 - RNA, 12 nt, Staphylococcus aureus subsp. aureus MW2
uaauaugauugg

SEQ ID NO: 2091150 - RNA, 13 nt, Staphylococcus aureus subsp. aureus MW2
uaaucgcauucuu

SEQ ID NO: 2091151 - RNA, 20 nt, Staphylococcus aureus subsp. aureus MW2
uaaucgauugguaaaucuac

SEQ ID NO: 2091152 - RNA, 18 nt, Staphylococcus aureus subsp. aureus MW2
uaaugauaauccaccaaa

SEQ ID NO: 2091153 - RNA, 20 nt, Staphylococcus aureus subsp. aureus MW2
uaaugaugacaucaauaucu

SEQ ID NO: 2091154 - RNA, 15 nt, Staphylococcus aureus subsp. aureus MW2
uaaugaucaaguagu

SEQ ID NO: 2091155 - RNA, 13 nt, Staphylococcus aureus subsp. aureus MW2
uaaugaucaucua

SEQ ID NO: 2091156 - RNA, 15 nt, Staphylococcus aureus subsp. aureus MW2
uaaugauagcaauga

SEQ ID NO: 2091157 - RNA, 13 nt, Staphylococcus aureus subsp. aureus MW2
uaaugauaauggu

SEQ ID NO: 2091158 - RNA, 19 nt, Staphylococcus aureus subsp. aureus MW2
uaaugauaguacauuuauu

SEQ ID NO: 2091159 - RNA, 18 nt, Staphylococcus aureus subsp. aureus MW2
uaaugauaaauuaaagcu

SEQ ID NO: 2091160 - RNA, 11 nt, Staphylococcus aureus subsp. aureus MW2
uaaugauuuug

SEQ ID NO: 2091161 - RNA, 21 nt, Staphylococcus aureus subsp. aureus MW2
uaauguaucauuucagaaaua

SEQ ID NO: 2091162 - RNA, 19 nt, Staphylococcus aureus subsp. aureus MW2
uaaugugcaaguuggcggg

SEQ ID NO: 2091163 - RNA, 22 nt, Staphylococcus aureus subsp. aureus MW2
uaaugugcaaguuggcggggcc

SEQ ID NO: 2091164 - RNA, 17 nt, Staphylococcus aureus subsp. aureus MW2
uaaugugcgucacucac

SEQ ID NO: 2091165 - RNA, 19 nt, Staphylococcus aureus subsp. aureus MW2
uaaugugcauauugaguau

SEQ ID NO: 2091166 - RNA, 15 nt, Staphylococcus aureus subsp. aureus MW2
uaauguauaaaacag

SEQ ID NO: 2091167 - RNA, 23 nt, Staphylococcus aureus subsp. aureus MW2
uaauguacauguauaaaagauau

SEQ ID NO: 2091168 - RNA, 17 nt, Staphylococcus aureus subsp. aureus MW2
uaauguacauguauaaa

SEQ ID NO: 2091169 - RNA, 12 nt, Staphylococcus aureus subsp. aureus MW2
uaauguaacuug

SEQ ID NO: 2091170 - RNA, 13 nt, Staphylococcus aureus subsp. aureus MW2
uaauguaaaauga

SEQ ID NO: 2091171 - RNA, 23 nt, Staphylococcus aureus subsp. aureus MW2
uaauguaaaaugaugauuuaaag

SEQ ID NO: 2091172 - RNA, 15 nt, Staphylococcus aureus subsp. aureus MW2
uaaugcuaugauuaa

SEQ ID NO: 2091173 - RNA, 17 nt, Staphylococcus aureus subsp. aureus MW2
uaaugcuacuauuaaau

SEQ ID NO: 2091174 - RNA, 23 nt, Staphylococcus aureus subsp. aureus MW2
uaaugcaagcgacgauuggaaag

SEQ ID NO: 2091175 - RNA, 21 nt, Staphylococcus aureus subsp. aureus MW2
uaaugccugccccuuagucau

SEQ ID NO: 2091176 - RNA, 22 nt, Staphylococcus aureus subsp. aureus MW2
uaaugccuaauuuguaacccca

SEQ ID NO: 2091177 - RNA, 15 nt, Staphylococcus aureus subsp. aureus MW2
uaauguuugcuuuuu

SEQ ID NO: 2091178 - RNA, 17 nt, Staphylococcus aureus subsp. aureus MW2
uaauguuuucauuggau

SEQ ID NO: 2091179 - RNA, 13 nt, Staphylococcus aureus subsp. aureus MW2
uaauguuuccauu

SEQ ID NO: 2091180 - RNA, 22 nt, Staphylococcus aureus subsp. aureus MW2
uaauguuggcaaacuauuaaua

SEQ ID NO: 2091181 - RNA, 23 nt, Staphylococcus aureus subsp. aureus MW2
uaauguuaaacuagaaaacauaa

SEQ ID NO: 2091182 - RNA, 13 nt, Staphylococcus aureus subsp. aureus MW2
uaauguuaaacac

SEQ ID NO: 2091183 - RNA, 17 nt, Staphylococcus aureus subsp. aureus MW2
uaauguguuaauacuuc

SEQ ID NO: 2091184 - RNA, 23 nt, Staphylococcus aureus subsp. aureus MW2
uaauguguaccuuuuuauugaua

SEQ ID NO: 2091185 - RNA, 15 nt, Staphylococcus aureus subsp. aureus MW2
uaauuaaagcaucuu

SEQ ID NO: 2091186 - RNA, 18 nt, Staphylococcus aureus subsp. aureus MW2
uaauuaaacauuuagauu

SEQ ID NO: 2091187 - RNA, 13 nt, Staphylococcus aureus subsp. aureus MW2
uaauuaaacaaaa

SEQ ID NO: 2091188 - RNA, 18 nt, Staphylococcus aureus subsp. aureus MW2
uaauuaaacaaaacuuaa

SEQ ID NO: 2091189 - RNA, 12 nt, Staphylococcus aureus subsp. aureus MW2
uaauuaaaauaa

SEQ ID NO: 2091190 - RNA, 22 nt, Staphylococcus aureus subsp. aureus MW2
uaauuaaaauaagauauauaau

SEQ ID NO: 2091191 - RNA, 16 nt, Staphylococcus aureus subsp. aureus MW2
uaauuaauuuuguaau

SEQ ID NO: 2091192 - RNA, 19 nt, Staphylococcus aureus subsp. aureus MW2
uaauuacgucauaaaauac

SEQ ID NO: 2091193 - RNA, 21 nt, Staphylococcus aureus subsp. aureus MW2
uaauuacuaaccuaaagauaa

SEQ ID NO: 2091194 - RNA, 20 nt, Staphylococcus aureus subsp. aureus MW2
uaauuauugagaauauuuau

SEQ ID NO: 2091195 - RNA, 14 nt, Staphylococcus aureus subsp. aureus MW2
uaauuauuuagauu

SEQ ID NO: 2091196 - RNA, 17 nt, Staphylococcus aureus subsp. aureus MW2
uaauuauugcaucauaa

SEQ ID NO: 2091197 - RNA, 16 nt, Staphylococcus aureus subsp. aureus MW2
uaauuauugagaauau

SEQ ID NO: 2091198 - RNA, 21 nt, Staphylococcus aureus subsp. aureus MW2
uaauuauuccuucauugaaga

SEQ ID NO: 2091199 - RNA, 15 nt, Staphylococcus aureus subsp. aureus MW2
uaauuauucaugaau

SEQ ID NO: 2091200 - RNA, 20 nt, Staphylococcus aureus subsp. aureus MW2
uaauuacuuucauuguaaau

SEQ ID NO: 2091201 - RNA, 19 nt, Staphylococcus aureus subsp. aureus MW2
uaauuaaacuguaaacauu

SEQ ID NO: 2091202 - RNA, 22 nt, Staphylococcus aureus subsp. aureus MW2
uaauuacuuucauuguaaauuu

SEQ ID NO: 2091203 - RNA, 12 nt, Staphylococcus aureus subsp. aureus MW2
uaauuaugaaaa

SEQ ID NO: 2091204 - RNA, 14 nt, Staphylococcus aureus subsp. aureus MW2
uaauuaugaaaagu

SEQ ID NO: 2091205 - RNA, 15 nt, Staphylococcus aureus subsp. aureus MW2
uaauucgccaucuuu

SEQ ID NO: 2091206 - RNA, 12 nt, Staphylococcus aureus subsp. aureus MW2
uaauuccuggug

SEQ ID NO: 2091207 - RNA, 17 nt, Staphylococcus aureus subsp. aureus MW2
uaauucccuguuaugaa

SEQ ID NO: 2091208 - RNA, 19 nt, Staphylococcus aureus subsp. aureus MW2
uaauucccuaggaaauaaa

SEQ ID NO: 2091209 - RNA, 12 nt, Staphylococcus aureus subsp. aureus MW2
uacaacuucauu

SEQ ID NO: 2091210 - RNA, 23 nt, Staphylococcus aureus subsp. aureus MW2
uacaaauuuuuuuuauuaauuaa

SEQ ID NO: 2091211 - RNA, 18 nt, Staphylococcus aureus subsp. aureus MW2
uacaacaccaauugaaau

SEQ ID NO: 2091212 - RNA, 22 nt, Staphylococcus aureus subsp. aureus MW2
uacaaauuuuaaaauaaaaaau

SEQ ID NO: 2091213 - RNA, 14 nt, Staphylococcus aureus subsp. aureus MW2
uacaacuaaauaug

SEQ ID NO: 2091214 - RNA, 15 nt, Staphylococcus aureus subsp. aureus MW2
uacaacaguugcacc

SEQ ID NO: 2091215 - RNA, 16 nt, Staphylococcus aureus subsp. aureus MW2
uacaaauuuauauuaa

SEQ ID NO: 2091216 - RNA, 12 nt, Staphylococcus aureus subsp. aureus MW2
uacaaauugauu

SEQ ID NO: 2091217 - RNA, 21 nt, Staphylococcus aureus subsp. aureus MW2
uacaaaucaugacauaaaacu

SEQ ID NO: 2091218 - RNA, 19 nt, Staphylococcus aureus subsp. aureus MW2
uacaaauaacaaacauuaa

SEQ ID NO: 2091219 - RNA, 14 nt, Staphylococcus aureus subsp. aureus MW2
uacaaauaacaaac

SEQ ID NO: 2091220 - RNA, 19 nt, Staphylococcus aureus subsp. aureus MW2
uacaaauacaguuaucacc

SEQ ID NO: 2091221 - RNA, 20 nt, Staphylococcus aureus subsp. aureus MW2
uacaaaguuuauacuuaaua

SEQ ID NO: 2091222 - RNA, 14 nt, Staphylococcus aureus subsp. aureus MW2
uacaaagugauuua

SEQ ID NO: 2091223 - RNA, 16 nt, Staphylococcus aureus subsp. aureus MW2
uacaaagucauuuuca

SEQ ID NO: 2091224 - RNA, 17 nt, Staphylococcus aureus subsp. aureus MW2
uacaaagccuuaauauc

SEQ ID NO: 2091225 - RNA, 22 nt, Staphylococcus aureus subsp. aureus MW2
uacaaacauuccucuauuguau

SEQ ID NO: 2091226 - RNA, 18 nt, Staphylococcus aureus subsp. aureus MW2
uacaaacauaaucauaau

SEQ ID NO: 2091227 - RNA, 15 nt, Staphylococcus aureus subsp. aureus MW2
uacaaaauugucuca

SEQ ID NO: 2091228 - RNA, 17 nt, Staphylococcus aureus subsp. aureus MW2
uacaaaaugaugaaaau

SEQ ID NO: 2091229 - RNA, 13 nt, Staphylococcus aureus subsp. aureus MW2
uacaaacacccac

SEQ ID NO: 2091230 - RNA, 21 nt, Staphylococcus aureus subsp. aureus MW2
uacaaaagaggcgccacaaca

SEQ ID NO: 2091231 - RNA, 16 nt, Staphylococcus aureus subsp. aureus MW2
uaauuuguuuuaaaua

SEQ ID NO: 2091232 - RNA, 16 nt, Staphylococcus aureus subsp. aureus MW2
uaauuuucuauuauuu

SEQ ID NO: 2091233 - RNA, 16 nt, Staphylococcus aureus subsp. aureus MW2
uaauuuuuaaaucuac

SEQ ID NO: 2091234 - RNA, 14 nt, Staphylococcus aureus subsp. aureus MW2
uaauuuuuaaacaa

SEQ ID NO: 2091235 - RNA, 20 nt, Staphylococcus aureus subsp. aureus MW2
uaauuuuuaaacaaaaauaa

SEQ ID NO: 2091236 - RNA, 15 nt, Staphylococcus aureus subsp. aureus MW2
uaauuuuuaacagcg

SEQ ID NO: 2091237 - RNA, 24 nt, Staphylococcus aureus subsp. aureus MW2
uaauuuuuaacagcgugaauauaa

SEQ ID NO: 2091238 - RNA, 16 nt, Staphylococcus aureus subsp. aureus MW2
uaauuuuuaacaucau

SEQ ID NO: 2091239 - RNA, 17 nt, Staphylococcus aureus subsp. aureus MW2
uaauuuuuaacaucauu

SEQ ID NO: 2091240 - RNA, 18 nt, Staphylococcus aureus subsp. aureus MW2
uaauuuugacauaaaaaa

SEQ ID NO: 2091241 - RNA, 21 nt, Staphylococcus aureus subsp. aureus MW2
uaauuuugagacaaaaaauga

SEQ ID NO: 2091242 - RNA, 13 nt, Staphylococcus aureus subsp. aureus MW2
uaauuuuguaauu

SEQ ID NO: 2091243 - RNA, 17 nt, Staphylococcus aureus subsp. aureus MW2
uacaaaacauauucagu

SEQ ID NO: 2091244 - RNA, 15 nt, Staphylococcus aureus subsp. aureus MW2
uaauuuuucuucuuu

SEQ ID NO: 2091245 - RNA, 14 nt, Staphylococcus aureus subsp. aureus MW2
uaauuuuucgucuu

SEQ ID NO: 2091246 - RNA, 24 nt, Staphylococcus aureus subsp. aureus MW2
uaauuuuuucguuaacucuaucua

SEQ ID NO: 2091247 - RNA, 13 nt, Staphylococcus aureus subsp. aureus MW2
uaauuuuucauua

SEQ ID NO: 2091248 - RNA, 14 nt, Staphylococcus aureus subsp. aureus MW2
uaauuuauuuauuu

SEQ ID NO: 2091249 - RNA, 16 nt, Staphylococcus aureus subsp. aureus MW2
uaauuuauugauaagc

SEQ ID NO: 2091250 - RNA, 15 nt, Staphylococcus aureus subsp. aureus MW2
uaauuuaucauuauu

SEQ ID NO: 2091251 - RNA, 16 nt, Staphylococcus aureus subsp. aureus MW2
uaauugcguuuaauaa

SEQ ID NO: 2091252 - RNA, 20 nt, Staphylococcus aureus subsp. aureus MW2
uaauugcaaaugcucuaaca

SEQ ID NO: 2091253 - RNA, 16 nt, Staphylococcus aureus subsp. aureus MW2
uaauugaugaaagacu

SEQ ID NO: 2091254 - RNA, 19 nt, Staphylococcus aureus subsp. aureus MW2
uaauugaugaugaugugcu

SEQ ID NO: 2091255 - RNA, 20 nt, Staphylococcus aureus subsp. aureus MW2
uaauugcauagcuaaauaaa

SEQ ID NO: 2091256 - RNA, 12 nt, Staphylococcus aureus subsp. aureus MW2
uaauugcauuac

SEQ ID NO: 2091257 - RNA, 22 nt, Staphylococcus aureus subsp. aureus MW2
uaauuucaauuuggaaauaucu

SEQ ID NO: 2091258 - RNA, 23 nt, Staphylococcus aureus subsp. aureus MW2
uaauuugauguucuugaaaacaa

SEQ ID NO: 2091259 - RNA, 11 nt, Staphylococcus aureus subsp. aureus MW2
uaauuugauua

SEQ ID NO: 2091260 - RNA, 12 nt, Staphylococcus aureus subsp. aureus MW2
uaauuugauuaa

SEQ ID NO: 2091261 - RNA, 18 nt, Staphylococcus aureus subsp. aureus MW2
uacagguuuuaaaauuaa

SEQ ID NO: 2091262 - RNA, 11 nt, Staphylococcus aureus subsp. aureus MW2
uacaauuuuug

SEQ ID NO: 2091263 - RNA, 21 nt, Staphylococcus aureus subsp. aureus MW2
uacaauuuuuggaaugguaua

SEQ ID NO: 2091264 - RNA, 20 nt, Staphylococcus aureus subsp. aureus MW2
uacaauuuuccuuucaauaa

SEQ ID NO: 2091265 - RNA, 17 nt, Staphylococcus aureus subsp. aureus MW2
uacaauuuucucauuaa

SEQ ID NO: 2091266 - RNA, 12 nt, Staphylococcus aureus subsp. aureus MW2
uacaguaauauu

SEQ ID NO: 2091267 - RNA, 15 nt, Staphylococcus aureus subsp. aureus MW2
uacaauuuccuaccc

SEQ ID NO: 2091268 - RNA, 21 nt, Staphylococcus aureus subsp. aureus MW2
uacaauuucuucauuuucauu

SEQ ID NO: 2091269 - RNA, 13 nt, Staphylococcus aureus subsp. aureus MW2
uacaauuuccuac

SEQ ID NO: 2091270 - RNA, 19 nt, Staphylococcus aureus subsp. aureus MW2
uacaauucauaagaaaaau

SEQ ID NO: 2091271 - RNA, 16 nt, Staphylococcus aureus subsp. aureus MW2
uacaauucauaagaaa

SEQ ID NO: 2091272 - RNA, 14 nt, Staphylococcus aureus subsp. aureus MW2
uacaagucuuauuu

SEQ ID NO: 2091273 - RNA, 18 nt, Staphylococcus aureus subsp. aureus MW2
uacaucgacaauuuucga

SEQ ID NO: 2091274 - RNA, 14 nt, Staphylococcus aureus subsp. aureus MW2
uacauccauacuuc

SEQ ID NO: 2091275 - RNA, 21 nt, Staphylococcus aureus subsp. aureus MW2
uacaucauuaaauauuuagau

SEQ ID NO: 2091276 - RNA, 19 nt, Staphylococcus aureus subsp. aureus MW2
uacaucauuagacuuucuu

SEQ ID NO: 2091277 - RNA, 17 nt, Staphylococcus aureus subsp. aureus MW2
uacaucauuaaauauuu

SEQ ID NO: 2091278 - RNA, 15 nt, Staphylococcus aureus subsp. aureus MW2
uacaucauuaaauau

SEQ ID NO: 2091279 - RNA, 14 nt, Staphylococcus aureus subsp. aureus MW2
uacaucauuaaaua

SEQ ID NO: 2091280 - RNA, 15 nt, Staphylococcus aureus subsp. aureus MW2
uacaucaauuucuag

SEQ ID NO: 2091281 - RNA, 15 nt, Staphylococcus aureus subsp. aureus MW2
uacauaauuugaauu

SEQ ID NO: 2091282 - RNA, 14 nt, Staphylococcus aureus subsp. aureus MW2
uacauaaugguuca

SEQ ID NO: 2091283 - RNA, 22 nt, Staphylococcus aureus subsp. aureus MW2
uacauaccacacuuuaaacaag

SEQ ID NO: 2091284 - RNA, 21 nt, Staphylococcus aureus subsp. aureus MW2
uacauaccacacuuuaaacaa

SEQ ID NO: 2091285 - RNA, 22 nt, Staphylococcus aureus subsp. aureus MW2
uacauaccgauuuucaaccauc

SEQ ID NO: 2091286 - RNA, 16 nt, Staphylococcus aureus subsp. aureus MW2
uacaucaauauugucu

SEQ ID NO: 2091287 - RNA, 19 nt, Staphylococcus aureus subsp. aureus MW2
uaccaaccaaaaccaaaug

SEQ ID NO: 2091288 - RNA, 19 nt, Staphylococcus aureus subsp. aureus MW2
uaccaacugcaaauacacc

SEQ ID NO: 2091289 - RNA, 21 nt, Staphylococcus aureus subsp. aureus MW2
uaccaacugcaaauacaccag

SEQ ID NO: 2091290 - RNA, 17 nt, Staphylococcus aureus subsp. aureus MW2
uaccaauuguuucagcu

SEQ ID NO: 2091291 - RNA, 18 nt, Staphylococcus aureus subsp. aureus MW2
uaccacacuuuaaacaag

SEQ ID NO: 2091292 - RNA, 13 nt, Staphylococcus aureus subsp. aureus MW2
uaccaaauuuaua

SEQ ID NO: 2091293 - RNA, 21 nt, Staphylococcus aureus subsp. aureus MW2
uaccaaauuuauaauuuguau

SEQ ID NO: 2091294 - RNA, 22 nt, Staphylococcus aureus subsp. aureus MW2
uaccaaauauauuuuuauuaau

SEQ ID NO: 2091295 - RNA, 16 nt, Staphylococcus aureus subsp. aureus MW2
uaccaaauaaauaagu

SEQ ID NO: 2091296 - RNA, 14 nt, Staphylococcus aureus subsp. aureus MW2
uacauugauaaaau

SEQ ID NO: 2091297 - RNA, 13 nt, Staphylococcus aureus subsp. aureus MW2
uacauuauuaaua

SEQ ID NO: 2091298 - RNA, 15 nt, Staphylococcus aureus subsp. aureus MW2
uacauuaauauaaau

SEQ ID NO: 2091299 - RNA, 17 nt, Staphylococcus aureus subsp. aureus MW2
uacauuaauauaaauau

SEQ ID NO: 2091300 - RNA, 19 nt, Staphylococcus aureus subsp. aureus MW2
uacauuaguuugaucauuu

SEQ ID NO: 2091301 - RNA, 22 nt, Staphylococcus aureus subsp. aureus MW2
uacauuaguuugaucauuuacu

SEQ ID NO: 2091302 - RNA, 13 nt, Staphylococcus aureus subsp. aureus MW2
uacauuaugaaca

SEQ ID NO: 2091303 - RNA, 15 nt, Staphylococcus aureus subsp. aureus MW2
uacauuaugaacaga

SEQ ID NO: 2091304 - RNA, 15 nt, Staphylococcus aureus subsp. aureus MW2
uaccacuugaauacu

SEQ ID NO: 2091305 - RNA, 16 nt, Staphylococcus aureus subsp. aureus MW2
uaccaccagccccaau

SEQ ID NO: 2091306 - RNA, 12 nt, Staphylococcus aureus subsp. aureus MW2
uaccagcaugaa

SEQ ID NO: 2091307 - RNA, 20 nt, Staphylococcus aureus subsp. aureus MW2
uacccacaucuuuuuaaaag

SEQ ID NO: 2091308 - RNA, 23 nt, Staphylococcus aureus subsp. aureus MW2
uacccaccuuucuuuaucauauc

SEQ ID NO: 2091309 - RNA, 19 nt, Staphylococcus aureus subsp. aureus MW2
uacccauuuuuuuccaagc

SEQ ID NO: 2091310 - RNA, 22 nt, Staphylococcus aureus subsp. aureus MW2
uacccauaauuuaaaugauauu

SEQ ID NO: 2091311 - RNA, 23 nt, Staphylococcus aureus subsp. aureus MW2
uaccauugugaugauaauuaaug

SEQ ID NO: 2091312 - RNA, 17 nt, Staphylococcus aureus subsp. aureus MW2
uaccauguuuuuuaagu

SEQ ID NO: 2091313 - RNA, 19 nt, Staphylococcus aureus subsp. aureus MW2
uaccaugaugagauaaaau

SEQ ID NO: 2091314 - RNA, 23 nt, Staphylococcus aureus subsp. aureus MW2
uaccaugaugagauaaaaucaua

SEQ ID NO: 2091315 - RNA, 15 nt, Staphylococcus aureus subsp. aureus MW2
uaccaucuuuaauac

SEQ ID NO: 2091316 - RNA, 13 nt, Staphylococcus aureus subsp. aureus MW2
uaccaucaauaaa

SEQ ID NO: 2091317 - RNA, 22 nt, Staphylococcus aureus subsp. aureus MW2
uaccaucaauaaaaauugaauu

SEQ ID NO: 2091318 - RNA, 19 nt, Staphylococcus aureus subsp. aureus MW2
uaccauauuuuuuaguaau

SEQ ID NO: 2091319 - RNA, 23 nt, Staphylococcus aureus subsp. aureus MW2
uaccauauuuuuuaguaauaaca

SEQ ID NO: 2091320 - RNA, 14 nt, Staphylococcus aureus subsp. aureus MW2
uaccauauaauucu

SEQ ID NO: 2091321 - RNA, 15 nt, Staphylococcus aureus subsp. aureus MW2
uaccauauaauucuu

SEQ ID NO: 2091322 - RNA, 18 nt, Staphylococcus aureus subsp. aureus MW2
uaccauagauuauauuau

SEQ ID NO: 2091323 - RNA, 21 nt, Staphylococcus aureus subsp. aureus MW2
uaccauaaauuuauauauaga

SEQ ID NO: 2091324 - RNA, 18 nt, Staphylococcus aureus subsp. aureus MW2
uaccagugggcuccaaac

SEQ ID NO: 2091325 - RNA, 20 nt, Staphylococcus aureus subsp. aureus MW2
uaccagugggcuccaaacau

SEQ ID NO: 2091326 - RNA, 22 nt, Staphylococcus aureus subsp. aureus MW2
uaccagugggcuccaaacauag

SEQ ID NO: 2091327 - RNA, 20 nt, Staphylococcus aureus subsp. aureus MW2
uaccccuguugaauauacua

SEQ ID NO: 2091328 - RNA, 15 nt, Staphylococcus aureus subsp. aureus MW2
uacccuauuuuacaa

SEQ ID NO: 2091329 - RNA, 13 nt, Staphylococcus aureus subsp. aureus MW2
uacccuuuuucaa

SEQ ID NO: 2091330 - RNA, 22 nt, Staphylococcus aureus subsp. aureus MW2
uacccuugcaaauauaucaucu

SEQ ID NO: 2091331 - RNA, 15 nt, Staphylococcus aureus subsp. aureus MW2
uacccuuuaaucuca

SEQ ID NO: 2091332 - RNA, 21 nt, Staphylococcus aureus subsp. aureus MW2
uaccgcuaaaauucuuucagc

SEQ ID NO: 2091333 - RNA, 15 nt, Staphylococcus aureus subsp. aureus MW2
uaccgcugcuuuuac

SEQ ID NO: 2091334 - RNA, 21 nt, Staphylococcus aureus subsp. aureus MW2
uaccgauugucaauuuaaagu

SEQ ID NO: 2091335 - RNA, 18 nt, Staphylococcus aureus subsp. aureus MW2
uacuguuuaaauaaaauu

SEQ ID NO: 2091336 - RNA, 16 nt, Staphylococcus aureus subsp. aureus MW2
uacuguuuaaauaaaa

SEQ ID NO: 2091337 - RNA, 13 nt, Staphylococcus aureus subsp. aureus MW2
uacuguuugcuuu

SEQ ID NO: 2091338 - RNA, 12 nt, Staphylococcus aureus subsp. aureus MW2
uacuguuuucau

SEQ ID NO: 2091339 - RNA, 16 nt, Staphylococcus aureus subsp. aureus MW2
uacugugaaaauacca

SEQ ID NO: 2091340 - RNA, 20 nt, Staphylococcus aureus subsp. aureus MW2
uacugucucaucuucuaaau

SEQ ID NO: 2091341 - RNA, 15 nt, Staphylococcus aureus subsp. aureus MW2
uacugcuguuuuuau

SEQ ID NO: 2091342 - RNA, 16 nt, Staphylococcus aureus subsp. aureus MW2
uacugcuuuuuuaaau

SEQ ID NO: 2091343 - RNA, 18 nt, Staphylococcus aureus subsp. aureus MW2
uacuucuuuggucuaaag

SEQ ID NO: 2091344 - RNA, 17 nt, Staphylococcus aureus subsp. aureus MW2
uacuugagcaaguuaua

SEQ ID NO: 2091345 - RNA, 22 nt, Staphylococcus aureus subsp. aureus MW2
uacuugagcaaguuauaucaua

SEQ ID NO: 2091346 - RNA, 20 nt, Staphylococcus aureus subsp. aureus MW2
uacuucaguuugguuugcuu

SEQ ID NO: 2091347 - RNA, 23 nt, Staphylococcus aureus subsp. aureus MW2
uacuuuagaaagugauucccaaa

SEQ ID NO: 2091348 - RNA, 16 nt, Staphylococcus aureus subsp. aureus MW2
uacuugcacaccagug

SEQ ID NO: 2091349 - RNA, 18 nt, Staphylococcus aureus subsp. aureus MW2
uacuugaauguaagaagu

SEQ ID NO: 2091350 - RNA, 20 nt, Staphylococcus aureus subsp. aureus MW2
uacuugauuagauuugugug

SEQ ID NO: 2091351 - RNA, 15 nt, Staphylococcus aureus subsp. aureus MW2
uacuuauuucuuuuc

SEQ ID NO: 2091352 - RNA, 13 nt, Staphylococcus aureus subsp. aureus MW2
uacuuauuucuuu

SEQ ID NO: 2091353 - RNA, 14 nt, Staphylococcus aureus subsp. aureus MW2
uacuguuuucauuu

SEQ ID NO: 2091354 - RNA, 18 nt, Staphylococcus aureus subsp. aureus MW2
uacuuaaaauaaguauuu

SEQ ID NO: 2091355 - RNA, 18 nt, Staphylococcus aureus subsp. aureus MW2
uacuuauuucuuuucauu

SEQ ID NO: 2091356 - RNA, 19 nt, Staphylococcus aureus subsp. aureus MW2
uacuuauuucuuuucauua

SEQ ID NO: 2091357 - RNA, 14 nt, Staphylococcus aureus subsp. aureus MW2
uacuagaauaacuu

SEQ ID NO: 2091358 - RNA, 16 nt, Staphylococcus aureus subsp. aureus MW2
uacuagaauaacuuga

SEQ ID NO: 2091359 - RNA, 16 nt, Staphylococcus aureus subsp. aureus MW2
uacuacuuaauuaaua

SEQ ID NO: 2091360 - RNA, 14 nt, Staphylococcus aureus subsp. aureus MW2
uacucuaacuuacc

SEQ ID NO: 2091361 - RNA, 15 nt, Staphylococcus aureus subsp. aureus MW2
uacuaguaauaauag

SEQ ID NO: 2091362 - RNA, 14 nt, Staphylococcus aureus subsp. aureus MW2
uacucuagcggaac

SEQ ID NO: 2091363 - RNA, 19 nt, Staphylococcus aureus subsp. aureus MW2
uacucuauagucaucuguu

SEQ ID NO: 2091364 - RNA, 17 nt, Staphylococcus aureus subsp. aureus MW2
uacucuaauuacauaua

SEQ ID NO: 2091365 - RNA, 17 nt, Staphylococcus aureus subsp. aureus MW2
uacucuggucugugaua

SEQ ID NO: 2091366 - RNA, 23 nt, Staphylococcus aureus subsp. aureus MW2
uacugcaccgauaucauauaaug

SEQ ID NO: 2091367 - RNA, 22 nt, Staphylococcus aureus subsp. aureus MW2
uacugcccaauguguuuaacuu

SEQ ID NO: 2091368 - RNA, 19 nt, Staphylococcus aureus subsp. aureus MW2
uacucuuuuuaauauuuuu

SEQ ID NO: 2091369 - RNA, 13 nt, Staphylococcus aureus subsp. aureus MW2
uacuacauuauua

SEQ ID NO: 2091370 - RNA, 16 nt, Staphylococcus aureus subsp. aureus MW2
uacuacucauuauuaa

SEQ ID NO: 2091371 - RNA, 15 nt, Staphylococcus aureus subsp. aureus MW2
uacuaaucaauacua

SEQ ID NO: 2091372 - RNA, 13 nt, Staphylococcus aureus subsp. aureus MW2
uacuaauaucuuc

SEQ ID NO: 2091373 - RNA, 20 nt, Staphylococcus aureus subsp. aureus MW2
uacuaaaaucacuugguaaa

SEQ ID NO: 2091374 - RNA, 14 nt, Staphylococcus aureus subsp. aureus MW2
uacuaaaauggauu

SEQ ID NO: 2091375 - RNA, 22 nt, Staphylococcus aureus subsp. aureus MW2
uacguaugcccucauaaaucau

SEQ ID NO: 2091376 - RNA, 16 nt, Staphylococcus aureus subsp. aureus MW2
uacgucauaaaauacc

SEQ ID NO: 2091377 - RNA, 19 nt, Staphylococcus aureus subsp. aureus MW2
uacuaaacgauaaauuaau

SEQ ID NO: 2091378 - RNA, 19 nt, Staphylococcus aureus subsp. aureus MW2
uacuaaauaaguaguucaa

SEQ ID NO: 2091379 - RNA, 13 nt, Staphylococcus aureus subsp. aureus MW2
uacuaaaugaauu

SEQ ID NO: 2091380 - RNA, 17 nt, Staphylococcus aureus subsp. aureus MW2
uacuaaaucaaauugac

SEQ ID NO: 2091381 - RNA, 14 nt, Staphylococcus aureus subsp. aureus MW2
uacuaaacuuuuuu

SEQ ID NO: 2091382 - RNA, 17 nt, Staphylococcus aureus subsp. aureus MW2
uacuaaccuauuaaaau

SEQ ID NO: 2091383 - RNA, 21 nt, Staphylococcus aureus subsp. aureus MW2
uacuaaccuauuaaaauaaac

SEQ ID NO: 2091384 - RNA, 18 nt, Staphylococcus aureus subsp. aureus MW2
uaccgucuucucuaucag

SEQ ID NO: 2091385 - RNA, 17 nt, Staphylococcus aureus subsp. aureus MW2
uacgcaaagaaaaacau

SEQ ID NO: 2091386 - RNA, 15 nt, Staphylococcus aureus subsp. aureus MW2
uacgcaaaaacuugu

SEQ ID NO: 2091387 - RNA, 13 nt, Staphylococcus aureus subsp. aureus MW2
uacgcaagguauu

SEQ ID NO: 2091388 - RNA, 20 nt, Staphylococcus aureus subsp. aureus MW2
uacgauaacuacacuuaaua

SEQ ID NO: 2091389 - RNA, 19 nt, Staphylococcus aureus subsp. aureus MW2
uacgaggucuuuaauuuau

SEQ ID NO: 2091390 - RNA, 18 nt, Staphylococcus aureus subsp. aureus MW2
uacgagacauuucuucaa

SEQ ID NO: 2091391 - RNA, 21 nt, Staphylococcus aureus subsp. aureus MW2
uacgcauuuuaaauaaaaugc

SEQ ID NO: 2091392 - RNA, 16 nt, Staphylococcus aureus subsp. aureus MW2
uacgccuucuuuauaa

SEQ ID NO: 2091393 - RNA, 19 nt, Staphylococcus aureus subsp. aureus MW2
uacgccuucuuuauaacuu

SEQ ID NO: 2091394 - RNA, 15 nt, Staphylococcus aureus subsp. aureus MW2
uacgccuaaauauuu

SEQ ID NO: 2091395 - RNA, 22 nt, Staphylococcus aureus subsp. aureus MW2
gucaucuucaauucuuacaccu

SEQ ID NO: 2091396 - RNA, 16 nt, Staphylococcus aureus subsp. aureus MW2
gucaucuguuaauuca

SEQ ID NO: 2091397 - RNA, 20 nt, Staphylococcus aureus subsp. aureus MW2
gucauguguucaaauaacgc

SEQ ID NO: 2091398 - RNA, 23 nt, Staphylococcus aureus subsp. aureus MW2
gucauuaacauaauaauaauaca

SEQ ID NO: 2091399 - RNA, 23 nt, Staphylococcus aureus subsp. aureus MW2
gucaugucuagauuucaaaucaa

SEQ ID NO: 2091400 - RNA, 17 nt, Staphylococcus aureus subsp. aureus MW2
gucauguguucaaauaa

SEQ ID NO: 2091401 - RNA, 18 nt, Staphylococcus aureus subsp. aureus MW2
gucauauuaauauuuuuu

SEQ ID NO: 2091402 - RNA, 20 nt, Staphylococcus aureus subsp. aureus MW2
gucaucauggucaacuuuuu

SEQ ID NO: 2091403 - RNA, 15 nt, Staphylococcus aureus subsp. aureus MW2
guccaaucaguuuca

SEQ ID NO: 2091404 - RNA, 13 nt, Staphylococcus aureus subsp. aureus MW2
guccacagaugca

SEQ ID NO: 2091405 - RNA, 18 nt, Staphylococcus aureus subsp. aureus MW2
guccacagaugcaucggu

SEQ ID NO: 2091406 - RNA, 20 nt, Staphylococcus aureus subsp. aureus MW2
guccauaaucuuuauuaaua

SEQ ID NO: 2091407 - RNA, 23 nt, Staphylococcus aureus subsp. aureus MW2
guccagcuaauaacgcugcaccu

SEQ ID NO: 2091408 - RNA, 20 nt, Staphylococcus aureus subsp. aureus MW2
gucaggggccccaacacaga

SEQ ID NO: 2091409 - RNA, 16 nt, Staphylococcus aureus subsp. aureus MW2
gucagcauacaauaau

SEQ ID NO: 2091410 - RNA, 22 nt, Staphylococcus aureus subsp. aureus MW2
gucaauuuuaccauguuuuaca

SEQ ID NO: 2091411 - RNA, 17 nt, Staphylococcus aureus subsp. aureus MW2
guccgcuuuuucauaga

SEQ ID NO: 2091412 - RNA, 19 nt, Staphylococcus aureus subsp. aureus MW2
gucccauaaggaaccuguc

SEQ ID NO: 2091413 - RNA, 22 nt, Staphylococcus aureus subsp. aureus MW2
gucgauaaauaugauguuaaaa

SEQ ID NO: 2091414 - RNA, 21 nt, Staphylococcus aureus subsp. aureus MW2
guccuuuuuauuuuauuuuuu

SEQ ID NO: 2091415 - RNA, 16 nt, Staphylococcus aureus subsp. aureus MW2
gucgaaaauagcuauu

SEQ ID NO: 2091416 - RNA, 22 nt, Staphylococcus aureus subsp. aureus MW2
gucgcacuauaaaauucaccaa

SEQ ID NO: 2091417 - RNA, 20 nt, Staphylococcus aureus subsp. aureus MW2
gucgauuucauuaauuuuuu

SEQ ID NO: 2091418 - RNA, 23 nt, Staphylococcus aureus subsp. aureus MW2
gucuguagaaauuggcuccccaa

SEQ ID NO: 2091419 - RNA, 17 nt, Staphylococcus aureus subsp. aureus MW2
gucugcuauuuuuuuaa

SEQ ID NO: 2091420 - RNA, 19 nt, Staphylococcus aureus subsp. aureus MW2
gucugaugucgaaaauagc

SEQ ID NO: 2091421 - RNA, 22 nt, Staphylococcus aureus subsp. aureus MW2
gucucagauucauaucuuucaa

SEQ ID NO: 2091422 - RNA, 15 nt, Staphylococcus aureus subsp. aureus MW2
gucguuuaaugggau

SEQ ID NO: 2091423 - RNA, 18 nt, Staphylococcus aureus subsp. aureus MW2
gucucuaaaacuuuuuca

SEQ ID NO: 2091424 - RNA, 22 nt, Staphylococcus aureus subsp. aureus MW2
gucuuaacaaauuaaaaaggua

SEQ ID NO: 2091425 - RNA, 12 nt, Staphylococcus aureus subsp. aureus MW2
gucuuaaacaua

SEQ ID NO: 2091426 - RNA, 16 nt, Staphylococcus aureus subsp. aureus MW2
gucuguauuauuauaa

SEQ ID NO: 2091427 - RNA, 20 nt, Staphylococcus aureus subsp. aureus MW2
gucuuguggcacauaaccga

SEQ ID NO: 2091428 - RNA, 12 nt, Staphylococcus aureus subsp. aureus MW2
gucuuuuuauuu

SEQ ID NO: 2091429 - RNA, 19 nt, Staphylococcus aureus subsp. aureus MW2
gucuuuuaauauuuucauu

SEQ ID NO: 2091430 - RNA, 18 nt, Staphylococcus aureus subsp. aureus MW2
gucuuuuuuuaugaaaag

SEQ ID NO: 2091431 - RNA, 11 nt, Staphylococcus aureus subsp. aureus MW2
gugaaaagugu

SEQ ID NO: 2091432 - RNA, 12 nt, Staphylococcus aureus subsp. aureus MW2
gugaaaaguguu

SEQ ID NO: 2091433 - RNA, 16 nt, Staphylococcus aureus subsp. aureus MW2
aaauagccauaucaua

SEQ ID NO: 2091434 - RNA, 12 nt, Staphylococcus aureus subsp. aureus MW2
aaauagcaacac

SEQ ID NO: 2091435 - RNA, 21 nt, Staphylococcus aureus subsp. aureus MW2
gugaaauuagaaaaauaugau

SEQ ID NO: 2091436 - RNA, 20 nt, Staphylococcus aureus subsp. aureus MW2
gugaaauucgaacuaucaau

SEQ ID NO: 2091437 - RNA, 19 nt, Staphylococcus aureus subsp. aureus MW2
gugaacaccccuucucuaa

SEQ ID NO: 2091438 - RNA, 22 nt, Staphylococcus aureus subsp. aureus MW2
gugaaauuagaaaaauaugauu

SEQ ID NO: 2091439 - RNA, 13 nt, Staphylococcus aureus subsp. aureus MW2
gugauucaucuau

SEQ ID NO: 2091440 - RNA, 16 nt, Staphylococcus aureus subsp. aureus MW2
gugcaaguuggggugg

SEQ ID NO: 2091441 - RNA, 21 nt, Staphylococcus aureus subsp. aureus MW2
gugauuucccacgugccucau

SEQ ID NO: 2091442 - RNA, 17 nt, Staphylococcus aureus subsp. aureus MW2
gugauuuaaaaaaauua

SEQ ID NO: 2091443 - RNA, 15 nt, Staphylococcus aureus subsp. aureus MW2
gugacucaaugaauu

SEQ ID NO: 2091444 - RNA, 20 nt, Staphylococcus aureus subsp. aureus MW2
gugagauacguuauuucaau

SEQ ID NO: 2091445 - RNA, 22 nt, Staphylococcus aureus subsp. aureus MW2
gugacuuuuauaauucuaaguc

SEQ ID NO: 2091446 - RNA, 17 nt, Staphylococcus aureus subsp. aureus MW2
gugacuuuuauaauucu

SEQ ID NO: 2091447 - RNA, 15 nt, Staphylococcus aureus subsp. aureus MW2
gugaggcccauaaau

SEQ ID NO: 2091448 - RNA, 14 nt, Staphylococcus aureus subsp. aureus MW2
gugagguaaaacua

SEQ ID NO: 2091449 - RNA, 18 nt, Staphylococcus aureus subsp. aureus MW2
gugagggacgucaucaug

SEQ ID NO: 2091450 - RNA, 19 nt, Staphylococcus aureus subsp. aureus MW2
gugagggccccaacacaga

SEQ ID NO: 2091451 - RNA, 22 nt, Staphylococcus aureus subsp. aureus MW2
gugauaauuaaaauaagauaua

SEQ ID NO: 2091452 - RNA, 14 nt, Staphylococcus aureus subsp. aureus MW2
aaauaguaagguuu

SEQ ID NO: 2091453 - RNA, 22 nt, Staphylococcus aureus subsp. aureus MW2
aaauaggguaauagaucuaucg

SEQ ID NO: 2091454 - RNA, 20 nt, Staphylococcus aureus subsp. aureus MW2
aaauaggucacuuuuaaucu

SEQ ID NO: 2091455 - RNA, 19 nt, Staphylococcus aureus subsp. aureus MW2
aaauaguucaaaauacuca

SEQ ID NO: 2091456 - RNA, 16 nt, Staphylococcus aureus subsp. aureus MW2
aaauagugaaauuaua

SEQ ID NO: 2091457 - RNA, 19 nt, Staphylococcus aureus subsp. aureus MW2
aaauaguucuuuaaauuau

SEQ ID NO: 2091458 - RNA, 20 nt, Staphylococcus aureus subsp. aureus MW2
aaauaguucaaauggacuaa

SEQ ID NO: 2091459 - RNA, 13 nt, Staphylococcus aureus subsp. aureus MW2
gugacauuuucaa

SEQ ID NO: 2091460 - RNA, 19 nt, Staphylococcus aureus subsp. aureus MW2
gugacgggguuuuaucaua

SEQ ID NO: 2091461 - RNA, 21 nt, Staphylococcus aureus subsp. aureus MW2
gugaauucgaugacuuuuuaa

SEQ ID NO: 2091462 - RNA, 22 nt, Staphylococcus aureus subsp. aureus MW2
gugaauguuuucuaaaucuaac

SEQ ID NO: 2091463 - RNA, 13 nt, Staphylococcus aureus subsp. aureus MW2
gugacaauuuaaa

SEQ ID NO: 2091464 - RNA, 17 nt, Staphylococcus aureus subsp. aureus MW2
gugaauuuucagcaucu

SEQ ID NO: 2091465 - RNA, 23 nt, Staphylococcus aureus subsp. aureus MW2
gugaaucuuauuuuguuuuaaaa

SEQ ID NO: 2091466 - RNA, 23 nt, Staphylococcus aureus subsp. aureus MW2
gugaauauaaguaaucauaauaa

SEQ ID NO: 2091467 - RNA, 22 nt, Staphylococcus aureus subsp. aureus MW2
gugaaguaaugugcauugcuuu

SEQ ID NO: 2091468 - RNA, 16 nt, Staphylococcus aureus subsp. aureus MW2
aaauagcuauuaaaau

SEQ ID NO: 2091469 - RNA, 15 nt, Staphylococcus aureus subsp. aureus MW2
aaauagcuauuaaaa

SEQ ID NO: 2091470 - RNA, 16 nt, Staphylococcus aureus subsp. aureus MW2
aaauagcgauuuuaaa

SEQ ID NO: 2091471 - RNA, 21 nt, Staphylococcus aureus subsp. aureus MW2
aaauagcgauuuuaaagaaaa

SEQ ID NO: 2091472 - RNA, 13 nt, Staphylococcus aureus subsp. aureus MW2
aaauagccuucaa

SEQ ID NO: 2091473 - RNA, 17 nt, Staphylococcus aureus subsp. aureus MW2
gugaagagaugaaagau

SEQ ID NO: 2091474 - RNA, 16 nt, Staphylococcus aureus subsp. aureus MW2
aaauauuuaaaauauu

SEQ ID NO: 2091475 - RNA, 15 nt, Staphylococcus aureus subsp. aureus MW2
aaauauuuaaacuag

SEQ ID NO: 2091476 - RNA, 21 nt, Staphylococcus aureus subsp. aureus MW2
aaauauugauucuagugaaau

SEQ ID NO: 2091477 - RNA, 16 nt, Staphylococcus aureus subsp. aureus MW2
aaauauuggaauacuc

SEQ ID NO: 2091478 - RNA, 19 nt, Staphylococcus aureus subsp. aureus MW2
aaauauugaagaugcuuua

SEQ ID NO: 2091479 - RNA, 22 nt, Staphylococcus aureus subsp. aureus MW2
aaauauuucuaaaccauuuuca

SEQ ID NO: 2091480 - RNA, 15 nt, Staphylococcus aureus subsp. aureus MW2
aaauauuuaucuuua

SEQ ID NO: 2091481 - RNA, 19 nt, Staphylococcus aureus subsp. aureus MW2
aaauauuuaaccuuuaaaa

SEQ ID NO: 2091482 - RNA, 20 nt, Staphylococcus aureus subsp. aureus MW2
aaauauuuaaccuuuaaaac

SEQ ID NO: 2091483 - RNA, 18 nt, Staphylococcus aureus subsp. aureus MW2
aaauauuuaaccuuuaaa

SEQ ID NO: 2091484 - RNA, 15 nt, Staphylococcus aureus subsp. aureus MW2
aaauauuuuuuaaaa

SEQ ID NO: 2091485 - RNA, 15 nt, Staphylococcus aureus subsp. aureus MW2
aaauauuuuaucugu

SEQ ID NO: 2091486 - RNA, 20 nt, Staphylococcus aureus subsp. aureus MW2
guuuccgcacaagcaucuau

SEQ ID NO: 2091487 - RNA, 17 nt, Staphylococcus aureus subsp. aureus MW2
aaaucaaaauaaugcaa

SEQ ID NO: 2091488 - RNA, 17 nt, Staphylococcus aureus subsp. aureus MW2
aaaucaaauacaucaau

SEQ ID NO: 2091489 - RNA, 20 nt, Staphylococcus aureus subsp. aureus MW2
aaaucaaaugguacaguuaa

SEQ ID NO: 2091490 - RNA, 14 nt, Staphylococcus aureus subsp. aureus MW2
aaaucaacaccaac

SEQ ID NO: 2091491 - RNA, 14 nt, Staphylococcus aureus subsp. aureus MW2
aaaucacgccauaa

SEQ ID NO: 2091492 - RNA, 20 nt, Staphylococcus aureus subsp. aureus MW2
aaaucaccuuuuuuaacuuu

SEQ ID NO: 2091493 - RNA, 18 nt, Staphylococcus aureus subsp. aureus MW2
aaaucaccuuuuuuaacu

SEQ ID NO: 2091494 - RNA, 14 nt, Staphylococcus aureus subsp. aureus MW2
guuucuccaguuuu

SEQ ID NO: 2091495 - RNA, 14 nt, Staphylococcus aureus subsp. aureus MW2
guuucuaaauucuu

SEQ ID NO: 2091496 - RNA, 22 nt, Staphylococcus aureus subsp. aureus MW2
aaaucacucaacugaugaaaag

SEQ ID NO: 2091497 - RNA, 15 nt, Staphylococcus aureus subsp. aureus MW2
aaaucaauccaucaa

SEQ ID NO: 2091498 - RNA, 12 nt, Staphylococcus aureus subsp. aureus MW2
aaaucaauccau

SEQ ID NO: 2091499 - RNA, 21 nt, Staphylococcus aureus subsp. aureus MW2
aaaucaauugaaaaagacaau

SEQ ID NO: 2091500 - RNA, 20 nt, Staphylococcus aureus subsp. aureus MW2
aaaucaacuuuaaucaaaaa

SEQ ID NO: 2091501 - RNA, 16 nt, Staphylococcus aureus subsp. aureus MW2
guuuguuucuaaauuc

SEQ ID NO: 2091502 - RNA, 17 nt, Staphylococcus aureus subsp. aureus MW2
guuuguuuauugagaau

SEQ ID NO: 2091503 - RNA, 13 nt, Staphylococcus aureus subsp. aureus MW2
guuugcuuuaaaa

SEQ ID NO: 2091504 - RNA, 19 nt, Staphylococcus aureus subsp. aureus MW2
guuuguauucacauagccu

SEQ ID NO: 2091505 - RNA, 16 nt, Staphylococcus aureus subsp. aureus MW2
guuugaucauaauuca

SEQ ID NO: 2091506 - RNA, 19 nt, Staphylococcus aureus subsp. aureus MW2
guuucugacuuuuaaaaaa

SEQ ID NO: 2091507 - RNA, 12 nt, Staphylococcus aureus subsp. aureus MW2
guuuugcuaacc

SEQ ID NO: 2091508 - RNA, 19 nt, Staphylococcus aureus subsp. aureus MW2
guuuugcaacauuuugagu

SEQ ID NO: 2091509 - RNA, 13 nt, Staphylococcus aureus subsp. aureus MW2
guuuuauuuuugg

SEQ ID NO: 2091510 - RNA, 22 nt, Staphylococcus aureus subsp. aureus MW2
guuuucacuguuuuaucuacag

SEQ ID NO: 2091511 - RNA, 21 nt, Staphylococcus aureus subsp. aureus MW2
guuuucuuuauuuuaaacaug

SEQ ID NO: 2091512 - RNA, 15 nt, Staphylococcus aureus subsp. aureus MW2
aaauccacacauuaa

SEQ ID NO: 2091513 - RNA, 16 nt, Staphylococcus aureus subsp. aureus MW2
aaauccacacauuaag

SEQ ID NO: 2091514 - RNA, 14 nt, Staphylococcus aureus subsp. aureus MW2
aaaucauucuuuau

SEQ ID NO: 2091515 - RNA, 19 nt, Staphylococcus aureus subsp. aureus MW2
aaaucauucuuuauagaaa

SEQ ID NO: 2091516 - RNA, 16 nt, Staphylococcus aureus subsp. aureus MW2
aaauccaaaaucuuua

SEQ ID NO: 2091517 - RNA, 18 nt, Staphylococcus aureus subsp. aureus MW2
aaaucauucauuugcaaa

SEQ ID NO: 2091518 - RNA, 18 nt, Staphylococcus aureus subsp. aureus MW2
aaaucauuaguuguauca

SEQ ID NO: 2091519 - RNA, 14 nt, Staphylococcus aureus subsp. aureus MW2
aaaucauaaauaac

SEQ ID NO: 2091520 - RNA, 21 nt, Staphylococcus aureus subsp. aureus MW2
aaaucauagucgguuauuaca

SEQ ID NO: 2091521 - RNA, 15 nt, Staphylococcus aureus subsp. aureus MW2
guuuuauagcauuuc

SEQ ID NO: 2091522 - RNA, 19 nt, Staphylococcus aureus subsp. aureus MW2
aaauauggaauuucauaua

SEQ ID NO: 2091523 - RNA, 15 nt, Staphylococcus aureus subsp. aureus MW2
aaauaugauuuaaaa

SEQ ID NO: 2091524 - RNA, 23 nt, Staphylococcus aureus subsp. aureus MW2
aaauauguauguuuuaucaauau

SEQ ID NO: 2091525 - RNA, 11 nt, Staphylococcus aureus subsp. aureus MW2
aaauauuauuu

SEQ ID NO: 2091526 - RNA, 21 nt, Staphylococcus aureus subsp. aureus MW2
aaauaugcuuuaggugaguua

SEQ ID NO: 2091527 - RNA, 16 nt, Staphylococcus aureus subsp. aureus MW2
aaauauuaauuuauaa

SEQ ID NO: 2091528 - RNA, 17 nt, Staphylococcus aureus subsp. aureus MW2
aaauauuauaaaaagau

SEQ ID NO: 2091529 - RNA, 19 nt, Staphylococcus aureus subsp. aureus MW2
aaauauuauaaaaagauau

SEQ ID NO: 2091530 - RNA, 21 nt, Staphylococcus aureus subsp. aureus MW2
guuucauacacuuuaacauaa

SEQ ID NO: 2091531 - RNA, 16 nt, Staphylococcus aureus subsp. aureus MW2
guuucauaaucucuuu

SEQ ID NO: 2091532 - RNA, 14 nt, Staphylococcus aureus subsp. aureus MW2
aaauauucuuaucu

SEQ ID NO: 2091533 - RNA, 17 nt, Staphylococcus aureus subsp. aureus MW2
guuucagaacugccaau

SEQ ID NO: 2091534 - RNA, 14 nt, Staphylococcus aureus subsp. aureus MW2
aaauaugaaaagag

SEQ ID NO: 2091535 - RNA, 13 nt, Staphylococcus aureus subsp. aureus MW2
aaauaugauuuaa

SEQ ID NO: 2091536 - RNA, 16 nt, Staphylococcus aureus subsp. aureus MW2
aaauaugcacuuuuua

SEQ ID NO: 2091537 - RNA, 16 nt, Staphylococcus aureus subsp. aureus MW2
aaauaucuuuuucuaa

SEQ ID NO: 2091538 - RNA, 23 nt, Staphylococcus aureus subsp. aureus MW2
guuucaacauuucagcauuugcu

SEQ ID NO: 2091539 - RNA, 13 nt, Staphylococcus aureus subsp. aureus MW2
guuucaaauuuug

SEQ ID NO: 2091540 - RNA, 13 nt, Staphylococcus aureus subsp. aureus MW2
guuuaucagcuuu

SEQ ID NO: 2091541 - RNA, 17 nt, Staphylococcus aureus subsp. aureus MW2
guuuauauugcaaaaau

SEQ ID NO: 2091542 - RNA, 15 nt, Staphylococcus aureus subsp. aureus MW2
guuuacugucaucuu

SEQ ID NO: 2091543 - RNA, 23 nt, Staphylococcus aureus subsp. aureus MW2
guuuagaaaaguaaguaaaauaa

SEQ ID NO: 2091544 - RNA, 22 nt, Staphylococcus aureus subsp. aureus MW2
guuuaucgaucgguauuuucau

SEQ ID NO: 2091545 - RNA, 15 nt, Staphylococcus aureus subsp. aureus MW2
guuuauccuuuaaau

SEQ ID NO: 2091546 - RNA, 18 nt, Staphylococcus aureus subsp. aureus MW2
guuuauccuuuaaaucau

SEQ ID NO: 2091547 - RNA, 22 nt, Staphylococcus aureus subsp. aureus MW2
guuuauccauauaugaugauuu

SEQ ID NO: 2091548 - RNA, 12 nt, Staphylococcus aureus subsp. aureus MW2
guuuaucuuuuu

SEQ ID NO: 2091549 - RNA, 17 nt, Staphylococcus aureus subsp. aureus MW2
guuuaagauuuuaucuu

SEQ ID NO: 2091550 - RNA, 16 nt, Staphylococcus aureus subsp. aureus MW2
guuuaauaaugguucu

SEQ ID NO: 2091551 - RNA, 19 nt, Staphylococcus aureus subsp. aureus MW2
guuuaaauucauuuuaagu

SEQ ID NO: 2091552 - RNA, 21 nt, Staphylococcus aureus subsp. aureus MW2
guuguauucugaaacuuuaau

SEQ ID NO: 2091553 - RNA, 17 nt, Staphylococcus aureus subsp. aureus MW2
guuuaaucgcauuguua

SEQ ID NO: 2091554 - RNA, 16 nt, Staphylococcus aureus subsp. aureus MW2
guuuaauauaauccac

SEQ ID NO: 2091555 - RNA, 15 nt, Staphylococcus aureus subsp. aureus MW2
guuuaaguuuuucag

SEQ ID NO: 2091556 - RNA, 18 nt, Staphylococcus aureus subsp. aureus MW2
guuuaaugggauuucuac

SEQ ID NO: 2091557 - RNA, 13 nt, Staphylococcus aureus subsp. aureus MW2
guuuacucuuacu

SEQ ID NO: 2091558 - RNA, 19 nt, Staphylococcus aureus subsp. aureus MW2
guuuacggauuuuucucau

SEQ ID NO: 2091559 - RNA, 15 nt, Staphylococcus aureus subsp. aureus MW2
guugcgcucuuuucu

SEQ ID NO: 2091560 - RNA, 17 nt, Staphylococcus aureus subsp. aureus MW2
guugguauuaauuuuuc

SEQ ID NO: 2091561 - RNA, 22 nt, Staphylococcus aureus subsp. aureus MW2
guuggugaguguuucauaaucu

SEQ ID NO: 2091562 - RNA, 15 nt, Staphylococcus aureus subsp. aureus MW2
guugguugugauuug

SEQ ID NO: 2091563 - RNA, 15 nt, Staphylococcus aureus subsp. aureus MW2
guucuauauaauuua

SEQ ID NO: 2091564 - RNA, 22 nt, Staphylococcus aureus subsp. aureus MW2
guucucauuauaaugauuuuua

SEQ ID NO: 2091565 - RNA, 14 nt, Staphylococcus aureus subsp. aureus MW2
guucuccgaucaug

SEQ ID NO: 2091566 - RNA, 19 nt, Staphylococcus aureus subsp. aureus MW2
guugcaauugaagugaaau

SEQ ID NO: 2091567 - RNA, 21 nt, Staphylococcus aureus subsp. aureus MW2
guugcaauugaagugaaauug

SEQ ID NO: 2091568 - RNA, 21 nt, Staphylococcus aureus subsp. aureus MW2
guugcgaauaccguuucuauu

SEQ ID NO: 2091569 - RNA, 15 nt, Staphylococcus aureus subsp. aureus MW2
guuaauuuaauaauu

SEQ ID NO: 2091570 - RNA, 23 nt, Staphylococcus aureus subsp. aureus MW2
guuaauuuaauaauuaaauauaa

SEQ ID NO: 2091571 - RNA, 20 nt, Staphylococcus aureus subsp. aureus MW2
guuaccaucuuuaauacgaa

SEQ ID NO: 2091572 - RNA, 13 nt, Staphylococcus aureus subsp. aureus MW2
guuaauuaaacaa

SEQ ID NO: 2091573 - RNA, 16 nt, Staphylococcus aureus subsp. aureus MW2
guuaauuaaacaaguu

SEQ ID NO: 2091574 - RNA, 14 nt, Staphylococcus aureus subsp. aureus MW2
guuaacucuaucua

SEQ ID NO: 2091575 - RNA, 18 nt, Staphylococcus aureus subsp. aureus MW2
guuaagauaccuuuuucu

SEQ ID NO: 2091576 - RNA, 16 nt, Staphylococcus aureus subsp. aureus MW2
guuaaaauauaugaau

SEQ ID NO: 2091577 - RNA, 23 nt, Staphylococcus aureus subsp. aureus MW2
guuaaaacacccugcuuaucauu

SEQ ID NO: 2091578 - RNA, 22 nt, Staphylococcus aureus subsp. aureus MW2
guuaaaaaauauguauguuuua

SEQ ID NO: 2091579 - RNA, 15 nt, Staphylococcus aureus subsp. aureus MW2
guuaaaaaauuaaaa

SEQ ID NO: 2091580 - RNA, 23 nt, Staphylococcus aureus subsp. aureus MW2
guguugaaaaguaauuaaauacu

SEQ ID NO: 2091581 - RNA, 23 nt, Staphylococcus aureus subsp. aureus MW2
guuauguacacgagucauuaaau

SEQ ID NO: 2091582 - RNA, 14 nt, Staphylococcus aureus subsp. aureus MW2
guuauguaugaaag

SEQ ID NO: 2091583 - RNA, 13 nt, Staphylococcus aureus subsp. aureus MW2
guuaugguguguu

SEQ ID NO: 2091584 - RNA, 22 nt, Staphylococcus aureus subsp. aureus MW2
guuaucuugcuuauugauauaa

SEQ ID NO: 2091585 - RNA, 13 nt, Staphylococcus aureus subsp. aureus MW2
guuauaucuuuuu

SEQ ID NO: 2091586 - RNA, 21 nt, Staphylococcus aureus subsp. aureus MW2
guuaccuacuacauucuaugu

SEQ ID NO: 2091587 - RNA, 23 nt, Staphylococcus aureus subsp. aureus MW2
guuacuauacaugguacugcuuc

SEQ ID NO: 2091588 - RNA, 20 nt, Staphylococcus aureus subsp. aureus MW2
guuaccuuugccaacaccau

SEQ ID NO: 2091589 - RNA, 19 nt, Staphylococcus aureus subsp. aureus MW2
guuaggcgacuuaacuuaa

SEQ ID NO: 2091590 - RNA, 15 nt, Staphylococcus aureus subsp. aureus MW2
guuaggagagaugua

SEQ ID NO: 2091591 - RNA, 18 nt, Staphylococcus aureus subsp. aureus MW2
guuauuuauacagugaau

SEQ ID NO: 2091592 - RNA, 17 nt, Staphylococcus aureus subsp. aureus MW2
guuauugcuuauuuuug

SEQ ID NO: 2091593 - RNA, 17 nt, Staphylococcus aureus subsp. aureus MW2
guuauuguuccaaucuu

SEQ ID NO: 2091594 - RNA, 14 nt, Staphylococcus aureus subsp. aureus MW2
guucaucuaaaauu

SEQ ID NO: 2091595 - RNA, 17 nt, Staphylococcus aureus subsp. aureus MW2
guucaucuaaaauuaga

SEQ ID NO: 2091596 - RNA, 18 nt, Staphylococcus aureus subsp. aureus MW2
guuccaccgaacccuguu

SEQ ID NO: 2091597 - RNA, 19 nt, Staphylococcus aureus subsp. aureus MW2
guuccaccgaacccuguua

SEQ ID NO: 2091598 - RNA, 18 nt, Staphylococcus aureus subsp. aureus MW2
guuccaacaacuaagaua

SEQ ID NO: 2091599 - RNA, 18 nt, Staphylococcus aureus subsp. aureus MW2
guucuaaaauuaaccauu

SEQ ID NO: 2091600 - RNA, 12 nt, Staphylococcus aureus subsp. aureus MW2
guucuaaaauag

SEQ ID NO: 2091601 - RNA, 15 nt, Staphylococcus aureus subsp. aureus MW2
guucgggaauuuuuu

SEQ ID NO: 2091602 - RNA, 20 nt, Staphylococcus aureus subsp. aureus MW2
gugugcaggauaacguucac

SEQ ID NO: 2091603 - RNA, 16 nt, Staphylococcus aureus subsp. aureus MW2
gugugccggcuuuuuc

SEQ ID NO: 2091604 - RNA, 22 nt, Staphylococcus aureus subsp. aureus MW2
aaauauauugcacauaaaaaau

SEQ ID NO: 2091605 - RNA, 13 nt, Staphylococcus aureus subsp. aureus MW2
aaauauauuauaa

SEQ ID NO: 2091606 - RNA, 15 nt, Staphylococcus aureus subsp. aureus MW2
aaauauauuauaaaa

SEQ ID NO: 2091607 - RNA, 11 nt, Staphylococcus aureus subsp. aureus MW2
aaauauauuug

SEQ ID NO: 2091608 - RNA, 18 nt, Staphylococcus aureus subsp. aureus MW2
aaauaucaugcaaaacua

SEQ ID NO: 2091609 - RNA, 15 nt, Staphylococcus aureus subsp. aureus MW2
aaauaucaugcaaaa

SEQ ID NO: 2091610 - RNA, 15 nt, Staphylococcus aureus subsp. aureus MW2
aaauaucauaaaugc

SEQ ID NO: 2091611 - RNA, 21 nt, Staphylococcus aureus subsp. aureus MW2
aaauaucccggaauauuaaca

SEQ ID NO: 2091612 - RNA, 19 nt, Staphylococcus aureus subsp. aureus MW2
aaauaucgacaaauuaaaa

SEQ ID NO: 2091613 - RNA, 17 nt, Staphylococcus aureus subsp. aureus MW2
guguuauauuguauuuu

SEQ ID NO: 2091614 - RNA, 14 nt, Staphylococcus aureus subsp. aureus MW2
guguuaauucuucu

SEQ ID NO: 2091615 - RNA, 24 nt, Staphylococcus aureus subsp. aureus MW2
guguucaaauaacgcaaugucuug

SEQ ID NO: 2091616 - RNA, 18 nt, Staphylococcus aureus subsp. aureus MW2
guguucgggaauuuuuua

SEQ ID NO: 2091617 - RNA, 16 nt, Staphylococcus aureus subsp. aureus MW2
aaauauaaccuaaaaa

SEQ ID NO: 2091618 - RNA, 12 nt, Staphylococcus aureus subsp. aureus MW2
aaauauaaauuu

SEQ ID NO: 2091619 - RNA, 15 nt, Staphylococcus aureus subsp. aureus MW2
aaauauaaauaaaag

SEQ ID NO: 2091620 - RNA, 16 nt, Staphylococcus aureus subsp. aureus MW2
aaauauaaaauccuaa

SEQ ID NO: 2091621 - RNA, 19 nt, Staphylococcus aureus subsp. aureus MW2
aaauauaaaauccuaagca

SEQ ID NO: 2091622 - RNA, 19 nt, Staphylococcus aureus subsp. aureus MW2
aaauauaauagaaauaauc

SEQ ID NO: 2091623 - RNA, 16 nt, Staphylococcus aureus subsp. aureus MW2
aaauauaccaaccaaa

SEQ ID NO: 2091624 - RNA, 19 nt, Staphylococcus aureus subsp. aureus MW2
aaauauaccaaccaaaacc

SEQ ID NO: 2091625 - RNA, 18 nt, Staphylococcus aureus subsp. aureus MW2
aaauauacuucuauuaaa

SEQ ID NO: 2091626 - RNA, 20 nt, Staphylococcus aureus subsp. aureus MW2
aaauauaccaaccaaaacca

SEQ ID NO: 2091627 - RNA, 22 nt, Staphylococcus aureus subsp. aureus MW2
gugcuguucuguuccacaacaa

SEQ ID NO: 2091628 - RNA, 13 nt, Staphylococcus aureus subsp. aureus MW2
guggagauuuaac

SEQ ID NO: 2091629 - RNA, 21 nt, Staphylococcus aureus subsp. aureus MW2
guggcguaguuugaauuggga

SEQ ID NO: 2091630 - RNA, 21 nt, Staphylococcus aureus subsp. aureus MW2
ucagcauugggacauaaaauu

SEQ ID NO: 2091631 - RNA, 19 nt, Staphylococcus aureus subsp. aureus MW2
ucagcauuaaucguauuuu

SEQ ID NO: 2091632 - RNA, 17 nt, Staphylococcus aureus subsp. aureus MW2
ucagcauacaauaaugu

SEQ ID NO: 2091633 - RNA, 20 nt, Staphylococcus aureus subsp. aureus MW2
ucagcaccgacaauuauaau

SEQ ID NO: 2091634 - RNA, 17 nt, Staphylococcus aureus subsp. aureus MW2
aaaucuauacuuuaucu

SEQ ID NO: 2091635 - RNA, 15 nt, Staphylococcus aureus subsp. aureus MW2
aaaucuauauaaagu

SEQ ID NO: 2091636 - RNA, 23 nt, Staphylococcus aureus subsp. aureus MW2
aaaucuauauaacgcuuuaaauc

SEQ ID NO: 2091637 - RNA, 16 nt, Staphylococcus aureus subsp. aureus MW2
aaaucucauaauaauu

SEQ ID NO: 2091638 - RNA, 22 nt, Staphylococcus aureus subsp. aureus MW2
aaaucucauaauaauucaguaa

SEQ ID NO: 2091639 - RNA, 18 nt, Staphylococcus aureus subsp. aureus MW2
ucaggcuuaauuaauaaa

SEQ ID NO: 2091640 - RNA, 17 nt, Staphylococcus aureus subsp. aureus MW2
ucaggcugggacauaaa

SEQ ID NO: 2091641 - RNA, 23 nt, Staphylococcus aureus subsp. aureus MW2
ucaguacgguuauuuaauaaugc

SEQ ID NO: 2091642 - RNA, 14 nt, Staphylococcus aureus subsp. aureus MW2
ucagucuucauguu

SEQ ID NO: 2091643 - RNA, 14 nt, Staphylococcus aureus subsp. aureus MW2
ucagugaagcuaga

SEQ ID NO: 2091644 - RNA, 18 nt, Staphylococcus aureus subsp. aureus MW2
aaaucuacaauauuaaaa

SEQ ID NO: 2091645 - RNA, 22 nt, Staphylococcus aureus subsp. aureus MW2
aaaucuacaauauuaaaauuaa

SEQ ID NO: 2091646 - RNA, 12 nt, Staphylococcus aureus subsp. aureus MW2
aaaucuacaauu

SEQ ID NO: 2091647 - RNA, 16 nt, Staphylococcus aureus subsp. aureus MW2
aaaucuaauuauucau

SEQ ID NO: 2091648 - RNA, 20 nt, Staphylococcus aureus subsp. aureus MW2
aaaucuaaaucuauacuuua

SEQ ID NO: 2091649 - RNA, 18 nt, Staphylococcus aureus subsp. aureus MW2
aaaucgugcccauaugau

SEQ ID NO: 2091650 - RNA, 15 nt, Staphylococcus aureus subsp. aureus MW2
aaaucguuauaagua

SEQ ID NO: 2091651 - RNA, 21 nt, Staphylococcus aureus subsp. aureus MW2
ucagaugauuuaauucugguu

SEQ ID NO: 2091652 - RNA, 17 nt, Staphylococcus aureus subsp. aureus MW2
ucagaugaauaauguuu

SEQ ID NO: 2091653 - RNA, 20 nt, Staphylococcus aureus subsp. aureus MW2
ucagaaguuguuuagaaaag

SEQ ID NO: 2091654 - RNA, 14 nt, Staphylococcus aureus subsp. aureus MW2
ucagaaauuuaaua

SEQ ID NO: 2091655 - RNA, 20 nt, Staphylococcus aureus subsp. aureus MW2
ucacugcaaacacaguacaa

SEQ ID NO: 2091656 - RNA, 16 nt, Staphylococcus aureus subsp. aureus MW2
ucacuguagauucaaa

SEQ ID NO: 2091657 - RNA, 11 nt, Staphylococcus aureus subsp. aureus MW2
ucacuucaacg

SEQ ID NO: 2091658 - RNA, 13 nt, Staphylococcus aureus subsp. aureus MW2
ucacgccauaauc

SEQ ID NO: 2091659 - RNA, 17 nt, Staphylococcus aureus subsp. aureus MW2
ucacuaaaaauauauuu

SEQ ID NO: 2091660 - RNA, 16 nt, Staphylococcus aureus subsp. aureus MW2
ucacguuuuucuuuaa

SEQ ID NO: 2091661 - RNA, 19 nt, Staphylococcus aureus subsp. aureus MW2
ucacuaggauguucaucaa

SEQ ID NO: 2091662 - RNA, 18 nt, Staphylococcus aureus subsp. aureus MW2
ucacuagauaguuuauac

SEQ ID NO: 2091663 - RNA, 17 nt, Staphylococcus aureus subsp. aureus MW2
ucacuaguguauacaag

SEQ ID NO: 2091664 - RNA, 13 nt, Staphylococcus aureus subsp. aureus MW2
ucacuaucagcuu

SEQ ID NO: 2091665 - RNA, 16 nt, Staphylococcus aureus subsp. aureus MW2
ucacgugguuucuuua

SEQ ID NO: 2091666 - RNA, 13 nt, Staphylococcus aureus subsp. aureus MW2
ucaaagcaucuaa

SEQ ID NO: 2091667 - RNA, 16 nt, Staphylococcus aureus subsp. aureus MW2
ucaaagcaucuaaucc

SEQ ID NO: 2091668 - RNA, 14 nt, Staphylococcus aureus subsp. aureus MW2
ucaaauauuaauuu

SEQ ID NO: 2091669 - RNA, 19 nt, Staphylococcus aureus subsp. aureus MW2
ucaaaucaauaucauucau

SEQ ID NO: 2091670 - RNA, 17 nt, Staphylococcus aureus subsp. aureus MW2
ucaaaucauaaguuaaa

SEQ ID NO: 2091671 - RNA, 21 nt, Staphylococcus aureus subsp. aureus MW2
ucaaauagacaccaaaaacag

SEQ ID NO: 2091672 - RNA, 14 nt, Staphylococcus aureus subsp. aureus MW2
ucaaagcugucaac

SEQ ID NO: 2091673 - RNA, 17 nt, Staphylococcus aureus subsp. aureus MW2
ucaaauagcccuuuaua

SEQ ID NO: 2091674 - RNA, 20 nt, Staphylococcus aureus subsp. aureus MW2
ucaaauagcccuuuauacaa

SEQ ID NO: 2091675 - RNA, 15 nt, Staphylococcus aureus subsp. aureus MW2
ucaaauuaaaucacc

SEQ ID NO: 2091676 - RNA, 18 nt, Staphylococcus aureus subsp. aureus MW2
ucaaauuagauaaaacaa

SEQ ID NO: 2091677 - RNA, 19 nt, Staphylococcus aureus subsp. aureus MW2
ucaaauucaaauuauaauu

SEQ ID NO: 2091678 - RNA, 22 nt, Staphylococcus aureus subsp. aureus MW2
ucaaauguugaauguggaacau

SEQ ID NO: 2091679 - RNA, 21 nt, Staphylococcus aureus subsp. aureus MW2
ucaaaugcuuaauaaaaucaa

SEQ ID NO: 2091680 - RNA, 23 nt, Staphylococcus aureus subsp. aureus MW2
ucaaauugguuuucaugugucau

SEQ ID NO: 2091681 - RNA, 14 nt, Staphylococcus aureus subsp. aureus MW2
ucaaauugguuuuc

SEQ ID NO: 2091682 - RNA, 14 nt, Staphylococcus aureus subsp. aureus MW2
ucaaacauauucau

SEQ ID NO: 2091683 - RNA, 13 nt, Staphylococcus aureus subsp. aureus MW2
ucaaaauuuugac

SEQ ID NO: 2091684 - RNA, 12 nt, Staphylococcus aureus subsp. aureus MW2
ucaaaauuuaau

SEQ ID NO: 2091685 - RNA, 13 nt, Staphylococcus aureus subsp. aureus MW2
ucaaaauuuaauu

SEQ ID NO: 2091686 - RNA, 22 nt, Staphylococcus aureus subsp. aureus MW2
ucaaaauuuaauugcuguaaau

SEQ ID NO: 2091687 - RNA, 21 nt, Staphylococcus aureus subsp. aureus MW2
ucaaaauuucgauuuucacca

SEQ ID NO: 2091688 - RNA, 21 nt, Staphylococcus aureus subsp. aureus MW2
ucaaaauuuugacuauucuca

SEQ ID NO: 2091689 - RNA, 21 nt, Staphylococcus aureus subsp. aureus MW2
ucaaacaacaucacuuuaggg

SEQ ID NO: 2091690 - RNA, 14 nt, Staphylococcus aureus subsp. aureus MW2
ucaaacagacuuaa

SEQ ID NO: 2091691 - RNA, 23 nt, Staphylococcus aureus subsp. aureus MW2
ucaaacaggcuuagcuaauucau

SEQ ID NO: 2091692 - RNA, 21 nt, Staphylococcus aureus subsp. aureus MW2
ucaaaauguuuaacaauaaua

SEQ ID NO: 2091693 - RNA, 20 nt, Staphylococcus aureus subsp. aureus MW2
ucaaaauguuuaacaauaau

SEQ ID NO: 2091694 - RNA, 23 nt, Staphylococcus aureus subsp. aureus MW2
ucaaaauucugacuaacauuggu

SEQ ID NO: 2091695 - RNA, 19 nt, Staphylococcus aureus subsp. aureus MW2
uauuuaauuuugauauuuu

SEQ ID NO: 2091696 - RNA, 18 nt, Staphylococcus aureus subsp. aureus MW2
uauuuaauuuuuuacuuu

SEQ ID NO: 2091697 - RNA, 16 nt, Staphylococcus aureus subsp. aureus MW2
ucaaaacguuuaauug

SEQ ID NO: 2091698 - RNA, 18 nt, Staphylococcus aureus subsp. aureus MW2
ucaaaacguuuaauugca

SEQ ID NO: 2091699 - RNA, 17 nt, Staphylococcus aureus subsp. aureus MW2
uauuuaauguuucaaau

SEQ ID NO: 2091700 - RNA, 14 nt, Staphylococcus aureus subsp. aureus MW2
ucaaccguuuuauu

SEQ ID NO: 2091701 - RNA, 14 nt, Staphylococcus aureus subsp. aureus MW2
ucaacgauugaauu

SEQ ID NO: 2091702 - RNA, 17 nt, Staphylococcus aureus subsp. aureus MW2
ucaacgccauauuuauu

SEQ ID NO: 2091703 - RNA, 10 nt, Staphylococcus aureus subsp. aureus MW2
ucaacuuuuc

SEQ ID NO: 2091704 - RNA, 14 nt, Staphylococcus aureus subsp. aureus MW2
ucaacuuucucuaa

SEQ ID NO: 2091705 - RNA, 22 nt, Staphylococcus aureus subsp. aureus MW2
ucaacuuuaguuguuaggggcu

SEQ ID NO: 2091706 - RNA, 14 nt, Staphylococcus aureus subsp. aureus MW2
ucaacuacugcuaa

SEQ ID NO: 2091707 - RNA, 19 nt, Staphylococcus aureus subsp. aureus MW2
ucaacuacugcuaaaauaa

SEQ ID NO: 2091708 - RNA, 15 nt, Staphylococcus aureus subsp. aureus MW2
ucaacuacugucaau

SEQ ID NO: 2091709 - RNA, 19 nt, Staphylococcus aureus subsp. aureus MW2
ucaacuaaucguguauuau

SEQ ID NO: 2091710 - RNA, 14 nt, Staphylococcus aureus subsp. aureus MW2
ucaacuaauaacuc

SEQ ID NO: 2091711 - RNA, 19 nt, Staphylococcus aureus subsp. aureus MW2
ucaacauaacucaaauauc

SEQ ID NO: 2091712 - RNA, 21 nt, Staphylococcus aureus subsp. aureus MW2
ucaacaguaauuuuuaaacaa

SEQ ID NO: 2091713 - RNA, 22 nt, Staphylococcus aureus subsp. aureus MW2
ucaacaguaauuuuuaaacaaa

SEQ ID NO: 2091714 - RNA, 21 nt, Staphylococcus aureus subsp. aureus MW2
ucaacaucaucuuuaauuuuc

SEQ ID NO: 2091715 - RNA, 20 nt, Staphylococcus aureus subsp. aureus MW2
ucaacaucguauucuuuuaa

SEQ ID NO: 2091716 - RNA, 19 nt, Staphylococcus aureus subsp. aureus MW2
ucaacaucaucuuuaauuu

SEQ ID NO: 2091717 - RNA, 15 nt, Staphylococcus aureus subsp. aureus MW2
ucaacauaacaaagu

SEQ ID NO: 2091718 - RNA, 19 nt, Staphylococcus aureus subsp. aureus MW2
ucaacauaacaaagucgaa

SEQ ID NO: 2091719 - RNA, 20 nt, Staphylococcus aureus subsp. aureus MW2
ucaacauaacucaaauaucu

SEQ ID NO: 2091720 - RNA, 22 nt, Staphylococcus aureus subsp. aureus MW2
ucaacauguuccgcuacaaaac

SEQ ID NO: 2091721 - RNA, 16 nt, Staphylococcus aureus subsp. aureus MW2
ucaacauuaauaaaua

SEQ ID NO: 2091722 - RNA, 15 nt, Staphylococcus aureus subsp. aureus MW2
ucaacauuaaaaugu

SEQ ID NO: 2091723 - RNA, 20 nt, Staphylococcus aureus subsp. aureus MW2
ucaaccauuuguucugcaga

SEQ ID NO: 2091724 - RNA, 23 nt, Staphylococcus aureus subsp. aureus MW2
ucaacaccaacaccuaauauuuu

SEQ ID NO: 2091725 - RNA, 15 nt, Staphylococcus aureus subsp. aureus MW2
ucaacacuuucuacu

SEQ ID NO: 2091726 - RNA, 18 nt, Staphylococcus aureus subsp. aureus MW2
ucaacaacaaguucuuga

SEQ ID NO: 2091727 - RNA, 13 nt, Staphylococcus aureus subsp. aureus MW2
ucaacaaauuuaa

SEQ ID NO: 2091728 - RNA, 18 nt, Staphylococcus aureus subsp. aureus MW2
ucaacaaaucuauaaaua

SEQ ID NO: 2091729 - RNA, 22 nt, Staphylococcus aureus subsp. aureus MW2
ucaacaaaucuauaaauaucaa

SEQ ID NO: 2091730 - RNA, 14 nt, Staphylococcus aureus subsp. aureus MW2
ucaacaauauaaaa

SEQ ID NO: 2091731 - RNA, 16 nt, Staphylococcus aureus subsp. aureus MW2
ucaacaauauaaaagc

SEQ ID NO: 2091732 - RNA, 15 nt, Staphylococcus aureus subsp. aureus MW2
ucacagcaauaauaa

SEQ ID NO: 2091733 - RNA, 22 nt, Staphylococcus aureus subsp. aureus MW2
ucacaaaauuaggcauucaucu

SEQ ID NO: 2091734 - RNA, 18 nt, Staphylococcus aureus subsp. aureus MW2
ucacaaacaagaauaaau

SEQ ID NO: 2091735 - RNA, 23 nt, Staphylococcus aureus subsp. aureus MW2
aaaucgaauugguaaaaaucuca

SEQ ID NO: 2091736 - RNA, 15 nt, Staphylococcus aureus subsp. aureus MW2
aaaucgauaacaguu

SEQ ID NO: 2091737 - RNA, 16 nt, Staphylococcus aureus subsp. aureus MW2
ucacauacauuuugaa

SEQ ID NO: 2091738 - RNA, 16 nt, Staphylococcus aureus subsp. aureus MW2
ucacauagccucuuaa

SEQ ID NO: 2091739 - RNA, 22 nt, Staphylococcus aureus subsp. aureus MW2
ucacauagccucuuaaaauacc

SEQ ID NO: 2091740 - RNA, 15 nt, Staphylococcus aureus subsp. aureus MW2
aaaucggauuaacau

SEQ ID NO: 2091741 - RNA, 16 nt, Staphylococcus aureus subsp. aureus MW2
aaaucggauuaacauu

SEQ ID NO: 2091742 - RNA, 15 nt, Staphylococcus aureus subsp. aureus MW2
aaaucggaauaaaau

SEQ ID NO: 2091743 - RNA, 15 nt, Staphylococcus aureus subsp. aureus MW2
aaaucggacagcuga

SEQ ID NO: 2091744 - RNA, 14 nt, Staphylococcus aureus subsp. aureus MW2
ucaccauaaaaaua

SEQ ID NO: 2091745 - RNA, 19 nt, Staphylococcus aureus subsp. aureus MW2
ucaccauacuaaaacauga

SEQ ID NO: 2091746 - RNA, 16 nt, Staphylococcus aureus subsp. aureus MW2
ucaccagcucguuuuu

SEQ ID NO: 2091747 - RNA, 23 nt, Staphylococcus aureus subsp. aureus MW2
ucacaucuuuagcuauuuaaaau

SEQ ID NO: 2091748 - RNA, 18 nt, Staphylococcus aureus subsp. aureus MW2
ucacaugaauuuuaauau

SEQ ID NO: 2091749 - RNA, 15 nt, Staphylococcus aureus subsp. aureus MW2
ucacaugugaaauaa

SEQ ID NO: 2091750 - RNA, 18 nt, Staphylococcus aureus subsp. aureus MW2
ucacauguaccacauuuu

SEQ ID NO: 2091751 - RNA, 18 nt, Staphylococcus aureus subsp. aureus MW2
ucacauaugacuuuauuu

SEQ ID NO: 2091752 - RNA, 13 nt, Staphylococcus aureus subsp. aureus MW2
ucacaucagugug

SEQ ID NO: 2091753 - RNA, 23 nt, Staphylococcus aureus subsp. aureus MW2
ucacaucacguugugcaauaccu

SEQ ID NO: 2091754 - RNA, 23 nt, Staphylococcus aureus subsp. aureus MW2
ucaaugacugagaaaaauauuuc

SEQ ID NO: 2091755 - RNA, 17 nt, Staphylococcus aureus subsp. aureus MW2
ucaaugacuuaacaucu

SEQ ID NO: 2091756 - RNA, 18 nt, Staphylococcus aureus subsp. aureus MW2
ucaaugacugagaaaaau

SEQ ID NO: 2091757 - RNA, 12 nt, Staphylococcus aureus subsp. aureus MW2
ucaaugacuaag

SEQ ID NO: 2091758 - RNA, 22 nt, Staphylococcus aureus subsp. aureus MW2
ucaaugagcaagucuucuaaaa

SEQ ID NO: 2091759 - RNA, 12 nt, Staphylococcus aureus subsp. aureus MW2
ucaaugauuuuu

SEQ ID NO: 2091760 - RNA, 16 nt, Staphylococcus aureus subsp. aureus MW2
ucaaugauuuuuaaaa

SEQ ID NO: 2091761 - RNA, 21 nt, Staphylococcus aureus subsp. aureus MW2
ucaaucacuauauuucacaca

SEQ ID NO: 2091762 - RNA, 16 nt, Staphylococcus aureus subsp. aureus MW2
ucaauccaauuaaaua

SEQ ID NO: 2091763 - RNA, 15 nt, Staphylococcus aureus subsp. aureus MW2
ucaaugaauucauuu

SEQ ID NO: 2091764 - RNA, 14 nt, Staphylococcus aureus subsp. aureus MW2
ucaaugaauuuacu

SEQ ID NO: 2091765 - RNA, 17 nt, Staphylococcus aureus subsp. aureus MW2
ucaaucaucaagacauu

SEQ ID NO: 2091766 - RNA, 14 nt, Staphylococcus aureus subsp. aureus MW2
ucaauguaauuuuc

SEQ ID NO: 2091767 - RNA, 20 nt, Staphylococcus aureus subsp. aureus MW2
ucaaugugagauauaaagga

SEQ ID NO: 2091768 - RNA, 21 nt, Staphylococcus aureus subsp. aureus MW2
ucaaugugauuuucuuucaua

SEQ ID NO: 2091769 - RNA, 12 nt, Staphylococcus aureus subsp. aureus MW2
ucaauucucuaa

SEQ ID NO: 2091770 - RNA, 15 nt, Staphylococcus aureus subsp. aureus MW2
ucaauuauuucaucg

SEQ ID NO: 2091771 - RNA, 11 nt, Staphylococcus aureus subsp. aureus MW2
ucaauuuaaug

SEQ ID NO: 2091772 - RNA, 15 nt, Staphylococcus aureus subsp. aureus MW2
ucaauuguaaaucuu

SEQ ID NO: 2091773 - RNA, 19 nt, Staphylococcus aureus subsp. aureus MW2
ucaauugucguuuaauaau

SEQ ID NO: 2091774 - RNA, 22 nt, Staphylococcus aureus subsp. aureus MW2
ucaauuuaguauaaauaaaaau

SEQ ID NO: 2091775 - RNA, 23 nt, Staphylococcus aureus subsp. aureus MW2
ucaauuguugcaaaauacgauuu

SEQ ID NO: 2091776 - RNA, 16 nt, Staphylococcus aureus subsp. aureus MW2
ucaauuuaguucacaa

SEQ ID NO: 2091777 - RNA, 16 nt, Staphylococcus aureus subsp. aureus MW2
ucaauaagauuuugcu

SEQ ID NO: 2091778 - RNA, 19 nt, Staphylococcus aureus subsp. aureus MW2
ucaauaacaccuuucauuu

SEQ ID NO: 2091779 - RNA, 12 nt, Staphylococcus aureus subsp. aureus MW2
ucaauaaucuua

SEQ ID NO: 2091780 - RNA, 14 nt, Staphylococcus aureus subsp. aureus MW2
ucaauaauuucuug

SEQ ID NO: 2091781 - RNA, 22 nt, Staphylococcus aureus subsp. aureus MW2
ucaaguuuacgaucauaaauau

SEQ ID NO: 2091782 - RNA, 20 nt, Staphylococcus aureus subsp. aureus MW2
ucaaguuggugugcaauuaa

SEQ ID NO: 2091783 - RNA, 18 nt, Staphylococcus aureus subsp. aureus MW2
ucaacuuuuuaauaauac

SEQ ID NO: 2091784 - RNA, 22 nt, Staphylococcus aureus subsp. aureus MW2
ucaacuuuuuuaacuuuaacaa

SEQ ID NO: 2091785 - RNA, 14 nt, Staphylococcus aureus subsp. aureus MW2
ucaacuuuuuuaac

SEQ ID NO: 2091786 - RNA, 15 nt, Staphylococcus aureus subsp. aureus MW2
ucaacuuuuuuaacu

SEQ ID NO: 2091787 - RNA, 12 nt, Staphylococcus aureus subsp. aureus MW2
ucaauaaaaaug

SEQ ID NO: 2091788 - RNA, 21 nt, Staphylococcus aureus subsp. aureus MW2
ucaaguuuuggucaaguaaau

SEQ ID NO: 2091789 - RNA, 22 nt, Staphylococcus aureus subsp. aureus MW2
ucaauaaaaauugaauuaugau

SEQ ID NO: 2091790 - RNA, 14 nt, Staphylococcus aureus subsp. aureus MW2
ucaauaaauuguuu

SEQ ID NO: 2091791 - RNA, 19 nt, Staphylococcus aureus subsp. aureus MW2
ucaauaaauaaacaacugc

SEQ ID NO: 2091792 - RNA, 13 nt, Staphylococcus aureus subsp. aureus MW2
ucaauaaauaaac

SEQ ID NO: 2091793 - RNA, 13 nt, Staphylococcus aureus subsp. aureus MW2
ucaauaaauauug

SEQ ID NO: 2091794 - RNA, 22 nt, Staphylococcus aureus subsp. aureus MW2
ucaauaggaauaccacuuaauc

SEQ ID NO: 2091795 - RNA, 21 nt, Staphylococcus aureus subsp. aureus MW2
ucaauaguaguauuaucuuuc

SEQ ID NO: 2091796 - RNA, 14 nt, Staphylococcus aureus subsp. aureus MW2
ucaauaucuucuaa

SEQ ID NO: 2091797 - RNA, 16 nt, Staphylococcus aureus subsp. aureus MW2
ucaauaucacuaucag

SEQ ID NO: 2091798 - RNA, 15 nt, Staphylococcus aureus subsp. aureus MW2
ucaauaguuuauaau

SEQ ID NO: 2091799 - RNA, 14 nt, Staphylococcus aureus subsp. aureus MW2
ucaauaguuucaau

SEQ ID NO: 2091800 - RNA, 20 nt, Staphylococcus aureus subsp. aureus MW2
ucaauaccauaauuaaauaa

SEQ ID NO: 2091801 - RNA, 15 nt, Staphylococcus aureus subsp. aureus MW2
ucaauacaaaacauu

SEQ ID NO: 2091802 - RNA, 17 nt, Staphylococcus aureus subsp. aureus MW2
ucaauacaaaacauuac

SEQ ID NO: 2091803 - RNA, 15 nt, Staphylococcus aureus subsp. aureus MW2
ucaauagaugaaaau

SEQ ID NO: 2091804 - RNA, 14 nt, Staphylococcus aureus subsp. aureus MW2
uauuaaauuucuga

SEQ ID NO: 2091805 - RNA, 17 nt, Staphylococcus aureus subsp. aureus MW2
uauuaacgaguuuucag

SEQ ID NO: 2091806 - RNA, 20 nt, Staphylococcus aureus subsp. aureus MW2
uauuaacgcuuauacuauau

SEQ ID NO: 2091807 - RNA, 16 nt, Staphylococcus aureus subsp. aureus MW2
uauuaagacugauuaa

SEQ ID NO: 2091808 - RNA, 17 nt, Staphylococcus aureus subsp. aureus MW2
uauuaagacugauuaau

SEQ ID NO: 2091809 - RNA, 22 nt, Staphylococcus aureus subsp. aureus MW2
uauuaaggggguaauacuauau

SEQ ID NO: 2091810 - RNA, 16 nt, Staphylococcus aureus subsp. aureus MW2
uauuaagugaguuuua

SEQ ID NO: 2091811 - RNA, 12 nt, Staphylococcus aureus subsp. aureus MW2
uauuaauauauu

SEQ ID NO: 2091812 - RNA, 22 nt, Staphylococcus aureus subsp. aureus MW2
uauuaauaucauuauuaccuuu

SEQ ID NO: 2091813 - RNA, 14 nt, Staphylococcus aureus subsp. aureus MW2
uauuaauauauaua

SEQ ID NO: 2091814 - RNA, 20 nt, Staphylococcus aureus subsp. aureus MW2
uauuaauccacaaauaacac

SEQ ID NO: 2091815 - RNA, 17 nt, Staphylococcus aureus subsp. aureus MW2
uauuacaaccaacaauu

SEQ ID NO: 2091816 - RNA, 12 nt, Staphylococcus aureus subsp. aureus MW2
uauuaauuucau

SEQ ID NO: 2091817 - RNA, 16 nt, Staphylococcus aureus subsp. aureus MW2
uauuaauuucauugua

SEQ ID NO: 2091818 - RNA, 16 nt, Staphylococcus aureus subsp. aureus MW2
uauuaauuuuacguuu

SEQ ID NO: 2091819 - RNA, 14 nt, Staphylococcus aureus subsp. aureus MW2
uauuaauuuucuca

SEQ ID NO: 2091820 - RNA, 16 nt, Staphylococcus aureus subsp. aureus MW2
uauuaauuuucucaaa

SEQ ID NO: 2091821 - RNA, 23 nt, Staphylococcus aureus subsp. aureus MW2
uauuaauuuucucaaacuaucuu

SEQ ID NO: 2091822 - RNA, 18 nt, Staphylococcus aureus subsp. aureus MW2
uauuaauuuuucaaaugu

SEQ ID NO: 2091823 - RNA, 23 nt, Staphylococcus aureus subsp. aureus MW2
uauuacaaaauuuccacuuugau

SEQ ID NO: 2091824 - RNA, 19 nt, Staphylococcus aureus subsp. aureus MW2
uauuaauuuauaauuucua

SEQ ID NO: 2091825 - RNA, 16 nt, Staphylococcus aureus subsp. aureus MW2
uauuaauuauuugaua

SEQ ID NO: 2091826 - RNA, 23 nt, Staphylococcus aureus subsp. aureus MW2
uauuauaaguugcauauaaaaac

SEQ ID NO: 2091827 - RNA, 15 nt, Staphylococcus aureus subsp. aureus MW2
uauuaucuaauucuu

SEQ ID NO: 2091828 - RNA, 15 nt, Staphylococcus aureus subsp. aureus MW2
uauuaucuauccauu

SEQ ID NO: 2091829 - RNA, 13 nt, Staphylococcus aureus subsp. aureus MW2
uauuauaaaaaga

SEQ ID NO: 2091830 - RNA, 16 nt, Staphylococcus aureus subsp. aureus MW2
uauuauaaaaagauau

SEQ ID NO: 2091831 - RNA, 19 nt, Staphylococcus aureus subsp. aureus MW2
uauuauaaaauaaauauaa

SEQ ID NO: 2091832 - RNA, 15 nt, Staphylococcus aureus subsp. aureus MW2
uauuauaaaauaaau

SEQ ID NO: 2091833 - RNA, 17 nt, Staphylococcus aureus subsp. aureus MW2
uauuaguuuuuacguuu

SEQ ID NO: 2091834 - RNA, 14 nt, Staphylococcus aureus subsp. aureus MW2
uauuaggucauguu

SEQ ID NO: 2091835 - RNA, 22 nt, Staphylococcus aureus subsp. aureus MW2
uauguuggacugguacuacuau

SEQ ID NO: 2091836 - RNA, 15 nt, Staphylococcus aureus subsp. aureus MW2
uauguuauaaauucu

SEQ ID NO: 2091837 - RNA, 17 nt, Staphylococcus aureus subsp. aureus MW2
uauguggcgcucuuaua

SEQ ID NO: 2091838 - RNA, 20 nt, Staphylococcus aureus subsp. aureus MW2
uaugugguuuugauuaaacu

SEQ ID NO: 2091839 - RNA, 14 nt, Staphylococcus aureus subsp. aureus MW2
uaugugucuuccaa

SEQ ID NO: 2091840 - RNA, 22 nt, Staphylococcus aureus subsp. aureus MW2
uauuaaacauugcuguaacccc

SEQ ID NO: 2091841 - RNA, 13 nt, Staphylococcus aureus subsp. aureus MW2
uauguuuuaucaa

SEQ ID NO: 2091842 - RNA, 15 nt, Staphylococcus aureus subsp. aureus MW2
uauguuuuauaauaa

SEQ ID NO: 2091843 - RNA, 16 nt, Staphylococcus aureus subsp. aureus MW2
uauguuguuucuaaug

SEQ ID NO: 2091844 - RNA, 19 nt, Staphylococcus aureus subsp. aureus MW2
uauguuguuuaaauuucaa

SEQ ID NO: 2091845 - RNA, 17 nt, Staphylococcus aureus subsp. aureus MW2
uauguuuaauguauaaa

SEQ ID NO: 2091846 - RNA, 16 nt, Staphylococcus aureus subsp. aureus MW2
uauguucuuuuuuaau

SEQ ID NO: 2091847 - RNA, 21 nt, Staphylococcus aureus subsp. aureus MW2
uaugugcaugagacuuauuca

SEQ ID NO: 2091848 - RNA, 21 nt, Staphylococcus aureus subsp. aureus MW2
uaugucucucuuucuuauuca

SEQ ID NO: 2091849 - RNA, 20 nt, Staphylococcus aureus subsp. aureus MW2
uaugucuuaacaacaugauu

SEQ ID NO: 2091850 - RNA, 15 nt, Staphylococcus aureus subsp. aureus MW2
uaugucuugcucuau

SEQ ID NO: 2091851 - RNA, 21 nt, Staphylococcus aureus subsp. aureus MW2
uaugucuagacuuauuugaau

SEQ ID NO: 2091852 - RNA, 20 nt, Staphylococcus aureus subsp. aureus MW2
uaugucuagacuuauuugaa

SEQ ID NO: 2091853 - RNA, 21 nt, Staphylococcus aureus subsp. aureus MW2
uauguaaauugguauaacaau

SEQ ID NO: 2091854 - RNA, 16 nt, Staphylococcus aureus subsp. aureus MW2
uaugguuguuuuccaa

SEQ ID NO: 2091855 - RNA, 12 nt, Staphylococcus aureus subsp. aureus MW2
uauguaaaaaau

SEQ ID NO: 2091856 - RNA, 21 nt, Staphylococcus aureus subsp. aureus MW2
uauguaaaaagugguuaauaa

SEQ ID NO: 2091857 - RNA, 15 nt, Staphylococcus aureus subsp. aureus MW2
uaugguuauggugug

SEQ ID NO: 2091858 - RNA, 19 nt, Staphylococcus aureus subsp. aureus MW2
uaugguuacccuuuuucaa

SEQ ID NO: 2091859 - RNA, 14 nt, Staphylococcus aureus subsp. aureus MW2
uaugguuagaaaaa

SEQ ID NO: 2091860 - RNA, 16 nt, Staphylococcus aureus subsp. aureus MW2
uaugguguggugugau

SEQ ID NO: 2091861 - RNA, 20 nt, Staphylococcus aureus subsp. aureus MW2
uaugucaaauugaacuuaua

SEQ ID NO: 2091862 - RNA, 14 nt, Staphylococcus aureus subsp. aureus MW2
uauguauaucuuua

SEQ ID NO: 2091863 - RNA, 21 nt, Staphylococcus aureus subsp. aureus MW2
uauguaccaaauuuauaauuu

SEQ ID NO: 2091864 - RNA, 14 nt, Staphylococcus aureus subsp. aureus MW2
uauguauaauacau

SEQ ID NO: 2091865 - RNA, 22 nt, Staphylococcus aureus subsp. aureus MW2
uauugguaucuccaauauuuua

SEQ ID NO: 2091866 - RNA, 17 nt, Staphylococcus aureus subsp. aureus MW2
uauuggaauacucuuua

SEQ ID NO: 2091867 - RNA, 13 nt, Staphylococcus aureus subsp. aureus MW2
uauuuaaaaaaca

SEQ ID NO: 2091868 - RNA, 14 nt, Staphylococcus aureus subsp. aureus MW2
uauuuaaaaauagc

SEQ ID NO: 2091869 - RNA, 15 nt, Staphylococcus aureus subsp. aureus MW2
uauuuaaaaauagcc

SEQ ID NO: 2091870 - RNA, 20 nt, Staphylococcus aureus subsp. aureus MW2
uauuuaacacuucaguuaaa

SEQ ID NO: 2091871 - RNA, 15 nt, Staphylococcus aureus subsp. aureus MW2
uauuguuuuauauuu

SEQ ID NO: 2091872 - RNA, 19 nt, Staphylococcus aureus subsp. aureus MW2
uauuguuuguuuuuauagu

SEQ ID NO: 2091873 - RNA, 20 nt, Staphylococcus aureus subsp. aureus MW2
uauuguuugaaaauuaacua

SEQ ID NO: 2091874 - RNA, 14 nt, Staphylococcus aureus subsp. aureus MW2
uauuguuuuuaaaa

SEQ ID NO: 2091875 - RNA, 23 nt, Staphylococcus aureus subsp. aureus MW2
uauuguuccagacuccuaaauua

SEQ ID NO: 2091876 - RNA, 14 nt, Staphylococcus aureus subsp. aureus MW2
uauuguuugaaaau

SEQ ID NO: 2091877 - RNA, 17 nt, Staphylococcus aureus subsp. aureus MW2
uauugcauuuagacuug

SEQ ID NO: 2091878 - RNA, 18 nt, Staphylococcus aureus subsp. aureus MW2
uauugcauguuuaaauau

SEQ ID NO: 2091879 - RNA, 21 nt, Staphylococcus aureus subsp. aureus MW2
uauugcaucauaauuuccuga

SEQ ID NO: 2091880 - RNA, 14 nt, Staphylococcus aureus subsp. aureus MW2
uauugcuuauuuuu

SEQ ID NO: 2091881 - RNA, 14 nt, Staphylococcus aureus subsp. aureus MW2
uauugcauuguaua

SEQ ID NO: 2091882 - RNA, 15 nt, Staphylococcus aureus subsp. aureus MW2
uauugcauuguauau

SEQ ID NO: 2091883 - RNA, 23 nt, Staphylococcus aureus subsp. aureus MW2
uauugcagcaacgcgauugcuaa

SEQ ID NO: 2091884 - RNA, 23 nt, Staphylococcus aureus subsp. aureus MW2
uauugauuugauucauuacaugu

SEQ ID NO: 2091885 - RNA, 18 nt, Staphylococcus aureus subsp. aureus MW2
uauucuuuuaauagaucu

SEQ ID NO: 2091886 - RNA, 14 nt, Staphylococcus aureus subsp. aureus MW2
uauucuuuauauuu

SEQ ID NO: 2091887 - RNA, 14 nt, Staphylococcus aureus subsp. aureus MW2
uauucuuuaauuaa

SEQ ID NO: 2091888 - RNA, 19 nt, Staphylococcus aureus subsp. aureus MW2
uauugaaaguguaugcaug

SEQ ID NO: 2091889 - RNA, 12 nt, Staphylococcus aureus subsp. aureus MW2
uauugaaacuaa

SEQ ID NO: 2091890 - RNA, 21 nt, Staphylococcus aureus subsp. aureus MW2
uauucuucuaauucugaaauc

SEQ ID NO: 2091891 - RNA, 13 nt, Staphylococcus aureus subsp. aureus MW2
uauucuucauuua

SEQ ID NO: 2091892 - RNA, 17 nt, Staphylococcus aureus subsp. aureus MW2
uauucuuaaaagacauc

SEQ ID NO: 2091893 - RNA, 14 nt, Staphylococcus aureus subsp. aureus MW2
uauucuaaguuaaa

SEQ ID NO: 2091894 - RNA, 17 nt, Staphylococcus aureus subsp. aureus MW2
uauucuaauugcacauu

SEQ ID NO: 2091895 - RNA, 14 nt, Staphylococcus aureus subsp. aureus MW2
uauucguuucuuua

SEQ ID NO: 2091896 - RNA, 16 nt, Staphylococcus aureus subsp. aureus MW2
uauucuaaaaaauuaa

SEQ ID NO: 2091897 - RNA, 21 nt, Staphylococcus aureus subsp. aureus MW2
uauucguaucuaguguucuca

SEQ ID NO: 2091898 - RNA, 20 nt, Staphylococcus aureus subsp. aureus MW2
uauuccuaguucuauguaua

SEQ ID NO: 2091899 - RNA, 17 nt, Staphylococcus aureus subsp. aureus MW2
uauuccuaauaaauauc

SEQ ID NO: 2091900 - RNA, 18 nt, Staphylococcus aureus subsp. aureus MW2
uauucaaauaaacacauc

SEQ ID NO: 2091901 - RNA, 15 nt, Staphylococcus aureus subsp. aureus MW2
uauucaaauuuacca

SEQ ID NO: 2091902 - RNA, 21 nt, Staphylococcus aureus subsp. aureus MW2
uauuccgagaauuauuauucu

SEQ ID NO: 2091903 - RNA, 14 nt, Staphylococcus aureus subsp. aureus MW2
uauuauguuauaaa

SEQ ID NO: 2091904 - RNA, 23 nt, Staphylococcus aureus subsp. aureus MW2
uauuauguuauaaauucuaucua

SEQ ID NO: 2091905 - RNA, 17 nt, Staphylococcus aureus subsp. aureus MW2
uauuaugaauuauuaau

SEQ ID NO: 2091906 - RNA, 16 nt, Staphylococcus aureus subsp. aureus MW2
uauuaugccuuugauu

SEQ ID NO: 2091907 - RNA, 13 nt, Staphylococcus aureus subsp. aureus MW2
uauuauuuuacuu

SEQ ID NO: 2091908 - RNA, 18 nt, Staphylococcus aureus subsp. aureus MW2
uauuauguaccaaauuua

SEQ ID NO: 2091909 - RNA, 17 nt, Staphylococcus aureus subsp. aureus MW2
uauucaaaguuuucauu

SEQ ID NO: 2091910 - RNA, 19 nt, Staphylococcus aureus subsp. aureus MW2
uaucuuucaaauuaauuaa

SEQ ID NO: 2091911 - RNA, 17 nt, Staphylococcus aureus subsp. aureus MW2
uaucuuuauuugauucu

SEQ ID NO: 2091912 - RNA, 16 nt, Staphylococcus aureus subsp. aureus MW2
uaucuuuaucauuauu

SEQ ID NO: 2091913 - RNA, 16 nt, Staphylococcus aureus subsp. aureus MW2
uaucuuuuucuaaguu

SEQ ID NO: 2091914 - RNA, 14 nt, Staphylococcus aureus subsp. aureus MW2
uaucuuuuaauguu

SEQ ID NO: 2091915 - RNA, 23 nt, Staphylococcus aureus subsp. aureus MW2
uaugaaaagagaaacaaaacaaa

SEQ ID NO: 2091916 - RNA, 14 nt, Staphylococcus aureus subsp. aureus MW2
uaugaaaagugaau

SEQ ID NO: 2091917 - RNA, 15 nt, Staphylococcus aureus subsp. aureus MW2
uaugaauaaugcaau

SEQ ID NO: 2091918 - RNA, 16 nt, Staphylococcus aureus subsp. aureus MW2
uaugaagugaaaucau

SEQ ID NO: 2091919 - RNA, 14 nt, Staphylococcus aureus subsp. aureus MW2
uaugaaauaacuag

SEQ ID NO: 2091920 - RNA, 12 nt, Staphylococcus aureus subsp. aureus MW2
uaucuucuucua

SEQ ID NO: 2091921 - RNA, 14 nt, Staphylococcus aureus subsp. aureus MW2
uaucuuguucuucu

SEQ ID NO: 2091922 - RNA, 17 nt, Staphylococcus aureus subsp. aureus MW2
uaucuuuaguauuucau

SEQ ID NO: 2091923 - RNA, 15 nt, Staphylococcus aureus subsp. aureus MW2
uaucuguauaaaaac

SEQ ID NO: 2091924 - RNA, 19 nt, Staphylococcus aureus subsp. aureus MW2
uaucuuaaagaauuaagua

SEQ ID NO: 2091925 - RNA, 17 nt, Staphylococcus aureus subsp. aureus MW2
uaucuuauaacaaaaau

SEQ ID NO: 2091926 - RNA, 20 nt, Staphylococcus aureus subsp. aureus MW2
uaucuuauauuuaugauaau

SEQ ID NO: 2091927 - RNA, 21 nt, Staphylococcus aureus subsp. aureus MW2
uaucuuauauuuaugauaauu

SEQ ID NO: 2091928 - RNA, 22 nt, Staphylococcus aureus subsp. aureus MW2
uaucuuaaucagcuauaaaagu

SEQ ID NO: 2091929 - RNA, 19 nt, Staphylococcus aureus subsp. aureus MW2
uaucuuacuacuuaauuaa

SEQ ID NO: 2091930 - RNA, 13 nt, Staphylococcus aureus subsp. aureus MW2
uaucugaaaauau

SEQ ID NO: 2091931 - RNA, 18 nt, Staphylococcus aureus subsp. aureus MW2
uaucucaaagauuccugu

SEQ ID NO: 2091932 - RNA, 15 nt, Staphylococcus aureus subsp. aureus MW2
uaucucaaauauuaa

SEQ ID NO: 2091933 - RNA, 16 nt, Staphylococcus aureus subsp. aureus MW2
uaucuauuucuauaua

SEQ ID NO: 2091934 - RNA, 18 nt, Staphylococcus aureus subsp. aureus MW2
uaucuccgcuacaauuau

SEQ ID NO: 2091935 - RNA, 14 nt, Staphylococcus aureus subsp. aureus MW2
uaucugacauuuaa

SEQ ID NO: 2091936 - RNA, 19 nt, Staphylococcus aureus subsp. aureus MW2
uaucugaaguagauugaua

SEQ ID NO: 2091937 - RNA, 17 nt, Staphylococcus aureus subsp. aureus MW2
uaucuaaagcuauaaaa

SEQ ID NO: 2091938 - RNA, 15 nt, Staphylococcus aureus subsp. aureus MW2
uaucuaaaugugaaa

SEQ ID NO: 2091939 - RNA, 13 nt, Staphylococcus aureus subsp. aureus MW2
uaucuaauucuuc

SEQ ID NO: 2091940 - RNA, 16 nt, Staphylococcus aureus subsp. aureus MW2
uaucuacauuaaagaa

SEQ ID NO: 2091941 - RNA, 11 nt, Staphylococcus aureus subsp. aureus MW2
uaucuaagucg

SEQ ID NO: 2091942 - RNA, 18 nt, Staphylococcus aureus subsp. aureus MW2
uaucuacaugguuuucac

SEQ ID NO: 2091943 - RNA, 17 nt, Staphylococcus aureus subsp. aureus MW2
uaucgugcguuaaauau

SEQ ID NO: 2091944 - RNA, 16 nt, Staphylococcus aureus subsp. aureus MW2
uaucuaguguucucau

SEQ ID NO: 2091945 - RNA, 22 nt, Staphylococcus aureus subsp. aureus MW2
uaucuacauuaaagaaaauauc

SEQ ID NO: 2091946 - RNA, 23 nt, Staphylococcus aureus subsp. aureus MW2
uaucuaguguucucauuauaaug

SEQ ID NO: 2091947 - RNA, 17 nt, Staphylococcus aureus subsp. aureus MW2
uaucuaguguucucauu

SEQ ID NO: 2091948 - RNA, 18 nt, Staphylococcus aureus subsp. aureus MW2
uaucuauaugcauauauu

SEQ ID NO: 2091949 - RNA, 15 nt, Staphylococcus aureus subsp. aureus MW2
uaucuauaugcauau

SEQ ID NO: 2091950 - RNA, 24 nt, Staphylococcus aureus subsp. aureus MW2
uaucuauacaauuauggauaaaau

SEQ ID NO: 2091951 - RNA, 21 nt, Staphylococcus aureus subsp. aureus MW2
uaucuauaucgucgauuucau

SEQ ID NO: 2091952 - RNA, 16 nt, Staphylococcus aureus subsp. aureus MW2
uaugauaaccauuaug

SEQ ID NO: 2091953 - RNA, 16 nt, Staphylococcus aureus subsp. aureus MW2
uaugauagaaaucgcc

SEQ ID NO: 2091954 - RNA, 22 nt, Staphylococcus aureus subsp. aureus MW2
uaugauacgcuuuuuaaaaaau

SEQ ID NO: 2091955 - RNA, 23 nt, Staphylococcus aureus subsp. aureus MW2
uaugauagaauacuaaaaguguu

SEQ ID NO: 2091956 - RNA, 19 nt, Staphylococcus aureus subsp. aureus MW2
uaugagucuuuuugauuaa

SEQ ID NO: 2091957 - RNA, 17 nt, Staphylococcus aureus subsp. aureus MW2
uaugagcuuaauaaauu

SEQ ID NO: 2091958 - RNA, 18 nt, Staphylococcus aureus subsp. aureus MW2
uaugacugcuuuuuauua

SEQ ID NO: 2091959 - RNA, 23 nt, Staphylococcus aureus subsp. aureus MW2
uaugacugguacauuaguuugau

SEQ ID NO: 2091960 - RNA, 15 nt, Staphylococcus aureus subsp. aureus MW2
uaugacuuuuuauua

SEQ ID NO: 2091961 - RNA, 23 nt, Staphylococcus aureus subsp. aureus MW2
uaugaauggcaaucuauauaaau

SEQ ID NO: 2091962 - RNA, 23 nt, Staphylococcus aureus subsp. aureus MW2
uaugaauuuagaugcauaaaaaa

SEQ ID NO: 2091963 - RNA, 17 nt, Staphylococcus aureus subsp. aureus MW2
uaugaauuauuaauaag

SEQ ID NO: 2091964 - RNA, 16 nt, Staphylococcus aureus subsp. aureus MW2
uaugaaucgauauaau

SEQ ID NO: 2091965 - RNA, 12 nt, Staphylococcus aureus subsp. aureus MW2
uaugacaacaua

SEQ ID NO: 2091966 - RNA, 13 nt, Staphylococcus aureus subsp. aureus MW2
uaugaauuuuaua

SEQ ID NO: 2091967 - RNA, 15 nt, Staphylococcus aureus subsp. aureus MW2
uaugaauuuuauaaa

SEQ ID NO: 2091968 - RNA, 22 nt, Staphylococcus aureus subsp. aureus MW2
uaugaauuuagcaucaaaaaua

SEQ ID NO: 2091969 - RNA, 21 nt, Staphylococcus aureus subsp. aureus MW2
uaugacgcgugaauuaaaaaa

SEQ ID NO: 2091970 - RNA, 16 nt, Staphylococcus aureus subsp. aureus MW2
uaugcaaaauuaauga

SEQ ID NO: 2091971 - RNA, 18 nt, Staphylococcus aureus subsp. aureus MW2
uaugcauauguaauacaa

SEQ ID NO: 2091972 - RNA, 20 nt, Staphylococcus aureus subsp. aureus MW2
uaugcaguuuuaauuaaacu

SEQ ID NO: 2091973 - RNA, 20 nt, Staphylococcus aureus subsp. aureus MW2
uaugcauaauaccaauugcu

SEQ ID NO: 2091974 - RNA, 16 nt, Staphylococcus aureus subsp. aureus MW2
uaugcacaucauugau

SEQ ID NO: 2091975 - RNA, 23 nt, Staphylococcus aureus subsp. aureus MW2
uaugcauccuaaaaaggcaagca

SEQ ID NO: 2091976 - RNA, 19 nt, Staphylococcus aureus subsp. aureus MW2
uaugcaugccagaugcaau

SEQ ID NO: 2091977 - RNA, 22 nt, Staphylococcus aureus subsp. aureus MW2
uaugccaaaguaauaauggcaa

SEQ ID NO: 2091978 - RNA, 15 nt, Staphylococcus aureus subsp. aureus MW2
uaugauguuaaaaaa

SEQ ID NO: 2091979 - RNA, 21 nt, Staphylococcus aureus subsp. aureus MW2
uaugauguguuacacaugcau

SEQ ID NO: 2091980 - RNA, 22 nt, Staphylococcus aureus subsp. aureus MW2
uaugaugucauguauuguccau

SEQ ID NO: 2091981 - RNA, 12 nt, Staphylococcus aureus subsp. aureus MW2
uaugauuuaaaa

SEQ ID NO: 2091982 - RNA, 13 nt, Staphylococcus aureus subsp. aureus MW2
uaugauuugauau

SEQ ID NO: 2091983 - RNA, 18 nt, Staphylococcus aureus subsp. aureus MW2
uaugauuugauuugggua

SEQ ID NO: 2091984 - RNA, 16 nt, Staphylococcus aureus subsp. aureus MW2
uaugauuauuuuucuc

SEQ ID NO: 2091985 - RNA, 19 nt, Staphylococcus aureus subsp. aureus MW2
uaugauugcuuauuuauuu

SEQ ID NO: 2091986 - RNA, 17 nt, Staphylococcus aureus subsp. aureus MW2
uaugaugucauguauug

SEQ ID NO: 2091987 - RNA, 21 nt, Staphylococcus aureus subsp. aureus MW2
uaugaucaauaagauuuugcu

SEQ ID NO: 2091988 - RNA, 13 nt, Staphylococcus aureus subsp. aureus MW2
uauggauaaaauu

SEQ ID NO: 2091989 - RNA, 16 nt, Staphylococcus aureus subsp. aureus MW2
uauggauguauuucug

SEQ ID NO: 2091990 - RNA, 22 nt, Staphylococcus aureus subsp. aureus MW2
uaugcuuuacuugcuuuuucaa

SEQ ID NO: 2091991 - RNA, 22 nt, Staphylococcus aureus subsp. aureus MW2
uaugcuugcugugaauaaaauu

SEQ ID NO: 2091992 - RNA, 16 nt, Staphylococcus aureus subsp. aureus MW2
uaugcuuuuuuuacaa

SEQ ID NO: 2091993 - RNA, 14 nt, Staphylococcus aureus subsp. aureus MW2
uauggaauaaaugg

SEQ ID NO: 2091994 - RNA, 21 nt, Staphylococcus aureus subsp. aureus MW2
uauggcgcaauuuuuaacaaa

SEQ ID NO: 2091995 - RNA, 21 nt, Staphylococcus aureus subsp. aureus MW2
uaugccgccuaauaauaaaau

SEQ ID NO: 2091996 - RNA, 21 nt, Staphylococcus aureus subsp. aureus MW2
uaugcgagggcuuucuuaauu

SEQ ID NO: 2091997 - RNA, 17 nt, Staphylococcus aureus subsp. aureus MW2
uaugcuagaaaguaaug

SEQ ID NO: 2091998 - RNA, 19 nt, Staphylococcus aureus subsp. aureus MW2
uaugcugcaagucucauau

SEQ ID NO: 2091999 - RNA, 13 nt, Staphylococcus aureus subsp. aureus MW2
uaugcguauaugu

SEQ ID NO: 2092000 - RNA, 12 nt, Staphylococcus aureus subsp. aureus MW2
uaucauaacaau

SEQ ID NO: 2092001 - RNA, 19 nt, Staphylococcus aureus subsp. aureus MW2
uaucauaacuuaacucuau

SEQ ID NO: 2092002 - RNA, 16 nt, Staphylococcus aureus subsp. aureus MW2
uaucauaugaacaauu

SEQ ID NO: 2092003 - RNA, 15 nt, Staphylococcus aureus subsp. aureus MW2
uaucauaauauugau

SEQ ID NO: 2092004 - RNA, 21 nt, Staphylococcus aureus subsp. aureus MW2
uaucauaauagccgcuucauu

SEQ ID NO: 2092005 - RNA, 13 nt, Staphylococcus aureus subsp. aureus MW2
uaucauaauauug

SEQ ID NO: 2092006 - RNA, 16 nt, Staphylococcus aureus subsp. aureus MW2
uaucauacauauuuau

SEQ ID NO: 2092007 - RNA, 23 nt, Staphylococcus aureus subsp. aureus MW2
uaucaucaaucguuaauuuccaa

SEQ ID NO: 2092008 - RNA, 18 nt, Staphylococcus aureus subsp. aureus MW2
uauccucaguauuuaaug

SEQ ID NO: 2092009 - RNA, 23 nt, Staphylococcus aureus subsp. aureus MW2
uaucccuaacaugggguuuuauu

SEQ ID NO: 2092010 - RNA, 15 nt, Staphylococcus aureus subsp. aureus MW2
uauccuuuuugacuc

SEQ ID NO: 2092011 - RNA, 19 nt, Staphylococcus aureus subsp. aureus MW2
uauccuuuuugacucaaaa

SEQ ID NO: 2092012 - RNA, 16 nt, Staphylococcus aureus subsp. aureus MW2
uauccuguguaaaaua

SEQ ID NO: 2092013 - RNA, 19 nt, Staphylococcus aureus subsp. aureus MW2
uaucgauauagcauaaaau

SEQ ID NO: 2092014 - RNA, 21 nt, Staphylococcus aureus subsp. aureus MW2
uaucgauaguucuauauaauu

SEQ ID NO: 2092015 - RNA, 17 nt, Staphylococcus aureus subsp. aureus MW2
uaucgauaguucuauau

SEQ ID NO: 2092016 - RNA, 14 nt, Staphylococcus aureus subsp. aureus MW2
uaucgauaguucua

SEQ ID NO: 2092017 - RNA, 19 nt, Staphylococcus aureus subsp. aureus MW2
uaucgccuaaaaauaaaau

SEQ ID NO: 2092018 - RNA, 16 nt, Staphylococcus aureus subsp. aureus MW2
uaucguaaacaacauc

SEQ ID NO: 2092019 - RNA, 20 nt, Staphylococcus aureus subsp. aureus MW2
uaucgucgauuucauuaauu

SEQ ID NO: 2092020 - RNA, 17 nt, Staphylococcus aureus subsp. aureus MW2
uaucguaaaaaaacguc

SEQ ID NO: 2092021 - RNA, 21 nt, Staphylococcus aureus subsp. aureus MW2
uaucaagggcuccuacuccau

SEQ ID NO: 2092022 - RNA, 14 nt, Staphylococcus aureus subsp. aureus MW2
uaucaauuucuauu

SEQ ID NO: 2092023 - RNA, 14 nt, Staphylococcus aureus subsp. aureus MW2
uaucaauuucuucc

SEQ ID NO: 2092024 - RNA, 21 nt, Staphylococcus aureus subsp. aureus MW2
uaucaauuguugcaaaauacg

SEQ ID NO: 2092025 - RNA, 23 nt, Staphylococcus aureus subsp. aureus MW2
uaucaagauguuugcaacauauu

SEQ ID NO: 2092026 - RNA, 15 nt, Staphylococcus aureus subsp. aureus MW2
uauauuuuauuagau

SEQ ID NO: 2092027 - RNA, 15 nt, Staphylococcus aureus subsp. aureus MW2
uaucaacauuaauaa

SEQ ID NO: 2092028 - RNA, 20 nt, Staphylococcus aureus subsp. aureus MW2
uaucaacauuaauaaauaau

SEQ ID NO: 2092029 - RNA, 15 nt, Staphylococcus aureus subsp. aureus MW2
uaucaccuaauugaa

SEQ ID NO: 2092030 - RNA, 16 nt, Staphylococcus aureus subsp. aureus MW2
uaucaccuucaaacuu

SEQ ID NO: 2092031 - RNA, 20 nt, Staphylococcus aureus subsp. aureus MW2
uaucacauauuaugauacgc

SEQ ID NO: 2092032 - RNA, 15 nt, Staphylococcus aureus subsp. aureus MW2
uaucaccauaaaaau

SEQ ID NO: 2092033 - RNA, 16 nt, Staphylococcus aureus subsp. aureus MW2
uaucaccauaaaaaua

SEQ ID NO: 2092034 - RNA, 11 nt, Staphylococcus aureus subsp. aureus MW2
uauauuuuaag

SEQ ID NO: 2092035 - RNA, 12 nt, Staphylococcus aureus subsp. aureus MW2
uauauuuagauc

SEQ ID NO: 2092036 - RNA, 12 nt, Staphylococcus aureus subsp. aureus MW2
uauauuauaaaa

SEQ ID NO: 2092037 - RNA, 14 nt, Staphylococcus aureus subsp. aureus MW2
uauauuauaaaaau

SEQ ID NO: 2092038 - RNA, 17 nt, Staphylococcus aureus subsp. aureus MW2
uauauuaucauugauau

SEQ ID NO: 2092039 - RNA, 12 nt, Staphylococcus aureus subsp. aureus MW2
uauauuaugaac

SEQ ID NO: 2092040 - RNA, 22 nt, Staphylococcus aureus subsp. aureus MW2
uauauuaugaacaugaaauuaa

SEQ ID NO: 2092041 - RNA, 23 nt, Staphylococcus aureus subsp. aureus MW2
uauauuaugaacaugaaauuaau

SEQ ID NO: 2092042 - RNA, 21 nt, Staphylococcus aureus subsp. aureus MW2
uauaugucucucuuucuuauu

SEQ ID NO: 2092043 - RNA, 15 nt, Staphylococcus aureus subsp. aureus MW2
uauauggcaucauca

SEQ ID NO: 2092044 - RNA, 16 nt, Staphylococcus aureus subsp. aureus MW2
uauauguaacaaaugc

SEQ ID NO: 2092045 - RNA, 14 nt, Staphylococcus aureus subsp. aureus MW2
uauauuaaauacua

SEQ ID NO: 2092046 - RNA, 20 nt, Staphylococcus aureus subsp. aureus MW2
uauauuaaaaaucaaaauaa

SEQ ID NO: 2092047 - RNA, 19 nt, Staphylococcus aureus subsp. aureus MW2
uauauuaaauuuacaaaaa

SEQ ID NO: 2092048 - RNA, 15 nt, Staphylococcus aureus subsp. aureus MW2
uauauuaauaaucuu

SEQ ID NO: 2092049 - RNA, 16 nt, Staphylococcus aureus subsp. aureus MW2
uauauuaauauuugau

SEQ ID NO: 2092050 - RNA, 21 nt, Staphylococcus aureus subsp. aureus MW2
uauauuaauauuugauuauuc

SEQ ID NO: 2092051 - RNA, 17 nt, Staphylococcus aureus subsp. aureus MW2
uauauuacccuccuauu

SEQ ID NO: 2092052 - RNA, 12 nt, Staphylococcus aureus subsp. aureus MW2
uauauggaauac

SEQ ID NO: 2092053 - RNA, 22 nt, Staphylococcus aureus subsp. aureus MW2
uauaucuuuuuuauguuuugaa

SEQ ID NO: 2092054 - RNA, 20 nt, Staphylococcus aureus subsp. aureus MW2
uauaauuucuguuuacgcca

SEQ ID NO: 2092055 - RNA, 14 nt, Staphylococcus aureus subsp. aureus MW2
uauaauuuguauaa

SEQ ID NO: 2092056 - RNA, 18 nt, Staphylococcus aureus subsp. aureus MW2
uauaauuucuaaaucuaa

SEQ ID NO: 2092057 - RNA, 15 nt, Staphylococcus aureus subsp. aureus MW2
uauaauuuuaauauu

SEQ ID NO: 2092058 - RNA, 15 nt, Staphylococcus aureus subsp. aureus MW2
uauaauuuuguuuca

SEQ ID NO: 2092059 - RNA, 16 nt, Staphylococcus aureus subsp. aureus MW2
uauacacuuacaaaua

SEQ ID NO: 2092060 - RNA, 17 nt, Staphylococcus aureus subsp. aureus MW2
uauagcugugauuugau

SEQ ID NO: 2092061 - RNA, 18 nt, Staphylococcus aureus subsp. aureus MW2
uauacaauguauuuugau

SEQ ID NO: 2092062 - RNA, 21 nt, Staphylococcus aureus subsp. aureus MW2
uauacaauaguauaaauauca

SEQ ID NO: 2092063 - RNA, 16 nt, Staphylococcus aureus subsp. aureus MW2
uauaguaaaauaaaua

SEQ ID NO: 2092064 - RNA, 19 nt, Staphylococcus aureus subsp. aureus MW2
uauaggugcaguuaaauua

SEQ ID NO: 2092065 - RNA, 15 nt, Staphylococcus aureus subsp. aureus MW2
uauaguaauaaaagu

SEQ ID NO: 2092066 - RNA, 13 nt, Staphylococcus aureus subsp. aureus MW2
uauaguuuagauu

SEQ ID NO: 2092067 - RNA, 21 nt, Staphylococcus aureus subsp. aureus MW2
uauaggugcaguuaaauuaaa

SEQ ID NO: 2092068 - RNA, 23 nt, Staphylococcus aureus subsp. aureus MW2
uauaguacuuacgaauagaaaau

SEQ ID NO: 2092069 - RNA, 12 nt, Staphylococcus aureus subsp. aureus MW2
uauauaucaaau

SEQ ID NO: 2092070 - RNA, 14 nt, Staphylococcus aureus subsp. aureus MW2
uauauauauuaaag

SEQ ID NO: 2092071 - RNA, 13 nt, Staphylococcus aureus subsp. aureus MW2
uauauauauuaaa

SEQ ID NO: 2092072 - RNA, 16 nt, Staphylococcus aureus subsp. aureus MW2
uauauaucaaauacau

SEQ ID NO: 2092073 - RNA, 18 nt, Staphylococcus aureus subsp. aureus MW2
uauauauccuguuucaua

SEQ ID NO: 2092074 - RNA, 19 nt, Staphylococcus aureus subsp. aureus MW2
uauauaaaaucauuaauaa

SEQ ID NO: 2092075 - RNA, 20 nt, Staphylococcus aureus subsp. aureus MW2
uauauaaaguugacaauaca

SEQ ID NO: 2092076 - RNA, 21 nt, Staphylococcus aureus subsp. aureus MW2
uauauaaaguugacaauacaa

SEQ ID NO: 2092077 - RNA, 23 nt, Staphylococcus aureus subsp. aureus MW2
uauauaaaguugacaauacaaau

SEQ ID NO: 2092078 - RNA, 16 nt, Staphylococcus aureus subsp. aureus MW2
uauauagauugccauu

SEQ ID NO: 2092079 - RNA, 21 nt, Staphylococcus aureus subsp. aureus MW2
uauaucuuuauuuuuuaucau

SEQ ID NO: 2092080 - RNA, 13 nt, Staphylococcus aureus subsp. aureus MW2
uauaucuuuuaua

SEQ ID NO: 2092081 - RNA, 14 nt, Staphylococcus aureus subsp. aureus MW2
uauaugaauuuuau

SEQ ID NO: 2092082 - RNA, 12 nt, Staphylococcus aureus subsp. aureus MW2
uauaucuuuauu

SEQ ID NO: 2092083 - RNA, 19 nt, Staphylococcus aureus subsp. aureus MW2
uauaucuuaaguacauaaa

SEQ ID NO: 2092084 - RNA, 14 nt, Staphylococcus aureus subsp. aureus MW2
uauauccauucaau

SEQ ID NO: 2092085 - RNA, 17 nt, Staphylococcus aureus subsp. aureus MW2
uauauccgcaucuuuug

SEQ ID NO: 2092086 - RNA, 15 nt, Staphylococcus aureus subsp. aureus MW2
uauauauuaaaguaa

SEQ ID NO: 2092087 - RNA, 18 nt, Staphylococcus aureus subsp. aureus MW2
uauauaucacaacacaua

SEQ ID NO: 2092088 - RNA, 19 nt, Staphylococcus aureus subsp. aureus MW2
uauauccauucuuuuucaa

SEQ ID NO: 2092089 - RNA, 18 nt, Staphylococcus aureus subsp. aureus MW2
uauaaguauuuugaauuu

SEQ ID NO: 2092090 - RNA, 14 nt, Staphylococcus aureus subsp. aureus MW2
uauaaguauaauga

SEQ ID NO: 2092091 - RNA, 14 nt, Staphylococcus aureus subsp. aureus MW2
uauaaguacaaaua

SEQ ID NO: 2092092 - RNA, 12 nt, Staphylococcus aureus subsp. aureus MW2
uauaaguacaaa

SEQ ID NO: 2092093 - RNA, 21 nt, Staphylococcus aureus subsp. aureus MW2
uauaaguagcucaaaacaauu

SEQ ID NO: 2092094 - RNA, 13 nt, Staphylococcus aureus subsp. aureus MW2
uauaaguuaaaaa

SEQ ID NO: 2092095 - RNA, 18 nt, Staphylococcus aureus subsp. aureus MW2
uauaaguugcauauaaaa

SEQ ID NO: 2092096 - RNA, 19 nt, Staphylococcus aureus subsp. aureus MW2
uauaaguaagcguaauauu

SEQ ID NO: 2092097 - RNA, 14 nt, Staphylococcus aureus subsp. aureus MW2
uauaaggauaucug

SEQ ID NO: 2092098 - RNA, 13 nt, Staphylococcus aureus subsp. aureus MW2
uauaauaaagauu

SEQ ID NO: 2092099 - RNA, 21 nt, Staphylococcus aureus subsp. aureus MW2
uauaauaaagauuauaucuuu

SEQ ID NO: 2092100 - RNA, 19 nt, Staphylococcus aureus subsp. aureus MW2
uauaauaaccuacauuaau

SEQ ID NO: 2092101 - RNA, 21 nt, Staphylococcus aureus subsp. aureus MW2
uauaauaaccuacauuaauuu

SEQ ID NO: 2092102 - RNA, 17 nt, Staphylococcus aureus subsp. aureus MW2
uauaauacaugauauaa

SEQ ID NO: 2092103 - RNA, 13 nt, Staphylococcus aureus subsp. aureus MW2
uauaauaccccaa

SEQ ID NO: 2092104 - RNA, 16 nt, Staphylococcus aureus subsp. aureus MW2
uauaauaauauugaaa

SEQ ID NO: 2092105 - RNA, 17 nt, Staphylococcus aureus subsp. aureus MW2
uauaauaauauugaaag

SEQ ID NO: 2092106 - RNA, 18 nt, Staphylococcus aureus subsp. aureus MW2
uauaauagagaaacguaa

SEQ ID NO: 2092107 - RNA, 16 nt, Staphylococcus aureus subsp. aureus MW2
uauaauauauacaaau

SEQ ID NO: 2092108 - RNA, 18 nt, Staphylococcus aureus subsp. aureus MW2
uauaauauauacaaauaa

SEQ ID NO: 2092109 - RNA, 20 nt, Staphylococcus aureus subsp. aureus MW2
uauaauauauacaaauaaac

SEQ ID NO: 2092110 - RNA, 14 nt, Staphylococcus aureus subsp. aureus MW2
uauaaguuaaaaau

SEQ ID NO: 2092111 - RNA, 17 nt, Staphylococcus aureus subsp. aureus MW2
uauaauauucaauaauu

SEQ ID NO: 2092112 - RNA, 13 nt, Staphylococcus aureus subsp. aureus MW2
uauaauuauuaaa

SEQ ID NO: 2092113 - RNA, 18 nt, Staphylococcus aureus subsp. aureus MW2
uauaauuaaguguauaua

SEQ ID NO: 2092114 - RNA, 13 nt, Staphylococcus aureus subsp. aureus MW2
uauaauuacaagu

SEQ ID NO: 2092115 - RNA, 20 nt, Staphylococcus aureus subsp. aureus MW2
uauaauuacaaguuacauua

SEQ ID NO: 2092116 - RNA, 16 nt, Staphylococcus aureus subsp. aureus MW2
uauaauuauuuuuaua

SEQ ID NO: 2092117 - RNA, 14 nt, Staphylococcus aureus subsp. aureus MW2
uauaauuccugaaa

SEQ ID NO: 2092118 - RNA, 15 nt, Staphylococcus aureus subsp. aureus MW2
uauaauuauuaaacu

SEQ ID NO: 2092119 - RNA, 17 nt, Staphylococcus aureus subsp. aureus MW2
uauaauuuauaaaaaga

SEQ ID NO: 2092120 - RNA, 14 nt, Staphylococcus aureus subsp. aureus MW2
uauaauguauaaaa

SEQ ID NO: 2092121 - RNA, 15 nt, Staphylococcus aureus subsp. aureus MW2
uauaauuuauaaaaa

SEQ ID NO: 2092122 - RNA, 14 nt, Staphylococcus aureus subsp. aureus MW2
uauaaugaccaucu

SEQ ID NO: 2092123 - RNA, 12 nt, Staphylococcus aureus subsp. aureus MW2
uauaaugauuaa

SEQ ID NO: 2092124 - RNA, 14 nt, Staphylococcus aureus subsp. aureus MW2
uauaaugauuuaau

SEQ ID NO: 2092125 - RNA, 13 nt, Staphylococcus aureus subsp. aureus MW2
uauaauuaaacau

SEQ ID NO: 2092126 - RNA, 14 nt, Staphylococcus aureus subsp. aureus MW2
uauaaucuaucuug

SEQ ID NO: 2092127 - RNA, 18 nt, Staphylococcus aureus subsp. aureus MW2
uauaaugaaguuaugaag

SEQ ID NO: 2092128 - RNA, 19 nt, Staphylococcus aureus subsp. aureus MW2
uauaaugaauaaauaauuu

SEQ ID NO: 2092129 - RNA, 16 nt, Staphylococcus aureus subsp. aureus MW2
uauaaucuauaaaugg

SEQ ID NO: 2092130 - RNA, 20 nt, Staphylococcus aureus subsp. aureus MW2
uauaaucauuuaaacgaucu

SEQ ID NO: 2092131 - RNA, 20 nt, Staphylococcus aureus subsp. aureus MW2
uauaaauaucauaaaugcau

SEQ ID NO: 2092132 - RNA, 19 nt, Staphylococcus aureus subsp. aureus MW2
uauaaaugcagcuguauaa

SEQ ID NO: 2092133 - RNA, 22 nt, Staphylococcus aureus subsp. aureus MW2
uauaagaauuguugaucaugag

SEQ ID NO: 2092134 - RNA, 15 nt, Staphylococcus aureus subsp. aureus MW2
uauaagauaguuuga

SEQ ID NO: 2092135 - RNA, 14 nt, Staphylococcus aureus subsp. aureus MW2
uauaagauuucuca

SEQ ID NO: 2092136 - RNA, 20 nt, Staphylococcus aureus subsp. aureus MW2
uauaagccuuuucaaacaua

SEQ ID NO: 2092137 - RNA, 20 nt, Staphylococcus aureus subsp. aureus MW2
uauaagaauuguugaucaug

SEQ ID NO: 2092138 - RNA, 17 nt, Staphylococcus aureus subsp. aureus MW2
uauaagauagauaaauc

SEQ ID NO: 2092139 - RNA, 17 nt, Staphylococcus aureus subsp. aureus MW2
uauaaccgcuacaauua

SEQ ID NO: 2092140 - RNA, 21 nt, Staphylococcus aureus subsp. aureus MW2
uauaacauucuucaaaaaaua

SEQ ID NO: 2092141 - RNA, 20 nt, Staphylococcus aureus subsp. aureus MW2
uauaacauucuucaaaaaau

SEQ ID NO: 2092142 - RNA, 21 nt, Staphylococcus aureus subsp. aureus MW2
uauaaaauaugagauuaucug

SEQ ID NO: 2092143 - RNA, 14 nt, Staphylococcus aureus subsp. aureus MW2
uauaaaauaaaaug

SEQ ID NO: 2092144 - RNA, 23 nt, Staphylococcus aureus subsp. aureus MW2
uauaaaauggugcgaauaauaau

SEQ ID NO: 2092145 - RNA, 21 nt, Staphylococcus aureus subsp. aureus MW2
uauaaaauaaugcuuauuaaa

SEQ ID NO: 2092146 - RNA, 22 nt, Staphylococcus aureus subsp. aureus MW2
uauaaaauaaugcuuauuaaaa

SEQ ID NO: 2092147 - RNA, 23 nt, Staphylococcus aureus subsp. aureus MW2
uauaaaauaaugcuuauuaaaau

SEQ ID NO: 2092148 - RNA, 13 nt, Staphylococcus aureus subsp. aureus MW2
uauaaaaguacuu

SEQ ID NO: 2092149 - RNA, 23 nt, Staphylococcus aureus subsp. aureus MW2
uaguuggacaaauucuaugagaa

SEQ ID NO: 2092150 - RNA, 21 nt, Staphylococcus aureus subsp. aureus MW2
uauaaaagcacuauuuuuaua

SEQ ID NO: 2092151 - RNA, 18 nt, Staphylococcus aureus subsp. aureus MW2
uaguugacuguaaaacaa

SEQ ID NO: 2092152 - RNA, 16 nt, Staphylococcus aureus subsp. aureus MW2
uauaaacauaucuucu

SEQ ID NO: 2092153 - RNA, 23 nt, Staphylococcus aureus subsp. aureus MW2
uauaaagaaugauuuauaaaaaa

SEQ ID NO: 2092154 - RNA, 18 nt, Staphylococcus aureus subsp. aureus MW2
uauaaagacgauuuauua

SEQ ID NO: 2092155 - RNA, 23 nt, Staphylococcus aureus subsp. aureus MW2
uauaaacaauuacaaaaucaccu

SEQ ID NO: 2092156 - RNA, 18 nt, Staphylococcus aureus subsp. aureus MW2
uauaaaguugacaauaca

SEQ ID NO: 2092157 - RNA, 13 nt, Staphylococcus aureus subsp. aureus MW2
uauaaauaaaaau

SEQ ID NO: 2092158 - RNA, 14 nt, Staphylococcus aureus subsp. aureus MW2
uauaaauaaaaaua

SEQ ID NO: 2092159 - RNA, 13 nt, Staphylococcus aureus subsp. aureus MW2
uauaaauaaacau

SEQ ID NO: 2092160 - RNA, 14 nt, Staphylococcus aureus subsp. aureus MW2
uaguacacguguau

SEQ ID NO: 2092161 - RNA, 18 nt, Staphylococcus aureus subsp. aureus MW2
uaguacggcugcuuuaac

SEQ ID NO: 2092162 - RNA, 17 nt, Staphylococcus aureus subsp. aureus MW2
uagucaauuaaugauaa

SEQ ID NO: 2092163 - RNA, 18 nt, Staphylococcus aureus subsp. aureus MW2
uaguaauagcuauauuuu

SEQ ID NO: 2092164 - RNA, 14 nt, Staphylococcus aureus subsp. aureus MW2
uaguaaugauguga

SEQ ID NO: 2092165 - RNA, 22 nt, Staphylococcus aureus subsp. aureus MW2
uaguaaugaugugaauuggauu

SEQ ID NO: 2092166 - RNA, 22 nt, Staphylococcus aureus subsp. aureus MW2
uagucaggggccccaacacaga

SEQ ID NO: 2092167 - RNA, 23 nt, Staphylococcus aureus subsp. aureus MW2
uaguccuucuuuacuaaaccuca

SEQ ID NO: 2092168 - RNA, 12 nt, Staphylococcus aureus subsp. aureus MW2
uagucaucuguu

SEQ ID NO: 2092169 - RNA, 17 nt, Staphylococcus aureus subsp. aureus MW2
uagguuuaauuuuaaau

SEQ ID NO: 2092170 - RNA, 21 nt, Staphylococcus aureus subsp. aureus MW2
uaguaaccuaauucuaagucu

SEQ ID NO: 2092171 - RNA, 23 nt, Staphylococcus aureus subsp. aureus MW2
uaguaaccuaauucuaagucuuu

SEQ ID NO: 2092172 - RNA, 20 nt, Staphylococcus aureus subsp. aureus MW2
uaguaagagcucucguguau

SEQ ID NO: 2092173 - RNA, 19 nt, Staphylococcus aureus subsp. aureus MW2
uaguaaguagaagcaaaag

SEQ ID NO: 2092174 - RNA, 16 nt, Staphylococcus aureus subsp. aureus MW2
uagguuauuauaaaau

SEQ ID NO: 2092175 - RNA, 16 nt, Staphylococcus aureus subsp. aureus MW2
uagguuaguaauauau

SEQ ID NO: 2092176 - RNA, 16 nt, Staphylococcus aureus subsp. aureus MW2
uagguucaucuuuaug

SEQ ID NO: 2092177 - RNA, 14 nt, Staphylococcus aureus subsp. aureus MW2
uagguucuucuuuc

SEQ ID NO: 2092178 - RNA, 13 nt, Staphylococcus aureus subsp. aureus MW2
uagguuuaauuuu

SEQ ID NO: 2092179 - RNA, 22 nt, Staphylococcus aureus subsp. aureus MW2
uaguaacagacuuuguuaaaaa

SEQ ID NO: 2092180 - RNA, 16 nt, Staphylococcus aureus subsp. aureus MW2
uacuuucaaacaaauc

SEQ ID NO: 2092181 - RNA, 15 nt, Staphylococcus aureus subsp. aureus MW2
uacuuucaaacaaau

SEQ ID NO: 2092182 - RNA, 17 nt, Staphylococcus aureus subsp. aureus MW2
uacuuuauaaauaucuu

SEQ ID NO: 2092183 - RNA, 19 nt, Staphylococcus aureus subsp. aureus MW2
uacuuuauuugauaauauu

SEQ ID NO: 2092184 - RNA, 18 nt, Staphylococcus aureus subsp. aureus MW2
uacuuucacuuuuuauau

SEQ ID NO: 2092185 - RNA, 17 nt, Staphylococcus aureus subsp. aureus MW2
uacuuucacuuuuuaua

SEQ ID NO: 2092186 - RNA, 19 nt, Staphylococcus aureus subsp. aureus MW2
uacuuucaaauaaugugaa

SEQ ID NO: 2092187 - RNA, 19 nt, Staphylococcus aureus subsp. aureus MW2
uacuuucacauuuucaaau

SEQ ID NO: 2092188 - RNA, 20 nt, Staphylococcus aureus subsp. aureus MW2
uagguggcuuuuuuauuuua

SEQ ID NO: 2092189 - RNA, 12 nt, Staphylococcus aureus subsp. aureus MW2
uaguucuguuga

SEQ ID NO: 2092190 - RNA, 17 nt, Staphylococcus aureus subsp. aureus MW2
uaguucuguugauauuu

SEQ ID NO: 2092191 - RNA, 17 nt, Staphylococcus aureus subsp. aureus MW2
uaguuaugugcuaaucu

SEQ ID NO: 2092192 - RNA, 14 nt, Staphylococcus aureus subsp. aureus MW2
uagugcuuuuucaa

SEQ ID NO: 2092193 - RNA, 22 nt, Staphylococcus aureus subsp. aureus MW2
uagugcuuuuuauuuuuauuca

SEQ ID NO: 2092194 - RNA, 12 nt, Staphylococcus aureus subsp. aureus MW2
uagugcuuguuu

SEQ ID NO: 2092195 - RNA, 21 nt, Staphylococcus aureus subsp. aureus MW2
uaguuaagauaccuuuuucua

SEQ ID NO: 2092196 - RNA, 19 nt, Staphylococcus aureus subsp. aureus MW2
uagugguucugauguuuua

SEQ ID NO: 2092197 - RNA, 16 nt, Staphylococcus aureus subsp. aureus MW2
uagucucguaauaaug

SEQ ID NO: 2092198 - RNA, 23 nt, Staphylococcus aureus subsp. aureus MW2
uagucuaugaauaauguuuucau

SEQ ID NO: 2092199 - RNA, 15 nt, Staphylococcus aureus subsp. aureus MW2
uagucgguguuuucu

SEQ ID NO: 2092200 - RNA, 17 nt, Staphylococcus aureus subsp. aureus MW2
uagucgucgaaaugccu

SEQ ID NO: 2092201 - RNA, 17 nt, Staphylococcus aureus subsp. aureus MW2
uagugaaauaccuccug

SEQ ID NO: 2092202 - RNA, 20 nt, Staphylococcus aureus subsp. aureus MW2
uagucuucggcuuuguaaaa

SEQ ID NO: 2092203 - RNA, 14 nt, Staphylococcus aureus subsp. aureus MW2
uagucugcuauuuu

SEQ ID NO: 2092204 - RNA, 14 nt, Staphylococcus aureus subsp. aureus MW2
uccuuuaaaucauu

SEQ ID NO: 2092205 - RNA, 18 nt, Staphylococcus aureus subsp. aureus MW2
uccuugguuauuaaaauu

SEQ ID NO: 2092206 - RNA, 19 nt, Staphylococcus aureus subsp. aureus MW2
uccuugguuauuaaaauua

SEQ ID NO: 2092207 - RNA, 15 nt, Staphylococcus aureus subsp. aureus MW2
uccuuuauauuuagu

SEQ ID NO: 2092208 - RNA, 16 nt, Staphylococcus aureus subsp. aureus MW2
uccuuuauaaauaaac

SEQ ID NO: 2092209 - RNA, 15 nt, Staphylococcus aureus subsp. aureus MW2
uccuuuauacguuac

SEQ ID NO: 2092210 - RNA, 17 nt, Staphylococcus aureus subsp. aureus MW2
uccuuuaccguguucag

SEQ ID NO: 2092211 - RNA, 22 nt, Staphylococcus aureus subsp. aureus MW2
uccuugcucaugagcacaaacu

SEQ ID NO: 2092212 - RNA, 17 nt, Staphylococcus aureus subsp. aureus MW2
ucgaaaauaaaacaaau

SEQ ID NO: 2092213 - RNA, 23 nt, Staphylococcus aureus subsp. aureus MW2
ucgaaaagaaauucuacagacaa

SEQ ID NO: 2092214 - RNA, 20 nt, Staphylococcus aureus subsp. aureus MW2
ucgaaaaacuguaaaucauc

SEQ ID NO: 2092215 - RNA, 20 nt, Staphylococcus aureus subsp. aureus MW2
uccuuuuuauguacuacaua

SEQ ID NO: 2092216 - RNA, 14 nt, Staphylococcus aureus subsp. aureus MW2
uccuuuuacuuaau

SEQ ID NO: 2092217 - RNA, 15 nt, Staphylococcus aureus subsp. aureus MW2
ucgaaauucucugug

SEQ ID NO: 2092218 - RNA, 21 nt, Staphylococcus aureus subsp. aureus MW2
ucgaacaugaaugauauugau

SEQ ID NO: 2092219 - RNA, 23 nt, Staphylococcus aureus subsp. aureus MW2
ucgaaaauagcuauuaaaauaga

SEQ ID NO: 2092220 - RNA, 23 nt, Staphylococcus aureus subsp. aureus MW2
ucgaaaagaaauucuacaggcaa

SEQ ID NO: 2092221 - RNA, 21 nt, Staphylococcus aureus subsp. aureus MW2
ucgaaaauagcuauuaaaaua

SEQ ID NO: 2092222 - RNA, 18 nt, Staphylococcus aureus subsp. aureus MW2
ucgaaauauuuauucgcu

SEQ ID NO: 2092223 - RNA, 17 nt, Staphylococcus aureus subsp. aureus MW2
ucgaacgauauuuuaaa

SEQ ID NO: 2092224 - RNA, 17 nt, Staphylococcus aureus subsp. aureus MW2
ucgaacguuugaaaaau

SEQ ID NO: 2092225 - RNA, 22 nt, Staphylococcus aureus subsp. aureus MW2
ucgaacuaguacgaaaugcauu

SEQ ID NO: 2092226 - RNA, 20 nt, Staphylococcus aureus subsp. aureus MW2
ucgacaacugauuuaauauc

SEQ ID NO: 2092227 - RNA, 21 nt, Staphylococcus aureus subsp. aureus MW2
ucgaauguauugcuauaagaa

SEQ ID NO: 2092228 - RNA, 19 nt, Staphylococcus aureus subsp. aureus MW2
ucgaauguuucaugaccaa

SEQ ID NO: 2092229 - RNA, 22 nt, Staphylococcus aureus subsp. aureus MW2
ucgaauguauugcuauaagaac

SEQ ID NO: 2092230 - RNA, 20 nt, Staphylococcus aureus subsp. aureus MW2
ucgaauaacuguuuaucaug

SEQ ID NO: 2092231 - RNA, 14 nt, Staphylococcus aureus subsp. aureus MW2
ucgacuacaaguuu

SEQ ID NO: 2092232 - RNA, 19 nt, Staphylococcus aureus subsp. aureus MW2
ucgacuacaaguuuauaau

SEQ ID NO: 2092233 - RNA, 14 nt, Staphylococcus aureus subsp. aureus MW2
ucgacuuuucuauc

SEQ ID NO: 2092234 - RNA, 15 nt, Staphylococcus aureus subsp. aureus MW2
ucgagaggguacacu

SEQ ID NO: 2092235 - RNA, 17 nt, Staphylococcus aureus subsp. aureus MW2
ucgaguagcccuauuuu

SEQ ID NO: 2092236 - RNA, 23 nt, Staphylococcus aureus subsp. aureus MW2
ucgaguuuguuucuaaauucuuu

SEQ ID NO: 2092237 - RNA, 22 nt, Staphylococcus aureus subsp. aureus MW2
ucgauaaauguauuaaacauug

SEQ ID NO: 2092238 - RNA, 12 nt, Staphylococcus aureus subsp. aureus MW2
ucgauaaaaugu

SEQ ID NO: 2092239 - RNA, 14 nt, Staphylococcus aureus subsp. aureus MW2
ucgauaauauaacu

SEQ ID NO: 2092240 - RNA, 23 nt, Staphylococcus aureus subsp. aureus MW2
ucgauaaguuuuugaauaucuaa

SEQ ID NO: 2092241 - RNA, 21 nt, Staphylococcus aureus subsp. aureus MW2
ucgauauagcauaaaauuucu

SEQ ID NO: 2092242 - RNA, 19 nt, Staphylococcus aureus subsp. aureus MW2
ucgauaguucuauauaauu

SEQ ID NO: 2092243 - RNA, 15 nt, Staphylococcus aureus subsp. aureus MW2
ucgauaugaauaacc

SEQ ID NO: 2092244 - RNA, 17 nt, Staphylococcus aureus subsp. aureus MW2
ucgauaccuaaaauacc

SEQ ID NO: 2092245 - RNA, 15 nt, Staphylococcus aureus subsp. aureus MW2
ucgauauuuguuucg

SEQ ID NO: 2092246 - RNA, 23 nt, Staphylococcus aureus subsp. aureus MW2
ucgauauggucuuuuaauauuuu

SEQ ID NO: 2092247 - RNA, 16 nt, Staphylococcus aureus subsp. aureus MW2
ucgaugacuuugucuu

SEQ ID NO: 2092248 - RNA, 17 nt, Staphylococcus aureus subsp. aureus MW2
ucgaugacuuugucuuu

SEQ ID NO: 2092249 - RNA, 16 nt, Staphylococcus aureus subsp. aureus MW2
ucgaugacuuuuuaau

SEQ ID NO: 2092250 - RNA, 16 nt, Staphylococcus aureus subsp. aureus MW2
ucgaucgguauuuuca

SEQ ID NO: 2092251 - RNA, 13 nt, Staphylococcus aureus subsp. aureus MW2
ucgcaaaaacaua

SEQ ID NO: 2092252 - RNA, 18 nt, Staphylococcus aureus subsp. aureus MW2
ucgcaaaaacauaaucau

SEQ ID NO: 2092253 - RNA, 15 nt, Staphylococcus aureus subsp. aureus MW2
ucgauuuaucauuau

SEQ ID NO: 2092254 - RNA, 14 nt, Staphylococcus aureus subsp. aureus MW2
ucgauuaauucuuc

SEQ ID NO: 2092255 - RNA, 19 nt, Staphylococcus aureus subsp. aureus MW2
ucgauuaauucuucuucag

SEQ ID NO: 2092256 - RNA, 18 nt, Staphylococcus aureus subsp. aureus MW2
ucgauucauaaaauuuaa

SEQ ID NO: 2092257 - RNA, 19 nt, Staphylococcus aureus subsp. aureus MW2
ucgauuauucuuaauuuaa

SEQ ID NO: 2092258 - RNA, 18 nt, Staphylococcus aureus subsp. aureus MW2
ucgauucgugauuuggaa

SEQ ID NO: 2092259 - RNA, 21 nt, Staphylococcus aureus subsp. aureus MW2
ucgcaaugucaucuugacaca

SEQ ID NO: 2092260 - RNA, 21 nt, Staphylococcus aureus subsp. aureus MW2
ucgcaccgucaaacuuaaaac

SEQ ID NO: 2092261 - RNA, 15 nt, Staphylococcus aureus subsp. aureus MW2
ucgcacuauaaaauu

SEQ ID NO: 2092262 - RNA, 15 nt, Staphylococcus aureus subsp. aureus MW2
ucgcacucugcaucg

SEQ ID NO: 2092263 - RNA, 15 nt, Staphylococcus aureus subsp. aureus MW2
ucgcagcuucuuuaa

SEQ ID NO: 2092264 - RNA, 22 nt, Staphylococcus aureus subsp. aureus MW2
uccguuuuagaauuuaacauuu

SEQ ID NO: 2092265 - RNA, 23 nt, Staphylococcus aureus subsp. aureus MW2
uccgucgaauauaauuuuuugac

SEQ ID NO: 2092266 - RNA, 16 nt, Staphylococcus aureus subsp. aureus MW2
uccguauuuaccuucu

SEQ ID NO: 2092267 - RNA, 17 nt, Staphylococcus aureus subsp. aureus MW2
uccuauggcgcaauuuu

SEQ ID NO: 2092268 - RNA, 21 nt, Staphylococcus aureus subsp. aureus MW2
uccuaugccaaauaacguuaa

SEQ ID NO: 2092269 - RNA, 20 nt, Staphylococcus aureus subsp. aureus MW2
uccuaucuguaccguauuuu

SEQ ID NO: 2092270 - RNA, 21 nt, Staphylococcus aureus subsp. aureus MW2
uccuauggcgcaauuuuuaac

SEQ ID NO: 2092271 - RNA, 20 nt, Staphylococcus aureus subsp. aureus MW2
uccuaauguaauuauugcau

SEQ ID NO: 2092272 - RNA, 21 nt, Staphylococcus aureus subsp. aureus MW2
uccuaauguaauuauugcauc

SEQ ID NO: 2092273 - RNA, 14 nt, Staphylococcus aureus subsp. aureus MW2
uccuaaauuauugu

SEQ ID NO: 2092274 - RNA, 19 nt, Staphylococcus aureus subsp. aureus MW2
uccuaagcaucguaaaaaa

SEQ ID NO: 2092275 - RNA, 16 nt, Staphylococcus aureus subsp. aureus MW2
uccuacuccauagaaa

SEQ ID NO: 2092276 - RNA, 18 nt, Staphylococcus aureus subsp. aureus MW2
uccuacuccauagaaauu

SEQ ID NO: 2092277 - RNA, 21 nt, Staphylococcus aureus subsp. aureus MW2
uccuacuuuucaacuuuaguu

SEQ ID NO: 2092278 - RNA, 22 nt, Staphylococcus aureus subsp. aureus MW2
uccuacgacacguguaaaaaug

SEQ ID NO: 2092279 - RNA, 14 nt, Staphylococcus aureus subsp. aureus MW2
uccugauuccacua

SEQ ID NO: 2092280 - RNA, 17 nt, Staphylococcus aureus subsp. aureus MW2
uccugaagagaaaauuu

SEQ ID NO: 2092281 - RNA, 16 nt, Staphylococcus aureus subsp. aureus MW2
uccugaaauuaacguc

SEQ ID NO: 2092282 - RNA, 19 nt, Staphylococcus aureus subsp. aureus MW2
uccuccuaccgcuaaaauu

SEQ ID NO: 2092283 - RNA, 22 nt, Staphylococcus aureus subsp. aureus MW2
uccuccgccaucaauauuuaua

SEQ ID NO: 2092284 - RNA, 15 nt, Staphylococcus aureus subsp. aureus MW2
uccucaguauuuaau

SEQ ID NO: 2092285 - RNA, 15 nt, Staphylococcus aureus subsp. aureus MW2
uccucauuaauaaau

SEQ ID NO: 2092286 - RNA, 16 nt, Staphylococcus aureus subsp. aureus MW2
uccuccaaagcuaagu

SEQ ID NO: 2092287 - RNA, 13 nt, Staphylococcus aureus subsp. aureus MW2
uccuccaaagcua

SEQ ID NO: 2092288 - RNA, 20 nt, Staphylococcus aureus subsp. aureus MW2
uccugcuacaacuucuucuc

SEQ ID NO: 2092289 - RNA, 20 nt, Staphylococcus aureus subsp. aureus MW2
uccuucaauguucaauucac

SEQ ID NO: 2092290 - RNA, 13 nt, Staphylococcus aureus subsp. aureus MW2
uccuuaccuuuua

SEQ ID NO: 2092291 - RNA, 20 nt, Staphylococcus aureus subsp. aureus MW2
uccuuaaacaaauaaauguc

SEQ ID NO: 2092292 - RNA, 15 nt, Staphylococcus aureus subsp. aureus MW2
uccuuaauacguugc

SEQ ID NO: 2092293 - RNA, 13 nt, Staphylococcus aureus subsp. aureus MW2
uccuuaacuuuau

SEQ ID NO: 2092294 - RNA, 16 nt, Staphylococcus aureus subsp. aureus MW2
uccugguauaauggac

SEQ ID NO: 2092295 - RNA, 19 nt, Staphylococcus aureus subsp. aureus MW2
ucccacgugccucauccuu

SEQ ID NO: 2092296 - RNA, 23 nt, Staphylococcus aureus subsp. aureus MW2
ucccauaaggaaccugucuuaau

SEQ ID NO: 2092297 - RNA, 13 nt, Staphylococcus aureus subsp. aureus MW2
ucccauaaugacu

SEQ ID NO: 2092298 - RNA, 16 nt, Staphylococcus aureus subsp. aureus MW2
uccccauuuauguguu

SEQ ID NO: 2092299 - RNA, 19 nt, Staphylococcus aureus subsp. aureus MW2
uccccauuaauuaacaaag

SEQ ID NO: 2092300 - RNA, 21 nt, Staphylococcus aureus subsp. aureus MW2
ucccauuaacacgaacugcau

SEQ ID NO: 2092301 - RNA, 14 nt, Staphylococcus aureus subsp. aureus MW2
ucccauuuuuaaaa

SEQ ID NO: 2092302 - RNA, 15 nt, Staphylococcus aureus subsp. aureus MW2
ucccauuuuuaaaau

SEQ ID NO: 2092303 - RNA, 13 nt, Staphylococcus aureus subsp. aureus MW2
uccccaacuugca

SEQ ID NO: 2092304 - RNA, 17 nt, Staphylococcus aureus subsp. aureus MW2
uccccaauuucucugug

SEQ ID NO: 2092305 - RNA, 22 nt, Staphylococcus aureus subsp. aureus MW2
uccccacguuuugaacauguuu

SEQ ID NO: 2092306 - RNA, 19 nt, Staphylococcus aureus subsp. aureus MW2
uccccucuuuucuuuaaaa

SEQ ID NO: 2092307 - RNA, 15 nt, Staphylococcus aureus subsp. aureus MW2
ucccgcuuaaaauga

SEQ ID NO: 2092308 - RNA, 19 nt, Staphylococcus aureus subsp. aureus MW2
ucccuaggaaauaaaaaau

SEQ ID NO: 2092309 - RNA, 18 nt, Staphylococcus aureus subsp. aureus MW2
ucccuaucauacauauuu

SEQ ID NO: 2092310 - RNA, 21 nt, Staphylococcus aureus subsp. aureus MW2
ucccucuaucaaauuaccauu

SEQ ID NO: 2092311 - RNA, 23 nt, Staphylococcus aureus subsp. aureus MW2
ucccucuaucaaauuaccauuca

SEQ ID NO: 2092312 - RNA, 20 nt, Staphylococcus aureus subsp. aureus MW2
ucccuuaaauacaauuucuu

SEQ ID NO: 2092313 - RNA, 22 nt, Staphylococcus aureus subsp. aureus MW2
ucccuuaaauacaauuucuuca

SEQ ID NO: 2092314 - RNA, 19 nt, Staphylococcus aureus subsp. aureus MW2
ucccuucaaaguagacauu

SEQ ID NO: 2092315 - RNA, 14 nt, Staphylococcus aureus subsp. aureus MW2
ucccuuaauaauaa

SEQ ID NO: 2092316 - RNA, 15 nt, Staphylococcus aureus subsp. aureus MW2
aaaucuguuuaaauu

SEQ ID NO: 2092317 - RNA, 20 nt, Staphylococcus aureus subsp. aureus MW2
aaaucuguuuaaauuuaaaa

SEQ ID NO: 2092318 - RNA, 14 nt, Staphylococcus aureus subsp. aureus MW2
uccgacugcaccuc

SEQ ID NO: 2092319 - RNA, 20 nt, Staphylococcus aureus subsp. aureus MW2
uccgacuuuugauuuugaau

SEQ ID NO: 2092320 - RNA, 15 nt, Staphylococcus aureus subsp. aureus MW2
aaaucugauucauua

SEQ ID NO: 2092321 - RNA, 12 nt, Staphylococcus aureus subsp. aureus MW2
ucccuuuuuaaa

SEQ ID NO: 2092322 - RNA, 21 nt, Staphylococcus aureus subsp. aureus MW2
ucccuuuucaucaaauucaaa

SEQ ID NO: 2092323 - RNA, 19 nt, Staphylococcus aureus subsp. aureus MW2
uccgaaaauugcuaaaaaa

SEQ ID NO: 2092324 - RNA, 19 nt, Staphylococcus aureus subsp. aureus MW2
uccgauaucuuuuaauucu

SEQ ID NO: 2092325 - RNA, 20 nt, Staphylococcus aureus subsp. aureus MW2
uccgauuugauaaaaaauga

SEQ ID NO: 2092326 - RNA, 14 nt, Staphylococcus aureus subsp. aureus MW2
uccgauuuuuucgc

SEQ ID NO: 2092327 - RNA, 19 nt, Staphylococcus aureus subsp. aureus MW2
uccgauuuugauauaaaaa

SEQ ID NO: 2092328 - RNA, 13 nt, Staphylococcus aureus subsp. aureus MW2
uccgcauaaauua

SEQ ID NO: 2092329 - RNA, 19 nt, Staphylococcus aureus subsp. aureus MW2
uccaucgucaucacuuuuu

SEQ ID NO: 2092330 - RNA, 22 nt, Staphylococcus aureus subsp. aureus MW2
uccaucgucaucacuuuuuaaa

SEQ ID NO: 2092331 - RNA, 20 nt, Staphylococcus aureus subsp. aureus MW2
uccauuagcuaauucacuuu

SEQ ID NO: 2092332 - RNA, 21 nt, Staphylococcus aureus subsp. aureus MW2
uccauuauaaagccugcaacc

SEQ ID NO: 2092333 - RNA, 22 nt, Staphylococcus aureus subsp. aureus MW2
uccauuagaacuaagaugugca

SEQ ID NO: 2092334 - RNA, 14 nt, Staphylococcus aureus subsp. aureus MW2
uccauggaauaaau

SEQ ID NO: 2092335 - RNA, 22 nt, Staphylococcus aureus subsp. aureus MW2
uccauggaauaaauuuauaacu

SEQ ID NO: 2092336 - RNA, 22 nt, Staphylococcus aureus subsp. aureus MW2
uccauucaauguuuaauuuucu

SEQ ID NO: 2092337 - RNA, 17 nt, Staphylococcus aureus subsp. aureus MW2
uccauucaauguuuaau

SEQ ID NO: 2092338 - RNA, 20 nt, Staphylococcus aureus subsp. aureus MW2
uccauugcacuaugcauaau

SEQ ID NO: 2092339 - RNA, 17 nt, Staphylococcus aureus subsp. aureus MW2
uccauucguauaagaau

SEQ ID NO: 2092340 - RNA, 15 nt, Staphylococcus aureus subsp. aureus MW2
ucccaacuuaauaac

SEQ ID NO: 2092341 - RNA, 17 nt, Staphylococcus aureus subsp. aureus MW2
ucccaccggacaaugua

SEQ ID NO: 2092342 - RNA, 14 nt, Staphylococcus aureus subsp. aureus MW2
uccaguuaauuauu

SEQ ID NO: 2092343 - RNA, 19 nt, Staphylococcus aureus subsp. aureus MW2
uccaguuaauuauuuagau

SEQ ID NO: 2092344 - RNA, 21 nt, Staphylococcus aureus subsp. aureus MW2
uccauacuucuauuuuauaau

SEQ ID NO: 2092345 - RNA, 17 nt, Staphylococcus aureus subsp. aureus MW2
uccauagaaauuguagu

SEQ ID NO: 2092346 - RNA, 20 nt, Staphylococcus aureus subsp. aureus MW2
uccauagaaauuguaguauu

SEQ ID NO: 2092347 - RNA, 17 nt, Staphylococcus aureus subsp. aureus MW2
uccauaguauguaucuu

SEQ ID NO: 2092348 - RNA, 17 nt, Staphylococcus aureus subsp. aureus MW2
uccaacucuaacagcuu

SEQ ID NO: 2092349 - RNA, 13 nt, Staphylococcus aureus subsp. aureus MW2
uccaacuuuaaau

SEQ ID NO: 2092350 - RNA, 17 nt, Staphylococcus aureus subsp. aureus MW2
uccaaauuggaaaucaa

SEQ ID NO: 2092351 - RNA, 15 nt, Staphylococcus aureus subsp. aureus MW2
uccaagugacaacau

SEQ ID NO: 2092352 - RNA, 19 nt, Staphylococcus aureus subsp. aureus MW2
uccaagugacaacauuauu

SEQ ID NO: 2092353 - RNA, 19 nt, Staphylococcus aureus subsp. aureus MW2
uccaauacuuuuuauauaa

SEQ ID NO: 2092354 - RNA, 23 nt, Staphylococcus aureus subsp. aureus MW2
uccaauacuuuuuauauaauucg

SEQ ID NO: 2092355 - RNA, 22 nt, Staphylococcus aureus subsp. aureus MW2
uccaaggauguuauaaaaugaa

SEQ ID NO: 2092356 - RNA, 19 nt, Staphylococcus aureus subsp. aureus MW2
uccaagucuaaaugcaaua

SEQ ID NO: 2092357 - RNA, 17 nt, Staphylococcus aureus subsp. aureus MW2
uccaaucuuuuuaauug

SEQ ID NO: 2092358 - RNA, 22 nt, Staphylococcus aureus subsp. aureus MW2
uccaaucuauuuuaaacucauc

SEQ ID NO: 2092359 - RNA, 24 nt, Staphylococcus aureus subsp. aureus MW2
uccaaugaugaauuguaaaaguga

SEQ ID NO: 2092360 - RNA, 20 nt, Staphylococcus aureus subsp. aureus MW2
uccaaucaucauuaaaucug

SEQ ID NO: 2092361 - RNA, 15 nt, Staphylococcus aureus subsp. aureus MW2
uccaauuauguuuau

SEQ ID NO: 2092362 - RNA, 15 nt, Staphylococcus aureus subsp. aureus MW2
uccaauuaccaauga

SEQ ID NO: 2092363 - RNA, 13 nt, Staphylococcus aureus subsp. aureus MW2
uccacacauuaag

SEQ ID NO: 2092364 - RNA, 20 nt, Staphylococcus aureus subsp. aureus MW2
ucauuuaacauguauuuagu

SEQ ID NO: 2092365 - RNA, 13 nt, Staphylococcus aureus subsp. aureus MW2
ucauuuaaauauu

SEQ ID NO: 2092366 - RNA, 12 nt, Staphylococcus aureus subsp. aureus MW2
ucauuuaaaaua

SEQ ID NO: 2092367 - RNA, 16 nt, Staphylococcus aureus subsp. aureus MW2
ucauuguuuuaaauuu

SEQ ID NO: 2092368 - RNA, 22 nt, Staphylococcus aureus subsp. aureus MW2
ucauuguguccauaaauauuaa

SEQ ID NO: 2092369 - RNA, 14 nt, Staphylococcus aureus subsp. aureus MW2
ucauuguauaaaaa

SEQ ID NO: 2092370 - RNA, 16 nt, Staphylococcus aureus subsp. aureus MW2
ucauuguauaaaaagu

SEQ ID NO: 2092371 - RNA, 19 nt, Staphylococcus aureus subsp. aureus MW2
ucauuucgauuaauuuaau

SEQ ID NO: 2092372 - RNA, 20 nt, Staphylococcus aureus subsp. aureus MW2
ucauuugaacaucauuuaau

SEQ ID NO: 2092373 - RNA, 22 nt, Staphylococcus aureus subsp. aureus MW2
ucauuuguacaaucaaaggcuu

SEQ ID NO: 2092374 - RNA, 15 nt, Staphylococcus aureus subsp. aureus MW2
uccaaagaaacggaa

SEQ ID NO: 2092375 - RNA, 22 nt, Staphylococcus aureus subsp. aureus MW2
ucauuuuuaauuuugacauaaa

SEQ ID NO: 2092376 - RNA, 13 nt, Staphylococcus aureus subsp. aureus MW2
uccaaacauagag

SEQ ID NO: 2092377 - RNA, 14 nt, Staphylococcus aureus subsp. aureus MW2
ucauuuucuugauu

SEQ ID NO: 2092378 - RNA, 17 nt, Staphylococcus aureus subsp. aureus MW2
ucauuuucuugauuuua

SEQ ID NO: 2092379 - RNA, 16 nt, Staphylococcus aureus subsp. aureus MW2
ucauuauaaugauuuu

SEQ ID NO: 2092380 - RNA, 15 nt, Staphylococcus aureus subsp. aureus MW2
ucauuaguguagaaa

SEQ ID NO: 2092381 - RNA, 18 nt, Staphylococcus aureus subsp. aureus MW2
ucauuagacuuucuuaau

SEQ ID NO: 2092382 - RNA, 18 nt, Staphylococcus aureus subsp. aureus MW2
ucauuagcgcaagagaua

SEQ ID NO: 2092383 - RNA, 14 nt, Staphylococcus aureus subsp. aureus MW2
ucauucagucaaac

SEQ ID NO: 2092384 - RNA, 22 nt, Staphylococcus aureus subsp. aureus MW2
ucauuccaaacacacuguugaa

SEQ ID NO: 2092385 - RNA, 20 nt, Staphylococcus aureus subsp. aureus MW2
ucauuagcgcaagagauaag

SEQ ID NO: 2092386 - RNA, 19 nt, Staphylococcus aureus subsp. aureus MW2
ucauuauauaauucuucaa

SEQ ID NO: 2092387 - RNA, 14 nt, Staphylococcus aureus subsp. aureus MW2
ucaguuaaaucuuu

SEQ ID NO: 2092388 - RNA, 16 nt, Staphylococcus aureus subsp. aureus MW2
ucaguugagucaauuu

SEQ ID NO: 2092389 - RNA, 22 nt, Staphylococcus aureus subsp. aureus MW2
ucaugugcaagcuuuuuaggaa

SEQ ID NO: 2092390 - RNA, 16 nt, Staphylococcus aureus subsp. aureus MW2
ucauguuuaaaauaaa

SEQ ID NO: 2092391 - RNA, 22 nt, Staphylococcus aureus subsp. aureus MW2
ucaugugcaagugguaaaaaug

SEQ ID NO: 2092392 - RNA, 15 nt, Staphylococcus aureus subsp. aureus MW2
ucauguuauguuuaa

SEQ ID NO: 2092393 - RNA, 11 nt, Staphylococcus aureus subsp. aureus MW2
ugauucccaaa

SEQ ID NO: 2092394 - RNA, 20 nt, Staphylococcus aureus subsp. aureus MW2
ugauuccaaguauuuucucu

SEQ ID NO: 2092395 - RNA, 17 nt, Staphylococcus aureus subsp. aureus MW2
ugaugaggcaauauuaa

SEQ ID NO: 2092396 - RNA, 14 nt, Staphylococcus aureus subsp. aureus MW2
ugaugauaaauuga

SEQ ID NO: 2092397 - RNA, 15 nt, Staphylococcus aureus subsp. aureus MW2
ugauuuaaaugcuuc

SEQ ID NO: 2092398 - RNA, 16 nt, Staphylococcus aureus subsp. aureus MW2
ugauuuaaaugcuucu

SEQ ID NO: 2092399 - RNA, 16 nt, Staphylococcus aureus subsp. aureus MW2
ugauuuaauuuuuaau

SEQ ID NO: 2092400 - RNA, 19 nt, Staphylococcus aureus subsp. aureus MW2
ugauuuaaaauauaaauuu

SEQ ID NO: 2092401 - RNA, 15 nt, Staphylococcus aureus subsp. aureus MW2
ugauuuaaaauauua

SEQ ID NO: 2092402 - RNA, 12 nt, Staphylococcus aureus subsp. aureus MW2
ugauuuaaaaaa

SEQ ID NO: 2092403 - RNA, 15 nt, Staphylococcus aureus subsp. aureus MW2
ugauuuuaauacuau

SEQ ID NO: 2092404 - RNA, 20 nt, Staphylococcus aureus subsp. aureus MW2
ugauuuuaccuguuucuaua

SEQ ID NO: 2092405 - RNA, 21 nt, Staphylococcus aureus subsp. aureus MW2
ugauuuuaccuguuucuauau

SEQ ID NO: 2092406 - RNA, 19 nt, Staphylococcus aureus subsp. aureus MW2
ugauuuagcauacauuaag

SEQ ID NO: 2092407 - RNA, 17 nt, Staphylococcus aureus subsp. aureus MW2
ugauugauaugguuaga

SEQ ID NO: 2092408 - RNA, 21 nt, Staphylococcus aureus subsp. aureus MW2
ugauugcauugauuucagcac

SEQ ID NO: 2092409 - RNA, 15 nt, Staphylococcus aureus subsp. aureus MW2
ugauuguuaauacaa

SEQ ID NO: 2092410 - RNA, 17 nt, Staphylococcus aureus subsp. aureus MW2
ugauuguucauguuuaa

SEQ ID NO: 2092411 - RNA, 12 nt, Staphylococcus aureus subsp. aureus MW2
ugcaaaauuaag

SEQ ID NO: 2092412 - RNA, 13 nt, Staphylococcus aureus subsp. aureus MW2
ugcaaaauuaaug

SEQ ID NO: 2092413 - RNA, 21 nt, Staphylococcus aureus subsp. aureus MW2
ugcaaaauuuugcaaaaaaau

SEQ ID NO: 2092414 - RNA, 22 nt, Staphylococcus aureus subsp. aureus MW2
ugcaaacgcguuauagauaagu

SEQ ID NO: 2092415 - RNA, 15 nt, Staphylococcus aureus subsp. aureus MW2
ugcaaacgauauguu

SEQ ID NO: 2092416 - RNA, 20 nt, Staphylococcus aureus subsp. aureus MW2
ugcaaacacaguacaaauaa

SEQ ID NO: 2092417 - RNA, 22 nt, Staphylococcus aureus subsp. aureus MW2
ugcaaauacgaguguuuuaauc

SEQ ID NO: 2092418 - RNA, 13 nt, Staphylococcus aureus subsp. aureus MW2
ugcaaauacgagu

SEQ ID NO: 2092419 - RNA, 16 nt, Staphylococcus aureus subsp. aureus MW2
ugcaaaucaaauacau

SEQ ID NO: 2092420 - RNA, 20 nt, Staphylococcus aureus subsp. aureus MW2
ugcaaagggcgaaauggauu

SEQ ID NO: 2092421 - RNA, 20 nt, Staphylococcus aureus subsp. aureus MW2
ugcaaaaauaauaugaauuu

SEQ ID NO: 2092422 - RNA, 16 nt, Staphylococcus aureus subsp. aureus MW2
ugauuuuuaauaauuu

SEQ ID NO: 2092423 - RNA, 22 nt, Staphylococcus aureus subsp. aureus MW2
ugauuuuuauuauugucaucau

SEQ ID NO: 2092424 - RNA, 12 nt, Staphylococcus aureus subsp. aureus MW2
ugauuuuuaaaa

SEQ ID NO: 2092425 - RNA, 14 nt, Staphylococcus aureus subsp. aureus MW2
ugauuuuuaauaau

SEQ ID NO: 2092426 - RNA, 18 nt, Staphylococcus aureus subsp. aureus MW2
ugauuuugcugccaaaaa

SEQ ID NO: 2092427 - RNA, 15 nt, Staphylococcus aureus subsp. aureus MW2
ugauuuugaauauaa

SEQ ID NO: 2092428 - RNA, 17 nt, Staphylococcus aureus subsp. aureus MW2
ugauuuuggaacauauu

SEQ ID NO: 2092429 - RNA, 14 nt, Staphylococcus aureus subsp. aureus MW2
ugauuuugaaucac

SEQ ID NO: 2092430 - RNA, 18 nt, Staphylococcus aureus subsp. aureus MW2
ugauuuuacuugaauaua

SEQ ID NO: 2092431 - RNA, 15 nt, Staphylococcus aureus subsp. aureus MW2
ugauuuucaauuucu

SEQ ID NO: 2092432 - RNA, 23 nt, Staphylococcus aureus subsp. aureus MW2
ugcaauaccuccccaacuuaaua

SEQ ID NO: 2092433 - RNA, 16 nt, Staphylococcus aureus subsp. aureus MW2
ugcaauaauucaucuu

SEQ ID NO: 2092434 - RNA, 18 nt, Staphylococcus aureus subsp. aureus MW2
ugcaauaauuacuaaccu

SEQ ID NO: 2092435 - RNA, 18 nt, Staphylococcus aureus subsp. aureus MW2
ugcaauacaccuauuaca

SEQ ID NO: 2092436 - RNA, 20 nt, Staphylococcus aureus subsp. aureus MW2
ugcaaguccaaauaauaucu

SEQ ID NO: 2092437 - RNA, 19 nt, Staphylococcus aureus subsp. aureus MW2
ugcaaguaauuuaauaggu

SEQ ID NO: 2092438 - RNA, 22 nt, Staphylococcus aureus subsp. aureus MW2
ugcaagucguucucuuaaauau

SEQ ID NO: 2092439 - RNA, 23 nt, Staphylococcus aureus subsp. aureus MW2
ugcaauaacaccaauugaauauu

SEQ ID NO: 2092440 - RNA, 22 nt, Staphylococcus aureus subsp. aureus MW2
ugcaaguuggcggggccccaac

SEQ ID NO: 2092441 - RNA, 17 nt, Staphylococcus aureus subsp. aureus MW2
ugcaaguuggggauggg

SEQ ID NO: 2092442 - RNA, 19 nt, Staphylococcus aureus subsp. aureus MW2
ugcaaguuggcggggcccc

SEQ ID NO: 2092443 - RNA, 19 nt, Staphylococcus aureus subsp. aureus MW2
ugcaauaacaccaauugaa

SEQ ID NO: 2092444 - RNA, 15 nt, Staphylococcus aureus subsp. aureus MW2
ugcaaucguauguaa

SEQ ID NO: 2092445 - RNA, 17 nt, Staphylococcus aureus subsp. aureus MW2
ugcaauggcuaaugacu

SEQ ID NO: 2092446 - RNA, 11 nt, Staphylococcus aureus subsp. aureus MW2
ugcaauuugua

SEQ ID NO: 2092447 - RNA, 18 nt, Staphylococcus aureus subsp. aureus MW2
ugcaauuuguaauacaag

SEQ ID NO: 2092448 - RNA, 20 nt, Staphylococcus aureus subsp. aureus MW2
ugcaauugccuuaucagcau

SEQ ID NO: 2092449 - RNA, 18 nt, Staphylococcus aureus subsp. aureus MW2
ugcaauugccuuaucagc

SEQ ID NO: 2092450 - RNA, 19 nt, Staphylococcus aureus subsp. aureus MW2
ugcaauuaauguaaugaua

SEQ ID NO: 2092451 - RNA, 17 nt, Staphylococcus aureus subsp. aureus MW2
ugcaacuugaucauuau

SEQ ID NO: 2092452 - RNA, 15 nt, Staphylococcus aureus subsp. aureus MW2
ugcaacuuauaauau

SEQ ID NO: 2092453 - RNA, 19 nt, Staphylococcus aureus subsp. aureus MW2
ugcaacuuauaauauuaaa

SEQ ID NO: 2092454 - RNA, 21 nt, Staphylococcus aureus subsp. aureus MW2
ugcaacgcaucacaaaauugu

SEQ ID NO: 2092455 - RNA, 20 nt, Staphylococcus aureus subsp. aureus MW2
ugcaacgaugcuacuuaaag

SEQ ID NO: 2092456 - RNA, 19 nt, Staphylococcus aureus subsp. aureus MW2
ugcaacuaauaugauuggu

SEQ ID NO: 2092457 - RNA, 16 nt, Staphylococcus aureus subsp. aureus MW2
ugcaagccaucaauau

SEQ ID NO: 2092458 - RNA, 16 nt, Staphylococcus aureus subsp. aureus MW2
ugcaaaugaaauucuu

SEQ ID NO: 2092459 - RNA, 20 nt, Staphylococcus aureus subsp. aureus MW2
ugcaaauuaucauuaaauug

SEQ ID NO: 2092460 - RNA, 16 nt, Staphylococcus aureus subsp. aureus MW2
ugcaaauuaucauuaa

SEQ ID NO: 2092461 - RNA, 14 nt, Staphylococcus aureus subsp. aureus MW2
ugcaaaugcucuaa

SEQ ID NO: 2092462 - RNA, 17 nt, Staphylococcus aureus subsp. aureus MW2
ugcaaaugcucuaacag

SEQ ID NO: 2092463 - RNA, 15 nt, Staphylococcus aureus subsp. aureus MW2
ugcaacccauguggu

SEQ ID NO: 2092464 - RNA, 19 nt, Staphylococcus aureus subsp. aureus MW2
ugcacuaugcauaauacca

SEQ ID NO: 2092465 - RNA, 16 nt, Staphylococcus aureus subsp. aureus MW2
ugcacugagcaacaaa

SEQ ID NO: 2092466 - RNA, 18 nt, Staphylococcus aureus subsp. aureus MW2
ugcacugcuaauauuaga

SEQ ID NO: 2092467 - RNA, 21 nt, Staphylococcus aureus subsp. aureus MW2
ugcaccuggucguacuuucaa

SEQ ID NO: 2092468 - RNA, 20 nt, Staphylococcus aureus subsp. aureus MW2
ugcacuaauggcacuuaaua

SEQ ID NO: 2092469 - RNA, 18 nt, Staphylococcus aureus subsp. aureus MW2
ugcacauuauuguaaccu

SEQ ID NO: 2092470 - RNA, 12 nt, Staphylococcus aureus subsp. aureus MW2
ugcacaacaguc

SEQ ID NO: 2092471 - RNA, 21 nt, Staphylococcus aureus subsp. aureus MW2
ugcauaaccaaguaauucuuu

SEQ ID NO: 2092472 - RNA, 19 nt, Staphylococcus aureus subsp. aureus MW2
ugcauaacgcacugcauua

SEQ ID NO: 2092473 - RNA, 13 nt, Staphylococcus aureus subsp. aureus MW2
ugcauaaaaaaag

SEQ ID NO: 2092474 - RNA, 19 nt, Staphylococcus aureus subsp. aureus MW2
ugcaguuuuaauuaaacug

SEQ ID NO: 2092475 - RNA, 22 nt, Staphylococcus aureus subsp. aureus MW2
ugcaguuucaaucgcauuuugu

SEQ ID NO: 2092476 - RNA, 23 nt, Staphylococcus aureus subsp. aureus MW2
ugcauagcgcucuggauuuuucu

SEQ ID NO: 2092477 - RNA, 13 nt, Staphylococcus aureus subsp. aureus MW2
ugcaucacagaua

SEQ ID NO: 2092478 - RNA, 22 nt, Staphylococcus aureus subsp. aureus MW2
ugcauaauuaggauuaacauaa

SEQ ID NO: 2092479 - RNA, 21 nt, Staphylococcus aureus subsp. aureus MW2
ugcagucauuugauuuaaaaa

SEQ ID NO: 2092480 - RNA, 16 nt, Staphylococcus aureus subsp. aureus MW2
ugccaauuaauucuuu

SEQ ID NO: 2092481 - RNA, 17 nt, Staphylococcus aureus subsp. aureus MW2
ugccaauuaauucuuug

SEQ ID NO: 2092482 - RNA, 17 nt, Staphylococcus aureus subsp. aureus MW2
ugcaucaguuaauaauu

SEQ ID NO: 2092483 - RNA, 17 nt, Staphylococcus aureus subsp. aureus MW2
ugcaucauaauuuccug

SEQ ID NO: 2092484 - RNA, 19 nt, Staphylococcus aureus subsp. aureus MW2
ugcaucauaauuuccugau

SEQ ID NO: 2092485 - RNA, 20 nt, Staphylococcus aureus subsp. aureus MW2
ugcauuauuauaauagcuuu

SEQ ID NO: 2092486 - RNA, 17 nt, Staphylococcus aureus subsp. aureus MW2
ugcauuacuaucuucau

SEQ ID NO: 2092487 - RNA, 22 nt, Staphylococcus aureus subsp. aureus MW2
ugcauugauuucagcaccgaca

SEQ ID NO: 2092488 - RNA, 18 nt, Staphylococcus aureus subsp. aureus MW2
ugcauugcuuuuguuaau

SEQ ID NO: 2092489 - RNA, 22 nt, Staphylococcus aureus subsp. aureus MW2
ugcauugcuuuuguuaauauug

SEQ ID NO: 2092490 - RNA, 17 nt, Staphylococcus aureus subsp. aureus MW2
ugagauaucuuauaaca

SEQ ID NO: 2092491 - RNA, 17 nt, Staphylococcus aureus subsp. aureus MW2
ugagauauauuaauauu

SEQ ID NO: 2092492 - RNA, 18 nt, Staphylococcus aureus subsp. aureus MW2
ugagauaaacgcacugcu

SEQ ID NO: 2092493 - RNA, 23 nt, Staphylococcus aureus subsp. aureus MW2
ugagcaacaaaagauguugcuag

SEQ ID NO: 2092494 - RNA, 14 nt, Staphylococcus aureus subsp. aureus MW2
ugagcaagucuucu

SEQ ID NO: 2092495 - RNA, 13 nt, Staphylococcus aureus subsp. aureus MW2
ugagcaaguuaua

SEQ ID NO: 2092496 - RNA, 15 nt, Staphylococcus aureus subsp. aureus MW2
ugagcguauuauuau

SEQ ID NO: 2092497 - RNA, 17 nt, Staphylococcus aureus subsp. aureus MW2
ugagcuaaccacaucau

SEQ ID NO: 2092498 - RNA, 14 nt, Staphylococcus aureus subsp. aureus MW2
ugagcuauucauag

SEQ ID NO: 2092499 - RNA, 19 nt, Staphylococcus aureus subsp. aureus MW2
ugaggcguuucagaaguug

SEQ ID NO: 2092500 - RNA, 16 nt, Staphylococcus aureus subsp. aureus MW2
ugagggacgucaucau

SEQ ID NO: 2092501 - RNA, 23 nt, Staphylococcus aureus subsp. aureus MW2
ugagucuuggacauuguaaaaug

SEQ ID NO: 2092502 - RNA, 18 nt, Staphylococcus aureus subsp. aureus MW2
ugaguuuuuuaaaauaau

SEQ ID NO: 2092503 - RNA, 15 nt, Staphylococcus aureus subsp. aureus MW2
ugaguuuuuuaaaau

SEQ ID NO: 2092504 - RNA, 15 nt, Staphylococcus aureus subsp. aureus MW2
ugauaacuuguaaua

SEQ ID NO: 2092505 - RNA, 19 nt, Staphylococcus aureus subsp. aureus MW2
ugauaagaagugcuuauga

SEQ ID NO: 2092506 - RNA, 13 nt, Staphylococcus aureus subsp. aureus MW2
ugauaaaauaaau

SEQ ID NO: 2092507 - RNA, 21 nt, Staphylococcus aureus subsp. aureus MW2
ugagugucaugcuuaauuuau

SEQ ID NO: 2092508 - RNA, 23 nt, Staphylococcus aureus subsp. aureus MW2
ugagugguuuucuuuauuuuaaa

SEQ ID NO: 2092509 - RNA, 18 nt, Staphylococcus aureus subsp. aureus MW2
ugaguguuucauaaucuc

SEQ ID NO: 2092510 - RNA, 17 nt, Staphylococcus aureus subsp. aureus MW2
ugaguguuuaugaaagu

SEQ ID NO: 2092511 - RNA, 17 nt, Staphylococcus aureus subsp. aureus MW2
ugauacgcuuuuuaaaa

SEQ ID NO: 2092512 - RNA, 22 nt, Staphylococcus aureus subsp. aureus MW2
ugauacgccuaaauauuuaccu

SEQ ID NO: 2092513 - RNA, 22 nt, Staphylococcus aureus subsp. aureus MW2
ugauacggaucauaaucauaaa

SEQ ID NO: 2092514 - RNA, 17 nt, Staphylococcus aureus subsp. aureus MW2
ugauacgcacguauaua

SEQ ID NO: 2092515 - RNA, 17 nt, Staphylococcus aureus subsp. aureus MW2
ugauacuucaccaucuu

SEQ ID NO: 2092516 - RNA, 17 nt, Staphylococcus aureus subsp. aureus MW2
ugauagacuaauuaucu

SEQ ID NO: 2092517 - RNA, 18 nt, Staphylococcus aureus subsp. aureus MW2
ugauacccgcgauacugc

SEQ ID NO: 2092518 - RNA, 16 nt, Staphylococcus aureus subsp. aureus MW2
ugauacccaauauuaa

SEQ ID NO: 2092519 - RNA, 20 nt, Staphylococcus aureus subsp. aureus MW2
ugauacccaauauuaaucca

SEQ ID NO: 2092520 - RNA, 22 nt, Staphylococcus aureus subsp. aureus MW2
ugauaauacuguuuaaauaaaa

SEQ ID NO: 2092521 - RNA, 20 nt, Staphylococcus aureus subsp. aureus MW2
ugauagcaaugaauuaauag

SEQ ID NO: 2092522 - RNA, 17 nt, Staphylococcus aureus subsp. aureus MW2
ugauagcaaugaauuaa

SEQ ID NO: 2092523 - RNA, 15 nt, Staphylococcus aureus subsp. aureus MW2
ugauagccaauauaa

SEQ ID NO: 2092524 - RNA, 21 nt, Staphylococcus aureus subsp. aureus MW2
ugauagccaauauaacaagcu

SEQ ID NO: 2092525 - RNA, 22 nt, Staphylococcus aureus subsp. aureus MW2
ugauagccaauauaacaagcua

SEQ ID NO: 2092526 - RNA, 22 nt, Staphylococcus aureus subsp. aureus MW2
ugauagcuaaacauuuuauacu

SEQ ID NO: 2092527 - RNA, 18 nt, Staphylococcus aureus subsp. aureus MW2
ugauagcuaaugcauuau

SEQ ID NO: 2092528 - RNA, 15 nt, Staphylococcus aureus subsp. aureus MW2
ugauaguacauuuau

SEQ ID NO: 2092529 - RNA, 14 nt, Staphylococcus aureus subsp. aureus MW2
ugauagugaauaau

SEQ ID NO: 2092530 - RNA, 19 nt, Staphylococcus aureus subsp. aureus MW2
ugauauacgacaaucacag

SEQ ID NO: 2092531 - RNA, 17 nt, Staphylococcus aureus subsp. aureus MW2
ugauauauaacaaguac

SEQ ID NO: 2092532 - RNA, 19 nt, Staphylococcus aureus subsp. aureus MW2
ugauauaaaaagugaaagu

SEQ ID NO: 2092533 - RNA, 15 nt, Staphylococcus aureus subsp. aureus MW2
ugauauauucaucuc

SEQ ID NO: 2092534 - RNA, 17 nt, Staphylococcus aureus subsp. aureus MW2
ugauauauaaccauagu

SEQ ID NO: 2092535 - RNA, 15 nt, Staphylococcus aureus subsp. aureus MW2
ugauauaugaaauau

SEQ ID NO: 2092536 - RNA, 18 nt, Staphylococcus aureus subsp. aureus MW2
ugaucgauuguuuauuag

SEQ ID NO: 2092537 - RNA, 20 nt, Staphylococcus aureus subsp. aureus MW2
ugaugaauuguuguacaugu

SEQ ID NO: 2092538 - RNA, 17 nt, Staphylococcus aureus subsp. aureus MW2
ugauccgauuaauugaa

SEQ ID NO: 2092539 - RNA, 16 nt, Staphylococcus aureus subsp. aureus MW2
ugaucauuauaaaaug

SEQ ID NO: 2092540 - RNA, 17 nt, Staphylococcus aureus subsp. aureus MW2
ugauauuaacuguacca

SEQ ID NO: 2092541 - RNA, 16 nt, Staphylococcus aureus subsp. aureus MW2
ugauauguuuccucuu

SEQ ID NO: 2092542 - RNA, 18 nt, Staphylococcus aureus subsp. aureus MW2
ugauaucugacauuucau

SEQ ID NO: 2092543 - RNA, 18 nt, Staphylococcus aureus subsp. aureus MW2
ugacguuuugguuguucu

SEQ ID NO: 2092544 - RNA, 12 nt, Staphylococcus aureus subsp. aureus MW2
ugacuauuuucc

SEQ ID NO: 2092545 - RNA, 18 nt, Staphylococcus aureus subsp. aureus MW2
ugacuagggguuuuuaau

SEQ ID NO: 2092546 - RNA, 16 nt, Staphylococcus aureus subsp. aureus MW2
ugacuagggguuuuua

SEQ ID NO: 2092547 - RNA, 13 nt, Staphylococcus aureus subsp. aureus MW2
ugacuagggguuu

SEQ ID NO: 2092548 - RNA, 22 nt, Staphylococcus aureus subsp. aureus MW2
ugacuacucaauccuaaauuau

SEQ ID NO: 2092549 - RNA, 22 nt, Staphylococcus aureus subsp. aureus MW2
ugacuuaauaucauauucaaaa

SEQ ID NO: 2092550 - RNA, 12 nt, Staphylococcus aureus subsp. aureus MW2
ugacugagaaaa

SEQ ID NO: 2092551 - RNA, 16 nt, Staphylococcus aureus subsp. aureus MW2
ugacugaauuaauauc

SEQ ID NO: 2092552 - RNA, 16 nt, Staphylococcus aureus subsp. aureus MW2
ugacuucuuuauauuu

SEQ ID NO: 2092553 - RNA, 15 nt, Staphylococcus aureus subsp. aureus MW2
ugacuucguuuuacc

SEQ ID NO: 2092554 - RNA, 15 nt, Staphylococcus aureus subsp. aureus MW2
ugacuuccuuaguca

SEQ ID NO: 2092555 - RNA, 18 nt, Staphylococcus aureus subsp. aureus MW2
ugacugaacgaaaaugcg

SEQ ID NO: 2092556 - RNA, 14 nt, Staphylococcus aureus subsp. aureus MW2
ugacucuuuucugc

SEQ ID NO: 2092557 - RNA, 20 nt, Staphylococcus aureus subsp. aureus MW2
ugagaaagguacguuguaau

SEQ ID NO: 2092558 - RNA, 15 nt, Staphylococcus aureus subsp. aureus MW2
ugagacuauuauaau

SEQ ID NO: 2092559 - RNA, 13 nt, Staphylococcus aureus subsp. aureus MW2
ugagacgcauugc

SEQ ID NO: 2092560 - RNA, 16 nt, Staphylococcus aureus subsp. aureus MW2
ugagagauuauuuaaa

SEQ ID NO: 2092561 - RNA, 23 nt, Staphylococcus aureus subsp. aureus MW2
ugagauaaaaucauaugucuuaa

SEQ ID NO: 2092562 - RNA, 12 nt, Staphylococcus aureus subsp. aureus MW2
ugagauaaaauc

SEQ ID NO: 2092563 - RNA, 17 nt, Staphylococcus aureus subsp. aureus MW2
ugacgaucuucaugaac

SEQ ID NO: 2092564 - RNA, 21 nt, Staphylococcus aureus subsp. aureus MW2
ugacgcgugaauuaaaaaaug

SEQ ID NO: 2092565 - RNA, 16 nt, Staphylococcus aureus subsp. aureus MW2
ugacgcggguaauauu

SEQ ID NO: 2092566 - RNA, 17 nt, Staphylococcus aureus subsp. aureus MW2
ugacgauaaugaaauac

SEQ ID NO: 2092567 - RNA, 15 nt, Staphylococcus aureus subsp. aureus MW2
ugaccaccacuuuca

SEQ ID NO: 2092568 - RNA, 15 nt, Staphylococcus aureus subsp. aureus MW2
ugacaucguugcuuu

SEQ ID NO: 2092569 - RNA, 15 nt, Staphylococcus aureus subsp. aureus MW2
ugacaucuucguaug

SEQ ID NO: 2092570 - RNA, 16 nt, Staphylococcus aureus subsp. aureus MW2
ugacauggaaaauaua

SEQ ID NO: 2092571 - RNA, 12 nt, Staphylococcus aureus subsp. aureus MW2
ugaauaaauuga

SEQ ID NO: 2092572 - RNA, 12 nt, Staphylococcus aureus subsp. aureus MW2
ugaauaaauugu

SEQ ID NO: 2092573 - RNA, 21 nt, Staphylococcus aureus subsp. aureus MW2
ugaauaaauuuuauucuucag

SEQ ID NO: 2092574 - RNA, 14 nt, Staphylococcus aureus subsp. aureus MW2
ugaauaaauaacuu

SEQ ID NO: 2092575 - RNA, 13 nt, Staphylococcus aureus subsp. aureus MW2
ugaauaaauacaa

SEQ ID NO: 2092576 - RNA, 19 nt, Staphylococcus aureus subsp. aureus MW2
ugaccaacagcuucaacac

SEQ ID NO: 2092577 - RNA, 13 nt, Staphylococcus aureus subsp. aureus MW2
ugacauuuaaaga

SEQ ID NO: 2092578 - RNA, 15 nt, Staphylococcus aureus subsp. aureus MW2
ugacauuuaaagauu

SEQ ID NO: 2092579 - RNA, 20 nt, Staphylococcus aureus subsp. aureus MW2
ugacauuucaucaauaauuu

SEQ ID NO: 2092580 - RNA, 19 nt, Staphylococcus aureus subsp. aureus MW2
ugacauguguuaaaccaac

SEQ ID NO: 2092581 - RNA, 17 nt, Staphylococcus aureus subsp. aureus MW2
ucugacuuuuaaaaaac

SEQ ID NO: 2092582 - RNA, 12 nt, Staphylococcus aureus subsp. aureus MW2
ucugaauuuagg

SEQ ID NO: 2092583 - RNA, 15 nt, Staphylococcus aureus subsp. aureus MW2
ucucuuucuuauuca

SEQ ID NO: 2092584 - RNA, 17 nt, Staphylococcus aureus subsp. aureus MW2
ucugaaaaacuucuuaa

SEQ ID NO: 2092585 - RNA, 14 nt, Staphylococcus aureus subsp. aureus MW2
ucucuuuucacgaa

SEQ ID NO: 2092586 - RNA, 16 nt, Staphylococcus aureus subsp. aureus MW2
ucucuuuugauaaauu

SEQ ID NO: 2092587 - RNA, 20 nt, Staphylococcus aureus subsp. aureus MW2
ucugaacauaaaaaaauacu

SEQ ID NO: 2092588 - RNA, 15 nt, Staphylococcus aureus subsp. aureus MW2
ucugaaaaauauuua

SEQ ID NO: 2092589 - RNA, 18 nt, Staphylococcus aureus subsp. aureus MW2
ucucuuauuuuaaaauau

SEQ ID NO: 2092590 - RNA, 14 nt, Staphylococcus aureus subsp. aureus MW2
aaaugcuaaaagua

SEQ ID NO: 2092591 - RNA, 14 nt, Staphylococcus aureus subsp. aureus MW2
ucucuaguaucuga

SEQ ID NO: 2092592 - RNA, 14 nt, Staphylococcus aureus subsp. aureus MW2
ucucuauacccuuu

SEQ ID NO: 2092593 - RNA, 19 nt, Staphylococcus aureus subsp. aureus MW2
ucucuuaaauaugaauaau

SEQ ID NO: 2092594 - RNA, 22 nt, Staphylococcus aureus subsp. aureus MW2
ucgcauucuugguuuuuuagau

SEQ ID NO: 2092595 - RNA, 18 nt, Staphylococcus aureus subsp. aureus MW2
ucgcaucuuuguuuucaa

SEQ ID NO: 2092596 - RNA, 19 nt, Staphylococcus aureus subsp. aureus MW2
ucgcaucuuuguuuucaaa

SEQ ID NO: 2092597 - RNA, 16 nt, Staphylococcus aureus subsp. aureus MW2
ucugcuaaucuucuca

SEQ ID NO: 2092598 - RNA, 21 nt, Staphylococcus aureus subsp. aureus MW2
ucugcuaaucuucucauaaaa

SEQ ID NO: 2092599 - RNA, 14 nt, Staphylococcus aureus subsp. aureus MW2
ucugcuauuuuuuu

SEQ ID NO: 2092600 - RNA, 17 nt, Staphylococcus aureus subsp. aureus MW2
ucugcuauuuuuuuaau

SEQ ID NO: 2092601 - RNA, 20 nt, Staphylococcus aureus subsp. aureus MW2
ucuggagacgaaccauuucc

SEQ ID NO: 2092602 - RNA, 17 nt, Staphylococcus aureus subsp. aureus MW2
ucuggaacaauaaucaa

SEQ ID NO: 2092603 - RNA, 13 nt, Staphylococcus aureus subsp. aureus MW2
ucugcgaaaugca

SEQ ID NO: 2092604 - RNA, 15 nt, Staphylococcus aureus subsp. aureus MW2
ucugccguguuuugu

SEQ ID NO: 2092605 - RNA, 15 nt, Staphylococcus aureus subsp. aureus MW2
ucuuaaacauaacau

SEQ ID NO: 2092606 - RNA, 21 nt, Staphylococcus aureus subsp. aureus MW2
ucuuaaaucacuagcuaaugc

SEQ ID NO: 2092607 - RNA, 18 nt, Staphylococcus aureus subsp. aureus MW2
ucuuaaacgcucuucuuc

SEQ ID NO: 2092608 - RNA, 14 nt, Staphylococcus aureus subsp. aureus MW2
ucuuaacaacauga

SEQ ID NO: 2092609 - RNA, 15 nt, Staphylococcus aureus subsp. aureus MW2
ucuuaacaauaucau

SEQ ID NO: 2092610 - RNA, 17 nt, Staphylococcus aureus subsp. aureus MW2
ucuuaacaauuuuaauu

SEQ ID NO: 2092611 - RNA, 14 nt, Staphylococcus aureus subsp. aureus MW2
ucugguaaugcuug

SEQ ID NO: 2092612 - RNA, 14 nt, Staphylococcus aureus subsp. aureus MW2
ucuuaauauuuauu

SEQ ID NO: 2092613 - RNA, 14 nt, Staphylococcus aureus subsp. aureus MW2
ucuuaauguacuuu

SEQ ID NO: 2092614 - RNA, 21 nt, Staphylococcus aureus subsp. aureus MW2
ucuuaaucgagugauucagga

SEQ ID NO: 2092615 - RNA, 14 nt, Staphylococcus aureus subsp. aureus MW2
ucuuaauucuucug

SEQ ID NO: 2092616 - RNA, 13 nt, Staphylococcus aureus subsp. aureus MW2
ucuuaauucuucu

SEQ ID NO: 2092617 - RNA, 24 nt, Staphylococcus aureus subsp. aureus MW2
ucuuaauucauuccaaacacacug

SEQ ID NO: 2092618 - RNA, 14 nt, Staphylococcus aureus subsp. aureus MW2
ucuuaauuuaaaaa

SEQ ID NO: 2092619 - RNA, 20 nt, Staphylococcus aureus subsp. aureus MW2
ucuuacugcuguucucuauu

SEQ ID NO: 2092620 - RNA, 20 nt, Staphylococcus aureus subsp. aureus MW2
ucuuacuucguacaucguug

SEQ ID NO: 2092621 - RNA, 23 nt, Staphylococcus aureus subsp. aureus MW2
ucuuaugauagagagcauaguuu

SEQ ID NO: 2092622 - RNA, 15 nt, Staphylococcus aureus subsp. aureus MW2
ucuuaggcaauguaa

SEQ ID NO: 2092623 - RNA, 13 nt, Staphylococcus aureus subsp. aureus MW2
ucuuccgcacugc

SEQ ID NO: 2092624 - RNA, 17 nt, Staphylococcus aureus subsp. aureus MW2
ucuucaucuucuucaaa

SEQ ID NO: 2092625 - RNA, 12 nt, Staphylococcus aureus subsp. aureus MW2
ucuucaucuucu

SEQ ID NO: 2092626 - RNA, 14 nt, Staphylococcus aureus subsp. aureus MW2
ucuucaugaacagc

SEQ ID NO: 2092627 - RNA, 15 nt, Staphylococcus aureus subsp. aureus MW2
ucuucauuaucaaua

SEQ ID NO: 2092628 - RNA, 18 nt, Staphylococcus aureus subsp. aureus MW2
ucuucauuaacaucaugu

SEQ ID NO: 2092629 - RNA, 19 nt, Staphylococcus aureus subsp. aureus MW2
ucuucauuaacaucauguc

SEQ ID NO: 2092630 - RNA, 19 nt, Staphylococcus aureus subsp. aureus MW2
ucuucaucaugacuauuuu

SEQ ID NO: 2092631 - RNA, 23 nt, Staphylococcus aureus subsp. aureus MW2
ucuucaucaugacuauuuuccau

SEQ ID NO: 2092632 - RNA, 20 nt, Staphylococcus aureus subsp. aureus MW2
ucuucaucauuguaaaacaa

SEQ ID NO: 2092633 - RNA, 14 nt, Staphylococcus aureus subsp. aureus MW2
ucuucaucuaaaaa

SEQ ID NO: 2092634 - RNA, 19 nt, Staphylococcus aureus subsp. aureus MW2
ucuuauuuguaauuucagc

SEQ ID NO: 2092635 - RNA, 20 nt, Staphylococcus aureus subsp. aureus MW2
ucuuauuuuguuuuaaaaaa

SEQ ID NO: 2092636 - RNA, 19 nt, Staphylococcus aureus subsp. aureus MW2
ucuuauuuguuuaauuauc

SEQ ID NO: 2092637 - RNA, 19 nt, Staphylococcus aureus subsp. aureus MW2
ucuuauuuuaaaauauuaa

SEQ ID NO: 2092638 - RNA, 17 nt, Staphylococcus aureus subsp. aureus MW2
ucuucagaaccuugaau

SEQ ID NO: 2092639 - RNA, 16 nt, Staphylococcus aureus subsp. aureus MW2
ucuucaacaauuucaa

SEQ ID NO: 2092640 - RNA, 17 nt, Staphylococcus aureus subsp. aureus MW2
ucuucagguguuuuacc

SEQ ID NO: 2092641 - RNA, 19 nt, Staphylococcus aureus subsp. aureus MW2
ucuucagguguuuuaccuu

SEQ ID NO: 2092642 - RNA, 19 nt, Staphylococcus aureus subsp. aureus MW2
ucuucaguuaaaucuuuaa

SEQ ID NO: 2092643 - RNA, 17 nt, Staphylococcus aureus subsp. aureus MW2
ucuucugcauagcgcuc

SEQ ID NO: 2092644 - RNA, 13 nt, Staphylococcus aureus subsp. aureus MW2
ucuucuucaucau

SEQ ID NO: 2092645 - RNA, 14 nt, Staphylococcus aureus subsp. aureus MW2
ucuucuucaucaua

SEQ ID NO: 2092646 - RNA, 20 nt, Staphylococcus aureus subsp. aureus MW2
ucuucuaguaauucuucauc

SEQ ID NO: 2092647 - RNA, 20 nt, Staphylococcus aureus subsp. aureus MW2
ucuucuauuaaacauuuuug

SEQ ID NO: 2092648 - RNA, 14 nt, Staphylococcus aureus subsp. aureus MW2
ucuucuaucuuuuc

SEQ ID NO: 2092649 - RNA, 15 nt, Staphylococcus aureus subsp. aureus MW2
ucuucucauaaaaua

SEQ ID NO: 2092650 - RNA, 17 nt, Staphylococcus aureus subsp. aureus MW2
ucuucuaauucugaaau

SEQ ID NO: 2092651 - RNA, 20 nt, Staphylococcus aureus subsp. aureus MW2
ucuucuaauuuaguuuuaau

SEQ ID NO: 2092652 - RNA, 13 nt, Staphylococcus aureus subsp. aureus MW2
ucuucuaauucug

SEQ ID NO: 2092653 - RNA, 20 nt, Staphylococcus aureus subsp. aureus MW2
ucuucuaaguuauuacaacc

SEQ ID NO: 2092654 - RNA, 16 nt, Staphylococcus aureus subsp. aureus MW2
ucuucuaaaucaauau

SEQ ID NO: 2092655 - RNA, 20 nt, Staphylococcus aureus subsp. aureus MW2
ucuugagcuguuacacuuuu

SEQ ID NO: 2092656 - RNA, 15 nt, Staphylococcus aureus subsp. aureus MW2
ucuugaauaaauuuu

SEQ ID NO: 2092657 - RNA, 15 nt, Staphylococcus aureus subsp. aureus MW2
ucuugaaauaaacau

SEQ ID NO: 2092658 - RNA, 23 nt, Staphylococcus aureus subsp. aureus MW2
ucuugaaauaaacauaucaucau

SEQ ID NO: 2092659 - RNA, 12 nt, Staphylococcus aureus subsp. aureus MW2
ucuucuuuuaau

SEQ ID NO: 2092660 - RNA, 15 nt, Staphylococcus aureus subsp. aureus MW2
ucuucuuuagcuauu

SEQ ID NO: 2092661 - RNA, 16 nt, Staphylococcus aureus subsp. aureus MW2
ucuugaugauauucau

SEQ ID NO: 2092662 - RNA, 14 nt, Staphylococcus aureus subsp. aureus MW2
ucuugauaaaauaa

SEQ ID NO: 2092663 - RNA, 16 nt, Staphylococcus aureus subsp. aureus MW2
ucuugauaaaauaaau

SEQ ID NO: 2092664 - RNA, 19 nt, Staphylococcus aureus subsp. aureus MW2
ucuugauuauauuuuucuu

SEQ ID NO: 2092665 - RNA, 15 nt, Staphylococcus aureus subsp. aureus MW2
ucuugauuauauuuu

SEQ ID NO: 2092666 - RNA, 23 nt, Staphylococcus aureus subsp. aureus MW2
ucuugauuggcacagucaaugac

SEQ ID NO: 2092667 - RNA, 15 nt, Staphylococcus aureus subsp. aureus MW2
ucuugcaaguauuuu

SEQ ID NO: 2092668 - RNA, 16 nt, Staphylococcus aureus subsp. aureus MW2
ucuugcaauagcaaca

SEQ ID NO: 2092669 - RNA, 22 nt, Staphylococcus aureus subsp. aureus MW2
ucuugcauacgaauuaaaauaa

SEQ ID NO: 2092670 - RNA, 15 nt, Staphylococcus aureus subsp. aureus MW2
ucuuuaaugaaagca

SEQ ID NO: 2092671 - RNA, 17 nt, Staphylococcus aureus subsp. aureus MW2
ucuuuaaucuaccaaua

SEQ ID NO: 2092672 - RNA, 18 nt, Staphylococcus aureus subsp. aureus MW2
ucuuuaaucuaccaauac

SEQ ID NO: 2092673 - RNA, 16 nt, Staphylococcus aureus subsp. aureus MW2
ucuuuaauuaaaucuu

SEQ ID NO: 2092674 - RNA, 16 nt, Staphylococcus aureus subsp. aureus MW2
ucuuuaauuuauuuau

SEQ ID NO: 2092675 - RNA, 16 nt, Staphylococcus aureus subsp. aureus MW2
ucuuuaccauauaauu

SEQ ID NO: 2092676 - RNA, 17 nt, Staphylococcus aureus subsp. aureus MW2
ucuuuagcuauuuaaaa

SEQ ID NO: 2092677 - RNA, 21 nt, Staphylococcus aureus subsp. aureus MW2
ucuuuagcaaaacgcauuuca

SEQ ID NO: 2092678 - RNA, 18 nt, Staphylococcus aureus subsp. aureus MW2
ucuuuacuuguaauuaau

SEQ ID NO: 2092679 - RNA, 20 nt, Staphylococcus aureus subsp. aureus MW2
ucuuuacuuguaauuaauac

SEQ ID NO: 2092680 - RNA, 16 nt, Staphylococcus aureus subsp. aureus MW2
ucuuuauuuuaaacau

SEQ ID NO: 2092681 - RNA, 15 nt, Staphylococcus aureus subsp. aureus MW2
ucuuucaaaugcuua

SEQ ID NO: 2092682 - RNA, 22 nt, Staphylococcus aureus subsp. aureus MW2
ucuuucaauuaauuuaaaugcu

SEQ ID NO: 2092683 - RNA, 17 nt, Staphylococcus aureus subsp. aureus MW2
ucuuucaacaaaaugcg

SEQ ID NO: 2092684 - RNA, 16 nt, Staphylococcus aureus subsp. aureus MW2
ucuuuauuaauaaauu

SEQ ID NO: 2092685 - RNA, 23 nt, Staphylococcus aureus subsp. aureus MW2
ucuuuauugggagcaaucaauac

SEQ ID NO: 2092686 - RNA, 13 nt, Staphylococcus aureus subsp. aureus MW2
ucuuuauuuacaa

SEQ ID NO: 2092687 - RNA, 13 nt, Staphylococcus aureus subsp. aureus MW2
ucuuuauguuggg

SEQ ID NO: 2092688 - RNA, 13 nt, Staphylococcus aureus subsp. aureus MW2
ucuuuauuaauaa

SEQ ID NO: 2092689 - RNA, 15 nt, Staphylococcus aureus subsp. aureus MW2
ucuuuauuaauaaau

SEQ ID NO: 2092690 - RNA, 16 nt, Staphylococcus aureus subsp. aureus MW2
ucuuuauacacaaagu

SEQ ID NO: 2092691 - RNA, 17 nt, Staphylococcus aureus subsp. aureus MW2
ucuuuauacacaaagua

SEQ ID NO: 2092692 - RNA, 16 nt, Staphylococcus aureus subsp. aureus MW2
ucuuuaucaagggcuc

SEQ ID NO: 2092693 - RNA, 18 nt, Staphylococcus aureus subsp. aureus MW2
ucuugugauaauucuuca

SEQ ID NO: 2092694 - RNA, 21 nt, Staphylococcus aureus subsp. aureus MW2
ucuuguucaaguaaucauuuu

SEQ ID NO: 2092695 - RNA, 17 nt, Staphylococcus aureus subsp. aureus MW2
ucuuguuucaaacaaag

SEQ ID NO: 2092696 - RNA, 16 nt, Staphylococcus aureus subsp. aureus MW2
ucuuguuggauuuuaa

SEQ ID NO: 2092697 - RNA, 17 nt, Staphylococcus aureus subsp. aureus MW2
ucuuuaacuuuaauuaa

SEQ ID NO: 2092698 - RNA, 19 nt, Staphylococcus aureus subsp. aureus MW2
ucuuuaagcccuuccccua

SEQ ID NO: 2092699 - RNA, 19 nt, Staphylococcus aureus subsp. aureus MW2
ucuuuaacucuugaaacac

SEQ ID NO: 2092700 - RNA, 23 nt, Staphylococcus aureus subsp. aureus MW2
ucuuuaacauuuauuuuuucucu

SEQ ID NO: 2092701 - RNA, 19 nt, Staphylococcus aureus subsp. aureus MW2
ucuuuaagcuuucuaucuu

SEQ ID NO: 2092702 - RNA, 14 nt, Staphylococcus aureus subsp. aureus MW2
ucuuuaaaaaagga

SEQ ID NO: 2092703 - RNA, 19 nt, Staphylococcus aureus subsp. aureus MW2
ucuuuaaagaaaauuucag

SEQ ID NO: 2092704 - RNA, 21 nt, Staphylococcus aureus subsp. aureus MW2
ucuuuaaagaaaauuucagua

SEQ ID NO: 2092705 - RNA, 18 nt, Staphylococcus aureus subsp. aureus MW2
ucuuuaaagcuaaauguu

SEQ ID NO: 2092706 - RNA, 17 nt, Staphylococcus aureus subsp. aureus MW2
ucuuuaaauauacuucu

SEQ ID NO: 2092707 - RNA, 20 nt, Staphylococcus aureus subsp. aureus MW2
ucuugucauuucaaucauuu

SEQ ID NO: 2092708 - RNA, 22 nt, Staphylococcus aureus subsp. aureus MW2
ucuugguucagcuuuacguucu

SEQ ID NO: 2092709 - RNA, 15 nt, Staphylococcus aureus subsp. aureus MW2
ucuuguaaacuucuu

SEQ ID NO: 2092710 - RNA, 22 nt, Staphylococcus aureus subsp. aureus MW2
ucuugguauuuuuuaaaugcga

SEQ ID NO: 2092711 - RNA, 17 nt, Staphylococcus aureus subsp. aureus MW2
ucuuggauguuuucguu

SEQ ID NO: 2092712 - RNA, 16 nt, Staphylococcus aureus subsp. aureus MW2
ucuuggacauuguaaa

SEQ ID NO: 2092713 - RNA, 16 nt, Staphylococcus aureus subsp. aureus MW2
ucuugcuuaucuaugu

SEQ ID NO: 2092714 - RNA, 19 nt, Staphylococcus aureus subsp. aureus MW2
ucuuugaacauauuauaaa

SEQ ID NO: 2092715 - RNA, 13 nt, Staphylococcus aureus subsp. aureus MW2
ucuuugacaugug

SEQ ID NO: 2092716 - RNA, 22 nt, Staphylococcus aureus subsp. aureus MW2
ucuuucuuagugaaucuucuaa

SEQ ID NO: 2092717 - RNA, 13 nt, Staphylococcus aureus subsp. aureus MW2
ucuuucuuuucug

SEQ ID NO: 2092718 - RNA, 18 nt, Staphylococcus aureus subsp. aureus MW2
ucuuucuuuuuuacauuu

SEQ ID NO: 2092719 - RNA, 21 nt, Staphylococcus aureus subsp. aureus MW2
ucuuucgucuuguaaacuucu

SEQ ID NO: 2092720 - RNA, 16 nt, Staphylococcus aureus subsp. aureus MW2
ucuuucuaaguuugaa

SEQ ID NO: 2092721 - RNA, 18 nt, Staphylococcus aureus subsp. aureus MW2
ucuuuccucguauuuuau

SEQ ID NO: 2092722 - RNA, 23 nt, Staphylococcus aureus subsp. aureus MW2
ucuuuccgccagucaucaucaug

SEQ ID NO: 2092723 - RNA, 19 nt, Staphylococcus aureus subsp. aureus MW2
ucuuucagcuaauucgucu

SEQ ID NO: 2092724 - RNA, 14 nt, Staphylococcus aureus subsp. aureus MW2
ucuuucauaaauug

SEQ ID NO: 2092725 - RNA, 18 nt, Staphylococcus aureus subsp. aureus MW2
ucuuuucgaaauucucug

SEQ ID NO: 2092726 - RNA, 15 nt, Staphylococcus aureus subsp. aureus MW2
ucuuuucauuaucau

SEQ ID NO: 2092727 - RNA, 15 nt, Staphylococcus aureus subsp. aureus MW2
ucuuuuauuuucaua

SEQ ID NO: 2092728 - RNA, 18 nt, Staphylococcus aureus subsp. aureus MW2
ucuuuucacgaauaucuu

SEQ ID NO: 2092729 - RNA, 17 nt, Staphylococcus aureus subsp. aureus MW2
ucuuuuauauuuuuauc

SEQ ID NO: 2092730 - RNA, 17 nt, Staphylococcus aureus subsp. aureus MW2
ucuuuucaaaaauaguc

SEQ ID NO: 2092731 - RNA, 15 nt, Staphylococcus aureus subsp. aureus MW2
ucuuuuauacaugua

SEQ ID NO: 2092732 - RNA, 13 nt, Staphylococcus aureus subsp. aureus MW2
ucuuuuauauuuu

SEQ ID NO: 2092733 - RNA, 18 nt, Staphylococcus aureus subsp. aureus MW2
ucuuuuaauagaucuuug

SEQ ID NO: 2092734 - RNA, 14 nt, Staphylococcus aureus subsp. aureus MW2
ucuuuuaauguuuu

SEQ ID NO: 2092735 - RNA, 19 nt, Staphylococcus aureus subsp. aureus MW2
ucuuuguuuuuaauuuuua

SEQ ID NO: 2092736 - RNA, 18 nt, Staphylococcus aureus subsp. aureus MW2
ucuuuguuuuuaauuuuu

SEQ ID NO: 2092737 - RNA, 15 nt, Staphylococcus aureus subsp. aureus MW2
ucuuuggugaaagua

SEQ ID NO: 2092738 - RNA, 16 nt, Staphylococcus aureus subsp. aureus MW2
ucuuuguuuuuaauuu

SEQ ID NO: 2092739 - RNA, 13 nt, Staphylococcus aureus subsp. aureus MW2
ucuuuguaaauuu

SEQ ID NO: 2092740 - RNA, 14 nt, Staphylococcus aureus subsp. aureus MW2
ucuuuguaaauuuu

SEQ ID NO: 2092741 - RNA, 17 nt, Staphylococcus aureus subsp. aureus MW2
ucuuuguauaccuauuc

SEQ ID NO: 2092742 - RNA, 17 nt, Staphylococcus aureus subsp. aureus MW2
ucuuuggucuaaagcuu

SEQ ID NO: 2092743 - RNA, 19 nt, Staphylococcus aureus subsp. aureus MW2
ucuuugucaucuuuugucu

SEQ ID NO: 2092744 - RNA, 18 nt, Staphylococcus aureus subsp. aureus MW2
ucuuuguguuugcuuuua

SEQ ID NO: 2092745 - RNA, 19 nt, Staphylococcus aureus subsp. aureus MW2
ucuuuguguuugcuuuuau

SEQ ID NO: 2092746 - RNA, 15 nt, Staphylococcus aureus subsp. aureus MW2
ucuuuuguuuuuaua

SEQ ID NO: 2092747 - RNA, 14 nt, Staphylococcus aureus subsp. aureus MW2
ucuuuuuaauauuu

SEQ ID NO: 2092748 - RNA, 18 nt, Staphylococcus aureus subsp. aureus MW2
ucuuuugaaucuuguuga

SEQ ID NO: 2092749 - RNA, 20 nt, Staphylococcus aureus subsp. aureus MW2
ucuuuuuguuguuuuaauuu

SEQ ID NO: 2092750 - RNA, 11 nt, Staphylococcus aureus subsp. aureus MW2
ucuuuuuguuu

SEQ ID NO: 2092751 - RNA, 13 nt, Staphylococcus aureus subsp. aureus MW2
ucuuuuuuaaaga

SEQ ID NO: 2092752 - RNA, 16 nt, Staphylococcus aureus subsp. aureus MW2
ucuuuuuuacauuuaa

SEQ ID NO: 2092753 - RNA, 21 nt, Staphylococcus aureus subsp. aureus MW2
ucuuuuugcguuuuuaaauaa

SEQ ID NO: 2092754 - RNA, 18 nt, Staphylococcus aureus subsp. aureus MW2
ucuuuuugcguuuuuaaa

SEQ ID NO: 2092755 - RNA, 15 nt, Staphylococcus aureus subsp. aureus MW2
ucuuuuucuaaauaa

SEQ ID NO: 2092756 - RNA, 22 nt, Staphylococcus aureus subsp. aureus MW2
ucuuuuuauuuauaacuuuaaa

SEQ ID NO: 2092757 - RNA, 15 nt, Staphylococcus aureus subsp. aureus MW2
ucuuuuuauuuacuc

SEQ ID NO: 2092758 - RNA, 13 nt, Staphylococcus aureus subsp. aureus MW2
ucuuuuuauuuau

SEQ ID NO: 2092759 - RNA, 12 nt, Staphylococcus aureus subsp. aureus MW2
ucuuuuucacua

SEQ ID NO: 2092760 - RNA, 19 nt, Staphylococcus aureus subsp. aureus MW2
ucuuuuucagcuaauuguc

SEQ ID NO: 2092761 - RNA, 13 nt, Staphylococcus aureus subsp. aureus MW2
ugaacauaaaaaa

SEQ ID NO: 2092762 - RNA, 21 nt, Staphylococcus aureus subsp. aureus MW2
ugaacauaccugcauaugugu

SEQ ID NO: 2092763 - RNA, 19 nt, Staphylococcus aureus subsp. aureus MW2
ugaaaucuauugugauaua

SEQ ID NO: 2092764 - RNA, 22 nt, Staphylococcus aureus subsp. aureus MW2
ugaaaugaaguauggaaguugu

SEQ ID NO: 2092765 - RNA, 13 nt, Staphylococcus aureus subsp. aureus MW2
ugaacuaaaacaa

SEQ ID NO: 2092766 - RNA, 15 nt, Staphylococcus aureus subsp. aureus MW2
ugaaguauuuuccuu

SEQ ID NO: 2092767 - RNA, 20 nt, Staphylococcus aureus subsp. aureus MW2
ugaaguaugcacaucauuga

SEQ ID NO: 2092768 - RNA, 15 nt, Staphylococcus aureus subsp. aureus MW2
ugaaguauggaaguu

SEQ ID NO: 2092769 - RNA, 20 nt, Staphylococcus aureus subsp. aureus MW2
ugaauaaagcuaacauaccu

SEQ ID NO: 2092770 - RNA, 17 nt, Staphylococcus aureus subsp. aureus MW2
ugaauaaaauauaucuu

SEQ ID NO: 2092771 - RNA, 14 nt, Staphylococcus aureus subsp. aureus MW2
ugaauaaaauugug

SEQ ID NO: 2092772 - RNA, 22 nt, Staphylococcus aureus subsp. aureus MW2
ugaagucuuucaacaaaaugcg

SEQ ID NO: 2092773 - RNA, 24 nt, Staphylococcus aureus subsp. aureus MW2
ugaagucuuucaacaaaaugcgua

SEQ ID NO: 2092774 - RNA, 23 nt, Staphylococcus aureus subsp. aureus MW2
ugaaguuuguuuacggauuuuuc

SEQ ID NO: 2092775 - RNA, 14 nt, Staphylococcus aureus subsp. aureus MW2
ugaauaaaaaaaca

SEQ ID NO: 2092776 - RNA, 13 nt, Staphylococcus aureus subsp. aureus MW2
ugaaguagauuga

SEQ ID NO: 2092777 - RNA, 22 nt, Staphylococcus aureus subsp. aureus MW2
ugaaggagauauugucuucuca

SEQ ID NO: 2092778 - RNA, 15 nt, Staphylococcus aureus subsp. aureus MW2
ugaagaauauaaacu

SEQ ID NO: 2092779 - RNA, 18 nt, Staphylococcus aureus subsp. aureus MW2
ugaagaauauaaacuauu

SEQ ID NO: 2092780 - RNA, 20 nt, Staphylococcus aureus subsp. aureus MW2
ugaagaauauaaacuauuaa

SEQ ID NO: 2092781 - RNA, 19 nt, Staphylococcus aureus subsp. aureus MW2
ugaagaauacaaauauuaa

SEQ ID NO: 2092782 - RNA, 20 nt, Staphylococcus aureus subsp. aureus MW2
ugaagcauuaaguucaucau

SEQ ID NO: 2092783 - RNA, 20 nt, Staphylococcus aureus subsp. aureus MW2
ugaaaaacuucuuaacuuga

SEQ ID NO: 2092784 - RNA, 22 nt, Staphylococcus aureus subsp. aureus MW2
ugaaaaagaguuaauaaaauua

SEQ ID NO: 2092785 - RNA, 17 nt, Staphylococcus aureus subsp. aureus MW2
ugaaaaagcuaauucuu

SEQ ID NO: 2092786 - RNA, 13 nt, Staphylococcus aureus subsp. aureus MW2
ugaaaaaguggau

SEQ ID NO: 2092787 - RNA, 14 nt, Staphylococcus aureus subsp. aureus MW2
ugaaaaaauaacug

SEQ ID NO: 2092788 - RNA, 23 nt, Staphylococcus aureus subsp. aureus MW2
ugaaaaaauaacuguaaaacauu

SEQ ID NO: 2092789 - RNA, 15 nt, Staphylococcus aureus subsp. aureus MW2
ugaaaaacuucuuaa

SEQ ID NO: 2092790 - RNA, 22 nt, Staphylococcus aureus subsp. aureus MW2
ucuuuuuuaugcuuauucugaa

SEQ ID NO: 2092791 - RNA, 18 nt, Staphylococcus aureus subsp. aureus MW2
ucuuuuuuacuaaaauca

SEQ ID NO: 2092792 - RNA, 16 nt, Staphylococcus aureus subsp. aureus MW2
ucuuuuuuacuaaaau

SEQ ID NO: 2092793 - RNA, 18 nt, Staphylococcus aureus subsp. aureus MW2
ucuuuuuugcuguauaua

SEQ ID NO: 2092794 - RNA, 18 nt, Staphylococcus aureus subsp. aureus MW2
ucuuuuuucaauguuugc

SEQ ID NO: 2092795 - RNA, 16 nt, Staphylococcus aureus subsp. aureus MW2
ugaaaaaaauuuucau

SEQ ID NO: 2092796 - RNA, 12 nt, Staphylococcus aureus subsp. aureus MW2
ucuuuuuuuaau

SEQ ID NO: 2092797 - RNA, 16 nt, Staphylococcus aureus subsp. aureus MW2
ucuuuuuuuaugaaaa

SEQ ID NO: 2092798 - RNA, 15 nt, Staphylococcus aureus subsp. aureus MW2
ugaaaagaauaaguu

SEQ ID NO: 2092799 - RNA, 22 nt, Staphylococcus aureus subsp. aureus MW2
ugaaaagagauuuuuuugaaaa

SEQ ID NO: 2092800 - RNA, 13 nt, Staphylococcus aureus subsp. aureus MW2
ugaaaagauaaac

SEQ ID NO: 2092801 - RNA, 16 nt, Staphylococcus aureus subsp. aureus MW2
ugaaaacuuaauagaa

SEQ ID NO: 2092802 - RNA, 17 nt, Staphylococcus aureus subsp. aureus MW2
ugaaaacuuaauagaaa

SEQ ID NO: 2092803 - RNA, 17 nt, Staphylococcus aureus subsp. aureus MW2
ugaaaagguuagaugga

SEQ ID NO: 2092804 - RNA, 14 nt, Staphylococcus aureus subsp. aureus MW2
ugaaaauaaccauu

SEQ ID NO: 2092805 - RNA, 23 nt, Staphylococcus aureus subsp. aureus MW2
ugaaaaauaucccggaauauuaa

SEQ ID NO: 2092806 - RNA, 15 nt, Staphylococcus aureus subsp. aureus MW2
ugaaaaauuaaaaaa

SEQ ID NO: 2092807 - RNA, 21 nt, Staphylococcus aureus subsp. aureus MW2
ugaaagcaucuugcaagccau

SEQ ID NO: 2092808 - RNA, 19 nt, Staphylococcus aureus subsp. aureus MW2
ugaaagcaccuaaaauaga

SEQ ID NO: 2092809 - RNA, 18 nt, Staphylococcus aureus subsp. aureus MW2
ugaaacuggauaaauaaa

SEQ ID NO: 2092810 - RNA, 13 nt, Staphylococcus aureus subsp. aureus MW2
ugaaacuguauca

SEQ ID NO: 2092811 - RNA, 18 nt, Staphylococcus aureus subsp. aureus MW2
ugaaacugaguucaauua

SEQ ID NO: 2092812 - RNA, 23 nt, Staphylococcus aureus subsp. aureus MW2
ugaaaggaguauuuuugcguuaa

SEQ ID NO: 2092813 - RNA, 13 nt, Staphylococcus aureus subsp. aureus MW2
ugaaauaaacaua

SEQ ID NO: 2092814 - RNA, 17 nt, Staphylococcus aureus subsp. aureus MW2
ugaaauaaacauaucau

SEQ ID NO: 2092815 - RNA, 21 nt, Staphylococcus aureus subsp. aureus MW2
ugaaauaaacauaucaucaua

SEQ ID NO: 2092816 - RNA, 17 nt, Staphylococcus aureus subsp. aureus MW2
ugaaaucauuuaaauua

SEQ ID NO: 2092817 - RNA, 21 nt, Staphylococcus aureus subsp. aureus MW2
ugaaaucaguuuuugaauauu

SEQ ID NO: 2092818 - RNA, 17 nt, Staphylococcus aureus subsp. aureus MW2
ugaaaaucaguugcuuc

SEQ ID NO: 2092819 - RNA, 23 nt, Staphylococcus aureus subsp. aureus MW2
ugaaaaucuaauccugguauaau

SEQ ID NO: 2092820 - RNA, 16 nt, Staphylococcus aureus subsp. aureus MW2
ugaaaauauuuuauua

SEQ ID NO: 2092821 - RNA, 17 nt, Staphylococcus aureus subsp. aureus MW2
ugaaaauauuuuauuau

SEQ ID NO: 2092822 - RNA, 18 nt, Staphylococcus aureus subsp. aureus MW2
ugaaaauauuuuauuaua

SEQ ID NO: 2092823 - RNA, 16 nt, Staphylococcus aureus subsp. aureus MW2
ugaaaaucuuuaacuc

SEQ ID NO: 2092824 - RNA, 13 nt, Staphylococcus aureus subsp. aureus MW2
ugaaaaucuuuaa

SEQ ID NO: 2092825 - RNA, 14 nt, Staphylococcus aureus subsp. aureus MW2
ugcucguauagaaa

SEQ ID NO: 2092826 - RNA, 17 nt, Staphylococcus aureus subsp. aureus MW2
ugcucuaauucaaugau

SEQ ID NO: 2092827 - RNA, 17 nt, Staphylococcus aureus subsp. aureus MW2
ugcucuaagcauucagu

SEQ ID NO: 2092828 - RNA, 20 nt, Staphylococcus aureus subsp. aureus MW2
ugcucuauuuacggcauaau

SEQ ID NO: 2092829 - RNA, 17 nt, Staphylococcus aureus subsp. aureus MW2
ugcugauaauuuuucuu

SEQ ID NO: 2092830 - RNA, 23 nt, Staphylococcus aureus subsp. aureus MW2
ugcugauaauuuuucuucuuuuu

SEQ ID NO: 2092831 - RNA, 18 nt, Staphylococcus aureus subsp. aureus MW2
ugcugccaaaaaguauuc

SEQ ID NO: 2092832 - RNA, 21 nt, Staphylococcus aureus subsp. aureus MW2
aaaugucaguuuugaagaaua

SEQ ID NO: 2092833 - RNA, 19 nt, Staphylococcus aureus subsp. aureus MW2
aaaugucaguuuugaagaa

SEQ ID NO: 2092834 - RNA, 23 nt, Staphylococcus aureus subsp. aureus MW2
aaauguaacauuaaaaauaaaag

SEQ ID NO: 2092835 - RNA, 17 nt, Staphylococcus aureus subsp. aureus MW2
ugcugcuuuuccauuau

SEQ ID NO: 2092836 - RNA, 19 nt, Staphylococcus aureus subsp. aureus MW2
ugcugguugcuucuuauca

SEQ ID NO: 2092837 - RNA, 16 nt, Staphylococcus aureus subsp. aureus MW2
ugcuguaaccccuugu

SEQ ID NO: 2092838 - RNA, 18 nt, Staphylococcus aureus subsp. aureus MW2
ugcugguugcuucuuauc

SEQ ID NO: 2092839 - RNA, 12 nt, Staphylococcus aureus subsp. aureus MW2
ugcuguaucuuc

SEQ ID NO: 2092840 - RNA, 19 nt, Staphylococcus aureus subsp. aureus MW2
ugcugucaaacaacaauca

SEQ ID NO: 2092841 - RNA, 23 nt, Staphylococcus aureus subsp. aureus MW2
ugcuguacguuuaauaccuauga

SEQ ID NO: 2092842 - RNA, 15 nt, Staphylococcus aureus subsp. aureus MW2
ugcugguaacucuuc

SEQ ID NO: 2092843 - RNA, 17 nt, Staphylococcus aureus subsp. aureus MW2
aaaugucguauauguaa

SEQ ID NO: 2092844 - RNA, 19 nt, Staphylococcus aureus subsp. aureus MW2
ugcuguugcaauaaaauca

SEQ ID NO: 2092845 - RNA, 22 nt, Staphylococcus aureus subsp. aureus MW2
ugcuguugaagaagguaauaaa

SEQ ID NO: 2092846 - RNA, 15 nt, Staphylococcus aureus subsp. aureus MW2
ugcuguucuguucca

SEQ ID NO: 2092847 - RNA, 13 nt, Staphylococcus aureus subsp. aureus MW2
ugcuguuacuucu

SEQ ID NO: 2092848 - RNA, 13 nt, Staphylococcus aureus subsp. aureus MW2
ugcugugauuguc

SEQ ID NO: 2092849 - RNA, 13 nt, Staphylococcus aureus subsp. aureus MW2
ugcuguuuuuauu

SEQ ID NO: 2092850 - RNA, 18 nt, Staphylococcus aureus subsp. aureus MW2
ugcuuaauuuguuuuaaa

SEQ ID NO: 2092851 - RNA, 16 nt, Staphylococcus aureus subsp. aureus MW2
ugcuuauguuuuuaac

SEQ ID NO: 2092852 - RNA, 21 nt, Staphylococcus aureus subsp. aureus MW2
ugcuuauucugaaaaauauuu

SEQ ID NO: 2092853 - RNA, 18 nt, Staphylococcus aureus subsp. aureus MW2
ugcuuaugaaugaaauca

SEQ ID NO: 2092854 - RNA, 20 nt, Staphylococcus aureus subsp. aureus MW2
ugcuuaugaaugaaaucagc

SEQ ID NO: 2092855 - RNA, 18 nt, Staphylococcus aureus subsp. aureus MW2
ugcuucaacuucaucuaa

SEQ ID NO: 2092856 - RNA, 12 nt, Staphylococcus aureus subsp. aureus MW2
ugcuucaacuac

SEQ ID NO: 2092857 - RNA, 18 nt, Staphylococcus aureus subsp. aureus MW2
ugcuucaaauguaacauu

SEQ ID NO: 2092858 - RNA, 19 nt, Staphylococcus aureus subsp. aureus MW2
ugcuucauaaauguuagau

SEQ ID NO: 2092859 - RNA, 16 nt, Staphylococcus aureus subsp. aureus MW2
ugcuucacuguuuuau

SEQ ID NO: 2092860 - RNA, 21 nt, Staphylococcus aureus subsp. aureus MW2
ugcuugaaauuauuauuuaaa

SEQ ID NO: 2092861 - RNA, 17 nt, Staphylococcus aureus subsp. aureus MW2
ugcuugaccuucaguuu

SEQ ID NO: 2092862 - RNA, 20 nt, Staphylococcus aureus subsp. aureus MW2
ugcuugaauuuuauuaggua

SEQ ID NO: 2092863 - RNA, 13 nt, Staphylococcus aureus subsp. aureus MW2
ugcuucucuuuga

SEQ ID NO: 2092864 - RNA, 13 nt, Staphylococcus aureus subsp. aureus MW2
ugcuucugcugua

SEQ ID NO: 2092865 - RNA, 21 nt, Staphylococcus aureus subsp. aureus MW2
ugcuucuucagguguuuuacc

SEQ ID NO: 2092866 - RNA, 24 nt, Staphylococcus aureus subsp. aureus MW2
ugcuucuacccuugcaaauauauc

SEQ ID NO: 2092867 - RNA, 17 nt, Staphylococcus aureus subsp. aureus MW2
ugcuucauuauauaauu

SEQ ID NO: 2092868 - RNA, 18 nt, Staphylococcus aureus subsp. aureus MW2
ugcuuccaccgcugcucu

SEQ ID NO: 2092869 - RNA, 13 nt, Staphylococcus aureus subsp. aureus MW2
ugcuugcuuacaa

SEQ ID NO: 2092870 - RNA, 23 nt, Staphylococcus aureus subsp. aureus MW2
ugcuuuaauuugauuaaauucuu

SEQ ID NO: 2092871 - RNA, 16 nt, Staphylococcus aureus subsp. aureus MW2
ugcuuuaauuaaaguu

SEQ ID NO: 2092872 - RNA, 18 nt, Staphylococcus aureus subsp. aureus MW2
ugcuuuacuauauucaau

SEQ ID NO: 2092873 - RNA, 14 nt, Staphylococcus aureus subsp. aureus MW2
ugcuuuaacuguac

SEQ ID NO: 2092874 - RNA, 16 nt, Staphylococcus aureus subsp. aureus MW2
ugcuuugauuucauuu

SEQ ID NO: 2092875 - RNA, 20 nt, Staphylococcus aureus subsp. aureus MW2
ugcuuuuauagauuuuaaua

SEQ ID NO: 2092876 - RNA, 13 nt, Staphylococcus aureus subsp. aureus MW2
ugcuuuucgcuuu

SEQ ID NO: 2092877 - RNA, 14 nt, Staphylococcus aureus subsp. aureus MW2
ugcuuuuguuaaua

SEQ ID NO: 2092878 - RNA, 16 nt, Staphylococcus aureus subsp. aureus MW2
ugcuuuuguuaauauu

SEQ ID NO: 2092879 - RNA, 13 nt, Staphylococcus aureus subsp. aureus MW2
ugcuuuuuuaaau

SEQ ID NO: 2092880 - RNA, 18 nt, Staphylococcus aureus subsp. aureus MW2
ugcuuuuuuaaauuuaau

SEQ ID NO: 2092881 - RNA, 21 nt, Staphylococcus aureus subsp. aureus MW2
ugcuuuuuuaaauuuaauuuc

SEQ ID NO: 2092882 - RNA, 12 nt, Staphylococcus aureus subsp. aureus MW2
ugcuuuuuuaag

SEQ ID NO: 2092883 - RNA, 13 nt, Staphylococcus aureus subsp. aureus MW2
ugcuuuuuuaaga

SEQ ID NO: 2092884 - RNA, 22 nt, Staphylococcus aureus subsp. aureus MW2
ugcuuuuucauaaauauuuaaa

SEQ ID NO: 2092885 - RNA, 18 nt, Staphylococcus aureus subsp. aureus MW2
ugcuuuuuauuaugcuuc

SEQ ID NO: 2092886 - RNA, 12 nt, Staphylococcus aureus subsp. aureus MW2
ugcuuuuuaaug

SEQ ID NO: 2092887 - RNA, 14 nt, Staphylococcus aureus subsp. aureus MW2
ugcuuuuuagcaua

SEQ ID NO: 2092888 - RNA, 18 nt, Staphylococcus aureus subsp. aureus MW2
ugcuuuuuuauucuaaua

SEQ ID NO: 2092889 - RNA, 22 nt, Staphylococcus aureus subsp. aureus MW2
ugcuuuuuuauucuaauacaaa

SEQ ID NO: 2092890 - RNA, 19 nt, Staphylococcus aureus subsp. aureus MW2
uggaaaguugguuuuauua

SEQ ID NO: 2092891 - RNA, 23 nt, Staphylococcus aureus subsp. aureus MW2
uggaaagacguuuuuuuauaaau

SEQ ID NO: 2092892 - RNA, 13 nt, Staphylococcus aureus subsp. aureus MW2
uggaaauaugaaa

SEQ ID NO: 2092893 - RNA, 18 nt, Staphylococcus aureus subsp. aureus MW2
uggaaauaugaaaagaga

SEQ ID NO: 2092894 - RNA, 17 nt, Staphylococcus aureus subsp. aureus MW2
uggaacaauaaucaaug

SEQ ID NO: 2092895 - RNA, 15 nt, Staphylococcus aureus subsp. aureus MW2
uggaacaccaauaua

SEQ ID NO: 2092896 - RNA, 20 nt, Staphylococcus aureus subsp. aureus MW2
uggaagaaugccuuuuauuu

SEQ ID NO: 2092897 - RNA, 22 nt, Staphylococcus aureus subsp. aureus MW2
uggacaaucuuaucguaaucuu

SEQ ID NO: 2092898 - RNA, 21 nt, Staphylococcus aureus subsp. aureus MW2
uggacauauacucuaaaaaag

SEQ ID NO: 2092899 - RNA, 20 nt, Staphylococcus aureus subsp. aureus MW2
uggaccucuugaaaaaguua

SEQ ID NO: 2092900 - RNA, 19 nt, Staphylococcus aureus subsp. aureus MW2
uggacauuguaaaaugcuc

SEQ ID NO: 2092901 - RNA, 23 nt, Staphylococcus aureus subsp. aureus MW2
uggaauacucuuuaaucuaccaa

SEQ ID NO: 2092902 - RNA, 14 nt, Staphylococcus aureus subsp. aureus MW2
uggaauaaauuuau

SEQ ID NO: 2092903 - RNA, 15 nt, Staphylococcus aureus subsp. aureus MW2
uggaauaaauuuaua

SEQ ID NO: 2092904 - RNA, 14 nt, Staphylococcus aureus subsp. aureus MW2
uggaaguauauguu

SEQ ID NO: 2092905 - RNA, 17 nt, Staphylococcus aureus subsp. aureus MW2
uggaaguguuuuaaguu

SEQ ID NO: 2092906 - RNA, 11 nt, Staphylococcus aureus subsp. aureus MW2
uggaaugacua

SEQ ID NO: 2092907 - RNA, 22 nt, Staphylococcus aureus subsp. aureus MW2
uggaaugauacgccuaaauauu

SEQ ID NO: 2092908 - RNA, 14 nt, Staphylococcus aureus subsp. aureus MW2
uggaauuaauuaua

SEQ ID NO: 2092909 - RNA, 14 nt, Staphylococcus aureus subsp. aureus MW2
uggaauuucauaua

SEQ ID NO: 2092910 - RNA, 14 nt, Staphylococcus aureus subsp. aureus MW2
ugcgucguuuauua

SEQ ID NO: 2092911 - RNA, 21 nt, Staphylococcus aureus subsp. aureus MW2
ugcguuuuaagacuuuaaaau

SEQ ID NO: 2092912 - RNA, 16 nt, Staphylococcus aureus subsp. aureus MW2
ugcgcuuauuuuacua

SEQ ID NO: 2092913 - RNA, 12 nt, Staphylococcus aureus subsp. aureus MW2
ugcgcuuccaau

SEQ ID NO: 2092914 - RNA, 17 nt, Staphylococcus aureus subsp. aureus MW2
ugcgcuuguaacaagcu

SEQ ID NO: 2092915 - RNA, 18 nt, Staphylococcus aureus subsp. aureus MW2
ugcgcuuguaacaagcuu

SEQ ID NO: 2092916 - RNA, 20 nt, Staphylococcus aureus subsp. aureus MW2
ugcuaaaaaguuagcaaaug

SEQ ID NO: 2092917 - RNA, 22 nt, Staphylococcus aureus subsp. aureus MW2
ugcuaaaaaauuugcaugaaaa

SEQ ID NO: 2092918 - RNA, 13 nt, Staphylococcus aureus subsp. aureus MW2
ugcguuuuuaaau

SEQ ID NO: 2092919 - RNA, 14 nt, Staphylococcus aureus subsp. aureus MW2
ugcuaaaucaucuu

SEQ ID NO: 2092920 - RNA, 20 nt, Staphylococcus aureus subsp. aureus MW2
ugcuaacucugaucuaaaac

SEQ ID NO: 2092921 - RNA, 14 nt, Staphylococcus aureus subsp. aureus MW2
ugcuacaauuuccu

SEQ ID NO: 2092922 - RNA, 15 nt, Staphylococcus aureus subsp. aureus MW2
ugcuaauuuuuucau

SEQ ID NO: 2092923 - RNA, 13 nt, Staphylococcus aureus subsp. aureus MW2
ugcuagugcucuu

SEQ ID NO: 2092924 - RNA, 14 nt, Staphylococcus aureus subsp. aureus MW2
ugcuauguauuuuu

SEQ ID NO: 2092925 - RNA, 17 nt, Staphylococcus aureus subsp. aureus MW2
ugcuaugauguguuaca

SEQ ID NO: 2092926 - RNA, 12 nt, Staphylococcus aureus subsp. aureus MW2
ugcuauguuuug

SEQ ID NO: 2092927 - RNA, 19 nt, Staphylococcus aureus subsp. aureus MW2
ugcuauuuuugacuguuaa

SEQ ID NO: 2092928 - RNA, 14 nt, Staphylococcus aureus subsp. aureus MW2
ugcucaucuucuaa

SEQ ID NO: 2092929 - RNA, 16 nt, Staphylococcus aureus subsp. aureus MW2
ugcucaucuucuaauu

SEQ ID NO: 2092930 - RNA, 20 nt, Staphylococcus aureus subsp. aureus MW2
ugcucauuuuuuuaauuauu

SEQ ID NO: 2092931 - RNA, 13 nt, Staphylococcus aureus subsp. aureus MW2
ugccuuuaaagca

SEQ ID NO: 2092932 - RNA, 23 nt, Staphylococcus aureus subsp. aureus MW2
ugccuuuaccgugaauauaauga

SEQ ID NO: 2092933 - RNA, 16 nt, Staphylococcus aureus subsp. aureus MW2
ugccuuuugaauaauu

SEQ ID NO: 2092934 - RNA, 21 nt, Staphylococcus aureus subsp. aureus MW2
ugccuuuuguuacgauugggc

SEQ ID NO: 2092935 - RNA, 17 nt, Staphylococcus aureus subsp. aureus MW2
ugccuugucuauuguaa

SEQ ID NO: 2092936 - RNA, 15 nt, Staphylococcus aureus subsp. aureus MW2
ugccuuucuaauauu

SEQ ID NO: 2092937 - RNA, 12 nt, Staphylococcus aureus subsp. aureus MW2
ugccuuucuaau

SEQ ID NO: 2092938 - RNA, 15 nt, Staphylococcus aureus subsp. aureus MW2
ugcgaaaugcauuac

SEQ ID NO: 2092939 - RNA, 18 nt, Staphylococcus aureus subsp. aureus MW2
ugccuuuuuguaauugua

SEQ ID NO: 2092940 - RNA, 22 nt, Staphylococcus aureus subsp. aureus MW2
ugcgaaaccuuucgauaaacua

SEQ ID NO: 2092941 - RNA, 16 nt, Staphylococcus aureus subsp. aureus MW2
ugcgaagauuuuuaac

SEQ ID NO: 2092942 - RNA, 17 nt, Staphylococcus aureus subsp. aureus MW2
ugcgccaguuucuaaua

SEQ ID NO: 2092943 - RNA, 20 nt, Staphylococcus aureus subsp. aureus MW2
ugccucugcaacgccuuuau

SEQ ID NO: 2092944 - RNA, 21 nt, Staphylococcus aureus subsp. aureus MW2
uguaaagcuaauuuuuuauuu

SEQ ID NO: 2092945 - RNA, 17 nt, Staphylococcus aureus subsp. aureus MW2
ugguuuggauaaaauga

SEQ ID NO: 2092946 - RNA, 22 nt, Staphylococcus aureus subsp. aureus MW2
ugguuugcuuuaaaauucucua

SEQ ID NO: 2092947 - RNA, 12 nt, Staphylococcus aureus subsp. aureus MW2
ugguuuuacugc

SEQ ID NO: 2092948 - RNA, 22 nt, Staphylococcus aureus subsp. aureus MW2
uguaaagcuuuaguuaaauagu

SEQ ID NO: 2092949 - RNA, 14 nt, Staphylococcus aureus subsp. aureus MW2
uguaaauaaaaauu

SEQ ID NO: 2092950 - RNA, 14 nt, Staphylococcus aureus subsp. aureus MW2
uguaaauauaguaa

SEQ ID NO: 2092951 - RNA, 18 nt, Staphylococcus aureus subsp. aureus MW2
uguaaauccuccauuuaa

SEQ ID NO: 2092952 - RNA, 15 nt, Staphylococcus aureus subsp. aureus MW2
uguaaaugaaagcac

SEQ ID NO: 2092953 - RNA, 18 nt, Staphylococcus aureus subsp. aureus MW2
uguaaaugaauuuugacg

SEQ ID NO: 2092954 - RNA, 16 nt, Staphylococcus aureus subsp. aureus MW2
uguaaaugaaauaggu

SEQ ID NO: 2092955 - RNA, 17 nt, Staphylococcus aureus subsp. aureus MW2
ugguucaucaaacaaca

SEQ ID NO: 2092956 - RNA, 17 nt, Staphylococcus aureus subsp. aureus MW2
ugguucugauguuuuau

SEQ ID NO: 2092957 - RNA, 17 nt, Staphylococcus aureus subsp. aureus MW2
uguaauuccucuggaac

SEQ ID NO: 2092958 - RNA, 15 nt, Staphylococcus aureus subsp. aureus MW2
uguaauugaaaugau

SEQ ID NO: 2092959 - RNA, 14 nt, Staphylococcus aureus subsp. aureus MW2
uguacaucauuaaa

SEQ ID NO: 2092960 - RNA, 16 nt, Staphylococcus aureus subsp. aureus MW2
uguacaguaauauuca

SEQ ID NO: 2092961 - RNA, 15 nt, Staphylococcus aureus subsp. aureus MW2
uguacauaaaaauaa

SEQ ID NO: 2092962 - RNA, 15 nt, Staphylococcus aureus subsp. aureus MW2
uguacauguauaaaa

SEQ ID NO: 2092963 - RNA, 13 nt, Staphylococcus aureus subsp. aureus MW2
uguacauuauuaa

SEQ ID NO: 2092964 - RNA, 17 nt, Staphylococcus aureus subsp. aureus MW2
uguacaucauuaaauau

SEQ ID NO: 2092965 - RNA, 16 nt, Staphylococcus aureus subsp. aureus MW2
uguacauuguaaauau

SEQ ID NO: 2092966 - RNA, 19 nt, Staphylococcus aureus subsp. aureus MW2
uguaagcuaucguaaacaa

SEQ ID NO: 2092967 - RNA, 15 nt, Staphylococcus aureus subsp. aureus MW2
uguaagacaacaaau

SEQ ID NO: 2092968 - RNA, 19 nt, Staphylococcus aureus subsp. aureus MW2
uguaaauguuaaauucuaa

SEQ ID NO: 2092969 - RNA, 14 nt, Staphylococcus aureus subsp. aureus MW2
uguaagcagacuaa

SEQ ID NO: 2092970 - RNA, 21 nt, Staphylococcus aureus subsp. aureus MW2
uguaauguuccccugaaaaga

SEQ ID NO: 2092971 - RNA, 18 nt, Staphylococcus aureus subsp. aureus MW2
uguaauaauaaucuuuaa

SEQ ID NO: 2092972 - RNA, 12 nt, Staphylococcus aureus subsp. aureus MW2
uguaauaaagca

SEQ ID NO: 2092973 - RNA, 14 nt, Staphylococcus aureus subsp. aureus MW2
uguaauacaagcaa

SEQ ID NO: 2092974 - RNA, 17 nt, Staphylococcus aureus subsp. aureus MW2
uguaauaccuuuacuuu

SEQ ID NO: 2092975 - RNA, 22 nt, Staphylococcus aureus subsp. aureus MW2
uguaauaccuuuacuuucauua

SEQ ID NO: 2092976 - RNA, 18 nt, Staphylococcus aureus subsp. aureus MW2
uguaauaauaucaccuuu

SEQ ID NO: 2092977 - RNA, 12 nt, Staphylococcus aureus subsp. aureus MW2
uguaagucgcuc

SEQ ID NO: 2092978 - RNA, 21 nt, Staphylococcus aureus subsp. aureus MW2
uguaagucgaaaguacccaga

SEQ ID NO: 2092979 - RNA, 18 nt, Staphylococcus aureus subsp. aureus MW2
uguaaguuugguuucuua

SEQ ID NO: 2092980 - RNA, 16 nt, Staphylococcus aureus subsp. aureus MW2
ugguucaaaaaucaua

SEQ ID NO: 2092981 - RNA, 14 nt, Staphylococcus aureus subsp. aureus MW2
ugguucaaaaauca

SEQ ID NO: 2092982 - RNA, 17 nt, Staphylococcus aureus subsp. aureus MW2
ugguuauuaaaauuaaa

SEQ ID NO: 2092983 - RNA, 19 nt, Staphylococcus aureus subsp. aureus MW2
ugguuagaaaaaaaucugu

SEQ ID NO: 2092984 - RNA, 15 nt, Staphylococcus aureus subsp. aureus MW2
ugguuaacauccugc

SEQ ID NO: 2092985 - RNA, 16 nt, Staphylococcus aureus subsp. aureus MW2
uggugagaaauugaau

SEQ ID NO: 2092986 - RNA, 23 nt, Staphylococcus aureus subsp. aureus MW2
uggugcccaaguuucauggggcu

SEQ ID NO: 2092987 - RNA, 17 nt, Staphylococcus aureus subsp. aureus MW2
uggugcuaaaaaauuug

SEQ ID NO: 2092988 - RNA, 20 nt, Staphylococcus aureus subsp. aureus MW2
uggucuaaagcuuauuaaau

SEQ ID NO: 2092989 - RNA, 17 nt, Staphylococcus aureus subsp. aureus MW2
uguauuguauuuuaaug

SEQ ID NO: 2092990 - RNA, 21 nt, Staphylococcus aureus subsp. aureus MW2
uguauuuuagcgucauuuuua

SEQ ID NO: 2092991 - RNA, 18 nt, Staphylococcus aureus subsp. aureus MW2
ugucaauauaacauugca

SEQ ID NO: 2092992 - RNA, 16 nt, Staphylococcus aureus subsp. aureus MW2
uguauuguauuuuaau

SEQ ID NO: 2092993 - RNA, 19 nt, Staphylococcus aureus subsp. aureus MW2
uguauuguuugaaaauuaa

SEQ ID NO: 2092994 - RNA, 19 nt, Staphylococcus aureus subsp. aureus MW2
uguauuguuuguuuuuaua

SEQ ID NO: 2092995 - RNA, 18 nt, Staphylococcus aureus subsp. aureus MW2
uguauuuauuuuuuuaaa

SEQ ID NO: 2092996 - RNA, 14 nt, Staphylococcus aureus subsp. aureus MW2
uguauuuaauaagu

SEQ ID NO: 2092997 - RNA, 19 nt, Staphylococcus aureus subsp. aureus MW2
uguauucuuggcguauuuu

SEQ ID NO: 2092998 - RNA, 16 nt, Staphylococcus aureus subsp. aureus MW2
uguauucuuagauauu

SEQ ID NO: 2092999 - RNA, 19 nt, Staphylococcus aureus subsp. aureus MW2
uguauucuucuaauucuga

SEQ ID NO: 2093000 - RNA, 18 nt, Staphylococcus aureus subsp. aureus MW2
uguauucauuuuaaauuu

SEQ ID NO: 2093001 - RNA, 18 nt, Staphylococcus aureus subsp. aureus MW2
uguauucgcuuacauuau

SEQ ID NO: 2093002 - RNA, 20 nt, Staphylococcus aureus subsp. aureus MW2
uguauucgcuuacauuauga

SEQ ID NO: 2093003 - RNA, 21 nt, Staphylococcus aureus subsp. aureus MW2
uguauucgcuuacauuaugaa

SEQ ID NO: 2093004 - RNA, 23 nt, Staphylococcus aureus subsp. aureus MW2
uguauucgcuuacauuaugaaca

SEQ ID NO: 2093005 - RNA, 19 nt, Staphylococcus aureus subsp. aureus MW2
uguauucugaaacuuuaau

SEQ ID NO: 2093006 - RNA, 20 nt, Staphylococcus aureus subsp. aureus MW2
uguaucucugaaaaacuucu

SEQ ID NO: 2093007 - RNA, 18 nt, Staphylococcus aureus subsp. aureus MW2
uguaucucugaaaaacuu

SEQ ID NO: 2093008 - RNA, 13 nt, Staphylococcus aureus subsp. aureus MW2
uguauccucagua

SEQ ID NO: 2093009 - RNA, 17 nt, Staphylococcus aureus subsp. aureus MW2
uguaucaucauaaucaa

SEQ ID NO: 2093010 - RNA, 13 nt, Staphylococcus aureus subsp. aureus MW2
uguauuauuauua

SEQ ID NO: 2093011 - RNA, 23 nt, Staphylococcus aureus subsp. aureus MW2
uguauuauucucucauuuguaua

SEQ ID NO: 2093012 - RNA, 17 nt, Staphylococcus aureus subsp. aureus MW2
uguauucagucaguaaa

SEQ ID NO: 2093013 - RNA, 21 nt, Staphylococcus aureus subsp. aureus MW2
uguauuauugaaacuaauaau

SEQ ID NO: 2093014 - RNA, 21 nt, Staphylococcus aureus subsp. aureus MW2
uguaucucugaaaaacuucuu

SEQ ID NO: 2093015 - RNA, 18 nt, Staphylococcus aureus subsp. aureus MW2
uguagcaggcaacuuuua

SEQ ID NO: 2093016 - RNA, 16 nt, Staphylococcus aureus subsp. aureus MW2
ugucaguaacuuuguc

SEQ ID NO: 2093017 - RNA, 19 nt, Staphylococcus aureus subsp. aureus MW2
uguccaucuuuuauuaaag

SEQ ID NO: 2093018 - RNA, 17 nt, Staphylococcus aureus subsp. aureus MW2
uguccuaaguuaugacu

SEQ ID NO: 2093019 - RNA, 17 nt, Staphylococcus aureus subsp. aureus MW2
uguccuaauaaguuacc

SEQ ID NO: 2093020 - RNA, 17 nt, Staphylococcus aureus subsp. aureus MW2
uguccuagacucuaaaa

SEQ ID NO: 2093021 - RNA, 19 nt, Staphylococcus aureus subsp. aureus MW2
uguccgauuugauaaaaaa

SEQ ID NO: 2093022 - RNA, 14 nt, Staphylococcus aureus subsp. aureus MW2
uguccuuuuuauuu

SEQ ID NO: 2093023 - RNA, 19 nt, Staphylococcus aureus subsp. aureus MW2
ugucguuguacaucauuaa

SEQ ID NO: 2093024 - RNA, 14 nt, Staphylococcus aureus subsp. aureus MW2
ugucuaaaaauguc

SEQ ID NO: 2093025 - RNA, 18 nt, Staphylococcus aureus subsp. aureus MW2
ugucuaaaaacauaaaaa

SEQ ID NO: 2093026 - RNA, 14 nt, Staphylococcus aureus subsp. aureus MW2
ugucuuugaacaua

SEQ ID NO: 2093027 - RNA, 17 nt, Staphylococcus aureus subsp. aureus MW2
ugucuuuuauauuuuua

SEQ ID NO: 2093028 - RNA, 17 nt, Staphylococcus aureus subsp. aureus MW2
ugucuucgucaucaaca

SEQ ID NO: 2093029 - RNA, 15 nt, Staphylococcus aureus subsp. aureus MW2
ugugauauauaacca

SEQ ID NO: 2093030 - RNA, 17 nt, Staphylococcus aureus subsp. aureus MW2
ugugauacuuucuaaga

SEQ ID NO: 2093031 - RNA, 22 nt, Staphylococcus aureus subsp. aureus MW2
ugugaaagaccguauuuuuuua

SEQ ID NO: 2093032 - RNA, 23 nt, Staphylococcus aureus subsp. aureus MW2
ugugcaauuagaauauauguaua

SEQ ID NO: 2093033 - RNA, 15 nt, Staphylococcus aureus subsp. aureus MW2
ugugcaauaccuguu

SEQ ID NO: 2093034 - RNA, 19 nt, Staphylococcus aureus subsp. aureus MW2
ugugcaacgguuugaaaaa

SEQ ID NO: 2093035 - RNA, 14 nt, Staphylococcus aureus subsp. aureus MW2
ugugauuaugcaua

SEQ ID NO: 2093036 - RNA, 14 nt, Staphylococcus aureus subsp. aureus MW2
ugugcaaaaguuug

SEQ ID NO: 2093037 - RNA, 23 nt, Staphylococcus aureus subsp. aureus MW2
ugugauuuuuaauaauuugaaua

SEQ ID NO: 2093038 - RNA, 15 nt, Staphylococcus aureus subsp. aureus MW2
uggguaauguuuuua

SEQ ID NO: 2093039 - RNA, 14 nt, Staphylococcus aureus subsp. aureus MW2
uggguaauguuuuu

SEQ ID NO: 2093040 - RNA, 18 nt, Staphylococcus aureus subsp. aureus MW2
uggguaagguuuuacaau

SEQ ID NO: 2093041 - RNA, 16 nt, Staphylococcus aureus subsp. aureus MW2
ugggcugacauuuuug

SEQ ID NO: 2093042 - RNA, 17 nt, Staphylococcus aureus subsp. aureus MW2
ugggccccaacacagag

SEQ ID NO: 2093043 - RNA, 19 nt, Staphylococcus aureus subsp. aureus MW2
ugggccccaacacagagaa

SEQ ID NO: 2093044 - RNA, 15 nt, Staphylococcus aureus subsp. aureus MW2
uggcugcaucaauau

SEQ ID NO: 2093045 - RNA, 17 nt, Staphylococcus aureus subsp. aureus MW2
uggcugcaacaauuugc

SEQ ID NO: 2093046 - RNA, 18 nt, Staphylococcus aureus subsp. aureus MW2
ugggacagaaaacaaagc

SEQ ID NO: 2093047 - RNA, 14 nt, Staphylococcus aureus subsp. aureus MW2
ugggaauuguauua

SEQ ID NO: 2093048 - RNA, 18 nt, Staphylococcus aureus subsp. aureus MW2
ugggacgacgaaauaauu

SEQ ID NO: 2093049 - RNA, 14 nt, Staphylococcus aureus subsp. aureus MW2
uggcuuaaaucaaa

SEQ ID NO: 2093050 - RNA, 18 nt, Staphylococcus aureus subsp. aureus MW2
uggcgcaauuuuuaacaa

SEQ ID NO: 2093051 - RNA, 15 nt, Staphylococcus aureus subsp. aureus MW2
uggacggcuacaauu

SEQ ID NO: 2093052 - RNA, 20 nt, Staphylococcus aureus subsp. aureus MW2
uggacuuauggguucaauau

SEQ ID NO: 2093053 - RNA, 14 nt, Staphylococcus aureus subsp. aureus MW2
uggacuucuaucuu

SEQ ID NO: 2093054 - RNA, 16 nt, Staphylococcus aureus subsp. aureus MW2
uggacuuuaaaguuaa

SEQ ID NO: 2093055 - RNA, 23 nt, Staphylococcus aureus subsp. aureus MW2
uggacuuugcuguccaucgucau

SEQ ID NO: 2093056 - RNA, 15 nt, Staphylococcus aureus subsp. aureus MW2
uggacugauaauaaa

SEQ ID NO: 2093057 - RNA, 22 nt, Staphylococcus aureus subsp. aureus MW2
uggagauucucgguuuuuucgg

SEQ ID NO: 2093058 - RNA, 22 nt, Staphylococcus aureus subsp. aureus MW2
uggagcaacgauaccaaauaua

SEQ ID NO: 2093059 - RNA, 18 nt, Staphylococcus aureus subsp. aureus MW2
uggagguccauaaucuuu

SEQ ID NO: 2093060 - RNA, 22 nt, Staphylococcus aureus subsp. aureus MW2
uggaugaauccuuuaccguguu

SEQ ID NO: 2093061 - RNA, 16 nt, Staphylococcus aureus subsp. aureus MW2
uggauaccuaaagcua

SEQ ID NO: 2093062 - RNA, 15 nt, Staphylococcus aureus subsp. aureus MW2
uggauaugauaacca

SEQ ID NO: 2093063 - RNA, 22 nt, Staphylococcus aureus subsp. aureus MW2
uggauaugcguauauguauaac

SEQ ID NO: 2093064 - RNA, 24 nt, Staphylococcus aureus subsp. aureus MW2
uggauagguaacuaaaaugucuuu

SEQ ID NO: 2093065 - RNA, 14 nt, Staphylococcus aureus subsp. aureus MW2
uggauaaaaugaua

SEQ ID NO: 2093066 - RNA, 17 nt, Staphylococcus aureus subsp. aureus MW2
uggauaaaaugauaucu

SEQ ID NO: 2093067 - RNA, 16 nt, Staphylococcus aureus subsp. aureus MW2
uggauaaauaaagauu

SEQ ID NO: 2093068 - RNA, 18 nt, Staphylococcus aureus subsp. aureus MW2
uggaugucaugucuagau

SEQ ID NO: 2093069 - RNA, 22 nt, Staphylococcus aureus subsp. aureus MW2
uggauucaaaugacauuuuaaa

SEQ ID NO: 2093070 - RNA, 17 nt, Staphylococcus aureus subsp. aureus MW2
uggauuaccguuaaaaa

SEQ ID NO: 2093071 - RNA, 18 nt, Staphylococcus aureus subsp. aureus MW2
uggauuuuaacaagauaa

SEQ ID NO: 2093072 - RNA, 23 nt, Staphylococcus aureus subsp. aureus MW2
uggauucaaaugacauuuuaaau

SEQ ID NO: 2093073 - RNA, 14 nt, Staphylococcus aureus subsp. aureus MW2
uggauuuuaacaag

SEQ ID NO: 2093074 - RNA, 19 nt, Staphylococcus aureus subsp. aureus MW2
uggauuuuuacaaagugau

SEQ ID NO: 2093075 - RNA, 20 nt, Staphylococcus aureus subsp. aureus MW2
uggauuuuucuuauaaaaau

SEQ ID NO: 2093076 - RNA, 13 nt, Staphylococcus aureus subsp. aureus MW2
uggauuuuucuua

SEQ ID NO: 2093077 - RNA, 13 nt, Staphylococcus aureus subsp. aureus MW2
uggauuuuuuggu

SEQ ID NO: 2093078 - RNA, 20 nt, Staphylococcus aureus subsp. aureus MW2
uggcaaccuuuugauguuua

SEQ ID NO: 2093079 - RNA, 23 nt, Staphylococcus aureus subsp. aureus MW2
uggcaacggcacauucauaccga

SEQ ID NO: 2093080 - RNA, 19 nt, Staphylococcus aureus subsp. aureus MW2
uggcauaucgauaaaugua

SEQ ID NO: 2093081 - RNA, 23 nt, Staphylococcus aureus subsp. aureus MW2
uggcauaucgauaaauguauuaa

SEQ ID NO: 2093082 - RNA, 14 nt, Staphylococcus aureus subsp. aureus MW2
uggcaguucugaaa

SEQ ID NO: 2093083 - RNA, 18 nt, Staphylococcus aureus subsp. aureus MW2
uggcauaaccuguuuuua

SEQ ID NO: 2093084 - RNA, 13 nt, Staphylococcus aureus subsp. aureus MW2
uggcauaauaaua

SEQ ID NO: 2093085 - RNA, 13 nt, Staphylococcus aureus subsp. aureus MW2
uuaagaaguuaaa

SEQ ID NO: 2093086 - RNA, 15 nt, Staphylococcus aureus subsp. aureus MW2
uuaacucuaucaaau

SEQ ID NO: 2093087 - RNA, 16 nt, Staphylococcus aureus subsp. aureus MW2
uuaacucuaucuauuu

SEQ ID NO: 2093088 - RNA, 18 nt, Staphylococcus aureus subsp. aureus MW2
uuaacuauaaauagaaga

SEQ ID NO: 2093089 - RNA, 15 nt, Staphylococcus aureus subsp. aureus MW2
uuaacuaauaacuag

SEQ ID NO: 2093090 - RNA, 18 nt, Staphylococcus aureus subsp. aureus MW2
uuaacguuauucauuugu

SEQ ID NO: 2093091 - RNA, 18 nt, Staphylococcus aureus subsp. aureus MW2
uuaacucaacuuaaauau

SEQ ID NO: 2093092 - RNA, 15 nt, Staphylococcus aureus subsp. aureus MW2
uuaagacuuuaaaau

SEQ ID NO: 2093093 - RNA, 13 nt, Staphylococcus aureus subsp. aureus MW2
uuaagcccuuccc

SEQ ID NO: 2093094 - RNA, 19 nt, Staphylococcus aureus subsp. aureus MW2
uuaagccugauguaccacu

SEQ ID NO: 2093095 - RNA, 22 nt, Staphylococcus aureus subsp. aureus MW2
uuaagcucauuucaauauuaaa

SEQ ID NO: 2093096 - RNA, 13 nt, Staphylococcus aureus subsp. aureus MW2
ugugcuuuuucau

SEQ ID NO: 2093097 - RNA, 19 nt, Staphylococcus aureus subsp. aureus MW2
ugugcuuuuucauaaauau

SEQ ID NO: 2093098 - RNA, 21 nt, Staphylococcus aureus subsp. aureus MW2
ugugcuuuuucauaaauauuu

SEQ ID NO: 2093099 - RNA, 22 nt, Staphylococcus aureus subsp. aureus MW2
ugugcuuuaaaggcauugugua

SEQ ID NO: 2093100 - RNA, 16 nt, Staphylococcus aureus subsp. aureus MW2
uuaaccauuucauuuc

SEQ ID NO: 2093101 - RNA, 15 nt, Staphylococcus aureus subsp. aureus MW2
uuaaccauuuaaaaa

SEQ ID NO: 2093102 - RNA, 18 nt, Staphylococcus aureus subsp. aureus MW2
ugugcuuuucgcuuuucu

SEQ ID NO: 2093103 - RNA, 21 nt, Staphylococcus aureus subsp. aureus MW2
uuaacccuucuccaaaaauaa

SEQ ID NO: 2093104 - RNA, 23 nt, Staphylococcus aureus subsp. aureus MW2
uuaauccgauuuugauauaaaaa

SEQ ID NO: 2093105 - RNA, 18 nt, Staphylococcus aureus subsp. aureus MW2
uuaauccgucuuuuuuua

SEQ ID NO: 2093106 - RNA, 14 nt, Staphylococcus aureus subsp. aureus MW2
uuaaucaauuuaau

SEQ ID NO: 2093107 - RNA, 18 nt, Staphylococcus aureus subsp. aureus MW2
uuaaucgcucuaaauagu

SEQ ID NO: 2093108 - RNA, 22 nt, Staphylococcus aureus subsp. aureus MW2
uuaaucguauuagccaauaaaa

SEQ ID NO: 2093109 - RNA, 20 nt, Staphylococcus aureus subsp. aureus MW2
uuaauacuaccguuuuuaua

SEQ ID NO: 2093110 - RNA, 23 nt, Staphylococcus aureus subsp. aureus MW2
uuaauagagaaaaaauaaauguu

SEQ ID NO: 2093111 - RNA, 13 nt, Staphylococcus aureus subsp. aureus MW2
uuaauagaucuuu

SEQ ID NO: 2093112 - RNA, 18 nt, Staphylococcus aureus subsp. aureus MW2
uuaauagcuuguuuauuu

SEQ ID NO: 2093113 - RNA, 13 nt, Staphylococcus aureus subsp. aureus MW2
uuaauauaaauau

SEQ ID NO: 2093114 - RNA, 13 nt, Staphylococcus aureus subsp. aureus MW2
uuaauauuuauua

SEQ ID NO: 2093115 - RNA, 18 nt, Staphylococcus aureus subsp. aureus MW2
uuaauauuugauaacaaa

SEQ ID NO: 2093116 - RNA, 15 nt, Staphylococcus aureus subsp. aureus MW2
uuaauauugaauaaa

SEQ ID NO: 2093117 - RNA, 20 nt, Staphylococcus aureus subsp. aureus MW2
uuaauauugaauaaaaaaac

SEQ ID NO: 2093118 - RNA, 12 nt, Staphylococcus aureus subsp. aureus MW2
uuaagugaguuu

SEQ ID NO: 2093119 - RNA, 18 nt, Staphylococcus aureus subsp. aureus MW2
uuaagugaguuuuauuua

SEQ ID NO: 2093120 - RNA, 17 nt, Staphylococcus aureus subsp. aureus MW2
uuaagugggacuuuuua

SEQ ID NO: 2093121 - RNA, 23 nt, Staphylococcus aureus subsp. aureus MW2
uuaagugaugaccaauauucugg

SEQ ID NO: 2093122 - RNA, 24 nt, Staphylococcus aureus subsp. aureus MW2
uuaaguguauauaguaggagugaa

SEQ ID NO: 2093123 - RNA, 19 nt, Staphylococcus aureus subsp. aureus MW2
uuaaguugaaaaccucuuu

SEQ ID NO: 2093124 - RNA, 22 nt, Staphylococcus aureus subsp. aureus MW2
uuaaguucaucuggugcaauau

SEQ ID NO: 2093125 - RNA, 19 nt, Staphylococcus aureus subsp. aureus MW2
uuaaguuaucuaaaccuuu

SEQ ID NO: 2093126 - RNA, 19 nt, Staphylococcus aureus subsp. aureus MW2
uuaaguuguugauuuaaaa

SEQ ID NO: 2093127 - RNA, 20 nt, Staphylococcus aureus subsp. aureus MW2
uuaauacuauaguaagaaaa

SEQ ID NO: 2093128 - RNA, 19 nt, Staphylococcus aureus subsp. aureus MW2
uuaauaagcuaauauuuau

SEQ ID NO: 2093129 - RNA, 19 nt, Staphylococcus aureus subsp. aureus MW2
uuaauaacccauuuucaaa

SEQ ID NO: 2093130 - RNA, 20 nt, Staphylococcus aureus subsp. aureus MW2
uuaauaacccauuuucaaaa

SEQ ID NO: 2093131 - RNA, 19 nt, Staphylococcus aureus subsp. aureus MW2
uuaauaaccauguaaaauu

SEQ ID NO: 2093132 - RNA, 14 nt, Staphylococcus aureus subsp. aureus MW2
uuaauaacaaaauu

SEQ ID NO: 2093133 - RNA, 19 nt, Staphylococcus aureus subsp. aureus MW2
uuaauaaccuuuaaaacau

SEQ ID NO: 2093134 - RNA, 17 nt, Staphylococcus aureus subsp. aureus MW2
uuaauaaccgaaauauu

SEQ ID NO: 2093135 - RNA, 20 nt, Staphylococcus aureus subsp. aureus MW2
uuaauugcagguaaacggaa

SEQ ID NO: 2093136 - RNA, 17 nt, Staphylococcus aureus subsp. aureus MW2
uuaauugcguuuaauaa

SEQ ID NO: 2093137 - RNA, 16 nt, Staphylococcus aureus subsp. aureus MW2
uuaauuucaugugcaa

SEQ ID NO: 2093138 - RNA, 16 nt, Staphylococcus aureus subsp. aureus MW2
uuaauucuuugaaaac

SEQ ID NO: 2093139 - RNA, 18 nt, Staphylococcus aureus subsp. aureus MW2
uuaauugaaaaaccaagu

SEQ ID NO: 2093140 - RNA, 14 nt, Staphylococcus aureus subsp. aureus MW2
uuaauugaaaauaa

SEQ ID NO: 2093141 - RNA, 22 nt, Staphylococcus aureus subsp. aureus MW2
uuaauucaggauggaaugauac

SEQ ID NO: 2093142 - RNA, 15 nt, Staphylococcus aureus subsp. aureus MW2
uuaauucauuccaaa

SEQ ID NO: 2093143 - RNA, 20 nt, Staphylococcus aureus subsp. aureus MW2
uuaauuaauaauuuaacuaa

SEQ ID NO: 2093144 - RNA, 12 nt, Staphylococcus aureus subsp. aureus MW2
uuaauuaacaaa

SEQ ID NO: 2093145 - RNA, 13 nt, Staphylococcus aureus subsp. aureus MW2
uuaauguuacauu

SEQ ID NO: 2093146 - RNA, 19 nt, Staphylococcus aureus subsp. aureus MW2
uuaauuacuguaaauauga

SEQ ID NO: 2093147 - RNA, 14 nt, Staphylococcus aureus subsp. aureus MW2
uuaauuauuugaua

SEQ ID NO: 2093148 - RNA, 20 nt, Staphylococcus aureus subsp. aureus MW2
uuaauuauguauuuuuauuu

SEQ ID NO: 2093149 - RNA, 22 nt, Staphylococcus aureus subsp. aureus MW2
uuaauuauugagaauauuuauu

SEQ ID NO: 2093150 - RNA, 16 nt, Staphylococcus aureus subsp. aureus MW2
uuaauuaucauaaaua

SEQ ID NO: 2093151 - RNA, 17 nt, Staphylococcus aureus subsp. aureus MW2
uuaauuaucauaaauau

SEQ ID NO: 2093152 - RNA, 19 nt, Staphylococcus aureus subsp. aureus MW2
uuaauuaucauaaauauaa

SEQ ID NO: 2093153 - RNA, 19 nt, Staphylococcus aureus subsp. aureus MW2
uuaaugauuuuucaucaau

SEQ ID NO: 2093154 - RNA, 15 nt, Staphylococcus aureus subsp. aureus MW2
uuaaugauuuuucau

SEQ ID NO: 2093155 - RNA, 14 nt, Staphylococcus aureus subsp. aureus MW2
uuaaucuauauaua

SEQ ID NO: 2093156 - RNA, 23 nt, Staphylococcus aureus subsp. aureus MW2
uuaaucucaugccaaaaacauua

SEQ ID NO: 2093157 - RNA, 21 nt, Staphylococcus aureus subsp. aureus MW2
uuaaugccauuguuauccaaa

SEQ ID NO: 2093158 - RNA, 20 nt, Staphylococcus aureus subsp. aureus MW2
uuaaugcuucaaauguaaca

SEQ ID NO: 2093159 - RNA, 22 nt, Staphylococcus aureus subsp. aureus MW2
uuaaugcuucaaauguaacauu

SEQ ID NO: 2093160 - RNA, 19 nt, Staphylococcus aureus subsp. aureus MW2
uuaauggcaacuaagauga

SEQ ID NO: 2093161 - RNA, 23 nt, Staphylococcus aureus subsp. aureus MW2
uuaaugggcgugccauuaaaauu

SEQ ID NO: 2093162 - RNA, 16 nt, Staphylococcus aureus subsp. aureus MW2
uuaauguauucuucua

SEQ ID NO: 2093163 - RNA, 15 nt, Staphylococcus aureus subsp. aureus MW2
uuaaugucacaugua

SEQ ID NO: 2093164 - RNA, 14 nt, Staphylococcus aureus subsp. aureus MW2
uuaaugugcauauu

SEQ ID NO: 2093165 - RNA, 14 nt, Staphylococcus aureus subsp. aureus MW2
uuaauguuaaacaa

SEQ ID NO: 2093166 - RNA, 14 nt, Staphylococcus aureus subsp. aureus MW2
uuaauguuuaauaa

SEQ ID NO: 2093167 - RNA, 22 nt, Staphylococcus aureus subsp. aureus MW2
uuaauguuauaacccuaauucu

SEQ ID NO: 2093168 - RNA, 11 nt, Staphylococcus aureus subsp. aureus MW2
uuaauguguaa

SEQ ID NO: 2093169 - RNA, 15 nt, Staphylococcus aureus subsp. aureus MW2
uuaauguguaaauuu

SEQ ID NO: 2093170 - RNA, 16 nt, Staphylococcus aureus subsp. aureus MW2
uuacagacaaacauua

SEQ ID NO: 2093171 - RNA, 13 nt, Staphylococcus aureus subsp. aureus MW2
uuacagauuucug

SEQ ID NO: 2093172 - RNA, 21 nt, Staphylococcus aureus subsp. aureus MW2
uuacaaugcgguauugcaugu

SEQ ID NO: 2093173 - RNA, 15 nt, Staphylococcus aureus subsp. aureus MW2
uuacaauaugauuaa

SEQ ID NO: 2093174 - RNA, 14 nt, Staphylococcus aureus subsp. aureus MW2
uuacaauuguucuc

SEQ ID NO: 2093175 - RNA, 23 nt, Staphylococcus aureus subsp. aureus MW2
uuaauuuuaugucccaaugcuga

SEQ ID NO: 2093176 - RNA, 18 nt, Staphylococcus aureus subsp. aureus MW2
uuaauuuuaugucccaau

SEQ ID NO: 2093177 - RNA, 17 nt, Staphylococcus aureus subsp. aureus MW2
uuaauuuguuuuaaaua

SEQ ID NO: 2093178 - RNA, 18 nt, Staphylococcus aureus subsp. aureus MW2
uuaauuuguauuuaaaau

SEQ ID NO: 2093179 - RNA, 17 nt, Staphylococcus aureus subsp. aureus MW2
uuacaauaaagacauau

SEQ ID NO: 2093180 - RNA, 12 nt, Staphylococcus aureus subsp. aureus MW2
uuacaaguuguu

SEQ ID NO: 2093181 - RNA, 11 nt, Staphylococcus aureus subsp. aureus MW2
uuacaauaaug

SEQ ID NO: 2093182 - RNA, 12 nt, Staphylococcus aureus subsp. aureus MW2
uuacaauaaugu

SEQ ID NO: 2093183 - RNA, 20 nt, Staphylococcus aureus subsp. aureus MW2
uuacaauaaugugcaaguug

SEQ ID NO: 2093184 - RNA, 23 nt, Staphylococcus aureus subsp. aureus MW2
uuaauuuccaauaucuucuuuua

SEQ ID NO: 2093185 - RNA, 11 nt, Staphylococcus aureus subsp. aureus MW2
uuaccaaaauu

SEQ ID NO: 2093186 - RNA, 12 nt, Staphylococcus aureus subsp. aureus MW2
uuaccaaaauuu

SEQ ID NO: 2093187 - RNA, 19 nt, Staphylococcus aureus subsp. aureus MW2
uuacauuuuaauaaaauca

SEQ ID NO: 2093188 - RNA, 20 nt, Staphylococcus aureus subsp. aureus MW2
uuacauuuggcguaaugaua

SEQ ID NO: 2093189 - RNA, 18 nt, Staphylococcus aureus subsp. aureus MW2
uuacauuuuaauaaaauc

SEQ ID NO: 2093190 - RNA, 20 nt, Staphylococcus aureus subsp. aureus MW2
uuacauguuacugaugaaca

SEQ ID NO: 2093191 - RNA, 12 nt, Staphylococcus aureus subsp. aureus MW2
uuacauguuggc

SEQ ID NO: 2093192 - RNA, 16 nt, Staphylococcus aureus subsp. aureus MW2
uuacauuuaacauuuc

SEQ ID NO: 2093193 - RNA, 20 nt, Staphylococcus aureus subsp. aureus MW2
uuacauuuaguacauauguu

SEQ ID NO: 2093194 - RNA, 12 nt, Staphylococcus aureus subsp. aureus MW2
uuacauuuaugg

SEQ ID NO: 2093195 - RNA, 22 nt, Staphylococcus aureus subsp. aureus MW2
uuacaugcaccuuuacaacaua

SEQ ID NO: 2093196 - RNA, 18 nt, Staphylococcus aureus subsp. aureus MW2
uuaguacuuaauacuaau

SEQ ID NO: 2093197 - RNA, 19 nt, Staphylococcus aureus subsp. aureus MW2
uuaguacuuaauacuaauu

SEQ ID NO: 2093198 - RNA, 18 nt, Staphylococcus aureus subsp. aureus MW2
uuaguacacguguauugu

SEQ ID NO: 2093199 - RNA, 22 nt, Staphylococcus aureus subsp. aureus MW2
uuaguacuaaaccgauuaauau

SEQ ID NO: 2093200 - RNA, 20 nt, Staphylococcus aureus subsp. aureus MW2
uuaguagaaaccuuaaaauc

SEQ ID NO: 2093201 - RNA, 20 nt, Staphylococcus aureus subsp. aureus MW2
uuaguaguuuauaucaaaaa

SEQ ID NO: 2093202 - RNA, 18 nt, Staphylococcus aureus subsp. aureus MW2
uuaguauaaauaaaaaua

SEQ ID NO: 2093203 - RNA, 21 nt, Staphylococcus aureus subsp. aureus MW2
uuaguauaauuuaucuuaauc

SEQ ID NO: 2093204 - RNA, 17 nt, Staphylococcus aureus subsp. aureus MW2
uuaguauucaaaaaaau

SEQ ID NO: 2093205 - RNA, 18 nt, Staphylococcus aureus subsp. aureus MW2
uuagucauugaaaauauu

SEQ ID NO: 2093206 - RNA, 22 nt, Staphylococcus aureus subsp. aureus MW2
uuagucauugaaaauauuuuau

SEQ ID NO: 2093207 - RNA, 20 nt, Staphylococcus aureus subsp. aureus MW2
uuagguggagauuuaacaau

SEQ ID NO: 2093208 - RNA, 17 nt, Staphylococcus aureus subsp. aureus MW2
uuagguugauuucugcu

SEQ ID NO: 2093209 - RNA, 13 nt, Staphylococcus aureus subsp. aureus MW2
uuagguaaaaauu

SEQ ID NO: 2093210 - RNA, 19 nt, Staphylococcus aureus subsp. aureus MW2
uuagguaaaaauuaacaac

SEQ ID NO: 2093211 - RNA, 14 nt, Staphylococcus aureus subsp. aureus MW2
uuaguacaaaauug

SEQ ID NO: 2093212 - RNA, 21 nt, Staphylococcus aureus subsp. aureus MW2
uuaguacggcugcuuuaacug

SEQ ID NO: 2093213 - RNA, 13 nt, Staphylococcus aureus subsp. aureus MW2
uuaguaaauauag

SEQ ID NO: 2093214 - RNA, 14 nt, Staphylococcus aureus subsp. aureus MW2
uuauaaaaaacggu

SEQ ID NO: 2093215 - RNA, 12 nt, Staphylococcus aureus subsp. aureus MW2
uuauaaaaaacg

SEQ ID NO: 2093216 - RNA, 14 nt, Staphylococcus aureus subsp. aureus MW2
uuauaaaaagagau

SEQ ID NO: 2093217 - RNA, 23 nt, Staphylococcus aureus subsp. aureus MW2
uuaguugccccuagcaaaaauac

SEQ ID NO: 2093218 - RNA, 15 nt, Staphylococcus aureus subsp. aureus MW2
uuaguguagaaaaua

SEQ ID NO: 2093219 - RNA, 15 nt, Staphylococcus aureus subsp. aureus MW2
uuaguuauacuacua

SEQ ID NO: 2093220 - RNA, 19 nt, Staphylococcus aureus subsp. aureus MW2
uuaguucacaugaauuuua

SEQ ID NO: 2093221 - RNA, 16 nt, Staphylococcus aureus subsp. aureus MW2
uuauaacaaaaauugc

SEQ ID NO: 2093222 - RNA, 12 nt, Staphylococcus aureus subsp. aureus MW2
uuauaacauuua

SEQ ID NO: 2093223 - RNA, 23 nt, Staphylococcus aureus subsp. aureus MW2
uuauaacccuaauucuuuaauaa

SEQ ID NO: 2093224 - RNA, 18 nt, Staphylococcus aureus subsp. aureus MW2
uuauaaaugauuaaagug

SEQ ID NO: 2093225 - RNA, 14 nt, Staphylococcus aureus subsp. aureus MW2
uuauaaauaucuuu

SEQ ID NO: 2093226 - RNA, 20 nt, Staphylococcus aureus subsp. aureus MW2
uuauaaauagagaacagcag

SEQ ID NO: 2093227 - RNA, 13 nt, Staphylococcus aureus subsp. aureus MW2
uuauaaagcugcg

SEQ ID NO: 2093228 - RNA, 21 nt, Staphylococcus aureus subsp. aureus MW2
uuauaaagcugcgaaacuugu

SEQ ID NO: 2093229 - RNA, 23 nt, Staphylococcus aureus subsp. aureus MW2
uuauaaauaaacauaaaaauauu

SEQ ID NO: 2093230 - RNA, 17 nt, Staphylococcus aureus subsp. aureus MW2
uuauaaaaugaauaauu

SEQ ID NO: 2093231 - RNA, 22 nt, Staphylococcus aureus subsp. aureus MW2
uuauaaagacaccuucaauauc

SEQ ID NO: 2093232 - RNA, 12 nt, Staphylococcus aureus subsp. aureus MW2
uuauaaagccug

SEQ ID NO: 2093233 - RNA, 13 nt, Staphylococcus aureus subsp. aureus MW2
uuauaauuguuca

SEQ ID NO: 2093234 - RNA, 12 nt, Staphylococcus aureus subsp. aureus MW2
uuauaauuuaau

SEQ ID NO: 2093235 - RNA, 15 nt, Staphylococcus aureus subsp. aureus MW2
uuauacagugaaucu

SEQ ID NO: 2093236 - RNA, 14 nt, Staphylococcus aureus subsp. aureus MW2
uuauacacuuuuug

SEQ ID NO: 2093237 - RNA, 15 nt, Staphylococcus aureus subsp. aureus MW2
uuauaauagagaaac

SEQ ID NO: 2093238 - RNA, 18 nt, Staphylococcus aureus subsp. aureus MW2
uuauaauaucgacuuuuc

SEQ ID NO: 2093239 - RNA, 19 nt, Staphylococcus aureus subsp. aureus MW2
uuauaaguuaaaaauguaa

SEQ ID NO: 2093240 - RNA, 22 nt, Staphylococcus aureus subsp. aureus MW2
uuauaaguuaaaaauguaaaua

SEQ ID NO: 2093241 - RNA, 16 nt, Staphylococcus aureus subsp. aureus MW2
uuauaaugauuaaaaa

SEQ ID NO: 2093242 - RNA, 16 nt, Staphylococcus aureus subsp. aureus MW2
uuauagaaagcaaugu

SEQ ID NO: 2093243 - RNA, 19 nt, Staphylococcus aureus subsp. aureus MW2
uuauacuaaauugagaagu

SEQ ID NO: 2093244 - RNA, 15 nt, Staphylococcus aureus subsp. aureus MW2
uuauacauaaauauu

SEQ ID NO: 2093245 - RNA, 20 nt, Staphylococcus aureus subsp. aureus MW2
uuacuaaaugaauugcuugu

SEQ ID NO: 2093246 - RNA, 12 nt, Staphylococcus aureus subsp. aureus MW2
uuacuaaaacaa

SEQ ID NO: 2093247 - RNA, 12 nt, Staphylococcus aureus subsp. aureus MW2
uuacuaaaauau

SEQ ID NO: 2093248 - RNA, 18 nt, Staphylococcus aureus subsp. aureus MW2
uuacgugaccuuuguaag

SEQ ID NO: 2093249 - RNA, 22 nt, Staphylococcus aureus subsp. aureus MW2
uuacuugcuuuuucaaauaaua

SEQ ID NO: 2093250 - RNA, 21 nt, Staphylococcus aureus subsp. aureus MW2
uuacuugcuuuuucaaauaau

SEQ ID NO: 2093251 - RNA, 18 nt, Staphylococcus aureus subsp. aureus MW2
uuacuucuaauaguaaug

SEQ ID NO: 2093252 - RNA, 22 nt, Staphylococcus aureus subsp. aureus MW2
uuagaacaguuagaaacagaau

SEQ ID NO: 2093253 - RNA, 11 nt, Staphylococcus aureus subsp. aureus MW2
uuacuuugaaa

SEQ ID NO: 2093254 - RNA, 12 nt, Staphylococcus aureus subsp. aureus MW2
uuacuuuaacuu

SEQ ID NO: 2093255 - RNA, 16 nt, Staphylococcus aureus subsp. aureus MW2
uuacugaugaacauac

SEQ ID NO: 2093256 - RNA, 23 nt, Staphylococcus aureus subsp. aureus MW2
uuagcuuuuguaaagcuuuaguu

SEQ ID NO: 2093257 - RNA, 18 nt, Staphylococcus aureus subsp. aureus MW2
uuaggaaugauagauuua

SEQ ID NO: 2093258 - RNA, 22 nt, Staphylococcus aureus subsp. aureus MW2
uuaggaaucgucauauuaauau

SEQ ID NO: 2093259 - RNA, 17 nt, Staphylococcus aureus subsp. aureus MW2
uuagccaaaucuuuaau

SEQ ID NO: 2093260 - RNA, 19 nt, Staphylococcus aureus subsp. aureus MW2
uuagcaucuuuaccauaua

SEQ ID NO: 2093261 - RNA, 18 nt, Staphylococcus aureus subsp. aureus MW2
uuagcaugacuguaagua

SEQ ID NO: 2093262 - RNA, 19 nt, Staphylococcus aureus subsp. aureus MW2
uuagccaauaccgaauaau

SEQ ID NO: 2093263 - RNA, 23 nt, Staphylococcus aureus subsp. aureus MW2
uuagaagaacaauaauugaugaa

SEQ ID NO: 2093264 - RNA, 23 nt, Staphylococcus aureus subsp. aureus MW2
uuagaaccaucauuuauauggaa

SEQ ID NO: 2093265 - RNA, 18 nt, Staphylococcus aureus subsp. aureus MW2
uuagaagaugauuauucu

SEQ ID NO: 2093266 - RNA, 23 nt, Staphylococcus aureus subsp. aureus MW2
uuagaagaugauuauucucuuua

SEQ ID NO: 2093267 - RNA, 14 nt, Staphylococcus aureus subsp. aureus MW2
uuagcauacauuaa

SEQ ID NO: 2093268 - RNA, 16 nt, Staphylococcus aureus subsp. aureus MW2
uucaacuuuuuaauaa

SEQ ID NO: 2093269 - RNA, 14 nt, Staphylococcus aureus subsp. aureus MW2
uucaaguuuaaaau

SEQ ID NO: 2093270 - RNA, 17 nt, Staphylococcus aureus subsp. aureus MW2
uucaagagguuuuauuu

SEQ ID NO: 2093271 - RNA, 15 nt, Staphylococcus aureus subsp. aureus MW2
uucaauaauaaauca

SEQ ID NO: 2093272 - RNA, 16 nt, Staphylococcus aureus subsp. aureus MW2
uucaauaaauuuuaua

SEQ ID NO: 2093273 - RNA, 18 nt, Staphylococcus aureus subsp. aureus MW2
uucaauacaaacacccac

SEQ ID NO: 2093274 - RNA, 16 nt, Staphylococcus aureus subsp. aureus MW2
uucaauaaucuuaggu

SEQ ID NO: 2093275 - RNA, 17 nt, Staphylococcus aureus subsp. aureus MW2
uucaauaaucuuaggug

SEQ ID NO: 2093276 - RNA, 17 nt, Staphylococcus aureus subsp. aureus MW2
uucaaccaauuauuaaa

SEQ ID NO: 2093277 - RNA, 12 nt, Staphylococcus aureus subsp. aureus MW2
uucaaacauauu

SEQ ID NO: 2093278 - RNA, 14 nt, Staphylococcus aureus subsp. aureus MW2
uucaacauauuaua

SEQ ID NO: 2093279 - RNA, 17 nt, Staphylococcus aureus subsp. aureus MW2
uucaaaaucuuuaucag

SEQ ID NO: 2093280 - RNA, 15 nt, Staphylococcus aureus subsp. aureus MW2
uucaaaauuuugacu

SEQ ID NO: 2093281 - RNA, 16 nt, Staphylococcus aureus subsp. aureus MW2
uucaaaauaacuuaug

SEQ ID NO: 2093282 - RNA, 20 nt, Staphylococcus aureus subsp. aureus MW2
uucaaaacguuuaauugcag

SEQ ID NO: 2093283 - RNA, 19 nt, Staphylococcus aureus subsp. aureus MW2
uucaaaacguuuaauugca

SEQ ID NO: 2093284 - RNA, 16 nt, Staphylococcus aureus subsp. aureus MW2
uucaaaaaucauacca

SEQ ID NO: 2093285 - RNA, 11 nt, Staphylococcus aureus subsp. aureus MW2
uucaaaaauag

SEQ ID NO: 2093286 - RNA, 23 nt, Staphylococcus aureus subsp. aureus MW2
uucaaaagaaauuguguuucuuu

SEQ ID NO: 2093287 - RNA, 17 nt, Staphylococcus aureus subsp. aureus MW2
uuauuuuuuucuuucuu

SEQ ID NO: 2093288 - RNA, 20 nt, Staphylococcus aureus subsp. aureus MW2
uuauuuuuugucuaugucaa

SEQ ID NO: 2093289 - RNA, 13 nt, Staphylococcus aureus subsp. aureus MW2
uuauuuuuuuaaa

SEQ ID NO: 2093290 - RNA, 15 nt, Staphylococcus aureus subsp. aureus MW2
uuauuuuaaaauauu

SEQ ID NO: 2093291 - RNA, 20 nt, Staphylococcus aureus subsp. aureus MW2
uuauuuuaaaauauuaauca

SEQ ID NO: 2093292 - RNA, 23 nt, Staphylococcus aureus subsp. aureus MW2
uuauuuuaaaauauuaaucaauu

SEQ ID NO: 2093293 - RNA, 14 nt, Staphylococcus aureus subsp. aureus MW2
uucaaaaaaauauu

SEQ ID NO: 2093294 - RNA, 15 nt, Staphylococcus aureus subsp. aureus MW2
uucaaaaaaauauuu

SEQ ID NO: 2093295 - RNA, 21 nt, Staphylococcus aureus subsp. aureus MW2
uuauuuuuuuaaaucuauaua

SEQ ID NO: 2093296 - RNA, 19 nt, Staphylococcus aureus subsp. aureus MW2
uucaaaaaucauaccacgg

SEQ ID NO: 2093297 - RNA, 21 nt, Staphylococcus aureus subsp. aureus MW2
uuauuugauaaugauagugua

SEQ ID NO: 2093298 - RNA, 15 nt, Staphylococcus aureus subsp. aureus MW2
uuauuugauuauucu

SEQ ID NO: 2093299 - RNA, 17 nt, Staphylococcus aureus subsp. aureus MW2
uuauuugaaugcaaauc

SEQ ID NO: 2093300 - RNA, 18 nt, Staphylococcus aureus subsp. aureus MW2
uuauuuggguaacauuag

SEQ ID NO: 2093301 - RNA, 15 nt, Staphylococcus aureus subsp. aureus MW2
uuauuuguaauuuca

SEQ ID NO: 2093302 - RNA, 13 nt, Staphylococcus aureus subsp. aureus MW2
uuauuuaacacuu

SEQ ID NO: 2093303 - RNA, 15 nt, Staphylococcus aureus subsp. aureus MW2
uuauuuaauaacgaa

SEQ ID NO: 2093304 - RNA, 19 nt, Staphylococcus aureus subsp. aureus MW2
uuauuucuuuucauuauca

SEQ ID NO: 2093305 - RNA, 13 nt, Staphylococcus aureus subsp. aureus MW2
uuauuugaaauaa

SEQ ID NO: 2093306 - RNA, 17 nt, Staphylococcus aureus subsp. aureus MW2
uuauuagauacuucuuu

SEQ ID NO: 2093307 - RNA, 14 nt, Staphylococcus aureus subsp. aureus MW2
uuauuauaaaauaa

SEQ ID NO: 2093308 - RNA, 17 nt, Staphylococcus aureus subsp. aureus MW2
uuauuaggauucaauaa

SEQ ID NO: 2093309 - RNA, 17 nt, Staphylococcus aureus subsp. aureus MW2
uuauucugaaaaauauu

SEQ ID NO: 2093310 - RNA, 22 nt, Staphylococcus aureus subsp. aureus MW2
uuauucuucacuuucaguagau

SEQ ID NO: 2093311 - RNA, 14 nt, Staphylococcus aureus subsp. aureus MW2
uuauuauaauagcu

SEQ ID NO: 2093312 - RNA, 15 nt, Staphylococcus aureus subsp. aureus MW2
uuauucuaauacaaa

SEQ ID NO: 2093313 - RNA, 15 nt, Staphylococcus aureus subsp. aureus MW2
uuauugaaaagauaa

SEQ ID NO: 2093314 - RNA, 20 nt, Staphylococcus aureus subsp. aureus MW2
uuauugaaaacaaaaaagag

SEQ ID NO: 2093315 - RNA, 17 nt, Staphylococcus aureus subsp. aureus MW2
uuauuguuccaaucuuu

SEQ ID NO: 2093316 - RNA, 22 nt, Staphylococcus aureus subsp. aureus MW2
uuauuuaaaacuuguaaauuua

SEQ ID NO: 2093317 - RNA, 17 nt, Staphylococcus aureus subsp. aureus MW2
uuauuguuuuuaaaauc

SEQ ID NO: 2093318 - RNA, 13 nt, Staphylococcus aureus subsp. aureus MW2
uuauuuaaaacuu

SEQ ID NO: 2093319 - RNA, 14 nt, Staphylococcus aureus subsp. aureus MW2
uuauuguuuuuaaa

SEQ ID NO: 2093320 - RNA, 15 nt, Staphylococcus aureus subsp. aureus MW2
uuauuuaaaaauagc

SEQ ID NO: 2093321 - RNA, 22 nt, Staphylococcus aureus subsp. aureus MW2
uucaauccaagcaaucuuagua

SEQ ID NO: 2093322 - RNA, 12 nt, Staphylococcus aureus subsp. aureus MW2
uucaauccuuug

SEQ ID NO: 2093323 - RNA, 18 nt, Staphylococcus aureus subsp. aureus MW2
uucacacagcuucauuaa

SEQ ID NO: 2093324 - RNA, 22 nt, Staphylococcus aureus subsp. aureus MW2
uucaaucaacgagucauaaaua

SEQ ID NO: 2093325 - RNA, 23 nt, Staphylococcus aureus subsp. aureus MW2
uucaauacuucuuguucgauaau

SEQ ID NO: 2093326 - RNA, 19 nt, Staphylococcus aureus subsp. aureus MW2
uucaauaguaccaugcucu

SEQ ID NO: 2093327 - RNA, 23 nt, Staphylococcus aureus subsp. aureus MW2
uucaauaguaccaugcucuuuuu

SEQ ID NO: 2093328 - RNA, 21 nt, Staphylococcus aureus subsp. aureus MW2
uucacgaauaucuuaaagaau

SEQ ID NO: 2093329 - RNA, 13 nt, Staphylococcus aureus subsp. aureus MW2
uucaccuaaucuu

SEQ ID NO: 2093330 - RNA, 16 nt, Staphylococcus aureus subsp. aureus MW2
uucacguaaugaauca

SEQ ID NO: 2093331 - RNA, 18 nt, Staphylococcus aureus subsp. aureus MW2
uucaccguaaucuuuuaa

SEQ ID NO: 2093332 - RNA, 14 nt, Staphylococcus aureus subsp. aureus MW2
uucaccguaaucuu

SEQ ID NO: 2093333 - RNA, 17 nt, Staphylococcus aureus subsp. aureus MW2
uucacuacauuaaaaau

SEQ ID NO: 2093334 - RNA, 22 nt, Staphylococcus aureus subsp. aureus MW2
uucacuaccauagauuauauua

SEQ ID NO: 2093335 - RNA, 19 nt, Staphylococcus aureus subsp. aureus MW2
uucacuaguguauacaagg

SEQ ID NO: 2093336 - RNA, 18 nt, Staphylococcus aureus subsp. aureus MW2
uucacuaaauucaauaau

SEQ ID NO: 2093337 - RNA, 20 nt, Staphylococcus aureus subsp. aureus MW2
uucacuaaaaauauauuuca

SEQ ID NO: 2093338 - RNA, 16 nt, Staphylococcus aureus subsp. aureus MW2
uucacuaaaaauauau

SEQ ID NO: 2093339 - RNA, 19 nt, Staphylococcus aureus subsp. aureus MW2
uucagcuucuaaguaauau

SEQ ID NO: 2093340 - RNA, 21 nt, Staphylococcus aureus subsp. aureus MW2
uucaggaauaucuuucaaauu

SEQ ID NO: 2093341 - RNA, 19 nt, Staphylococcus aureus subsp. aureus MW2
uucagcauugggacauaaa

SEQ ID NO: 2093342 - RNA, 23 nt, Staphylococcus aureus subsp. aureus MW2
uuauguauuuuuauuuauacuaa

SEQ ID NO: 2093343 - RNA, 14 nt, Staphylococcus aureus subsp. aureus MW2
uuauguaaaaaaua

SEQ ID NO: 2093344 - RNA, 22 nt, Staphylococcus aureus subsp. aureus MW2
uuauggcagauccauaaggauu

SEQ ID NO: 2093345 - RNA, 13 nt, Staphylococcus aureus subsp. aureus MW2
uuauggauuuauu

SEQ ID NO: 2093346 - RNA, 17 nt, Staphylococcus aureus subsp. aureus MW2
uuaugggauguauuuuu

SEQ ID NO: 2093347 - RNA, 17 nt, Staphylococcus aureus subsp. aureus MW2
uuaugcccgauaauucu

SEQ ID NO: 2093348 - RNA, 21 nt, Staphylococcus aureus subsp. aureus MW2
uuaugcauauguaauacaaaa

SEQ ID NO: 2093349 - RNA, 15 nt, Staphylococcus aureus subsp. aureus MW2
uuaugcaaaauuaau

SEQ ID NO: 2093350 - RNA, 12 nt, Staphylococcus aureus subsp. aureus MW2
uuaugugcauca

SEQ ID NO: 2093351 - RNA, 18 nt, Staphylococcus aureus subsp. aureus MW2
uuaugugcuaaucuauuu

SEQ ID NO: 2093352 - RNA, 20 nt, Staphylococcus aureus subsp. aureus MW2
uuauguuauaaauucuaucu

SEQ ID NO: 2093353 - RNA, 16 nt, Staphylococcus aureus subsp. aureus MW2
uuauguuuaaacauuu

SEQ ID NO: 2093354 - RNA, 17 nt, Staphylococcus aureus subsp. aureus MW2
uuauguucgauuauucu

SEQ ID NO: 2093355 - RNA, 18 nt, Staphylococcus aureus subsp. aureus MW2
uuauuaaaucuuuuacua

SEQ ID NO: 2093356 - RNA, 13 nt, Staphylococcus aureus subsp. aureus MW2
uuauuaaaucuuu

SEQ ID NO: 2093357 - RNA, 20 nt, Staphylococcus aureus subsp. aureus MW2
uuauuaaaucuuuuacuaaa

SEQ ID NO: 2093358 - RNA, 12 nt, Staphylococcus aureus subsp. aureus MW2
uuauuaaauuca

SEQ ID NO: 2093359 - RNA, 18 nt, Staphylococcus aureus subsp. aureus MW2
uuauuaacuuuaauauaa

SEQ ID NO: 2093360 - RNA, 13 nt, Staphylococcus aureus subsp. aureus MW2
uuauuaacucaug

SEQ ID NO: 2093361 - RNA, 22 nt, Staphylococcus aureus subsp. aureus MW2
uuauuaaggggguaauacuaua

SEQ ID NO: 2093362 - RNA, 23 nt, Staphylococcus aureus subsp. aureus MW2
uuauuaauaaauucucuuggaua

SEQ ID NO: 2093363 - RNA, 12 nt, Staphylococcus aureus subsp. aureus MW2
uuauuaauuccu

SEQ ID NO: 2093364 - RNA, 13 nt, Staphylococcus aureus subsp. aureus MW2
uuauuaacugugu

SEQ ID NO: 2093365 - RNA, 12 nt, Staphylococcus aureus subsp. aureus MW2
uuauuaacugua

SEQ ID NO: 2093366 - RNA, 17 nt, Staphylococcus aureus subsp. aureus MW2
uuauuaacaaaagugaa

SEQ ID NO: 2093367 - RNA, 14 nt, Staphylococcus aureus subsp. aureus MW2
uuauuaacuuuaau

SEQ ID NO: 2093368 - RNA, 20 nt, Staphylococcus aureus subsp. aureus MW2
uuauuaccuuugcuaaauau

SEQ ID NO: 2093369 - RNA, 22 nt, Staphylococcus aureus subsp. aureus MW2
uuauuaccuuugcuaaauauua

SEQ ID NO: 2093370 - RNA, 16 nt, Staphylococcus aureus subsp. aureus MW2
uuauuaccauaaauuu

SEQ ID NO: 2093371 - RNA, 22 nt, Staphylococcus aureus subsp. aureus MW2
uuauuacaaacauuccucuauu

SEQ ID NO: 2093372 - RNA, 22 nt, Staphylococcus aureus subsp. aureus MW2
uuauuaauucugauuauguuca

SEQ ID NO: 2093373 - RNA, 15 nt, Staphylococcus aureus subsp. aureus MW2
uuauuaauuuaaaaa

SEQ ID NO: 2093374 - RNA, 14 nt, Staphylococcus aureus subsp. aureus MW2
uuaucuaacucaua

SEQ ID NO: 2093375 - RNA, 14 nt, Staphylococcus aureus subsp. aureus MW2
uuaucuauauauga

SEQ ID NO: 2093376 - RNA, 23 nt, Staphylococcus aureus subsp. aureus MW2
uuaucugaaucugcuaauuuaua

SEQ ID NO: 2093377 - RNA, 18 nt, Staphylococcus aureus subsp. aureus MW2
uuaucugacauuguugcu

SEQ ID NO: 2093378 - RNA, 15 nt, Staphylococcus aureus subsp. aureus MW2
uuaucugaaaauauc

SEQ ID NO: 2093379 - RNA, 19 nt, Staphylococcus aureus subsp. aureus MW2
uuaucgaucgguauuuuca

SEQ ID NO: 2093380 - RNA, 16 nt, Staphylococcus aureus subsp. aureus MW2
uuaucguaaaaaaacg

SEQ ID NO: 2093381 - RNA, 17 nt, Staphylococcus aureus subsp. aureus MW2
uuaucguaaaaaaacgu

SEQ ID NO: 2093382 - RNA, 13 nt, Staphylococcus aureus subsp. aureus MW2
uuaucguaaucuu

SEQ ID NO: 2093383 - RNA, 15 nt, Staphylococcus aureus subsp. aureus MW2
uuaucuaaacauuuu

SEQ ID NO: 2093384 - RNA, 20 nt, Staphylococcus aureus subsp. aureus MW2
uuaucuguagauuagcuuaa

SEQ ID NO: 2093385 - RNA, 19 nt, Staphylococcus aureus subsp. aureus MW2
uuaucuguagaaacacuuu

SEQ ID NO: 2093386 - RNA, 14 nt, Staphylococcus aureus subsp. aureus MW2
uuaucuuuaaauua

SEQ ID NO: 2093387 - RNA, 15 nt, Staphylococcus aureus subsp. aureus MW2
uuaugaaaagugaau

SEQ ID NO: 2093388 - RNA, 17 nt, Staphylococcus aureus subsp. aureus MW2
uuaugagcuucuuuaaa

SEQ ID NO: 2093389 - RNA, 16 nt, Staphylococcus aureus subsp. aureus MW2
uuauagguauaagaau

SEQ ID NO: 2093390 - RNA, 14 nt, Staphylococcus aureus subsp. aureus MW2
uuauauaaaaagaa

SEQ ID NO: 2093391 - RNA, 21 nt, Staphylococcus aureus subsp. aureus MW2
uuauagaugacuguagaaaac

SEQ ID NO: 2093392 - RNA, 13 nt, Staphylococcus aureus subsp. aureus MW2
uuauagccuucau

SEQ ID NO: 2093393 - RNA, 17 nt, Staphylococcus aureus subsp. aureus MW2
uuauauaauucuucaaa

SEQ ID NO: 2093394 - RNA, 23 nt, Staphylococcus aureus subsp. aureus MW2
uuauauaagugaccgauugcacg

SEQ ID NO: 2093395 - RNA, 17 nt, Staphylococcus aureus subsp. aureus MW2
uuauauauauuaaagua

SEQ ID NO: 2093396 - RNA, 14 nt, Staphylococcus aureus subsp. aureus MW2
uuauauauauuaaa

SEQ ID NO: 2093397 - RNA, 20 nt, Staphylococcus aureus subsp. aureus MW2
uuauaucaaaaaauauguuu

SEQ ID NO: 2093398 - RNA, 13 nt, Staphylococcus aureus subsp. aureus MW2
uuauaucaaaauc

SEQ ID NO: 2093399 - RNA, 15 nt, Staphylococcus aureus subsp. aureus MW2
uuauaucauaacuua

SEQ ID NO: 2093400 - RNA, 14 nt, Staphylococcus aureus subsp. aureus MW2
uuauauuaugaaca

SEQ ID NO: 2093401 - RNA, 12 nt, Staphylococcus aureus subsp. aureus MW2
uuauauuaaaua

SEQ ID NO: 2093402 - RNA, 17 nt, Staphylococcus aureus subsp. aureus MW2
uuauauugcaaaaauaa

SEQ ID NO: 2093403 - RNA, 22 nt, Staphylococcus aureus subsp. aureus MW2
uuauauugcaaaaauaauauga

SEQ ID NO: 2093404 - RNA, 16 nt, Staphylococcus aureus subsp. aureus MW2
uuauauuauuucaaua

SEQ ID NO: 2093405 - RNA, 16 nt, Staphylococcus aureus subsp. aureus MW2
uuauauugcaaaaaua

SEQ ID NO: 2093406 - RNA, 22 nt, Staphylococcus aureus subsp. aureus MW2
uuauaucuuuuauacauguaca

SEQ ID NO: 2093407 - RNA, 20 nt, Staphylococcus aureus subsp. aureus MW2
uuauaugaagcguuuuuauu

SEQ ID NO: 2093408 - RNA, 14 nt, Staphylococcus aureus subsp. aureus MW2
uuauaugcaacuua

SEQ ID NO: 2093409 - RNA, 17 nt, Staphylococcus aureus subsp. aureus MW2
uuauauuuuauuuaaaa

SEQ ID NO: 2093410 - RNA, 18 nt, Staphylococcus aureus subsp. aureus MW2
uuauauuguauuuuauuu

SEQ ID NO: 2093411 - RNA, 16 nt, Staphylococcus aureus subsp. aureus MW2
uuauauuguuaaaauu

SEQ ID NO: 2093412 - RNA, 14 nt, Staphylococcus aureus subsp. aureus MW2
uuauauuuaaacuc

SEQ ID NO: 2093413 - RNA, 23 nt, Staphylococcus aureus subsp. aureus MW2
uuauauuuaaaugcuuucaaaua

SEQ ID NO: 2093414 - RNA, 14 nt, Staphylococcus aureus subsp. aureus MW2
uuaucaaauugacc

SEQ ID NO: 2093415 - RNA, 18 nt, Staphylococcus aureus subsp. aureus MW2
uuauauuuuucuucaguu

SEQ ID NO: 2093416 - RNA, 22 nt, Staphylococcus aureus subsp. aureus MW2
uuaucgacuuugucauuuugau

SEQ ID NO: 2093417 - RNA, 14 nt, Staphylococcus aureus subsp. aureus MW2
uuauccuuuaaauc

SEQ ID NO: 2093418 - RNA, 15 nt, Staphylococcus aureus subsp. aureus MW2
uuauccuacugcugu

SEQ ID NO: 2093419 - RNA, 21 nt, Staphylococcus aureus subsp. aureus MW2
uuauccaaggauguuauaaaa

SEQ ID NO: 2093420 - RNA, 15 nt, Staphylococcus aureus subsp. aureus MW2
uuauccaaaacauuu

SEQ ID NO: 2093421 - RNA, 22 nt, Staphylococcus aureus subsp. aureus MW2
uuaucauuaaauugcuugaaau

SEQ ID NO: 2093422 - RNA, 16 nt, Staphylococcus aureus subsp. aureus MW2
uuaucauuacagauaa

SEQ ID NO: 2093423 - RNA, 13 nt, Staphylococcus aureus subsp. aureus MW2
uuaucauuauuua

SEQ ID NO: 2093424 - RNA, 15 nt, Staphylococcus aureus subsp. aureus MW2
uuaucauuauuuaau

SEQ ID NO: 2093425 - RNA, 20 nt, Staphylococcus aureus subsp. aureus MW2
uuaucaauuucuauuucacu

SEQ ID NO: 2093426 - RNA, 19 nt, Staphylococcus aureus subsp. aureus MW2
uuaucacaacaguauuaau

SEQ ID NO: 2093427 - RNA, 13 nt, Staphylococcus aureus subsp. aureus MW2
uucuauucgaaaa

SEQ ID NO: 2093428 - RNA, 16 nt, Staphylococcus aureus subsp. aureus MW2
uucuauucgaaaaagg

SEQ ID NO: 2093429 - RNA, 19 nt, Staphylococcus aureus subsp. aureus MW2
uucuauuauuuuacuuugu

SEQ ID NO: 2093430 - RNA, 13 nt, Staphylococcus aureus subsp. aureus MW2
uucuauuaauaau

SEQ ID NO: 2093431 - RNA, 17 nt, Staphylococcus aureus subsp. aureus MW2
uucuauggcacaaauga

SEQ ID NO: 2093432 - RNA, 18 nt, Staphylococcus aureus subsp. aureus MW2
uucuauguauaauacaug

SEQ ID NO: 2093433 - RNA, 23 nt, Staphylococcus aureus subsp. aureus MW2
uucuauacaaugaauuucuaauu

SEQ ID NO: 2093434 - RNA, 16 nt, Staphylococcus aureus subsp. aureus MW2
uucuauacauuccaaa

SEQ ID NO: 2093435 - RNA, 21 nt, Staphylococcus aureus subsp. aureus MW2
uucuacgaccagaaaauacag

SEQ ID NO: 2093436 - RNA, 15 nt, Staphylococcus aureus subsp. aureus MW2
uucuacgaauacuaa

SEQ ID NO: 2093437 - RNA, 19 nt, Staphylococcus aureus subsp. aureus MW2
uucuaauuguuguaauucu

SEQ ID NO: 2093438 - RNA, 13 nt, Staphylococcus aureus subsp. aureus MW2
uucuaauuguuuu

SEQ ID NO: 2093439 - RNA, 13 nt, Staphylococcus aureus subsp. aureus MW2
uucuaauuugcaa

SEQ ID NO: 2093440 - RNA, 13 nt, Staphylococcus aureus subsp. aureus MW2
uucuaaucuaaau

SEQ ID NO: 2093441 - RNA, 20 nt, Staphylococcus aureus subsp. aureus MW2
uucuaaucguuaauaaaccu

SEQ ID NO: 2093442 - RNA, 13 nt, Staphylococcus aureus subsp. aureus MW2
uucuaagucucuu

SEQ ID NO: 2093443 - RNA, 19 nt, Staphylococcus aureus subsp. aureus MW2
uucuaagucucuugucauu

SEQ ID NO: 2093444 - RNA, 22 nt, Staphylococcus aureus subsp. aureus MW2
uucuaagucuuuugaaguuugu

SEQ ID NO: 2093445 - RNA, 17 nt, Staphylococcus aureus subsp. aureus MW2
uucuaaguguugaccau

SEQ ID NO: 2093446 - RNA, 16 nt, Staphylococcus aureus subsp. aureus MW2
uucuaccaauaauucc

SEQ ID NO: 2093447 - RNA, 21 nt, Staphylococcus aureus subsp. aureus MW2
uucuacccauaauuuaaauga

SEQ ID NO: 2093448 - RNA, 21 nt, Staphylococcus aureus subsp. aureus MW2
uucuacaggcaaugcaaguug

SEQ ID NO: 2093449 - RNA, 21 nt, Staphylococcus aureus subsp. aureus MW2
uucuacagacaaugcaaguug

SEQ ID NO: 2093450 - RNA, 19 nt, Staphylococcus aureus subsp. aureus MW2
uucuacaggcaaugcaagu

SEQ ID NO: 2093451 - RNA, 18 nt, Staphylococcus aureus subsp. aureus MW2
uucuacaggcaaugcaag

SEQ ID NO: 2093452 - RNA, 22 nt, Staphylococcus aureus subsp. aureus MW2
uucuaauuuaguuuuaauauaa

SEQ ID NO: 2093453 - RNA, 14 nt, Staphylococcus aureus subsp. aureus MW2
uucuaauuuuucuu

SEQ ID NO: 2093454 - RNA, 22 nt, Staphylococcus aureus subsp. aureus MW2
uucucacugcuguucuuuuuau

SEQ ID NO: 2093455 - RNA, 14 nt, Staphylococcus aureus subsp. aureus MW2
uucucggcaagugc

SEQ ID NO: 2093456 - RNA, 13 nt, Staphylococcus aureus subsp. aureus MW2
uucucuuaaauau

SEQ ID NO: 2093457 - RNA, 15 nt, Staphylococcus aureus subsp. aureus MW2
uucucugcuucuaaa

SEQ ID NO: 2093458 - RNA, 19 nt, Staphylococcus aureus subsp. aureus MW2
uucggaauuugcacaaaga

SEQ ID NO: 2093459 - RNA, 20 nt, Staphylococcus aureus subsp. aureus MW2
uucgcuuuucuaauuuuucu

SEQ ID NO: 2093460 - RNA, 23 nt, Staphylococcus aureus subsp. aureus MW2
uucggaaaauaucacuaauauau

SEQ ID NO: 2093461 - RNA, 19 nt, Staphylococcus aureus subsp. aureus MW2
uucguaacauuuaaaaaau

SEQ ID NO: 2093462 - RNA, 19 nt, Staphylococcus aureus subsp. aureus MW2
uucguagcaugacauuaag

SEQ ID NO: 2093463 - RNA, 17 nt, Staphylococcus aureus subsp. aureus MW2
uucguaaaugccaaugg

SEQ ID NO: 2093464 - RNA, 17 nt, Staphylococcus aureus subsp. aureus MW2
uucguaacauuuaaaaa

SEQ ID NO: 2093465 - RNA, 18 nt, Staphylococcus aureus subsp. aureus MW2
uucguguuccaauuuuau

SEQ ID NO: 2093466 - RNA, 21 nt, Staphylococcus aureus subsp. aureus MW2
uucgugauuacauucuauacu

SEQ ID NO: 2093467 - RNA, 16 nt, Staphylococcus aureus subsp. aureus MW2
uucguauugaaugaau

SEQ ID NO: 2093468 - RNA, 14 nt, Staphylococcus aureus subsp. aureus MW2
uucuaaauguguua

SEQ ID NO: 2093469 - RNA, 21 nt, Staphylococcus aureus subsp. aureus MW2
uucuaacgguaaauaaccacu

SEQ ID NO: 2093470 - RNA, 22 nt, Staphylococcus aureus subsp. aureus MW2
uucuaacuugaacagauucacc

SEQ ID NO: 2093471 - RNA, 22 nt, Staphylococcus aureus subsp. aureus MW2
uucuaaauuauuuauucauuau

SEQ ID NO: 2093472 - RNA, 14 nt, Staphylococcus aureus subsp. aureus MW2
uucgccuaaauggu

SEQ ID NO: 2093473 - RNA, 21 nt, Staphylococcus aureus subsp. aureus MW2
uucgcaucuccgaaggccaug

SEQ ID NO: 2093474 - RNA, 18 nt, Staphylococcus aureus subsp. aureus MW2
uucgccaacuaaaucacc

SEQ ID NO: 2093475 - RNA, 19 nt, Staphylococcus aureus subsp. aureus MW2
uucgcugcuacaccaccug

SEQ ID NO: 2093476 - RNA, 15 nt, Staphylococcus aureus subsp. aureus MW2
uuccuuguuggucug

SEQ ID NO: 2093477 - RNA, 19 nt, Staphylococcus aureus subsp. aureus MW2
uuccuuucaauaauaaauc

SEQ ID NO: 2093478 - RNA, 19 nt, Staphylococcus aureus subsp. aureus MW2
uuccuuuugaauaauaaac

SEQ ID NO: 2093479 - RNA, 21 nt, Staphylococcus aureus subsp. aureus MW2
uuccuuuugaauaauaaacuu

SEQ ID NO: 2093480 - RNA, 20 nt, Staphylococcus aureus subsp. aureus MW2
uucgaacgauauuuuaaaaa

SEQ ID NO: 2093481 - RNA, 15 nt, Staphylococcus aureus subsp. aureus MW2
uucgaaaagaaauuc

SEQ ID NO: 2093482 - RNA, 20 nt, Staphylococcus aureus subsp. aureus MW2
uucgcauacuuuuucagaau

SEQ ID NO: 2093483 - RNA, 14 nt, Staphylococcus aureus subsp. aureus MW2
uucgcauacuuuuu

SEQ ID NO: 2093484 - RNA, 16 nt, Staphylococcus aureus subsp. aureus MW2
uucgcagcuuuauaau

SEQ ID NO: 2093485 - RNA, 16 nt, Staphylococcus aureus subsp. aureus MW2
uuccaguccauuuuuu

SEQ ID NO: 2093486 - RNA, 16 nt, Staphylococcus aureus subsp. aureus MW2
uuccaauuuaaaauga

SEQ ID NO: 2093487 - RNA, 20 nt, Staphylococcus aureus subsp. aureus MW2
uucaggguuuaagauuuuau

SEQ ID NO: 2093488 - RNA, 20 nt, Staphylococcus aureus subsp. aureus MW2
uuccacagcuuguucaauac

SEQ ID NO: 2093489 - RNA, 15 nt, Staphylococcus aureus subsp. aureus MW2
uuccagacuccuaaa

SEQ ID NO: 2093490 - RNA, 19 nt, Staphylococcus aureus subsp. aureus MW2
uuccucaacgggaacauca

SEQ ID NO: 2093491 - RNA, 20 nt, Staphylococcus aureus subsp. aureus MW2
uuccuccuaccgcuaaaauu

SEQ ID NO: 2093492 - RNA, 19 nt, Staphylococcus aureus subsp. aureus MW2
uuccuaauggucgugcuug

SEQ ID NO: 2093493 - RNA, 20 nt, Staphylococcus aureus subsp. aureus MW2
uuccugcuacaacuucuucu

SEQ ID NO: 2093494 - RNA, 15 nt, Staphylococcus aureus subsp. aureus MW2
uuccugcuacaacuu

SEQ ID NO: 2093495 - RNA, 21 nt, Staphylococcus aureus subsp. aureus MW2
uuccugauauuucaacuuuuu

SEQ ID NO: 2093496 - RNA, 15 nt, Staphylococcus aureus subsp. aureus MW2
uucccuuuucaucaa

SEQ ID NO: 2093497 - RNA, 19 nt, Staphylococcus aureus subsp. aureus MW2
uugccuguagaauuucuuu

SEQ ID NO: 2093498 - RNA, 22 nt, Staphylococcus aureus subsp. aureus MW2
uugcuaaaaaaauuaaaauguu

SEQ ID NO: 2093499 - RNA, 14 nt, Staphylococcus aureus subsp. aureus MW2
uugcuaaaaaaauu

SEQ ID NO: 2093500 - RNA, 21 nt, Staphylococcus aureus subsp. aureus MW2
uugcuaaaaaaauuaaaaugu

SEQ ID NO: 2093501 - RNA, 17 nt, Staphylococcus aureus subsp. aureus MW2
uugcguuuaauaacauu

SEQ ID NO: 2093502 - RNA, 15 nt, Staphylococcus aureus subsp. aureus MW2
uugcucuuuaacaau

SEQ ID NO: 2093503 - RNA, 21 nt, Staphylococcus aureus subsp. aureus MW2
uugcacaguuucaucuucaac

SEQ ID NO: 2093504 - RNA, 12 nt, Staphylococcus aureus subsp. aureus MW2
uugcacauuauu

SEQ ID NO: 2093505 - RNA, 16 nt, Staphylococcus aureus subsp. aureus MW2
uugcacuaugcauaau

SEQ ID NO: 2093506 - RNA, 16 nt, Staphylococcus aureus subsp. aureus MW2
uugauuuaaaauauua

SEQ ID NO: 2093507 - RNA, 17 nt, Staphylococcus aureus subsp. aureus MW2
uugauugaauaugugua

SEQ ID NO: 2093508 - RNA, 15 nt, Staphylococcus aureus subsp. aureus MW2
uugauugauaugguu

SEQ ID NO: 2093509 - RNA, 14 nt, Staphylococcus aureus subsp. aureus MW2
uugcaaaauacgau

SEQ ID NO: 2093510 - RNA, 15 nt, Staphylococcus aureus subsp. aureus MW2
uugcaaaauuaagag

SEQ ID NO: 2093511 - RNA, 13 nt, Staphylococcus aureus subsp. aureus MW2
uugcaaaauuuug

SEQ ID NO: 2093512 - RNA, 19 nt, Staphylococcus aureus subsp. aureus MW2
uugauuuugaaucacauua

SEQ ID NO: 2093513 - RNA, 16 nt, Staphylococcus aureus subsp. aureus MW2
uugauucuacuucacc

SEQ ID NO: 2093514 - RNA, 17 nt, Staphylococcus aureus subsp. aureus MW2
uugaugaucaauuaaca

SEQ ID NO: 2093515 - RNA, 21 nt, Staphylococcus aureus subsp. aureus MW2
uugcaaauauaucaucucuau

SEQ ID NO: 2093516 - RNA, 21 nt, Staphylococcus aureus subsp. aureus MW2
uugcaaauagcgauuuuaaag

SEQ ID NO: 2093517 - RNA, 13 nt, Staphylococcus aureus subsp. aureus MW2
uugcaaguauuuu

SEQ ID NO: 2093518 - RNA, 19 nt, Staphylococcus aureus subsp. aureus MW2
uugcacaaagauauguuua

SEQ ID NO: 2093519 - RNA, 16 nt, Staphylococcus aureus subsp. aureus MW2
uugauaacaauuuuaa

SEQ ID NO: 2093520 - RNA, 23 nt, Staphylococcus aureus subsp. aureus MW2
uugauaaaaaggaucuuggccaa

SEQ ID NO: 2093521 - RNA, 12 nt, Staphylococcus aureus subsp. aureus MW2
uugauaaaaaau

SEQ ID NO: 2093522 - RNA, 18 nt, Staphylococcus aureus subsp. aureus MW2
uugagacaaaaaaugaag

SEQ ID NO: 2093523 - RNA, 17 nt, Staphylococcus aureus subsp. aureus MW2
uugacuuuaauugcucu

SEQ ID NO: 2093524 - RNA, 22 nt, Staphylococcus aureus subsp. aureus MW2
uugagaaaauuaauagagaaaa

SEQ ID NO: 2093525 - RNA, 11 nt, Staphylococcus aureus subsp. aureus MW2
uugaucaaccu

SEQ ID NO: 2093526 - RNA, 14 nt, Staphylococcus aureus subsp. aureus MW2
uugaucauaauuca

SEQ ID NO: 2093527 - RNA, 18 nt, Staphylococcus aureus subsp. aureus MW2
uugaucaugagauaaacg

SEQ ID NO: 2093528 - RNA, 13 nt, Staphylococcus aureus subsp. aureus MW2
uugaucuuuuaua

SEQ ID NO: 2093529 - RNA, 14 nt, Staphylococcus aureus subsp. aureus MW2
uugauauuauauaa

SEQ ID NO: 2093530 - RNA, 16 nt, Staphylococcus aureus subsp. aureus MW2
uugauauucuaaaaaa

SEQ ID NO: 2093531 - RNA, 17 nt, Staphylococcus aureus subsp. aureus MW2
uugauauuuuucacgua

SEQ ID NO: 2093532 - RNA, 21 nt, Staphylococcus aureus subsp. aureus MW2
uugauaugguuagaaaaaaau

SEQ ID NO: 2093533 - RNA, 16 nt, Staphylococcus aureus subsp. aureus MW2
uugauaacuauuuaau

SEQ ID NO: 2093534 - RNA, 18 nt, Staphylococcus aureus subsp. aureus MW2
uugauauauauuuugcaa

SEQ ID NO: 2093535 - RNA, 16 nt, Staphylococcus aureus subsp. aureus MW2
uugaaauugacaguuu

SEQ ID NO: 2093536 - RNA, 20 nt, Staphylococcus aureus subsp. aureus MW2
uugaaauuugguaggcauuu

SEQ ID NO: 2093537 - RNA, 19 nt, Staphylococcus aureus subsp. aureus MW2
uugaaauuauuauuuaaau

SEQ ID NO: 2093538 - RNA, 20 nt, Staphylococcus aureus subsp. aureus MW2
uugaaauuauuauuuaaauu

SEQ ID NO: 2093539 - RNA, 15 nt, Staphylococcus aureus subsp. aureus MW2
uugaaauuaauuauc

SEQ ID NO: 2093540 - RNA, 13 nt, Staphylococcus aureus subsp. aureus MW2
uugaacaauaaua

SEQ ID NO: 2093541 - RNA, 17 nt, Staphylococcus aureus subsp. aureus MW2
uugaaacuguaucaaca

SEQ ID NO: 2093542 - RNA, 19 nt, Staphylococcus aureus subsp. aureus MW2
uugaaacuaauaauuugua

SEQ ID NO: 2093543 - RNA, 15 nt, Staphylococcus aureus subsp. aureus MW2
uugaaagauauuucu

SEQ ID NO: 2093544 - RNA, 20 nt, Staphylococcus aureus subsp. aureus MW2
uugaaaggaauguuuaaaaa

SEQ ID NO: 2093545 - RNA, 22 nt, Staphylococcus aureus subsp. aureus MW2
uugaaaggaauguuuaaaaaac

SEQ ID NO: 2093546 - RNA, 13 nt, Staphylococcus aureus subsp. aureus MW2
uucuuuuuuacau

SEQ ID NO: 2093547 - RNA, 18 nt, Staphylococcus aureus subsp. aureus MW2
uucuuuuuguucggcuuu

SEQ ID NO: 2093548 - RNA, 12 nt, Staphylococcus aureus subsp. aureus MW2
uucuuuuuucaa

SEQ ID NO: 2093549 - RNA, 20 nt, Staphylococcus aureus subsp. aureus MW2
uugaaaaaccaaguuuugca

SEQ ID NO: 2093550 - RNA, 18 nt, Staphylococcus aureus subsp. aureus MW2
uucuuuuuguuguuuuaa

SEQ ID NO: 2093551 - RNA, 13 nt, Staphylococcus aureus subsp. aureus MW2
uugaaaaagacua

SEQ ID NO: 2093552 - RNA, 21 nt, Staphylococcus aureus subsp. aureus MW2
uugaaaauagccauaucauau

SEQ ID NO: 2093553 - RNA, 23 nt, Staphylococcus aureus subsp. aureus MW2
uugaaaauaaucgaacagaaaau

SEQ ID NO: 2093554 - RNA, 16 nt, Staphylococcus aureus subsp. aureus MW2
uugaaaaucuaauccu

SEQ ID NO: 2093555 - RNA, 16 nt, Staphylococcus aureus subsp. aureus MW2
uugaaaaauuaaaaaa

SEQ ID NO: 2093556 - RNA, 19 nt, Staphylococcus aureus subsp. aureus MW2
uugaaaaauuaaaaaacaa

SEQ ID NO: 2093557 - RNA, 19 nt, Staphylococcus aureus subsp. aureus MW2
uucuuuuguaacguucuua

SEQ ID NO: 2093558 - RNA, 11 nt, Staphylococcus aureus subsp. aureus MW2
uucuuuuuaaa

SEQ ID NO: 2093559 - RNA, 15 nt, Staphylococcus aureus subsp. aureus MW2
uucuuuuguuuuuau

SEQ ID NO: 2093560 - RNA, 20 nt, Staphylococcus aureus subsp. aureus MW2
uucuuuuucagcuaauuguc

SEQ ID NO: 2093561 - RNA, 22 nt, Staphylococcus aureus subsp. aureus MW2
uucuuuuugcguuuuuaaauaa

SEQ ID NO: 2093562 - RNA, 13 nt, Staphylococcus aureus subsp. aureus MW2
uucuuuuugcuuu

SEQ ID NO: 2093563 - RNA, 18 nt, Staphylococcus aureus subsp. aureus MW2
uucuuuuaaguuaucaaa

SEQ ID NO: 2093564 - RNA, 17 nt, Staphylococcus aureus subsp. aureus MW2
uucuuuuauaucgcuuu

SEQ ID NO: 2093565 - RNA, 13 nt, Staphylococcus aureus subsp. aureus MW2
uucuuucuaaaau

SEQ ID NO: 2093566 - RNA, 16 nt, Staphylococcus aureus subsp. aureus MW2
uucuuucuaaaauaac

SEQ ID NO: 2093567 - RNA, 22 nt, Staphylococcus aureus subsp. aureus MW2
uucuuuguguuugcuuuuuacu

SEQ ID NO: 2093568 - RNA, 14 nt, Staphylococcus aureus subsp. aureus MW2
uucuuucaggcuuu

SEQ ID NO: 2093569 - RNA, 23 nt, Staphylococcus aureus subsp. aureus MW2
uucuuuauuucuuucgaaaacag

SEQ ID NO: 2093570 - RNA, 20 nt, Staphylococcus aureus subsp. aureus MW2
uucuuuauuagaaugaaacc

SEQ ID NO: 2093571 - RNA, 13 nt, Staphylococcus aureus subsp. aureus MW2
uucuuuaacaauu

SEQ ID NO: 2093572 - RNA, 15 nt, Staphylococcus aureus subsp. aureus MW2
uucuuuaaauacauc

SEQ ID NO: 2093573 - RNA, 17 nt, Staphylococcus aureus subsp. aureus MW2
uucuuuaagcuuucuau

SEQ ID NO: 2093574 - RNA, 21 nt, Staphylococcus aureus subsp. aureus MW2
uucuuuaauauaaauuuugaa

SEQ ID NO: 2093575 - RNA, 19 nt, Staphylococcus aureus subsp. aureus MW2
uucuugagcuguuacacuu

SEQ ID NO: 2093576 - RNA, 13 nt, Staphylococcus aureus subsp. aureus MW2
uucuugauuuuag

SEQ ID NO: 2093577 - RNA, 18 nt, Staphylococcus aureus subsp. aureus MW2
uucuugauuuuaggugcc

SEQ ID NO: 2093578 - RNA, 11 nt, Staphylococcus aureus subsp. aureus MW2
uugaacuuuua

SEQ ID NO: 2093579 - RNA, 21 nt, Staphylococcus aureus subsp. aureus MW2
uugaaccggaaauuaaaucua

SEQ ID NO: 2093580 - RNA, 16 nt, Staphylococcus aureus subsp. aureus MW2
uugaacgaaagagaaa

SEQ ID NO: 2093581 - RNA, 20 nt, Staphylococcus aureus subsp. aureus MW2
uugaacgaaagagaaaagcu

SEQ ID NO: 2093582 - RNA, 21 nt, Staphylococcus aureus subsp. aureus MW2
uugaacgaaagagaaaagcua

SEQ ID NO: 2093583 - RNA, 21 nt, Staphylococcus aureus subsp. aureus MW2
uugaacgauaacaauuuauua

SEQ ID NO: 2093584 - RNA, 15 nt, Staphylococcus aureus subsp. aureus MW2
uugaacgagagagaa

SEQ ID NO: 2093585 - RNA, 20 nt, Staphylococcus aureus subsp. aureus MW2
uugaacgagagagaaaagcu

SEQ ID NO: 2093586 - RNA, 21 nt, Staphylococcus aureus subsp. aureus MW2
uugaacgagagagaaaagcua

SEQ ID NO: 2093587 - RNA, 15 nt, Staphylococcus aureus subsp. aureus MW2
uugaacgauaacaau

SEQ ID NO: 2093588 - RNA, 16 nt, Staphylococcus aureus subsp. aureus MW2
uugaaccggaaauuaa

SEQ ID NO: 2093589 - RNA, 17 nt, Staphylococcus aureus subsp. aureus MW2
uugaagcuaauucauau

SEQ ID NO: 2093590 - RNA, 18 nt, Staphylococcus aureus subsp. aureus MW2
uugaagcggguugaagca

SEQ ID NO: 2093591 - RNA, 21 nt, Staphylococcus aureus subsp. aureus MW2
uugaagcauuaaguucaucau

SEQ ID NO: 2093592 - RNA, 22 nt, Staphylococcus aureus subsp. aureus MW2
uugaagaauguuucauaugcau

SEQ ID NO: 2093593 - RNA, 23 nt, Staphylococcus aureus subsp. aureus MW2
uugaagaaggaugaguuuaaaaa

SEQ ID NO: 2093594 - RNA, 17 nt, Staphylococcus aureus subsp. aureus MW2
uugaauaaauuuuauuc

SEQ ID NO: 2093595 - RNA, 21 nt, Staphylococcus aureus subsp. aureus MW2
uugaauaauaaacuuaaaaga

SEQ ID NO: 2093596 - RNA, 22 nt, Staphylococcus aureus subsp. aureus MW2
uugaauacuuuuuaacugguug

SEQ ID NO: 2093597 - RNA, 19 nt, Staphylococcus aureus subsp. aureus MW2
uugaauacuuuauuugaua

SEQ ID NO: 2093598 - RNA, 19 nt, Staphylococcus aureus subsp. aureus MW2
uugaauaauauauuuagga

SEQ ID NO: 2093599 - RNA, 17 nt, Staphylococcus aureus subsp. aureus MW2
uugaaucaguauaauca

SEQ ID NO: 2093600 - RNA, 17 nt, Staphylococcus aureus subsp. aureus MW2
uugaaucuuguugaacu

SEQ ID NO: 2093601 - RNA, 16 nt, Staphylococcus aureus subsp. aureus MW2
uugaaucguauugaaa

SEQ ID NO: 2093602 - RNA, 17 nt, Staphylococcus aureus subsp. aureus MW2
uugaaucguauugaaaa

SEQ ID NO: 2093603 - RNA, 11 nt, Staphylococcus aureus subsp. aureus MW2
uugaauauuuu

SEQ ID NO: 2093604 - RNA, 16 nt, Staphylococcus aureus subsp. aureus MW2
uugaauauuugcuuuu

SEQ ID NO: 2093605 - RNA, 23 nt, Staphylococcus aureus subsp. aureus MW2
uugaaugaaguaauauauaaaag

SEQ ID NO: 2093606 - RNA, 12 nt, Staphylococcus aureus subsp. aureus MW2
uugaaugaaccu

SEQ ID NO: 2093607 - RNA, 15 nt, Staphylococcus aureus subsp. aureus MW2
uugaauguaagaagu

SEQ ID NO: 2093608 - RNA, 14 nt, Staphylococcus aureus subsp. aureus MW2
uugacuaaguuugu

SEQ ID NO: 2093609 - RNA, 20 nt, Staphylococcus aureus subsp. aureus MW2
uugacuaaguuuguuuucuu

SEQ ID NO: 2093610 - RNA, 19 nt, Staphylococcus aureus subsp. aureus MW2
uugacugaacgaaaaugcg

SEQ ID NO: 2093611 - RNA, 19 nt, Staphylococcus aureus subsp. aureus MW2
uugacuguaaaacaaugcc

SEQ ID NO: 2093612 - RNA, 23 nt, Staphylococcus aureus subsp. aureus MW2
uugacgccaguggcauuuaaaaa

SEQ ID NO: 2093613 - RNA, 13 nt, Staphylococcus aureus subsp. aureus MW2
uugaauuuaauuu

SEQ ID NO: 2093614 - RNA, 17 nt, Staphylococcus aureus subsp. aureus MW2
uugaauugaaaaauuaa

SEQ ID NO: 2093615 - RNA, 22 nt, Staphylococcus aureus subsp. aureus MW2
uugaauuaacaauauuaaauuu

SEQ ID NO: 2093616 - RNA, 15 nt, Staphylococcus aureus subsp. aureus MW2
uugacauuugaccaa

SEQ ID NO: 2093617 - RNA, 17 nt, Staphylococcus aureus subsp. aureus MW2
uugacauuugaccaagu

SEQ ID NO: 2093618 - RNA, 18 nt, Staphylococcus aureus subsp. aureus MW2
uugacauguguuaaacca

SEQ ID NO: 2093619 - RNA, 15 nt, Staphylococcus aureus subsp. aureus MW2
uugacauauuuuuua

SEQ ID NO: 2093620 - RNA, 21 nt, Staphylococcus aureus subsp. aureus MW2
uugacauaccagguuauagaa

SEQ ID NO: 2093621 - RNA, 15 nt, Staphylococcus aureus subsp. aureus MW2
uugacacauuauuga

SEQ ID NO: 2093622 - RNA, 20 nt, Staphylococcus aureus subsp. aureus MW2
uuuaccauguuuuacaaguu

SEQ ID NO: 2093623 - RNA, 14 nt, Staphylococcus aureus subsp. aureus MW2
uuuaccuucaucuu

SEQ ID NO: 2093624 - RNA, 17 nt, Staphylococcus aureus subsp. aureus MW2
uuuaauuuuucauuaau

SEQ ID NO: 2093625 - RNA, 19 nt, Staphylococcus aureus subsp. aureus MW2
uuuaauuuugacauaaaaa

SEQ ID NO: 2093626 - RNA, 20 nt, Staphylococcus aureus subsp. aureus MW2
uuuacaaaaacuauuuuuua

SEQ ID NO: 2093627 - RNA, 17 nt, Staphylococcus aureus subsp. aureus MW2
uuuaccaauaucaugca

SEQ ID NO: 2093628 - RNA, 20 nt, Staphylococcus aureus subsp. aureus MW2
uuuacaagucuuauuuguuu

SEQ ID NO: 2093629 - RNA, 22 nt, Staphylococcus aureus subsp. aureus MW2
uuuacaaucaucacacauaaau

SEQ ID NO: 2093630 - RNA, 19 nt, Staphylococcus aureus subsp. aureus MW2
uuuacaauccuaaaauacu

SEQ ID NO: 2093631 - RNA, 22 nt, Staphylococcus aureus subsp. aureus MW2
uuuacaauccuaaaauacuguu

SEQ ID NO: 2093632 - RNA, 14 nt, Staphylococcus aureus subsp. aureus MW2
uuuaauuucacuuu

SEQ ID NO: 2093633 - RNA, 18 nt, Staphylococcus aureus subsp. aureus MW2
uuuaauuuaguacucaau

SEQ ID NO: 2093634 - RNA, 23 nt, Staphylococcus aureus subsp. aureus MW2
uuuaauuucugguaaaaaaauaa

SEQ ID NO: 2093635 - RNA, 19 nt, Staphylococcus aureus subsp. aureus MW2
uuuaauuucugguaaaaaa

SEQ ID NO: 2093636 - RNA, 14 nt, Staphylococcus aureus subsp. aureus MW2
uuuaauuuucuaaa

SEQ ID NO: 2093637 - RNA, 21 nt, Staphylococcus aureus subsp. aureus MW2
uuuaauuuucuaaagauauaa

SEQ ID NO: 2093638 - RNA, 22 nt, Staphylococcus aureus subsp. aureus MW2
uuuaauucugguuuaaugagcu

SEQ ID NO: 2093639 - RNA, 14 nt, Staphylococcus aureus subsp. aureus MW2
uuuaauuccaaaga

SEQ ID NO: 2093640 - RNA, 13 nt, Staphylococcus aureus subsp. aureus MW2
uuuaauuguuuaa

SEQ ID NO: 2093641 - RNA, 18 nt, Staphylococcus aureus subsp. aureus MW2
uuuaauugcaaaugcucu

SEQ ID NO: 2093642 - RNA, 17 nt, Staphylococcus aureus subsp. aureus MW2
uuuaauugggucuuuau

SEQ ID NO: 2093643 - RNA, 17 nt, Staphylococcus aureus subsp. aureus MW2
uuuaauuaauuaucaua

SEQ ID NO: 2093644 - RNA, 14 nt, Staphylococcus aureus subsp. aureus MW2
uuuaauuaaaguua

SEQ ID NO: 2093645 - RNA, 16 nt, Staphylococcus aureus subsp. aureus MW2
uuuaauguuuaauaau

SEQ ID NO: 2093646 - RNA, 14 nt, Staphylococcus aureus subsp. aureus MW2
uuuaauguuugcuu

SEQ ID NO: 2093647 - RNA, 19 nt, Staphylococcus aureus subsp. aureus MW2
uuuaauguugcaaaauuaa

SEQ ID NO: 2093648 - RNA, 17 nt, Staphylococcus aureus subsp. aureus MW2
uuuaacugggcaacuuu

SEQ ID NO: 2093649 - RNA, 23 nt, Staphylococcus aureus subsp. aureus MW2
uuuaacucuugaaacacaaaaag

SEQ ID NO: 2093650 - RNA, 23 nt, Staphylococcus aureus subsp. aureus MW2
uuuaggacgugccuuaacuucau

SEQ ID NO: 2093651 - RNA, 19 nt, Staphylococcus aureus subsp. aureus MW2
uuuagcuauuuaaaauuau

SEQ ID NO: 2093652 - RNA, 17 nt, Staphylococcus aureus subsp. aureus MW2
uuuagcgucauuuuuaa

SEQ ID NO: 2093653 - RNA, 16 nt, Staphylococcus aureus subsp. aureus MW2
uuuacucuacacucaa

SEQ ID NO: 2093654 - RNA, 14 nt, Staphylococcus aureus subsp. aureus MW2
uuuacucuaaagga

SEQ ID NO: 2093655 - RNA, 21 nt, Staphylococcus aureus subsp. aureus MW2
uuuaguucacaugaauuuuaa

SEQ ID NO: 2093656 - RNA, 20 nt, Staphylococcus aureus subsp. aureus MW2
uuuaguuaaagugauuuuac

SEQ ID NO: 2093657 - RNA, 21 nt, Staphylococcus aureus subsp. aureus MW2
uuuaguucaaagcgauaaagu

SEQ ID NO: 2093658 - RNA, 21 nt, Staphylococcus aureus subsp. aureus MW2
uuuaguucacaauuucguguu

SEQ ID NO: 2093659 - RNA, 14 nt, Staphylococcus aureus subsp. aureus MW2
uuuauaaaauugua

SEQ ID NO: 2093660 - RNA, 23 nt, Staphylococcus aureus subsp. aureus MW2
uuuaguuuucguaguaaccuaau

SEQ ID NO: 2093661 - RNA, 20 nt, Staphylococcus aureus subsp. aureus MW2
uuuauaaauaaacauaaaaa

SEQ ID NO: 2093662 - RNA, 15 nt, Staphylococcus aureus subsp. aureus MW2
uuuauaaaaaguuau

SEQ ID NO: 2093663 - RNA, 22 nt, Staphylococcus aureus subsp. aureus MW2
uuuaguuagcccuauucaacua

SEQ ID NO: 2093664 - RNA, 15 nt, Staphylococcus aureus subsp. aureus MW2
uuuaguuaaauacaa

SEQ ID NO: 2093665 - RNA, 14 nt, Staphylococcus aureus subsp. aureus MW2
uuuagugacaaaca

SEQ ID NO: 2093666 - RNA, 21 nt, Staphylococcus aureus subsp. aureus MW2
uuuaguauguuuuauuuucuu

SEQ ID NO: 2093667 - RNA, 18 nt, Staphylococcus aureus subsp. aureus MW2
uuuaguaucucauuuuuu

SEQ ID NO: 2093668 - RNA, 22 nt, Staphylococcus aureus subsp. aureus MW2
uuuagguucuucaucuuuuaug

SEQ ID NO: 2093669 - RNA, 18 nt, Staphylococcus aureus subsp. aureus MW2
uuguugguuuuuaaaagu

SEQ ID NO: 2093670 - RNA, 21 nt, Staphylococcus aureus subsp. aureus MW2
uuguuauacauauauucuaau

SEQ ID NO: 2093671 - RNA, 22 nt, Staphylococcus aureus subsp. aureus MW2
uuguuauacauauauucuaauu

SEQ ID NO: 2093672 - RNA, 23 nt, Staphylococcus aureus subsp. aureus MW2
uuguuauacauauauucuaauug

SEQ ID NO: 2093673 - RNA, 17 nt, Staphylococcus aureus subsp. aureus MW2
uuguuaccaaacaauac

SEQ ID NO: 2093674 - RNA, 14 nt, Staphylococcus aureus subsp. aureus MW2
uuguuacauauugc

SEQ ID NO: 2093675 - RNA, 13 nt, Staphylococcus aureus subsp. aureus MW2
uuguuaauuucaa

SEQ ID NO: 2093676 - RNA, 15 nt, Staphylococcus aureus subsp. aureus MW2
uuguuaauacaacca

SEQ ID NO: 2093677 - RNA, 14 nt, Staphylococcus aureus subsp. aureus MW2
uuguuaauacaugc

SEQ ID NO: 2093678 - RNA, 17 nt, Staphylococcus aureus subsp. aureus MW2
uuguuaacgguuaauaa

SEQ ID NO: 2093679 - RNA, 22 nt, Staphylococcus aureus subsp. aureus MW2
uuguuaacgguuaauaagcuaa

SEQ ID NO: 2093680 - RNA, 18 nt, Staphylococcus aureus subsp. aureus MW2
uugcugccaaaaaguauu

SEQ ID NO: 2093681 - RNA, 13 nt, Staphylococcus aureus subsp. aureus MW2
uuguuuagaaaag

SEQ ID NO: 2093682 - RNA, 17 nt, Staphylococcus aureus subsp. aureus MW2
uuguuuaccuaaaucuu

SEQ ID NO: 2093683 - RNA, 16 nt, Staphylococcus aureus subsp. aureus MW2
uuguuuacagaugcgu

SEQ ID NO: 2093684 - RNA, 14 nt, Staphylococcus aureus subsp. aureus MW2
uuguuuaauaacaa

SEQ ID NO: 2093685 - RNA, 13 nt, Staphylococcus aureus subsp. aureus MW2
uuguuucuaaauu

SEQ ID NO: 2093686 - RNA, 12 nt, Staphylococcus aureus subsp. aureus MW2
uuguuucaccag

SEQ ID NO: 2093687 - RNA, 15 nt, Staphylococcus aureus subsp. aureus MW2
uuguuucauuaucaa

SEQ ID NO: 2093688 - RNA, 23 nt, Staphylococcus aureus subsp. aureus MW2
uuguuucagacuguggacaaacu

SEQ ID NO: 2093689 - RNA, 23 nt, Staphylococcus aureus subsp. aureus MW2
uuguuuagcgucguguauucaga

SEQ ID NO: 2093690 - RNA, 16 nt, Staphylococcus aureus subsp. aureus MW2
uuuaaaaaauuuaaau

SEQ ID NO: 2093691 - RNA, 13 nt, Staphylococcus aureus subsp. aureus MW2
uuuaaaaaaggaa

SEQ ID NO: 2093692 - RNA, 9 nt, Staphylococcus aureus subsp. aureus MW2
uuuaaaagu

SEQ ID NO: 2093693 - RNA, 22 nt, Staphylococcus aureus subsp. aureus MW2
uuuaaaaaacaguguagcacaa

SEQ ID NO: 2093694 - RNA, 23 nt, Staphylococcus aureus subsp. aureus MW2
uuuaaaugauuucacuucauaaa

SEQ ID NO: 2093695 - RNA, 15 nt, Staphylococcus aureus subsp. aureus MW2
uuuaaaugcuuuaaa

SEQ ID NO: 2093696 - RNA, 15 nt, Staphylococcus aureus subsp. aureus MW2
uuuaaauuaaaauaa

SEQ ID NO: 2093697 - RNA, 16 nt, Staphylococcus aureus subsp. aureus MW2
uuuaaauuacaauuaa

SEQ ID NO: 2093698 - RNA, 23 nt, Staphylococcus aureus subsp. aureus MW2
uuuaaauugacuuuaauugcucu

SEQ ID NO: 2093699 - RNA, 23 nt, Staphylococcus aureus subsp. aureus MW2
uuuaaauuuaacucaacuuaaau

SEQ ID NO: 2093700 - RNA, 22 nt, Staphylococcus aureus subsp. aureus MW2
uuuaaauuggaaucccaaugcu

SEQ ID NO: 2093701 - RNA, 13 nt, Staphylococcus aureus subsp. aureus MW2
uuuaaauauuguc

SEQ ID NO: 2093702 - RNA, 16 nt, Staphylococcus aureus subsp. aureus MW2
uuuaaaucuauauaaa

SEQ ID NO: 2093703 - RNA, 19 nt, Staphylococcus aureus subsp. aureus MW2
uuuaaaucuuguucuaauu

SEQ ID NO: 2093704 - RNA, 17 nt, Staphylococcus aureus subsp. aureus MW2
uuuaaaucauuaagaaa

SEQ ID NO: 2093705 - RNA, 22 nt, Staphylococcus aureus subsp. aureus MW2
uuuaaaucaaagaguaaaguua

SEQ ID NO: 2093706 - RNA, 14 nt, Staphylococcus aureus subsp. aureus MW2
uuuaaaucaauauu

SEQ ID NO: 2093707 - RNA, 16 nt, Staphylococcus aureus subsp. aureus MW2
uuuaaauacuugcucu

SEQ ID NO: 2093708 - RNA, 16 nt, Staphylococcus aureus subsp. aureus MW2
uuuaacacuucaguua

SEQ ID NO: 2093709 - RNA, 22 nt, Staphylococcus aureus subsp. aureus MW2
uuuaacauuuacacgucuaauu

SEQ ID NO: 2093710 - RNA, 17 nt, Staphylococcus aureus subsp. aureus MW2
uuuaaccuacacgacca

SEQ ID NO: 2093711 - RNA, 22 nt, Staphylococcus aureus subsp. aureus MW2
uuuaacaacuguucuaaaauua

SEQ ID NO: 2093712 - RNA, 24 nt, Staphylococcus aureus subsp. aureus MW2
uuuaacaagauaacuagcaaaugc

SEQ ID NO: 2093713 - RNA, 22 nt, Staphylococcus aureus subsp. aureus MW2
uuuaacaagugaugaaaaagag

SEQ ID NO: 2093714 - RNA, 19 nt, Staphylococcus aureus subsp. aureus MW2
uuuaacagcgugaauauaa

SEQ ID NO: 2093715 - RNA, 15 nt, Staphylococcus aureus subsp. aureus MW2
uuuaacaaaauauac

SEQ ID NO: 2093716 - RNA, 13 nt, Staphylococcus aureus subsp. aureus MW2
uuuaaauuuaaga

SEQ ID NO: 2093717 - RNA, 14 nt, Staphylococcus aureus subsp. aureus MW2
uuuaaauuuaagaa

SEQ ID NO: 2093718 - RNA, 20 nt, Staphylococcus aureus subsp. aureus MW2
uuuaaauuuucaucauaauc

SEQ ID NO: 2093719 - RNA, 22 nt, Staphylococcus aureus subsp. aureus MW2
uuuaaauaaaugacuucacauu

SEQ ID NO: 2093720 - RNA, 23 nt, Staphylococcus aureus subsp. aureus MW2
uuuaaauaauaauucauaaaugc

SEQ ID NO: 2093721 - RNA, 16 nt, Staphylococcus aureus subsp. aureus MW2
uuuaaagcuaaauguu

SEQ ID NO: 2093722 - RNA, 16 nt, Staphylococcus aureus subsp. aureus MW2
uuuaaacucguaaauu

SEQ ID NO: 2093723 - RNA, 18 nt, Staphylococcus aureus subsp. aureus MW2
uuuaaagcaucauauaca

SEQ ID NO: 2093724 - RNA, 16 nt, Staphylococcus aureus subsp. aureus MW2
uuuaaagaaaaguuua

SEQ ID NO: 2093725 - RNA, 15 nt, Staphylococcus aureus subsp. aureus MW2
uuuaaagaaaaguuu

SEQ ID NO: 2093726 - RNA, 16 nt, Staphylococcus aureus subsp. aureus MW2
uuuaaacgguaacaaa

SEQ ID NO: 2093727 - RNA, 20 nt, Staphylococcus aureus subsp. aureus MW2
uuuaaacucauaauuuucua

SEQ ID NO: 2093728 - RNA, 14 nt, Staphylococcus aureus subsp. aureus MW2
uuuaaaauaauaga

SEQ ID NO: 2093729 - RNA, 15 nt, Staphylococcus aureus subsp. aureus MW2
uuuaaaauaaagaaa

SEQ ID NO: 2093730 - RNA, 21 nt, Staphylococcus aureus subsp. aureus MW2
uuuaaaauacgacaccaacau

SEQ ID NO: 2093731 - RNA, 11 nt, Staphylococcus aureus subsp. aureus MW2
uuuaaaauacg

SEQ ID NO: 2093732 - RNA, 13 nt, Staphylococcus aureus subsp. aureus MW2
uuuaaaauauuau

SEQ ID NO: 2093733 - RNA, 15 nt, Staphylococcus aureus subsp. aureus MW2
uuuaaacaaaaauaa

SEQ ID NO: 2093734 - RNA, 23 nt, Staphylococcus aureus subsp. aureus MW2
uuuaaacaagcaucaugaaauua

SEQ ID NO: 2093735 - RNA, 17 nt, Staphylococcus aureus subsp. aureus MW2
uuucacaaauucuuuua

SEQ ID NO: 2093736 - RNA, 21 nt, Staphylococcus aureus subsp. aureus MW2
uuucacgauuuuuaaaaugcu

SEQ ID NO: 2093737 - RNA, 14 nt, Staphylococcus aureus subsp. aureus MW2
uuucaagaccaaau

SEQ ID NO: 2093738 - RNA, 17 nt, Staphylococcus aureus subsp. aureus MW2
uuucaagaccaaauauu

SEQ ID NO: 2093739 - RNA, 15 nt, Staphylococcus aureus subsp. aureus MW2
uuucaauaaauuuua

SEQ ID NO: 2093740 - RNA, 19 nt, Staphylococcus aureus subsp. aureus MW2
uuucaaguuuaaaauacga

SEQ ID NO: 2093741 - RNA, 13 nt, Staphylococcus aureus subsp. aureus MW2
uuucaauaaauaa

SEQ ID NO: 2093742 - RNA, 20 nt, Staphylococcus aureus subsp. aureus MW2
uuucaauugcaugucuuaaa

SEQ ID NO: 2093743 - RNA, 21 nt, Staphylococcus aureus subsp. aureus MW2
uuucaauguuugcaucacuug

SEQ ID NO: 2093744 - RNA, 12 nt, Staphylococcus aureus subsp. aureus MW2
uuucaauauuag

SEQ ID NO: 2093745 - RNA, 15 nt, Staphylococcus aureus subsp. aureus MW2
uuucaacaaaaugcg

SEQ ID NO: 2093746 - RNA, 18 nt, Staphylococcus aureus subsp. aureus MW2
uuucaaaugugaaaguca

SEQ ID NO: 2093747 - RNA, 23 nt, Staphylococcus aureus subsp. aureus MW2
uuucaaauuaauuaaaccaauac

SEQ ID NO: 2093748 - RNA, 12 nt, Staphylococcus aureus subsp. aureus MW2
uuuauuuuaaau

SEQ ID NO: 2093749 - RNA, 16 nt, Staphylococcus aureus subsp. aureus MW2
uuuauuuuaaauuuaa

SEQ ID NO: 2093750 - RNA, 16 nt, Staphylococcus aureus subsp. aureus MW2
uuuauuuuaauauuuu

SEQ ID NO: 2093751 - RNA, 15 nt, Staphylococcus aureus subsp. aureus MW2
uuucaaauaauauaa

SEQ ID NO: 2093752 - RNA, 14 nt, Staphylococcus aureus subsp. aureus MW2
uuucaaauaagaau

SEQ ID NO: 2093753 - RNA, 19 nt, Staphylococcus aureus subsp. aureus MW2
uuucaaacgauuuucaaaa

SEQ ID NO: 2093754 - RNA, 23 nt, Staphylococcus aureus subsp. aureus MW2
uuucaaagcugucaacuugucua

SEQ ID NO: 2093755 - RNA, 19 nt, Staphylococcus aureus subsp. aureus MW2
uuuauuagaucacuauuuu

SEQ ID NO: 2093756 - RNA, 12 nt, Staphylococcus aureus subsp. aureus MW2
uuuauuaucagu

SEQ ID NO: 2093757 - RNA, 15 nt, Staphylococcus aureus subsp. aureus MW2
uuuauucaaaucaua

SEQ ID NO: 2093758 - RNA, 17 nt, Staphylococcus aureus subsp. aureus MW2
uuuauucagauauuaau

SEQ ID NO: 2093759 - RNA, 14 nt, Staphylococcus aureus subsp. aureus MW2
uuuauuuauucuaa

SEQ ID NO: 2093760 - RNA, 22 nt, Staphylococcus aureus subsp. aureus MW2
uuuauucccaccggacaaugua

SEQ ID NO: 2093761 - RNA, 18 nt, Staphylococcus aureus subsp. aureus MW2
uuuauagauuuuaauaaa

SEQ ID NO: 2093762 - RNA, 21 nt, Staphylococcus aureus subsp. aureus MW2
uuuauagccgccuuuuaacau

SEQ ID NO: 2093763 - RNA, 13 nt, Staphylococcus aureus subsp. aureus MW2
uuuauauaaguga

SEQ ID NO: 2093764 - RNA, 21 nt, Staphylococcus aureus subsp. aureus MW2
uuuauacuauaaauaaaaaua

SEQ ID NO: 2093765 - RNA, 22 nt, Staphylococcus aureus subsp. aureus MW2
uuuauaaaucuuugauuaugaa

SEQ ID NO: 2093766 - RNA, 14 nt, Staphylococcus aureus subsp. aureus MW2
uuuauaaauuauag

SEQ ID NO: 2093767 - RNA, 20 nt, Staphylococcus aureus subsp. aureus MW2
uuucauaugcaucaacagau

SEQ ID NO: 2093768 - RNA, 18 nt, Staphylococcus aureus subsp. aureus MW2
uuucaucaaauucaaauu

SEQ ID NO: 2093769 - RNA, 21 nt, Staphylococcus aureus subsp. aureus MW2
uuucaucaaauucucauucau

SEQ ID NO: 2093770 - RNA, 16 nt, Staphylococcus aureus subsp. aureus MW2
uuucaucguucauaua

SEQ ID NO: 2093771 - RNA, 19 nt, Staphylococcus aureus subsp. aureus MW2
uuucaucgaagauguuaaa

SEQ ID NO: 2093772 - RNA, 20 nt, Staphylococcus aureus subsp. aureus MW2
uuucaucauuaaaccgugag

SEQ ID NO: 2093773 - RNA, 22 nt, Staphylococcus aureus subsp. aureus MW2
uuucauuggauagguaacuaaa

SEQ ID NO: 2093774 - RNA, 15 nt, Staphylococcus aureus subsp. aureus MW2
uuucauuaauuuuuu

SEQ ID NO: 2093775 - RNA, 13 nt, Staphylococcus aureus subsp. aureus MW2
uuucaugaccaac

SEQ ID NO: 2093776 - RNA, 22 nt, Staphylococcus aureus subsp. aureus MW2
uuucaucuucaacuuucucuaa

SEQ ID NO: 2093777 - RNA, 23 nt, Staphylococcus aureus subsp. aureus MW2
uuucaucuucaacuuucucuaaa

SEQ ID NO: 2093778 - RNA, 14 nt, Staphylococcus aureus subsp. aureus MW2
uuucaucuuuuuca

SEQ ID NO: 2093779 - RNA, 20 nt, Staphylococcus aureus subsp. aureus MW2
uuucauguuugauucuaaau

SEQ ID NO: 2093780 - RNA, 22 nt, Staphylococcus aureus subsp. aureus MW2
uuuccacagcaauucacuuaua

SEQ ID NO: 2093781 - RNA, 15 nt, Staphylococcus aureus subsp. aureus MW2
uuuccaauaucuucu

SEQ ID NO: 2093782 - RNA, 14 nt, Staphylococcus aureus subsp. aureus MW2
uuuccaauccauua

SEQ ID NO: 2093783 - RNA, 14 nt, Staphylococcus aureus subsp. aureus MW2
uuuccaacuucuuu

SEQ ID NO: 2093784 - RNA, 13 nt, Staphylococcus aureus subsp. aureus MW2
uuucauuuuuuca

SEQ ID NO: 2093785 - RNA, 21 nt, Staphylococcus aureus subsp. aureus MW2
uuucauuuaacccuucuccaa

SEQ ID NO: 2093786 - RNA, 15 nt, Staphylococcus aureus subsp. aureus MW2
uuucaguauacucau

SEQ ID NO: 2093787 - RNA, 19 nt, Staphylococcus aureus subsp. aureus MW2
uuucauaauuaauaacauc

SEQ ID NO: 2093788 - RNA, 13 nt, Staphylococcus aureus subsp. aureus MW2
uuucauaauguua

SEQ ID NO: 2093789 - RNA, 18 nt, Staphylococcus aureus subsp. aureus MW2
uuucauaauuaauaacau

SEQ ID NO: 2093790 - RNA, 13 nt, Staphylococcus aureus subsp. aureus MW2
uuucauaaucucu

SEQ ID NO: 2093791 - RNA, 22 nt, Staphylococcus aureus subsp. aureus MW2
uuucauaguuauuaaaucuuuu

SEQ ID NO: 2093792 - RNA, 21 nt, Staphylococcus aureus subsp. aureus MW2
uuucauaaauauuuaaaauau

SEQ ID NO: 2093793 - RNA, 17 nt, Staphylococcus aureus subsp. aureus MW2
uuucacucauauuacuu

SEQ ID NO: 2093794 - RNA, 18 nt, Staphylococcus aureus subsp. aureus MW2
uuucacuuuaacuucuuu

SEQ ID NO: 2093795 - RNA, 14 nt, Staphylococcus aureus subsp. aureus MW2
uuucacuucauaaa

SEQ ID NO: 2093796 - RNA, 19 nt, Staphylococcus aureus subsp. aureus MW2
uuucagcgauaacguacaa

SEQ ID NO: 2093797 - RNA, 18 nt, Staphylococcus aureus subsp. aureus MW2
uuucagcaucuacuaaau

SEQ ID NO: 2093798 - RNA, 23 nt, Staphylococcus aureus subsp. aureus MW2
uuugcauaccuauaaacauaucu

SEQ ID NO: 2093799 - RNA, 16 nt, Staphylococcus aureus subsp. aureus MW2
uuugcaucacuuguug

SEQ ID NO: 2093800 - RNA, 17 nt, Staphylococcus aureus subsp. aureus MW2
uuugcuaugauguguua

SEQ ID NO: 2093801 - RNA, 14 nt, Staphylococcus aureus subsp. aureus MW2
uuugcgguguggcg

SEQ ID NO: 2093802 - RNA, 17 nt, Staphylococcus aureus subsp. aureus MW2
uuugauuuuacuugaau

SEQ ID NO: 2093803 - RNA, 17 nt, Staphylococcus aureus subsp. aureus MW2
uuugauuuugaauauaa

SEQ ID NO: 2093804 - RNA, 14 nt, Staphylococcus aureus subsp. aureus MW2
uuugauuguaauaa

SEQ ID NO: 2093805 - RNA, 17 nt, Staphylococcus aureus subsp. aureus MW2
uuugauuuauauuuuuu

SEQ ID NO: 2093806 - RNA, 14 nt, Staphylococcus aureus subsp. aureus MW2
uuugauauuucaaa

SEQ ID NO: 2093807 - RNA, 16 nt, Staphylococcus aureus subsp. aureus MW2
uuugaucuuuaaauau

SEQ ID NO: 2093808 - RNA, 17 nt, Staphylococcus aureus subsp. aureus MW2
uuugaucuuuaaauaua

SEQ ID NO: 2093809 - RNA, 18 nt, Staphylococcus aureus subsp. aureus MW2
uuugaucuuuaaauauac

SEQ ID NO: 2093810 - RNA, 22 nt, Staphylococcus aureus subsp. aureus MW2
uuugauauaaaaagugaaagua

SEQ ID NO: 2093811 - RNA, 23 nt, Staphylococcus aureus subsp. aureus MW2
uuugauauaaaaagugaaaguau

SEQ ID NO: 2093812 - RNA, 17 nt, Staphylococcus aureus subsp. aureus MW2
uuugauauaaacuacua

SEQ ID NO: 2093813 - RNA, 17 nt, Staphylococcus aureus subsp. aureus MW2
uuugauaguaauaguua

SEQ ID NO: 2093814 - RNA, 15 nt, Staphylococcus aureus subsp. aureus MW2
uuugauagaaaucag

SEQ ID NO: 2093815 - RNA, 22 nt, Staphylococcus aureus subsp. aureus MW2
uuugauagaugauacauucuau

SEQ ID NO: 2093816 - RNA, 18 nt, Staphylococcus aureus subsp. aureus MW2
uuugaguauccaauacua

SEQ ID NO: 2093817 - RNA, 21 nt, Staphylococcus aureus subsp. aureus MW2
uuugaggugugguguaaagau

SEQ ID NO: 2093818 - RNA, 23 nt, Staphylococcus aureus subsp. aureus MW2
uuucuugaugaauuaaacugauc

SEQ ID NO: 2093819 - RNA, 15 nt, Staphylococcus aureus subsp. aureus MW2
uuucuugaucuaaug

SEQ ID NO: 2093820 - RNA, 13 nt, Staphylococcus aureus subsp. aureus MW2
uuucuugaaauaa

SEQ ID NO: 2093821 - RNA, 12 nt, Staphylococcus aureus subsp. aureus MW2
uuucuucugcua

SEQ ID NO: 2093822 - RNA, 17 nt, Staphylococcus aureus subsp. aureus MW2
uuucuuuguguuugcuu

SEQ ID NO: 2093823 - RNA, 22 nt, Staphylococcus aureus subsp. aureus MW2
uuucuuugauaacaauuuuaaa

SEQ ID NO: 2093824 - RNA, 17 nt, Staphylococcus aureus subsp. aureus MW2
uuucuuguucuaaaaaa

SEQ ID NO: 2093825 - RNA, 18 nt, Staphylococcus aureus subsp. aureus MW2
uuucuuuaagcuuucuau

SEQ ID NO: 2093826 - RNA, 12 nt, Staphylococcus aureus subsp. aureus MW2
uuucuucauuuu

SEQ ID NO: 2093827 - RNA, 19 nt, Staphylococcus aureus subsp. aureus MW2
uuucuucauaguucaaauu

SEQ ID NO: 2093828 - RNA, 19 nt, Staphylococcus aureus subsp. aureus MW2
uuucugugaccaauagaau

SEQ ID NO: 2093829 - RNA, 18 nt, Staphylococcus aureus subsp. aureus MW2
uuucuuaaacgcucuucu

SEQ ID NO: 2093830 - RNA, 21 nt, Staphylococcus aureus subsp. aureus MW2
uuugaaugcaaaucaaauaca

SEQ ID NO: 2093831 - RNA, 22 nt, Staphylococcus aureus subsp. aureus MW2
uuugaaugcaaaucaaauacau

SEQ ID NO: 2093832 - RNA, 12 nt, Staphylococcus aureus subsp. aureus MW2
uuugaaugcaaa

SEQ ID NO: 2093833 - RNA, 15 nt, Staphylococcus aureus subsp. aureus MW2
uuugaauugacuuac

SEQ ID NO: 2093834 - RNA, 17 nt, Staphylococcus aureus subsp. aureus MW2
uuugacacauuauugaa

SEQ ID NO: 2093835 - RNA, 18 nt, Staphylococcus aureus subsp. aureus MW2
uuugaacgagagagaaaa

SEQ ID NO: 2093836 - RNA, 18 nt, Staphylococcus aureus subsp. aureus MW2
uuugaacgaaagagaaaa

SEQ ID NO: 2093837 - RNA, 15 nt, Staphylococcus aureus subsp. aureus MW2
uuugaacauauuaua

SEQ ID NO: 2093838 - RNA, 16 nt, Staphylococcus aureus subsp. aureus MW2
uuugaacguuuacucu

SEQ ID NO: 2093839 - RNA, 16 nt, Staphylococcus aureus subsp. aureus MW2
uuugaauacuuuauuu

SEQ ID NO: 2093840 - RNA, 16 nt, Staphylococcus aureus subsp. aureus MW2
uuugaauauuugcuuu

SEQ ID NO: 2093841 - RNA, 20 nt, Staphylococcus aureus subsp. aureus MW2
uuucuuuuguuuuuauauua

SEQ ID NO: 2093842 - RNA, 22 nt, Staphylococcus aureus subsp. aureus MW2
uuucuuuuuuuauggauuucuu

SEQ ID NO: 2093843 - RNA, 20 nt, Staphylococcus aureus subsp. aureus MW2
uuucuuuuuugcuguauaua

SEQ ID NO: 2093844 - RNA, 19 nt, Staphylococcus aureus subsp. aureus MW2
uuugaaaaaguguuuaaau

SEQ ID NO: 2093845 - RNA, 23 nt, Staphylococcus aureus subsp. aureus MW2
uuugaaaaaguguuuaaaugcua

SEQ ID NO: 2093846 - RNA, 13 nt, Staphylococcus aureus subsp. aureus MW2
uuugaaauauacc

SEQ ID NO: 2093847 - RNA, 17 nt, Staphylococcus aureus subsp. aureus MW2
uuugaaaugguaucuaa

SEQ ID NO: 2093848 - RNA, 14 nt, Staphylococcus aureus subsp. aureus MW2
uuucccuacugcuu

SEQ ID NO: 2093849 - RNA, 19 nt, Staphylococcus aureus subsp. aureus MW2
uuuccauaaauaaaaugcu

SEQ ID NO: 2093850 - RNA, 20 nt, Staphylococcus aureus subsp. aureus MW2
uuuccauaaauaaaaugcua

SEQ ID NO: 2093851 - RNA, 15 nt, Staphylococcus aureus subsp. aureus MW2
uuuccauuaugauua

SEQ ID NO: 2093852 - RNA, 22 nt, Staphylococcus aureus subsp. aureus MW2
uuuccucuuuaaagcuaaaugu

SEQ ID NO: 2093853 - RNA, 11 nt, Staphylococcus aureus subsp. aureus MW2
uuuccucuuua

SEQ ID NO: 2093854 - RNA, 16 nt, Staphylococcus aureus subsp. aureus MW2
uuuccugcagucauuu

SEQ ID NO: 2093855 - RNA, 18 nt, Staphylococcus aureus subsp. aureus MW2
uuuccuguuacuuucaca

SEQ ID NO: 2093856 - RNA, 19 nt, Staphylococcus aureus subsp. aureus MW2
uuuccucgguuuuauuuuu

SEQ ID NO: 2093857 - RNA, 22 nt, Staphylococcus aureus subsp. aureus MW2
uuuccucaacgggaacaucaua

SEQ ID NO: 2093858 - RNA, 22 nt, Staphylococcus aureus subsp. aureus MW2
uuuccuauuaggauccaauuua

SEQ ID NO: 2093859 - RNA, 18 nt, Staphylococcus aureus subsp. aureus MW2
uuuccuacacuguuuuau

SEQ ID NO: 2093860 - RNA, 13 nt, Staphylococcus aureus subsp. aureus MW2
uuucgauauuugu

SEQ ID NO: 2093861 - RNA, 21 nt, Staphylococcus aureus subsp. aureus MW2
uuucgacaucuagaugaaauu

SEQ ID NO: 2093862 - RNA, 17 nt, Staphylococcus aureus subsp. aureus MW2
uuucgauuaauucuucu

SEQ ID NO: 2093863 - RNA, 19 nt, Staphylococcus aureus subsp. aureus MW2
uuucguaacauuuaaaaaa

SEQ ID NO: 2093864 - RNA, 18 nt, Staphylococcus aureus subsp. aureus MW2
uuucggacgauugaacau

SEQ ID NO: 2093865 - RNA, 22 nt, Staphylococcus aureus subsp. aureus MW2
uuucgcuuuucuaauuuuucuu

SEQ ID NO: 2093866 - RNA, 19 nt, Staphylococcus aureus subsp. aureus MW2
uuucggcuagauuuuaaac

SEQ ID NO: 2093867 - RNA, 20 nt, Staphylococcus aureus subsp. aureus MW2
uuucuaaaucuaacuggaaa

SEQ ID NO: 2093868 - RNA, 19 nt, Staphylococcus aureus subsp. aureus MW2
uuucuaaauucuuuuuguu

SEQ ID NO: 2093869 - RNA, 15 nt, Staphylococcus aureus subsp. aureus MW2
uuucuaaaauaacua

SEQ ID NO: 2093870 - RNA, 23 nt, Staphylococcus aureus subsp. aureus MW2
uuucguuagacucacuucuuaaa

SEQ ID NO: 2093871 - RNA, 21 nt, Staphylococcus aureus subsp. aureus MW2
uuucgucuuguaaacuucuuu

SEQ ID NO: 2093872 - RNA, 17 nt, Staphylococcus aureus subsp. aureus MW2
uuucguguuccaauuuu

SEQ ID NO: 2093873 - RNA, 21 nt, Staphylococcus aureus subsp. aureus MW2
uuucuauacaaugaauuucua

SEQ ID NO: 2093874 - RNA, 14 nt, Staphylococcus aureus subsp. aureus MW2
uuucuauauuuuau

SEQ ID NO: 2093875 - RNA, 14 nt, Staphylococcus aureus subsp. aureus MW2
uuucuaucaaaaaa

SEQ ID NO: 2093876 - RNA, 18 nt, Staphylococcus aureus subsp. aureus MW2
uuucuaucaaaaaaacaa

SEQ ID NO: 2093877 - RNA, 14 nt, Staphylococcus aureus subsp. aureus MW2
uuucuauuaauaua

SEQ ID NO: 2093878 - RNA, 18 nt, Staphylococcus aureus subsp. aureus MW2
uuucuauuaauauagaag

SEQ ID NO: 2093879 - RNA, 14 nt, Staphylococcus aureus subsp. aureus MW2
uuucuaucaaauaa

SEQ ID NO: 2093880 - RNA, 22 nt, Staphylococcus aureus subsp. aureus MW2
uuucuagcuuguuuguuacaua

SEQ ID NO: 2093881 - RNA, 21 nt, Staphylococcus aureus subsp. aureus MW2
uuucuacgaauacuaaaaugg

SEQ ID NO: 2093882 - RNA, 21 nt, Staphylococcus aureus subsp. aureus MW2
uuucuacaccuacaacuguug

SEQ ID NO: 2093883 - RNA, 17 nt, Staphylococcus aureus subsp. aureus MW2
uuucuacagacaaugca

SEQ ID NO: 2093884 - RNA, 14 nt, Staphylococcus aureus subsp. aureus MW2
uuucuaauuuuucu

SEQ ID NO: 2093885 - RNA, 15 nt, Staphylococcus aureus subsp. aureus MW2
uuucuaaugcucauu

SEQ ID NO: 2093886 - RNA, 15 nt, Staphylococcus aureus subsp. aureus MW2
uuucuaaguuuguug

SEQ ID NO: 2093887 - RNA, 15 nt, Staphylococcus aureus subsp. aureus MW2
uuucucaaacuaucu

SEQ ID NO: 2093888 - RNA, 14 nt, Staphylococcus aureus subsp. aureus MW2
uuucucacugcugu

SEQ ID NO: 2093889 - RNA, 21 nt, Staphylococcus aureus subsp. aureus MW2
uuucucuauuaauuuucucaa

SEQ ID NO: 2093890 - RNA, 19 nt, Staphylococcus aureus subsp. aureus MW2
uuucuguaccaaauuugug

SEQ ID NO: 2093891 - RNA, 14 nt, Staphylococcus aureus subsp. aureus MW2
uuucugguaaaaaa

SEQ ID NO: 2093892 - RNA, 22 nt, Staphylococcus aureus subsp. aureus MW2
uuucugaucgacuaauuuuucu

SEQ ID NO: 2093893 - RNA, 16 nt, Staphylococcus aureus subsp. aureus MW2
uuuucacgaauaucuu

SEQ ID NO: 2093894 - RNA, 18 nt, Staphylococcus aureus subsp. aureus MW2
uuuucauauaauuuuaau

SEQ ID NO: 2093895 - RNA, 20 nt, Staphylococcus aureus subsp. aureus MW2
uuuucauagaacaaaaugua

SEQ ID NO: 2093896 - RNA, 15 nt, Staphylococcus aureus subsp. aureus MW2
uuuucauaaauauuu

SEQ ID NO: 2093897 - RNA, 21 nt, Staphylococcus aureus subsp. aureus MW2
uuuucauaaauauuuaaaaua

SEQ ID NO: 2093898 - RNA, 22 nt, Staphylococcus aureus subsp. aureus MW2
uuuucaauucgcucacauguga

SEQ ID NO: 2093899 - RNA, 13 nt, Staphylococcus aureus subsp. aureus MW2
uuuucaauuucua

SEQ ID NO: 2093900 - RNA, 15 nt, Staphylococcus aureus subsp. aureus MW2
uuuucaauaaauuuu

SEQ ID NO: 2093901 - RNA, 16 nt, Staphylococcus aureus subsp. aureus MW2
uuuucaaauguguaaa

SEQ ID NO: 2093902 - RNA, 18 nt, Staphylococcus aureus subsp. aureus MW2
uuuucaacaguuuuaaag

SEQ ID NO: 2093903 - RNA, 18 nt, Staphylococcus aureus subsp. aureus MW2
uuuucaacauaauauuuc

SEQ ID NO: 2093904 - RNA, 19 nt, Staphylococcus aureus subsp. aureus MW2
uuuucaacauaauauuucu

SEQ ID NO: 2093905 - RNA, 22 nt, Staphylococcus aureus subsp. aureus MW2
uuuucaagaccaaauauuuuau

SEQ ID NO: 2093906 - RNA, 21 nt, Staphylococcus aureus subsp. aureus MW2
uuuucaaacauauucauucua

SEQ ID NO: 2093907 - RNA, 14 nt, Staphylococcus aureus subsp. aureus MW2
uuuucaaagauaca

SEQ ID NO: 2093908 - RNA, 16 nt, Staphylococcus aureus subsp. aureus MW2
uuuuauuuuugaaaaa

SEQ ID NO: 2093909 - RNA, 14 nt, Staphylococcus aureus subsp. aureus MW2
uuuuauuuucaaau

SEQ ID NO: 2093910 - RNA, 23 nt, Staphylococcus aureus subsp. aureus MW2
uuuuauuuugugcuuuuuuguuu

SEQ ID NO: 2093911 - RNA, 19 nt, Staphylococcus aureus subsp. aureus MW2
uuuuccaguccauuuuuua

SEQ ID NO: 2093912 - RNA, 20 nt, Staphylococcus aureus subsp. aureus MW2
uuuucguagccguuuuugaa

SEQ ID NO: 2093913 - RNA, 13 nt, Staphylococcus aureus subsp. aureus MW2
uuuucguuuuaau

SEQ ID NO: 2093914 - RNA, 18 nt, Staphylococcus aureus subsp. aureus MW2
uuuucgauuaauucuucu

SEQ ID NO: 2093915 - RNA, 19 nt, Staphylococcus aureus subsp. aureus MW2
uuuucgaugcauauucauc

SEQ ID NO: 2093916 - RNA, 21 nt, Staphylococcus aureus subsp. aureus MW2
uuuucgaugcauauucaucau

SEQ ID NO: 2093917 - RNA, 16 nt, Staphylococcus aureus subsp. aureus MW2
uuuuauaccaauaauu

SEQ ID NO: 2093918 - RNA, 14 nt, Staphylococcus aureus subsp. aureus MW2
uuuuauacauuaac

SEQ ID NO: 2093919 - RNA, 22 nt, Staphylococcus aureus subsp. aureus MW2
uuuuauagcaaauugauuaaau

SEQ ID NO: 2093920 - RNA, 18 nt, Staphylococcus aureus subsp. aureus MW2
uuuuauagccgccuuuua

SEQ ID NO: 2093921 - RNA, 23 nt, Staphylococcus aureus subsp. aureus MW2
uuuuauaguaauagcuauauuuu

SEQ ID NO: 2093922 - RNA, 14 nt, Staphylococcus aureus subsp. aureus MW2
uuuuauaaauuuug

SEQ ID NO: 2093923 - RNA, 24 nt, Staphylococcus aureus subsp. aureus MW2
uuuuauaaguauucauacgcuauu

SEQ ID NO: 2093924 - RNA, 16 nt, Staphylococcus aureus subsp. aureus MW2
uuuuauaaguuaaaaa

SEQ ID NO: 2093925 - RNA, 15 nt, Staphylococcus aureus subsp. aureus MW2
uuuuagguaauaauu

SEQ ID NO: 2093926 - RNA, 14 nt, Staphylococcus aureus subsp. aureus MW2
uuuuagcuuuugua

SEQ ID NO: 2093927 - RNA, 15 nt, Staphylococcus aureus subsp. aureus MW2
uuuuagcuagacauu

SEQ ID NO: 2093928 - RNA, 11 nt, Staphylococcus aureus subsp. aureus MW2
uuuuagguuua

SEQ ID NO: 2093929 - RNA, 17 nt, Staphylococcus aureus subsp. aureus MW2
uuuuaggcauuuuagau

SEQ ID NO: 2093930 - RNA, 16 nt, Staphylococcus aureus subsp. aureus MW2
uuuuagugacaaacau

SEQ ID NO: 2093931 - RNA, 16 nt, Staphylococcus aureus subsp. aureus MW2
uuuuaguaauuuuaca

SEQ ID NO: 2093932 - RNA, 21 nt, Staphylococcus aureus subsp. aureus MW2
uuuuagugacaaacauuuguu

SEQ ID NO: 2093933 - RNA, 13 nt, Staphylococcus aureus subsp. aureus MW2
uuuuagaaaagga

SEQ ID NO: 2093934 - RNA, 17 nt, Staphylococcus aureus subsp. aureus MW2
uuuuagaauuuaacauu

SEQ ID NO: 2093935 - RNA, 15 nt, Staphylococcus aureus subsp. aureus MW2
uuuuagauuugaaau

SEQ ID NO: 2093936 - RNA, 20 nt, Staphylococcus aureus subsp. aureus MW2
uuuuacuuucaccauuuacu

SEQ ID NO: 2093937 - RNA, 18 nt, Staphylococcus aureus subsp. aureus MW2
uuuuacgcuuacuuauau

SEQ ID NO: 2093938 - RNA, 21 nt, Staphylococcus aureus subsp. aureus MW2
uuuuauauucaacuuauuauu

SEQ ID NO: 2093939 - RNA, 17 nt, Staphylococcus aureus subsp. aureus MW2
uuuuauauuuaaacucu

SEQ ID NO: 2093940 - RNA, 22 nt, Staphylococcus aureus subsp. aureus MW2
uuuuauauugcgaaaaauaauu

SEQ ID NO: 2093941 - RNA, 13 nt, Staphylococcus aureus subsp. aureus MW2
uuuuauauuuuua

SEQ ID NO: 2093942 - RNA, 21 nt, Staphylococcus aureus subsp. aureus MW2
uuuuauauuuaaacucucuaa

SEQ ID NO: 2093943 - RNA, 19 nt, Staphylococcus aureus subsp. aureus MW2
uuuuaucaucuauucaaau

SEQ ID NO: 2093944 - RNA, 17 nt, Staphylococcus aureus subsp. aureus MW2
uuuuaucauuuuuaauu

SEQ ID NO: 2093945 - RNA, 24 nt, Staphylococcus aureus subsp. aureus MW2
uuuuaugcauuauagaugacugua

SEQ ID NO: 2093946 - RNA, 20 nt, Staphylococcus aureus subsp. aureus MW2
uuuuaugagcuucuuuaaau

SEQ ID NO: 2093947 - RNA, 14 nt, Staphylococcus aureus subsp. aureus MW2
uuuuaucugaaucu

SEQ ID NO: 2093948 - RNA, 17 nt, Staphylococcus aureus subsp. aureus MW2
uuuuaucugaaucugcu

SEQ ID NO: 2093949 - RNA, 14 nt, Staphylococcus aureus subsp. aureus MW2
uuuuaugaaaagaa

SEQ ID NO: 2093950 - RNA, 14 nt, Staphylococcus aureus subsp. aureus MW2
uuuuaugaauauca

SEQ ID NO: 2093951 - RNA, 16 nt, Staphylococcus aureus subsp. aureus MW2
uuuuaucuaaacauuu

SEQ ID NO: 2093952 - RNA, 17 nt, Staphylococcus aureus subsp. aureus MW2
uuuuaucugaaaauauc

SEQ ID NO: 2093953 - RNA, 19 nt, Staphylococcus aureus subsp. aureus MW2
uuuuauuaucuuuguaaau

SEQ ID NO: 2093954 - RNA, 13 nt, Staphylococcus aureus subsp. aureus MW2
uuuuauuauuaau

SEQ ID NO: 2093955 - RNA, 20 nt, Staphylococcus aureus subsp. aureus MW2
uuuuauucuaauacaaaccu

SEQ ID NO: 2093956 - RNA, 16 nt, Staphylococcus aureus subsp. aureus MW2
uuuuauuguuuuggcu

SEQ ID NO: 2093957 - RNA, 13 nt, Staphylococcus aureus subsp. aureus MW2
uuuuauuuaaauu

SEQ ID NO: 2093958 - RNA, 14 nt, Staphylococcus aureus subsp. aureus MW2
uuuuauuuaaauua

SEQ ID NO: 2093959 - RNA, 17 nt, Staphylococcus aureus subsp. aureus MW2
uuuuauuuuaauauuuu

SEQ ID NO: 2093960 - RNA, 17 nt, Staphylococcus aureus subsp. aureus MW2
uuuuauuuauacuaaau

SEQ ID NO: 2093961 - RNA, 22 nt, Staphylococcus aureus subsp. aureus MW2
uuuuauuauacacuuuuugaca

SEQ ID NO: 2093962 - RNA, 19 nt, Staphylococcus aureus subsp. aureus MW2
uuuuauuacuuauuucuuu

SEQ ID NO: 2093963 - RNA, 16 nt, Staphylococcus aureus subsp. aureus MW2
uuuuauuaauuaaaaa

SEQ ID NO: 2093964 - RNA, 23 nt, Staphylococcus aureus subsp. aureus MW2
uuuuauuaaaucguauauuaaau

SEQ ID NO: 2093965 - RNA, 18 nt, Staphylococcus aureus subsp. aureus MW2
uuuuaugguuuaauuuag

SEQ ID NO: 2093966 - RNA, 21 nt, Staphylococcus aureus subsp. aureus MW2
uuuuauggugcuaaaaaauuu

SEQ ID NO: 2093967 - RNA, 20 nt, Staphylococcus aureus subsp. aureus MW2
uuuuaugucuaguucuugag

SEQ ID NO: 2093968 - RNA, 21 nt, Staphylococcus aureus subsp. aureus MW2
uuuuauguucagaaauuuaau

SEQ ID NO: 2093969 - RNA, 22 nt, Staphylococcus aureus subsp. aureus MW2
uuuuaugucuuuuuuuguaaau

SEQ ID NO: 2093970 - RNA, 14 nt, Staphylococcus aureus subsp. aureus MW2
uuuuauguuuuaau

SEQ ID NO: 2093971 - RNA, 15 nt, Staphylococcus aureus subsp. aureus MW2
uuuuauguuuuaauu

SEQ ID NO: 2093972 - RNA, 18 nt, Staphylococcus aureus subsp. aureus MW2
uuuuauguuuaaacauuu

SEQ ID NO: 2093973 - RNA, 12 nt, Staphylococcus aureus subsp. aureus MW2
uuuguauuuaug

SEQ ID NO: 2093974 - RNA, 17 nt, Staphylococcus aureus subsp. aureus MW2
uuugucaguaacuuugu

SEQ ID NO: 2093975 - RNA, 23 nt, Staphylococcus aureus subsp. aureus MW2
uuuguccaacauguaacaaaaua

SEQ ID NO: 2093976 - RNA, 14 nt, Staphylococcus aureus subsp. aureus MW2
uuugugggcguucu

SEQ ID NO: 2093977 - RNA, 20 nt, Staphylococcus aureus subsp. aureus MW2
uuuguaaccccauuuuaaag

SEQ ID NO: 2093978 - RNA, 23 nt, Staphylococcus aureus subsp. aureus MW2
uuuguaaccccauuuuaaaguca

SEQ ID NO: 2093979 - RNA, 15 nt, Staphylococcus aureus subsp. aureus MW2
uuuguaaccuaaaaa

SEQ ID NO: 2093980 - RNA, 20 nt, Staphylococcus aureus subsp. aureus MW2
uuuguaaauauuuuuuaaaa

SEQ ID NO: 2093981 - RNA, 22 nt, Staphylococcus aureus subsp. aureus MW2
uuuguaaagcuuuaguuaaaua

SEQ ID NO: 2093982 - RNA, 19 nt, Staphylococcus aureus subsp. aureus MW2
uuuguaauacaagcaauac

SEQ ID NO: 2093983 - RNA, 13 nt, Staphylococcus aureus subsp. aureus MW2
uuuguaauuagga

SEQ ID NO: 2093984 - RNA, 22 nt, Staphylococcus aureus subsp. aureus MW2
uuuguaauucuuguaaaucaua

SEQ ID NO: 2093985 - RNA, 20 nt, Staphylococcus aureus subsp. aureus MW2
uuuguaagcucaugaaucag

SEQ ID NO: 2093986 - RNA, 22 nt, Staphylococcus aureus subsp. aureus MW2
uuuguacuuuucuuuuuacuug

SEQ ID NO: 2093987 - RNA, 14 nt, Staphylococcus aureus subsp. aureus MW2
uuuguagaauuucu

SEQ ID NO: 2093988 - RNA, 17 nt, Staphylococcus aureus subsp. aureus MW2
uuuguaugauaaccauu

SEQ ID NO: 2093989 - RNA, 17 nt, Staphylococcus aureus subsp. aureus MW2
uuuguauugacaucuuc

SEQ ID NO: 2093990 - RNA, 17 nt, Staphylococcus aureus subsp. aureus MW2
uuuguauaccuauuccu

SEQ ID NO: 2093991 - RNA, 16 nt, Staphylococcus aureus subsp. aureus MW2
uuuguaccaucaauaa

SEQ ID NO: 2093992 - RNA, 22 nt, Staphylococcus aureus subsp. aureus MW2
uuugcugcuuuuccauuaugau

SEQ ID NO: 2093993 - RNA, 17 nt, Staphylococcus aureus subsp. aureus MW2
uuuggaaaccguuuaga

SEQ ID NO: 2093994 - RNA, 23 nt, Staphylococcus aureus subsp. aureus MW2
uuugcuuuagcucuuuuuugauu

SEQ ID NO: 2093995 - RNA, 18 nt, Staphylococcus aureus subsp. aureus MW2
uuugcuuuauuuucuugu

SEQ ID NO: 2093996 - RNA, 14 nt, Staphylococcus aureus subsp. aureus MW2
uuuggauuccaucu

SEQ ID NO: 2093997 - RNA, 19 nt, Staphylococcus aureus subsp. aureus MW2
uuuggauuucuuuuuaaaa

SEQ ID NO: 2093998 - RNA, 21 nt, Staphylococcus aureus subsp. aureus MW2
uuuggauuucuuuuuaaaauc

SEQ ID NO: 2093999 - RNA, 18 nt, Staphylococcus aureus subsp. aureus MW2
uuuggucaaguuuugguc

SEQ ID NO: 2094000 - RNA, 15 nt, Staphylococcus aureus subsp. aureus MW2
uuugggcuuuuucac

SEQ ID NO: 2094001 - RNA, 20 nt, Staphylococcus aureus subsp. aureus MW2
uuugguaagcuaauuucuaa

SEQ ID NO: 2094002 - RNA, 16 nt, Staphylococcus aureus subsp. aureus MW2
uuugguucuucuaucu

SEQ ID NO: 2094003 - RNA, 24 nt, Staphylococcus aureus subsp. aureus MW2
uuuggcacauaaaucaauguacua

SEQ ID NO: 2094004 - RNA, 17 nt, Staphylococcus aureus subsp. aureus MW2
uuuuaccuuuaauuaca

SEQ ID NO: 2094005 - RNA, 13 nt, Staphylococcus aureus subsp. aureus MW2
uuuuacaauuuuu

SEQ ID NO: 2094006 - RNA, 22 nt, Staphylococcus aureus subsp. aureus MW2
uuuuaaugggcgauaaaaguug

SEQ ID NO: 2094007 - RNA, 20 nt, Staphylococcus aureus subsp. aureus MW2
uuuuaauguauucuucuaau

SEQ ID NO: 2094008 - RNA, 16 nt, Staphylococcus aureus subsp. aureus MW2
uuuuaauguuauaaau

SEQ ID NO: 2094009 - RNA, 12 nt, Staphylococcus aureus subsp. aureus MW2
uuuuaaugauuu

SEQ ID NO: 2094010 - RNA, 19 nt, Staphylococcus aureus subsp. aureus MW2
uuuuaaugggcgauaaaag

SEQ ID NO: 2094011 - RNA, 21 nt, Staphylococcus aureus subsp. aureus MW2
uuuuaaugaaucuguagucau

SEQ ID NO: 2094012 - RNA, 15 nt, Staphylococcus aureus subsp. aureus MW2
uuuuacaaagugauu

SEQ ID NO: 2094013 - RNA, 18 nt, Staphylococcus aureus subsp. aureus MW2
uuuuacaaacuucacauu

SEQ ID NO: 2094014 - RNA, 23 nt, Staphylococcus aureus subsp. aureus MW2
uuuuacaaaauauggaauuucau

SEQ ID NO: 2094015 - RNA, 21 nt, Staphylococcus aureus subsp. aureus MW2
uuuuacaaagugauuuaaaaa

SEQ ID NO: 2094016 - RNA, 20 nt, Staphylococcus aureus subsp. aureus MW2
uuuuacaaucaucacacaua

SEQ ID NO: 2094017 - RNA, 15 nt, Staphylococcus aureus subsp. aureus MW2
uuuuaacagcugcag

SEQ ID NO: 2094018 - RNA, 21 nt, Staphylococcus aureus subsp. aureus MW2
uuuuaacauagcuuaauaauu

SEQ ID NO: 2094019 - RNA, 21 nt, Staphylococcus aureus subsp. aureus MW2
uuuuaaauuuaguaucucauu

SEQ ID NO: 2094020 - RNA, 19 nt, Staphylococcus aureus subsp. aureus MW2
uuuuaacaaugaaccaucc

SEQ ID NO: 2094021 - RNA, 17 nt, Staphylococcus aureus subsp. aureus MW2
uuuuaaauuuuuuaaua

SEQ ID NO: 2094022 - RNA, 21 nt, Staphylococcus aureus subsp. aureus MW2
uuuuaaauucuuauaaaauaa

SEQ ID NO: 2094023 - RNA, 17 nt, Staphylococcus aureus subsp. aureus MW2
uuuuaagaucaauauca

SEQ ID NO: 2094024 - RNA, 20 nt, Staphylococcus aureus subsp. aureus MW2
uuuuaauauugaaaugagcu

SEQ ID NO: 2094025 - RNA, 16 nt, Staphylococcus aureus subsp. aureus MW2
uuuuaauauuuucauu

SEQ ID NO: 2094026 - RNA, 14 nt, Staphylococcus aureus subsp. aureus MW2
uuuuaauauuuuuu

SEQ ID NO: 2094027 - RNA, 19 nt, Staphylococcus aureus subsp. aureus MW2
uuuuaaucauuguuuuaaa

SEQ ID NO: 2094028 - RNA, 20 nt, Staphylococcus aureus subsp. aureus MW2
uuuuaaucauuguuuuaaau

SEQ ID NO: 2094029 - RNA, 23 nt, Staphylococcus aureus subsp. aureus MW2
uuuuaauagguuaguaauauauu

SEQ ID NO: 2094030 - RNA, 20 nt, Staphylococcus aureus subsp. aureus MW2
uuuuaauaguuuuaauauuu

SEQ ID NO: 2094031 - RNA, 23 nt, Staphylococcus aureus subsp. aureus MW2
uuuuaagugaugaccaauauucu

SEQ ID NO: 2094032 - RNA, 21 nt, Staphylococcus aureus subsp. aureus MW2
uuuguugguguuuagucuuuu

SEQ ID NO: 2094033 - RNA, 15 nt, Staphylococcus aureus subsp. aureus MW2
uuuguugguguuuag

SEQ ID NO: 2094034 - RNA, 14 nt, Staphylococcus aureus subsp. aureus MW2
uuuguucaaucacu

SEQ ID NO: 2094035 - RNA, 15 nt, Staphylococcus aureus subsp. aureus MW2
uuuguuacuucuaau

SEQ ID NO: 2094036 - RNA, 14 nt, Staphylococcus aureus subsp. aureus MW2
uuuguuacuucuaa

SEQ ID NO: 2094037 - RNA, 16 nt, Staphylococcus aureus subsp. aureus MW2
uuuguuaaaaaauuaa

SEQ ID NO: 2094038 - RNA, 14 nt, Staphylococcus aureus subsp. aureus MW2
uuuguuuucacugu

SEQ ID NO: 2094039 - RNA, 13 nt, Staphylococcus aureus subsp. aureus MW2
uuuguuuuuauau

SEQ ID NO: 2094040 - RNA, 16 nt, Staphylococcus aureus subsp. aureus MW2
uuuguuuuaaauacuu

SEQ ID NO: 2094041 - RNA, 14 nt, Staphylococcus aureus subsp. aureus MW2
uuuguuguuauaua

SEQ ID NO: 2094042 - RNA, 12 nt, Staphylococcus aureus subsp. aureus MW2
uuuguuuguaag

SEQ ID NO: 2094043 - RNA, 14 nt, Staphylococcus aureus subsp. aureus MW2
uuuguuuuaaaaaa

SEQ ID NO: 2094044 - RNA, 17 nt, Staphylococcus aureus subsp. aureus MW2
uuuuaaaagauaaauaa

SEQ ID NO: 2094045 - RNA, 21 nt, Staphylococcus aureus subsp. aureus MW2
uuuuaaaaucucauaauaauu

SEQ ID NO: 2094046 - RNA, 14 nt, Staphylococcus aureus subsp. aureus MW2
uuuuaaaaugauag

SEQ ID NO: 2094047 - RNA, 22 nt, Staphylococcus aureus subsp. aureus MW2
uuuuaaacaugaacaaucagau

SEQ ID NO: 2094048 - RNA, 14 nt, Staphylococcus aureus subsp. aureus MW2
uuuuaaacaaauaa

SEQ ID NO: 2094049 - RNA, 20 nt, Staphylococcus aureus subsp. aureus MW2
uuuuaaaggaccacuuagau

SEQ ID NO: 2094050 - RNA, 16 nt, Staphylococcus aureus subsp. aureus MW2
uuuuaaagaaaaguuu

SEQ ID NO: 2094051 - RNA, 18 nt, Staphylococcus aureus subsp. aureus MW2
uuuuaaagaaaaguuuag

SEQ ID NO: 2094052 - RNA, 22 nt, Staphylococcus aureus subsp. aureus MW2
uuuuaaauuacuauauuuaaau

SEQ ID NO: 2094053 - RNA, 14 nt, Staphylococcus aureus subsp. aureus MW2
uuuugcuguauaua

SEQ ID NO: 2094054 - RNA, 16 nt, Staphylococcus aureus subsp. aureus MW2
uuuugcgaaaauauca

SEQ ID NO: 2094055 - RNA, 21 nt, Staphylococcus aureus subsp. aureus MW2
uuuugcccaugucaugaauuu

SEQ ID NO: 2094056 - RNA, 14 nt, Staphylococcus aureus subsp. aureus MW2
uuuugcaucacaga

SEQ ID NO: 2094057 - RNA, 14 nt, Staphylococcus aureus subsp. aureus MW2
uuuugauuuuaaua

SEQ ID NO: 2094058 - RNA, 9 nt, Staphylococcus aureus subsp. aureus MW2
uuuugauug

SEQ ID NO: 2094059 - RNA, 20 nt, Staphylococcus aureus subsp. aureus MW2
uuuugauuguuuaaacaugu

SEQ ID NO: 2094060 - RNA, 14 nt, Staphylococcus aureus subsp. aureus MW2
uuuugcacuaaugg

SEQ ID NO: 2094061 - RNA, 12 nt, Staphylococcus aureus subsp. aureus MW2
uuuugcaccuuc

SEQ ID NO: 2094062 - RNA, 14 nt, Staphylococcus aureus subsp. aureus MW2
uuuugcaaaaaaau

SEQ ID NO: 2094063 - RNA, 21 nt, Staphylococcus aureus subsp. aureus MW2
uuuugagcacuuaauaaguca

SEQ ID NO: 2094064 - RNA, 18 nt, Staphylococcus aureus subsp. aureus MW2
uuuugauacguaaacacu

SEQ ID NO: 2094065 - RNA, 13 nt, Staphylococcus aureus subsp. aureus MW2
uuuugauauaaaa

SEQ ID NO: 2094066 - RNA, 23 nt, Staphylococcus aureus subsp. aureus MW2
uuuugauauaaaaagugaaagua

SEQ ID NO: 2094067 - RNA, 19 nt, Staphylococcus aureus subsp. aureus MW2
uuuugaauuacagauuucu

SEQ ID NO: 2094068 - RNA, 13 nt, Staphylococcus aureus subsp. aureus MW2
uuuugaauuacag

SEQ ID NO: 2094069 - RNA, 18 nt, Staphylococcus aureus subsp. aureus MW2
uuuugaauguuucuccua

SEQ ID NO: 2094070 - RNA, 20 nt, Staphylococcus aureus subsp. aureus MW2
uuuugacuguuaaacaaggu

SEQ ID NO: 2094071 - RNA, 18 nt, Staphylococcus aureus subsp. aureus MW2
uuuugagacaaaaaauga

SEQ ID NO: 2094072 - RNA, 19 nt, Staphylococcus aureus subsp. aureus MW2
uuuugagagauuauuuaaa

SEQ ID NO: 2094073 - RNA, 17 nt, Staphylococcus aureus subsp. aureus MW2
uuuucuuauaaaaaucu

SEQ ID NO: 2094074 - RNA, 22 nt, Staphylococcus aureus subsp. aureus MW2
uuuucuuuauuuuaaacaugaa

SEQ ID NO: 2094075 - RNA, 20 nt, Staphylococcus aureus subsp. aureus MW2
uuuucuuuaucuauaugcau

SEQ ID NO: 2094076 - RNA, 14 nt, Staphylococcus aureus subsp. aureus MW2
uuuucuaauuguuu

SEQ ID NO: 2094077 - RNA, 23 nt, Staphylococcus aureus subsp. aureus MW2
uuuucucaacaguuucuuggucu

SEQ ID NO: 2094078 - RNA, 17 nt, Staphylococcus aureus subsp. aureus MW2
uuuucugccauaaacau

SEQ ID NO: 2094079 - RNA, 15 nt, Staphylococcus aureus subsp. aureus MW2
uuuuucauauucaca

SEQ ID NO: 2094080 - RNA, 15 nt, Staphylococcus aureus subsp. aureus MW2
uuuuuauuuuacuua

SEQ ID NO: 2094081 - RNA, 14 nt, Staphylococcus aureus subsp. aureus MW2
uuuuucaaauaaua

SEQ ID NO: 2094082 - RNA, 17 nt, Staphylococcus aureus subsp. aureus MW2
uuuuucaaauaauauaa

SEQ ID NO: 2094083 - RNA, 14 nt, Staphylococcus aureus subsp. aureus MW2
uuuuucaauucgcu

SEQ ID NO: 2094084 - RNA, 14 nt, Staphylococcus aureus subsp. aureus MW2
uuuuucaaugucua

SEQ ID NO: 2094085 - RNA, 19 nt, Staphylococcus aureus subsp. aureus MW2
uuuuucaacuaauaacuca

SEQ ID NO: 2094086 - RNA, 22 nt, Staphylococcus aureus subsp. aureus MW2
uuuuucagcuguccgauuuuuu

SEQ ID NO: 2094087 - RNA, 19 nt, Staphylococcus aureus subsp. aureus MW2
uuuuucauaaauauuuaaa

SEQ ID NO: 2094088 - RNA, 19 nt, Staphylococcus aureus subsp. aureus MW2
uuuuuacuaggaauauaaa

SEQ ID NO: 2094089 - RNA, 20 nt, Staphylococcus aureus subsp. aureus MW2
uuuuuagacauuaaaaaauc

SEQ ID NO: 2094090 - RNA, 18 nt, Staphylococcus aureus subsp. aureus MW2
uuuuuauaaguauucaua

SEQ ID NO: 2094091 - RNA, 15 nt, Staphylococcus aureus subsp. aureus MW2
uuuuuaguuaaagua

SEQ ID NO: 2094092 - RNA, 18 nt, Staphylococcus aureus subsp. aureus MW2
uuuuuagccccagcaaau

SEQ ID NO: 2094093 - RNA, 11 nt, Staphylococcus aureus subsp. aureus MW2
uuuuuauauug

SEQ ID NO: 2094094 - RNA, 15 nt, Staphylococcus aureus subsp. aureus MW2
uuuuuaucaucuucu

SEQ ID NO: 2094095 - RNA, 20 nt, Staphylococcus aureus subsp. aureus MW2
uuuuuaugcacaaaaaaauc

SEQ ID NO: 2094096 - RNA, 12 nt, Staphylococcus aureus subsp. aureus MW2
uuuuuaugauuc

SEQ ID NO: 2094097 - RNA, 23 nt, Staphylococcus aureus subsp. aureus MW2
uuuuuauuaaucuguaaugcacu

SEQ ID NO: 2094098 - RNA, 17 nt, Staphylococcus aureus subsp. aureus MW2
uuuuuauuaguauucaa

SEQ ID NO: 2094099 - RNA, 23 nt, Staphylococcus aureus subsp. aureus MW2
uuuuuaacuuuaacaucugaauc

SEQ ID NO: 2094100 - RNA, 16 nt, Staphylococcus aureus subsp. aureus MW2
uuuuuaauauauuuau

SEQ ID NO: 2094101 - RNA, 14 nt, Staphylococcus aureus subsp. aureus MW2
uuuuuaauaaugca

SEQ ID NO: 2094102 - RNA, 12 nt, Staphylococcus aureus subsp. aureus MW2
uuuuuaauaauu

SEQ ID NO: 2094103 - RNA, 16 nt, Staphylococcus aureus subsp. aureus MW2
uuuuuaauuauuuccc

SEQ ID NO: 2094104 - RNA, 15 nt, Staphylococcus aureus subsp. aureus MW2
uuuuuaauuuugaca

SEQ ID NO: 2094105 - RNA, 22 nt, Staphylococcus aureus subsp. aureus MW2
uuuuuacaauaugauuaauaaa

SEQ ID NO: 2094106 - RNA, 11 nt, Staphylococcus aureus subsp. aureus MW2
uuuuuaaauac

SEQ ID NO: 2094107 - RNA, 18 nt, Staphylococcus aureus subsp. aureus MW2
uuuuuaacagcuuuuucu

SEQ ID NO: 2094108 - RNA, 23 nt, Staphylococcus aureus subsp. aureus MW2
uuuuuaacauagcuuaauaauua

SEQ ID NO: 2094109 - RNA, 17 nt, Staphylococcus aureus subsp. aureus MW2
uuuuuaaaugauuuaau

SEQ ID NO: 2094110 - RNA, 21 nt, Staphylococcus aureus subsp. aureus MW2
uuuuuaaaugauuuaauaaac

SEQ ID NO: 2094111 - RNA, 14 nt, Staphylococcus aureus subsp. aureus MW2
uuuuuaaaaauaca

SEQ ID NO: 2094112 - RNA, 19 nt, Staphylococcus aureus subsp. aureus MW2
uuuuuaaaauuaucaauug

SEQ ID NO: 2094113 - RNA, 17 nt, Staphylococcus aureus subsp. aureus MW2
uuuuguugguuuuuaaa

SEQ ID NO: 2094114 - RNA, 20 nt, Staphylococcus aureus subsp. aureus MW2
uuuuggucaaguaaauguuu

SEQ ID NO: 2094115 - RNA, 17 nt, Staphylococcus aureus subsp. aureus MW2
uuuuggucaaguaaaug

SEQ ID NO: 2094116 - RNA, 17 nt, Staphylococcus aureus subsp. aureus MW2
uuuuguaucucugaaaa

SEQ ID NO: 2094117 - RNA, 12 nt, Staphylococcus aureus subsp. aureus MW2
uuuuguauaucu

SEQ ID NO: 2094118 - RNA, 19 nt, Staphylococcus aureus subsp. aureus MW2
uuuugugggcguucugcua

SEQ ID NO: 2094119 - RNA, 23 nt, Staphylococcus aureus subsp. aureus MW2
uuuuguguauuuauuuuuuuaaa

SEQ ID NO: 2094120 - RNA, 13 nt, Staphylococcus aureus subsp. aureus MW2
uuuugugauuuuu

SEQ ID NO: 2094121 - RNA, 14 nt, Staphylococcus aureus subsp. aureus MW2
uuuuguuaauuuuu

SEQ ID NO: 2094122 - RNA, 18 nt, Staphylococcus aureus subsp. aureus MW2
uuuuguugcucagugcau

SEQ ID NO: 2094123 - RNA, 20 nt, Staphylococcus aureus subsp. aureus MW2
aaauguuuacugucaucuuu

SEQ ID NO: 2094124 - RNA, 18 nt, Staphylococcus aureus subsp. aureus MW2
aaauuaaaaaacaaaacu

SEQ ID NO: 2094125 - RNA, 12 nt, Staphylococcus aureus subsp. aureus MW2
aaauuaaaaaau

SEQ ID NO: 2094126 - RNA, 14 nt, Staphylococcus aureus subsp. aureus MW2
aaauuaaaaacacc

SEQ ID NO: 2094127 - RNA, 22 nt, Staphylococcus aureus subsp. aureus MW2
aaauuaaaaacaccuucguuua

SEQ ID NO: 2094128 - RNA, 16 nt, Staphylococcus aureus subsp. aureus MW2
aaauguuuaacaauaa

SEQ ID NO: 2094129 - RNA, 18 nt, Staphylococcus aureus subsp. aureus MW2
aaauguuuauaauaauau

SEQ ID NO: 2094130 - RNA, 15 nt, Staphylococcus aureus subsp. aureus MW2
aaauguuuaacaaua

SEQ ID NO: 2094131 - RNA, 20 nt, Staphylococcus aureus subsp. aureus MW2
aaauguuuaucaauucccug

SEQ ID NO: 2094132 - RNA, 14 nt, Staphylococcus aureus subsp. aureus MW2
aaauguuauugcuu

SEQ ID NO: 2094133 - RNA, 15 nt, Staphylococcus aureus subsp. aureus MW2
aaauguuauugcuua

SEQ ID NO: 2094134 - RNA, 22 nt, Staphylococcus aureus subsp. aureus MW2
aaauguuauugcuuauuuuugu

SEQ ID NO: 2094135 - RNA, 18 nt, Staphylococcus aureus subsp. aureus MW2
aaauguugacuacucaau

SEQ ID NO: 2094136 - RNA, 16 nt, Staphylococcus aureus subsp. aureus MW2
aaauguuaaauucuaa

SEQ ID NO: 2094137 - RNA, 21 nt, Staphylococcus aureus subsp. aureus MW2
aaauguuaaagauuauuauua

SEQ ID NO: 2094138 - RNA, 21 nt, Staphylococcus aureus subsp. aureus MW2
aaauguuacacaaauuaaaac

SEQ ID NO: 2094139 - RNA, 15 nt, Staphylococcus aureus subsp. aureus MW2
aaauguuacacaaau

SEQ ID NO: 2094140 - RNA, 14 nt, Staphylococcus aureus subsp. aureus MW2
uuuuuuauuugucu

SEQ ID NO: 2094141 - RNA, 18 nt, Staphylococcus aureus subsp. aureus MW2
aaauguguuaaaauauau

SEQ ID NO: 2094142 - RNA, 16 nt, Staphylococcus aureus subsp. aureus MW2
uuuuuuacauucguuu

SEQ ID NO: 2094143 - RNA, 14 nt, Staphylococcus aureus subsp. aureus MW2
uuuuuuauucuaau

SEQ ID NO: 2094144 - RNA, 12 nt, Staphylococcus aureus subsp. aureus MW2
uuuuuuauuaau

SEQ ID NO: 2094145 - RNA, 20 nt, Staphylococcus aureus subsp. aureus MW2
aaauuaaagcuagaaacaau

SEQ ID NO: 2094146 - RNA, 12 nt, Staphylococcus aureus subsp. aureus MW2
aaauuaaaauaa

SEQ ID NO: 2094147 - RNA, 12 nt, Staphylococcus aureus subsp. aureus MW2
aaauuaaaacag

SEQ ID NO: 2094148 - RNA, 20 nt, Staphylococcus aureus subsp. aureus MW2
aaauuaacuuaaaauuuaaa

SEQ ID NO: 2094149 - RNA, 22 nt, Staphylococcus aureus subsp. aureus MW2
aaauuaacuuaaaauuuaaaua

SEQ ID NO: 2094150 - RNA, 13 nt, Staphylococcus aureus subsp. aureus MW2
aaauuaacuagug

SEQ ID NO: 2094151 - RNA, 13 nt, Staphylococcus aureus subsp. aureus MW2
aaauuaaaucuac

SEQ ID NO: 2094152 - RNA, 19 nt, Staphylococcus aureus subsp. aureus MW2
aaauuaaaugcauaauaua

SEQ ID NO: 2094153 - RNA, 19 nt, Staphylococcus aureus subsp. aureus MW2
aaauuaauaugaacaaaaa

SEQ ID NO: 2094154 - RNA, 19 nt, Staphylococcus aureus subsp. aureus MW2
aaauuaauagagaaaaaau

SEQ ID NO: 2094155 - RNA, 17 nt, Staphylococcus aureus subsp. aureus MW2
aaauuaauaauuuucca

SEQ ID NO: 2094156 - RNA, 14 nt, Staphylococcus aureus subsp. aureus MW2
aaauuaacuuaaaa

SEQ ID NO: 2094157 - RNA, 22 nt, Staphylococcus aureus subsp. aureus MW2
aaauuaauguagguuauuauaa

SEQ ID NO: 2094158 - RNA, 24 nt, Staphylococcus aureus subsp. aureus MW2
aaauuaauguagguuauuauaaaa

SEQ ID NO: 2094159 - RNA, 15 nt, Staphylococcus aureus subsp. aureus MW2
aaauuaauguuuuca

SEQ ID NO: 2094160 - RNA, 14 nt, Staphylococcus aureus subsp. aureus MW2
uuuuucuuuuguuu

SEQ ID NO: 2094161 - RNA, 22 nt, Staphylococcus aureus subsp. aureus MW2
uuuuugaaaugguaucuaaaug

SEQ ID NO: 2094162 - RNA, 13 nt, Staphylococcus aureus subsp. aureus MW2
uuuuugaaaugua

SEQ ID NO: 2094163 - RNA, 14 nt, Staphylococcus aureus subsp. aureus MW2
uuuuucuuuaagcu

SEQ ID NO: 2094164 - RNA, 16 nt, Staphylococcus aureus subsp. aureus MW2
uuuuugaauaucuaau

SEQ ID NO: 2094165 - RNA, 20 nt, Staphylococcus aureus subsp. aureus MW2
uuuuugaaauuucgacaucu

SEQ ID NO: 2094166 - RNA, 22 nt, Staphylococcus aureus subsp. aureus MW2
uuuuucucaaugugagauauaa

SEQ ID NO: 2094167 - RNA, 18 nt, Staphylococcus aureus subsp. aureus MW2
uuuuucuccaguuuucaa

SEQ ID NO: 2094168 - RNA, 13 nt, Staphylococcus aureus subsp. aureus MW2
uuuuucguuguuc

SEQ ID NO: 2094169 - RNA, 17 nt, Staphylococcus aureus subsp. aureus MW2
uuuuuuaauaccaucau

SEQ ID NO: 2094170 - RNA, 12 nt, Staphylococcus aureus subsp. aureus MW2
uuuuuuaaauac

SEQ ID NO: 2094171 - RNA, 21 nt, Staphylococcus aureus subsp. aureus MW2
uuuuugauaguaauaguuaac

SEQ ID NO: 2094172 - RNA, 20 nt, Staphylococcus aureus subsp. aureus MW2
uuuuugauauaaacuacuaa

SEQ ID NO: 2094173 - RNA, 14 nt, Staphylococcus aureus subsp. aureus MW2
uuuuugauuuuaau

SEQ ID NO: 2094174 - RNA, 16 nt, Staphylococcus aureus subsp. aureus MW2
aaauucaacgucauca

SEQ ID NO: 2094175 - RNA, 18 nt, Staphylococcus aureus subsp. aureus MW2
aaauucaacgucaucaaa

SEQ ID NO: 2094176 - RNA, 16 nt, Staphylococcus aureus subsp. aureus MW2
aaauucgcaagccuuc

SEQ ID NO: 2094177 - RNA, 16 nt, Staphylococcus aureus subsp. aureus MW2
aaauucuaugagaaua

SEQ ID NO: 2094178 - RNA, 22 nt, Staphylococcus aureus subsp. aureus MW2
aaauucuacagacaaugcaagu

SEQ ID NO: 2094179 - RNA, 22 nt, Staphylococcus aureus subsp. aureus MW2
aaauucuacaaacaaugcaagu

SEQ ID NO: 2094180 - RNA, 14 nt, Staphylococcus aureus subsp. aureus MW2
aaauucucaauuaa

SEQ ID NO: 2094181 - RNA, 13 nt, Staphylococcus aureus subsp. aureus MW2
aaauucucuaauu

SEQ ID NO: 2094182 - RNA, 22 nt, Staphylococcus aureus subsp. aureus MW2
aaauucucuaauuucucccguu

SEQ ID NO: 2094183 - RNA, 12 nt, Staphylococcus aureus subsp. aureus MW2
aaauucucugug

SEQ ID NO: 2094184 - RNA, 17 nt, Staphylococcus aureus subsp. aureus MW2
aaauucucuguguuggg

SEQ ID NO: 2094185 - RNA, 15 nt, Staphylococcus aureus subsp. aureus MW2
aaauuacuuauucaa

SEQ ID NO: 2094186 - RNA, 12 nt, Staphylococcus aureus subsp. aureus MW2
aaauuagaauua

SEQ ID NO: 2094187 - RNA, 15 nt, Staphylococcus aureus subsp. aureus MW2
aaauuacuauauuua

SEQ ID NO: 2094188 - RNA, 15 nt, Staphylococcus aureus subsp. aureus MW2
aaauuacacccuuua

SEQ ID NO: 2094189 - RNA, 14 nt, Staphylococcus aureus subsp. aureus MW2
aaauuacacccuuu

SEQ ID NO: 2094190 - RNA, 17 nt, Staphylococcus aureus subsp. aureus MW2
aaauuacgcaaagaaaa

SEQ ID NO: 2094191 - RNA, 21 nt, Staphylococcus aureus subsp. aureus MW2
aaauuacgcaaagaaaaacau

SEQ ID NO: 2094192 - RNA, 23 nt, Staphylococcus aureus subsp. aureus MW2
uuuuuuuauaaguuaaaaaugua

SEQ ID NO: 2094193 - RNA, 12 nt, Staphylococcus aureus subsp. aureus MW2
uuuuuuuauuaa

SEQ ID NO: 2094194 - RNA, 11 nt, Staphylococcus aureus subsp. aureus MW2
uuuuuuuguug

SEQ ID NO: 2094195 - RNA, 10 nt, Staphylococcus aureus subsp. aureus MW2
uuuuuuguua

SEQ ID NO: 2094196 - RNA, 13 nt, Staphylococcus aureus subsp. aureus MW2
aaauuauaauugu

SEQ ID NO: 2094197 - RNA, 12 nt, Staphylococcus aureus subsp. aureus MW2
aaauuauauaaa

SEQ ID NO: 2094198 - RNA, 22 nt, Staphylococcus aureus subsp. aureus MW2
aaauuagcaagugaguaacauu

SEQ ID NO: 2094199 - RNA, 15 nt, Staphylococcus aureus subsp. aureus MW2
aaauuagauaaaaca

SEQ ID NO: 2094200 - RNA, 14 nt, Staphylococcus aureus subsp. aureus MW2
aaauuagaugaaau

SEQ ID NO: 2094201 - RNA, 20 nt, Staphylococcus aureus subsp. aureus MW2
aaauuagauuuuaugcuuua

SEQ ID NO: 2094202 - RNA, 21 nt, Staphylococcus aureus subsp. aureus MW2
aaauuagcgauacuuuuaaaa

SEQ ID NO: 2094203 - RNA, 18 nt, Staphylococcus aureus subsp. aureus MW2
aaauuaggcauucaucua

SEQ ID NO: 2094204 - RNA, 13 nt, Staphylococcus aureus subsp. aureus MW2
aaauuaugauuau

SEQ ID NO: 2094205 - RNA, 21 nt, Staphylococcus aureus subsp. aureus MW2
aaauuaugauuauuuuucuca

SEQ ID NO: 2094206 - RNA, 16 nt, Staphylococcus aureus subsp. aureus MW2
aaauuauguaaaaaau

SEQ ID NO: 2094207 - RNA, 13 nt, Staphylococcus aureus subsp. aureus MW2
aaauuauuauuua

SEQ ID NO: 2094208 - RNA, 21 nt, Staphylococcus aureus subsp. aureus MW2
aaauuaucuuucaucaaauuc

SEQ ID NO: 2094209 - RNA, 17 nt, Staphylococcus aureus subsp. aureus MW2
aaauuauuauuuaaauu

SEQ ID NO: 2094210 - RNA, 20 nt, Staphylococcus aureus subsp. aureus MW2
aaauuauugacauugcaaaa

SEQ ID NO: 2094211 - RNA, 13 nt, Staphylococcus aureus subsp. aureus MW2
aaauuauuugaua

SEQ ID NO: 2094212 - RNA, 19 nt, Staphylococcus aureus subsp. aureus MW2
aauaaaggucuauauauau

SEQ ID NO: 2094213 - RNA, 24 nt, Staphylococcus aureus subsp. aureus MW2
aauaaaggucuauauauauuuaaa

SEQ ID NO: 2094214 - RNA, 17 nt, Staphylococcus aureus subsp. aureus MW2
aauaaaguccaauacaa

SEQ ID NO: 2094215 - RNA, 17 nt, Staphylococcus aureus subsp. aureus MW2
aauaaagauuauaucuu

SEQ ID NO: 2094216 - RNA, 18 nt, Staphylococcus aureus subsp. aureus MW2
aauaaagcaguguugcau

SEQ ID NO: 2094217 - RNA, 19 nt, Staphylococcus aureus subsp. aureus MW2
aauacaauuucuucauuuu

SEQ ID NO: 2094218 - RNA, 22 nt, Staphylococcus aureus subsp. aureus MW2
aauacaauuuagguuaauuaaa

SEQ ID NO: 2094219 - RNA, 14 nt, Staphylococcus aureus subsp. aureus MW2
aauacaauuuuagc

SEQ ID NO: 2094220 - RNA, 15 nt, Staphylococcus aureus subsp. aureus MW2
aauacaauuuuagca

SEQ ID NO: 2094221 - RNA, 21 nt, Staphylococcus aureus subsp. aureus MW2
aauacacgaucaguugaguca

SEQ ID NO: 2094222 - RNA, 16 nt, Staphylococcus aureus subsp. aureus MW2
aauacaagucuuuacu

SEQ ID NO: 2094223 - RNA, 16 nt, Staphylococcus aureus subsp. aureus MW2
aauacaaauauuaagu

SEQ ID NO: 2094224 - RNA, 19 nt, Staphylococcus aureus subsp. aureus MW2
aauacacuugcuaaaacua

SEQ ID NO: 2094225 - RNA, 11 nt, Staphylococcus aureus subsp. aureus MW2
aauacagauga

SEQ ID NO: 2094226 - RNA, 18 nt, Staphylococcus aureus subsp. aureus MW2
aauacaguuguaccaaug

SEQ ID NO: 2094227 - RNA, 19 nt, Staphylococcus aureus subsp. aureus MW2
aauacagcuagcaagaaua

SEQ ID NO: 2094228 - RNA, 21 nt, Staphylococcus aureus subsp. aureus MW2
aauacauacugauuaaacugu

SEQ ID NO: 2094229 - RNA, 18 nt, Staphylococcus aureus subsp. aureus MW2
aauacauagguucaucuu

SEQ ID NO: 2094230 - RNA, 16 nt, Staphylococcus aureus subsp. aureus MW2
aauacauacugauuaa

SEQ ID NO: 2094231 - RNA, 16 nt, Staphylococcus aureus subsp. aureus MW2
aauacauccauacuuc

SEQ ID NO: 2094232 - RNA, 14 nt, Staphylococcus aureus subsp. aureus MW2
aauacaucaucaag

SEQ ID NO: 2094233 - RNA, 18 nt, Staphylococcus aureus subsp. aureus MW2
aauacaucuaauaaauau

SEQ ID NO: 2094234 - RNA, 17 nt, Staphylococcus aureus subsp. aureus MW2
aauacauuaauauaaau

SEQ ID NO: 2094235 - RNA, 17 nt, Staphylococcus aureus subsp. aureus MW2
aauacauuucaaaaaaa

SEQ ID NO: 2094236 - RNA, 16 nt, Staphylococcus aureus subsp. aureus MW2
aauacauuucaaaaaa

SEQ ID NO: 2094237 - RNA, 22 nt, Staphylococcus aureus subsp. aureus MW2
aauacuaccguuuuuauauacu

SEQ ID NO: 2094238 - RNA, 14 nt, Staphylococcus aureus subsp. aureus MW2
aauacuaagauuag

SEQ ID NO: 2094239 - RNA, 13 nt, Staphylococcus aureus subsp. aureus MW2
aauacuaagauua

SEQ ID NO: 2094240 - RNA, 14 nt, Staphylococcus aureus subsp. aureus MW2
aauacuaauaacuc

SEQ ID NO: 2094241 - RNA, 18 nt, Staphylococcus aureus subsp. aureus MW2
aauacuaaucaaagaaaa

SEQ ID NO: 2094242 - RNA, 19 nt, Staphylococcus aureus subsp. aureus MW2
aauacuauacugaugaaaa

SEQ ID NO: 2094243 - RNA, 14 nt, Staphylococcus aureus subsp. aureus MW2
aauacuauaguaag

SEQ ID NO: 2094244 - RNA, 14 nt, Staphylococcus aureus subsp. aureus MW2
aauacuauauauaa

SEQ ID NO: 2094245 - RNA, 18 nt, Staphylococcus aureus subsp. aureus MW2
aauacuauacugaugaaa

SEQ ID NO: 2094246 - RNA, 22 nt, Staphylococcus aureus subsp. aureus MW2
aauacucauguaacguaaaaau

SEQ ID NO: 2094247 - RNA, 16 nt, Staphylococcus aureus subsp. aureus MW2
aauacucccuucaaca

SEQ ID NO: 2094248 - RNA, 14 nt, Staphylococcus aureus subsp. aureus MW2
aauacuguuuucau

SEQ ID NO: 2094249 - RNA, 21 nt, Staphylococcus aureus subsp. aureus MW2
aauacuguuuucauuuguuaa

SEQ ID NO: 2094250 - RNA, 20 nt, Staphylococcus aureus subsp. aureus MW2
aauacuucuaacgcaacuga

SEQ ID NO: 2094251 - RNA, 15 nt, Staphylococcus aureus subsp. aureus MW2
aauacuugaauguaa

SEQ ID NO: 2094252 - RNA, 21 nt, Staphylococcus aureus subsp. aureus MW2
aauacuugaauguaagaaguc

SEQ ID NO: 2094253 - RNA, 19 nt, Staphylococcus aureus subsp. aureus MW2
aauacuucuuguucgauaa

SEQ ID NO: 2094254 - RNA, 16 nt, Staphylococcus aureus subsp. aureus MW2
aauacuuuauuugaua

SEQ ID NO: 2094255 - RNA, 19 nt, Staphylococcus aureus subsp. aureus MW2
aauagaagguuauuuuuua

SEQ ID NO: 2094256 - RNA, 18 nt, Staphylococcus aureus subsp. aureus MW2
aauagaagaaaagaacau

SEQ ID NO: 2094257 - RNA, 21 nt, Staphylococcus aureus subsp. aureus MW2
aauacgaguguuuuaaucuua

SEQ ID NO: 2094258 - RNA, 16 nt, Staphylococcus aureus subsp. aureus MW2
aauacgauaauaacua

SEQ ID NO: 2094259 - RNA, 13 nt, Staphylococcus aureus subsp. aureus MW2
aauacgaguguug

SEQ ID NO: 2094260 - RNA, 15 nt, Staphylococcus aureus subsp. aureus MW2
aauacgucaucuuua

SEQ ID NO: 2094261 - RNA, 19 nt, Staphylococcus aureus subsp. aureus MW2
aauacguggcucuaaaaac

SEQ ID NO: 2094262 - RNA, 22 nt, Staphylococcus aureus subsp. aureus MW2
aauacguggcucuaaaaacaaa

SEQ ID NO: 2094263 - RNA, 20 nt, Staphylococcus aureus subsp. aureus MW2
aauaccuuugccguauuuca

SEQ ID NO: 2094264 - RNA, 23 nt, Staphylococcus aureus subsp. aureus MW2
aauaccuuugccguauuucaaau

SEQ ID NO: 2094265 - RNA, 13 nt, Staphylococcus aureus subsp. aureus MW2
aauaccuuuuucu

SEQ ID NO: 2094266 - RNA, 19 nt, Staphylococcus aureus subsp. aureus MW2
aauaccauugugaugauaa

SEQ ID NO: 2094267 - RNA, 15 nt, Staphylococcus aureus subsp. aureus MW2
aauagcuauuaaaau

SEQ ID NO: 2094268 - RNA, 17 nt, Staphylococcus aureus subsp. aureus MW2
aauagcuauauuuaaaa

SEQ ID NO: 2094269 - RNA, 18 nt, Staphylococcus aureus subsp. aureus MW2
aauagagguauaauuaaa

SEQ ID NO: 2094270 - RNA, 20 nt, Staphylococcus aureus subsp. aureus MW2
aauagacugccaauaaaaug

SEQ ID NO: 2094271 - RNA, 19 nt, Staphylococcus aureus subsp. aureus MW2
aauagacugccaauaaaau

SEQ ID NO: 2094272 - RNA, 16 nt, Staphylococcus aureus subsp. aureus MW2
aauagacauuguuaaa

SEQ ID NO: 2094273 - RNA, 17 nt, Staphylococcus aureus subsp. aureus MW2
aauagacaccaaaaaca

SEQ ID NO: 2094274 - RNA, 18 nt, Staphylococcus aureus subsp. aureus MW2
aauagagaaacguaagac

SEQ ID NO: 2094275 - RNA, 22 nt, Staphylococcus aureus subsp. aureus MW2
aauagacugccaauaaaaugca

SEQ ID NO: 2094276 - RNA, 15 nt, Staphylococcus aureus subsp. aureus MW2
aauagagaaaaaaua

SEQ ID NO: 2094277 - RNA, 18 nt, Staphylococcus aureus subsp. aureus MW2
aauagucaauuaaugaua

SEQ ID NO: 2094278 - RNA, 18 nt, Staphylococcus aureus subsp. aureus MW2
aauaguaaagugaaauaa

SEQ ID NO: 2094279 - RNA, 12 nt, Staphylococcus aureus subsp. aureus MW2
aauaguaaugau

SEQ ID NO: 2094280 - RNA, 21 nt, Staphylococcus aureus subsp. aureus MW2
aauaguucuuuaaauuauaua

SEQ ID NO: 2094281 - RNA, 13 nt, Staphylococcus aureus subsp. aureus MW2
aauaguucuuuaa

SEQ ID NO: 2094282 - RNA, 15 nt, Staphylococcus aureus subsp. aureus MW2
aauaguuucaaugcc

SEQ ID NO: 2094283 - RNA, 15 nt, Staphylococcus aureus subsp. aureus MW2
aauaguuuauaauuu

SEQ ID NO: 2094284 - RNA, 17 nt, Staphylococcus aureus subsp. aureus MW2
aauaguuuuauaagaag

SEQ ID NO: 2094285 - RNA, 12 nt, Staphylococcus aureus subsp. aureus MW2
aauagcugcaau

SEQ ID NO: 2094286 - RNA, 13 nt, Staphylococcus aureus subsp. aureus MW2
aauaggaauacca

SEQ ID NO: 2094287 - RNA, 18 nt, Staphylococcus aureus subsp. aureus MW2
aauaggauaugcuaaaca

SEQ ID NO: 2094288 - RNA, 14 nt, Staphylococcus aureus subsp. aureus MW2
aauaguaaagugaa

SEQ ID NO: 2094289 - RNA, 18 nt, Staphylococcus aureus subsp. aureus MW2
aauaguaacgucugguuu

SEQ ID NO: 2094290 - RNA, 17 nt, Staphylococcus aureus subsp. aureus MW2
aauaguaaagugaaaua

SEQ ID NO: 2094291 - RNA, 16 nt, Staphylococcus aureus subsp. aureus MW2
aauaucuaaacaauuc

SEQ ID NO: 2094292 - RNA, 13 nt, Staphylococcus aureus subsp. aureus MW2
aauaucuugucau

SEQ ID NO: 2094293 - RNA, 14 nt, Staphylococcus aureus subsp. aureus MW2
aauaucuuacugcu

SEQ ID NO: 2094294 - RNA, 22 nt, Staphylococcus aureus subsp. aureus MW2
aauaugaacaaaaauaaaaacu

SEQ ID NO: 2094295 - RNA, 13 nt, Staphylococcus aureus subsp. aureus MW2
aauaugaacaaaa

SEQ ID NO: 2094296 - RNA, 14 nt, Staphylococcus aureus subsp. aureus MW2
aauaugaaaagaga

SEQ ID NO: 2094297 - RNA, 15 nt, Staphylococcus aureus subsp. aureus MW2
aauaugaaaagagau

SEQ ID NO: 2094298 - RNA, 22 nt, Staphylococcus aureus subsp. aureus MW2
aauaucuugucauggcaagauu

SEQ ID NO: 2094299 - RNA, 18 nt, Staphylococcus aureus subsp. aureus MW2
aauaucuuuuaauguuuu

SEQ ID NO: 2094300 - RNA, 20 nt, Staphylococcus aureus subsp. aureus MW2
aauaucuuuuaauguuuuag

SEQ ID NO: 2094301 - RNA, 18 nt, Staphylococcus aureus subsp. aureus MW2
aauaucaaaauauaaaau

SEQ ID NO: 2094302 - RNA, 14 nt, Staphylococcus aureus subsp. aureus MW2
aauaucgacaaauu

SEQ ID NO: 2094303 - RNA, 22 nt, Staphylococcus aureus subsp. aureus MW2
aauaucgacaaauuaaaaaaca

SEQ ID NO: 2094304 - RNA, 12 nt, Staphylococcus aureus subsp. aureus MW2
aauauaaaauaa

SEQ ID NO: 2094305 - RNA, 13 nt, Staphylococcus aureus subsp. aureus MW2
aauauaaacuauu

SEQ ID NO: 2094306 - RNA, 16 nt, Staphylococcus aureus subsp. aureus MW2
aauauaaacuauuaaa

SEQ ID NO: 2094307 - RNA, 19 nt, Staphylococcus aureus subsp. aureus MW2
aauauaaaacgauaagaau

SEQ ID NO: 2094308 - RNA, 17 nt, Staphylococcus aureus subsp. aureus MW2
aauauaacaucaaauag

SEQ ID NO: 2094309 - RNA, 18 nt, Staphylococcus aureus subsp. aureus MW2
aauauaacaucaaauaga

SEQ ID NO: 2094310 - RNA, 22 nt, Staphylococcus aureus subsp. aureus MW2
aauauauucggcaaaagauguu

SEQ ID NO: 2094311 - RNA, 12 nt, Staphylococcus aureus subsp. aureus MW2
aauauauuauaa

SEQ ID NO: 2094312 - RNA, 13 nt, Staphylococcus aureus subsp. aureus MW2
aauauauuauaaa

SEQ ID NO: 2094313 - RNA, 22 nt, Staphylococcus aureus subsp. aureus MW2
aauauauuaacaacuuuauuau

SEQ ID NO: 2094314 - RNA, 19 nt, Staphylococcus aureus subsp. aureus MW2
aauauaagucuauuaugua

SEQ ID NO: 2094315 - RNA, 20 nt, Staphylococcus aureus subsp. aureus MW2
aauauauuaaaaaucaaaau

SEQ ID NO: 2094316 - RNA, 13 nt, Staphylococcus aureus subsp. aureus MW2
aauaucaaaauau

SEQ ID NO: 2094317 - RNA, 13 nt, Staphylococcus aureus subsp. aureus MW2
aauaugacacaua

SEQ ID NO: 2094318 - RNA, 22 nt, Staphylococcus aureus subsp. aureus MW2
aauaugagugaaaguuugaagg

SEQ ID NO: 2094319 - RNA, 18 nt, Staphylococcus aureus subsp. aureus MW2
aauaugauaacucguaau

SEQ ID NO: 2094320 - RNA, 21 nt, Staphylococcus aureus subsp. aureus MW2
aauaugauccuuuaaugcuuu

SEQ ID NO: 2094321 - RNA, 14 nt, Staphylococcus aureus subsp. aureus MW2
aauaugauauuaag

SEQ ID NO: 2094322 - RNA, 17 nt, Staphylococcus aureus subsp. aureus MW2
aauaugauguuaaaaaa

SEQ ID NO: 2094323 - RNA, 18 nt, Staphylococcus aureus subsp. aureus MW2
aauaugauugcaaauuau

SEQ ID NO: 2094324 - RNA, 22 nt, Staphylococcus aureus subsp. aureus MW2
aauaugauugcaaauuaucauu

SEQ ID NO: 2094325 - RNA, 23 nt, Staphylococcus aureus subsp. aureus MW2
aauaugauguuaaaaaauaugua

SEQ ID NO: 2094326 - RNA, 21 nt, Staphylococcus aureus subsp. aureus MW2
aauauuaaauucaucuugcaa

SEQ ID NO: 2094327 - RNA, 12 nt, Staphylococcus aureus subsp. aureus MW2
aauauuauaagu

SEQ ID NO: 2094328 - RNA, 16 nt, Staphylococcus aureus subsp. aureus MW2
aauauuauaaaaagau

SEQ ID NO: 2094329 - RNA, 18 nt, Staphylococcus aureus subsp. aureus MW2
aauauuauaaaaagauau

SEQ ID NO: 2094330 - RNA, 20 nt, Staphylococcus aureus subsp. aureus MW2
aauauuauaaguugcauaua

SEQ ID NO: 2094331 - RNA, 13 nt, Staphylococcus aureus subsp. aureus MW2
aauauuagucauu

SEQ ID NO: 2094332 - RNA, 18 nt, Staphylococcus aureus subsp. aureus MW2
aauauuauucauaauaua

SEQ ID NO: 2094333 - RNA, 18 nt, Staphylococcus aureus subsp. aureus MW2
aauauuaauauaaaauaa

SEQ ID NO: 2094334 - RNA, 15 nt, Staphylococcus aureus subsp. aureus MW2
aauauuaagauguau

SEQ ID NO: 2094335 - RNA, 22 nt, Staphylococcus aureus subsp. aureus MW2
aauauuaagauguauaugaauu

SEQ ID NO: 2094336 - RNA, 18 nt, Staphylococcus aureus subsp. aureus MW2
aauauuaauaaaguguaa

SEQ ID NO: 2094337 - RNA, 14 nt, Staphylococcus aureus subsp. aureus MW2
aauauuaauuuaua

SEQ ID NO: 2094338 - RNA, 16 nt, Staphylococcus aureus subsp. aureus MW2
aauauuuaaauuuuaa

SEQ ID NO: 2094339 - RNA, 17 nt, Staphylococcus aureus subsp. aureus MW2
aauauuuaaauuuuaag

SEQ ID NO: 2094340 - RNA, 13 nt, Staphylococcus aureus subsp. aureus MW2
aauauuuaaaaaa

SEQ ID NO: 2094341 - RNA, 15 nt, Staphylococcus aureus subsp. aureus MW2
aauauuuaaaaaaca

SEQ ID NO: 2094342 - RNA, 16 nt, Staphylococcus aureus subsp. aureus MW2
aauauuuaaaaaacaa

SEQ ID NO: 2094343 - RNA, 17 nt, Staphylococcus aureus subsp. aureus MW2
aauauuuaaaauauuau

SEQ ID NO: 2094344 - RNA, 20 nt, Staphylococcus aureus subsp. aureus MW2
aauauugucuucauuaacau

SEQ ID NO: 2094345 - RNA, 18 nt, Staphylococcus aureus subsp. aureus MW2
aauauuuaaccuuuaaaa

SEQ ID NO: 2094346 - RNA, 15 nt, Staphylococcus aureus subsp. aureus MW2
aauauugguuauaua

SEQ ID NO: 2094347 - RNA, 15 nt, Staphylococcus aureus subsp. aureus MW2
aauauugaugaauaa

SEQ ID NO: 2094348 - RNA, 14 nt, Staphylococcus aureus subsp. aureus MW2
aauauugaugaaua

SEQ ID NO: 2094349 - RNA, 13 nt, Staphylococcus aureus subsp. aureus MW2
aauauugagacua

SEQ ID NO: 2094350 - RNA, 15 nt, Staphylococcus aureus subsp. aureus MW2
aauauugaaagauau

SEQ ID NO: 2094351 - RNA, 16 nt, Staphylococcus aureus subsp. aureus MW2
aauauugaaagauauu

SEQ ID NO: 2094352 - RNA, 20 nt, Staphylococcus aureus subsp. aureus MW2
aaucaaauuagucauccaaa

SEQ ID NO: 2094353 - RNA, 14 nt, Staphylococcus aureus subsp. aureus MW2
aaucaaauacauca

SEQ ID NO: 2094354 - RNA, 17 nt, Staphylococcus aureus subsp. aureus MW2
aaucaaauacaucaauu

SEQ ID NO: 2094355 - RNA, 14 nt, Staphylococcus aureus subsp. aureus MW2
aaucaaauauuuua

SEQ ID NO: 2094356 - RNA, 12 nt, Staphylococcus aureus subsp. aureus MW2
aaucaacaucau

SEQ ID NO: 2094357 - RNA, 17 nt, Staphylococcus aureus subsp. aureus MW2
aaucaacaguuuuauua

SEQ ID NO: 2094358 - RNA, 21 nt, Staphylococcus aureus subsp. aureus MW2
aaucaaagaggcuuuaaaauu

SEQ ID NO: 2094359 - RNA, 12 nt, Staphylococcus aureus subsp. aureus MW2
aaucaaagagua

SEQ ID NO: 2094360 - RNA, 21 nt, Staphylococcus aureus subsp. aureus MW2
aaucaaagaguaaaguuaaaa

SEQ ID NO: 2094361 - RNA, 20 nt, Staphylococcus aureus subsp. aureus MW2
aaucaaagaggcuuuaaaau

SEQ ID NO: 2094362 - RNA, 19 nt, Staphylococcus aureus subsp. aureus MW2
aaucaaagaggcuuuaaaa

SEQ ID NO: 2094363 - RNA, 18 nt, Staphylococcus aureus subsp. aureus MW2
aaucaaaauaaugcaacu

SEQ ID NO: 2094364 - RNA, 20 nt, Staphylococcus aureus subsp. aureus MW2
aauauuugcuaaugcuagua

SEQ ID NO: 2094365 - RNA, 15 nt, Staphylococcus aureus subsp. aureus MW2
aauauuucuuaccau

SEQ ID NO: 2094366 - RNA, 19 nt, Staphylococcus aureus subsp. aureus MW2
aauauuuauauuaaauacu

SEQ ID NO: 2094367 - RNA, 17 nt, Staphylococcus aureus subsp. aureus MW2
aauauuuauauuaaaua

SEQ ID NO: 2094368 - RNA, 16 nt, Staphylococcus aureus subsp. aureus MW2
aauauuuauagcauca

SEQ ID NO: 2094369 - RNA, 15 nt, Staphylococcus aureus subsp. aureus MW2
aauauuuauauuaaa

SEQ ID NO: 2094370 - RNA, 21 nt, Staphylococcus aureus subsp. aureus MW2
aauauuuauuguuuuuaaaau

SEQ ID NO: 2094371 - RNA, 14 nt, Staphylococcus aureus subsp. aureus MW2
aauauuuauuuuaa

SEQ ID NO: 2094372 - RNA, 19 nt, Staphylococcus aureus subsp. aureus MW2
aauauuuauuguuuuuaaa

SEQ ID NO: 2094373 - RNA, 19 nt, Staphylococcus aureus subsp. aureus MW2
aauauuucccuaugaaaua

SEQ ID NO: 2094374 - RNA, 17 nt, Staphylococcus aureus subsp. aureus MW2
aauauuuuuuaaaauga

SEQ ID NO: 2094375 - RNA, 16 nt, Staphylococcus aureus subsp. aureus MW2
aauauuuuuuaaugaa

SEQ ID NO: 2094376 - RNA, 16 nt, Staphylococcus aureus subsp. aureus MW2
aauauuuuuuaaaaug

SEQ ID NO: 2094377 - RNA, 15 nt, Staphylococcus aureus subsp. aureus MW2
aaucaaaaaagacau

SEQ ID NO: 2094378 - RNA, 15 nt, Staphylococcus aureus subsp. aureus MW2
aauauuuuuugauau

SEQ ID NO: 2094379 - RNA, 15 nt, Staphylococcus aureus subsp. aureus MW2
aauauuuuauuauaa

SEQ ID NO: 2094380 - RNA, 22 nt, Staphylococcus aureus subsp. aureus MW2
aauauuuucauguccaucuuuu

SEQ ID NO: 2094381 - RNA, 17 nt, Staphylococcus aureus subsp. aureus MW2
aauauuuuacaaaauau

SEQ ID NO: 2094382 - RNA, 18 nt, Staphylococcus aureus subsp. aureus MW2
aaucaccuuuuuuaacuu

SEQ ID NO: 2094383 - RNA, 21 nt, Staphylococcus aureus subsp. aureus MW2
aaucacuccucuauuuuauga

SEQ ID NO: 2094384 - RNA, 20 nt, Staphylococcus aureus subsp. aureus MW2
aaucacuauuuguuguuaua

SEQ ID NO: 2094385 - RNA, 16 nt, Staphylococcus aureus subsp. aureus MW2
aaucagaugauuuaau

SEQ ID NO: 2094386 - RNA, 21 nt, Staphylococcus aureus subsp. aureus MW2
aaucacuuggcgacauuugua

SEQ ID NO: 2094387 - RNA, 20 nt, Staphylococcus aureus subsp. aureus MW2
aaucagugaaauaucaagau

SEQ ID NO: 2094388 - RNA, 16 nt, Staphylococcus aureus subsp. aureus MW2
aaucagcuauaaaagu

SEQ ID NO: 2094389 - RNA, 14 nt, Staphylococcus aureus subsp. aureus MW2
aaucaucacacaua

SEQ ID NO: 2094390 - RNA, 15 nt, Staphylococcus aureus subsp. aureus MW2
aaucaagaaauguua

SEQ ID NO: 2094391 - RNA, 15 nt, Staphylococcus aureus subsp. aureus MW2
aaucaacuuuaauca

SEQ ID NO: 2094392 - RNA, 19 nt, Staphylococcus aureus subsp. aureus MW2
aaucaacguauauaaguua

SEQ ID NO: 2094393 - RNA, 15 nt, Staphylococcus aureus subsp. aureus MW2
aaucaacuuagaauu

SEQ ID NO: 2094394 - RNA, 17 nt, Staphylococcus aureus subsp. aureus MW2
aaucaagaauauaaaug

SEQ ID NO: 2094395 - RNA, 20 nt, Staphylococcus aureus subsp. aureus MW2
aaucaagaauauaaaugauu

SEQ ID NO: 2094396 - RNA, 16 nt, Staphylococcus aureus subsp. aureus MW2
aaucaagcuagcauca

SEQ ID NO: 2094397 - RNA, 18 nt, Staphylococcus aureus subsp. aureus MW2
aaucaagucugcauuaau

SEQ ID NO: 2094398 - RNA, 13 nt, Staphylococcus aureus subsp. aureus MW2
aaucaauuauuga

SEQ ID NO: 2094399 - RNA, 18 nt, Staphylococcus aureus subsp. aureus MW2
aaucaauugcauacguaa

SEQ ID NO: 2094400 - RNA, 22 nt, Staphylococcus aureus subsp. aureus MW2
aaucaauaguuuauaauuuaau

SEQ ID NO: 2094401 - RNA, 18 nt, Staphylococcus aureus subsp. aureus MW2
aaucaccucaauaugagu

SEQ ID NO: 2094402 - RNA, 15 nt, Staphylococcus aureus subsp. aureus MW2
aaucacaguuauaua

SEQ ID NO: 2094403 - RNA, 20 nt, Staphylococcus aureus subsp. aureus MW2
aaucacaguuauauauuacu

SEQ ID NO: 2094404 - RNA, 20 nt, Staphylococcus aureus subsp. aureus MW2
aaucugcaacgauuuuaaaa

SEQ ID NO: 2094405 - RNA, 21 nt, Staphylococcus aureus subsp. aureus MW2
aaucuugaugauauucauaua

SEQ ID NO: 2094406 - RNA, 22 nt, Staphylococcus aureus subsp. aureus MW2
aaucuucaagugccauuuuuaa

SEQ ID NO: 2094407 - RNA, 17 nt, Staphylococcus aureus subsp. aureus MW2
aaucuucaucuaaaaag

SEQ ID NO: 2094408 - RNA, 17 nt, Staphylococcus aureus subsp. aureus MW2
aaucuucauuaauuaca

SEQ ID NO: 2094409 - RNA, 21 nt, Staphylococcus aureus subsp. aureus MW2
aaucuuuacuuguaauuaaua

SEQ ID NO: 2094410 - RNA, 19 nt, Staphylococcus aureus subsp. aureus MW2
aaucuuguugaacucugau

SEQ ID NO: 2094411 - RNA, 20 nt, Staphylococcus aureus subsp. aureus MW2
aaucuugauuauauuuuucu

SEQ ID NO: 2094412 - RNA, 17 nt, Staphylococcus aureus subsp. aureus MW2
aaucuuggugauagucu

SEQ ID NO: 2094413 - RNA, 22 nt, Staphylococcus aureus subsp. aureus MW2
aaucuuguuggauuuuaacaag

SEQ ID NO: 2094414 - RNA, 15 nt, Staphylococcus aureus subsp. aureus MW2
aaucuuuaucaguuu

SEQ ID NO: 2094415 - RNA, 14 nt, Staphylococcus aureus subsp. aureus MW2
aaucuuuauuaaua

SEQ ID NO: 2094416 - RNA, 20 nt, Staphylococcus aureus subsp. aureus MW2
aaugaaccagcuaaccaaau

SEQ ID NO: 2094417 - RNA, 12 nt, Staphylococcus aureus subsp. aureus MW2
aaugaagaauac

SEQ ID NO: 2094418 - RNA, 19 nt, Staphylococcus aureus subsp. aureus MW2
aaugaagaauacaaauauu

SEQ ID NO: 2094419 - RNA, 15 nt, Staphylococcus aureus subsp. aureus MW2
aaugaagaauacaaa

SEQ ID NO: 2094420 - RNA, 21 nt, Staphylococcus aureus subsp. aureus MW2
aaugaagcauuuuauuuuuaa

SEQ ID NO: 2094421 - RNA, 21 nt, Staphylococcus aureus subsp. aureus MW2
aaugaagucuuucaacaaaau

SEQ ID NO: 2094422 - RNA, 18 nt, Staphylococcus aureus subsp. aureus MW2
aaugaaguaauauauaaa

SEQ ID NO: 2094423 - RNA, 21 nt, Staphylococcus aureus subsp. aureus MW2
aaugaaguaauauauaaaagu

SEQ ID NO: 2094424 - RNA, 20 nt, Staphylococcus aureus subsp. aureus MW2
aaugaaguaggcugaaguug

SEQ ID NO: 2094425 - RNA, 24 nt, Staphylococcus aureus subsp. aureus MW2
aaugaaguaggcugaaguugaagc

SEQ ID NO: 2094426 - RNA, 12 nt, Staphylococcus aureus subsp. aureus MW2
aaugaauugcuu

SEQ ID NO: 2094427 - RNA, 15 nt, Staphylococcus aureus subsp. aureus MW2
aaugauagcuaaaca

SEQ ID NO: 2094428 - RNA, 20 nt, Staphylococcus aureus subsp. aureus MW2
aaugauagcuaaacauuuua

SEQ ID NO: 2094429 - RNA, 19 nt, Staphylococcus aureus subsp. aureus MW2
aaugauacgccuaaauauu

SEQ ID NO: 2094430 - RNA, 13 nt, Staphylococcus aureus subsp. aureus MW2
aaugauuaaaaau

SEQ ID NO: 2094431 - RNA, 23 nt, Staphylococcus aureus subsp. aureus MW2
aaugauucuuaucuuuaaucaaa

SEQ ID NO: 2094432 - RNA, 21 nt, Staphylococcus aureus subsp. aureus MW2
aaugauucuuaucuuuaauca

SEQ ID NO: 2094433 - RNA, 19 nt, Staphylococcus aureus subsp. aureus MW2
aaugauuaaaaaucaaaga

SEQ ID NO: 2094434 - RNA, 21 nt, Staphylococcus aureus subsp. aureus MW2
aaugauuacuuuaagauuauu

SEQ ID NO: 2094435 - RNA, 15 nt, Staphylococcus aureus subsp. aureus MW2
aaugauugcauugau

SEQ ID NO: 2094436 - RNA, 17 nt, Staphylococcus aureus subsp. aureus MW2
aaugauugcauugauuu

SEQ ID NO: 2094437 - RNA, 21 nt, Staphylococcus aureus subsp. aureus MW2
aaugcaaguuggcggggcccc

SEQ ID NO: 2094438 - RNA, 15 nt, Staphylococcus aureus subsp. aureus MW2
aaugcaacuugauca

SEQ ID NO: 2094439 - RNA, 16 nt, Staphylococcus aureus subsp. aureus MW2
aaugauaauccaccaa

SEQ ID NO: 2094440 - RNA, 23 nt, Staphylococcus aureus subsp. aureus MW2
aaugagaaugcgcuuguaacaag

SEQ ID NO: 2094441 - RNA, 23 nt, Staphylococcus aureus subsp. aureus MW2
aaugacuauaacaccaauuaaau

SEQ ID NO: 2094442 - RNA, 14 nt, Staphylococcus aureus subsp. aureus MW2
aaugacugaauuaa

SEQ ID NO: 2094443 - RNA, 17 nt, Staphylococcus aureus subsp. aureus MW2
aaugacuauaacaccaa

SEQ ID NO: 2094444 - RNA, 16 nt, Staphylococcus aureus subsp. aureus MW2
aaugacugagaaaaau

SEQ ID NO: 2094445 - RNA, 20 nt, Staphylococcus aureus subsp. aureus MW2
aaugacuucuuuauauuuau

SEQ ID NO: 2094446 - RNA, 19 nt, Staphylococcus aureus subsp. aureus MW2
aaugacuucuuuauauuua

SEQ ID NO: 2094447 - RNA, 20 nt, Staphylococcus aureus subsp. aureus MW2
aaugaccauugucaugccuu

SEQ ID NO: 2094448 - RNA, 15 nt, Staphylococcus aureus subsp. aureus MW2
aaugaccauugucau

SEQ ID NO: 2094449 - RNA, 18 nt, Staphylococcus aureus subsp. aureus MW2
aaugacuaugcaaaugaa

SEQ ID NO: 2094450 - RNA, 20 nt, Staphylococcus aureus subsp. aureus MW2
aaucucauucuuuaauauaa

SEQ ID NO: 2094451 - RNA, 15 nt, Staphylococcus aureus subsp. aureus MW2
aaucucaugccaaaa

SEQ ID NO: 2094452 - RNA, 17 nt, Staphylococcus aureus subsp. aureus MW2
aaucucaugccaaaaac

SEQ ID NO: 2094453 - RNA, 13 nt, Staphylococcus aureus subsp. aureus MW2
aaucucaucuaac

SEQ ID NO: 2094454 - RNA, 17 nt, Staphylococcus aureus subsp. aureus MW2
aaucuccauuagaacua

SEQ ID NO: 2094455 - RNA, 12 nt, Staphylococcus aureus subsp. aureus MW2
aaucucaaaauu

SEQ ID NO: 2094456 - RNA, 16 nt, Staphylococcus aureus subsp. aureus MW2
aaucucauaauaauuc

SEQ ID NO: 2094457 - RNA, 19 nt, Staphylococcus aureus subsp. aureus MW2
aaucguuguggcuuuuuau

SEQ ID NO: 2094458 - RNA, 14 nt, Staphylococcus aureus subsp. aureus MW2
aaucuaaauguaaa

SEQ ID NO: 2094459 - RNA, 15 nt, Staphylococcus aureus subsp. aureus MW2
aaucuaaauguaaaa

SEQ ID NO: 2094460 - RNA, 19 nt, Staphylococcus aureus subsp. aureus MW2
aaucuaaauguaaaaucau

SEQ ID NO: 2094461 - RNA, 21 nt, Staphylococcus aureus subsp. aureus MW2
aaucuaauacuuucaaacaaa

SEQ ID NO: 2094462 - RNA, 16 nt, Staphylococcus aureus subsp. aureus MW2
aaucugauucauuaaa

SEQ ID NO: 2094463 - RNA, 15 nt, Staphylococcus aureus subsp. aureus MW2
aaucuccgguuuaau

SEQ ID NO: 2094464 - RNA, 17 nt, Staphylococcus aureus subsp. aureus MW2
aaucgaguuugaaauaa

SEQ ID NO: 2094465 - RNA, 15 nt, Staphylococcus aureus subsp. aureus MW2
aaucgaguuugaaau

SEQ ID NO: 2094466 - RNA, 13 nt, Staphylococcus aureus subsp. aureus MW2
aaucgaaauuucc

SEQ ID NO: 2094467 - RNA, 12 nt, Staphylococcus aureus subsp. aureus MW2
aaucgaaaauau

SEQ ID NO: 2094468 - RNA, 19 nt, Staphylococcus aureus subsp. aureus MW2
aaucaucgaacaugaauga

SEQ ID NO: 2094469 - RNA, 18 nt, Staphylococcus aureus subsp. aureus MW2
aaucggcuauacauugau

SEQ ID NO: 2094470 - RNA, 18 nt, Staphylococcus aureus subsp. aureus MW2
aaucgugcccauaugauu

SEQ ID NO: 2094471 - RNA, 23 nt, Staphylococcus aureus subsp. aureus MW2
aaucggacugauagaaaaaguuu

SEQ ID NO: 2094472 - RNA, 19 nt, Staphylococcus aureus subsp. aureus MW2
aaucggacagaugagcuca

SEQ ID NO: 2094473 - RNA, 18 nt, Staphylococcus aureus subsp. aureus MW2
aaucggaauaaaauaaau

SEQ ID NO: 2094474 - RNA, 20 nt, Staphylococcus aureus subsp. aureus MW2
aaucgauauaaugaaguuau

SEQ ID NO: 2094475 - RNA, 15 nt, Staphylococcus aureus subsp. aureus MW2
aaucgauauaaugaa

SEQ ID NO: 2094476 - RNA, 17 nt, Staphylococcus aureus subsp. aureus MW2
aauuaaagauuaaaaua

SEQ ID NO: 2094477 - RNA, 20 nt, Staphylococcus aureus subsp. aureus MW2
aauuaaagucaauuuaaaua

SEQ ID NO: 2094478 - RNA, 13 nt, Staphylococcus aureus subsp. aureus MW2
aauuaaagugaau

SEQ ID NO: 2094479 - RNA, 14 nt, Staphylococcus aureus subsp. aureus MW2
aauuaaacaaaacu

SEQ ID NO: 2094480 - RNA, 11 nt, Staphylococcus aureus subsp. aureus MW2
aauuaaacugu

SEQ ID NO: 2094481 - RNA, 14 nt, Staphylococcus aureus subsp. aureus MW2
aauuaaaguuaaag

SEQ ID NO: 2094482 - RNA, 15 nt, Staphylococcus aureus subsp. aureus MW2
aauuaaauaaugaua

SEQ ID NO: 2094483 - RNA, 12 nt, Staphylococcus aureus subsp. aureus MW2
aauuaaaauaac

SEQ ID NO: 2094484 - RNA, 20 nt, Staphylococcus aureus subsp. aureus MW2
aauuaaaauaagauauauaa

SEQ ID NO: 2094485 - RNA, 15 nt, Staphylococcus aureus subsp. aureus MW2
aauuaaaauuuguua

SEQ ID NO: 2094486 - RNA, 13 nt, Staphylococcus aureus subsp. aureus MW2
aauuaaaauguua

SEQ ID NO: 2094487 - RNA, 21 nt, Staphylococcus aureus subsp. aureus MW2
aauuaaacaagccuuaaaaua

SEQ ID NO: 2094488 - RNA, 23 nt, Staphylococcus aureus subsp. aureus MW2
aauuaaacaagccuuaaaauauu

SEQ ID NO: 2094489 - RNA, 13 nt, Staphylococcus aureus subsp. aureus MW2
aauuaaacaaguu

SEQ ID NO: 2094490 - RNA, 22 nt, Staphylococcus aureus subsp. aureus MW2
aauuaacuuaaaauuuaaauau

SEQ ID NO: 2094491 - RNA, 13 nt, Staphylococcus aureus subsp. aureus MW2
aauuaaauguuua

SEQ ID NO: 2094492 - RNA, 20 nt, Staphylococcus aureus subsp. aureus MW2
aauuaacuagugccucuuuu

SEQ ID NO: 2094493 - RNA, 14 nt, Staphylococcus aureus subsp. aureus MW2
aauuaacuugauau

SEQ ID NO: 2094494 - RNA, 16 nt, Staphylococcus aureus subsp. aureus MW2
aauuaacuaguguaau

SEQ ID NO: 2094495 - RNA, 12 nt, Staphylococcus aureus subsp. aureus MW2
aauuaauaaaaa

SEQ ID NO: 2094496 - RNA, 13 nt, Staphylococcus aureus subsp. aureus MW2
aauuaagaugaaa

SEQ ID NO: 2094497 - RNA, 14 nt, Staphylococcus aureus subsp. aureus MW2
aauuaagaugaaau

SEQ ID NO: 2094498 - RNA, 18 nt, Staphylococcus aureus subsp. aureus MW2
aauuacuuucauuguaaa

SEQ ID NO: 2094499 - RNA, 20 nt, Staphylococcus aureus subsp. aureus MW2
aauuacuugaauauuauuca

SEQ ID NO: 2094500 - RNA, 21 nt, Staphylococcus aureus subsp. aureus MW2
aauuacuugcacaccagugcc

SEQ ID NO: 2094501 - RNA, 14 nt, Staphylococcus aureus subsp. aureus MW2
aauuacgacaagaa

SEQ ID NO: 2094502 - RNA, 15 nt, Staphylococcus aureus subsp. aureus MW2
aauuacgcaaagaaa

SEQ ID NO: 2094503 - RNA, 16 nt, Staphylococcus aureus subsp. aureus MW2
aauuacgacaagaauu

SEQ ID NO: 2094504 - RNA, 13 nt, Staphylococcus aureus subsp. aureus MW2
aauuacuuauuca

SEQ ID NO: 2094505 - RNA, 19 nt, Staphylococcus aureus subsp. aureus MW2
aauuaauagagacauuuua

SEQ ID NO: 2094506 - RNA, 17 nt, Staphylococcus aureus subsp. aureus MW2
aauuaauacaucaauau

SEQ ID NO: 2094507 - RNA, 16 nt, Staphylococcus aureus subsp. aureus MW2
aauuaaucaauuuaau

SEQ ID NO: 2094508 - RNA, 13 nt, Staphylococcus aureus subsp. aureus MW2
aauuaaugauaaa

SEQ ID NO: 2094509 - RNA, 23 nt, Staphylococcus aureus subsp. aureus MW2
aauuacauauacgacauuuuuag

SEQ ID NO: 2094510 - RNA, 22 nt, Staphylococcus aureus subsp. aureus MW2
aauuaccaaugaauaaauugau

SEQ ID NO: 2094511 - RNA, 12 nt, Staphylococcus aureus subsp. aureus MW2
aauuaauguaau

SEQ ID NO: 2094512 - RNA, 18 nt, Staphylococcus aureus subsp. aureus MW2
aauguuuuugauaguaau

SEQ ID NO: 2094513 - RNA, 14 nt, Staphylococcus aureus subsp. aureus MW2
aauuaaaaaaugcu

SEQ ID NO: 2094514 - RNA, 23 nt, Staphylococcus aureus subsp. aureus MW2
aauguuuucagccacugucaugu

SEQ ID NO: 2094515 - RNA, 22 nt, Staphylococcus aureus subsp. aureus MW2
aauuaaaacagcaaauaaaauc

SEQ ID NO: 2094516 - RNA, 12 nt, Staphylococcus aureus subsp. aureus MW2
aauuaaaagccc

SEQ ID NO: 2094517 - RNA, 14 nt, Staphylococcus aureus subsp. aureus MW2
aauuaaaacuauaa

SEQ ID NO: 2094518 - RNA, 20 nt, Staphylococcus aureus subsp. aureus MW2
aauuaaaacuuucagagaua

SEQ ID NO: 2094519 - RNA, 13 nt, Staphylococcus aureus subsp. aureus MW2
aauuaaaaauuuc

SEQ ID NO: 2094520 - RNA, 17 nt, Staphylococcus aureus subsp. aureus MW2
aauuaaaacagcaaaua

SEQ ID NO: 2094521 - RNA, 22 nt, Staphylococcus aureus subsp. aureus MW2
aauguuuauaauaauauugaaa

SEQ ID NO: 2094522 - RNA, 14 nt, Staphylococcus aureus subsp. aureus MW2
aauguuucagaacu

SEQ ID NO: 2094523 - RNA, 16 nt, Staphylococcus aureus subsp. aureus MW2
aauguuucaugaccaa

SEQ ID NO: 2094524 - RNA, 19 nt, Staphylococcus aureus subsp. aureus MW2
aauguuucaugaccaacag

SEQ ID NO: 2094525 - RNA, 18 nt, Staphylococcus aureus subsp. aureus MW2
aauguuugcuuuuuguaa

SEQ ID NO: 2094526 - RNA, 19 nt, Staphylococcus aureus subsp. aureus MW2
aauguuucuucaauugucu

SEQ ID NO: 2094527 - RNA, 11 nt, Staphylococcus aureus subsp. aureus MW2
aauguugaaug

SEQ ID NO: 2094528 - RNA, 21 nt, Staphylococcus aureus subsp. aureus MW2
aauguugucguuucuagcaac

SEQ ID NO: 2094529 - RNA, 18 nt, Staphylococcus aureus subsp. aureus MW2
aaugugauuuucuuucau

SEQ ID NO: 2094530 - RNA, 18 nt, Staphylococcus aureus subsp. aureus MW2
aaugugcaaguuggggug

SEQ ID NO: 2094531 - RNA, 15 nt, Staphylococcus aureus subsp. aureus MW2
aaugugcauugcuuu

SEQ ID NO: 2094532 - RNA, 19 nt, Staphylococcus aureus subsp. aureus MW2
aaugugcauugcuuuuguu

SEQ ID NO: 2094533 - RNA, 15 nt, Staphylococcus aureus subsp. aureus MW2
aaugugccuuuuguu

SEQ ID NO: 2094534 - RNA, 21 nt, Staphylococcus aureus subsp. aureus MW2
aaugugccuuuuguuacgauu

SEQ ID NO: 2094535 - RNA, 18 nt, Staphylococcus aureus subsp. aureus MW2
aauguguuaauacuucau

SEQ ID NO: 2094536 - RNA, 14 nt, Staphylococcus aureus subsp. aureus MW2
aauguguuaauacu

SEQ ID NO: 2094537 - RNA, 23 nt, Staphylococcus aureus subsp. aureus MW2
aauguguuaaucaacguauauaa

SEQ ID NO: 2094538 - RNA, 15 nt, Staphylococcus aureus subsp. aureus MW2
aauguguaaacuaga

SEQ ID NO: 2094539 - RNA, 17 nt, Staphylococcus aureus subsp. aureus MW2
aauguguaccuuuuuau

SEQ ID NO: 2094540 - RNA, 21 nt, Staphylococcus aureus subsp. aureus MW2
aauguguggauuuaauuuuua

SEQ ID NO: 2094541 - RNA, 15 nt, Staphylococcus aureus subsp. aureus MW2
aauguucaauuuaua

SEQ ID NO: 2094542 - RNA, 16 nt, Staphylococcus aureus subsp. aureus MW2
aauguucccuucaaag

SEQ ID NO: 2094543 - RNA, 14 nt, Staphylococcus aureus subsp. aureus MW2
aauguuauuagaua

SEQ ID NO: 2094544 - RNA, 24 nt, Staphylococcus aureus subsp. aureus MW2
aauguuaucuugcuuauugauaua

SEQ ID NO: 2094545 - RNA, 17 nt, Staphylococcus aureus subsp. aureus MW2
aauguuaaauucuaaaa

SEQ ID NO: 2094546 - RNA, 18 nt, Staphylococcus aureus subsp. aureus MW2
aauguuacacaaauuaaa

SEQ ID NO: 2094547 - RNA, 16 nt, Staphylococcus aureus subsp. aureus MW2
aauguuaaagauuauu

SEQ ID NO: 2094548 - RNA, 12 nt, Staphylococcus aureus subsp. aureus MW2
aauguuagauuu

SEQ ID NO: 2094549 - RNA, 19 nt, Staphylococcus aureus subsp. aureus MW2
aaugcuaguaacuuaucug

SEQ ID NO: 2094550 - RNA, 12 nt, Staphylococcus aureus subsp. aureus MW2
aaugcuaugauu

SEQ ID NO: 2094551 - RNA, 15 nt, Staphylococcus aureus subsp. aureus MW2
aaugcuacaauuucc

SEQ ID NO: 2094552 - RNA, 16 nt, Staphylococcus aureus subsp. aureus MW2
aaugcuaauuuaacug

SEQ ID NO: 2094553 - RNA, 17 nt, Staphylococcus aureus subsp. aureus MW2
aaugcuaaaaguauaaa

SEQ ID NO: 2094554 - RNA, 16 nt, Staphylococcus aureus subsp. aureus MW2
aaugcaccugugauaa

SEQ ID NO: 2094555 - RNA, 20 nt, Staphylococcus aureus subsp. aureus MW2
aaugcacuagcaacaucuuu

SEQ ID NO: 2094556 - RNA, 21 nt, Staphylococcus aureus subsp. aureus MW2
aaugcacuagcaacaucuuuu

SEQ ID NO: 2094557 - RNA, 21 nt, Staphylococcus aureus subsp. aureus MW2
aaugccauuguuauccaaaac

SEQ ID NO: 2094558 - RNA, 21 nt, Staphylococcus aureus subsp. aureus MW2
aauggcaaucuauauaaaugu

SEQ ID NO: 2094559 - RNA, 19 nt, Staphylococcus aureus subsp. aureus MW2
aauggcaaucuauauaaau

SEQ ID NO: 2094560 - RNA, 15 nt, Staphylococcus aureus subsp. aureus MW2
aaugcucuauauauc

SEQ ID NO: 2094561 - RNA, 19 nt, Staphylococcus aureus subsp. aureus MW2
aaugcucuauauauccauu

SEQ ID NO: 2094562 - RNA, 19 nt, Staphylococcus aureus subsp. aureus MW2
aauggauuauuaugccuuu

SEQ ID NO: 2094563 - RNA, 21 nt, Staphylococcus aureus subsp. aureus MW2
aauguaguuaagauaccuuuu

SEQ ID NO: 2094564 - RNA, 13 nt, Staphylococcus aureus subsp. aureus MW2
aauguaucauuuc

SEQ ID NO: 2094565 - RNA, 14 nt, Staphylococcus aureus subsp. aureus MW2
aauguaugacauaa

SEQ ID NO: 2094566 - RNA, 22 nt, Staphylococcus aureus subsp. aureus MW2
aauguauucuucuaauucugaa

SEQ ID NO: 2094567 - RNA, 15 nt, Staphylococcus aureus subsp. aureus MW2
aauguauuaaacauu

SEQ ID NO: 2094568 - RNA, 21 nt, Staphylococcus aureus subsp. aureus MW2
aaugguauugauuauucuuua

SEQ ID NO: 2094569 - RNA, 20 nt, Staphylococcus aureus subsp. aureus MW2
aaugggcgugccauuaaaau

SEQ ID NO: 2094570 - RNA, 14 nt, Staphylococcus aureus subsp. aureus MW2
aaugucguauaugu

SEQ ID NO: 2094571 - RNA, 15 nt, Staphylococcus aureus subsp. aureus MW2
aaugucguauaugua

SEQ ID NO: 2094572 - RNA, 15 nt, Staphylococcus aureus subsp. aureus MW2
aaugucuaaaaaugu

SEQ ID NO: 2094573 - RNA, 15 nt, Staphylococcus aureus subsp. aureus MW2
aaugucuaaaaaaau

SEQ ID NO: 2094574 - RNA, 18 nt, Staphylococcus aureus subsp. aureus MW2
aaugucuaaaaaaauguu

SEQ ID NO: 2094575 - RNA, 15 nt, Staphylococcus aureus subsp. aureus MW2
aaugucuuacuuguc

SEQ ID NO: 2094576 - RNA, 19 nt, Staphylococcus aureus subsp. aureus MW2
aaugucucuuuucacgaau

SEQ ID NO: 2094577 - RNA, 17 nt, Staphylococcus aureus subsp. aureus MW2
aaugugagauauaaagg

SEQ ID NO: 2094578 - RNA, 19 nt, Staphylococcus aureus subsp. aureus MW2
aauguauucagucaguaaa

SEQ ID NO: 2094579 - RNA, 22 nt, Staphylococcus aureus subsp. aureus MW2
aauguauucagucaguaaaaau

SEQ ID NO: 2094580 - RNA, 22 nt, Staphylococcus aureus subsp. aureus MW2
aaugucgaucuaacaauugcag

SEQ ID NO: 2094581 - RNA, 16 nt, Staphylococcus aureus subsp. aureus MW2
aagaccaaauauuuua

SEQ ID NO: 2094582 - RNA, 12 nt, Staphylococcus aureus subsp. aureus MW2
aagacauuuuaa

SEQ ID NO: 2094583 - RNA, 14 nt, Staphylococcus aureus subsp. aureus MW2
aagacauuuuaaca

SEQ ID NO: 2094584 - RNA, 13 nt, Staphylococcus aureus subsp. aureus MW2
aagaccauuuuau

SEQ ID NO: 2094585 - RNA, 19 nt, Staphylococcus aureus subsp. aureus MW2
aagacauacagucaauaca

SEQ ID NO: 2094586 - RNA, 15 nt, Staphylococcus aureus subsp. aureus MW2
aagacaugagauuau

SEQ ID NO: 2094587 - RNA, 12 nt, Staphylococcus aureus subsp. aureus MW2
aagacauaugca

SEQ ID NO: 2094588 - RNA, 21 nt, Staphylococcus aureus subsp. aureus MW2
aagaccauuuuauauuuuagu

SEQ ID NO: 2094589 - RNA, 19 nt, Staphylococcus aureus subsp. aureus MW2
aagaccauuuuauauuuua

SEQ ID NO: 2094590 - RNA, 18 nt, Staphylococcus aureus subsp. aureus MW2
aagaccuucuaaaaucgu

SEQ ID NO: 2094591 - RNA, 12 nt, Staphylococcus aureus subsp. aureus MW2
aagaauuuaaaa

SEQ ID NO: 2094592 - RNA, 16 nt, Staphylococcus aureus subsp. aureus MW2
aagaauuauucaagua

SEQ ID NO: 2094593 - RNA, 19 nt, Staphylococcus aureus subsp. aureus MW2
aagaauuauucaaguaaaa

SEQ ID NO: 2094594 - RNA, 15 nt, Staphylococcus aureus subsp. aureus MW2
aagaauauaacgaau

SEQ ID NO: 2094595 - RNA, 14 nt, Staphylococcus aureus subsp. aureus MW2
aagaauauaaauga

SEQ ID NO: 2094596 - RNA, 19 nt, Staphylococcus aureus subsp. aureus MW2
aagaaugcaccaacaauag

SEQ ID NO: 2094597 - RNA, 16 nt, Staphylococcus aureus subsp. aureus MW2
aagaaugauuuauaaa

SEQ ID NO: 2094598 - RNA, 20 nt, Staphylococcus aureus subsp. aureus MW2
aagaaugccuuuuauuuauc

SEQ ID NO: 2094599 - RNA, 14 nt, Staphylococcus aureus subsp. aureus MW2
aagaauuaaguagu

SEQ ID NO: 2094600 - RNA, 21 nt, Staphylococcus aureus subsp. aureus MW2
aagaauuaauucgccuaaaug

SEQ ID NO: 2094601 - RNA, 18 nt, Staphylococcus aureus subsp. aureus MW2
aaauugaacuuuguaucu

SEQ ID NO: 2094602 - RNA, 16 nt, Staphylococcus aureus subsp. aureus MW2
aaauugaaauguuuau

SEQ ID NO: 2094603 - RNA, 15 nt, Staphylococcus aureus subsp. aureus MW2
aaauugacgcauuaa

SEQ ID NO: 2094604 - RNA, 14 nt, Staphylococcus aureus subsp. aureus MW2
aaauugaaauuauc

SEQ ID NO: 2094605 - RNA, 13 nt, Staphylococcus aureus subsp. aureus MW2
aaauugaaauuau

SEQ ID NO: 2094606 - RNA, 19 nt, Staphylococcus aureus subsp. aureus MW2
aaauucuuuuacagcaaga

SEQ ID NO: 2094607 - RNA, 17 nt, Staphylococcus aureus subsp. aureus MW2
aaauucuuauaaaauaa

SEQ ID NO: 2094608 - RNA, 18 nt, Staphylococcus aureus subsp. aureus MW2
aaauucuuauaaaauaaa

SEQ ID NO: 2094609 - RNA, 12 nt, Staphylococcus aureus subsp. aureus MW2
aaauucuuauaa

SEQ ID NO: 2094610 - RNA, 15 nt, Staphylococcus aureus subsp. aureus MW2
aagaaguuuccaacg

SEQ ID NO: 2094611 - RNA, 14 nt, Staphylococcus aureus subsp. aureus MW2
aagaauaaacaaca

SEQ ID NO: 2094612 - RNA, 17 nt, Staphylococcus aureus subsp. aureus MW2
aagaauacaaauauuaa

SEQ ID NO: 2094613 - RNA, 15 nt, Staphylococcus aureus subsp. aureus MW2
aagaauacaaauauu

SEQ ID NO: 2094614 - RNA, 13 nt, Staphylococcus aureus subsp. aureus MW2
aagagaaaagcua

SEQ ID NO: 2094615 - RNA, 21 nt, Staphylococcus aureus subsp. aureus MW2
aagagauacugguuaguaaaa

SEQ ID NO: 2094616 - RNA, 15 nt, Staphylococcus aureus subsp. aureus MW2
aagagauaagaaaau

SEQ ID NO: 2094617 - RNA, 16 nt, Staphylococcus aureus subsp. aureus MW2
aagacucaauuucauu

SEQ ID NO: 2094618 - RNA, 22 nt, Staphylococcus aureus subsp. aureus MW2
aagacucccuuuuuaaaauacg

SEQ ID NO: 2094619 - RNA, 15 nt, Staphylococcus aureus subsp. aureus MW2
aagacuauaaugaau

SEQ ID NO: 2094620 - RNA, 12 nt, Staphylococcus aureus subsp. aureus MW2
aagacuucccua

SEQ ID NO: 2094621 - RNA, 22 nt, Staphylococcus aureus subsp. aureus MW2
aagacgauuuauuaguuuuuac

SEQ ID NO: 2094622 - RNA, 21 nt, Staphylococcus aureus subsp. aureus MW2
aagaggcgccacaacauguuu

SEQ ID NO: 2094623 - RNA, 22 nt, Staphylococcus aureus subsp. aureus MW2
aagagggaccuuacuacucauu

SEQ ID NO: 2094624 - RNA, 19 nt, Staphylococcus aureus subsp. aureus MW2
aagagguauacaguuaugc

SEQ ID NO: 2094625 - RNA, 19 nt, Staphylococcus aureus subsp. aureus MW2
aagaggucuccaauacuuu

SEQ ID NO: 2094626 - RNA, 22 nt, Staphylococcus aureus subsp. aureus MW2
aagagauuuucuuaauugaaaa

SEQ ID NO: 2094627 - RNA, 17 nt, Staphylococcus aureus subsp. aureus MW2
aagagcaauuaaaguca

SEQ ID NO: 2094628 - RNA, 21 nt, Staphylococcus aureus subsp. aureus MW2
aagauaacuagcaaaugcacu

SEQ ID NO: 2094629 - RNA, 15 nt, Staphylococcus aureus subsp. aureus MW2
aagauaaacaagcca

SEQ ID NO: 2094630 - RNA, 16 nt, Staphylococcus aureus subsp. aureus MW2
aagaguaaaguuaaaa

SEQ ID NO: 2094631 - RNA, 16 nt, Staphylococcus aureus subsp. aureus MW2
aagaguuaauaaaauu

SEQ ID NO: 2094632 - RNA, 13 nt, Staphylococcus aureus subsp. aureus MW2
aagcaaucauaau

SEQ ID NO: 2094633 - RNA, 14 nt, Staphylococcus aureus subsp. aureus MW2
aagcaauacgauug

SEQ ID NO: 2094634 - RNA, 23 nt, Staphylococcus aureus subsp. aureus MW2
aagcaauacgauugcaauggcuu

SEQ ID NO: 2094635 - RNA, 17 nt, Staphylococcus aureus subsp. aureus MW2
aagcaacuguaaaugaa

SEQ ID NO: 2094636 - RNA, 19 nt, Staphylococcus aureus subsp. aureus MW2
aagcaacuguaaaugaaau

SEQ ID NO: 2094637 - RNA, 14 nt, Staphylococcus aureus subsp. aureus MW2
aagcaaaagaugaa

SEQ ID NO: 2094638 - RNA, 15 nt, Staphylococcus aureus subsp. aureus MW2
aagcaauuucguuuu

SEQ ID NO: 2094639 - RNA, 22 nt, Staphylococcus aureus subsp. aureus MW2
aagcaauuucguuuuauuaaug

SEQ ID NO: 2094640 - RNA, 23 nt, Staphylococcus aureus subsp. aureus MW2
aagcacgugguugguuaccaucu

SEQ ID NO: 2094641 - RNA, 19 nt, Staphylococcus aureus subsp. aureus MW2
aagcaccuaaaauagaaaa

SEQ ID NO: 2094642 - RNA, 18 nt, Staphylococcus aureus subsp. aureus MW2
aagcauuaaguucaucau

SEQ ID NO: 2094643 - RNA, 12 nt, Staphylococcus aureus subsp. aureus MW2
aagcauuuaaau

SEQ ID NO: 2094644 - RNA, 17 nt, Staphylococcus aureus subsp. aureus MW2
aagcauaccuacagaau

SEQ ID NO: 2094645 - RNA, 15 nt, Staphylococcus aureus subsp. aureus MW2
aagcauaccuacaga

SEQ ID NO: 2094646 - RNA, 18 nt, Staphylococcus aureus subsp. aureus MW2
aagcauaucuuuaucauu

SEQ ID NO: 2094647 - RNA, 14 nt, Staphylococcus aureus subsp. aureus MW2
aagcauauuucuaa

SEQ ID NO: 2094648 - RNA, 14 nt, Staphylococcus aureus subsp. aureus MW2
aagcaucauauaca

SEQ ID NO: 2094649 - RNA, 22 nt, Staphylococcus aureus subsp. aureus MW2
aagcaucguaaaaaacaaaaaa

SEQ ID NO: 2094650 - RNA, 21 nt, Staphylococcus aureus subsp. aureus MW2
aagcaucuucaauauuuaaau

SEQ ID NO: 2094651 - RNA, 14 nt, Staphylococcus aureus subsp. aureus MW2
aagcagcuugccua

SEQ ID NO: 2094652 - RNA, 13 nt, Staphylococcus aureus subsp. aureus MW2
aagcaguaagaga

SEQ ID NO: 2094653 - RNA, 18 nt, Staphylococcus aureus subsp. aureus MW2
aagcagucugcucuuuuu

SEQ ID NO: 2094654 - RNA, 17 nt, Staphylococcus aureus subsp. aureus MW2
aagauagguuuauuucu

SEQ ID NO: 2094655 - RNA, 20 nt, Staphylococcus aureus subsp. aureus MW2
aagauagguuuauuucugaa

SEQ ID NO: 2094656 - RNA, 20 nt, Staphylococcus aureus subsp. aureus MW2
aagauaguuugagaaaauua

SEQ ID NO: 2094657 - RNA, 13 nt, Staphylococcus aureus subsp. aureus MW2
aagauauaagaaa

SEQ ID NO: 2094658 - RNA, 19 nt, Staphylococcus aureus subsp. aureus MW2
aagauauaagaaaaagacg

SEQ ID NO: 2094659 - RNA, 19 nt, Staphylococcus aureus subsp. aureus MW2
aagauauuucuguuuuccu

SEQ ID NO: 2094660 - RNA, 20 nt, Staphylococcus aureus subsp. aureus MW2
aagauauauaacuaugguca

SEQ ID NO: 2094661 - RNA, 14 nt, Staphylococcus aureus subsp. aureus MW2
aagauaauauuaaa

SEQ ID NO: 2094662 - RNA, 12 nt, Staphylococcus aureus subsp. aureus MW2
aagauacaccaa

SEQ ID NO: 2094663 - RNA, 19 nt, Staphylococcus aureus subsp. aureus MW2
aagaugauuauucucuuua

SEQ ID NO: 2094664 - RNA, 13 nt, Staphylococcus aureus subsp. aureus MW2
aagaugauuccaa

SEQ ID NO: 2094665 - RNA, 14 nt, Staphylococcus aureus subsp. aureus MW2
aagaugauuucaaa

SEQ ID NO: 2094666 - RNA, 20 nt, Staphylococcus aureus subsp. aureus MW2
aagaugcuuuaauuaaaguu

SEQ ID NO: 2094667 - RNA, 18 nt, Staphylococcus aureus subsp. aureus MW2
aagaugcuuuaauuaaag

SEQ ID NO: 2094668 - RNA, 20 nt, Staphylococcus aureus subsp. aureus MW2
aagauuagaugauauuuaac

SEQ ID NO: 2094669 - RNA, 18 nt, Staphylococcus aureus subsp. aureus MW2
aagaugguuuuguuuugc

SEQ ID NO: 2094670 - RNA, 21 nt, Staphylococcus aureus subsp. aureus MW2
aagaugcuuuaauuaaaguua

SEQ ID NO: 2094671 - RNA, 21 nt, Staphylococcus aureus subsp. aureus MW2
aagauguauaugaauuuuaua

SEQ ID NO: 2094672 - RNA, 16 nt, Staphylococcus aureus subsp. aureus MW2
aagauguugaaaagua

SEQ ID NO: 2094673 - RNA, 15 nt, Staphylococcus aureus subsp. aureus MW2
aagauuaugaaaaca

SEQ ID NO: 2094674 - RNA, 19 nt, Staphylococcus aureus subsp. aureus MW2
aagauuagcuaugaacgaa

SEQ ID NO: 2094675 - RNA, 20 nt, Staphylococcus aureus subsp. aureus MW2
aagauuauugaaauuuggua

SEQ ID NO: 2094676 - RNA, 23 nt, Staphylococcus aureus subsp. aureus MW2
aagauuuguagcuugaauaauau

SEQ ID NO: 2094677 - RNA, 17 nt, Staphylococcus aureus subsp. aureus MW2
aagauuuaauaaagugu

SEQ ID NO: 2094678 - RNA, 15 nt, Staphylococcus aureus subsp. aureus MW2
aauaaaaaaugcacu

SEQ ID NO: 2094679 - RNA, 17 nt, Staphylococcus aureus subsp. aureus MW2
aauaaaaacuucuauca

SEQ ID NO: 2094680 - RNA, 15 nt, Staphylococcus aureus subsp. aureus MW2
aauaaaaauacauaa

SEQ ID NO: 2094681 - RNA, 17 nt, Staphylococcus aureus subsp. aureus MW2
aauaaaaauacauaauu

SEQ ID NO: 2094682 - RNA, 13 nt, Staphylococcus aureus subsp. aureus MW2
aauaaaaaaugca

SEQ ID NO: 2094683 - RNA, 21 nt, Staphylococcus aureus subsp. aureus MW2
aauaaaaaaaucacgcuaaca

SEQ ID NO: 2094684 - RNA, 13 nt, Staphylococcus aureus subsp. aureus MW2
aauaaaaaaccaa

SEQ ID NO: 2094685 - RNA, 18 nt, Staphylococcus aureus subsp. aureus MW2
aauaaaagucgauaaaua

SEQ ID NO: 2094686 - RNA, 18 nt, Staphylococcus aureus subsp. aureus MW2
aauaaaaggcuuuguuaa

SEQ ID NO: 2094687 - RNA, 19 nt, Staphylococcus aureus subsp. aureus MW2
aauaaaaggcuuuguuaaa

SEQ ID NO: 2094688 - RNA, 13 nt, Staphylococcus aureus subsp. aureus MW2
aauaaaaggcuuu

SEQ ID NO: 2094689 - RNA, 18 nt, Staphylococcus aureus subsp. aureus MW2
aauaaaacugcaauaauu

SEQ ID NO: 2094690 - RNA, 17 nt, Staphylococcus aureus subsp. aureus MW2
aauaaaagcaacaaaua

SEQ ID NO: 2094691 - RNA, 15 nt, Staphylococcus aureus subsp. aureus MW2
aauaaaaauugaauu

SEQ ID NO: 2094692 - RNA, 15 nt, Staphylococcus aureus subsp. aureus MW2
aauaaaaauuauaua

SEQ ID NO: 2094693 - RNA, 13 nt, Staphylococcus aureus subsp. aureus MW2
aauaaaacaaauu

SEQ ID NO: 2094694 - RNA, 15 nt, Staphylococcus aureus subsp. aureus MW2
aauaaacaacugcaa

SEQ ID NO: 2094695 - RNA, 16 nt, Staphylococcus aureus subsp. aureus MW2
aauaaacauaaaaaua

SEQ ID NO: 2094696 - RNA, 20 nt, Staphylococcus aureus subsp. aureus MW2
aauaaaccacgcacaucuaa

SEQ ID NO: 2094697 - RNA, 19 nt, Staphylococcus aureus subsp. aureus MW2
aauaaacauaucaucauaa

SEQ ID NO: 2094698 - RNA, 13 nt, Staphylococcus aureus subsp. aureus MW2
aauaaacuuaaaa

SEQ ID NO: 2094699 - RNA, 15 nt, Staphylococcus aureus subsp. aureus MW2
aauaaacuuaaaaga

SEQ ID NO: 2094700 - RNA, 21 nt, Staphylococcus aureus subsp. aureus MW2
aauaaaccuacaauauagaaa

SEQ ID NO: 2094701 - RNA, 22 nt, Staphylococcus aureus subsp. aureus MW2
aauaaaccgauuguuucaccag

SEQ ID NO: 2094702 - RNA, 13 nt, Staphylococcus aureus subsp. aureus MW2
aauaaaauuaaaa

SEQ ID NO: 2094703 - RNA, 15 nt, Staphylococcus aureus subsp. aureus MW2
aauaaaauucuauaa

SEQ ID NO: 2094704 - RNA, 13 nt, Staphylococcus aureus subsp. aureus MW2
aauaaaauauauc

SEQ ID NO: 2094705 - RNA, 15 nt, Staphylococcus aureus subsp. aureus MW2
aauaaaaugcuacaa

SEQ ID NO: 2094706 - RNA, 14 nt, Staphylococcus aureus subsp. aureus MW2
aauaaaaucaaagc

SEQ ID NO: 2094707 - RNA, 21 nt, Staphylococcus aureus subsp. aureus MW2
aaguuggggaugggccccaac

SEQ ID NO: 2094708 - RNA, 20 nt, Staphylococcus aureus subsp. aureus MW2
aaguuggggaugggccccaa

SEQ ID NO: 2094709 - RNA, 22 nt, Staphylococcus aureus subsp. aureus MW2
aaguugaagcggguugaagcaa

SEQ ID NO: 2094710 - RNA, 18 nt, Staphylococcus aureus subsp. aureus MW2
aaguuggcggggccccaa

SEQ ID NO: 2094711 - RNA, 19 nt, Staphylococcus aureus subsp. aureus MW2
aaguuggcggggccccaac

SEQ ID NO: 2094712 - RNA, 16 nt, Staphylococcus aureus subsp. aureus MW2
aaguuguacuucuuug

SEQ ID NO: 2094713 - RNA, 14 nt, Staphylococcus aureus subsp. aureus MW2
aaguuggugugcaa

SEQ ID NO: 2094714 - RNA, 23 nt, Staphylococcus aureus subsp. aureus MW2
aaguuuaaucguauuagccaaua

SEQ ID NO: 2094715 - RNA, 15 nt, Staphylococcus aureus subsp. aureus MW2
aaguuguugauuuaa

SEQ ID NO: 2094716 - RNA, 14 nt, Staphylococcus aureus subsp. aureus MW2
aaguuuaaaauacg

SEQ ID NO: 2094717 - RNA, 12 nt, Staphylococcus aureus subsp. aureus MW2
aaguuagcaaau

SEQ ID NO: 2094718 - RNA, 14 nt, Staphylococcus aureus subsp. aureus MW2
aaguuagacuaaaa

SEQ ID NO: 2094719 - RNA, 23 nt, Staphylococcus aureus subsp. aureus MW2
aaguucuuaugcaguuuuaauua

SEQ ID NO: 2094720 - RNA, 18 nt, Staphylococcus aureus subsp. aureus MW2
aaguuuuagcuuguuguu

SEQ ID NO: 2094721 - RNA, 20 nt, Staphylococcus aureus subsp. aureus MW2
aaguuugucuuugaacauau

SEQ ID NO: 2094722 - RNA, 15 nt, Staphylococcus aureus subsp. aureus MW2
aaguuuguuuucuuu

SEQ ID NO: 2094723 - RNA, 13 nt, Staphylococcus aureus subsp. aureus MW2
aaguuuucauuuu

SEQ ID NO: 2094724 - RNA, 13 nt, Staphylococcus aureus subsp. aureus MW2
aaguuuucauuua

SEQ ID NO: 2094725 - RNA, 17 nt, Staphylococcus aureus subsp. aureus MW2
aaguuuuauuuaaauua

SEQ ID NO: 2094726 - RNA, 23 nt, Staphylococcus aureus subsp. aureus MW2
aaguuuuucaggguuuaagauuu

SEQ ID NO: 2094727 - RNA, 13 nt, Staphylococcus aureus subsp. aureus MW2
aaguuuuugaaua

SEQ ID NO: 2094728 - RNA, 18 nt, Staphylococcus aureus subsp. aureus MW2
aaguuugaaggagauauu

SEQ ID NO: 2094729 - RNA, 14 nt, Staphylococcus aureus subsp. aureus MW2
aaguuuacaucaaa

SEQ ID NO: 2094730 - RNA, 15 nt, Staphylococcus aureus subsp. aureus MW2
aaguuuacaucaaag

SEQ ID NO: 2094731 - RNA, 18 nt, Staphylococcus aureus subsp. aureus MW2
aaguuuaggucaguccau

SEQ ID NO: 2094732 - RNA, 18 nt, Staphylococcus aureus subsp. aureus MW2
aagucuaauguuggaaaa

SEQ ID NO: 2094733 - RNA, 19 nt, Staphylococcus aureus subsp. aureus MW2
aagucgugccgaacuggaa

SEQ ID NO: 2094734 - RNA, 22 nt, Staphylococcus aureus subsp. aureus MW2
aagucaggaucacguuuuucuu

SEQ ID NO: 2094735 - RNA, 17 nt, Staphylococcus aureus subsp. aureus MW2
aagucagcuuacaauaa

SEQ ID NO: 2094736 - RNA, 12 nt, Staphylococcus aureus subsp. aureus MW2
aaguccaauaca

SEQ ID NO: 2094737 - RNA, 21 nt, Staphylococcus aureus subsp. aureus MW2
aaguaucugugaauaugcuuu

SEQ ID NO: 2094738 - RNA, 21 nt, Staphylococcus aureus subsp. aureus MW2
aaguaugagacgcauugcaag

SEQ ID NO: 2094739 - RNA, 20 nt, Staphylococcus aureus subsp. aureus MW2
aaguaugucaucuucaauuc

SEQ ID NO: 2094740 - RNA, 14 nt, Staphylococcus aureus subsp. aureus MW2
aaguauggcaguuu

SEQ ID NO: 2094741 - RNA, 16 nt, Staphylococcus aureus subsp. aureus MW2
aaguauggaaguuguu

SEQ ID NO: 2094742 - RNA, 20 nt, Staphylococcus aureus subsp. aureus MW2
aaguaugcgccauacauaug

SEQ ID NO: 2094743 - RNA, 14 nt, Staphylococcus aureus subsp. aureus MW2
aaguauuagauaua

SEQ ID NO: 2094744 - RNA, 13 nt, Staphylococcus aureus subsp. aureus MW2
aagucaccuucag

SEQ ID NO: 2094745 - RNA, 16 nt, Staphylococcus aureus subsp. aureus MW2
aaguaacucaagugau

SEQ ID NO: 2094746 - RNA, 13 nt, Staphylococcus aureus subsp. aureus MW2
aaguaacucaagu

SEQ ID NO: 2094747 - RNA, 21 nt, Staphylococcus aureus subsp. aureus MW2
aaguaagcguaauauuuaaga

SEQ ID NO: 2094748 - RNA, 17 nt, Staphylococcus aureus subsp. aureus MW2
aaguaacauaugcaagu

SEQ ID NO: 2094749 - RNA, 12 nt, Staphylococcus aureus subsp. aureus MW2
aaguaauaacuc

SEQ ID NO: 2094750 - RNA, 12 nt, Staphylococcus aureus subsp. aureus MW2
aaguaaguaaaa

SEQ ID NO: 2094751 - RNA, 19 nt, Staphylococcus aureus subsp. aureus MW2
aaguaucgccaaucuauug

SEQ ID NO: 2094752 - RNA, 15 nt, Staphylococcus aureus subsp. aureus MW2
aaguaauaauauaaa

SEQ ID NO: 2094753 - RNA, 20 nt, Staphylococcus aureus subsp. aureus MW2
aaguaauaauauaaauaaaa

SEQ ID NO: 2094754 - RNA, 21 nt, Staphylococcus aureus subsp. aureus MW2
aaguaauaauggcaauuaaaa

SEQ ID NO: 2094755 - RNA, 19 nt, Staphylococcus aureus subsp. aureus MW2
aagugcuucaacuucaucu

SEQ ID NO: 2094756 - RNA, 15 nt, Staphylococcus aureus subsp. aureus MW2
aagugggaaacauuu

SEQ ID NO: 2094757 - RNA, 14 nt, Staphylococcus aureus subsp. aureus MW2
aaguguuucaacau

SEQ ID NO: 2094758 - RNA, 15 nt, Staphylococcus aureus subsp. aureus MW2
aaguguuucaacaua

SEQ ID NO: 2094759 - RNA, 20 nt, Staphylococcus aureus subsp. aureus MW2
aaguguuucaacauauuaua

SEQ ID NO: 2094760 - RNA, 12 nt, Staphylococcus aureus subsp. aureus MW2
aaguuaaaaccu

SEQ ID NO: 2094761 - RNA, 21 nt, Staphylococcus aureus subsp. aureus MW2
aaguuaaaaccuuuucaaacu

SEQ ID NO: 2094762 - RNA, 16 nt, Staphylococcus aureus subsp. aureus MW2
aaguguugaggcguuu

SEQ ID NO: 2094763 - RNA, 19 nt, Staphylococcus aureus subsp. aureus MW2
aaguuaacuauaacaauag

SEQ ID NO: 2094764 - RNA, 14 nt, Staphylococcus aureus subsp. aureus MW2
aaguuaauuaugua

SEQ ID NO: 2094765 - RNA, 18 nt, Staphylococcus aureus subsp. aureus MW2
aaguuaacuauaacaaua

SEQ ID NO: 2094766 - RNA, 13 nt, Staphylococcus aureus subsp. aureus MW2
aaguuaagucgcc

SEQ ID NO: 2094767 - RNA, 21 nt, Staphylococcus aureus subsp. aureus MW2
aagucuucaucuuuaaagaaa

SEQ ID NO: 2094768 - RNA, 16 nt, Staphylococcus aureus subsp. aureus MW2
aagucucauuaucacc

SEQ ID NO: 2094769 - RNA, 18 nt, Staphylococcus aureus subsp. aureus MW2
aagugaaaucauuuaaau

SEQ ID NO: 2094770 - RNA, 16 nt, Staphylococcus aureus subsp. aureus MW2
aagugaaguuguauaa

SEQ ID NO: 2094771 - RNA, 19 nt, Staphylococcus aureus subsp. aureus MW2
aagugaugaccaauauucu

SEQ ID NO: 2094772 - RNA, 19 nt, Staphylococcus aureus subsp. aureus MW2
aagugaauaauugagaaaa

SEQ ID NO: 2094773 - RNA, 20 nt, Staphylococcus aureus subsp. aureus MW2
aagugauuuauuucauauuu

SEQ ID NO: 2094774 - RNA, 23 nt, Staphylococcus aureus subsp. aureus MW2
aagugauuuauuucauauuuaau

SEQ ID NO: 2094775 - RNA, 20 nt, Staphylococcus aureus subsp. aureus MW2
aagugcuguuacuucucccu

SEQ ID NO: 2094776 - RNA, 15 nt, Staphylococcus aureus subsp. aureus MW2
aagugcucaaauuuu

SEQ ID NO: 2094777 - RNA, 15 nt, Staphylococcus aureus subsp. aureus MW2
aagugccagauuuga

SEQ ID NO: 2094778 - RNA, 15 nt, Staphylococcus aureus subsp. aureus MW2
aagcuagaaguucuu

SEQ ID NO: 2094779 - RNA, 18 nt, Staphylococcus aureus subsp. aureus MW2
aagcuagaaguucuuaug

SEQ ID NO: 2094780 - RNA, 17 nt, Staphylococcus aureus subsp. aureus MW2
aagcuaauucauauuca

SEQ ID NO: 2094781 - RNA, 13 nt, Staphylococcus aureus subsp. aureus MW2
aagcuaauauuua

SEQ ID NO: 2094782 - RNA, 20 nt, Staphylococcus aureus subsp. aureus MW2
aagcuaauauuuauuuuaaa

SEQ ID NO: 2094783 - RNA, 13 nt, Staphylococcus aureus subsp. aureus MW2
aagcuaaugcaag

SEQ ID NO: 2094784 - RNA, 19 nt, Staphylococcus aureus subsp. aureus MW2
aagcucggcacucaauuua

SEQ ID NO: 2094785 - RNA, 14 nt, Staphylococcus aureus subsp. aureus MW2
aagccaagauaaau

SEQ ID NO: 2094786 - RNA, 16 nt, Staphylococcus aureus subsp. aureus MW2
aagcguaugauguugu

SEQ ID NO: 2094787 - RNA, 15 nt, Staphylococcus aureus subsp. aureus MW2
aagcggauucguuuu

SEQ ID NO: 2094788 - RNA, 20 nt, Staphylococcus aureus subsp. aureus MW2
aaggaauagcuacaauuaaa

SEQ ID NO: 2094789 - RNA, 18 nt, Staphylococcus aureus subsp. aureus MW2
aaggauaucugaaguaga

SEQ ID NO: 2094790 - RNA, 19 nt, Staphylococcus aureus subsp. aureus MW2
aaggaucauguuccccauu

SEQ ID NO: 2094791 - RNA, 20 nt, Staphylococcus aureus subsp. aureus MW2
aagcugcucgauauaagucu

SEQ ID NO: 2094792 - RNA, 17 nt, Staphylococcus aureus subsp. aureus MW2
aagcugcaauuaugcca

SEQ ID NO: 2094793 - RNA, 23 nt, Staphylococcus aureus subsp. aureus MW2
aagcugauuucuaucaaauaaug

SEQ ID NO: 2094794 - RNA, 17 nt, Staphylococcus aureus subsp. aureus MW2
aagcuuuaguuaaauag

SEQ ID NO: 2094795 - RNA, 18 nt, Staphylococcus aureus subsp. aureus MW2
aagcuuuauaaaacgcuu

SEQ ID NO: 2094796 - RNA, 15 nt, Staphylococcus aureus subsp. aureus MW2
aagcuuuaguuaaau

SEQ ID NO: 2094797 - RNA, 21 nt, Staphylococcus aureus subsp. aureus MW2
aagguacguuguaauaguaag

SEQ ID NO: 2094798 - RNA, 19 nt, Staphylococcus aureus subsp. aureus MW2
aaggucuacuaaauaacua

SEQ ID NO: 2094799 - RNA, 14 nt, Staphylococcus aureus subsp. aureus MW2
aaggucuauauaua

SEQ ID NO: 2094800 - RNA, 18 nt, Staphylococcus aureus subsp. aureus MW2
aaggucuauauauauuua

SEQ ID NO: 2094801 - RNA, 14 nt, Staphylococcus aureus subsp. aureus MW2
aagguaauuuaaca

SEQ ID NO: 2094802 - RNA, 17 nt, Staphylococcus aureus subsp. aureus MW2
aagguuuuacaauuuuu

SEQ ID NO: 2094803 - RNA, 19 nt, Staphylococcus aureus subsp. aureus MW2
aagguuauuuuuuaugguc

SEQ ID NO: 2094804 - RNA, 20 nt, Staphylococcus aureus subsp. aureus MW2
aagguuaauauuaaauuuug

SEQ ID NO: 2094805 - RNA, 16 nt, Staphylococcus aureus subsp. aureus MW2
aaggcgcucucuuuuu

SEQ ID NO: 2094806 - RNA, 18 nt, Staphylococcus aureus subsp. aureus MW2
aaggcgcucucuuuuuag

SEQ ID NO: 2094807 - RNA, 14 nt, Staphylococcus aureus subsp. aureus MW2
aaggccugcaucac

SEQ ID NO: 2094808 - RNA, 16 nt, Staphylococcus aureus subsp. aureus MW2
aaggccauuuguagac

SEQ ID NO: 2094809 - RNA, 13 nt, Staphylococcus aureus subsp. aureus MW2
acaaaucuauaaa

SEQ ID NO: 2094810 - RNA, 20 nt, Staphylococcus aureus subsp. aureus MW2
acaaaucaugacauaaaacu

SEQ ID NO: 2094811 - RNA, 12 nt, Staphylococcus aureus subsp. aureus MW2
acaaauauguaa

SEQ ID NO: 2094812 - RNA, 23 nt, Staphylococcus aureus subsp. aureus MW2
acaaauauaauguauaaaacaga

SEQ ID NO: 2094813 - RNA, 18 nt, Staphylococcus aureus subsp. aureus MW2
acaaauacaguuaucacc

SEQ ID NO: 2094814 - RNA, 14 nt, Staphylococcus aureus subsp. aureus MW2
acaaauaacaccga

SEQ ID NO: 2094815 - RNA, 12 nt, Staphylococcus aureus subsp. aureus MW2
acaaauaaaagc

SEQ ID NO: 2094816 - RNA, 13 nt, Staphylococcus aureus subsp. aureus MW2
acaacaaugaauc

SEQ ID NO: 2094817 - RNA, 21 nt, Staphylococcus aureus subsp. aureus MW2
acaaauuugaauauacuuaau

SEQ ID NO: 2094818 - RNA, 17 nt, Staphylococcus aureus subsp. aureus MW2
acaaauuuauauuaaau

SEQ ID NO: 2094819 - RNA, 22 nt, Staphylococcus aureus subsp. aureus MW2
acaaauuuauauuaaauaaagu

SEQ ID NO: 2094820 - RNA, 22 nt, Staphylococcus aureus subsp. aureus MW2
acaaauucuaugagaauagaca

SEQ ID NO: 2094821 - RNA, 17 nt, Staphylococcus aureus subsp. aureus MW2
acaaauuaaaaaacaau

SEQ ID NO: 2094822 - RNA, 22 nt, Staphylococcus aureus subsp. aureus MW2
acaaauuaaaaaacaauaaaau

SEQ ID NO: 2094823 - RNA, 13 nt, Staphylococcus aureus subsp. aureus MW2
acaaauuaaaaag

SEQ ID NO: 2094824 - RNA, 18 nt, Staphylococcus aureus subsp. aureus MW2
acaaauuaaaaagguacu

SEQ ID NO: 2094825 - RNA, 23 nt, Staphylococcus aureus subsp. aureus MW2
acaaauguauaccuauuggcauu

SEQ ID NO: 2094826 - RNA, 24 nt, Staphylococcus aureus subsp. aureus MW2
acaaauguauaccuauuggcauua

SEQ ID NO: 2094827 - RNA, 18 nt, Staphylococcus aureus subsp. aureus MW2
acaaauaaaaaaaccguu

SEQ ID NO: 2094828 - RNA, 20 nt, Staphylococcus aureus subsp. aureus MW2
acaaaguuaaucauacauau

SEQ ID NO: 2094829 - RNA, 13 nt, Staphylococcus aureus subsp. aureus MW2
acaaagucauuuu

SEQ ID NO: 2094830 - RNA, 21 nt, Staphylococcus aureus subsp. aureus MW2
acaaagcuuguaaucauacca

SEQ ID NO: 2094831 - RNA, 13 nt, Staphylococcus aureus subsp. aureus MW2
acaaagaaauuaa

SEQ ID NO: 2094832 - RNA, 16 nt, Staphylococcus aureus subsp. aureus MW2
acaagccaagauaaau

SEQ ID NO: 2094833 - RNA, 15 nt, Staphylococcus aureus subsp. aureus MW2
acaagcaucaugaaa

SEQ ID NO: 2094834 - RNA, 22 nt, Staphylococcus aureus subsp. aureus MW2
acaagccuuaaaauauuuaacu

SEQ ID NO: 2094835 - RNA, 23 nt, Staphylococcus aureus subsp. aureus MW2
acaacuucuucuccguauuuacc

SEQ ID NO: 2094836 - RNA, 18 nt, Staphylococcus aureus subsp. aureus MW2
acaacuugaacuaaaaca

SEQ ID NO: 2094837 - RNA, 21 nt, Staphylococcus aureus subsp. aureus MW2
acaacuugaacuaaaacaaua

SEQ ID NO: 2094838 - RNA, 23 nt, Staphylococcus aureus subsp. aureus MW2
acaacuugaacuaaaacaauaau

SEQ ID NO: 2094839 - RNA, 15 nt, Staphylococcus aureus subsp. aureus MW2
acaacuuuauuauac

SEQ ID NO: 2094840 - RNA, 21 nt, Staphylococcus aureus subsp. aureus MW2
acaagaacaugauacugaaau

SEQ ID NO: 2094841 - RNA, 17 nt, Staphylococcus aureus subsp. aureus MW2
acaacuaauaacaaaua

SEQ ID NO: 2094842 - RNA, 13 nt, Staphylococcus aureus subsp. aureus MW2
acaacugauuuaa

SEQ ID NO: 2094843 - RNA, 15 nt, Staphylococcus aureus subsp. aureus MW2
acaacuguucuaaaa

SEQ ID NO: 2094844 - RNA, 19 nt, Staphylococcus aureus subsp. aureus MW2
acaacuguucuaaaauuaa

SEQ ID NO: 2094845 - RNA, 21 nt, Staphylococcus aureus subsp. aureus MW2
acaacuguucuaaaauuaacc

SEQ ID NO: 2094846 - RNA, 19 nt, Staphylococcus aureus subsp. aureus MW2
acaaccugugauaaaaauc

SEQ ID NO: 2094847 - RNA, 21 nt, Staphylococcus aureus subsp. aureus MW2
acaaccucugauacuucacca

SEQ ID NO: 2094848 - RNA, 23 nt, Staphylococcus aureus subsp. aureus MW2
acaacggcauaauacacauugca

SEQ ID NO: 2094849 - RNA, 21 nt, Staphylococcus aureus subsp. aureus MW2
acaacaucgauuuaucauuau

SEQ ID NO: 2094850 - RNA, 18 nt, Staphylococcus aureus subsp. aureus MW2
acaacaugauuucuucuc

SEQ ID NO: 2094851 - RNA, 21 nt, Staphylococcus aureus subsp. aureus MW2
acaacaugauuucuucuccuu

SEQ ID NO: 2094852 - RNA, 14 nt, Staphylococcus aureus subsp. aureus MW2
acaacagugcucua

SEQ ID NO: 2094853 - RNA, 21 nt, Staphylococcus aureus subsp. aureus MW2
acaacauuauuuauauuuaga

SEQ ID NO: 2094854 - RNA, 20 nt, Staphylococcus aureus subsp. aureus MW2
aauuuugacgcucagguaua

SEQ ID NO: 2094855 - RNA, 13 nt, Staphylococcus aureus subsp. aureus MW2
aauuuugagaaaa

SEQ ID NO: 2094856 - RNA, 19 nt, Staphylococcus aureus subsp. aureus MW2
aauuuugauuuaccuucau

SEQ ID NO: 2094857 - RNA, 12 nt, Staphylococcus aureus subsp. aureus MW2
aauuuugaagaa

SEQ ID NO: 2094858 - RNA, 14 nt, Staphylococcus aureus subsp. aureus MW2
aauuuuuaacaaaa

SEQ ID NO: 2094859 - RNA, 15 nt, Staphylococcus aureus subsp. aureus MW2
aauuuuuaaacaaaa

SEQ ID NO: 2094860 - RNA, 18 nt, Staphylococcus aureus subsp. aureus MW2
aauuuuuaaaaaaauaau

SEQ ID NO: 2094861 - RNA, 19 nt, Staphylococcus aureus subsp. aureus MW2
aauuuuuaaaucuacaaua

SEQ ID NO: 2094862 - RNA, 16 nt, Staphylococcus aureus subsp. aureus MW2
aauuuuguuuucuuug

SEQ ID NO: 2094863 - RNA, 19 nt, Staphylococcus aureus subsp. aureus MW2
aauuuuguacauaaaaaua

SEQ ID NO: 2094864 - RNA, 16 nt, Staphylococcus aureus subsp. aureus MW2
aauuuucuaaagauau

SEQ ID NO: 2094865 - RNA, 17 nt, Staphylococcus aureus subsp. aureus MW2
aauuuucuaaagauaua

SEQ ID NO: 2094866 - RNA, 15 nt, Staphylococcus aureus subsp. aureus MW2
aauuuucucaaacua

SEQ ID NO: 2094867 - RNA, 20 nt, Staphylococcus aureus subsp. aureus MW2
aauuuucucaaacuaucuua

SEQ ID NO: 2094868 - RNA, 22 nt, Staphylococcus aureus subsp. aureus MW2
aauuuucucaaacuaucuuaua

SEQ ID NO: 2094869 - RNA, 18 nt, Staphylococcus aureus subsp. aureus MW2
aauuuucaucauuaaacc

SEQ ID NO: 2094870 - RNA, 18 nt, Staphylococcus aureus subsp. aureus MW2
aauuuucagcaucuacua

SEQ ID NO: 2094871 - RNA, 20 nt, Staphylococcus aureus subsp. aureus MW2
aauuuucagcaucuacuaaa

SEQ ID NO: 2094872 - RNA, 16 nt, Staphylococcus aureus subsp. aureus MW2
aauuuuuuggaaacau

SEQ ID NO: 2094873 - RNA, 19 nt, Staphylococcus aureus subsp. aureus MW2
aauuuuuaugcauuauaga

SEQ ID NO: 2094874 - RNA, 18 nt, Staphylococcus aureus subsp. aureus MW2
aauuuuuaugcauuauag

SEQ ID NO: 2094875 - RNA, 19 nt, Staphylococcus aureus subsp. aureus MW2
aauuuuucauuaauacaag

SEQ ID NO: 2094876 - RNA, 19 nt, Staphylococcus aureus subsp. aureus MW2
aauuuuuccaacuucuuuu

SEQ ID NO: 2094877 - RNA, 13 nt, Staphylococcus aureus subsp. aureus MW2
aauuuuucuuuaa

SEQ ID NO: 2094878 - RNA, 13 nt, Staphylococcus aureus subsp. aureus MW2
acaaaaaugaaga

SEQ ID NO: 2094879 - RNA, 16 nt, Staphylococcus aureus subsp. aureus MW2
acaaaaauaaaaccga

SEQ ID NO: 2094880 - RNA, 17 nt, Staphylococcus aureus subsp. aureus MW2
acaaaaauauagcuauu

SEQ ID NO: 2094881 - RNA, 18 nt, Staphylococcus aureus subsp. aureus MW2
acaaaagcaacuguaaau

SEQ ID NO: 2094882 - RNA, 22 nt, Staphylococcus aureus subsp. aureus MW2
acaaaagcaacuguaaaugaaa

SEQ ID NO: 2094883 - RNA, 22 nt, Staphylococcus aureus subsp. aureus MW2
acaaaagauguugcuagugcau

SEQ ID NO: 2094884 - RNA, 15 nt, Staphylococcus aureus subsp. aureus MW2
acaaaagaggcgcca

SEQ ID NO: 2094885 - RNA, 13 nt, Staphylococcus aureus subsp. aureus MW2
acaaaaaauuauc

SEQ ID NO: 2094886 - RNA, 22 nt, Staphylococcus aureus subsp. aureus MW2
acaaaaaauaauuuaauuuuuu

SEQ ID NO: 2094887 - RNA, 16 nt, Staphylococcus aureus subsp. aureus MW2
acaaaauaacauguuu

SEQ ID NO: 2094888 - RNA, 15 nt, Staphylococcus aureus subsp. aureus MW2
acaaaaucaccuuuu

SEQ ID NO: 2094889 - RNA, 19 nt, Staphylococcus aureus subsp. aureus MW2
acaaaaguaugauuuguuu

SEQ ID NO: 2094890 - RNA, 16 nt, Staphylococcus aureus subsp. aureus MW2
acaaaauuuccacuuu

SEQ ID NO: 2094891 - RNA, 22 nt, Staphylococcus aureus subsp. aureus MW2
acaaaaugcguaucaauauuca

SEQ ID NO: 2094892 - RNA, 18 nt, Staphylococcus aureus subsp. aureus MW2
aauuuggucauuuaaaca

SEQ ID NO: 2094893 - RNA, 16 nt, Staphylococcus aureus subsp. aureus MW2
aauuugcaaaaucaac

SEQ ID NO: 2094894 - RNA, 21 nt, Staphylococcus aureus subsp. aureus MW2
aauuugaauauacuuaauuua

SEQ ID NO: 2094895 - RNA, 17 nt, Staphylococcus aureus subsp. aureus MW2
aauuugauuaaauucau

SEQ ID NO: 2094896 - RNA, 16 nt, Staphylococcus aureus subsp. aureus MW2
aauuugauuaaauucu

SEQ ID NO: 2094897 - RNA, 23 nt, Staphylococcus aureus subsp. aureus MW2
aauuugauguucuugaaaacaau

SEQ ID NO: 2094898 - RNA, 13 nt, Staphylococcus aureus subsp. aureus MW2
aauuuuauauauc

SEQ ID NO: 2094899 - RNA, 17 nt, Staphylococcus aureus subsp. aureus MW2
aauuuuauuagguaaua

SEQ ID NO: 2094900 - RNA, 14 nt, Staphylococcus aureus subsp. aureus MW2
aauuuuauuauuaa

SEQ ID NO: 2094901 - RNA, 16 nt, Staphylococcus aureus subsp. aureus MW2
aauuuuaucaauuucu

SEQ ID NO: 2094902 - RNA, 22 nt, Staphylococcus aureus subsp. aureus MW2
aauuuuaugucccaaugcugaa

SEQ ID NO: 2094903 - RNA, 20 nt, Staphylococcus aureus subsp. aureus MW2
aauuuuacaaaaugaugaaa

SEQ ID NO: 2094904 - RNA, 23 nt, Staphylococcus aureus subsp. aureus MW2
aauuuuagcaguguguaucucuu

SEQ ID NO: 2094905 - RNA, 16 nt, Staphylococcus aureus subsp. aureus MW2
aauuuuaacuuauaua

SEQ ID NO: 2094906 - RNA, 16 nt, Staphylococcus aureus subsp. aureus MW2
aauuuguuuuaaauac

SEQ ID NO: 2094907 - RNA, 15 nt, Staphylococcus aureus subsp. aureus MW2
aauuuguuuuaaaua

SEQ ID NO: 2094908 - RNA, 15 nt, Staphylococcus aureus subsp. aureus MW2
aauuuguaauuuaaa

SEQ ID NO: 2094909 - RNA, 17 nt, Staphylococcus aureus subsp. aureus MW2
aauuuguauuuaaaauc

SEQ ID NO: 2094910 - RNA, 18 nt, Staphylococcus aureus subsp. aureus MW2
aauuucugguaaaaaaau

SEQ ID NO: 2094911 - RNA, 17 nt, Staphylococcus aureus subsp. aureus MW2
aauuucugcuucuuuua

SEQ ID NO: 2094912 - RNA, 23 nt, Staphylococcus aureus subsp. aureus MW2
aauuucuguuuacgccauaagaa

SEQ ID NO: 2094913 - RNA, 14 nt, Staphylococcus aureus subsp. aureus MW2
aauuucuauuuaaa

SEQ ID NO: 2094914 - RNA, 14 nt, Staphylococcus aureus subsp. aureus MW2
aauuucuaugaaaa

SEQ ID NO: 2094915 - RNA, 15 nt, Staphylococcus aureus subsp. aureus MW2
aauuucugaacauaa

SEQ ID NO: 2094916 - RNA, 17 nt, Staphylococcus aureus subsp. aureus MW2
aauuucucuguguuggg

SEQ ID NO: 2094917 - RNA, 16 nt, Staphylococcus aureus subsp. aureus MW2
aauuucgacaucuaga

SEQ ID NO: 2094918 - RNA, 21 nt, Staphylococcus aureus subsp. aureus MW2
aauuucgacaucuagaugaaa

SEQ ID NO: 2094919 - RNA, 23 nt, Staphylococcus aureus subsp. aureus MW2
aauuucgacaucuagaugaaauu

SEQ ID NO: 2094920 - RNA, 13 nt, Staphylococcus aureus subsp. aureus MW2
aauuucgcacaau

SEQ ID NO: 2094921 - RNA, 14 nt, Staphylococcus aureus subsp. aureus MW2
aauuucgaaaagaa

SEQ ID NO: 2094922 - RNA, 22 nt, Staphylococcus aureus subsp. aureus MW2
aauuuccugcagucauuugauu

SEQ ID NO: 2094923 - RNA, 22 nt, Staphylococcus aureus subsp. aureus MW2
aauuucuacagacaaugcaagu

SEQ ID NO: 2094924 - RNA, 19 nt, Staphylococcus aureus subsp. aureus MW2
aauuucuaauuuaguaucu

SEQ ID NO: 2094925 - RNA, 17 nt, Staphylococcus aureus subsp. aureus MW2
aauuucauuuuugauaa

SEQ ID NO: 2094926 - RNA, 20 nt, Staphylococcus aureus subsp. aureus MW2
aauuucauaguuaucgauuu

SEQ ID NO: 2094927 - RNA, 16 nt, Staphylococcus aureus subsp. aureus MW2
aauuuccaaaguaaua

SEQ ID NO: 2094928 - RNA, 16 nt, Staphylococcus aureus subsp. aureus MW2
aauuuccaauaucuuc

SEQ ID NO: 2094929 - RNA, 16 nt, Staphylococcus aureus subsp. aureus MW2
aauuucaucaaaucca

SEQ ID NO: 2094930 - RNA, 22 nt, Staphylococcus aureus subsp. aureus MW2
aauuauaauaaaacuugugaua

SEQ ID NO: 2094931 - RNA, 23 nt, Staphylococcus aureus subsp. aureus MW2
aauuauacgagaauaugaucuaa

SEQ ID NO: 2094932 - RNA, 23 nt, Staphylococcus aureus subsp. aureus MW2
aauuagagggcacgagaaauguc

SEQ ID NO: 2094933 - RNA, 20 nt, Staphylococcus aureus subsp. aureus MW2
aauuagucauccaaagaaac

SEQ ID NO: 2094934 - RNA, 16 nt, Staphylococcus aureus subsp. aureus MW2
aauuagucauugaaaa

SEQ ID NO: 2094935 - RNA, 16 nt, Staphylococcus aureus subsp. aureus MW2
aauuauaaaugauuaa

SEQ ID NO: 2094936 - RNA, 22 nt, Staphylococcus aureus subsp. aureus MW2
aauuauaaguagugauuuuuua

SEQ ID NO: 2094937 - RNA, 12 nt, Staphylococcus aureus subsp. aureus MW2
aauuauaauaaa

SEQ ID NO: 2094938 - RNA, 18 nt, Staphylococcus aureus subsp. aureus MW2
acacaaaggauauugaaa

SEQ ID NO: 2094939 - RNA, 19 nt, Staphylococcus aureus subsp. aureus MW2
acacaaauaaaagcaacaa

SEQ ID NO: 2094940 - RNA, 23 nt, Staphylococcus aureus subsp. aureus MW2
acacaaauaaaagcaacaaauau

SEQ ID NO: 2094941 - RNA, 11 nt, Staphylococcus aureus subsp. aureus MW2
acaauuuuugg

SEQ ID NO: 2094942 - RNA, 15 nt, Staphylococcus aureus subsp. aureus MW2
acaauuuuuaaaaac

SEQ ID NO: 2094943 - RNA, 16 nt, Staphylococcus aureus subsp. aureus MW2
acaauuuucucauuaa

SEQ ID NO: 2094944 - RNA, 24 nt, Staphylococcus aureus subsp. aureus MW2
acaauuucuauuuaaacaagaaaa

SEQ ID NO: 2094945 - RNA, 15 nt, Staphylococcus aureus subsp. aureus MW2
acaauuuaaaaagca

SEQ ID NO: 2094946 - RNA, 17 nt, Staphylococcus aureus subsp. aureus MW2
acaauuuauuaaaacga

SEQ ID NO: 2094947 - RNA, 18 nt, Staphylococcus aureus subsp. aureus MW2
acaauuuagguuaauuaa

SEQ ID NO: 2094948 - RNA, 20 nt, Staphylococcus aureus subsp. aureus MW2
acaauuuagguuaauuaaac

SEQ ID NO: 2094949 - RNA, 14 nt, Staphylococcus aureus subsp. aureus MW2
acaauuuaaauuaa

SEQ ID NO: 2094950 - RNA, 20 nt, Staphylococcus aureus subsp. aureus MW2
acaauuuagcaaauauuucu

SEQ ID NO: 2094951 - RNA, 13 nt, Staphylococcus aureus subsp. aureus MW2
acaauugcagaga

SEQ ID NO: 2094952 - RNA, 18 nt, Staphylococcus aureus subsp. aureus MW2
acaauuccccaaagccuu

SEQ ID NO: 2094953 - RNA, 14 nt, Staphylococcus aureus subsp. aureus MW2
acaauucauuaaua

SEQ ID NO: 2094954 - RNA, 15 nt, Staphylococcus aureus subsp. aureus MW2
acaauuauaauaaaa

SEQ ID NO: 2094955 - RNA, 17 nt, Staphylococcus aureus subsp. aureus MW2
acaauuauaauaaaacu

SEQ ID NO: 2094956 - RNA, 16 nt, Staphylococcus aureus subsp. aureus MW2
acaauucauaagaaaa

SEQ ID NO: 2094957 - RNA, 19 nt, Staphylococcus aureus subsp. aureus MW2
acaauguuauuagauacuu

SEQ ID NO: 2094958 - RNA, 13 nt, Staphylococcus aureus subsp. aureus MW2
acaauguauuacc

SEQ ID NO: 2094959 - RNA, 17 nt, Staphylococcus aureus subsp. aureus MW2
acaaugcgcaaugaaaa

SEQ ID NO: 2094960 - RNA, 21 nt, Staphylococcus aureus subsp. aureus MW2
acacaucaugacauuaaucau

SEQ ID NO: 2094961 - RNA, 13 nt, Staphylococcus aureus subsp. aureus MW2
acacaucaacaua

SEQ ID NO: 2094962 - RNA, 22 nt, Staphylococcus aureus subsp. aureus MW2
acacauauaguuguaucaaaua

SEQ ID NO: 2094963 - RNA, 13 nt, Staphylococcus aureus subsp. aureus MW2
acacaguacaaau

SEQ ID NO: 2094964 - RNA, 22 nt, Staphylococcus aureus subsp. aureus MW2
acacagguaaauuuaaaauaau

SEQ ID NO: 2094965 - RNA, 15 nt, Staphylococcus aureus subsp. aureus MW2
acacaguacaaauaa

SEQ ID NO: 2094966 - RNA, 20 nt, Staphylococcus aureus subsp. aureus MW2
acacagguaaauuuaaaaua

SEQ ID NO: 2094967 - RNA, 21 nt, Staphylococcus aureus subsp. aureus MW2
acacagguaaauuuaaaauaa

SEQ ID NO: 2094968 - RNA, 16 nt, Staphylococcus aureus subsp. aureus MW2
acacaguaauucuuaa

SEQ ID NO: 2094969 - RNA, 22 nt, Staphylococcus aureus subsp. aureus MW2
acacaaauuuuuuggaaacaug

SEQ ID NO: 2094970 - RNA, 18 nt, Staphylococcus aureus subsp. aureus MW2
acacaaugauuauaaaua

SEQ ID NO: 2094971 - RNA, 21 nt, Staphylococcus aureus subsp. aureus MW2
acacacuguugaaaaugacua

SEQ ID NO: 2094972 - RNA, 22 nt, Staphylococcus aureus subsp. aureus MW2
acacacugcuaaaauuguauua

SEQ ID NO: 2094973 - RNA, 15 nt, Staphylococcus aureus subsp. aureus MW2
acacacccaaauuua

SEQ ID NO: 2094974 - RNA, 13 nt, Staphylococcus aureus subsp. aureus MW2
acacagaagcuga

SEQ ID NO: 2094975 - RNA, 23 nt, Staphylococcus aureus subsp. aureus MW2
acacagaagcugacgaaaaguca

SEQ ID NO: 2094976 - RNA, 14 nt, Staphylococcus aureus subsp. aureus MW2
acacagaagcuggc

SEQ ID NO: 2094977 - RNA, 23 nt, Staphylococcus aureus subsp. aureus MW2
acacagagaauuucgaaaagaaa

SEQ ID NO: 2094978 - RNA, 15 nt, Staphylococcus aureus subsp. aureus MW2
acaaguauaaaugca

SEQ ID NO: 2094979 - RNA, 20 nt, Staphylococcus aureus subsp. aureus MW2
acaaguauaaaugcagcugu

SEQ ID NO: 2094980 - RNA, 14 nt, Staphylococcus aureus subsp. aureus MW2
acaaguauaaaugc

SEQ ID NO: 2094981 - RNA, 18 nt, Staphylococcus aureus subsp. aureus MW2
acaaguacaauaauaccu

SEQ ID NO: 2094982 - RNA, 18 nt, Staphylococcus aureus subsp. aureus MW2
acaagucuuuacucuaca

SEQ ID NO: 2094983 - RNA, 22 nt, Staphylococcus aureus subsp. aureus MW2
acaagucuuuacucuacacuca

SEQ ID NO: 2094984 - RNA, 20 nt, Staphylococcus aureus subsp. aureus MW2
acaagucuuauuuguuuaau

SEQ ID NO: 2094985 - RNA, 23 nt, Staphylococcus aureus subsp. aureus MW2
acaagucuaguucgaacacacac

SEQ ID NO: 2094986 - RNA, 20 nt, Staphylococcus aureus subsp. aureus MW2
acaagguaugaaauaacaau

SEQ ID NO: 2094987 - RNA, 10 nt, Staphylococcus aureus subsp. aureus MW2
acaagcuuua

SEQ ID NO: 2094988 - RNA, 13 nt, Staphylococcus aureus subsp. aureus MW2
acaagcuuuuuuc

SEQ ID NO: 2094989 - RNA, 18 nt, Staphylococcus aureus subsp. aureus MW2
acaaggaauauacaauag

SEQ ID NO: 2094990 - RNA, 15 nt, Staphylococcus aureus subsp. aureus MW2
acaauacaaaucgau

SEQ ID NO: 2094991 - RNA, 14 nt, Staphylococcus aureus subsp. aureus MW2
acaauaaugugcaa

SEQ ID NO: 2094992 - RNA, 20 nt, Staphylococcus aureus subsp. aureus MW2
acaauaaugugcaaguuggc

SEQ ID NO: 2094993 - RNA, 15 nt, Staphylococcus aureus subsp. aureus MW2
acaauaacuguucuu

SEQ ID NO: 2094994 - RNA, 17 nt, Staphylococcus aureus subsp. aureus MW2
acaauaacuguucuuuc

SEQ ID NO: 2094995 - RNA, 11 nt, Staphylococcus aureus subsp. aureus MW2
acaauaaaauu

SEQ ID NO: 2094996 - RNA, 14 nt, Staphylococcus aureus subsp. aureus MW2
acaauaaaauuacu

SEQ ID NO: 2094997 - RNA, 15 nt, Staphylococcus aureus subsp. aureus MW2
acaaguuguucaauu

SEQ ID NO: 2094998 - RNA, 18 nt, Staphylococcus aureus subsp. aureus MW2
acaaguugcacauuauaa

SEQ ID NO: 2094999 - RNA, 17 nt, Staphylococcus aureus subsp. aureus MW2
acaaguugcacauuaua

SEQ ID NO: 2095000 - RNA, 15 nt, Staphylococcus aureus subsp. aureus MW2
acaauaaaaaaccaa

SEQ ID NO: 2095001 - RNA, 22 nt, Staphylococcus aureus subsp. aureus MW2
acaauaguauuaacuauaaaua

SEQ ID NO: 2095002 - RNA, 19 nt, Staphylococcus aureus subsp. aureus MW2
acaauaguauaaauaucau

SEQ ID NO: 2095003 - RNA, 15 nt, Staphylococcus aureus subsp. aureus MW2
acaauauaaaagcac

SEQ ID NO: 2095004 - RNA, 17 nt, Staphylococcus aureus subsp. aureus MW2
acaauauaaaagcacua

SEQ ID NO: 2095005 - RNA, 14 nt, Staphylococcus aureus subsp. aureus MW2
acaauauugacuuu

SEQ ID NO: 2095006 - RNA, 14 nt, Staphylococcus aureus subsp. aureus MW2
acaaucaaaggcuu

SEQ ID NO: 2095007 - RNA, 19 nt, Staphylococcus aureus subsp. aureus MW2
acaaucacagcaauaauaa

SEQ ID NO: 2095008 - RNA, 21 nt, Staphylococcus aureus subsp. aureus MW2
acaaucaacuuagaauuuaca

SEQ ID NO: 2095009 - RNA, 18 nt, Staphylococcus aureus subsp. aureus MW2
acaaucacagcaauaaua

SEQ ID NO: 2095010 - RNA, 15 nt, Staphylococcus aureus subsp. aureus MW2
acaaucagauaaguu

SEQ ID NO: 2095011 - RNA, 15 nt, Staphylococcus aureus subsp. aureus MW2
acaaucauuagucau

SEQ ID NO: 2095012 - RNA, 21 nt, Staphylococcus aureus subsp. aureus MW2
acaaucauagauauaagaaau

SEQ ID NO: 2095013 - RNA, 16 nt, Staphylococcus aureus subsp. aureus MW2
acaaugauuaaaauua

SEQ ID NO: 2095014 - RNA, 16 nt, Staphylococcus aureus subsp. aureus MW2
acaaugauucaucagu

SEQ ID NO: 2095015 - RNA, 23 nt, Staphylococcus aureus subsp. aureus MW2
acaaugaauuucuaauuuaguau

SEQ ID NO: 2095016 - RNA, 20 nt, Staphylococcus aureus subsp. aureus MW2
acaaugaagcuaaguauaua

SEQ ID NO: 2095017 - RNA, 24 nt, Staphylococcus aureus subsp. aureus MW2
acaaugaagcuaaguauauaagca

SEQ ID NO: 2095018 - RNA, 20 nt, Staphylococcus aureus subsp. aureus MW2
acaaucggaagcauauuucu

SEQ ID NO: 2095019 - RNA, 19 nt, Staphylococcus aureus subsp. aureus MW2
acaaucggaagcauauuuc

SEQ ID NO: 2095020 - RNA, 17 nt, Staphylococcus aureus subsp. aureus MW2
acaaucggaagcauauu

SEQ ID NO: 2095021 - RNA, 15 nt, Staphylococcus aureus subsp. aureus MW2
acaauccugaagaga

SEQ ID NO: 2095022 - RNA, 22 nt, Staphylococcus aureus subsp. aureus MW2
acaccuuucgcgacuucauuac

SEQ ID NO: 2095023 - RNA, 14 nt, Staphylococcus aureus subsp. aureus MW2
acaccuucaauauc

SEQ ID NO: 2095024 - RNA, 19 nt, Staphylococcus aureus subsp. aureus MW2
acacgcauuacuuuagaaa

SEQ ID NO: 2095025 - RNA, 12 nt, Staphylococcus aureus subsp. aureus MW2
acacccaaauuu

SEQ ID NO: 2095026 - RNA, 13 nt, Staphylococcus aureus subsp. aureus MW2
acaccagauauca

SEQ ID NO: 2095027 - RNA, 22 nt, Staphylococcus aureus subsp. aureus MW2
acacauucuuauuugaaaugau

SEQ ID NO: 2095028 - RNA, 17 nt, Staphylococcus aureus subsp. aureus MW2
acacauucuuauuugaa

SEQ ID NO: 2095029 - RNA, 21 nt, Staphylococcus aureus subsp. aureus MW2
acacauguacguuuuuuuaaa

SEQ ID NO: 2095030 - RNA, 13 nt, Staphylococcus aureus subsp. aureus MW2
acaccaacauauu

SEQ ID NO: 2095031 - RNA, 16 nt, Staphylococcus aureus subsp. aureus MW2
acacuacgcugaugaa

SEQ ID NO: 2095032 - RNA, 22 nt, Staphylococcus aureus subsp. aureus MW2
acacuaucauuaucaaauaacc

SEQ ID NO: 2095033 - RNA, 24 nt, Staphylococcus aureus subsp. aureus MW2
acagaaaauacauuucuguauaaa

SEQ ID NO: 2095034 - RNA, 21 nt, Staphylococcus aureus subsp. aureus MW2
acagaagcuggcggaaaguca

SEQ ID NO: 2095035 - RNA, 21 nt, Staphylococcus aureus subsp. aureus MW2
acacguguauuguauuuuaau

SEQ ID NO: 2095036 - RNA, 14 nt, Staphylococcus aureus subsp. aureus MW2
acacguguaaaaau

SEQ ID NO: 2095037 - RNA, 16 nt, Staphylococcus aureus subsp. aureus MW2
acagcaguaagauauu

SEQ ID NO: 2095038 - RNA, 22 nt, Staphylococcus aureus subsp. aureus MW2
acagcaguaagacgauuucaau

SEQ ID NO: 2095039 - RNA, 17 nt, Staphylococcus aureus subsp. aureus MW2
acagcaguaagauuauu

SEQ ID NO: 2095040 - RNA, 12 nt, Staphylococcus aureus subsp. aureus MW2
acagcaaauaaa

SEQ ID NO: 2095041 - RNA, 19 nt, Staphylococcus aureus subsp. aureus MW2
acagauuuuaaaaauucau

SEQ ID NO: 2095042 - RNA, 14 nt, Staphylococcus aureus subsp. aureus MW2
acagcaaauaaaau

SEQ ID NO: 2095043 - RNA, 18 nt, Staphylococcus aureus subsp. aureus MW2
acagcaaauaaaaucaua

SEQ ID NO: 2095044 - RNA, 15 nt, Staphylococcus aureus subsp. aureus MW2
acagaguugucauuc

SEQ ID NO: 2095045 - RNA, 18 nt, Staphylococcus aureus subsp. aureus MW2
acagaguugucauucuuc

SEQ ID NO: 2095046 - RNA, 20 nt, Staphylococcus aureus subsp. aureus MW2
acauagagaaauuugauuuu

SEQ ID NO: 2095047 - RNA, 18 nt, Staphylococcus aureus subsp. aureus MW2
acauagagaauuucaaaa

SEQ ID NO: 2095048 - RNA, 14 nt, Staphylococcus aureus subsp. aureus MW2
acauagaagcuggc

SEQ ID NO: 2095049 - RNA, 23 nt, Staphylococcus aureus subsp. aureus MW2
acauagaagcuggcggaaaguca

SEQ ID NO: 2095050 - RNA, 17 nt, Staphylococcus aureus subsp. aureus MW2
acauagacacuuaacuu

SEQ ID NO: 2095051 - RNA, 13 nt, Staphylococcus aureus subsp. aureus MW2
acauauaagaauu

SEQ ID NO: 2095052 - RNA, 22 nt, Staphylococcus aureus subsp. aureus MW2
acauaguuucuucuauuauauu

SEQ ID NO: 2095053 - RNA, 17 nt, Staphylococcus aureus subsp. aureus MW2
acauagcguaauuuuac

SEQ ID NO: 2095054 - RNA, 16 nt, Staphylococcus aureus subsp. aureus MW2
acauaagcaaagauga

SEQ ID NO: 2095055 - RNA, 14 nt, Staphylococcus aureus subsp. aureus MW2
acauaagaaaaagc

SEQ ID NO: 2095056 - RNA, 16 nt, Staphylococcus aureus subsp. aureus MW2
acauaagaaaaagcag

SEQ ID NO: 2095057 - RNA, 16 nt, Staphylococcus aureus subsp. aureus MW2
acauaaaacuuacauu

SEQ ID NO: 2095058 - RNA, 15 nt, Staphylococcus aureus subsp. aureus MW2
acauaaccuugcuuu

SEQ ID NO: 2095059 - RNA, 23 nt, Staphylococcus aureus subsp. aureus MW2
acauaauaauaauacaauuuuag

SEQ ID NO: 2095060 - RNA, 19 nt, Staphylococcus aureus subsp. aureus MW2
acauaccaguggaaauuau

SEQ ID NO: 2095061 - RNA, 22 nt, Staphylococcus aureus subsp. aureus MW2
acauaccaguggaaauuaugua

SEQ ID NO: 2095062 - RNA, 19 nt, Staphylococcus aureus subsp. aureus MW2
acauaaaaaaagagaccuu

SEQ ID NO: 2095063 - RNA, 23 nt, Staphylococcus aureus subsp. aureus MW2
acaguuuuauuaucuuuguaaau

SEQ ID NO: 2095064 - RNA, 22 nt, Staphylococcus aureus subsp. aureus MW2
acaguuucuuggucugcuguau

SEQ ID NO: 2095065 - RNA, 21 nt, Staphylococcus aureus subsp. aureus MW2
acaguuucaucuucaacuuuc

SEQ ID NO: 2095066 - RNA, 19 nt, Staphylococcus aureus subsp. aureus MW2
acaguuuccauaaauaaaa

SEQ ID NO: 2095067 - RNA, 15 nt, Staphylococcus aureus subsp. aureus MW2
acauauuauaaaagu

SEQ ID NO: 2095068 - RNA, 21 nt, Staphylococcus aureus subsp. aureus MW2
acaucaauauugucuucauua

SEQ ID NO: 2095069 - RNA, 15 nt, Staphylococcus aureus subsp. aureus MW2
acaucauaauaaauc

SEQ ID NO: 2095070 - RNA, 15 nt, Staphylococcus aureus subsp. aureus MW2
acauaugacuuuauu

SEQ ID NO: 2095071 - RNA, 19 nt, Staphylococcus aureus subsp. aureus MW2
acauauguguaugauagaa

SEQ ID NO: 2095072 - RNA, 20 nt, Staphylococcus aureus subsp. aureus MW2
acauauguguaugauagaau

SEQ ID NO: 2095073 - RNA, 16 nt, Staphylococcus aureus subsp. aureus MW2
acauaugcuauaucca

SEQ ID NO: 2095074 - RNA, 16 nt, Staphylococcus aureus subsp. aureus MW2
acauauaguuguauca

SEQ ID NO: 2095075 - RNA, 13 nt, Staphylococcus aureus subsp. aureus MW2
acauauacaaauu

SEQ ID NO: 2095076 - RNA, 17 nt, Staphylococcus aureus subsp. aureus MW2
acauauacaaauuuaua

SEQ ID NO: 2095077 - RNA, 21 nt, Staphylococcus aureus subsp. aureus MW2
acaucauaauaaaucuaucua

SEQ ID NO: 2095078 - RNA, 17 nt, Staphylococcus aureus subsp. aureus MW2
acaucaucgccagcauu

SEQ ID NO: 2095079 - RNA, 15 nt, Staphylococcus aureus subsp. aureus MW2
acauccccaaaaaua

SEQ ID NO: 2095080 - RNA, 12 nt, Staphylococcus aureus subsp. aureus MW2
acaucuuuuguu

SEQ ID NO: 2095081 - RNA, 16 nt, Staphylococcus aureus subsp. aureus MW2
acaucuucuucaucau

SEQ ID NO: 2095082 - RNA, 14 nt, Staphylococcus aureus subsp. aureus MW2
acaugaacaaucag

SEQ ID NO: 2095083 - RNA, 20 nt, Staphylococcus aureus subsp. aureus MW2
acaucuuuuuaaaaggugug

SEQ ID NO: 2095084 - RNA, 13 nt, Staphylococcus aureus subsp. aureus MW2
acaucuuuuugau

SEQ ID NO: 2095085 - RNA, 17 nt, Staphylococcus aureus subsp. aureus MW2
acaucuuuuguuguuuu

SEQ ID NO: 2095086 - RNA, 15 nt, Staphylococcus aureus subsp. aureus MW2
acaucuuuuugauaa

SEQ ID NO: 2095087 - RNA, 12 nt, Staphylococcus aureus subsp. aureus MW2
acauuaauauaa

SEQ ID NO: 2095088 - RNA, 15 nt, Staphylococcus aureus subsp. aureus MW2
acauuaaucuauaua

SEQ ID NO: 2095089 - RNA, 19 nt, Staphylococcus aureus subsp. aureus MW2
acauuaaugauagcaauga

SEQ ID NO: 2095090 - RNA, 21 nt, Staphylococcus aureus subsp. aureus MW2
acauuaaucaugcguuuuaag

SEQ ID NO: 2095091 - RNA, 16 nt, Staphylococcus aureus subsp. aureus MW2
acauuaacgauuaaua

SEQ ID NO: 2095092 - RNA, 23 nt, Staphylococcus aureus subsp. aureus MW2
acauuaaagaaaauaucugaaaa

SEQ ID NO: 2095093 - RNA, 15 nt, Staphylococcus aureus subsp. aureus MW2
acauuaaaaugauau

SEQ ID NO: 2095094 - RNA, 21 nt, Staphylococcus aureus subsp. aureus MW2
acauuaaacauauuuuuugau

SEQ ID NO: 2095095 - RNA, 16 nt, Staphylococcus aureus subsp. aureus MW2
acauguuucuagauau

SEQ ID NO: 2095096 - RNA, 20 nt, Staphylococcus aureus subsp. aureus MW2
acauguuucuagauaugccu

SEQ ID NO: 2095097 - RNA, 19 nt, Staphylococcus aureus subsp. aureus MW2
acauguuuggaugaacaaa

SEQ ID NO: 2095098 - RNA, 20 nt, Staphylococcus aureus subsp. aureus MW2
acauguuuggaugaacaaaa

SEQ ID NO: 2095099 - RNA, 20 nt, Staphylococcus aureus subsp. aureus MW2
acauguuacugaugaacaua

SEQ ID NO: 2095100 - RNA, 16 nt, Staphylococcus aureus subsp. aureus MW2
acauguugauaaaaag

SEQ ID NO: 2095101 - RNA, 20 nt, Staphylococcus aureus subsp. aureus MW2
acauguugauaaaaaggauc

SEQ ID NO: 2095102 - RNA, 17 nt, Staphylococcus aureus subsp. aureus MW2
acauuggauuacuucca

SEQ ID NO: 2095103 - RNA, 16 nt, Staphylococcus aureus subsp. aureus MW2
acauugauaaaauaau

SEQ ID NO: 2095104 - RNA, 15 nt, Staphylococcus aureus subsp. aureus MW2
acauugauaaauuuu

SEQ ID NO: 2095105 - RNA, 20 nt, Staphylococcus aureus subsp. aureus MW2
acauugauuucuguaccaaa

SEQ ID NO: 2095106 - RNA, 19 nt, Staphylococcus aureus subsp. aureus MW2
acauugccacuuuuguguu

SEQ ID NO: 2095107 - RNA, 18 nt, Staphylococcus aureus subsp. aureus MW2
acauugaaaggaacauuu

SEQ ID NO: 2095108 - RNA, 22 nt, Staphylococcus aureus subsp. aureus MW2
acauugaacgauaacaauuuau

SEQ ID NO: 2095109 - RNA, 23 nt, Staphylococcus aureus subsp. aureus MW2
acauucuaacuacggaaguggua

SEQ ID NO: 2095110 - RNA, 18 nt, Staphylococcus aureus subsp. aureus MW2
acauugagauuaucuuua

SEQ ID NO: 2095111 - RNA, 12 nt, Staphylococcus aureus subsp. aureus MW2
acauucuaugua

SEQ ID NO: 2095112 - RNA, 19 nt, Staphylococcus aureus subsp. aureus MW2
acauuccaaaaccgaaaau

SEQ ID NO: 2095113 - RNA, 21 nt, Staphylococcus aureus subsp. aureus MW2
acauucauuuaguuaaauaca

SEQ ID NO: 2095114 - RNA, 19 nt, Staphylococcus aureus subsp. aureus MW2
acauucacauuauuuaaac

SEQ ID NO: 2095115 - RNA, 18 nt, Staphylococcus aureus subsp. aureus MW2
acauucagugcaaugaua

SEQ ID NO: 2095116 - RNA, 20 nt, Staphylococcus aureus subsp. aureus MW2
acauuauuguaaguuggcuu

SEQ ID NO: 2095117 - RNA, 17 nt, Staphylococcus aureus subsp. aureus MW2
acauuagcaugauaaag

SEQ ID NO: 2095118 - RNA, 16 nt, Staphylococcus aureus subsp. aureus MW2
acauuagaacaaucuc

SEQ ID NO: 2095119 - RNA, 19 nt, Staphylococcus aureus subsp. aureus MW2
acauuaguuugaucauuua

SEQ ID NO: 2095120 - RNA, 14 nt, Staphylococcus aureus subsp. aureus MW2
acauuacaucuuua

SEQ ID NO: 2095121 - RNA, 15 nt, Staphylococcus aureus subsp. aureus MW2
acauuacaucuuuaa

SEQ ID NO: 2095122 - RNA, 22 nt, Staphylococcus aureus subsp. aureus MW2
acauuguaaaaugcucccuuca

SEQ ID NO: 2095123 - RNA, 15 nt, Staphylococcus aureus subsp. aureus MW2
acauuguaaaaugcu

SEQ ID NO: 2095124 - RNA, 16 nt, Staphylococcus aureus subsp. aureus MW2
acauugguuuuuacua

SEQ ID NO: 2095125 - RNA, 15 nt, Staphylococcus aureus subsp. aureus MW2
acauugguuuuuacu

SEQ ID NO: 2095126 - RNA, 18 nt, Staphylococcus aureus subsp. aureus MW2
acauuuaaaaaaugcgcu

SEQ ID NO: 2095127 - RNA, 12 nt, Staphylococcus aureus subsp. aureus MW2
acauuuaaaaaa

SEQ ID NO: 2095128 - RNA, 14 nt, Staphylococcus aureus subsp. aureus MW2
acauuuuaaaucua

SEQ ID NO: 2095129 - RNA, 22 nt, Staphylococcus aureus subsp. aureus MW2
acauuuuaaaucuaauuauuca

SEQ ID NO: 2095130 - RNA, 15 nt, Staphylococcus aureus subsp. aureus MW2
acauuuuaauaaaau

SEQ ID NO: 2095131 - RNA, 15 nt, Staphylococcus aureus subsp. aureus MW2
acauuugguucuucu

SEQ ID NO: 2095132 - RNA, 22 nt, Staphylococcus aureus subsp. aureus MW2
acauuuguaaauauuuuuuaaa

SEQ ID NO: 2095133 - RNA, 20 nt, Staphylococcus aureus subsp. aureus MW2
acauuugaagcauuaaguuc

SEQ ID NO: 2095134 - RNA, 17 nt, Staphylococcus aureus subsp. aureus MW2
acauuugucacucuuua

SEQ ID NO: 2095135 - RNA, 22 nt, Staphylococcus aureus subsp. aureus MW2
acauuuuaauaaaaucaucuua

SEQ ID NO: 2095136 - RNA, 14 nt, Staphylococcus aureus subsp. aureus MW2
acauuuuaugucca

SEQ ID NO: 2095137 - RNA, 18 nt, Staphylococcus aureus subsp. aureus MW2
acauuuuaucugaaaaua

SEQ ID NO: 2095138 - RNA, 16 nt, Staphylococcus aureus subsp. aureus MW2
accaaauuuauaauuu

SEQ ID NO: 2095139 - RNA, 22 nt, Staphylococcus aureus subsp. aureus MW2
accaagcccaugcccgauaaaa

SEQ ID NO: 2095140 - RNA, 13 nt, Staphylococcus aureus subsp. aureus MW2
accaagaauauaa

SEQ ID NO: 2095141 - RNA, 21 nt, Staphylococcus aureus subsp. aureus MW2
accaacaauagguacaacuaa

SEQ ID NO: 2095142 - RNA, 11 nt, Staphylococcus aureus subsp. aureus MW2
accaauaauua

SEQ ID NO: 2095143 - RNA, 21 nt, Staphylococcus aureus subsp. aureus MW2
accaauacguuuccaauccau

SEQ ID NO: 2095144 - RNA, 16 nt, Staphylococcus aureus subsp. aureus MW2
accaaugauuguuaau

SEQ ID NO: 2095145 - RNA, 14 nt, Staphylococcus aureus subsp. aureus MW2
accacaacaaugaa

SEQ ID NO: 2095146 - RNA, 23 nt, Staphylococcus aureus subsp. aureus MW2
accacacuuuaaacaagcaucau

SEQ ID NO: 2095147 - RNA, 18 nt, Staphylococcus aureus subsp. aureus MW2
accagcuaaccaaauaau

SEQ ID NO: 2095148 - RNA, 23 nt, Staphylococcus aureus subsp. aureus MW2
accacuugaauacuuuuuaacug

SEQ ID NO: 2095149 - RNA, 17 nt, Staphylococcus aureus subsp. aureus MW2
accacuucuucaccugc

SEQ ID NO: 2095150 - RNA, 14 nt, Staphylococcus aureus subsp. aureus MW2
accacuucuucacc

SEQ ID NO: 2095151 - RNA, 14 nt, Staphylococcus aureus subsp. aureus MW2
accagcacaucaaa

SEQ ID NO: 2095152 - RNA, 19 nt, Staphylococcus aureus subsp. aureus MW2
accacuauaauuucuuaau

SEQ ID NO: 2095153 - RNA, 14 nt, Staphylococcus aureus subsp. aureus MW2
accaucucuauuuu

SEQ ID NO: 2095154 - RNA, 20 nt, Staphylococcus aureus subsp. aureus MW2
accaucucaacuaaucgugu

SEQ ID NO: 2095155 - RNA, 22 nt, Staphylococcus aureus subsp. aureus MW2
accaucuuuaauacgaauuuca

SEQ ID NO: 2095156 - RNA, 19 nt, Staphylococcus aureus subsp. aureus MW2
accaucuuuaauacgaauu

SEQ ID NO: 2095157 - RNA, 20 nt, Staphylococcus aureus subsp. aureus MW2
accaucuucuugauuguaaa

SEQ ID NO: 2095158 - RNA, 15 nt, Staphylococcus aureus subsp. aureus MW2
accaugauuggcuug

SEQ ID NO: 2095159 - RNA, 22 nt, Staphylococcus aureus subsp. aureus MW2
accaugaugagauaaaaucaua

SEQ ID NO: 2095160 - RNA, 18 nt, Staphylococcus aureus subsp. aureus MW2
accaugacgauuccaauc

SEQ ID NO: 2095161 - RNA, 19 nt, Staphylococcus aureus subsp. aureus MW2
accauauuuacacagaaug

SEQ ID NO: 2095162 - RNA, 21 nt, Staphylococcus aureus subsp. aureus MW2
accaucaacgccauauuuauu

SEQ ID NO: 2095163 - RNA, 23 nt, Staphylococcus aureus subsp. aureus MW2
accagcuuucguaccugcucuuu

SEQ ID NO: 2095164 - RNA, 14 nt, Staphylococcus aureus subsp. aureus MW2
accaugcucuuuuu

SEQ ID NO: 2095165 - RNA, 15 nt, Staphylococcus aureus subsp. aureus MW2
accauguuuuuuaag

SEQ ID NO: 2095166 - RNA, 14 nt, Staphylococcus aureus subsp. aureus MW2
accauuuaaaaauu

SEQ ID NO: 2095167 - RNA, 18 nt, Staphylococcus aureus subsp. aureus MW2
accauuucuuuuuucaau

SEQ ID NO: 2095168 - RNA, 23 nt, Staphylococcus aureus subsp. aureus MW2
accauuucuuuuuucaauguuug

SEQ ID NO: 2095169 - RNA, 13 nt, Staphylococcus aureus subsp. aureus MW2
accauuuuuuuau

SEQ ID NO: 2095170 - RNA, 18 nt, Staphylococcus aureus subsp. aureus MW2
acccauaauuuaaaugau

SEQ ID NO: 2095171 - RNA, 13 nt, Staphylococcus aureus subsp. aureus MW2
acccauauaauuu

SEQ ID NO: 2095172 - RNA, 23 nt, Staphylococcus aureus subsp. aureus MW2
acccauuuuuuuccaagcaucau

SEQ ID NO: 2095173 - RNA, 21 nt, Staphylococcus aureus subsp. aureus MW2
accccuuuguuugaagugaaa

SEQ ID NO: 2095174 - RNA, 13 nt, Staphylococcus aureus subsp. aureus MW2
accccuuuauuuu

SEQ ID NO: 2095175 - RNA, 16 nt, Staphylococcus aureus subsp. aureus MW2
accgaauaauuuugau

SEQ ID NO: 2095176 - RNA, 23 nt, Staphylococcus aureus subsp. aureus MW2
acccuaaaaguugaauauaauuu

SEQ ID NO: 2095177 - RNA, 17 nt, Staphylococcus aureus subsp. aureus MW2
accgcaaugccacauca

SEQ ID NO: 2095178 - RNA, 19 nt, Staphylococcus aureus subsp. aureus MW2
accgcuucucgccuaauua

SEQ ID NO: 2095179 - RNA, 19 nt, Staphylococcus aureus subsp. aureus MW2
acguauauaaguuaaaauu

SEQ ID NO: 2095180 - RNA, 18 nt, Staphylococcus aureus subsp. aureus MW2
acguauauaaguuaaaau

SEQ ID NO: 2095181 - RNA, 17 nt, Staphylococcus aureus subsp. aureus MW2
acguauauaaguuaaaa

SEQ ID NO: 2095182 - RNA, 15 nt, Staphylococcus aureus subsp. aureus MW2
acguaucaucaaaau

SEQ ID NO: 2095183 - RNA, 18 nt, Staphylococcus aureus subsp. aureus MW2
acguaucaucccauugca

SEQ ID NO: 2095184 - RNA, 16 nt, Staphylococcus aureus subsp. aureus MW2
acguaucauuuaaaau

SEQ ID NO: 2095185 - RNA, 14 nt, Staphylococcus aureus subsp. aureus MW2
acgucaacagcaua

SEQ ID NO: 2095186 - RNA, 15 nt, Staphylococcus aureus subsp. aureus MW2
acgucacuuuauuaa

SEQ ID NO: 2095187 - RNA, 19 nt, Staphylococcus aureus subsp. aureus MW2
acgucauauguuuuauaau

SEQ ID NO: 2095188 - RNA, 13 nt, Staphylococcus aureus subsp. aureus MW2
acgugaacaacau

SEQ ID NO: 2095189 - RNA, 16 nt, Staphylococcus aureus subsp. aureus MW2
acguccaaacacaaau

SEQ ID NO: 2095190 - RNA, 22 nt, Staphylococcus aureus subsp. aureus MW2
acgucuuguaucaacauuaaua

SEQ ID NO: 2095191 - RNA, 14 nt, Staphylococcus aureus subsp. aureus MW2
acguggcucuaaaa

SEQ ID NO: 2095192 - RNA, 17 nt, Staphylococcus aureus subsp. aureus MW2
acguucagguaauguuu

SEQ ID NO: 2095193 - RNA, 21 nt, Staphylococcus aureus subsp. aureus MW2
acuagcauuagcaaauauuau

SEQ ID NO: 2095194 - RNA, 19 nt, Staphylococcus aureus subsp. aureus MW2
acuagcaacaucuuuuguu

SEQ ID NO: 2095195 - RNA, 16 nt, Staphylococcus aureus subsp. aureus MW2
acuacuacauuauuac

SEQ ID NO: 2095196 - RNA, 15 nt, Staphylococcus aureus subsp. aureus MW2
acuacucauuauuaa

SEQ ID NO: 2095197 - RNA, 19 nt, Staphylococcus aureus subsp. aureus MW2
acuacacuccccuuaucaa

SEQ ID NO: 2095198 - RNA, 19 nt, Staphylococcus aureus subsp. aureus MW2
acuacacacguagaaagau

SEQ ID NO: 2095199 - RNA, 14 nt, Staphylococcus aureus subsp. aureus MW2
acuacgucaagcuu

SEQ ID NO: 2095200 - RNA, 20 nt, Staphylococcus aureus subsp. aureus MW2
acuaauuuuguacauaaaaa

SEQ ID NO: 2095201 - RNA, 22 nt, Staphylococcus aureus subsp. aureus MW2
acuaauuuuguacauaaaaaua

SEQ ID NO: 2095202 - RNA, 16 nt, Staphylococcus aureus subsp. aureus MW2
acuauaauaauuggaa

SEQ ID NO: 2095203 - RNA, 16 nt, Staphylococcus aureus subsp. aureus MW2
acuauacugaugaaaa

SEQ ID NO: 2095204 - RNA, 22 nt, Staphylococcus aureus subsp. aureus MW2
acuauauucaauuuaauagaca

SEQ ID NO: 2095205 - RNA, 17 nt, Staphylococcus aureus subsp. aureus MW2
acuauaugugucgagua

SEQ ID NO: 2095206 - RNA, 16 nt, Staphylococcus aureus subsp. aureus MW2
acuauauucaauuuaa

SEQ ID NO: 2095207 - RNA, 22 nt, Staphylococcus aureus subsp. aureus MW2
acuauaugaaaagagaaacaaa

SEQ ID NO: 2095208 - RNA, 20 nt, Staphylococcus aureus subsp. aureus MW2
acuaguaaaucaaagaugac

SEQ ID NO: 2095209 - RNA, 20 nt, Staphylococcus aureus subsp. aureus MW2
acuaguauccuuuauaaaua

SEQ ID NO: 2095210 - RNA, 23 nt, Staphylococcus aureus subsp. aureus MW2
acuaguauccuuuauaaauaaac

SEQ ID NO: 2095211 - RNA, 16 nt, Staphylococcus aureus subsp. aureus MW2
acuagggguuuuuaau

SEQ ID NO: 2095212 - RNA, 14 nt, Staphylococcus aureus subsp. aureus MW2
acuagggguuuuua

SEQ ID NO: 2095213 - RNA, 23 nt, Staphylococcus aureus subsp. aureus MW2
acuaggaauauaaaacugugcau

SEQ ID NO: 2095214 - RNA, 19 nt, Staphylococcus aureus subsp. aureus MW2
acuagcuaaugcacgugag

SEQ ID NO: 2095215 - RNA, 13 nt, Staphylococcus aureus subsp. aureus MW2
acuaauauauuua

SEQ ID NO: 2095216 - RNA, 14 nt, Staphylococcus aureus subsp. aureus MW2
acuaauaauugucc

SEQ ID NO: 2095217 - RNA, 16 nt, Staphylococcus aureus subsp. aureus MW2
acuaauaauuuguaau

SEQ ID NO: 2095218 - RNA, 17 nt, Staphylococcus aureus subsp. aureus MW2
acuaaguuuguuuucuu

SEQ ID NO: 2095219 - RNA, 18 nt, Staphylococcus aureus subsp. aureus MW2
acuaaguuuguuuucuuu

SEQ ID NO: 2095220 - RNA, 14 nt, Staphylococcus aureus subsp. aureus MW2
acuaauauuuaaaa

SEQ ID NO: 2095221 - RNA, 20 nt, Staphylococcus aureus subsp. aureus MW2
acuaauauuuaaaaaacaaa

SEQ ID NO: 2095222 - RNA, 18 nt, Staphylococcus aureus subsp. aureus MW2
acuaaucaaauuagucau

SEQ ID NO: 2095223 - RNA, 20 nt, Staphylococcus aureus subsp. aureus MW2
acuaaucguuccaacaacua

SEQ ID NO: 2095224 - RNA, 23 nt, Staphylococcus aureus subsp. aureus MW2
acuaaucaauacuaaaccaauga

SEQ ID NO: 2095225 - RNA, 21 nt, Staphylococcus aureus subsp. aureus MW2
acuaaguauguauaguguuaa

SEQ ID NO: 2095226 - RNA, 21 nt, Staphylococcus aureus subsp. aureus MW2
acuaagcagucugcucuuuuu

SEQ ID NO: 2095227 - RNA, 14 nt, Staphylococcus aureus subsp. aureus MW2
acuaagauauauug

SEQ ID NO: 2095228 - RNA, 16 nt, Staphylococcus aureus subsp. aureus MW2
acuaaccuauuaaaau

SEQ ID NO: 2095229 - RNA, 22 nt, Staphylococcus aureus subsp. aureus MW2
acuaaaugaauugcuuguucuu

SEQ ID NO: 2095230 - RNA, 16 nt, Staphylococcus aureus subsp. aureus MW2
acuaaauucaauaauc

SEQ ID NO: 2095231 - RNA, 16 nt, Staphylococcus aureus subsp. aureus MW2
acguucuaauaauuua

SEQ ID NO: 2095232 - RNA, 12 nt, Staphylococcus aureus subsp. aureus MW2
acucauuuuuug

SEQ ID NO: 2095233 - RNA, 20 nt, Staphylococcus aureus subsp. aureus MW2
acucauguaacguaaaaaug

SEQ ID NO: 2095234 - RNA, 21 nt, Staphylococcus aureus subsp. aureus MW2
acucaucuguccgauaucuuu

SEQ ID NO: 2095235 - RNA, 16 nt, Staphylococcus aureus subsp. aureus MW2
acucaugcacuuuauu

SEQ ID NO: 2095236 - RNA, 21 nt, Staphylococcus aureus subsp. aureus MW2
acucauccauugaucuuuuau

SEQ ID NO: 2095237 - RNA, 17 nt, Staphylococcus aureus subsp. aureus MW2
acucauccauugaucuu

SEQ ID NO: 2095238 - RNA, 18 nt, Staphylococcus aureus subsp. aureus MW2
acuccauagaaauuguag

SEQ ID NO: 2095239 - RNA, 17 nt, Staphylococcus aureus subsp. aureus MW2
acucaggcuuaauuaau

SEQ ID NO: 2095240 - RNA, 21 nt, Staphylococcus aureus subsp. aureus MW2
acucauacaaauuuuuuuuau

SEQ ID NO: 2095241 - RNA, 19 nt, Staphylococcus aureus subsp. aureus MW2
acucauaaccgcuucuuuu

SEQ ID NO: 2095242 - RNA, 13 nt, Staphylococcus aureus subsp. aureus MW2
acucagauuuuau

SEQ ID NO: 2095243 - RNA, 13 nt, Staphylococcus aureus subsp. aureus MW2
acucacuucaacg

SEQ ID NO: 2095244 - RNA, 12 nt, Staphylococcus aureus subsp. aureus MW2
acucacuucuua

SEQ ID NO: 2095245 - RNA, 18 nt, Staphylococcus aureus subsp. aureus MW2
acucaauuucauuugaaa

SEQ ID NO: 2095246 - RNA, 15 nt, Staphylococcus aureus subsp. aureus MW2
acucaauuucauuug

SEQ ID NO: 2095247 - RNA, 21 nt, Staphylococcus aureus subsp. aureus MW2
acuaugcaaaugaaauucuuu

SEQ ID NO: 2095248 - RNA, 20 nt, Staphylococcus aureus subsp. aureus MW2
acuaugcauaauaccaauug

SEQ ID NO: 2095249 - RNA, 14 nt, Staphylococcus aureus subsp. aureus MW2
acuaugcaaaugaa

SEQ ID NO: 2095250 - RNA, 14 nt, Staphylococcus aureus subsp. aureus MW2
acuaucuauaauac

SEQ ID NO: 2095251 - RNA, 15 nt, Staphylococcus aureus subsp. aureus MW2
acuaucuucaucaua

SEQ ID NO: 2095252 - RNA, 18 nt, Staphylococcus aureus subsp. aureus MW2
acuaucuucaucauauuc

SEQ ID NO: 2095253 - RNA, 16 nt, Staphylococcus aureus subsp. aureus MW2
acucguugcgcucuuu

SEQ ID NO: 2095254 - RNA, 21 nt, Staphylococcus aureus subsp. aureus MW2
acucguugcgcucuuuucuug

SEQ ID NO: 2095255 - RNA, 23 nt, Staphylococcus aureus subsp. aureus MW2
acucguugcgcucuuuucuuguu

SEQ ID NO: 2095256 - RNA, 19 nt, Staphylococcus aureus subsp. aureus MW2
acucguaaauuuuaucuaa

SEQ ID NO: 2095257 - RNA, 24 nt, Staphylococcus aureus subsp. aureus MW2
acucguaaauuuuaucuaaacauu

SEQ ID NO: 2095258 - RNA, 19 nt, Staphylococcus aureus subsp. aureus MW2
acucgcccccguaauaauu

SEQ ID NO: 2095259 - RNA, 22 nt, Staphylococcus aureus subsp. aureus MW2
acugacacuuuaaccacuccuu

SEQ ID NO: 2095260 - RNA, 16 nt, Staphylococcus aureus subsp. aureus MW2
acugacacaguaauuc

SEQ ID NO: 2095261 - RNA, 22 nt, Staphylococcus aureus subsp. aureus MW2
acugaaauuucauaaaguuuau

SEQ ID NO: 2095262 - RNA, 18 nt, Staphylococcus aureus subsp. aureus MW2
acugaaugcuaauacuaa

SEQ ID NO: 2095263 - RNA, 13 nt, Staphylococcus aureus subsp. aureus MW2
acgccuuuccauu

SEQ ID NO: 2095264 - RNA, 23 nt, Staphylococcus aureus subsp. aureus MW2
acgccuuggccuacuuuuucaau

SEQ ID NO: 2095265 - RNA, 23 nt, Staphylococcus aureus subsp. aureus MW2
acgcauacaggaaauugaagcgu

SEQ ID NO: 2095266 - RNA, 23 nt, Staphylococcus aureus subsp. aureus MW2
acgcauuacuuuagaaagugauu

SEQ ID NO: 2095267 - RNA, 15 nt, Staphylococcus aureus subsp. aureus MW2
acgccauaagaaaau

SEQ ID NO: 2095268 - RNA, 16 nt, Staphylococcus aureus subsp. aureus MW2
acgccauaagaaaaua

SEQ ID NO: 2095269 - RNA, 22 nt, Staphylococcus aureus subsp. aureus MW2
acgcuaauggaugaauauauug

SEQ ID NO: 2095270 - RNA, 18 nt, Staphylococcus aureus subsp. aureus MW2
acgcguuauagauaagua

SEQ ID NO: 2095271 - RNA, 16 nt, Staphylococcus aureus subsp. aureus MW2
acgcucuucuucuuca

SEQ ID NO: 2095272 - RNA, 23 nt, Staphylococcus aureus subsp. aureus MW2
acgcucaugaguuucucaucuac

SEQ ID NO: 2095273 - RNA, 15 nt, Staphylococcus aureus subsp. aureus MW2
acgcggguaauauuu

SEQ ID NO: 2095274 - RNA, 15 nt, Staphylococcus aureus subsp. aureus MW2
acgcuucaauuauuu

SEQ ID NO: 2095275 - RNA, 17 nt, Staphylococcus aureus subsp. aureus MW2
acgcuucaauuauuuca

SEQ ID NO: 2095276 - RNA, 14 nt, Staphylococcus aureus subsp. aureus MW2
acgcuuuaaaucau

SEQ ID NO: 2095277 - RNA, 15 nt, Staphylococcus aureus subsp. aureus MW2
acgcuuuaaaucauu

SEQ ID NO: 2095278 - RNA, 21 nt, Staphylococcus aureus subsp. aureus MW2
acgcuuauugaaaagauaaac

SEQ ID NO: 2095279 - RNA, 14 nt, Staphylococcus aureus subsp. aureus MW2
acggcugcuuuaac

SEQ ID NO: 2095280 - RNA, 15 nt, Staphylococcus aureus subsp. aureus MW2
agaauauaaacuauu

SEQ ID NO: 2095281 - RNA, 17 nt, Staphylococcus aureus subsp. aureus MW2
agaauauaaacuauuaa

SEQ ID NO: 2095282 - RNA, 20 nt, Staphylococcus aureus subsp. aureus MW2
agaauauaaacuauuaaauc

SEQ ID NO: 2095283 - RNA, 14 nt, Staphylococcus aureus subsp. aureus MW2
agaauauaaaauaa

SEQ ID NO: 2095284 - RNA, 15 nt, Staphylococcus aureus subsp. aureus MW2
agaauauaaaauaau

SEQ ID NO: 2095285 - RNA, 20 nt, Staphylococcus aureus subsp. aureus MW2
agaauaacgucauauguuuu

SEQ ID NO: 2095286 - RNA, 12 nt, Staphylococcus aureus subsp. aureus MW2
agaauaaaaggc

SEQ ID NO: 2095287 - RNA, 16 nt, Staphylococcus aureus subsp. aureus MW2
agaauaaacaacauac

SEQ ID NO: 2095288 - RNA, 14 nt, Staphylococcus aureus subsp. aureus MW2
agaauaaacuuuau

SEQ ID NO: 2095289 - RNA, 14 nt, Staphylococcus aureus subsp. aureus MW2
agaaguucuuaugc

SEQ ID NO: 2095290 - RNA, 15 nt, Staphylococcus aureus subsp. aureus MW2
agaaguuuuuugauu

SEQ ID NO: 2095291 - RNA, 16 nt, Staphylococcus aureus subsp. aureus MW2
agaaugccauaccugc

SEQ ID NO: 2095292 - RNA, 18 nt, Staphylococcus aureus subsp. aureus MW2
agaaugcaccaacaauag

SEQ ID NO: 2095293 - RNA, 15 nt, Staphylococcus aureus subsp. aureus MW2
agaaugauacuguau

SEQ ID NO: 2095294 - RNA, 13 nt, Staphylococcus aureus subsp. aureus MW2
agaaucaucuaaa

SEQ ID NO: 2095295 - RNA, 21 nt, Staphylococcus aureus subsp. aureus MW2
agaaauucgcaagccuucuau

SEQ ID NO: 2095296 - RNA, 19 nt, Staphylococcus aureus subsp. aureus MW2
agaaauguaugacauaaac

SEQ ID NO: 2095297 - RNA, 17 nt, Staphylococcus aureus subsp. aureus MW2
agaaauucuacaaacaa

SEQ ID NO: 2095298 - RNA, 16 nt, Staphylococcus aureus subsp. aureus MW2
agaaauucuacaaaca

SEQ ID NO: 2095299 - RNA, 19 nt, Staphylococcus aureus subsp. aureus MW2
agaaauucuacaggcaaug

SEQ ID NO: 2095300 - RNA, 23 nt, Staphylococcus aureus subsp. aureus MW2
agaagucugaugucgaaaauagc

SEQ ID NO: 2095301 - RNA, 13 nt, Staphylococcus aureus subsp. aureus MW2
agaauuaaagucu

SEQ ID NO: 2095302 - RNA, 20 nt, Staphylococcus aureus subsp. aureus MW2
agacaauguucuuuucaaca

SEQ ID NO: 2095303 - RNA, 20 nt, Staphylococcus aureus subsp. aureus MW2
agacaauuucuauuuaaaca

SEQ ID NO: 2095304 - RNA, 21 nt, Staphylococcus aureus subsp. aureus MW2
agacaaugauuugugguaauc

SEQ ID NO: 2095305 - RNA, 13 nt, Staphylococcus aureus subsp. aureus MW2
agacaaugcaagu

SEQ ID NO: 2095306 - RNA, 17 nt, Staphylococcus aureus subsp. aureus MW2
agacaaugcaaguuggc

SEQ ID NO: 2095307 - RNA, 14 nt, Staphylococcus aureus subsp. aureus MW2
agacaccaaaaaca

SEQ ID NO: 2095308 - RNA, 12 nt, Staphylococcus aureus subsp. aureus MW2
agacgaacauca

SEQ ID NO: 2095309 - RNA, 15 nt, Staphylococcus aureus subsp. aureus MW2
agacgaacaucaucu

SEQ ID NO: 2095310 - RNA, 12 nt, Staphylococcus aureus subsp. aureus MW2
agacauuaaaaa

SEQ ID NO: 2095311 - RNA, 15 nt, Staphylococcus aureus subsp. aureus MW2
agacaugagauuauu

SEQ ID NO: 2095312 - RNA, 22 nt, Staphylococcus aureus subsp. aureus MW2
agacauugaaaggaacauuuca

SEQ ID NO: 2095313 - RNA, 16 nt, Staphylococcus aureus subsp. aureus MW2
agacauuucuucaauu

SEQ ID NO: 2095314 - RNA, 17 nt, Staphylococcus aureus subsp. aureus MW2
agacauuuuaucugaaa

SEQ ID NO: 2095315 - RNA, 14 nt, Staphylococcus aureus subsp. aureus MW2
agacucacuucuua

SEQ ID NO: 2095316 - RNA, 13 nt, Staphylococcus aureus subsp. aureus MW2
agacucacuucuu

SEQ ID NO: 2095317 - RNA, 22 nt, Staphylococcus aureus subsp. aureus MW2
agacucauacacaaugccuuua

SEQ ID NO: 2095318 - RNA, 14 nt, Staphylococcus aureus subsp. aureus MW2
agacgccgaaaaga

SEQ ID NO: 2095319 - RNA, 16 nt, Staphylococcus aureus subsp. aureus MW2
agacucuaaaauguuc

SEQ ID NO: 2095320 - RNA, 13 nt, Staphylococcus aureus subsp. aureus MW2
agacuccuaaauu

SEQ ID NO: 2095321 - RNA, 17 nt, Staphylococcus aureus subsp. aureus MW2
agacuccuaaauuauug

SEQ ID NO: 2095322 - RNA, 24 nt, Staphylococcus aureus subsp. aureus MW2
agacuugguuacuuaguaaggaau

SEQ ID NO: 2095323 - RNA, 22 nt, Staphylococcus aureus subsp. aureus MW2
agacuugguuacuuaguaagga

SEQ ID NO: 2095324 - RNA, 19 nt, Staphylococcus aureus subsp. aureus MW2
agagaaauauaguaacaga

SEQ ID NO: 2095325 - RNA, 21 nt, Staphylococcus aureus subsp. aureus MW2
agagaaacaaaacaaaaaaua

SEQ ID NO: 2095326 - RNA, 16 nt, Staphylococcus aureus subsp. aureus MW2
agagaaacaaaacaaa

SEQ ID NO: 2095327 - RNA, 16 nt, Staphylococcus aureus subsp. aureus MW2
agagaaaagcuagaag

SEQ ID NO: 2095328 - RNA, 23 nt, Staphylococcus aureus subsp. aureus MW2
agagaaaaaauaaauguuaaaga

SEQ ID NO: 2095329 - RNA, 23 nt, Staphylococcus aureus subsp. aureus MW2
agacuuucuuaauugaauuaaau

SEQ ID NO: 2095330 - RNA, 18 nt, Staphylococcus aureus subsp. aureus MW2
agagaauuucgaaaagaa

SEQ ID NO: 2095331 - RNA, 13 nt, Staphylococcus aureus subsp. aureus MW2
agagaauuucaaa

SEQ ID NO: 2095332 - RNA, 15 nt, Staphylococcus aureus subsp. aureus MW2
agagaauuucaaaaa

SEQ ID NO: 2095333 - RNA, 19 nt, Staphylococcus aureus subsp. aureus MW2
agagaauuucaaaaaggaa

SEQ ID NO: 2095334 - RNA, 13 nt, Staphylococcus aureus subsp. aureus MW2
agagaaucaauua

SEQ ID NO: 2095335 - RNA, 17 nt, Staphylococcus aureus subsp. aureus MW2
agagaauauaaaauaau

SEQ ID NO: 2095336 - RNA, 20 nt, Staphylococcus aureus subsp. aureus MW2
agagaaauuugauuuucaau

SEQ ID NO: 2095337 - RNA, 12 nt, Staphylococcus aureus subsp. aureus MW2
agagaacagcag

SEQ ID NO: 2095338 - RNA, 20 nt, Staphylococcus aureus subsp. aureus MW2
agauaacuagaaugauuaaa

SEQ ID NO: 2095339 - RNA, 15 nt, Staphylococcus aureus subsp. aureus MW2
agauaaauuaauaug

SEQ ID NO: 2095340 - RNA, 16 nt, Staphylococcus aureus subsp. aureus MW2
agauaaauuaauauga

SEQ ID NO: 2095341 - RNA, 18 nt, Staphylococcus aureus subsp. aureus MW2
agauaaagcuucgucaau

SEQ ID NO: 2095342 - RNA, 19 nt, Staphylococcus aureus subsp. aureus MW2
agauaaaucgauaaaaugu

SEQ ID NO: 2095343 - RNA, 12 nt, Staphylococcus aureus subsp. aureus MW2
agauaaaaaaua

SEQ ID NO: 2095344 - RNA, 13 nt, Staphylococcus aureus subsp. aureus MW2
agagcguuuugcu

SEQ ID NO: 2095345 - RNA, 18 nt, Staphylococcus aureus subsp. aureus MW2
agagcucaagacauuaca

SEQ ID NO: 2095346 - RNA, 16 nt, Staphylococcus aureus subsp. aureus MW2
agagccgugaaagaaa

SEQ ID NO: 2095347 - RNA, 22 nt, Staphylococcus aureus subsp. aureus MW2
agagccgugaaagaaaaaacuu

SEQ ID NO: 2095348 - RNA, 20 nt, Staphylococcus aureus subsp. aureus MW2
agaggcaaucuugaacaauu

SEQ ID NO: 2095349 - RNA, 23 nt, Staphylococcus aureus subsp. aureus MW2
agagacugaagagcuuuuaguaa

SEQ ID NO: 2095350 - RNA, 17 nt, Staphylococcus aureus subsp. aureus MW2
acuuuucaacuuuaguu

SEQ ID NO: 2095351 - RNA, 15 nt, Staphylococcus aureus subsp. aureus MW2
acuuuucaauauuag

SEQ ID NO: 2095352 - RNA, 11 nt, Staphylococcus aureus subsp. aureus MW2
agaaaaaaauc

SEQ ID NO: 2095353 - RNA, 14 nt, Staphylococcus aureus subsp. aureus MW2
agaaaaaauaaaug

SEQ ID NO: 2095354 - RNA, 22 nt, Staphylococcus aureus subsp. aureus MW2
agaaaagcagucgaacaaugau

SEQ ID NO: 2095355 - RNA, 18 nt, Staphylococcus aureus subsp. aureus MW2
agaaaaggauuauaggua

SEQ ID NO: 2095356 - RNA, 17 nt, Staphylococcus aureus subsp. aureus MW2
agaaaagcuagaaguuc

SEQ ID NO: 2095357 - RNA, 21 nt, Staphylococcus aureus subsp. aureus MW2
agaaaagcuagaaguucuuau

SEQ ID NO: 2095358 - RNA, 23 nt, Staphylococcus aureus subsp. aureus MW2
agaaaaggcucauuuguuaaauu

SEQ ID NO: 2095359 - RNA, 16 nt, Staphylococcus aureus subsp. aureus MW2
agaaaaguaaguaaaa

SEQ ID NO: 2095360 - RNA, 20 nt, Staphylococcus aureus subsp. aureus MW2
agaaaaguaaguaaaauaaa

SEQ ID NO: 2095361 - RNA, 16 nt, Staphylococcus aureus subsp. aureus MW2
agaaacacaaggaaua

SEQ ID NO: 2095362 - RNA, 13 nt, Staphylococcus aureus subsp. aureus MW2
agaaacacaagga

SEQ ID NO: 2095363 - RNA, 22 nt, Staphylococcus aureus subsp. aureus MW2
agaaacaaugcgaagaaaucau

SEQ ID NO: 2095364 - RNA, 17 nt, Staphylococcus aureus subsp. aureus MW2
agaaaguuuuauuuaaa

SEQ ID NO: 2095365 - RNA, 14 nt, Staphylococcus aureus subsp. aureus MW2
agaaagauguguau

SEQ ID NO: 2095366 - RNA, 22 nt, Staphylococcus aureus subsp. aureus MW2
agaaaucagcuuuucuucaacu

SEQ ID NO: 2095367 - RNA, 17 nt, Staphylococcus aureus subsp. aureus MW2
agaaaucucuaucgccu

SEQ ID NO: 2095368 - RNA, 14 nt, Staphylococcus aureus subsp. aureus MW2
agaaauaauuuaaa

SEQ ID NO: 2095369 - RNA, 19 nt, Staphylococcus aureus subsp. aureus MW2
acuuguucaacaacugcga

SEQ ID NO: 2095370 - RNA, 22 nt, Staphylococcus aureus subsp. aureus MW2
acuugugcgcgacguuuaaaug

SEQ ID NO: 2095371 - RNA, 17 nt, Staphylococcus aureus subsp. aureus MW2
acuugucguauucuuca

SEQ ID NO: 2095372 - RNA, 16 nt, Staphylococcus aureus subsp. aureus MW2
acuugucuuuuuuaaa

SEQ ID NO: 2095373 - RNA, 18 nt, Staphylococcus aureus subsp. aureus MW2
acuugugauauauaacca

SEQ ID NO: 2095374 - RNA, 21 nt, Staphylococcus aureus subsp. aureus MW2
acuuguccguuuuauauuuau

SEQ ID NO: 2095375 - RNA, 23 nt, Staphylococcus aureus subsp. aureus MW2
acuuuaaaaauuaaguaauagca

SEQ ID NO: 2095376 - RNA, 16 nt, Staphylococcus aureus subsp. aureus MW2
acuuguuuguuuuugu

SEQ ID NO: 2095377 - RNA, 22 nt, Staphylococcus aureus subsp. aureus MW2
acuuuaaaguuaaaguuuuguu

SEQ ID NO: 2095378 - RNA, 16 nt, Staphylococcus aureus subsp. aureus MW2
acuuuaaauacauaua

SEQ ID NO: 2095379 - RNA, 16 nt, Staphylococcus aureus subsp. aureus MW2
acuuuaacaauuuuau

SEQ ID NO: 2095380 - RNA, 23 nt, Staphylococcus aureus subsp. aureus MW2
acuuuaaccacuccuuaaacaaa

SEQ ID NO: 2095381 - RNA, 11 nt, Staphylococcus aureus subsp. aureus MW2
acuuuaacuuc

SEQ ID NO: 2095382 - RNA, 22 nt, Staphylococcus aureus subsp. aureus MW2
acuuuaauacuaccguuuuuau

SEQ ID NO: 2095383 - RNA, 21 nt, Staphylococcus aureus subsp. aureus MW2
acuuuaauacuaccguuuuua

SEQ ID NO: 2095384 - RNA, 13 nt, Staphylococcus aureus subsp. aureus MW2
acuuuaccaucuu

SEQ ID NO: 2095385 - RNA, 23 nt, Staphylococcus aureus subsp. aureus MW2
acuuucaaacaaaucuuuuaaau

SEQ ID NO: 2095386 - RNA, 13 nt, Staphylococcus aureus subsp. aureus MW2
acuuuauuuuucc

SEQ ID NO: 2095387 - RNA, 20 nt, Staphylococcus aureus subsp. aureus MW2
acuuucaaacaaaucuuuua

SEQ ID NO: 2095388 - RNA, 17 nt, Staphylococcus aureus subsp. aureus MW2
acuuucacaauaucacu

SEQ ID NO: 2095389 - RNA, 15 nt, Staphylococcus aureus subsp. aureus MW2
acuuucacuuuuuau

SEQ ID NO: 2095390 - RNA, 19 nt, Staphylococcus aureus subsp. aureus MW2
acuuucagucguuaaaaua

SEQ ID NO: 2095391 - RNA, 14 nt, Staphylococcus aureus subsp. aureus MW2
acuuuaguauuaua

SEQ ID NO: 2095392 - RNA, 11 nt, Staphylococcus aureus subsp. aureus MW2
acuuuagcauu

SEQ ID NO: 2095393 - RNA, 15 nt, Staphylococcus aureus subsp. aureus MW2
acuuuagaaagugau

SEQ ID NO: 2095394 - RNA, 16 nt, Staphylococcus aureus subsp. aureus MW2
acuuuaucuauuucua

SEQ ID NO: 2095395 - RNA, 20 nt, Staphylococcus aureus subsp. aureus MW2
acuuuaucuauuucuauaua

SEQ ID NO: 2095396 - RNA, 19 nt, Staphylococcus aureus subsp. aureus MW2
acuuugucuuuaaugaaag

SEQ ID NO: 2095397 - RNA, 15 nt, Staphylococcus aureus subsp. aureus MW2
acuuuguuaaaaaau

SEQ ID NO: 2095398 - RNA, 16 nt, Staphylococcus aureus subsp. aureus MW2
acuuuguaauucuugu

SEQ ID NO: 2095399 - RNA, 15 nt, Staphylococcus aureus subsp. aureus MW2
acuuuggcaaaguca

SEQ ID NO: 2095400 - RNA, 21 nt, Staphylococcus aureus subsp. aureus MW2
acuuuggcagacguaucauca

SEQ ID NO: 2095401 - RNA, 19 nt, Staphylococcus aureus subsp. aureus MW2
acuuuggcaucauaauuaa

SEQ ID NO: 2095402 - RNA, 22 nt, Staphylococcus aureus subsp. aureus MW2
acuuuggcaucauaauuaaaua

SEQ ID NO: 2095403 - RNA, 14 nt, Staphylococcus aureus subsp. aureus MW2
acuuugauauguuu

SEQ ID NO: 2095404 - RNA, 20 nt, Staphylococcus aureus subsp. aureus MW2
acuuugauaucuacagagaa

SEQ ID NO: 2095405 - RNA, 19 nt, Staphylococcus aureus subsp. aureus MW2
acuuugaucuuuaaauaua

SEQ ID NO: 2095406 - RNA, 22 nt, Staphylococcus aureus subsp. aureus MW2
acuuugagcggaaauaugauug

SEQ ID NO: 2095407 - RNA, 17 nt, Staphylococcus aureus subsp. aureus MW2
acuuugauauguuuccu

SEQ ID NO: 2095408 - RNA, 16 nt, Staphylococcus aureus subsp. aureus MW2
acuuucucuaaaggua

SEQ ID NO: 2095409 - RNA, 22 nt, Staphylococcus aureus subsp. aureus MW2
acuuucucaucuauuuaauaau

SEQ ID NO: 2095410 - RNA, 18 nt, Staphylococcus aureus subsp. aureus MW2
acuuuccgccuucaaucc

SEQ ID NO: 2095411 - RNA, 15 nt, Staphylococcus aureus subsp. aureus MW2
acuuucccuacugcu

SEQ ID NO: 2095412 - RNA, 16 nt, Staphylococcus aureus subsp. aureus MW2
acuuucuaaagcaauu

SEQ ID NO: 2095413 - RNA, 15 nt, Staphylococcus aureus subsp. aureus MW2
acuuucgcuugcaaa

SEQ ID NO: 2095414 - RNA, 19 nt, Staphylococcus aureus subsp. aureus MW2
acuuaccgcugcuuuuacu

SEQ ID NO: 2095415 - RNA, 20 nt, Staphylococcus aureus subsp. aureus MW2
acuuacugugaaaauaccaa

SEQ ID NO: 2095416 - RNA, 13 nt, Staphylococcus aureus subsp. aureus MW2
acuuacugcugcu

SEQ ID NO: 2095417 - RNA, 17 nt, Staphylococcus aureus subsp. aureus MW2
acuuacauuacauauau

SEQ ID NO: 2095418 - RNA, 23 nt, Staphylococcus aureus subsp. aureus MW2
acuuaccaugaugagauaaaauc

SEQ ID NO: 2095419 - RNA, 22 nt, Staphylococcus aureus subsp. aureus MW2
acuuacaaauauuguggaaaac

SEQ ID NO: 2095420 - RNA, 12 nt, Staphylococcus aureus subsp. aureus MW2
acuuacaaauau

SEQ ID NO: 2095421 - RNA, 15 nt, Staphylococcus aureus subsp. aureus MW2
acuuauuaauuaaua

SEQ ID NO: 2095422 - RNA, 14 nt, Staphylococcus aureus subsp. aureus MW2
acuuauuaauuaau

SEQ ID NO: 2095423 - RNA, 12 nt, Staphylococcus aureus subsp. aureus MW2
acuuauucuuca

SEQ ID NO: 2095424 - RNA, 18 nt, Staphylococcus aureus subsp. aureus MW2
acuuauucuucacuuuca

SEQ ID NO: 2095425 - RNA, 15 nt, Staphylococcus aureus subsp. aureus MW2
acuuauuauuuugua

SEQ ID NO: 2095426 - RNA, 22 nt, Staphylococcus aureus subsp. aureus MW2
acuuaugcucaucuacuuaaaa

SEQ ID NO: 2095427 - RNA, 18 nt, Staphylococcus aureus subsp. aureus MW2
acuuauggguucaauauc

SEQ ID NO: 2095428 - RNA, 13 nt, Staphylococcus aureus subsp. aureus MW2
acuuacuuuucua

SEQ ID NO: 2095429 - RNA, 22 nt, Staphylococcus aureus subsp. aureus MW2
acuuagaccccuaauuaaaaug

SEQ ID NO: 2095430 - RNA, 15 nt, Staphylococcus aureus subsp. aureus MW2
acuuauuugaaugca

SEQ ID NO: 2095431 - RNA, 18 nt, Staphylococcus aureus subsp. aureus MW2
acuuauuugaaugcaaau

SEQ ID NO: 2095432 - RNA, 23 nt, Staphylococcus aureus subsp. aureus MW2
acuucaaagcaucuaauccccaa

SEQ ID NO: 2095433 - RNA, 21 nt, Staphylococcus aureus subsp. aureus MW2
acuucaucuguccgauuuaau

SEQ ID NO: 2095434 - RNA, 15 nt, Staphylococcus aureus subsp. aureus MW2
acuucauuacaaaca

SEQ ID NO: 2095435 - RNA, 21 nt, Staphylococcus aureus subsp. aureus MW2
acuucauuacaaacauaauca

SEQ ID NO: 2095436 - RNA, 15 nt, Staphylococcus aureus subsp. aureus MW2
acuucauuaguugcc

SEQ ID NO: 2095437 - RNA, 17 nt, Staphylococcus aureus subsp. aureus MW2
acuucauaagucacagu

SEQ ID NO: 2095438 - RNA, 13 nt, Staphylococcus aureus subsp. aureus MW2
acuucauaaguca

SEQ ID NO: 2095439 - RNA, 13 nt, Staphylococcus aureus subsp. aureus MW2
acuucauauaagu

SEQ ID NO: 2095440 - RNA, 15 nt, Staphylococcus aureus subsp. aureus MW2
acuguuggaauaccu

SEQ ID NO: 2095441 - RNA, 21 nt, Staphylococcus aureus subsp. aureus MW2
acuguuucacguaaugaauca

SEQ ID NO: 2095442 - RNA, 22 nt, Staphylococcus aureus subsp. aureus MW2
acuuaauuaauaauuuaacuaa

SEQ ID NO: 2095443 - RNA, 20 nt, Staphylococcus aureus subsp. aureus MW2
acuguuuguuuauugagaau

SEQ ID NO: 2095444 - RNA, 19 nt, Staphylococcus aureus subsp. aureus MW2
acugugauauuaauugaaa

SEQ ID NO: 2095445 - RNA, 13 nt, Staphylococcus aureus subsp. aureus MW2
acuguaaaucauc

SEQ ID NO: 2095446 - RNA, 23 nt, Staphylococcus aureus subsp. aureus MW2
acuguauaaauaaccgcacuuuc

SEQ ID NO: 2095447 - RNA, 18 nt, Staphylococcus aureus subsp. aureus MW2
acuguaguggaagacaau

SEQ ID NO: 2095448 - RNA, 15 nt, Staphylococcus aureus subsp. aureus MW2
acugucaucuuuaua

SEQ ID NO: 2095449 - RNA, 17 nt, Staphylococcus aureus subsp. aureus MW2
acugucaugaaguaauu

SEQ ID NO: 2095450 - RNA, 15 nt, Staphylococcus aureus subsp. aureus MW2
acuucuaauuugcaa

SEQ ID NO: 2095451 - RNA, 15 nt, Staphylococcus aureus subsp. aureus MW2
acuucuaauaguaau

SEQ ID NO: 2095452 - RNA, 19 nt, Staphylococcus aureus subsp. aureus MW2
acuucuccauggcuuaaau

SEQ ID NO: 2095453 - RNA, 22 nt, Staphylococcus aureus subsp. aureus MW2
acuucuauuuuauaauaaauuu

SEQ ID NO: 2095454 - RNA, 22 nt, Staphylococcus aureus subsp. aureus MW2
acuucuauauuaauagaaagug

SEQ ID NO: 2095455 - RNA, 22 nt, Staphylococcus aureus subsp. aureus MW2
acuucuaauuugcaaaaucaac

SEQ ID NO: 2095456 - RNA, 14 nt, Staphylococcus aureus subsp. aureus MW2
acuuccaucaaucc

SEQ ID NO: 2095457 - RNA, 18 nt, Staphylococcus aureus subsp. aureus MW2
acuucuuuauauuuauca

SEQ ID NO: 2095458 - RNA, 21 nt, Staphylococcus aureus subsp. aureus MW2
acuucuuuagcaaaacgcauu

SEQ ID NO: 2095459 - RNA, 15 nt, Staphylococcus aureus subsp. aureus MW2
acuucuuuauauuua

SEQ ID NO: 2095460 - RNA, 16 nt, Staphylococcus aureus subsp. aureus MW2
acuucuuuuguuuuac

SEQ ID NO: 2095461 - RNA, 20 nt, Staphylococcus aureus subsp. aureus MW2
acuucuuuuguuuuaccauc

SEQ ID NO: 2095462 - RNA, 14 nt, Staphylococcus aureus subsp. aureus MW2
acuucuuuuguuuu

SEQ ID NO: 2095463 - RNA, 22 nt, Staphylococcus aureus subsp. aureus MW2
acuucuuuucuuugauaacaau

SEQ ID NO: 2095464 - RNA, 16 nt, Staphylococcus aureus subsp. aureus MW2
acuucucuaucagucc

SEQ ID NO: 2095465 - RNA, 15 nt, Staphylococcus aureus subsp. aureus MW2
acuucugaaaauaac

SEQ ID NO: 2095466 - RNA, 19 nt, Staphylococcus aureus subsp. aureus MW2
acuucuuaaaauaugauuu

SEQ ID NO: 2095467 - RNA, 18 nt, Staphylococcus aureus subsp. aureus MW2
acuugaucauuauaaaau

SEQ ID NO: 2095468 - RNA, 17 nt, Staphylococcus aureus subsp. aureus MW2
acuugaauaauucuuuu

SEQ ID NO: 2095469 - RNA, 16 nt, Staphylococcus aureus subsp. aureus MW2
acuugaacuaaaacaa

SEQ ID NO: 2095470 - RNA, 17 nt, Staphylococcus aureus subsp. aureus MW2
acuucuuuuuuguaucu

SEQ ID NO: 2095471 - RNA, 15 nt, Staphylococcus aureus subsp. aureus MW2
acuugcacauuauug

SEQ ID NO: 2095472 - RNA, 19 nt, Staphylococcus aureus subsp. aureus MW2
acuugcacauuauuguaac

SEQ ID NO: 2095473 - RNA, 20 nt, Staphylococcus aureus subsp. aureus MW2
acuugcauugucuguagaaa

SEQ ID NO: 2095474 - RNA, 18 nt, Staphylococcus aureus subsp. aureus MW2
acuuggauucaaaugaca

SEQ ID NO: 2095475 - RNA, 17 nt, Staphylococcus aureus subsp. aureus MW2
acuuggauucaaaugac

SEQ ID NO: 2095476 - RNA, 18 nt, Staphylococcus aureus subsp. aureus MW2
acuuguaauauaacaagu

SEQ ID NO: 2095477 - RNA, 21 nt, Staphylococcus aureus subsp. aureus MW2
acuugguuaucauuauucaua

SEQ ID NO: 2095478 - RNA, 19 nt, Staphylococcus aureus subsp. aureus MW2
acuuguaaauuuauuuuua

SEQ ID NO: 2095479 - RNA, 22 nt, Staphylococcus aureus subsp. aureus MW2
agccaaaucuuuaauaaccuuu

SEQ ID NO: 2095480 - RNA, 15 nt, Staphylococcus aureus subsp. aureus MW2
agccaaauaaauuuu

SEQ ID NO: 2095481 - RNA, 16 nt, Staphylococcus aureus subsp. aureus MW2
agccaacacauaaaug

SEQ ID NO: 2095482 - RNA, 23 nt, Staphylococcus aureus subsp. aureus MW2
agcauuuuauuuuuaaauaugau

SEQ ID NO: 2095483 - RNA, 23 nt, Staphylococcus aureus subsp. aureus MW2
agccaauggaacgccgaauaauc

SEQ ID NO: 2095484 - RNA, 21 nt, Staphylococcus aureus subsp. aureus MW2
agccaauuucuacagacaaug

SEQ ID NO: 2095485 - RNA, 14 nt, Staphylococcus aureus subsp. aureus MW2
agccaauaaaaugu

SEQ ID NO: 2095486 - RNA, 22 nt, Staphylococcus aureus subsp. aureus MW2
agcauuagcaaauauuauuaaa

SEQ ID NO: 2095487 - RNA, 20 nt, Staphylococcus aureus subsp. aureus MW2
agcauuaaguucaucaugca

SEQ ID NO: 2095488 - RNA, 19 nt, Staphylococcus aureus subsp. aureus MW2
agcauuaaucguauuuuua

SEQ ID NO: 2095489 - RNA, 23 nt, Staphylococcus aureus subsp. aureus MW2
agcauucccguauaauaguuuac

SEQ ID NO: 2095490 - RNA, 15 nt, Staphylococcus aureus subsp. aureus MW2
agcaugauaaaaaua

SEQ ID NO: 2095491 - RNA, 21 nt, Staphylococcus aureus subsp. aureus MW2
agcaugauaaaguauguuguc

SEQ ID NO: 2095492 - RNA, 22 nt, Staphylococcus aureus subsp. aureus MW2
agccauuauuauuuuuuucuuu

SEQ ID NO: 2095493 - RNA, 18 nt, Staphylococcus aureus subsp. aureus MW2
agccauaccuuauuucag

SEQ ID NO: 2095494 - RNA, 13 nt, Staphylococcus aureus subsp. aureus MW2
agccaucaauauu

SEQ ID NO: 2095495 - RNA, 20 nt, Staphylococcus aureus subsp. aureus MW2
agcauaucuuuaucauuauu

SEQ ID NO: 2095496 - RNA, 17 nt, Staphylococcus aureus subsp. aureus MW2
agcauaucucaagauau

SEQ ID NO: 2095497 - RNA, 15 nt, Staphylococcus aureus subsp. aureus MW2
agcaucaaaaauaaa

SEQ ID NO: 2095498 - RNA, 19 nt, Staphylococcus aureus subsp. aureus MW2
agcaucacaguguugaauu

SEQ ID NO: 2095499 - RNA, 14 nt, Staphylococcus aureus subsp. aureus MW2
agcaucguaaaaaa

SEQ ID NO: 2095500 - RNA, 22 nt, Staphylococcus aureus subsp. aureus MW2
agcaucgggaucuaauuuuucc

SEQ ID NO: 2095501 - RNA, 21 nt, Staphylococcus aureus subsp. aureus MW2
agcaucuugucuaguucgauu

SEQ ID NO: 2095502 - RNA, 23 nt, Staphylococcus aureus subsp. aureus MW2
agcaucugcaugguuugcugguu

SEQ ID NO: 2095503 - RNA, 18 nt, Staphylococcus aureus subsp. aureus MW2
agcaucuacuaaaucaaa

SEQ ID NO: 2095504 - RNA, 17 nt, Staphylococcus aureus subsp. aureus MW2
agcaucuauaauauuca

SEQ ID NO: 2095505 - RNA, 21 nt, Staphylococcus aureus subsp. aureus MW2
agcauaccuuuauuauuuaau

SEQ ID NO: 2095506 - RNA, 15 nt, Staphylococcus aureus subsp. aureus MW2
agcauacaauaaugu

SEQ ID NO: 2095507 - RNA, 17 nt, Staphylococcus aureus subsp. aureus MW2
agcauaccuacagaaug

SEQ ID NO: 2095508 - RNA, 17 nt, Staphylococcus aureus subsp. aureus MW2
agcauaguuuucauacu

SEQ ID NO: 2095509 - RNA, 20 nt, Staphylococcus aureus subsp. aureus MW2
agcauaguuuucauacuacu

SEQ ID NO: 2095510 - RNA, 19 nt, Staphylococcus aureus subsp. aureus MW2
agcaguaguugacuguaaa

SEQ ID NO: 2095511 - RNA, 18 nt, Staphylococcus aureus subsp. aureus MW2
agcaguauauaucaaaua

SEQ ID NO: 2095512 - RNA, 22 nt, Staphylococcus aureus subsp. aureus MW2
agcaguaagaugauuucaaaug

SEQ ID NO: 2095513 - RNA, 21 nt, Staphylococcus aureus subsp. aureus MW2
agcaguaagauuauuuucaau

SEQ ID NO: 2095514 - RNA, 22 nt, Staphylococcus aureus subsp. aureus MW2
agcaauuucgauugcguuuucu

SEQ ID NO: 2095515 - RNA, 19 nt, Staphylococcus aureus subsp. aureus MW2
agcaauucuucaauuucau

SEQ ID NO: 2095516 - RNA, 17 nt, Staphylococcus aureus subsp. aureus MW2
agcaauucacuuauaca

SEQ ID NO: 2095517 - RNA, 14 nt, Staphylococcus aureus subsp. aureus MW2
agcacaaacuaaaa

SEQ ID NO: 2095518 - RNA, 20 nt, Staphylococcus aureus subsp. aureus MW2
agcacauuuuuaguuagaaa

SEQ ID NO: 2095519 - RNA, 21 nt, Staphylococcus aureus subsp. aureus MW2
agcacauuuuuaguuagaaag

SEQ ID NO: 2095520 - RNA, 13 nt, Staphylococcus aureus subsp. aureus MW2
agcacauuuuuag

SEQ ID NO: 2095521 - RNA, 17 nt, Staphylococcus aureus subsp. aureus MW2
agcacagcgauuaaaug

SEQ ID NO: 2095522 - RNA, 20 nt, Staphylococcus aureus subsp. aureus MW2
agcacagcgauuaaaugaug

SEQ ID NO: 2095523 - RNA, 23 nt, Staphylococcus aureus subsp. aureus MW2
agcaccgauuuggucagcgacau

SEQ ID NO: 2095524 - RNA, 18 nt, Staphylococcus aureus subsp. aureus MW2
agcaccguaacauaugua

SEQ ID NO: 2095525 - RNA, 23 nt, Staphylococcus aureus subsp. aureus MW2
agcaccggcaccuuuaggaaucg

SEQ ID NO: 2095526 - RNA, 23 nt, Staphylococcus aureus subsp. aureus MW2
agcaccguaacauauguacuauu

SEQ ID NO: 2095527 - RNA, 16 nt, Staphylococcus aureus subsp. aureus MW2
agcacuaucuuuugcu

SEQ ID NO: 2095528 - RNA, 17 nt, Staphylococcus aureus subsp. aureus MW2
agcacugaaaucuagac

SEQ ID NO: 2095529 - RNA, 22 nt, Staphylococcus aureus subsp. aureus MW2
agcacuguugugaguucauaau

SEQ ID NO: 2095530 - RNA, 18 nt, Staphylococcus aureus subsp. aureus MW2
agcacuagccguuauuuu

SEQ ID NO: 2095531 - RNA, 13 nt, Staphylococcus aureus subsp. aureus MW2
agcacuacaucaa

SEQ ID NO: 2095532 - RNA, 14 nt, Staphylococcus aureus subsp. aureus MW2
agcagacuaaaagu

SEQ ID NO: 2095533 - RNA, 18 nt, Staphylococcus aureus subsp. aureus MW2
agauuugaauuuaauuuc

SEQ ID NO: 2095534 - RNA, 15 nt, Staphylococcus aureus subsp. aureus MW2
agauuugaaauuuau

SEQ ID NO: 2095535 - RNA, 19 nt, Staphylococcus aureus subsp. aureus MW2
agauuugaaauuuauuaua

SEQ ID NO: 2095536 - RNA, 19 nt, Staphylococcus aureus subsp. aureus MW2
agauuucaaacgauuuuca

SEQ ID NO: 2095537 - RNA, 12 nt, Staphylococcus aureus subsp. aureus MW2
agauuuaacaau

SEQ ID NO: 2095538 - RNA, 14 nt, Staphylococcus aureus subsp. aureus MW2
agauuuaacaauau

SEQ ID NO: 2095539 - RNA, 22 nt, Staphylococcus aureus subsp. aureus MW2
agauuuaccucuugauaaaaua

SEQ ID NO: 2095540 - RNA, 15 nt, Staphylococcus aureus subsp. aureus MW2
agauuguauguuaua

SEQ ID NO: 2095541 - RNA, 20 nt, Staphylococcus aureus subsp. aureus MW2
agauuguauguuauagcuag

SEQ ID NO: 2095542 - RNA, 15 nt, Staphylococcus aureus subsp. aureus MW2
agauuguauuuaaua

SEQ ID NO: 2095543 - RNA, 23 nt, Staphylococcus aureus subsp. aureus MW2
agauuuaaacauccaauuauguu

SEQ ID NO: 2095544 - RNA, 18 nt, Staphylococcus aureus subsp. aureus MW2
agauugugacaauuuaaa

SEQ ID NO: 2095545 - RNA, 21 nt, Staphylococcus aureus subsp. aureus MW2
agauugugacaauuuaaauua

SEQ ID NO: 2095546 - RNA, 16 nt, Staphylococcus aureus subsp. aureus MW2
agauaaguuacuagca

SEQ ID NO: 2095547 - RNA, 17 nt, Staphylococcus aureus subsp. aureus MW2
agauaaguaauaauaua

SEQ ID NO: 2095548 - RNA, 15 nt, Staphylococcus aureus subsp. aureus MW2
agcaaaugcacugua

SEQ ID NO: 2095549 - RNA, 17 nt, Staphylococcus aureus subsp. aureus MW2
agcaaaugguccaacug

SEQ ID NO: 2095550 - RNA, 17 nt, Staphylococcus aureus subsp. aureus MW2
agcaaauauuauuaaau

SEQ ID NO: 2095551 - RNA, 13 nt, Staphylococcus aureus subsp. aureus MW2
agcaaauauuucu

SEQ ID NO: 2095552 - RNA, 13 nt, Staphylococcus aureus subsp. aureus MW2
agcaaauaaaauc

SEQ ID NO: 2095553 - RNA, 16 nt, Staphylococcus aureus subsp. aureus MW2
agcaaauauuauuaaa

SEQ ID NO: 2095554 - RNA, 17 nt, Staphylococcus aureus subsp. aureus MW2
agcaaauacuucaagag

SEQ ID NO: 2095555 - RNA, 21 nt, Staphylococcus aureus subsp. aureus MW2
agcaaaauuauguaaaaaaua

SEQ ID NO: 2095556 - RNA, 16 nt, Staphylococcus aureus subsp. aureus MW2
agcaaaauuauguaaa

SEQ ID NO: 2095557 - RNA, 18 nt, Staphylococcus aureus subsp. aureus MW2
agcaaaagaugaaaaucu

SEQ ID NO: 2095558 - RNA, 15 nt, Staphylococcus aureus subsp. aureus MW2
agcaaaaauauuuaa

SEQ ID NO: 2095559 - RNA, 23 nt, Staphylococcus aureus subsp. aureus MW2
agauuuuguugaaacuguaucaa

SEQ ID NO: 2095560 - RNA, 16 nt, Staphylococcus aureus subsp. aureus MW2
agcaacaucggcacca

SEQ ID NO: 2095561 - RNA, 20 nt, Staphylococcus aureus subsp. aureus MW2
agcaaauugauuaaauaaau

SEQ ID NO: 2095562 - RNA, 13 nt, Staphylococcus aureus subsp. aureus MW2
agcaacaaaagau

SEQ ID NO: 2095563 - RNA, 12 nt, Staphylococcus aureus subsp. aureus MW2
agcaacaaauau

SEQ ID NO: 2095564 - RNA, 19 nt, Staphylococcus aureus subsp. aureus MW2
agcaacgauaccaaauaua

SEQ ID NO: 2095565 - RNA, 15 nt, Staphylococcus aureus subsp. aureus MW2
agcaacgaugucacu

SEQ ID NO: 2095566 - RNA, 17 nt, Staphylococcus aureus subsp. aureus MW2
agcaacgauaccaaaua

SEQ ID NO: 2095567 - RNA, 21 nt, Staphylococcus aureus subsp. aureus MW2
agcaaugcaugcuucucaauu

SEQ ID NO: 2095568 - RNA, 22 nt, Staphylococcus aureus subsp. aureus MW2
agcaauuaaagucaauuuaaau

SEQ ID NO: 2095569 - RNA, 19 nt, Staphylococcus aureus subsp. aureus MW2
agcaagucuucuaaaaaau

SEQ ID NO: 2095570 - RNA, 15 nt, Staphylococcus aureus subsp. aureus MW2
agcaaguuauaucau

SEQ ID NO: 2095571 - RNA, 13 nt, Staphylococcus aureus subsp. aureus MW2
agcugauuuuuca

SEQ ID NO: 2095572 - RNA, 15 nt, Staphylococcus aureus subsp. aureus MW2
agcucuucaaauuua

SEQ ID NO: 2095573 - RNA, 23 nt, Staphylococcus aureus subsp. aureus MW2
agcucuuaaucuauaaauuauuu

SEQ ID NO: 2095574 - RNA, 19 nt, Staphylococcus aureus subsp. aureus MW2
agcugacgaaaagucagcu

SEQ ID NO: 2095575 - RNA, 20 nt, Staphylococcus aureus subsp. aureus MW2
agcugacgaaaagucagcuu

SEQ ID NO: 2095576 - RNA, 13 nt, Staphylococcus aureus subsp. aureus MW2
agcuauagaaaug

SEQ ID NO: 2095577 - RNA, 23 nt, Staphylococcus aureus subsp. aureus MW2
agcuauauuuuuguauuuauguu

SEQ ID NO: 2095578 - RNA, 22 nt, Staphylococcus aureus subsp. aureus MW2
agcuauagaaaugauagggcau

SEQ ID NO: 2095579 - RNA, 16 nt, Staphylococcus aureus subsp. aureus MW2
agcuccuccaaagcua

SEQ ID NO: 2095580 - RNA, 21 nt, Staphylococcus aureus subsp. aureus MW2
agcguuucuugaucuaaugua

SEQ ID NO: 2095581 - RNA, 15 nt, Staphylococcus aureus subsp. aureus MW2
agcguucgugauaga

SEQ ID NO: 2095582 - RNA, 19 nt, Staphylococcus aureus subsp. aureus MW2
agcuacuaaaggaauuuca

SEQ ID NO: 2095583 - RNA, 20 nt, Staphylococcus aureus subsp. aureus MW2
agcuacuaaaggaauuucaa

SEQ ID NO: 2095584 - RNA, 15 nt, Staphylococcus aureus subsp. aureus MW2
agcuagaaacaaugc

SEQ ID NO: 2095585 - RNA, 14 nt, Staphylococcus aureus subsp. aureus MW2
agcuagaaacacau

SEQ ID NO: 2095586 - RNA, 18 nt, Staphylococcus aureus subsp. aureus MW2
agcuacccuauuuuacaa

SEQ ID NO: 2095587 - RNA, 13 nt, Staphylococcus aureus subsp. aureus MW2
agcgucagcaaaa

SEQ ID NO: 2095588 - RNA, 16 nt, Staphylococcus aureus subsp. aureus MW2
agcguauuuuaaugau

SEQ ID NO: 2095589 - RNA, 22 nt, Staphylococcus aureus subsp. aureus MW2
agcgauuuuaaagaaaaguuua

SEQ ID NO: 2095590 - RNA, 21 nt, Staphylococcus aureus subsp. aureus MW2
agcgauaagcaugauaaaaau

SEQ ID NO: 2095591 - RNA, 17 nt, Staphylococcus aureus subsp. aureus MW2
agcgauaauuguugcau

SEQ ID NO: 2095592 - RNA, 17 nt, Staphylococcus aureus subsp. aureus MW2
agcgaugaaaguugcuu

SEQ ID NO: 2095593 - RNA, 12 nt, Staphylococcus aureus subsp. aureus MW2
agcgauuaaaug

SEQ ID NO: 2095594 - RNA, 17 nt, Staphylococcus aureus subsp. aureus MW2
agcgcaggcgcuccuac

SEQ ID NO: 2095595 - RNA, 16 nt, Staphylococcus aureus subsp. aureus MW2
agccccuuacaacuuu

SEQ ID NO: 2095596 - RNA, 14 nt, Staphylococcus aureus subsp. aureus MW2
agccccuuuuaaau

SEQ ID NO: 2095597 - RNA, 14 nt, Staphylococcus aureus subsp. aureus MW2
agcccguuaaaaag

SEQ ID NO: 2095598 - RNA, 17 nt, Staphylococcus aureus subsp. aureus MW2
agccauuuguuguaaac

SEQ ID NO: 2095599 - RNA, 13 nt, Staphylococcus aureus subsp. aureus MW2
agccauuucaauu

SEQ ID NO: 2095600 - RNA, 23 nt, Staphylococcus aureus subsp. aureus MW2
agccauuuguuguaaaccagcua

SEQ ID NO: 2095601 - RNA, 18 nt, Staphylococcus aureus subsp. aureus MW2
agccccagcaaauacuuc

SEQ ID NO: 2095602 - RNA, 20 nt, Staphylococcus aureus subsp. aureus MW2
agcccuuuauacaauuuuuu

SEQ ID NO: 2095603 - RNA, 17 nt, Staphylococcus aureus subsp. aureus MW2
agccuuaaaauauuuaa

SEQ ID NO: 2095604 - RNA, 23 nt, Staphylococcus aureus subsp. aureus MW2
agccuuaaaauauuuaacuuuuu

SEQ ID NO: 2095605 - RNA, 21 nt, Staphylococcus aureus subsp. aureus MW2
agccuguuugacacauuauug

SEQ ID NO: 2095606 - RNA, 13 nt, Staphylococcus aureus subsp. aureus MW2
agccuucaaaaug

SEQ ID NO: 2095607 - RNA, 13 nt, Staphylococcus aureus subsp. aureus MW2
agccuucuaucuu

SEQ ID NO: 2095608 - RNA, 15 nt, Staphylococcus aureus subsp. aureus MW2
agccuuuucaaacau

SEQ ID NO: 2095609 - RNA, 22 nt, Staphylococcus aureus subsp. aureus MW2
agcgaaaguaucuaugaaauuu

SEQ ID NO: 2095610 - RNA, 17 nt, Staphylococcus aureus subsp. aureus MW2
agcgaaauuuguaaaga

SEQ ID NO: 2095611 - RNA, 23 nt, Staphylococcus aureus subsp. aureus MW2
agccuuuuucaauucuagucagg

SEQ ID NO: 2095612 - RNA, 18 nt, Staphylococcus aureus subsp. aureus MW2
agcgaccgugguucaaaa

SEQ ID NO: 2095613 - RNA, 15 nt, Staphylococcus aureus subsp. aureus MW2
agccuauccauucaa

SEQ ID NO: 2095614 - RNA, 13 nt, Staphylococcus aureus subsp. aureus MW2
agccuauccauuc

SEQ ID NO: 2095615 - RNA, 20 nt, Staphylococcus aureus subsp. aureus MW2
agccuacuuugucugcaauu

SEQ ID NO: 2095616 - RNA, 17 nt, Staphylococcus aureus subsp. aureus MW2
agccguuuuugaaaugu

SEQ ID NO: 2095617 - RNA, 19 nt, Staphylococcus aureus subsp. aureus MW2
agccucuugccuugaaauc

SEQ ID NO: 2095618 - RNA, 17 nt, Staphylococcus aureus subsp. aureus MW2
agccucuugccuugaaa

SEQ ID NO: 2095619 - RNA, 15 nt, Staphylococcus aureus subsp. aureus MW2
agccgugaaagaaaa

SEQ ID NO: 2095620 - RNA, 16 nt, Staphylococcus aureus subsp. aureus MW2
aguacgguuauuuaau

SEQ ID NO: 2095621 - RNA, 22 nt, Staphylococcus aureus subsp. aureus MW2
aguacggcugcuuuaacuguac

SEQ ID NO: 2095622 - RNA, 19 nt, Staphylococcus aureus subsp. aureus MW2
aguacgcuguaauccauuc

SEQ ID NO: 2095623 - RNA, 20 nt, Staphylococcus aureus subsp. aureus MW2
aguacgaggaccaucucuaa

SEQ ID NO: 2095624 - RNA, 16 nt, Staphylococcus aureus subsp. aureus MW2
aguacgaaaugcauug

SEQ ID NO: 2095625 - RNA, 15 nt, Staphylococcus aureus subsp. aureus MW2
aguacgaacaacuaa

SEQ ID NO: 2095626 - RNA, 14 nt, Staphylococcus aureus subsp. aureus MW2
agcuggcggaaagu

SEQ ID NO: 2095627 - RNA, 17 nt, Staphylococcus aureus subsp. aureus MW2
agcuggcggaaagucag

SEQ ID NO: 2095628 - RNA, 18 nt, Staphylococcus aureus subsp. aureus MW2
agcuggcggaaagucagc

SEQ ID NO: 2095629 - RNA, 23 nt, Staphylococcus aureus subsp. aureus MW2
aguacuuuaaaauuguauagaau

SEQ ID NO: 2095630 - RNA, 17 nt, Staphylococcus aureus subsp. aureus MW2
aguacuucaaagcaucu

SEQ ID NO: 2095631 - RNA, 16 nt, Staphylococcus aureus subsp. aureus MW2
aguacuaaaaguauga

SEQ ID NO: 2095632 - RNA, 23 nt, Staphylococcus aureus subsp. aureus MW2
aguacuaaucaauacuaaaccaa

SEQ ID NO: 2095633 - RNA, 22 nt, Staphylococcus aureus subsp. aureus MW2
aguacucaauguuaggugcuug

SEQ ID NO: 2095634 - RNA, 21 nt, Staphylococcus aureus subsp. aureus MW2
aguacuaaaccgauuaauaua

SEQ ID NO: 2095635 - RNA, 16 nt, Staphylococcus aureus subsp. aureus MW2
aguagacauugaaagg

SEQ ID NO: 2095636 - RNA, 21 nt, Staphylococcus aureus subsp. aureus MW2
aguacuuucgaguaauacuuu

SEQ ID NO: 2095637 - RNA, 16 nt, Staphylococcus aureus subsp. aureus MW2
aguagcuagaacagau

SEQ ID NO: 2095638 - RNA, 23 nt, Staphylococcus aureus subsp. aureus MW2
aguauaaaccgccaacuaauguu

SEQ ID NO: 2095639 - RNA, 12 nt, Staphylococcus aureus subsp. aureus MW2
aguauaaauaaa

SEQ ID NO: 2095640 - RNA, 14 nt, Staphylococcus aureus subsp. aureus MW2
aguaguuuauauca

SEQ ID NO: 2095641 - RNA, 18 nt, Staphylococcus aureus subsp. aureus MW2
aguaguuaucuaaugauc

SEQ ID NO: 2095642 - RNA, 15 nt, Staphylococcus aureus subsp. aureus MW2
aguaguguauucauu

SEQ ID NO: 2095643 - RNA, 13 nt, Staphylococcus aureus subsp. aureus MW2
aguauaauuaaac

SEQ ID NO: 2095644 - RNA, 21 nt, Staphylococcus aureus subsp. aureus MW2
aguauaaguagcucaaaacaa

SEQ ID NO: 2095645 - RNA, 18 nt, Staphylococcus aureus subsp. aureus MW2
aguauaagguugaagaag

SEQ ID NO: 2095646 - RNA, 15 nt, Staphylococcus aureus subsp. aureus MW2
aguauauaucaaaua

SEQ ID NO: 2095647 - RNA, 18 nt, Staphylococcus aureus subsp. aureus MW2
aguauauccgcaucuuuu

SEQ ID NO: 2095648 - RNA, 12 nt, Staphylococcus aureus subsp. aureus MW2
aguauauaagca

SEQ ID NO: 2095649 - RNA, 15 nt, Staphylococcus aureus subsp. aureus MW2
aguauauaagcaaag

SEQ ID NO: 2095650 - RNA, 16 nt, Staphylococcus aureus subsp. aureus MW2
aguauauaagcaaaga

SEQ ID NO: 2095651 - RNA, 15 nt, Staphylococcus aureus subsp. aureus MW2
aguauaaaugcagcu

SEQ ID NO: 2095652 - RNA, 20 nt, Staphylococcus aureus subsp. aureus MW2
agucaggggccccaacacag

SEQ ID NO: 2095653 - RNA, 15 nt, Staphylococcus aureus subsp. aureus MW2
agucaggggccccaa

SEQ ID NO: 2095654 - RNA, 16 nt, Staphylococcus aureus subsp. aureus MW2
agucaggggccccaac

SEQ ID NO: 2095655 - RNA, 19 nt, Staphylococcus aureus subsp. aureus MW2
agucaggggccccaacaca

SEQ ID NO: 2095656 - RNA, 13 nt, Staphylococcus aureus subsp. aureus MW2
agucaggggcccc

SEQ ID NO: 2095657 - RNA, 14 nt, Staphylococcus aureus subsp. aureus MW2
agucaggggcccca

SEQ ID NO: 2095658 - RNA, 18 nt, Staphylococcus aureus subsp. aureus MW2
agucagcuuacaauaaug

SEQ ID NO: 2095659 - RNA, 19 nt, Staphylococcus aureus subsp. aureus MW2
agucagcuuacaauaaugu

SEQ ID NO: 2095660 - RNA, 16 nt, Staphylococcus aureus subsp. aureus MW2
agucauaaauauaaaa

SEQ ID NO: 2095661 - RNA, 15 nt, Staphylococcus aureus subsp. aureus MW2
agucauaauuuagaa

SEQ ID NO: 2095662 - RNA, 16 nt, Staphylococcus aureus subsp. aureus MW2
agucagguuacaauaa

SEQ ID NO: 2095663 - RNA, 19 nt, Staphylococcus aureus subsp. aureus MW2
agucaacaucguauucuuu

SEQ ID NO: 2095664 - RNA, 23 nt, Staphylococcus aureus subsp. aureus MW2
agucaaaaaaucgaacaaaugaa

SEQ ID NO: 2095665 - RNA, 17 nt, Staphylococcus aureus subsp. aureus MW2
aguauuuuuuuauguuc

SEQ ID NO: 2095666 - RNA, 13 nt, Staphylococcus aureus subsp. aureus MW2
agucaaucaaguu

SEQ ID NO: 2095667 - RNA, 15 nt, Staphylococcus aureus subsp. aureus MW2
agucaauacaaaaca

SEQ ID NO: 2095668 - RNA, 14 nt, Staphylococcus aureus subsp. aureus MW2
agucaauuuuuuca

SEQ ID NO: 2095669 - RNA, 15 nt, Staphylococcus aureus subsp. aureus MW2
agucaauuuuuucau

SEQ ID NO: 2095670 - RNA, 23 nt, Staphylococcus aureus subsp. aureus MW2
aguaucauuguguccauaaauau

SEQ ID NO: 2095671 - RNA, 16 nt, Staphylococcus aureus subsp. aureus MW2
aguauccugauuuaau

SEQ ID NO: 2095672 - RNA, 19 nt, Staphylococcus aureus subsp. aureus MW2
aguauccuuuauaaauaaa

SEQ ID NO: 2095673 - RNA, 21 nt, Staphylococcus aureus subsp. aureus MW2
aguauccuuuauaaauaaaca

SEQ ID NO: 2095674 - RNA, 18 nt, Staphylococcus aureus subsp. aureus MW2
aguaucugugaauaugcu

SEQ ID NO: 2095675 - RNA, 14 nt, Staphylococcus aureus subsp. aureus MW2
aguaucucauuuuu

SEQ ID NO: 2095676 - RNA, 18 nt, Staphylococcus aureus subsp. aureus MW2
aguaucucaaauauuaau

SEQ ID NO: 2095677 - RNA, 19 nt, Staphylococcus aureus subsp. aureus MW2
aguauggaauaaaugguuu

SEQ ID NO: 2095678 - RNA, 18 nt, Staphylococcus aureus subsp. aureus MW2
aguaugacuuaccuaaua

SEQ ID NO: 2095679 - RNA, 22 nt, Staphylococcus aureus subsp. aureus MW2
aguaugacaaauuaaaaaggcg

SEQ ID NO: 2095680 - RNA, 15 nt, Staphylococcus aureus subsp. aureus MW2
aguaugauagaaauc

SEQ ID NO: 2095681 - RNA, 18 nt, Staphylococcus aureus subsp. aureus MW2
aguauggcgaaauguuuu

SEQ ID NO: 2095682 - RNA, 14 nt, Staphylococcus aureus subsp. aureus MW2
aguauuaucuuuca

SEQ ID NO: 2095683 - RNA, 23 nt, Staphylococcus aureus subsp. aureus MW2
aguauuauagccuauccauucaa

SEQ ID NO: 2095684 - RNA, 21 nt, Staphylococcus aureus subsp. aureus MW2
aguauuguuuuauauuuaaac

SEQ ID NO: 2095685 - RNA, 15 nt, Staphylococcus aureus subsp. aureus MW2
aguauuguuuuauau

SEQ ID NO: 2095686 - RNA, 15 nt, Staphylococcus aureus subsp. aureus MW2
aguauuuaauguuuu

SEQ ID NO: 2095687 - RNA, 17 nt, Staphylococcus aureus subsp. aureus MW2
aguauuugaaguauuuu

SEQ ID NO: 2095688 - RNA, 22 nt, Staphylococcus aureus subsp. aureus MW2
aguauuuuccuucagucuucau

SEQ ID NO: 2095689 - RNA, 22 nt, Staphylococcus aureus subsp. aureus MW2
aguauuuuugcguuaauaauuu

SEQ ID NO: 2095690 - RNA, 19 nt, Staphylococcus aureus subsp. aureus MW2
agucggggccccaacacag

SEQ ID NO: 2095691 - RNA, 12 nt, Staphylococcus aureus subsp. aureus MW2
agucggggcccc

SEQ ID NO: 2095692 - RNA, 15 nt, Staphylococcus aureus subsp. aureus MW2
agucgauaaguuuuu

SEQ ID NO: 2095693 - RNA, 12 nt, Staphylococcus aureus subsp. aureus MW2
aguccauuuucu

SEQ ID NO: 2095694 - RNA, 14 nt, Staphylococcus aureus subsp. aureus MW2
aguccauuuucuuu

SEQ ID NO: 2095695 - RNA, 23 nt, Staphylococcus aureus subsp. aureus MW2
aguccauucgacuccaaccuuuu

SEQ ID NO: 2095696 - RNA, 17 nt, Staphylococcus aureus subsp. aureus MW2
agucauacacaaugauu

SEQ ID NO: 2095697 - RNA, 19 nt, Staphylococcus aureus subsp. aureus MW2
agucaucaaccucauuuga

SEQ ID NO: 2095698 - RNA, 19 nt, Staphylococcus aureus subsp. aureus MW2
agucaucaucaugauuacu

SEQ ID NO: 2095699 - RNA, 21 nt, Staphylococcus aureus subsp. aureus MW2
agucauguuuggcauaauaau

SEQ ID NO: 2095700 - RNA, 21 nt, Staphylococcus aureus subsp. aureus MW2
agucauuugaauuagaagcaa

SEQ ID NO: 2095701 - RNA, 23 nt, Staphylococcus aureus subsp. aureus MW2
agucauuugaugguuuaauugca

SEQ ID NO: 2095702 - RNA, 17 nt, Staphylococcus aureus subsp. aureus MW2
agucauuguauaaaaag

SEQ ID NO: 2095703 - RNA, 21 nt, Staphylococcus aureus subsp. aureus MW2
agugcuuuuuauuuuuauuca

SEQ ID NO: 2095704 - RNA, 19 nt, Staphylococcus aureus subsp. aureus MW2
agugcuucaacuucaucua

SEQ ID NO: 2095705 - RNA, 18 nt, Staphylococcus aureus subsp. aureus MW2
agugcaaguccaaauaau

SEQ ID NO: 2095706 - RNA, 12 nt, Staphylococcus aureus subsp. aureus MW2
agugccagguuc

SEQ ID NO: 2095707 - RNA, 16 nt, Staphylococcus aureus subsp. aureus MW2
agugauuuaaaaaaau

SEQ ID NO: 2095708 - RNA, 13 nt, Staphylococcus aureus subsp. aureus MW2
agugauaauuaaa

SEQ ID NO: 2095709 - RNA, 21 nt, Staphylococcus aureus subsp. aureus MW2
agugauaauuaaaauaagaua

SEQ ID NO: 2095710 - RNA, 15 nt, Staphylococcus aureus subsp. aureus MW2
agugaugaccaauau

SEQ ID NO: 2095711 - RNA, 19 nt, Staphylococcus aureus subsp. aureus MW2
agugaaucgucuacauuua

SEQ ID NO: 2095712 - RNA, 17 nt, Staphylococcus aureus subsp. aureus MW2
agugaauaauugagaaa

SEQ ID NO: 2095713 - RNA, 19 nt, Staphylococcus aureus subsp. aureus MW2
agugaauaauugagaaaaa

SEQ ID NO: 2095714 - RNA, 13 nt, Staphylococcus aureus subsp. aureus MW2
agucucguaauaa

SEQ ID NO: 2095715 - RNA, 16 nt, Staphylococcus aureus subsp. aureus MW2
agugaaaauaccaacu

SEQ ID NO: 2095716 - RNA, 16 nt, Staphylococcus aureus subsp. aureus MW2
agugaaaucauuuaaa

SEQ ID NO: 2095717 - RNA, 14 nt, Staphylococcus aureus subsp. aureus MW2
agugaaauaccucc

SEQ ID NO: 2095718 - RNA, 16 nt, Staphylococcus aureus subsp. aureus MW2
agucgguguuuucuua

SEQ ID NO: 2095719 - RNA, 16 nt, Staphylococcus aureus subsp. aureus MW2
auaacaauuuauuaaa

SEQ ID NO: 2095720 - RNA, 21 nt, Staphylococcus aureus subsp. aureus MW2
auaacagcuacaaauaaugag

SEQ ID NO: 2095721 - RNA, 16 nt, Staphylococcus aureus subsp. aureus MW2
auaacagcuacaaaua

SEQ ID NO: 2095722 - RNA, 18 nt, Staphylococcus aureus subsp. aureus MW2
auaacagcuacaaauaau

SEQ ID NO: 2095723 - RNA, 16 nt, Staphylococcus aureus subsp. aureus MW2
auaacaacgauaauug

SEQ ID NO: 2095724 - RNA, 16 nt, Staphylococcus aureus subsp. aureus MW2
auaacaaccuauuaau

SEQ ID NO: 2095725 - RNA, 15 nt, Staphylococcus aureus subsp. aureus MW2
auaacaaacauuaau

SEQ ID NO: 2095726 - RNA, 20 nt, Staphylococcus aureus subsp. aureus MW2
auaacaaguauaaaugcagc

SEQ ID NO: 2095727 - RNA, 17 nt, Staphylococcus aureus subsp. aureus MW2
auaacaagaaguaaugu

SEQ ID NO: 2095728 - RNA, 22 nt, Staphylococcus aureus subsp. aureus MW2
auaaauuuagauauaauaaaaa

SEQ ID NO: 2095729 - RNA, 22 nt, Staphylococcus aureus subsp. aureus MW2
auaaauuuaacguuauucauuu

SEQ ID NO: 2095730 - RNA, 14 nt, Staphylococcus aureus subsp. aureus MW2
auaaauuuauauau

SEQ ID NO: 2095731 - RNA, 11 nt, Staphylococcus aureus subsp. aureus MW2
auaacaaacau

SEQ ID NO: 2095732 - RNA, 22 nt, Staphylococcus aureus subsp. aureus MW2
auaaauuucaagguauacacaa

SEQ ID NO: 2095733 - RNA, 22 nt, Staphylococcus aureus subsp. aureus MW2
auaaauugaguuuuuuaaaaua

SEQ ID NO: 2095734 - RNA, 20 nt, Staphylococcus aureus subsp. aureus MW2
auaaauugaguuuuuuaaaa

SEQ ID NO: 2095735 - RNA, 21 nt, Staphylococcus aureus subsp. aureus MW2
auaaauugaguuuuuuaaaau

SEQ ID NO: 2095736 - RNA, 23 nt, Staphylococcus aureus subsp. aureus MW2
auaaauugaguuuuuuaaaauaa

SEQ ID NO: 2095737 - RNA, 20 nt, Staphylococcus aureus subsp. aureus MW2
auaaauuguaugaauaauau

SEQ ID NO: 2095738 - RNA, 20 nt, Staphylococcus aureus subsp. aureus MW2
auaacgagcaguauauauca

SEQ ID NO: 2095739 - RNA, 20 nt, Staphylococcus aureus subsp. aureus MW2
auaacgauagauuuuuucau

SEQ ID NO: 2095740 - RNA, 22 nt, Staphylococcus aureus subsp. aureus MW2
auaaccuuuaaaacaucauuca

SEQ ID NO: 2095741 - RNA, 15 nt, Staphylococcus aureus subsp. aureus MW2
auaaccuuuaaaaca

SEQ ID NO: 2095742 - RNA, 19 nt, Staphylococcus aureus subsp. aureus MW2
auaaccuuuaaaacaucau

SEQ ID NO: 2095743 - RNA, 15 nt, Staphylococcus aureus subsp. aureus MW2
auaacaucaaauaga

SEQ ID NO: 2095744 - RNA, 17 nt, Staphylococcus aureus subsp. aureus MW2
auaacauuaaaaugaua

SEQ ID NO: 2095745 - RNA, 15 nt, Staphylococcus aureus subsp. aureus MW2
auaacaucuaaauuu

SEQ ID NO: 2095746 - RNA, 24 nt, Staphylococcus aureus subsp. aureus MW2
auaacaguauuuuagguuuaucau

SEQ ID NO: 2095747 - RNA, 13 nt, Staphylococcus aureus subsp. aureus MW2
auaacaucuaaau

SEQ ID NO: 2095748 - RNA, 18 nt, Staphylococcus aureus subsp. aureus MW2
auaaccauaguaacaaaa

SEQ ID NO: 2095749 - RNA, 19 nt, Staphylococcus aureus subsp. aureus MW2
auaaccauaguaacaaaau

SEQ ID NO: 2095750 - RNA, 22 nt, Staphylococcus aureus subsp. aureus MW2
auaaaugauuucuucauuauca

SEQ ID NO: 2095751 - RNA, 16 nt, Staphylococcus aureus subsp. aureus MW2
auaaaugcauacgcag

SEQ ID NO: 2095752 - RNA, 17 nt, Staphylococcus aureus subsp. aureus MW2
auaaaugacugaauuaa

SEQ ID NO: 2095753 - RNA, 17 nt, Staphylococcus aureus subsp. aureus MW2
auaaaucaugaaauuaa

SEQ ID NO: 2095754 - RNA, 20 nt, Staphylococcus aureus subsp. aureus MW2
auaaaucaugaaauuaaaaa

SEQ ID NO: 2095755 - RNA, 20 nt, Staphylococcus aureus subsp. aureus MW2
auaaaucaagaaauguuaaa

SEQ ID NO: 2095756 - RNA, 17 nt, Staphylococcus aureus subsp. aureus MW2
auaaaucaauauucuau

SEQ ID NO: 2095757 - RNA, 18 nt, Staphylococcus aureus subsp. aureus MW2
auaaaucacgccauaauc

SEQ ID NO: 2095758 - RNA, 23 nt, Staphylococcus aureus subsp. aureus MW2
auaaaucacgccauaaucuucau

SEQ ID NO: 2095759 - RNA, 17 nt, Staphylococcus aureus subsp. aureus MW2
auaaaucaagaaauguu

SEQ ID NO: 2095760 - RNA, 16 nt, Staphylococcus aureus subsp. aureus MW2
auaaaucaagaaaugu

SEQ ID NO: 2095761 - RNA, 14 nt, Staphylococcus aureus subsp. aureus MW2
auaaaucaaacuuu

SEQ ID NO: 2095762 - RNA, 16 nt, Staphylococcus aureus subsp. aureus MW2
auaaaucauucuuuau

SEQ ID NO: 2095763 - RNA, 21 nt, Staphylococcus aureus subsp. aureus MW2
auaaaucauucuuuauagaaa

SEQ ID NO: 2095764 - RNA, 22 nt, Staphylococcus aureus subsp. aureus MW2
auaaaucauacgagaaauuaga

SEQ ID NO: 2095765 - RNA, 19 nt, Staphylococcus aureus subsp. aureus MW2
auaaaucauacgagaaauu

SEQ ID NO: 2095766 - RNA, 19 nt, Staphylococcus aureus subsp. aureus MW2
auaaauucucuuggauagu

SEQ ID NO: 2095767 - RNA, 17 nt, Staphylococcus aureus subsp. aureus MW2
auaaaugcuaaaaguau

SEQ ID NO: 2095768 - RNA, 22 nt, Staphylococcus aureus subsp. aureus MW2
auaaaugcgguuaaugacuaug

SEQ ID NO: 2095769 - RNA, 13 nt, Staphylococcus aureus subsp. aureus MW2
auaaaugucacug

SEQ ID NO: 2095770 - RNA, 22 nt, Staphylococcus aureus subsp. aureus MW2
auaaauaucaauuguugcaaaa

SEQ ID NO: 2095771 - RNA, 23 nt, Staphylococcus aureus subsp. aureus MW2
auaaauaaaaggcauucuuccaa

SEQ ID NO: 2095772 - RNA, 14 nt, Staphylococcus aureus subsp. aureus MW2
auaaauaaaagcca

SEQ ID NO: 2095773 - RNA, 14 nt, Staphylococcus aureus subsp. aureus MW2
auaaauaaaaauau

SEQ ID NO: 2095774 - RNA, 21 nt, Staphylococcus aureus subsp. aureus MW2
auaaagacaccuucaauaucu

SEQ ID NO: 2095775 - RNA, 15 nt, Staphylococcus aureus subsp. aureus MW2
auaaagacaccuuca

SEQ ID NO: 2095776 - RNA, 19 nt, Staphylococcus aureus subsp. aureus MW2
auaaaguugacaauacaaa

SEQ ID NO: 2095777 - RNA, 16 nt, Staphylococcus aureus subsp. aureus MW2
auaaaguuuauuuaug

SEQ ID NO: 2095778 - RNA, 13 nt, Staphylococcus aureus subsp. aureus MW2
auaaaguuuauuu

SEQ ID NO: 2095779 - RNA, 15 nt, Staphylococcus aureus subsp. aureus MW2
auaaaguuuauuuau

SEQ ID NO: 2095780 - RNA, 16 nt, Staphylococcus aureus subsp. aureus MW2
auaaagucauaugguu

SEQ ID NO: 2095781 - RNA, 18 nt, Staphylococcus aureus subsp. aureus MW2
auaaaguccaauacaauu

SEQ ID NO: 2095782 - RNA, 14 nt, Staphylococcus aureus subsp. aureus MW2
auaaaauuucugcu

SEQ ID NO: 2095783 - RNA, 15 nt, Staphylococcus aureus subsp. aureus MW2
auaaaauuuaaaaca

SEQ ID NO: 2095784 - RNA, 19 nt, Staphylococcus aureus subsp. aureus MW2
auaaaauuuaaaacaauga

SEQ ID NO: 2095785 - RNA, 17 nt, Staphylococcus aureus subsp. aureus MW2
auaaacgcaaauuaaau

SEQ ID NO: 2095786 - RNA, 16 nt, Staphylococcus aureus subsp. aureus MW2
auaaaauuaaaacagc

SEQ ID NO: 2095787 - RNA, 20 nt, Staphylococcus aureus subsp. aureus MW2
auaaaauggugcgaauaaua

SEQ ID NO: 2095788 - RNA, 16 nt, Staphylococcus aureus subsp. aureus MW2
auaaaaugcuacaauu

SEQ ID NO: 2095789 - RNA, 13 nt, Staphylococcus aureus subsp. aureus MW2
auaaaauuuaaaa

SEQ ID NO: 2095790 - RNA, 16 nt, Staphylococcus aureus subsp. aureus MW2
auaaaauuguaauacu

SEQ ID NO: 2095791 - RNA, 14 nt, Staphylococcus aureus subsp. aureus MW2
auaaaauucaccaa

SEQ ID NO: 2095792 - RNA, 14 nt, Staphylococcus aureus subsp. aureus MW2
auaaaauuaaaaca

SEQ ID NO: 2095793 - RNA, 19 nt, Staphylococcus aureus subsp. aureus MW2
auaaaauuacgcaaagaaa

SEQ ID NO: 2095794 - RNA, 21 nt, Staphylococcus aureus subsp. aureus MW2
auaaaauuacuugaauauuau

SEQ ID NO: 2095795 - RNA, 20 nt, Staphylococcus aureus subsp. aureus MW2
auaaaaucaucguauuucau

SEQ ID NO: 2095796 - RNA, 20 nt, Staphylococcus aureus subsp. aureus MW2
auaaaauauaucuuaugaua

SEQ ID NO: 2095797 - RNA, 13 nt, Staphylococcus aureus subsp. aureus MW2
auaaaaucauuaa

SEQ ID NO: 2095798 - RNA, 19 nt, Staphylococcus aureus subsp. aureus MW2
auaaaacuuauaacugaua

SEQ ID NO: 2095799 - RNA, 23 nt, Staphylococcus aureus subsp. aureus MW2
auaaaacuuacauuacauauauc

SEQ ID NO: 2095800 - RNA, 21 nt, Staphylococcus aureus subsp. aureus MW2
auaaaaguuaggcgacuuaac

SEQ ID NO: 2095801 - RNA, 19 nt, Staphylococcus aureus subsp. aureus MW2
auaaaagucgauaaauaug

SEQ ID NO: 2095802 - RNA, 12 nt, Staphylococcus aureus subsp. aureus MW2
auaaaauaaaau

SEQ ID NO: 2095803 - RNA, 13 nt, Staphylococcus aureus subsp. aureus MW2
auaaaauaaaaug

SEQ ID NO: 2095804 - RNA, 13 nt, Staphylococcus aureus subsp. aureus MW2
auaaaauaaauaa

SEQ ID NO: 2095805 - RNA, 22 nt, Staphylococcus aureus subsp. aureus MW2
auaaaagucgauaaauaugaug

SEQ ID NO: 2095806 - RNA, 20 nt, Staphylococcus aureus subsp. aureus MW2
auaaaagucgauaaauauga

SEQ ID NO: 2095807 - RNA, 16 nt, Staphylococcus aureus subsp. aureus MW2
auaaaaguacuuuaaa

SEQ ID NO: 2095808 - RNA, 23 nt, Staphylococcus aureus subsp. aureus MW2
auaaaaguacuuuaaaauuguau

SEQ ID NO: 2095809 - RNA, 20 nt, Staphylococcus aureus subsp. aureus MW2
auaaaaggggaaaucauuug

SEQ ID NO: 2095810 - RNA, 16 nt, Staphylococcus aureus subsp. aureus MW2
auaaaacuauguguau

SEQ ID NO: 2095811 - RNA, 22 nt, Staphylococcus aureus subsp. aureus MW2
auaaaacuauguguauaugugg

SEQ ID NO: 2095812 - RNA, 15 nt, Staphylococcus aureus subsp. aureus MW2
auaaaacuaucuaca

SEQ ID NO: 2095813 - RNA, 15 nt, Staphylococcus aureus subsp. aureus MW2
auaaaacgauaagaa

SEQ ID NO: 2095814 - RNA, 19 nt, Staphylococcus aureus subsp. aureus MW2
auaaaaauaggauuguguu

SEQ ID NO: 2095815 - RNA, 15 nt, Staphylococcus aureus subsp. aureus MW2
auaaaacaucaucgu

SEQ ID NO: 2095816 - RNA, 13 nt, Staphylococcus aureus subsp. aureus MW2
auaaaacagaauu

SEQ ID NO: 2095817 - RNA, 21 nt, Staphylococcus aureus subsp. aureus MW2
auaaaacaaaaccaaaauacu

SEQ ID NO: 2095818 - RNA, 18 nt, Staphylococcus aureus subsp. aureus MW2
aguucaggaucaagugca

SEQ ID NO: 2095819 - RNA, 15 nt, Staphylococcus aureus subsp. aureus MW2
aguucagcguuaucu

SEQ ID NO: 2095820 - RNA, 15 nt, Staphylococcus aureus subsp. aureus MW2
aguucauuucaauac

SEQ ID NO: 2095821 - RNA, 20 nt, Staphylococcus aureus subsp. aureus MW2
aguuccguugaauuaacaau

SEQ ID NO: 2095822 - RNA, 16 nt, Staphylococcus aureus subsp. aureus MW2
aguucuauguauaaua

SEQ ID NO: 2095823 - RNA, 22 nt, Staphylococcus aureus subsp. aureus MW2
aguucggaugagaaauguuaac

SEQ ID NO: 2095824 - RNA, 12 nt, Staphylococcus aureus subsp. aureus MW2
aguucuuuaaau

SEQ ID NO: 2095825 - RNA, 21 nt, Staphylococcus aureus subsp. aureus MW2
aguucuugauuggcacaguca

SEQ ID NO: 2095826 - RNA, 17 nt, Staphylococcus aureus subsp. aureus MW2
aguuaugacuaacgaaa

SEQ ID NO: 2095827 - RNA, 21 nt, Staphylococcus aureus subsp. aureus MW2
aguuaugaagggaaaaaaugg

SEQ ID NO: 2095828 - RNA, 14 nt, Staphylococcus aureus subsp. aureus MW2
aguuauauuguuaa

SEQ ID NO: 2095829 - RNA, 14 nt, Staphylococcus aureus subsp. aureus MW2
aguuaccaaaauuu

SEQ ID NO: 2095830 - RNA, 14 nt, Staphylococcus aureus subsp. aureus MW2
aguuauuuaaguuc

SEQ ID NO: 2095831 - RNA, 13 nt, Staphylococcus aureus subsp. aureus MW2
aguuaauuauuua

SEQ ID NO: 2095832 - RNA, 16 nt, Staphylococcus aureus subsp. aureus MW2
aguuaauauaauuaaa

SEQ ID NO: 2095833 - RNA, 14 nt, Staphylococcus aureus subsp. aureus MW2
aguuaaauaguaag

SEQ ID NO: 2095834 - RNA, 13 nt, Staphylococcus aureus subsp. aureus MW2
aguuaaauuaaac

SEQ ID NO: 2095835 - RNA, 15 nt, Staphylococcus aureus subsp. aureus MW2
aguuaacuauaacaa

SEQ ID NO: 2095836 - RNA, 23 nt, Staphylococcus aureus subsp. aureus MW2
aguuaaaguuccaaguuaaugca

SEQ ID NO: 2095837 - RNA, 16 nt, Staphylococcus aureus subsp. aureus MW2
aguuaaaguacuuaca

SEQ ID NO: 2095838 - RNA, 15 nt, Staphylococcus aureus subsp. aureus MW2
aguggccuuuuaaac

SEQ ID NO: 2095839 - RNA, 20 nt, Staphylococcus aureus subsp. aureus MW2
aguugugguuguuaauguau

SEQ ID NO: 2095840 - RNA, 23 nt, Staphylococcus aureus subsp. aureus MW2
aguuguggucuaaccaucucaac

SEQ ID NO: 2095841 - RNA, 17 nt, Staphylococcus aureus subsp. aureus MW2
aguuuagguugauuucu

SEQ ID NO: 2095842 - RNA, 17 nt, Staphylococcus aureus subsp. aureus MW2
aguuuacggggugcuuu

SEQ ID NO: 2095843 - RNA, 23 nt, Staphylococcus aureus subsp. aureus MW2
aguuuacggggugcuuuuuaugu

SEQ ID NO: 2095844 - RNA, 15 nt, Staphylococcus aureus subsp. aureus MW2
aguugguggauguca

SEQ ID NO: 2095845 - RNA, 19 nt, Staphylococcus aureus subsp. aureus MW2
aguuggggugugggcccca

SEQ ID NO: 2095846 - RNA, 22 nt, Staphylococcus aureus subsp. aureus MW2
aguugguuuuauuaauucugau

SEQ ID NO: 2095847 - RNA, 22 nt, Staphylococcus aureus subsp. aureus MW2
aguugaucaaaaauguuaucua

SEQ ID NO: 2095848 - RNA, 14 nt, Staphylococcus aureus subsp. aureus MW2
aguugauaacuauu

SEQ ID NO: 2095849 - RNA, 21 nt, Staphylococcus aureus subsp. aureus MW2
aguuggcugauagaugaaaau

SEQ ID NO: 2095850 - RNA, 17 nt, Staphylococcus aureus subsp. aureus MW2
aguuggcggggccccaa

SEQ ID NO: 2095851 - RNA, 20 nt, Staphylococcus aureus subsp. aureus MW2
aguuuuucaggguuuaagau

SEQ ID NO: 2095852 - RNA, 22 nt, Staphylococcus aureus subsp. aureus MW2
aguuuuugguagcauuuuagau

SEQ ID NO: 2095853 - RNA, 13 nt, Staphylococcus aureus subsp. aureus MW2
aguuuuuuaaaau

SEQ ID NO: 2095854 - RNA, 21 nt, Staphylococcus aureus subsp. aureus MW2
aguuuuuuaaaauaaugauau

SEQ ID NO: 2095855 - RNA, 14 nt, Staphylococcus aureus subsp. aureus MW2
auaaaaaaugaaug

SEQ ID NO: 2095856 - RNA, 12 nt, Staphylococcus aureus subsp. aureus MW2
auaaaaaauacu

SEQ ID NO: 2095857 - RNA, 12 nt, Staphylococcus aureus subsp. aureus MW2
auaaaaaagcca

SEQ ID NO: 2095858 - RNA, 17 nt, Staphylococcus aureus subsp. aureus MW2
aguuucaacuuuugaug

SEQ ID NO: 2095859 - RNA, 22 nt, Staphylococcus aureus subsp. aureus MW2
aguuuccauaaauaaaaugcua

SEQ ID NO: 2095860 - RNA, 22 nt, Staphylococcus aureus subsp. aureus MW2
aguuuuauuuauaaacaauaaa

SEQ ID NO: 2095861 - RNA, 13 nt, Staphylococcus aureus subsp. aureus MW2
aguuuuaugaaua

SEQ ID NO: 2095862 - RNA, 14 nt, Staphylococcus aureus subsp. aureus MW2
aguuuguaauaauu

SEQ ID NO: 2095863 - RNA, 16 nt, Staphylococcus aureus subsp. aureus MW2
aguuuggagaauuuau

SEQ ID NO: 2095864 - RNA, 14 nt, Staphylococcus aureus subsp. aureus MW2
auagaacaaaaugu

SEQ ID NO: 2095865 - RNA, 23 nt, Staphylococcus aureus subsp. aureus MW2
auagaaccuauuuuuuauaugau

SEQ ID NO: 2095866 - RNA, 19 nt, Staphylococcus aureus subsp. aureus MW2
auagaaaucagcuuuucuu

SEQ ID NO: 2095867 - RNA, 20 nt, Staphylococcus aureus subsp. aureus MW2
auagaagaacgaagaaugau

SEQ ID NO: 2095868 - RNA, 19 nt, Staphylococcus aureus subsp. aureus MW2
auagaaauuguaguauuuu

SEQ ID NO: 2095869 - RNA, 21 nt, Staphylococcus aureus subsp. aureus MW2
auagaaauuguaguauuuuuu

SEQ ID NO: 2095870 - RNA, 16 nt, Staphylococcus aureus subsp. aureus MW2
auagaaauaaucacau

SEQ ID NO: 2095871 - RNA, 19 nt, Staphylococcus aureus subsp. aureus MW2
auagaaauaacgauaccuu

SEQ ID NO: 2095872 - RNA, 12 nt, Staphylococcus aureus subsp. aureus MW2
auagaaggggac

SEQ ID NO: 2095873 - RNA, 20 nt, Staphylococcus aureus subsp. aureus MW2
auagaagguuauuuuuuaug

SEQ ID NO: 2095874 - RNA, 16 nt, Staphylococcus aureus subsp. aureus MW2
auagaauaccaauugg

SEQ ID NO: 2095875 - RNA, 14 nt, Staphylococcus aureus subsp. aureus MW2
auagaauacuaaaa

SEQ ID NO: 2095876 - RNA, 15 nt, Staphylococcus aureus subsp. aureus MW2
auacuaauuuuguac

SEQ ID NO: 2095877 - RNA, 16 nt, Staphylococcus aureus subsp. aureus MW2
auacuaccguuuuuau

SEQ ID NO: 2095878 - RNA, 18 nt, Staphylococcus aureus subsp. aureus MW2
auacuaccguuuuuauau

SEQ ID NO: 2095879 - RNA, 23 nt, Staphylococcus aureus subsp. aureus MW2
auacuacucccccguaguauaua

SEQ ID NO: 2095880 - RNA, 19 nt, Staphylococcus aureus subsp. aureus MW2
auacuacuuguuuguuuuu

SEQ ID NO: 2095881 - RNA, 13 nt, Staphylococcus aureus subsp. aureus MW2
auacuauacugau

SEQ ID NO: 2095882 - RNA, 15 nt, Staphylococcus aureus subsp. aureus MW2
auacuauaaauaaaa

SEQ ID NO: 2095883 - RNA, 16 nt, Staphylococcus aureus subsp. aureus MW2
auagaaaaauuucaaa

SEQ ID NO: 2095884 - RNA, 20 nt, Staphylococcus aureus subsp. aureus MW2
auagaaaaugaguacaacau

SEQ ID NO: 2095885 - RNA, 14 nt, Staphylococcus aureus subsp. aureus MW2
auagaaaauuaacu

SEQ ID NO: 2095886 - RNA, 22 nt, Staphylococcus aureus subsp. aureus MW2
auacuuuuggucuguugaaguc

SEQ ID NO: 2095887 - RNA, 12 nt, Staphylococcus aureus subsp. aureus MW2
auacuuuucuuc

SEQ ID NO: 2095888 - RNA, 18 nt, Staphylococcus aureus subsp. aureus MW2
auacuuuuggucuguuga

SEQ ID NO: 2095889 - RNA, 17 nt, Staphylococcus aureus subsp. aureus MW2
auacuucaccaucuuua

SEQ ID NO: 2095890 - RNA, 13 nt, Staphylococcus aureus subsp. aureus MW2
auagaccuaugaa

SEQ ID NO: 2095891 - RNA, 19 nt, Staphylococcus aureus subsp. aureus MW2
auagauagaaauugugcuu

SEQ ID NO: 2095892 - RNA, 13 nt, Staphylococcus aureus subsp. aureus MW2
auagauaaggcua

SEQ ID NO: 2095893 - RNA, 14 nt, Staphylococcus aureus subsp. aureus MW2
auagauaaugcacc

SEQ ID NO: 2095894 - RNA, 16 nt, Staphylococcus aureus subsp. aureus MW2
auagacugccaauaaa

SEQ ID NO: 2095895 - RNA, 17 nt, Staphylococcus aureus subsp. aureus MW2
auagccuauuuaaaaga

SEQ ID NO: 2095896 - RNA, 17 nt, Staphylococcus aureus subsp. aureus MW2
auagccgccuuuuaaca

SEQ ID NO: 2095897 - RNA, 12 nt, Staphylococcus aureus subsp. aureus MW2
auagauuuuaau

SEQ ID NO: 2095898 - RNA, 15 nt, Staphylococcus aureus subsp. aureus MW2
auagauuuuaauaaa

SEQ ID NO: 2095899 - RNA, 18 nt, Staphylococcus aureus subsp. aureus MW2
auagcaaccauauuuuua

SEQ ID NO: 2095900 - RNA, 20 nt, Staphylococcus aureus subsp. aureus MW2
auagauuuuuucauagcuuu

SEQ ID NO: 2095901 - RNA, 19 nt, Staphylococcus aureus subsp. aureus MW2
auagcaaaauuauguaaaa

SEQ ID NO: 2095902 - RNA, 21 nt, Staphylococcus aureus subsp. aureus MW2
auagcaaccauauuuuuagaa

SEQ ID NO: 2095903 - RNA, 21 nt, Staphylococcus aureus subsp. aureus MW2
auagcauaaaaagagguuuuc

SEQ ID NO: 2095904 - RNA, 19 nt, Staphylococcus aureus subsp. aureus MW2
auacgcuuuuuaaaaaauu

SEQ ID NO: 2095905 - RNA, 14 nt, Staphylococcus aureus subsp. aureus MW2
auacgcuuuuuaaa

SEQ ID NO: 2095906 - RNA, 20 nt, Staphylococcus aureus subsp. aureus MW2
auacgacauuuuuagacauu

SEQ ID NO: 2095907 - RNA, 13 nt, Staphylococcus aureus subsp. aureus MW2
auacgacaaucac

SEQ ID NO: 2095908 - RNA, 14 nt, Staphylococcus aureus subsp. aureus MW2
auacgccuaaauau

SEQ ID NO: 2095909 - RNA, 13 nt, Staphylococcus aureus subsp. aureus MW2
auacgacaccaac

SEQ ID NO: 2095910 - RNA, 19 nt, Staphylococcus aureus subsp. aureus MW2
auacuaauaucuucuuuau

SEQ ID NO: 2095911 - RNA, 22 nt, Staphylococcus aureus subsp. aureus MW2
auacuaaucaaagaaaaaguga

SEQ ID NO: 2095912 - RNA, 13 nt, Staphylococcus aureus subsp. aureus MW2
auacuaacaauua

SEQ ID NO: 2095913 - RNA, 17 nt, Staphylococcus aureus subsp. aureus MW2
auacuaaauugagaagu

SEQ ID NO: 2095914 - RNA, 24 nt, Staphylococcus aureus subsp. aureus MW2
auacuaagauuagcuaugaacgaa

SEQ ID NO: 2095915 - RNA, 13 nt, Staphylococcus aureus subsp. aureus MW2
auacuaaaacaug

SEQ ID NO: 2095916 - RNA, 12 nt, Staphylococcus aureus subsp. aureus MW2
auacuaaaacau

SEQ ID NO: 2095917 - RNA, 12 nt, Staphylococcus aureus subsp. aureus MW2
auacuaaaaugg

SEQ ID NO: 2095918 - RNA, 18 nt, Staphylococcus aureus subsp. aureus MW2
auacuaaaauggauuuua

SEQ ID NO: 2095919 - RNA, 14 nt, Staphylococcus aureus subsp. aureus MW2
auacguuuauaucu

SEQ ID NO: 2095920 - RNA, 19 nt, Staphylococcus aureus subsp. aureus MW2
auacguuuauccuuuaaau

SEQ ID NO: 2095921 - RNA, 21 nt, Staphylococcus aureus subsp. aureus MW2
auaccgaauaauuuugauaua

SEQ ID NO: 2095922 - RNA, 13 nt, Staphylococcus aureus subsp. aureus MW2
auaccgaauaauu

SEQ ID NO: 2095923 - RNA, 20 nt, Staphylococcus aureus subsp. aureus MW2
auaccguuaguacggcugcu

SEQ ID NO: 2095924 - RNA, 16 nt, Staphylococcus aureus subsp. aureus MW2
auaccuuuuucuacca

SEQ ID NO: 2095925 - RNA, 19 nt, Staphylococcus aureus subsp. aureus MW2
auaccuuugccguauuuca

SEQ ID NO: 2095926 - RNA, 19 nt, Staphylococcus aureus subsp. aureus MW2
auaccuuuacuuucauuac

SEQ ID NO: 2095927 - RNA, 16 nt, Staphylococcus aureus subsp. aureus MW2
auacgaauuaaaauaa

SEQ ID NO: 2095928 - RNA, 17 nt, Staphylococcus aureus subsp. aureus MW2
auacgaaaccaaaaaua

SEQ ID NO: 2095929 - RNA, 16 nt, Staphylococcus aureus subsp. aureus MW2
auaccuaccacaauaa

SEQ ID NO: 2095930 - RNA, 21 nt, Staphylococcus aureus subsp. aureus MW2
auaccuacagauuuuaaaaau

SEQ ID NO: 2095931 - RNA, 14 nt, Staphylococcus aureus subsp. aureus MW2
auaccuaaaauacc

SEQ ID NO: 2095932 - RNA, 17 nt, Staphylococcus aureus subsp. aureus MW2
auaccuaaaauacccau

SEQ ID NO: 2095933 - RNA, 16 nt, Staphylococcus aureus subsp. aureus MW2
auaccaucaucgauau

SEQ ID NO: 2095934 - RNA, 16 nt, Staphylococcus aureus subsp. aureus MW2
auaccauuccaaaaau

SEQ ID NO: 2095935 - RNA, 18 nt, Staphylococcus aureus subsp. aureus MW2
auacccgcgauacugcca

SEQ ID NO: 2095936 - RNA, 21 nt, Staphylococcus aureus subsp. aureus MW2
auaccacaucgcauaauaucu

SEQ ID NO: 2095937 - RNA, 16 nt, Staphylococcus aureus subsp. aureus MW2
auaccaaccaaaacca

SEQ ID NO: 2095938 - RNA, 18 nt, Staphylococcus aureus subsp. aureus MW2
auaccaaccaaaaccaaa

SEQ ID NO: 2095939 - RNA, 20 nt, Staphylococcus aureus subsp. aureus MW2
auacauuuugcucuaaacuu

SEQ ID NO: 2095940 - RNA, 15 nt, Staphylococcus aureus subsp. aureus MW2
auaccaaauauauuu

SEQ ID NO: 2095941 - RNA, 16 nt, Staphylococcus aureus subsp. aureus MW2
auaauuuuaauauuau

SEQ ID NO: 2095942 - RNA, 18 nt, Staphylococcus aureus subsp. aureus MW2
auaauuuuaauauuaugu

SEQ ID NO: 2095943 - RNA, 19 nt, Staphylococcus aureus subsp. aureus MW2
auaauuugguuaauacguu

SEQ ID NO: 2095944 - RNA, 16 nt, Staphylococcus aureus subsp. aureus MW2
auaauuugugugcgau

SEQ ID NO: 2095945 - RNA, 22 nt, Staphylococcus aureus subsp. aureus MW2
auaauuuauuuagcaucuuuac

SEQ ID NO: 2095946 - RNA, 17 nt, Staphylococcus aureus subsp. aureus MW2
auaauuucuaaaucuaa

SEQ ID NO: 2095947 - RNA, 15 nt, Staphylococcus aureus subsp. aureus MW2
auaauuuaauaaugu

SEQ ID NO: 2095948 - RNA, 18 nt, Staphylococcus aureus subsp. aureus MW2
auaauuuaaauuaaaaua

SEQ ID NO: 2095949 - RNA, 19 nt, Staphylococcus aureus subsp. aureus MW2
auaauuuaaauuaaaauaa

SEQ ID NO: 2095950 - RNA, 20 nt, Staphylococcus aureus subsp. aureus MW2
auaauuuaaauuaaaauaau

SEQ ID NO: 2095951 - RNA, 15 nt, Staphylococcus aureus subsp. aureus MW2
auaauuuagaagauu

SEQ ID NO: 2095952 - RNA, 23 nt, Staphylococcus aureus subsp. aureus MW2
auaauuuaggagucuggaacaau

SEQ ID NO: 2095953 - RNA, 15 nt, Staphylococcus aureus subsp. aureus MW2
auaauuguugcauua

SEQ ID NO: 2095954 - RNA, 18 nt, Staphylococcus aureus subsp. aureus MW2
auaauuggaaucaucuuu

SEQ ID NO: 2095955 - RNA, 16 nt, Staphylococcus aureus subsp. aureus MW2
auaauugaaaaucuaa

SEQ ID NO: 2095956 - RNA, 16 nt, Staphylococcus aureus subsp. aureus MW2
auaauguacauguaua

SEQ ID NO: 2095957 - RNA, 17 nt, Staphylococcus aureus subsp. aureus MW2
auaaugguugaauaaca

SEQ ID NO: 2095958 - RNA, 19 nt, Staphylococcus aureus subsp. aureus MW2
auaauguauaaaacagaau

SEQ ID NO: 2095959 - RNA, 19 nt, Staphylococcus aureus subsp. aureus MW2
auaaugguucuaaaauaga

SEQ ID NO: 2095960 - RNA, 14 nt, Staphylococcus aureus subsp. aureus MW2
auaaugguuucaaa

SEQ ID NO: 2095961 - RNA, 16 nt, Staphylococcus aureus subsp. aureus MW2
auaaugguuucaaaau

SEQ ID NO: 2095962 - RNA, 16 nt, Staphylococcus aureus subsp. aureus MW2
auaaugugaaaaaucu

SEQ ID NO: 2095963 - RNA, 16 nt, Staphylococcus aureus subsp. aureus MW2
auaauuaugaaaagug

SEQ ID NO: 2095964 - RNA, 17 nt, Staphylococcus aureus subsp. aureus MW2
auaauuaugaaaaguga

SEQ ID NO: 2095965 - RNA, 13 nt, Staphylococcus aureus subsp. aureus MW2
auaauuaugaaaa

SEQ ID NO: 2095966 - RNA, 16 nt, Staphylococcus aureus subsp. aureus MW2
auaauuccaguauuaa

SEQ ID NO: 2095967 - RNA, 13 nt, Staphylococcus aureus subsp. aureus MW2
auaauucaucuug

SEQ ID NO: 2095968 - RNA, 17 nt, Staphylococcus aureus subsp. aureus MW2
auaauucaguguuacua

SEQ ID NO: 2095969 - RNA, 17 nt, Staphylococcus aureus subsp. aureus MW2
auaauucagaugaauaa

SEQ ID NO: 2095970 - RNA, 16 nt, Staphylococcus aureus subsp. aureus MW2
auaauuccugaaacaa

SEQ ID NO: 2095971 - RNA, 17 nt, Staphylococcus aureus subsp. aureus MW2
auaauuccugaaacaau

SEQ ID NO: 2095972 - RNA, 20 nt, Staphylococcus aureus subsp. aureus MW2
auaauuccugaaacaaugau

SEQ ID NO: 2095973 - RNA, 20 nt, Staphylococcus aureus subsp. aureus MW2
auaauucgugauuacauucu

SEQ ID NO: 2095974 - RNA, 24 nt, Staphylococcus aureus subsp. aureus MW2
auaacgucacaacggcauaauaca

SEQ ID NO: 2095975 - RNA, 14 nt, Staphylococcus aureus subsp. aureus MW2
auaacgcuuuaaau

SEQ ID NO: 2095976 - RNA, 21 nt, Staphylococcus aureus subsp. aureus MW2
auaauccaagauauauaacua

SEQ ID NO: 2095977 - RNA, 13 nt, Staphylococcus aureus subsp. aureus MW2
auaauccaccuaa

SEQ ID NO: 2095978 - RNA, 16 nt, Staphylococcus aureus subsp. aureus MW2
auaauccaccuaaaaa

SEQ ID NO: 2095979 - RNA, 11 nt, Staphylococcus aureus subsp. aureus MW2
auaauccauuc

SEQ ID NO: 2095980 - RNA, 17 nt, Staphylococcus aureus subsp. aureus MW2
auaauccauucuucuug

SEQ ID NO: 2095981 - RNA, 18 nt, Staphylococcus aureus subsp. aureus MW2
auaaucccaaccauucua

SEQ ID NO: 2095982 - RNA, 18 nt, Staphylococcus aureus subsp. aureus MW2
auaaucucauucuuuaau

SEQ ID NO: 2095983 - RNA, 23 nt, Staphylococcus aureus subsp. aureus MW2
auaaucucuucaauuuauuuuua

SEQ ID NO: 2095984 - RNA, 15 nt, Staphylococcus aureus subsp. aureus MW2
auaaucucuucaauu

SEQ ID NO: 2095985 - RNA, 13 nt, Staphylococcus aureus subsp. aureus MW2
auaaucucuuuac

SEQ ID NO: 2095986 - RNA, 14 nt, Staphylococcus aureus subsp. aureus MW2
auaaucucuuuaca

SEQ ID NO: 2095987 - RNA, 14 nt, Staphylococcus aureus subsp. aureus MW2
auaaugauacuaau

SEQ ID NO: 2095988 - RNA, 14 nt, Staphylococcus aureus subsp. aureus MW2
auaaugaucaagua

SEQ ID NO: 2095989 - RNA, 14 nt, Staphylococcus aureus subsp. aureus MW2
auaaugacugcaga

SEQ ID NO: 2095990 - RNA, 19 nt, Staphylococcus aureus subsp. aureus MW2
auaaugacaaauuaucacu

SEQ ID NO: 2095991 - RNA, 23 nt, Staphylococcus aureus subsp. aureus MW2
auaaugaugugccucaucuucaa

SEQ ID NO: 2095992 - RNA, 13 nt, Staphylococcus aureus subsp. aureus MW2
auaaugauugucu

SEQ ID NO: 2095993 - RNA, 23 nt, Staphylococcus aureus subsp. aureus MW2
auacacuaucauuaucaaauaac

SEQ ID NO: 2095994 - RNA, 13 nt, Staphylococcus aureus subsp. aureus MW2
auacacguacaaa

SEQ ID NO: 2095995 - RNA, 16 nt, Staphylococcus aureus subsp. aureus MW2
auacacguacaaaaua

SEQ ID NO: 2095996 - RNA, 22 nt, Staphylococcus aureus subsp. aureus MW2
auacagaaccaacaauaaaucu

SEQ ID NO: 2095997 - RNA, 19 nt, Staphylococcus aureus subsp. aureus MW2
auacagaaccaacaauaaa

SEQ ID NO: 2095998 - RNA, 18 nt, Staphylococcus aureus subsp. aureus MW2
auacagaaccaacaauaa

SEQ ID NO: 2095999 - RNA, 15 nt, Staphylococcus aureus subsp. aureus MW2
auacacuuacaaaua

SEQ ID NO: 2096000 - RNA, 16 nt, Staphylococcus aureus subsp. aureus MW2
auacacuuacaaauau

SEQ ID NO: 2096001 - RNA, 23 nt, Staphylococcus aureus subsp. aureus MW2
auacacuuuuugacauauuuuuu

SEQ ID NO: 2096002 - RNA, 22 nt, Staphylococcus aureus subsp. aureus MW2
auacacuugguuaucauuauuc

SEQ ID NO: 2096003 - RNA, 23 nt, Staphylococcus aureus subsp. aureus MW2
auacacuugguuaucauuauuca

SEQ ID NO: 2096004 - RNA, 19 nt, Staphylococcus aureus subsp. aureus MW2
auacacuugcuaaaacuaa

SEQ ID NO: 2096005 - RNA, 21 nt, Staphylococcus aureus subsp. aureus MW2
auacaaugaauuucuaauuua

SEQ ID NO: 2096006 - RNA, 17 nt, Staphylococcus aureus subsp. aureus MW2
auacaauguauuuugau

SEQ ID NO: 2096007 - RNA, 18 nt, Staphylococcus aureus subsp. aureus MW2
auacaaugaauuucuaau

SEQ ID NO: 2096008 - RNA, 20 nt, Staphylococcus aureus subsp. aureus MW2
auacaauuauggauaaaauu

SEQ ID NO: 2096009 - RNA, 21 nt, Staphylococcus aureus subsp. aureus MW2
auacaauuucuucauuuucau

SEQ ID NO: 2096010 - RNA, 21 nt, Staphylococcus aureus subsp. aureus MW2
auacaauuuagguuaauuaaa

SEQ ID NO: 2096011 - RNA, 23 nt, Staphylococcus aureus subsp. aureus MW2
auacacaaugauuauaaauacau

SEQ ID NO: 2096012 - RNA, 18 nt, Staphylococcus aureus subsp. aureus MW2
auacacacugcuaaaauu

SEQ ID NO: 2096013 - RNA, 17 nt, Staphylococcus aureus subsp. aureus MW2
auacaauaguauaaaua

SEQ ID NO: 2096014 - RNA, 13 nt, Staphylococcus aureus subsp. aureus MW2
auacaauauguga

SEQ ID NO: 2096015 - RNA, 16 nt, Staphylococcus aureus subsp. aureus MW2
auacaauaaugugcaa

SEQ ID NO: 2096016 - RNA, 18 nt, Staphylococcus aureus subsp. aureus MW2
auacaaauuuauauuaaa

SEQ ID NO: 2096017 - RNA, 22 nt, Staphylococcus aureus subsp. aureus MW2
auacaaauuuauauuaaauaaa

SEQ ID NO: 2096018 - RNA, 14 nt, Staphylococcus aureus subsp. aureus MW2
auaauuuuggauuu

SEQ ID NO: 2096019 - RNA, 20 nt, Staphylococcus aureus subsp. aureus MW2
auaauuuuccaucuauccga

SEQ ID NO: 2096020 - RNA, 22 nt, Staphylococcus aureus subsp. aureus MW2
auacaaaacauuacguaucuuu

SEQ ID NO: 2096021 - RNA, 19 nt, Staphylococcus aureus subsp. aureus MW2
auacaaacccauauaaaug

SEQ ID NO: 2096022 - RNA, 19 nt, Staphylococcus aureus subsp. aureus MW2
auacauaccacacuuuaaa

SEQ ID NO: 2096023 - RNA, 23 nt, Staphylococcus aureus subsp. aureus MW2
auacauaacgucccauaauagcu

SEQ ID NO: 2096024 - RNA, 19 nt, Staphylococcus aureus subsp. aureus MW2
auacauaauucaaugccau

SEQ ID NO: 2096025 - RNA, 22 nt, Staphylococcus aureus subsp. aureus MW2
auacaguuaucaccgcauuaaa

SEQ ID NO: 2096026 - RNA, 20 nt, Staphylococcus aureus subsp. aureus MW2
auacagucaauacaaaacau

SEQ ID NO: 2096027 - RNA, 15 nt, Staphylococcus aureus subsp. aureus MW2
auacaggaaauugaa

SEQ ID NO: 2096028 - RNA, 15 nt, Staphylococcus aureus subsp. aureus MW2
auacauuuugcucua

SEQ ID NO: 2096029 - RNA, 13 nt, Staphylococcus aureus subsp. aureus MW2
auacauuucaaaa

SEQ ID NO: 2096030 - RNA, 15 nt, Staphylococcus aureus subsp. aureus MW2
auacauuucaaaaaa

SEQ ID NO: 2096031 - RNA, 16 nt, Staphylococcus aureus subsp. aureus MW2
auacauuagaacaauc

SEQ ID NO: 2096032 - RNA, 15 nt, Staphylococcus aureus subsp. aureus MW2
auacauuauuaaaua

SEQ ID NO: 2096033 - RNA, 20 nt, Staphylococcus aureus subsp. aureus MW2
auacauuaaacauauuuuuu

SEQ ID NO: 2096034 - RNA, 16 nt, Staphylococcus aureus subsp. aureus MW2
auacauuaacgauuaa

SEQ ID NO: 2096035 - RNA, 18 nt, Staphylococcus aureus subsp. aureus MW2
auacauuaauauaaauau

SEQ ID NO: 2096036 - RNA, 17 nt, Staphylococcus aureus subsp. aureus MW2
auacaugacauucauuu

SEQ ID NO: 2096037 - RNA, 17 nt, Staphylococcus aureus subsp. aureus MW2
auacaugccaauggaag

SEQ ID NO: 2096038 - RNA, 13 nt, Staphylococcus aureus subsp. aureus MW2
auacaucaauauc

SEQ ID NO: 2096039 - RNA, 14 nt, Staphylococcus aureus subsp. aureus MW2
auacaucaauuucu

SEQ ID NO: 2096040 - RNA, 20 nt, Staphylococcus aureus subsp. aureus MW2
auacaucauuagacuuucuu

SEQ ID NO: 2096041 - RNA, 22 nt, Staphylococcus aureus subsp. aureus MW2
auacauagguucaucuuuaugc

SEQ ID NO: 2096042 - RNA, 13 nt, Staphylococcus aureus subsp. aureus MW2
auacauacugauu

SEQ ID NO: 2096043 - RNA, 12 nt, Staphylococcus aureus subsp. aureus MW2
auacauaucuuu

SEQ ID NO: 2096044 - RNA, 15 nt, Staphylococcus aureus subsp. aureus MW2
auacauaucuuuugc

SEQ ID NO: 2096045 - RNA, 16 nt, Staphylococcus aureus subsp. aureus MW2
auauuucggacaauaa

SEQ ID NO: 2096046 - RNA, 21 nt, Staphylococcus aureus subsp. aureus MW2
auauuucgguuagucuuaauc

SEQ ID NO: 2096047 - RNA, 19 nt, Staphylococcus aureus subsp. aureus MW2
auauuucccuaugaaauaa

SEQ ID NO: 2096048 - RNA, 14 nt, Staphylococcus aureus subsp. aureus MW2
auauuuauuuuaaa

SEQ ID NO: 2096049 - RNA, 15 nt, Staphylococcus aureus subsp. aureus MW2
auauuuauuuuaaau

SEQ ID NO: 2096050 - RNA, 17 nt, Staphylococcus aureus subsp. aureus MW2
auauuuauuuuauaaua

SEQ ID NO: 2096051 - RNA, 14 nt, Staphylococcus aureus subsp. aureus MW2
auauuuauuuuuga

SEQ ID NO: 2096052 - RNA, 20 nt, Staphylococcus aureus subsp. aureus MW2
auauuuccaaauugaaauua

SEQ ID NO: 2096053 - RNA, 16 nt, Staphylococcus aureus subsp. aureus MW2
auauuucauuugacug

SEQ ID NO: 2096054 - RNA, 15 nt, Staphylococcus aureus subsp. aureus MW2
auauuucuuaccauu

SEQ ID NO: 2096055 - RNA, 19 nt, Staphylococcus aureus subsp. aureus MW2
auauuugaaagguaaguac

SEQ ID NO: 2096056 - RNA, 21 nt, Staphylococcus aureus subsp. aureus MW2
auauuugaaagguaaguacuu

SEQ ID NO: 2096057 - RNA, 14 nt, Staphylococcus aureus subsp. aureus MW2
auauuugauuauuc

SEQ ID NO: 2096058 - RNA, 23 nt, Staphylococcus aureus subsp. aureus MW2
aucaaaauauaaaauccuaagca

SEQ ID NO: 2096059 - RNA, 23 nt, Staphylococcus aureus subsp. aureus MW2
aucaaagaaauguaugacauaaa

SEQ ID NO: 2096060 - RNA, 20 nt, Staphylococcus aureus subsp. aureus MW2
aucaaagaggcuuuaaaauu

SEQ ID NO: 2096061 - RNA, 20 nt, Staphylococcus aureus subsp. aureus MW2
aucaaagaguaaaguuaaaa

SEQ ID NO: 2096062 - RNA, 17 nt, Staphylococcus aureus subsp. aureus MW2
aucaaaguaucuuuugc

SEQ ID NO: 2096063 - RNA, 13 nt, Staphylococcus aureus subsp. aureus MW2
aucaaauucaaau

SEQ ID NO: 2096064 - RNA, 18 nt, Staphylococcus aureus subsp. aureus MW2
aucaaauucaaauuauaa

SEQ ID NO: 2096065 - RNA, 19 nt, Staphylococcus aureus subsp. aureus MW2
aucaaauucaaauuauaau

SEQ ID NO: 2096066 - RNA, 21 nt, Staphylococcus aureus subsp. aureus MW2
aucaaauuagucauccaaaga

SEQ ID NO: 2096067 - RNA, 11 nt, Staphylococcus aureus subsp. aureus MW2
aucaaauuacc

SEQ ID NO: 2096068 - RNA, 22 nt, Staphylococcus aureus subsp. aureus MW2
aucaaaugguacaguuaauucu

SEQ ID NO: 2096069 - RNA, 23 nt, Staphylococcus aureus subsp. aureus MW2
aucaaauccaaaaucuuuacuug

SEQ ID NO: 2096070 - RNA, 18 nt, Staphylococcus aureus subsp. aureus MW2
aucaaauacauuucaaaa

SEQ ID NO: 2096071 - RNA, 17 nt, Staphylococcus aureus subsp. aureus MW2
aucaaauacauuucaaa

SEQ ID NO: 2096072 - RNA, 19 nt, Staphylococcus aureus subsp. aureus MW2
aucaaauauuuuauuacau

SEQ ID NO: 2096073 - RNA, 23 nt, Staphylococcus aureus subsp. aureus MW2
aucaacacacacaguuuauaaua

SEQ ID NO: 2096074 - RNA, 14 nt, Staphylococcus aureus subsp. aureus MW2
aucaacacacacag

SEQ ID NO: 2096075 - RNA, 14 nt, Staphylococcus aureus subsp. aureus MW2
aucaacaaauuuaa

SEQ ID NO: 2096076 - RNA, 17 nt, Staphylococcus aureus subsp. aureus MW2
aucaacaaauuuaacuu

SEQ ID NO: 2096077 - RNA, 16 nt, Staphylococcus aureus subsp. aureus MW2
aucaacuauuuacauc

SEQ ID NO: 2096078 - RNA, 12 nt, Staphylococcus aureus subsp. aureus MW2
aucaauccauca

SEQ ID NO: 2096079 - RNA, 21 nt, Staphylococcus aureus subsp. aureus MW2
aucaauaccauaauuaaauaa

SEQ ID NO: 2096080 - RNA, 16 nt, Staphylococcus aureus subsp. aureus MW2
aucaagagguaaaucu

SEQ ID NO: 2096081 - RNA, 22 nt, Staphylococcus aureus subsp. aureus MW2
aucaagacucccuuuuuaaaau

SEQ ID NO: 2096082 - RNA, 22 nt, Staphylococcus aureus subsp. aureus MW2
aucaagacauuuuaacaaguga

SEQ ID NO: 2096083 - RNA, 12 nt, Staphylococcus aureus subsp. aureus MW2
aucaacuuuaau

SEQ ID NO: 2096084 - RNA, 19 nt, Staphylococcus aureus subsp. aureus MW2
aucaagaaauguuaaauua

SEQ ID NO: 2096085 - RNA, 13 nt, Staphylococcus aureus subsp. aureus MW2
aucaacuuuucua

SEQ ID NO: 2096086 - RNA, 19 nt, Staphylococcus aureus subsp. aureus MW2
auauugguuauauauuguc

SEQ ID NO: 2096087 - RNA, 16 nt, Staphylococcus aureus subsp. aureus MW2
auauugagaauauuaa

SEQ ID NO: 2096088 - RNA, 21 nt, Staphylococcus aureus subsp. aureus MW2
auauuggcaguucugaaacau

SEQ ID NO: 2096089 - RNA, 21 nt, Staphylococcus aureus subsp. aureus MW2
auauugguaucuccaauauuu

SEQ ID NO: 2096090 - RNA, 23 nt, Staphylococcus aureus subsp. aureus MW2
auauuggcuugcuucauuauaua

SEQ ID NO: 2096091 - RNA, 20 nt, Staphylococcus aureus subsp. aureus MW2
auauuggaauacucuuuaau

SEQ ID NO: 2096092 - RNA, 16 nt, Staphylococcus aureus subsp. aureus MW2
auauugcuuauguaca

SEQ ID NO: 2096093 - RNA, 17 nt, Staphylococcus aureus subsp. aureus MW2
auauuuaagaaguuaaa

SEQ ID NO: 2096094 - RNA, 17 nt, Staphylococcus aureus subsp. aureus MW2
auauuuacacagaauga

SEQ ID NO: 2096095 - RNA, 13 nt, Staphylococcus aureus subsp. aureus MW2
auauuuacacaga

SEQ ID NO: 2096096 - RNA, 22 nt, Staphylococcus aureus subsp. aureus MW2
auauuuauuguuuuuaaaaucu

SEQ ID NO: 2096097 - RNA, 22 nt, Staphylococcus aureus subsp. aureus MW2
auauuuagauuggucaaacuua

SEQ ID NO: 2096098 - RNA, 23 nt, Staphylococcus aureus subsp. aureus MW2
auauuuaggugugucaauaguaa

SEQ ID NO: 2096099 - RNA, 15 nt, Staphylococcus aureus subsp. aureus MW2
auauuauauauauuc

SEQ ID NO: 2096100 - RNA, 16 nt, Staphylococcus aureus subsp. aureus MW2
auauuauauuuugaau

SEQ ID NO: 2096101 - RNA, 18 nt, Staphylococcus aureus subsp. aureus MW2
auauuaucguaauuguua

SEQ ID NO: 2096102 - RNA, 23 nt, Staphylococcus aureus subsp. aureus MW2
auauuaugaacaugaaauuaauc

SEQ ID NO: 2096103 - RNA, 22 nt, Staphylococcus aureus subsp. aureus MW2
auauuaugauacgcuuuuuaaa

SEQ ID NO: 2096104 - RNA, 22 nt, Staphylococcus aureus subsp. aureus MW2
auauucauguucuuguaauccu

SEQ ID NO: 2096105 - RNA, 12 nt, Staphylococcus aureus subsp. aureus MW2
auauucaucaua

SEQ ID NO: 2096106 - RNA, 15 nt, Staphylococcus aureus subsp. aureus MW2
auauucaucauauau

SEQ ID NO: 2096107 - RNA, 17 nt, Staphylococcus aureus subsp. aureus MW2
auauugaauugaaaaau

SEQ ID NO: 2096108 - RNA, 16 nt, Staphylococcus aureus subsp. aureus MW2
auauugaauaaaaaaa

SEQ ID NO: 2096109 - RNA, 19 nt, Staphylococcus aureus subsp. aureus MW2
auauugaauaaaaaaacac

SEQ ID NO: 2096110 - RNA, 23 nt, Staphylococcus aureus subsp. aureus MW2
auauugagaauauuaagauguau

SEQ ID NO: 2096111 - RNA, 12 nt, Staphylococcus aureus subsp. aureus MW2
auauugacugcc

SEQ ID NO: 2096112 - RNA, 21 nt, Staphylococcus aureus subsp. aureus MW2
auauggugguauuagaacuuc

SEQ ID NO: 2096113 - RNA, 17 nt, Staphylococcus aureus subsp. aureus MW2
auaugguuagaaaaaaa

SEQ ID NO: 2096114 - RNA, 21 nt, Staphylococcus aureus subsp. aureus MW2
auaugguuagaaaaaaaucug

SEQ ID NO: 2096115 - RNA, 17 nt, Staphylococcus aureus subsp. aureus MW2
auauggucuuuuaauau

SEQ ID NO: 2096116 - RNA, 23 nt, Staphylococcus aureus subsp. aureus MW2
auauguauagaggauauuuauuc

SEQ ID NO: 2096117 - RNA, 17 nt, Staphylococcus aureus subsp. aureus MW2
auauguauuauagauua

SEQ ID NO: 2096118 - RNA, 16 nt, Staphylococcus aureus subsp. aureus MW2
auauguaaaugaaaua

SEQ ID NO: 2096119 - RNA, 17 nt, Staphylococcus aureus subsp. aureus MW2
auauguacuauuaucua

SEQ ID NO: 2096120 - RNA, 14 nt, Staphylococcus aureus subsp. aureus MW2
auauguauaacaau

SEQ ID NO: 2096121 - RNA, 19 nt, Staphylococcus aureus subsp. aureus MW2
auauguuuggauaucuuug

SEQ ID NO: 2096122 - RNA, 22 nt, Staphylococcus aureus subsp. aureus MW2
auauguuuuauaauaaauguca

SEQ ID NO: 2096123 - RNA, 12 nt, Staphylococcus aureus subsp. aureus MW2
auaugugagcaa

SEQ ID NO: 2096124 - RNA, 19 nt, Staphylococcus aureus subsp. aureus MW2
auaugugguggcuauauaa

SEQ ID NO: 2096125 - RNA, 16 nt, Staphylococcus aureus subsp. aureus MW2
auauguguagugaaaa

SEQ ID NO: 2096126 - RNA, 19 nt, Staphylococcus aureus subsp. aureus MW2
auauguguaugauagaaua

SEQ ID NO: 2096127 - RNA, 16 nt, Staphylococcus aureus subsp. aureus MW2
auauguguuaacugau

SEQ ID NO: 2096128 - RNA, 19 nt, Staphylococcus aureus subsp. aureus MW2
auauuacuuuggaaauuua

SEQ ID NO: 2096129 - RNA, 18 nt, Staphylococcus aureus subsp. aureus MW2
auauuacuucucaucgaa

SEQ ID NO: 2096130 - RNA, 16 nt, Staphylococcus aureus subsp. aureus MW2
auauuaauuuuacguu

SEQ ID NO: 2096131 - RNA, 21 nt, Staphylococcus aureus subsp. aureus MW2
auauuacuuuggaaauuuauu

SEQ ID NO: 2096132 - RNA, 18 nt, Staphylococcus aureus subsp. aureus MW2
auauuauaaaaagauaua

SEQ ID NO: 2096133 - RNA, 14 nt, Staphylococcus aureus subsp. aureus MW2
auauuauaaaaaua

SEQ ID NO: 2096134 - RNA, 21 nt, Staphylococcus aureus subsp. aureus MW2
auauuaaaauuaaaacuuuca

SEQ ID NO: 2096135 - RNA, 23 nt, Staphylococcus aureus subsp. aureus MW2
auauuaaacacgcgguaaaacga

SEQ ID NO: 2096136 - RNA, 16 nt, Staphylococcus aureus subsp. aureus MW2
auauuaaaguaaaaua

SEQ ID NO: 2096137 - RNA, 14 nt, Staphylococcus aureus subsp. aureus MW2
auauuaacaccaga

SEQ ID NO: 2096138 - RNA, 19 nt, Staphylococcus aureus subsp. aureus MW2
auauuaacguuaguauaaa

SEQ ID NO: 2096139 - RNA, 15 nt, Staphylococcus aureus subsp. aureus MW2
auauuaacaacuuua

SEQ ID NO: 2096140 - RNA, 13 nt, Staphylococcus aureus subsp. aureus MW2
auauuaaauuucu

SEQ ID NO: 2096141 - RNA, 12 nt, Staphylococcus aureus subsp. aureus MW2
auauuaaauuca

SEQ ID NO: 2096142 - RNA, 18 nt, Staphylococcus aureus subsp. aureus MW2
auauuaagcgucuaucuc

SEQ ID NO: 2096143 - RNA, 13 nt, Staphylococcus aureus subsp. aureus MW2
auauuaacuguac

SEQ ID NO: 2096144 - RNA, 13 nt, Staphylococcus aureus subsp. aureus MW2
auauuaauuuuac

SEQ ID NO: 2096145 - RNA, 16 nt, Staphylococcus aureus subsp. aureus MW2
auauuaauccacaaau

SEQ ID NO: 2096146 - RNA, 21 nt, Staphylococcus aureus subsp. aureus MW2
auauuaauccacaaauaacac

SEQ ID NO: 2096147 - RNA, 13 nt, Staphylococcus aureus subsp. aureus MW2
auauuaaucaauu

SEQ ID NO: 2096148 - RNA, 13 nt, Staphylococcus aureus subsp. aureus MW2
auauauagaaaua

SEQ ID NO: 2096149 - RNA, 14 nt, Staphylococcus aureus subsp. aureus MW2
auauagugauugaa

SEQ ID NO: 2096150 - RNA, 13 nt, Staphylococcus aureus subsp. aureus MW2
auauauaaccaua

SEQ ID NO: 2096151 - RNA, 16 nt, Staphylococcus aureus subsp. aureus MW2
auauauaacaaguaca

SEQ ID NO: 2096152 - RNA, 14 nt, Staphylococcus aureus subsp. aureus MW2
auauauacaaauaa

SEQ ID NO: 2096153 - RNA, 17 nt, Staphylococcus aureus subsp. aureus MW2
auauagucuaugaauaa

SEQ ID NO: 2096154 - RNA, 19 nt, Staphylococcus aureus subsp. aureus MW2
auauauaaaaucauuaaua

SEQ ID NO: 2096155 - RNA, 14 nt, Staphylococcus aureus subsp. aureus MW2
auauaguuggcaau

SEQ ID NO: 2096156 - RNA, 14 nt, Staphylococcus aureus subsp. aureus MW2
auauaguaaaauaa

SEQ ID NO: 2096157 - RNA, 14 nt, Staphylococcus aureus subsp. aureus MW2
auauagucaaugaa

SEQ ID NO: 2096158 - RNA, 23 nt, Staphylococcus aureus subsp. aureus MW2
auauaguaacagacuuuguuaaa

SEQ ID NO: 2096159 - RNA, 23 nt, Staphylococcus aureus subsp. aureus MW2
auauaguaggagugaacuauaua

SEQ ID NO: 2096160 - RNA, 21 nt, Staphylococcus aureus subsp. aureus MW2
auauaguaggguauugaaaua

SEQ ID NO: 2096161 - RNA, 21 nt, Staphylococcus aureus subsp. aureus MW2
auauagcacgcuuauugaaaa

SEQ ID NO: 2096162 - RNA, 18 nt, Staphylococcus aureus subsp. aureus MW2
auauagcggugucaauau

SEQ ID NO: 2096163 - RNA, 19 nt, Staphylococcus aureus subsp. aureus MW2
auauagcggugucaauauu

SEQ ID NO: 2096164 - RNA, 18 nt, Staphylococcus aureus subsp. aureus MW2
auauagcugugauuugau

SEQ ID NO: 2096165 - RNA, 14 nt, Staphylococcus aureus subsp. aureus MW2
auauacucuaaaaa

SEQ ID NO: 2096166 - RNA, 17 nt, Staphylococcus aureus subsp. aureus MW2
auauacuaaauuugaaa

SEQ ID NO: 2096167 - RNA, 22 nt, Staphylococcus aureus subsp. aureus MW2
auauacgauugaguugaaaaua

SEQ ID NO: 2096168 - RNA, 13 nt, Staphylococcus aureus subsp. aureus MW2
auauagagaaaag

SEQ ID NO: 2096169 - RNA, 13 nt, Staphylococcus aureus subsp. aureus MW2
auauagauuaaac

SEQ ID NO: 2096170 - RNA, 21 nt, Staphylococcus aureus subsp. aureus MW2
auauacgacauuuuuagacau

SEQ ID NO: 2096171 - RNA, 15 nt, Staphylococcus aureus subsp. aureus MW2
auauacgacauuuuu

SEQ ID NO: 2096172 - RNA, 13 nt, Staphylococcus aureus subsp. aureus MW2
auauaccaaccaa

SEQ ID NO: 2096173 - RNA, 22 nt, Staphylococcus aureus subsp. aureus MW2
auauaaugcugauaauuuuucu

SEQ ID NO: 2096174 - RNA, 21 nt, Staphylococcus aureus subsp. aureus MW2
auauaaugcugauaauuuuuc

SEQ ID NO: 2096175 - RNA, 21 nt, Staphylococcus aureus subsp. aureus MW2
auauaaugauuuaauuuguua

SEQ ID NO: 2096176 - RNA, 13 nt, Staphylococcus aureus subsp. aureus MW2
auauaauagaaau

SEQ ID NO: 2096177 - RNA, 20 nt, Staphylococcus aureus subsp. aureus MW2
auauaauauauacaaauaaa

SEQ ID NO: 2096178 - RNA, 16 nt, Staphylococcus aureus subsp. aureus MW2
auauaagcaaagacaa

SEQ ID NO: 2096179 - RNA, 22 nt, Staphylococcus aureus subsp. aureus MW2
auauaagcaaagacaaaagcaa

SEQ ID NO: 2096180 - RNA, 14 nt, Staphylococcus aureus subsp. aureus MW2
auagucaucuguua

SEQ ID NO: 2096181 - RNA, 12 nt, Staphylococcus aureus subsp. aureus MW2
auagucaucuua

SEQ ID NO: 2096182 - RNA, 20 nt, Staphylococcus aureus subsp. aureus MW2
auaguccgcguguacuuuac

SEQ ID NO: 2096183 - RNA, 22 nt, Staphylococcus aureus subsp. aureus MW2
auagucauucauaauuuguuga

SEQ ID NO: 2096184 - RNA, 14 nt, Staphylococcus aureus subsp. aureus MW2
auagccuucauuug

SEQ ID NO: 2096185 - RNA, 14 nt, Staphylococcus aureus subsp. aureus MW2
auagccuucaaaau

SEQ ID NO: 2096186 - RNA, 15 nt, Staphylococcus aureus subsp. aureus MW2
auauaaacuauuaaa

SEQ ID NO: 2096187 - RNA, 18 nt, Staphylococcus aureus subsp. aureus MW2
auauaaacuauuaaauca

SEQ ID NO: 2096188 - RNA, 18 nt, Staphylococcus aureus subsp. aureus MW2
auauaaaggaauagcuac

SEQ ID NO: 2096189 - RNA, 22 nt, Staphylococcus aureus subsp. aureus MW2
auaguucaaauugaacuucuuu

SEQ ID NO: 2096190 - RNA, 21 nt, Staphylococcus aureus subsp. aureus MW2
auauaaacaucuucuucauca

SEQ ID NO: 2096191 - RNA, 14 nt, Staphylococcus aureus subsp. aureus MW2
auaguucuuuaaau

SEQ ID NO: 2096192 - RNA, 22 nt, Staphylococcus aureus subsp. aureus MW2
auagucuuaaacauaacaugac

SEQ ID NO: 2096193 - RNA, 22 nt, Staphylococcus aureus subsp. aureus MW2
auagucugcuauuuuuuuaaua

SEQ ID NO: 2096194 - RNA, 14 nt, Staphylococcus aureus subsp. aureus MW2
auagucggggcccc

SEQ ID NO: 2096195 - RNA, 16 nt, Staphylococcus aureus subsp. aureus MW2
auaguuaagauuuuaa

SEQ ID NO: 2096196 - RNA, 14 nt, Staphylococcus aureus subsp. aureus MW2
auaguuaccaaaau

SEQ ID NO: 2096197 - RNA, 12 nt, Staphylococcus aureus subsp. aureus MW2
auagugaaauua

SEQ ID NO: 2096198 - RNA, 15 nt, Staphylococcus aureus subsp. aureus MW2
auaucaugcaaaaua

SEQ ID NO: 2096199 - RNA, 16 nt, Staphylococcus aureus subsp. aureus MW2
auaucauauaaugguu

SEQ ID NO: 2096200 - RNA, 21 nt, Staphylococcus aureus subsp. aureus MW2
auauccauucuuuuucaaaau

SEQ ID NO: 2096201 - RNA, 20 nt, Staphylococcus aureus subsp. aureus MW2
auauccauucaauguuuaau

SEQ ID NO: 2096202 - RNA, 15 nt, Staphylococcus aureus subsp. aureus MW2
auauaugaaauauuu

SEQ ID NO: 2096203 - RNA, 17 nt, Staphylococcus aureus subsp. aureus MW2
auauaugaaauauuuau

SEQ ID NO: 2096204 - RNA, 14 nt, Staphylococcus aureus subsp. aureus MW2
auauaugaaauauu

SEQ ID NO: 2096205 - RNA, 21 nt, Staphylococcus aureus subsp. aureus MW2
auauauccugccaauauauuc

SEQ ID NO: 2096206 - RNA, 12 nt, Staphylococcus aureus subsp. aureus MW2
auauaucaaaua

SEQ ID NO: 2096207 - RNA, 12 nt, Staphylococcus aureus subsp. aureus MW2
auauauauuuaa

SEQ ID NO: 2096208 - RNA, 13 nt, Staphylococcus aureus subsp. aureus MW2
auauauauuuaaa

SEQ ID NO: 2096209 - RNA, 16 nt, Staphylococcus aureus subsp. aureus MW2
auauauguaacaaaug

SEQ ID NO: 2096210 - RNA, 12 nt, Staphylococcus aureus subsp. aureus MW2
auauaugauaaa

SEQ ID NO: 2096211 - RNA, 20 nt, Staphylococcus aureus subsp. aureus MW2
auaucauaccaaaaaguauu

SEQ ID NO: 2096212 - RNA, 13 nt, Staphylococcus aureus subsp. aureus MW2
auaucauauuacu

SEQ ID NO: 2096213 - RNA, 15 nt, Staphylococcus aureus subsp. aureus MW2
auaucauauucaaaa

SEQ ID NO: 2096214 - RNA, 18 nt, Staphylococcus aureus subsp. aureus MW2
auaucauauucaaaauaa

SEQ ID NO: 2096215 - RNA, 19 nt, Staphylococcus aureus subsp. aureus MW2
auauauguaacauaaagcu

SEQ ID NO: 2096216 - RNA, 15 nt, Staphylococcus aureus subsp. aureus MW2
auaucauaacuuaac

SEQ ID NO: 2096217 - RNA, 17 nt, Staphylococcus aureus subsp. aureus MW2
auauccuucaaagauuu

SEQ ID NO: 2096218 - RNA, 14 nt, Staphylococcus aureus subsp. aureus MW2
auauccuucauuag

SEQ ID NO: 2096219 - RNA, 19 nt, Staphylococcus aureus subsp. aureus MW2
auaucgcgcaucaaaaaug

SEQ ID NO: 2096220 - RNA, 17 nt, Staphylococcus aureus subsp. aureus MW2
auaucgcuuuugaaguu

SEQ ID NO: 2096221 - RNA, 16 nt, Staphylococcus aureus subsp. aureus MW2
auaucgucguaacucu

SEQ ID NO: 2096222 - RNA, 23 nt, Staphylococcus aureus subsp. aureus MW2
auaucgugcguuaaauauauauu

SEQ ID NO: 2096223 - RNA, 17 nt, Staphylococcus aureus subsp. aureus MW2
auaucccggaauauuaa

SEQ ID NO: 2096224 - RNA, 18 nt, Staphylococcus aureus subsp. aureus MW2
auaucccggaauauuaac

SEQ ID NO: 2096225 - RNA, 14 nt, Staphylococcus aureus subsp. aureus MW2
auaucucaaagauu

SEQ ID NO: 2096226 - RNA, 12 nt, Staphylococcus aureus subsp. aureus MW2
auaucucaagau

SEQ ID NO: 2096227 - RNA, 15 nt, Staphylococcus aureus subsp. aureus MW2
auaucucaagauauc

SEQ ID NO: 2096228 - RNA, 20 nt, Staphylococcus aureus subsp. aureus MW2
auaucugaaguagauugaua

SEQ ID NO: 2096229 - RNA, 20 nt, Staphylococcus aureus subsp. aureus MW2
auaugaauuuagaugcauaa

SEQ ID NO: 2096230 - RNA, 11 nt, Staphylococcus aureus subsp. aureus MW2
auaugaaaugu

SEQ ID NO: 2096231 - RNA, 15 nt, Staphylococcus aureus subsp. aureus MW2
auaugaaauauuuau

SEQ ID NO: 2096232 - RNA, 23 nt, Staphylococcus aureus subsp. aureus MW2
auaugacgcgugaauuaaaaaau

SEQ ID NO: 2096233 - RNA, 21 nt, Staphylococcus aureus subsp. aureus MW2
auaugacgcgugaauuaaaaa

SEQ ID NO: 2096234 - RNA, 13 nt, Staphylococcus aureus subsp. aureus MW2
auaugauugguuu

SEQ ID NO: 2096235 - RNA, 18 nt, Staphylococcus aureus subsp. aureus MW2
auaugauugcaaauuauc

SEQ ID NO: 2096236 - RNA, 23 nt, Staphylococcus aureus subsp. aureus MW2
auaugcacuuuuuauacauuaac

SEQ ID NO: 2096237 - RNA, 15 nt, Staphylococcus aureus subsp. aureus MW2
auauggaaaauguau

SEQ ID NO: 2096238 - RNA, 16 nt, Staphylococcus aureus subsp. aureus MW2
auauggaauacuacac

SEQ ID NO: 2096239 - RNA, 23 nt, Staphylococcus aureus subsp. aureus MW2
auauggcaucaucaccauacuaa

SEQ ID NO: 2096240 - RNA, 14 nt, Staphylococcus aureus subsp. aureus MW2
auauggauuuugaa

SEQ ID NO: 2096241 - RNA, 21 nt, Staphylococcus aureus subsp. aureus MW2
auaugcuugcugugaauaaaa

SEQ ID NO: 2096242 - RNA, 22 nt, Staphylococcus aureus subsp. aureus MW2
auaugcuugcugugaauaaaau

SEQ ID NO: 2096243 - RNA, 18 nt, Staphylococcus aureus subsp. aureus MW2
aucuuaugacugcuuuuu

SEQ ID NO: 2096244 - RNA, 20 nt, Staphylococcus aureus subsp. aureus MW2
aucuuaugacugcuuuuuau

SEQ ID NO: 2096245 - RNA, 20 nt, Staphylococcus aureus subsp. aureus MW2
aucuuaugauacuuugaaag

SEQ ID NO: 2096246 - RNA, 23 nt, Staphylococcus aureus subsp. aureus MW2
aucuucaacauaacucaaauauc

SEQ ID NO: 2096247 - RNA, 16 nt, Staphylococcus aureus subsp. aureus MW2
aucuucaauauuuaaa

SEQ ID NO: 2096248 - RNA, 15 nt, Staphylococcus aureus subsp. aureus MW2
aucuucaucauugua

SEQ ID NO: 2096249 - RNA, 22 nt, Staphylococcus aureus subsp. aureus MW2
aucuguuuuagguuuguugcuu

SEQ ID NO: 2096250 - RNA, 14 nt, Staphylococcus aureus subsp. aureus MW2
aucuguuucuuguu

SEQ ID NO: 2096251 - RNA, 21 nt, Staphylococcus aureus subsp. aureus MW2
aucuuaaguacauaaaugcua

SEQ ID NO: 2096252 - RNA, 22 nt, Staphylococcus aureus subsp. aureus MW2
aucuuaaguacauaaaugcuaa

SEQ ID NO: 2096253 - RNA, 22 nt, Staphylococcus aureus subsp. aureus MW2
aucuuaaagcauaucucaagau

SEQ ID NO: 2096254 - RNA, 23 nt, Staphylococcus aureus subsp. aureus MW2
aucuguuacagguuuuaaaauua

SEQ ID NO: 2096255 - RNA, 16 nt, Staphylococcus aureus subsp. aureus MW2
aucuguugucaucaug

SEQ ID NO: 2096256 - RNA, 20 nt, Staphylococcus aureus subsp. aureus MW2
aucuuauaacaaaaauugcu

SEQ ID NO: 2096257 - RNA, 21 nt, Staphylococcus aureus subsp. aureus MW2
aucuuagacgcuguuuuaaau

SEQ ID NO: 2096258 - RNA, 17 nt, Staphylococcus aureus subsp. aureus MW2
aucuuaacaauuuuaau

SEQ ID NO: 2096259 - RNA, 15 nt, Staphylococcus aureus subsp. aureus MW2
aucuuaaucuaaaaa

SEQ ID NO: 2096260 - RNA, 15 nt, Staphylococcus aureus subsp. aureus MW2
aucuuacugcuuuuu

SEQ ID NO: 2096261 - RNA, 19 nt, Staphylococcus aureus subsp. aureus MW2
aucuuacugcuuuuuuaaa

SEQ ID NO: 2096262 - RNA, 16 nt, Staphylococcus aureus subsp. aureus MW2
aucuuaccuuuauguu

SEQ ID NO: 2096263 - RNA, 15 nt, Staphylococcus aureus subsp. aureus MW2
aucuguagguuuaau

SEQ ID NO: 2096264 - RNA, 17 nt, Staphylococcus aureus subsp. aureus MW2
aucuguauauccauucu

SEQ ID NO: 2096265 - RNA, 22 nt, Staphylococcus aureus subsp. aureus MW2
aucuguaucaaagucucuagua

SEQ ID NO: 2096266 - RNA, 23 nt, Staphylococcus aureus subsp. aureus MW2
aucuaaugcaacuugaucauuau

SEQ ID NO: 2096267 - RNA, 20 nt, Staphylococcus aureus subsp. aureus MW2
aucuaaugggucaaugacug

SEQ ID NO: 2096268 - RNA, 12 nt, Staphylococcus aureus subsp. aureus MW2
aucuaauuuuuc

SEQ ID NO: 2096269 - RNA, 18 nt, Staphylococcus aureus subsp. aureus MW2
aucuaacuggaaaugaua

SEQ ID NO: 2096270 - RNA, 16 nt, Staphylococcus aureus subsp. aureus MW2
aucuaacuggaaauga

SEQ ID NO: 2096271 - RNA, 13 nt, Staphylococcus aureus subsp. aureus MW2
aucuaacuggaaa

SEQ ID NO: 2096272 - RNA, 13 nt, Staphylococcus aureus subsp. aureus MW2
aucuaauaaauau

SEQ ID NO: 2096273 - RNA, 19 nt, Staphylococcus aureus subsp. aureus MW2
aucuugauuauauuuuucu

SEQ ID NO: 2096274 - RNA, 21 nt, Staphylococcus aureus subsp. aureus MW2
aucuugucuaguucgauuuuu

SEQ ID NO: 2096275 - RNA, 23 nt, Staphylococcus aureus subsp. aureus MW2
aucuugucuaguucgauuuuuua

SEQ ID NO: 2096276 - RNA, 20 nt, Staphylococcus aureus subsp. aureus MW2
aucuugcuuauugauauaag

SEQ ID NO: 2096277 - RNA, 21 nt, Staphylococcus aureus subsp. aureus MW2
aucuugcuuggauaauugcau

SEQ ID NO: 2096278 - RNA, 16 nt, Staphylococcus aureus subsp. aureus MW2
aucuugcuuggauaau

SEQ ID NO: 2096279 - RNA, 21 nt, Staphylococcus aureus subsp. aureus MW2
aucuuggccaauuaacuugau

SEQ ID NO: 2096280 - RNA, 16 nt, Staphylococcus aureus subsp. aureus MW2
aucuucccaucuuuua

SEQ ID NO: 2096281 - RNA, 23 nt, Staphylococcus aureus subsp. aureus MW2
aucuucgacuacaaguuuauaau

SEQ ID NO: 2096282 - RNA, 16 nt, Staphylococcus aureus subsp. aureus MW2
aucuucgacuacaagu

SEQ ID NO: 2096283 - RNA, 22 nt, Staphylococcus aureus subsp. aureus MW2
aucuucguauaguacuaaaagu

SEQ ID NO: 2096284 - RNA, 23 nt, Staphylococcus aureus subsp. aureus MW2
aucuucguauaguacuaaaagua

SEQ ID NO: 2096285 - RNA, 15 nt, Staphylococcus aureus subsp. aureus MW2
aucuuuuugaaauuu

SEQ ID NO: 2096286 - RNA, 13 nt, Staphylococcus aureus subsp. aureus MW2
augaaaaaguaaa

SEQ ID NO: 2096287 - RNA, 22 nt, Staphylococcus aureus subsp. aureus MW2
augaaaaagaguuaauaaaauu

SEQ ID NO: 2096288 - RNA, 21 nt, Staphylococcus aureus subsp. aureus MW2
augaaauuguguugaaucaac

SEQ ID NO: 2096289 - RNA, 18 nt, Staphylococcus aureus subsp. aureus MW2
augaacaaaauaacaugu

SEQ ID NO: 2096290 - RNA, 18 nt, Staphylococcus aureus subsp. aureus MW2
augaacaaaaauaaaaac

SEQ ID NO: 2096291 - RNA, 14 nt, Staphylococcus aureus subsp. aureus MW2
augaacaaaauaac

SEQ ID NO: 2096292 - RNA, 10 nt, Staphylococcus aureus subsp. aureus MW2
augaaaagaa

SEQ ID NO: 2096293 - RNA, 17 nt, Staphylococcus aureus subsp. aureus MW2
augaaaagagauuuuuu

SEQ ID NO: 2096294 - RNA, 13 nt, Staphylococcus aureus subsp. aureus MW2
augaaaagugaau

SEQ ID NO: 2096295 - RNA, 22 nt, Staphylococcus aureus subsp. aureus MW2
augaaaagguuagauggauugu

SEQ ID NO: 2096296 - RNA, 14 nt, Staphylococcus aureus subsp. aureus MW2
augaaauucuuuug

SEQ ID NO: 2096297 - RNA, 11 nt, Staphylococcus aureus subsp. aureus MW2
aucuuuauaaa

SEQ ID NO: 2096298 - RNA, 12 nt, Staphylococcus aureus subsp. aureus MW2
aucuuuauacac

SEQ ID NO: 2096299 - RNA, 13 nt, Staphylococcus aureus subsp. aureus MW2
aucuuuauacaca

SEQ ID NO: 2096300 - RNA, 17 nt, Staphylococcus aureus subsp. aureus MW2
aucuuguucuaauuguu

SEQ ID NO: 2096301 - RNA, 21 nt, Staphylococcus aureus subsp. aureus MW2
aucuuuagagacuuauuuuau

SEQ ID NO: 2096302 - RNA, 19 nt, Staphylococcus aureus subsp. aureus MW2
aucuuuaucaguuuguccu

SEQ ID NO: 2096303 - RNA, 15 nt, Staphylococcus aureus subsp. aureus MW2
aucuuuauuuuuuau

SEQ ID NO: 2096304 - RNA, 19 nt, Staphylococcus aureus subsp. aureus MW2
aucuuuauuugauucuuca

SEQ ID NO: 2096305 - RNA, 15 nt, Staphylococcus aureus subsp. aureus MW2
aucuuucuuuguguu

SEQ ID NO: 2096306 - RNA, 22 nt, Staphylococcus aureus subsp. aureus MW2
aucuuuguaaccuaaaaacaaa

SEQ ID NO: 2096307 - RNA, 23 nt, Staphylococcus aureus subsp. aureus MW2
aucuuuguaugcaucaguuaaua

SEQ ID NO: 2096308 - RNA, 13 nt, Staphylococcus aureus subsp. aureus MW2
aucuuuuugaaau

SEQ ID NO: 2096309 - RNA, 14 nt, Staphylococcus aureus subsp. aureus MW2
aucuuuuuaaaagg

SEQ ID NO: 2096310 - RNA, 22 nt, Staphylococcus aureus subsp. aureus MW2
aucuuuuucaaugugauuuucu

SEQ ID NO: 2096311 - RNA, 14 nt, Staphylococcus aureus subsp. aureus MW2
augacaucaauauc

SEQ ID NO: 2096312 - RNA, 15 nt, Staphylococcus aureus subsp. aureus MW2
augacaguaaucaaa

SEQ ID NO: 2096313 - RNA, 16 nt, Staphylococcus aureus subsp. aureus MW2
augacaccuaauacca

SEQ ID NO: 2096314 - RNA, 15 nt, Staphylococcus aureus subsp. aureus MW2
augacaaauuaucac

SEQ ID NO: 2096315 - RNA, 15 nt, Staphylococcus aureus subsp. aureus MW2
augacaaaaauaaaa

SEQ ID NO: 2096316 - RNA, 13 nt, Staphylococcus aureus subsp. aureus MW2
augaauuuuauaa

SEQ ID NO: 2096317 - RNA, 16 nt, Staphylococcus aureus subsp. aureus MW2
augaauuuucaucauu

SEQ ID NO: 2096318 - RNA, 24 nt, Staphylococcus aureus subsp. aureus MW2
augaacucacaacagugcucuaug

SEQ ID NO: 2096319 - RNA, 16 nt, Staphylococcus aureus subsp. aureus MW2
augaacgaaucuauaa

SEQ ID NO: 2096320 - RNA, 23 nt, Staphylococcus aureus subsp. aureus MW2
augaaccauuuaacucaccuuua

SEQ ID NO: 2096321 - RNA, 13 nt, Staphylococcus aureus subsp. aureus MW2
augaaccaaaaaa

SEQ ID NO: 2096322 - RNA, 14 nt, Staphylococcus aureus subsp. aureus MW2
augaacauaccugc

SEQ ID NO: 2096323 - RNA, 20 nt, Staphylococcus aureus subsp. aureus MW2
augacugagaaaaauauuuc

SEQ ID NO: 2096324 - RNA, 16 nt, Staphylococcus aureus subsp. aureus MW2
augacugacacuuuaa

SEQ ID NO: 2096325 - RNA, 23 nt, Staphylococcus aureus subsp. aureus MW2
augacuaugcaaaugaaauucuu

SEQ ID NO: 2096326 - RNA, 14 nt, Staphylococcus aureus subsp. aureus MW2
augacuaacgaaaa

SEQ ID NO: 2096327 - RNA, 19 nt, Staphylococcus aureus subsp. aureus MW2
augagcuucuuuaaauaca

SEQ ID NO: 2096328 - RNA, 15 nt, Staphylococcus aureus subsp. aureus MW2
augagcucugaagaa

SEQ ID NO: 2096329 - RNA, 16 nt, Staphylococcus aureus subsp. aureus MW2
augagcucauguuuca

SEQ ID NO: 2096330 - RNA, 20 nt, Staphylococcus aureus subsp. aureus MW2
augagcucauguuucaguau

SEQ ID NO: 2096331 - RNA, 15 nt, Staphylococcus aureus subsp. aureus MW2
augauagauuuagga

SEQ ID NO: 2096332 - RNA, 22 nt, Staphylococcus aureus subsp. aureus MW2
augauacgcuuuuuaaaaaauu

SEQ ID NO: 2096333 - RNA, 19 nt, Staphylococcus aureus subsp. aureus MW2
augauagcaaugaauuaau

SEQ ID NO: 2096334 - RNA, 21 nt, Staphylococcus aureus subsp. aureus MW2
augauacugaaauuucauaaa

SEQ ID NO: 2096335 - RNA, 21 nt, Staphylococcus aureus subsp. aureus MW2
augauacgcuuuuuaaaaaau

SEQ ID NO: 2096336 - RNA, 18 nt, Staphylococcus aureus subsp. aureus MW2
augauacgccuaaauauu

SEQ ID NO: 2096337 - RNA, 17 nt, Staphylococcus aureus subsp. aureus MW2
augauacucaauaaaau

SEQ ID NO: 2096338 - RNA, 22 nt, Staphylococcus aureus subsp. aureus MW2
augauaguguaugaauggcaau

SEQ ID NO: 2096339 - RNA, 15 nt, Staphylococcus aureus subsp. aureus MW2
augauagugcuuuuu

SEQ ID NO: 2096340 - RNA, 16 nt, Staphylococcus aureus subsp. aureus MW2
augauagcuaaacauu

SEQ ID NO: 2096341 - RNA, 16 nt, Staphylococcus aureus subsp. aureus MW2
augauaauaagaauau

SEQ ID NO: 2096342 - RNA, 14 nt, Staphylococcus aureus subsp. aureus MW2
augauaauaagaau

SEQ ID NO: 2096343 - RNA, 18 nt, Staphylococcus aureus subsp. aureus MW2
augauaauuaaugccauu

SEQ ID NO: 2096344 - RNA, 15 nt, Staphylococcus aureus subsp. aureus MW2
augauaauuaaugcc

SEQ ID NO: 2096345 - RNA, 16 nt, Staphylococcus aureus subsp. aureus MW2
augauaauuaauuaaa

SEQ ID NO: 2096346 - RNA, 18 nt, Staphylococcus aureus subsp. aureus MW2
augaucagggaaaucauc

SEQ ID NO: 2096347 - RNA, 18 nt, Staphylococcus aureus subsp. aureus MW2
augauauuaccuucaagu

SEQ ID NO: 2096348 - RNA, 16 nt, Staphylococcus aureus subsp. aureus MW2
augaucaauaagauuu

SEQ ID NO: 2096349 - RNA, 20 nt, Staphylococcus aureus subsp. aureus MW2
augauauugauuugauucau

SEQ ID NO: 2096350 - RNA, 22 nt, Staphylococcus aureus subsp. aureus MW2
augauauugaaaguguaugcau

SEQ ID NO: 2096351 - RNA, 18 nt, Staphylococcus aureus subsp. aureus MW2
augauauuuaacgaaaau

SEQ ID NO: 2096352 - RNA, 19 nt, Staphylococcus aureus subsp. aureus MW2
augauauuuaacgaaaauu

SEQ ID NO: 2096353 - RNA, 15 nt, Staphylococcus aureus subsp. aureus MW2
augauauuuucgcaa

SEQ ID NO: 2096354 - RNA, 23 nt, Staphylococcus aureus subsp. aureus MW2
augauauuuucgcaaaauuuauu

SEQ ID NO: 2096355 - RNA, 20 nt, Staphylococcus aureus subsp. aureus MW2
augauauuaggcuuaaauau

SEQ ID NO: 2096356 - RNA, 15 nt, Staphylococcus aureus subsp. aureus MW2
augauauguucgcuu

SEQ ID NO: 2096357 - RNA, 22 nt, Staphylococcus aureus subsp. aureus MW2
augauuacuuuaagauuauuug

SEQ ID NO: 2096358 - RNA, 15 nt, Staphylococcus aureus subsp. aureus MW2
augauuacuaauaca

SEQ ID NO: 2096359 - RNA, 22 nt, Staphylococcus aureus subsp. aureus MW2
augauuaauuaaagauuaaaau

SEQ ID NO: 2096360 - RNA, 23 nt, Staphylococcus aureus subsp. aureus MW2
augauuacguugguuuaaaaauu

SEQ ID NO: 2096361 - RNA, 16 nt, Staphylococcus aureus subsp. aureus MW2
augauuacuuuaagau

SEQ ID NO: 2096362 - RNA, 16 nt, Staphylococcus aureus subsp. aureus MW2
augauuaauuaaagau

SEQ ID NO: 2096363 - RNA, 14 nt, Staphylococcus aureus subsp. aureus MW2
augauuaaaauuaa

SEQ ID NO: 2096364 - RNA, 17 nt, Staphylococcus aureus subsp. aureus MW2
augauuaaaaaucaaag

SEQ ID NO: 2096365 - RNA, 22 nt, Staphylococcus aureus subsp. aureus MW2
augauuaaaaaucaaagaggcu

SEQ ID NO: 2096366 - RNA, 17 nt, Staphylococcus aureus subsp. aureus MW2
augcaccuuuacaacau

SEQ ID NO: 2096367 - RNA, 17 nt, Staphylococcus aureus subsp. aureus MW2
augcacgaaugguucuu

SEQ ID NO: 2096368 - RNA, 18 nt, Staphylococcus aureus subsp. aureus MW2
augcacgaaugguucuuc

SEQ ID NO: 2096369 - RNA, 19 nt, Staphylococcus aureus subsp. aureus MW2
augcacuuuuuauacauua

SEQ ID NO: 2096370 - RNA, 14 nt, Staphylococcus aureus subsp. aureus MW2
augcacuuuauuaa

SEQ ID NO: 2096371 - RNA, 14 nt, Staphylococcus aureus subsp. aureus MW2
augcauaauaccaa

SEQ ID NO: 2096372 - RNA, 20 nt, Staphylococcus aureus subsp. aureus MW2
augcauaauaccaauugcuu

SEQ ID NO: 2096373 - RNA, 14 nt, Staphylococcus aureus subsp. aureus MW2
augcauaauauauu

SEQ ID NO: 2096374 - RNA, 14 nt, Staphylococcus aureus subsp. aureus MW2
augcagauucuuca

SEQ ID NO: 2096375 - RNA, 15 nt, Staphylococcus aureus subsp. aureus MW2
augcauauucaucau

SEQ ID NO: 2096376 - RNA, 22 nt, Staphylococcus aureus subsp. aureus MW2
augauuuuuauuauugucauca

SEQ ID NO: 2096377 - RNA, 20 nt, Staphylococcus aureus subsp. aureus MW2
augcacaucauugauagaua

SEQ ID NO: 2096378 - RNA, 14 nt, Staphylococcus aureus subsp. aureus MW2
augauuauuuuucu

SEQ ID NO: 2096379 - RNA, 13 nt, Staphylococcus aureus subsp. aureus MW2
augauuuugcuuu

SEQ ID NO: 2096380 - RNA, 16 nt, Staphylococcus aureus subsp. aureus MW2
augauugcauugauuu

SEQ ID NO: 2096381 - RNA, 20 nt, Staphylococcus aureus subsp. aureus MW2
auggcugcaucaauaugacc

SEQ ID NO: 2096382 - RNA, 18 nt, Staphylococcus aureus subsp. aureus MW2
auggcgcaauuuuuaaca

SEQ ID NO: 2096383 - RNA, 21 nt, Staphylococcus aureus subsp. aureus MW2
auggcgcaauuuuuaacaaaa

SEQ ID NO: 2096384 - RNA, 14 nt, Staphylococcus aureus subsp. aureus MW2
auggauuucuuauu

SEQ ID NO: 2096385 - RNA, 15 nt, Staphylococcus aureus subsp. aureus MW2
auggcuuaaaucaaa

SEQ ID NO: 2096386 - RNA, 18 nt, Staphylococcus aureus subsp. aureus MW2
auggcuugguuauuuuca

SEQ ID NO: 2096387 - RNA, 23 nt, Staphylococcus aureus subsp. aureus MW2
augggucaaugacugagaaaaau

SEQ ID NO: 2096388 - RNA, 21 nt, Staphylococcus aureus subsp. aureus MW2
auggguauccuucucaucauu

SEQ ID NO: 2096389 - RNA, 22 nt, Staphylococcus aureus subsp. aureus MW2
augguaucuuuaauuucauuua

SEQ ID NO: 2096390 - RNA, 20 nt, Staphylococcus aureus subsp. aureus MW2
auggucaacuuuuuuaacuu

SEQ ID NO: 2096391 - RNA, 19 nt, Staphylococcus aureus subsp. aureus MW2
augguugauucgauaugaa

SEQ ID NO: 2096392 - RNA, 16 nt, Staphylococcus aureus subsp. aureus MW2
auguaaauaaaaauua

SEQ ID NO: 2096393 - RNA, 18 nt, Staphylococcus aureus subsp. aureus MW2
auguaaauaaaaauuaua

SEQ ID NO: 2096394 - RNA, 19 nt, Staphylococcus aureus subsp. aureus MW2
auguaaauaaaaauuauau

SEQ ID NO: 2096395 - RNA, 19 nt, Staphylococcus aureus subsp. aureus MW2
auguaaagaguacagcggu

SEQ ID NO: 2096396 - RNA, 19 nt, Staphylococcus aureus subsp. aureus MW2
auguaaagccaccuaaauc

SEQ ID NO: 2096397 - RNA, 18 nt, Staphylococcus aureus subsp. aureus MW2
auggugcuaaaaaauuug

SEQ ID NO: 2096398 - RNA, 16 nt, Staphylococcus aureus subsp. aureus MW2
auguaacaauuuagca

SEQ ID NO: 2096399 - RNA, 15 nt, Staphylococcus aureus subsp. aureus MW2
auguaacguaaaaau

SEQ ID NO: 2096400 - RNA, 20 nt, Staphylococcus aureus subsp. aureus MW2
auguaacagugugaaauaau

SEQ ID NO: 2096401 - RNA, 21 nt, Staphylococcus aureus subsp. aureus MW2
auguaacagugugaaauaaua

SEQ ID NO: 2096402 - RNA, 22 nt, Staphylococcus aureus subsp. aureus MW2
auguaaauugguauaacaauuu

SEQ ID NO: 2096403 - RNA, 13 nt, Staphylococcus aureus subsp. aureus MW2
auguaauuauuuu

SEQ ID NO: 2096404 - RNA, 22 nt, Staphylococcus aureus subsp. aureus MW2
auguaacauaaagcuguuuauu

SEQ ID NO: 2096405 - RNA, 19 nt, Staphylococcus aureus subsp. aureus MW2
auguaacauuaaaaauaaa

SEQ ID NO: 2096406 - RNA, 17 nt, Staphylococcus aureus subsp. aureus MW2
auguaacuuuagacaua

SEQ ID NO: 2096407 - RNA, 18 nt, Staphylococcus aureus subsp. aureus MW2
auguacaauuuuuaaaaa

SEQ ID NO: 2096408 - RNA, 20 nt, Staphylococcus aureus subsp. aureus MW2
auguacacgagucauuaaau

SEQ ID NO: 2096409 - RNA, 17 nt, Staphylococcus aureus subsp. aureus MW2
auguacauguauaaaag

SEQ ID NO: 2096410 - RNA, 18 nt, Staphylococcus aureus subsp. aureus MW2
auguacguuuuuuuaaau

SEQ ID NO: 2096411 - RNA, 22 nt, Staphylococcus aureus subsp. aureus MW2
auguacuuuucugucuguaaau

SEQ ID NO: 2096412 - RNA, 13 nt, Staphylococcus aureus subsp. aureus MW2
auguauugcuaua

SEQ ID NO: 2096413 - RNA, 14 nt, Staphylococcus aureus subsp. aureus MW2
auguagcaauuuuc

SEQ ID NO: 2096414 - RNA, 23 nt, Staphylococcus aureus subsp. aureus MW2
augucauaucuuuauuugauucu

SEQ ID NO: 2096415 - RNA, 14 nt, Staphylococcus aureus subsp. aureus MW2
auguauuuauuacu

SEQ ID NO: 2096416 - RNA, 23 nt, Staphylococcus aureus subsp. aureus MW2
auguauuuaguaucauaauagcc

SEQ ID NO: 2096417 - RNA, 24 nt, Staphylococcus aureus subsp. aureus MW2
augucaaaucggcuauacauugau

SEQ ID NO: 2096418 - RNA, 15 nt, Staphylococcus aureus subsp. aureus MW2
augucacauaugacu

SEQ ID NO: 2096419 - RNA, 18 nt, Staphylococcus aureus subsp. aureus MW2
augucacugcaaacacag

SEQ ID NO: 2096420 - RNA, 23 nt, Staphylococcus aureus subsp. aureus MW2
augucacugcaaacacaguacaa

SEQ ID NO: 2096421 - RNA, 18 nt, Staphylococcus aureus subsp. aureus MW2
auguuccccauuaauuaa

SEQ ID NO: 2096422 - RNA, 22 nt, Staphylococcus aureus subsp. aureus MW2
auguucccuuaccauuucuuca

SEQ ID NO: 2096423 - RNA, 19 nt, Staphylococcus aureus subsp. aureus MW2
auguuacacaaauuaaaac

SEQ ID NO: 2096424 - RNA, 22 nt, Staphylococcus aureus subsp. aureus MW2
augugucauaauccauucuucu

SEQ ID NO: 2096425 - RNA, 14 nt, Staphylococcus aureus subsp. aureus MW2
auguguguugcuuu

SEQ ID NO: 2096426 - RNA, 18 nt, Staphylococcus aureus subsp. aureus MW2
auguguuaaaauauauuu

SEQ ID NO: 2096427 - RNA, 22 nt, Staphylococcus aureus subsp. aureus MW2
auguguuaaucaacguauauaa

SEQ ID NO: 2096428 - RNA, 24 nt, Staphylococcus aureus subsp. aureus MW2
auguguuaaucaacguauauaagu

SEQ ID NO: 2096429 - RNA, 18 nt, Staphylococcus aureus subsp. aureus MW2
auguuagugacaagguau

SEQ ID NO: 2096430 - RNA, 15 nt, Staphylococcus aureus subsp. aureus MW2
auguuauauuaugaa

SEQ ID NO: 2096431 - RNA, 13 nt, Staphylococcus aureus subsp. aureus MW2
auguuaucgauau

SEQ ID NO: 2096432 - RNA, 15 nt, Staphylococcus aureus subsp. aureus MW2
auguuagauuucaaa

SEQ ID NO: 2096433 - RNA, 14 nt, Staphylococcus aureus subsp. aureus MW2
auguuacugaugaa

SEQ ID NO: 2096434 - RNA, 17 nt, Staphylococcus aureus subsp. aureus MW2
auguguaugauagaaua

SEQ ID NO: 2096435 - RNA, 16 nt, Staphylococcus aureus subsp. aureus MW2
augugcuaaucuauuu

SEQ ID NO: 2096436 - RNA, 13 nt, Staphylococcus aureus subsp. aureus MW2
augugcgugguuu

SEQ ID NO: 2096437 - RNA, 22 nt, Staphylococcus aureus subsp. aureus MW2
augucuuaggcgcuacaauguu

SEQ ID NO: 2096438 - RNA, 15 nt, Staphylococcus aureus subsp. aureus MW2
augucuuaaauucuu

SEQ ID NO: 2096439 - RNA, 22 nt, Staphylococcus aureus subsp. aureus MW2
augucuagauuucaaaucaaua

SEQ ID NO: 2096440 - RNA, 21 nt, Staphylococcus aureus subsp. aureus MW2
auggacguaacuguuuuaaau

SEQ ID NO: 2096441 - RNA, 16 nt, Staphylococcus aureus subsp. aureus MW2
auggauacuuaaagau

SEQ ID NO: 2096442 - RNA, 13 nt, Staphylococcus aureus subsp. aureus MW2
auggauauucaau

SEQ ID NO: 2096443 - RNA, 16 nt, Staphylococcus aureus subsp. aureus MW2
auggaugaauauauug

SEQ ID NO: 2096444 - RNA, 22 nt, Staphylococcus aureus subsp. aureus MW2
auggauuacagcguacuaaaga

SEQ ID NO: 2096445 - RNA, 23 nt, Staphylococcus aureus subsp. aureus MW2
augcuuuuuuuacaauaugauua

SEQ ID NO: 2096446 - RNA, 22 nt, Staphylococcus aureus subsp. aureus MW2
auggaaaauauauuauaaaaau

SEQ ID NO: 2096447 - RNA, 15 nt, Staphylococcus aureus subsp. aureus MW2
auggaaaaguuuuuu

SEQ ID NO: 2096448 - RNA, 16 nt, Staphylococcus aureus subsp. aureus MW2
auggaaaaguuuuuua

SEQ ID NO: 2096449 - RNA, 22 nt, Staphylococcus aureus subsp. aureus MW2
augcuuuuuagcauauucugca

SEQ ID NO: 2096450 - RNA, 18 nt, Staphylococcus aureus subsp. aureus MW2
augcuuucaucuuuuuca

SEQ ID NO: 2096451 - RNA, 20 nt, Staphylococcus aureus subsp. aureus MW2
auggaaaguugguuuuauua

SEQ ID NO: 2096452 - RNA, 17 nt, Staphylococcus aureus subsp. aureus MW2
augcugaauaaauaacu

SEQ ID NO: 2096453 - RNA, 22 nt, Staphylococcus aureus subsp. aureus MW2
augcuucgcacaacugcauaua

SEQ ID NO: 2096454 - RNA, 15 nt, Staphylococcus aureus subsp. aureus MW2
augcuucuaacugaa

SEQ ID NO: 2096455 - RNA, 21 nt, Staphylococcus aureus subsp. aureus MW2
augcuucugguucuucaauau

SEQ ID NO: 2096456 - RNA, 22 nt, Staphylococcus aureus subsp. aureus MW2
augcuuguacaaaaaauuguaa

SEQ ID NO: 2096457 - RNA, 15 nt, Staphylococcus aureus subsp. aureus MW2
augcuugaauguuug

SEQ ID NO: 2096458 - RNA, 21 nt, Staphylococcus aureus subsp. aureus MW2
augcuugccacugcaauggcu

SEQ ID NO: 2096459 - RNA, 14 nt, Staphylococcus aureus subsp. aureus MW2
augcuuuaaauauu

SEQ ID NO: 2096460 - RNA, 20 nt, Staphylococcus aureus subsp. aureus MW2
augcuuucaaauacacagau

SEQ ID NO: 2096461 - RNA, 14 nt, Staphylococcus aureus subsp. aureus MW2
augcuucauaugga

SEQ ID NO: 2096462 - RNA, 20 nt, Staphylococcus aureus subsp. aureus MW2
augcucacuuuuuaaaguaa

SEQ ID NO: 2096463 - RNA, 16 nt, Staphylococcus aureus subsp. aureus MW2
augcuauaaguauuuu

SEQ ID NO: 2096464 - RNA, 13 nt, Staphylococcus aureus subsp. aureus MW2
augcuauauccag

SEQ ID NO: 2096465 - RNA, 15 nt, Staphylococcus aureus subsp. aureus MW2
augcucguauagaaa

SEQ ID NO: 2096466 - RNA, 16 nt, Staphylococcus aureus subsp. aureus MW2
augccaaaaacauuaa

SEQ ID NO: 2096467 - RNA, 17 nt, Staphylococcus aureus subsp. aureus MW2
augcaugcgcaaaagcg

SEQ ID NO: 2096468 - RNA, 21 nt, Staphylococcus aureus subsp. aureus MW2
augcaugccagaugcaaugau

SEQ ID NO: 2096469 - RNA, 12 nt, Staphylococcus aureus subsp. aureus MW2
augcaucuauga

SEQ ID NO: 2096470 - RNA, 13 nt, Staphylococcus aureus subsp. aureus MW2
augcauauauaua

SEQ ID NO: 2096471 - RNA, 17 nt, Staphylococcus aureus subsp. aureus MW2
augcgcuuguaacaagc

SEQ ID NO: 2096472 - RNA, 22 nt, Staphylococcus aureus subsp. aureus MW2
aucaaucgcuuuagcaauugaa

SEQ ID NO: 2096473 - RNA, 23 nt, Staphylococcus aureus subsp. aureus MW2
aucaaucgcuuuagcaauugaau

SEQ ID NO: 2096474 - RNA, 16 nt, Staphylococcus aureus subsp. aureus MW2
aucaguauaaucagca

SEQ ID NO: 2096475 - RNA, 20 nt, Staphylococcus aureus subsp. aureus MW2
aucaguauaaucagcaaugu

SEQ ID NO: 2096476 - RNA, 19 nt, Staphylococcus aureus subsp. aureus MW2
aucaguagcauauugaugu

SEQ ID NO: 2096477 - RNA, 21 nt, Staphylococcus aureus subsp. aureus MW2
aucaguaacauguaaugaauc

SEQ ID NO: 2096478 - RNA, 15 nt, Staphylococcus aureus subsp. aureus MW2
aucagggaaaucauc

SEQ ID NO: 2096479 - RNA, 23 nt, Staphylococcus aureus subsp. aureus MW2
aucaggcuuuauuguugugcuuu

SEQ ID NO: 2096480 - RNA, 15 nt, Staphylococcus aureus subsp. aureus MW2
aucaguuauuuuaau

SEQ ID NO: 2096481 - RNA, 12 nt, Staphylococcus aureus subsp. aureus MW2
aucaguuauuuu

SEQ ID NO: 2096482 - RNA, 17 nt, Staphylococcus aureus subsp. aureus MW2
aucagugugauuuugga

SEQ ID NO: 2096483 - RNA, 21 nt, Staphylococcus aureus subsp. aureus MW2
aucaguguagcaguauauguc

SEQ ID NO: 2096484 - RNA, 17 nt, Staphylococcus aureus subsp. aureus MW2
aucaguccgcuuuuuca

SEQ ID NO: 2096485 - RNA, 18 nt, Staphylococcus aureus subsp. aureus MW2
aucaguccgcuuuuucau

SEQ ID NO: 2096486 - RNA, 24 nt, Staphylococcus aureus subsp. aureus MW2
aucaguauuuguauugacaucuuc

SEQ ID NO: 2096487 - RNA, 13 nt, Staphylococcus aureus subsp. aureus MW2
aucagugaagcua

SEQ ID NO: 2096488 - RNA, 19 nt, Staphylococcus aureus subsp. aureus MW2
aucaguuuuugaauauuug

SEQ ID NO: 2096489 - RNA, 14 nt, Staphylococcus aureus subsp. aureus MW2
aucaguuuuugaau

SEQ ID NO: 2096490 - RNA, 20 nt, Staphylococcus aureus subsp. aureus MW2
aucaguuguguaauaaagca

SEQ ID NO: 2096491 - RNA, 16 nt, Staphylococcus aureus subsp. aureus MW2
aucaguugagucaauu

SEQ ID NO: 2096492 - RNA, 17 nt, Staphylococcus aureus subsp. aureus MW2
aucauaaucauaaaaau

SEQ ID NO: 2096493 - RNA, 19 nt, Staphylococcus aureus subsp. aureus MW2
aucauaauaagauuuuuua

SEQ ID NO: 2096494 - RNA, 13 nt, Staphylococcus aureus subsp. aureus MW2
aucauaauauuga

SEQ ID NO: 2096495 - RNA, 21 nt, Staphylococcus aureus subsp. aureus MW2
aucauaaucaagaauauaaau

SEQ ID NO: 2096496 - RNA, 13 nt, Staphylococcus aureus subsp. aureus MW2
aucauaaaguaaa

SEQ ID NO: 2096497 - RNA, 13 nt, Staphylococcus aureus subsp. aureus MW2
aucauaaaugacg

SEQ ID NO: 2096498 - RNA, 15 nt, Staphylococcus aureus subsp. aureus MW2
aucauaacuuaacuc

SEQ ID NO: 2096499 - RNA, 16 nt, Staphylococcus aureus subsp. aureus MW2
aucauaaucuacugcu

SEQ ID NO: 2096500 - RNA, 17 nt, Staphylococcus aureus subsp. aureus MW2
aucauacauauuuauau

SEQ ID NO: 2096501 - RNA, 18 nt, Staphylococcus aureus subsp. aureus MW2
aucauacauauuuauauu

SEQ ID NO: 2096502 - RNA, 15 nt, Staphylococcus aureus subsp. aureus MW2
aucauacuucaauaa

SEQ ID NO: 2096503 - RNA, 16 nt, Staphylococcus aureus subsp. aureus MW2
aucauagauauaagaa

SEQ ID NO: 2096504 - RNA, 16 nt, Staphylococcus aureus subsp. aureus MW2
aucauacgagaaauua

SEQ ID NO: 2096505 - RNA, 14 nt, Staphylococcus aureus subsp. aureus MW2
aucauaucauacca

SEQ ID NO: 2096506 - RNA, 15 nt, Staphylococcus aureus subsp. aureus MW2
aucauaugucuuaac

SEQ ID NO: 2096507 - RNA, 15 nt, Staphylococcus aureus subsp. aureus MW2
aucauauugcacaua

SEQ ID NO: 2096508 - RNA, 16 nt, Staphylococcus aureus subsp. aureus MW2
aucaucgcaaaaacau

SEQ ID NO: 2096509 - RNA, 20 nt, Staphylococcus aureus subsp. aureus MW2
aucaucgcaaaaacauaauc

SEQ ID NO: 2096510 - RNA, 23 nt, Staphylococcus aureus subsp. aureus MW2
aucaucugcaagugcuucaacuu

SEQ ID NO: 2096511 - RNA, 20 nt, Staphylococcus aureus subsp. aureus MW2
aucaucucugcuuuaauaua

SEQ ID NO: 2096512 - RNA, 23 nt, Staphylococcus aureus subsp. aureus MW2
aucaucuccuugguuauuaaaau

SEQ ID NO: 2096513 - RNA, 21 nt, Staphylococcus aureus subsp. aureus MW2
aucaucuaaaugguuaucuaa

SEQ ID NO: 2096514 - RNA, 15 nt, Staphylococcus aureus subsp. aureus MW2
aucaucuuaacaauu

SEQ ID NO: 2096515 - RNA, 19 nt, Staphylococcus aureus subsp. aureus MW2
aucaucuuaacaauuuuaa

SEQ ID NO: 2096516 - RNA, 14 nt, Staphylococcus aureus subsp. aureus MW2
aucaucuucaguua

SEQ ID NO: 2096517 - RNA, 19 nt, Staphylococcus aureus subsp. aureus MW2
aucaucuuuaauuuucuug

SEQ ID NO: 2096518 - RNA, 19 nt, Staphylococcus aureus subsp. aureus MW2
aucaucguauuucauauau

SEQ ID NO: 2096519 - RNA, 24 nt, Staphylococcus aureus subsp. aureus MW2
aucaucguauagaugugucuuuug

SEQ ID NO: 2096520 - RNA, 11 nt, Staphylococcus aureus subsp. aureus MW2
aucaucuauuc

SEQ ID NO: 2096521 - RNA, 14 nt, Staphylococcus aureus subsp. aureus MW2
aucaucuauucaaa

SEQ ID NO: 2096522 - RNA, 16 nt, Staphylococcus aureus subsp. aureus MW2
aucaucuauauuuaau

SEQ ID NO: 2096523 - RNA, 22 nt, Staphylococcus aureus subsp. aureus MW2
aucaucaaguucaccguaaucu

SEQ ID NO: 2096524 - RNA, 23 nt, Staphylococcus aureus subsp. aureus MW2
aucaucaagacauuuuaacaagu

SEQ ID NO: 2096525 - RNA, 14 nt, Staphylococcus aureus subsp. aureus MW2
aucaucaaaauuua

SEQ ID NO: 2096526 - RNA, 17 nt, Staphylococcus aureus subsp. aureus MW2
aucaucauguuuauuag

SEQ ID NO: 2096527 - RNA, 23 nt, Staphylococcus aureus subsp. aureus MW2
aucaucauauugcacauaaacuu

SEQ ID NO: 2096528 - RNA, 19 nt, Staphylococcus aureus subsp. aureus MW2
aucaugccuucaugaauaa

SEQ ID NO: 2096529 - RNA, 14 nt, Staphylococcus aureus subsp. aureus MW2
aucaugcgcaauau

SEQ ID NO: 2096530 - RNA, 21 nt, Staphylococcus aureus subsp. aureus MW2
aucauggucaacuuuuuuaac

SEQ ID NO: 2096531 - RNA, 12 nt, Staphylococcus aureus subsp. aureus MW2
aucaugcuuuuu

SEQ ID NO: 2096532 - RNA, 15 nt, Staphylococcus aureus subsp. aureus MW2
aucaugcaaaacuaa

SEQ ID NO: 2096533 - RNA, 14 nt, Staphylococcus aureus subsp. aureus MW2
aucaugauuacuaa

SEQ ID NO: 2096534 - RNA, 12 nt, Staphylococcus aureus subsp. aureus MW2
aucaugauuauu

SEQ ID NO: 2096535 - RNA, 20 nt, Staphylococcus aureus subsp. aureus MW2
aucaucuuuuugaaauuucg

SEQ ID NO: 2096536 - RNA, 17 nt, Staphylococcus aureus subsp. aureus MW2
aucaugaaauuaaaaac

SEQ ID NO: 2096537 - RNA, 18 nt, Staphylococcus aureus subsp. aureus MW2
aucaugaaauuaaaaaca

SEQ ID NO: 2096538 - RNA, 16 nt, Staphylococcus aureus subsp. aureus MW2
aucaugaaguugguuu

SEQ ID NO: 2096539 - RNA, 19 nt, Staphylococcus aureus subsp. aureus MW2
aucaugacuauuuuccauc

SEQ ID NO: 2096540 - RNA, 21 nt, Staphylococcus aureus subsp. aureus MW2
aucauuaguuuuuaaaauuau

SEQ ID NO: 2096541 - RNA, 19 nt, Staphylococcus aureus subsp. aureus MW2
aucauuaguguagaaaaua

SEQ ID NO: 2096542 - RNA, 15 nt, Staphylococcus aureus subsp. aureus MW2
aucauuauaaaaugg

SEQ ID NO: 2096543 - RNA, 13 nt, Staphylococcus aureus subsp. aureus MW2
aucauuauaaaau

SEQ ID NO: 2096544 - RNA, 14 nt, Staphylococcus aureus subsp. aureus MW2
aucauuauaaaaug

SEQ ID NO: 2096545 - RNA, 19 nt, Staphylococcus aureus subsp. aureus MW2
aucauuagacuuucuuaau

SEQ ID NO: 2096546 - RNA, 14 nt, Staphylococcus aureus subsp. aureus MW2
aucauuagauaaua

SEQ ID NO: 2096547 - RNA, 19 nt, Staphylococcus aureus subsp. aureus MW2
aucauuauuugauaaauaa

SEQ ID NO: 2096548 - RNA, 13 nt, Staphylococcus aureus subsp. aureus MW2
aucauuauuuuac

SEQ ID NO: 2096549 - RNA, 18 nt, Staphylococcus aureus subsp. aureus MW2
aucauuauuuaauuuuaa

SEQ ID NO: 2096550 - RNA, 23 nt, Staphylococcus aureus subsp. aureus MW2
aucauguauauggcaucaucacc

SEQ ID NO: 2096551 - RNA, 15 nt, Staphylococcus aureus subsp. aureus MW2
aucauucgaauacug

SEQ ID NO: 2096552 - RNA, 18 nt, Staphylococcus aureus subsp. aureus MW2
aucauuucagaaauacau

SEQ ID NO: 2096553 - RNA, 23 nt, Staphylococcus aureus subsp. aureus MW2
aucauuuacuuuagaaacaccuu

SEQ ID NO: 2096554 - RNA, 15 nt, Staphylococcus aureus subsp. aureus MW2
aucauuucaaauaag

SEQ ID NO: 2096555 - RNA, 19 nt, Staphylococcus aureus subsp. aureus MW2
aucauuuaaauuaguuaua

SEQ ID NO: 2096556 - RNA, 23 nt, Staphylococcus aureus subsp. aureus MW2
aucauuuaaauuaguuauacuaa

SEQ ID NO: 2096557 - RNA, 20 nt, Staphylococcus aureus subsp. aureus MW2
aucauuguggcuuuuuuuau

SEQ ID NO: 2096558 - RNA, 22 nt, Staphylococcus aureus subsp. aureus MW2
aucauuguguccauaaauauua

SEQ ID NO: 2096559 - RNA, 19 nt, Staphylococcus aureus subsp. aureus MW2
aucauuuaaaauauuuuuu

SEQ ID NO: 2096560 - RNA, 23 nt, Staphylococcus aureus subsp. aureus MW2
auccaaggauguuauaaaaugaa

SEQ ID NO: 2096561 - RNA, 13 nt, Staphylococcus aureus subsp. aureus MW2
auccaaauauuaa

SEQ ID NO: 2096562 - RNA, 20 nt, Staphylococcus aureus subsp. aureus MW2
auccaaagaaacggaaauga

SEQ ID NO: 2096563 - RNA, 18 nt, Staphylococcus aureus subsp. aureus MW2
aucauuuggcguucaaca

SEQ ID NO: 2096564 - RNA, 23 nt, Staphylococcus aureus subsp. aureus MW2
aucauuuguacaaucaaaggcuu

SEQ ID NO: 2096565 - RNA, 13 nt, Staphylococcus aureus subsp. aureus MW2
aucauuguggcuu

SEQ ID NO: 2096566 - RNA, 17 nt, Staphylococcus aureus subsp. aureus MW2
aucauuuucuugauuuu

SEQ ID NO: 2096567 - RNA, 19 nt, Staphylococcus aureus subsp. aureus MW2
aucauuuucuugauuuuag

SEQ ID NO: 2096568 - RNA, 18 nt, Staphylococcus aureus subsp. aureus MW2
auccaaaauccugaaauu

SEQ ID NO: 2096569 - RNA, 14 nt, Staphylococcus aureus subsp. aureus MW2
auccaaaacauuuu

SEQ ID NO: 2096570 - RNA, 16 nt, Staphylococcus aureus subsp. aureus MW2
auccaccguuaaaaua

SEQ ID NO: 2096571 - RNA, 18 nt, Staphylococcus aureus subsp. aureus MW2
auccaccguuaaaauaua

SEQ ID NO: 2096572 - RNA, 20 nt, Staphylococcus aureus subsp. aureus MW2
auccaagucuaaaugcaaua

SEQ ID NO: 2096573 - RNA, 21 nt, Staphylococcus aureus subsp. aureus MW2
auccaagucuaaaugcaauau

SEQ ID NO: 2096574 - RNA, 20 nt, Staphylococcus aureus subsp. aureus MW2
auccaagugacaacauuauu

SEQ ID NO: 2096575 - RNA, 17 nt, Staphylococcus aureus subsp. aureus MW2
auccaauuaaauauuua

SEQ ID NO: 2096576 - RNA, 15 nt, Staphylococcus aureus subsp. aureus MW2
auccaucaauaccau

SEQ ID NO: 2096577 - RNA, 21 nt, Staphylococcus aureus subsp. aureus MW2
auccauauauguaacaaaugc

SEQ ID NO: 2096578 - RNA, 13 nt, Staphylococcus aureus subsp. aureus MW2
auccaucuaauuc

SEQ ID NO: 2096579 - RNA, 14 nt, Staphylococcus aureus subsp. aureus MW2
auccaucuacaccc

SEQ ID NO: 2096580 - RNA, 23 nt, Staphylococcus aureus subsp. aureus MW2
auccauucccuuuucaucaaauu

SEQ ID NO: 2096581 - RNA, 15 nt, Staphylococcus aureus subsp. aureus MW2
auccauucuuuuuca

SEQ ID NO: 2096582 - RNA, 17 nt, Staphylococcus aureus subsp. aureus MW2
auccauucuuuuucaaa

SEQ ID NO: 2096583 - RNA, 21 nt, Staphylococcus aureus subsp. aureus MW2
auccauucuaacgguaaauaa

SEQ ID NO: 2096584 - RNA, 12 nt, Staphylococcus aureus subsp. aureus MW2
auccauucuuuu

SEQ ID NO: 2096585 - RNA, 15 nt, Staphylococcus aureus subsp. aureus MW2
aucccauuaaaccac

SEQ ID NO: 2096586 - RNA, 18 nt, Staphylococcus aureus subsp. aureus MW2
aucccaaccaugcuuuuu

SEQ ID NO: 2096587 - RNA, 15 nt, Staphylococcus aureus subsp. aureus MW2
auccauuuuuugccu

SEQ ID NO: 2096588 - RNA, 20 nt, Staphylococcus aureus subsp. aureus MW2
aucccaaguuacgauaucau

SEQ ID NO: 2096589 - RNA, 19 nt, Staphylococcus aureus subsp. aureus MW2
auccaguuaauuauuuaga

SEQ ID NO: 2096590 - RNA, 22 nt, Staphylococcus aureus subsp. aureus MW2
auccccaacccggugcauguug

SEQ ID NO: 2096591 - RNA, 19 nt, Staphylococcus aureus subsp. aureus MW2
auccccagccauuuguugu

SEQ ID NO: 2096592 - RNA, 14 nt, Staphylococcus aureus subsp. aureus MW2
auccccauuuaugu

SEQ ID NO: 2096593 - RNA, 18 nt, Staphylococcus aureus subsp. aureus MW2
aucccgaaaguuagacua

SEQ ID NO: 2096594 - RNA, 22 nt, Staphylococcus aureus subsp. aureus MW2
auccgauuuugauauaaaaagu

SEQ ID NO: 2096595 - RNA, 16 nt, Staphylococcus aureus subsp. aureus MW2
aucccuguaaaaccau

SEQ ID NO: 2096596 - RNA, 15 nt, Staphylococcus aureus subsp. aureus MW2
aucccuguaaaacca

SEQ ID NO: 2096597 - RNA, 17 nt, Staphylococcus aureus subsp. aureus MW2
auccgccaauuaaaauu

SEQ ID NO: 2096598 - RNA, 21 nt, Staphylococcus aureus subsp. aureus MW2
auccuauggcgcaauuuuuaa

SEQ ID NO: 2096599 - RNA, 23 nt, Staphylococcus aureus subsp. aureus MW2
auccuacgacacguguaaaaaug

SEQ ID NO: 2096600 - RNA, 17 nt, Staphylococcus aureus subsp. aureus MW2
auccuaaauuauaaaua

SEQ ID NO: 2096601 - RNA, 20 nt, Staphylococcus aureus subsp. aureus MW2
auccuaaaaagcucaauccu

SEQ ID NO: 2096602 - RNA, 18 nt, Staphylococcus aureus subsp. aureus MW2
auccuaaaaagcucaauc

SEQ ID NO: 2096603 - RNA, 19 nt, Staphylococcus aureus subsp. aureus MW2
auccugccaauauauucac

SEQ ID NO: 2096604 - RNA, 20 nt, Staphylococcus aureus subsp. aureus MW2
auccugccauuaaacgaaug

SEQ ID NO: 2096605 - RNA, 16 nt, Staphylococcus aureus subsp. aureus MW2
auccugccaauauauu

SEQ ID NO: 2096606 - RNA, 19 nt, Staphylococcus aureus subsp. aureus MW2
auccugcuuauuaauuguu

SEQ ID NO: 2096607 - RNA, 16 nt, Staphylococcus aureus subsp. aureus MW2
auccugaagagaaaau

SEQ ID NO: 2096608 - RNA, 24 nt, Staphylococcus aureus subsp. aureus MW2
auccugauuuaauguuaaacaaua

SEQ ID NO: 2096609 - RNA, 19 nt, Staphylococcus aureus subsp. aureus MW2
aucguaaacacuauaaaag

SEQ ID NO: 2096610 - RNA, 22 nt, Staphylococcus aureus subsp. aureus MW2
aucguauugaaaaugagcugaa

SEQ ID NO: 2096611 - RNA, 16 nt, Staphylococcus aureus subsp. aureus MW2
aucguauucuuuuaau

SEQ ID NO: 2096612 - RNA, 22 nt, Staphylococcus aureus subsp. aureus MW2
aucuaacaaucguuuuaaugcc

SEQ ID NO: 2096613 - RNA, 13 nt, Staphylococcus aureus subsp. aureus MW2
aucuaacaucauu

SEQ ID NO: 2096614 - RNA, 17 nt, Staphylococcus aureus subsp. aureus MW2
aucuaacaucauuaacu

SEQ ID NO: 2096615 - RNA, 12 nt, Staphylococcus aureus subsp. aureus MW2
aucguuucuucc

SEQ ID NO: 2096616 - RNA, 18 nt, Staphylococcus aureus subsp. aureus MW2
aucguuuacuacaucaua

SEQ ID NO: 2096617 - RNA, 22 nt, Staphylococcus aureus subsp. aureus MW2
aucguuuucaacauaauauuuc

SEQ ID NO: 2096618 - RNA, 18 nt, Staphylococcus aureus subsp. aureus MW2
aucgucaucacuuuuuaa

SEQ ID NO: 2096619 - RNA, 20 nt, Staphylococcus aureus subsp. aureus MW2
aucgucuccaacuuuaaaug

SEQ ID NO: 2096620 - RNA, 15 nt, Staphylococcus aureus subsp. aureus MW2
aucggaauaaaauaa

SEQ ID NO: 2096621 - RNA, 19 nt, Staphylococcus aureus subsp. aureus MW2
aucgccuuguuuauuuuua

SEQ ID NO: 2096622 - RNA, 21 nt, Staphylococcus aureus subsp. aureus MW2
aucgagagauuaugcuugcca

SEQ ID NO: 2096623 - RNA, 14 nt, Staphylococcus aureus subsp. aureus MW2
aucgacuuuucuau

SEQ ID NO: 2096624 - RNA, 20 nt, Staphylococcus aureus subsp. aureus MW2
aucgauuaagaaugcaccaa

SEQ ID NO: 2096625 - RNA, 23 nt, Staphylococcus aureus subsp. aureus MW2
aucgcauuuuguuucaacauuuc

SEQ ID NO: 2096626 - RNA, 14 nt, Staphylococcus aureus subsp. aureus MW2
aucgaauucauuug

SEQ ID NO: 2096627 - RNA, 18 nt, Staphylococcus aureus subsp. aureus MW2
aucgaauugguaaaaauc

SEQ ID NO: 2096628 - RNA, 23 nt, Staphylococcus aureus subsp. aureus MW2
aucgaauuagaucuaugguuaug

SEQ ID NO: 2096629 - RNA, 22 nt, Staphylococcus aureus subsp. aureus MW2
auccuuuauaaauaaacauaaa

SEQ ID NO: 2096630 - RNA, 14 nt, Staphylococcus aureus subsp. aureus MW2
aucgaacuagacaa

SEQ ID NO: 2096631 - RNA, 20 nt, Staphylococcus aureus subsp. aureus MW2
auccuucaaagauuuuaccu

SEQ ID NO: 2096632 - RNA, 20 nt, Staphylococcus aureus subsp. aureus MW2
auccuuaccuuuuaaaccug

SEQ ID NO: 2096633 - RNA, 21 nt, Staphylococcus aureus subsp. aureus MW2
auccuguguaaaauaaaucau

SEQ ID NO: 2096634 - RNA, 21 nt, Staphylococcus aureus subsp. aureus MW2
caauucgcucacaugugaaau

SEQ ID NO: 2096635 - RNA, 22 nt, Staphylococcus aureus subsp. aureus MW2
caauugauauuuaccgucuuau

SEQ ID NO: 2096636 - RNA, 18 nt, Staphylococcus aureus subsp. aureus MW2
caauugcauacguaaaug

SEQ ID NO: 2096637 - RNA, 17 nt, Staphylococcus aureus subsp. aureus MW2
caauugcacuuacugcu

SEQ ID NO: 2096638 - RNA, 15 nt, Staphylococcus aureus subsp. aureus MW2
caauugaagugaaau

SEQ ID NO: 2096639 - RNA, 18 nt, Staphylococcus aureus subsp. aureus MW2
caauugaaucaaauacau

SEQ ID NO: 2096640 - RNA, 22 nt, Staphylococcus aureus subsp. aureus MW2
caauugaagugaaauugcgugc

SEQ ID NO: 2096641 - RNA, 22 nt, Staphylococcus aureus subsp. aureus MW2
caauugaaugaaguaauauaua

SEQ ID NO: 2096642 - RNA, 19 nt, Staphylococcus aureus subsp. aureus MW2
caauuuaaauaaguuacuc

SEQ ID NO: 2096643 - RNA, 16 nt, Staphylococcus aureus subsp. aureus MW2
caauuuaaauuaagua

SEQ ID NO: 2096644 - RNA, 16 nt, Staphylococcus aureus subsp. aureus MW2
caauuuaaaaagcagu

SEQ ID NO: 2096645 - RNA, 18 nt, Staphylococcus aureus subsp. aureus MW2
caauuuaauagacauuaa

SEQ ID NO: 2096646 - RNA, 15 nt, Staphylococcus aureus subsp. aureus MW2
caauuuaauagacau

SEQ ID NO: 2096647 - RNA, 16 nt, Staphylococcus aureus subsp. aureus MW2
caauuguuacuuuaac

SEQ ID NO: 2096648 - RNA, 15 nt, Staphylococcus aureus subsp. aureus MW2
caauugucguuuaau

SEQ ID NO: 2096649 - RNA, 15 nt, Staphylococcus aureus subsp. aureus MW2
caauugcuaaaucau

SEQ ID NO: 2096650 - RNA, 17 nt, Staphylococcus aureus subsp. aureus MW2
caauuggaaguauuuau

SEQ ID NO: 2096651 - RNA, 16 nt, Staphylococcus aureus subsp. aureus MW2
caauugguuguuucaa

SEQ ID NO: 2096652 - RNA, 12 nt, Staphylococcus aureus subsp. aureus MW2
caauuauggaua

SEQ ID NO: 2096653 - RNA, 14 nt, Staphylococcus aureus subsp. aureus MW2
caauuauggauaaa

SEQ ID NO: 2096654 - RNA, 19 nt, Staphylococcus aureus subsp. aureus MW2
caauuauuauugcugugau

SEQ ID NO: 2096655 - RNA, 17 nt, Staphylococcus aureus subsp. aureus MW2
caauucacuuauacaug

SEQ ID NO: 2096656 - RNA, 12 nt, Staphylococcus aureus subsp. aureus MW2
caauucaaugua

SEQ ID NO: 2096657 - RNA, 15 nt, Staphylococcus aureus subsp. aureus MW2
caauuauaauaaaac

SEQ ID NO: 2096658 - RNA, 19 nt, Staphylococcus aureus subsp. aureus MW2
caauuagaaaauuucucac

SEQ ID NO: 2096659 - RNA, 22 nt, Staphylococcus aureus subsp. aureus MW2
caauuagccccaguauagaagc

SEQ ID NO: 2096660 - RNA, 23 nt, Staphylococcus aureus subsp. aureus MW2
caauuaauuuagucauuacaaau

SEQ ID NO: 2096661 - RNA, 22 nt, Staphylococcus aureus subsp. aureus MW2
caauuaauuuagucauuacaaa

SEQ ID NO: 2096662 - RNA, 22 nt, Staphylococcus aureus subsp. aureus MW2
caauuaaucggaucauuauuua

SEQ ID NO: 2096663 - RNA, 13 nt, Staphylococcus aureus subsp. aureus MW2
caauuaauaaaca

SEQ ID NO: 2096664 - RNA, 15 nt, Staphylococcus aureus subsp. aureus MW2
caauuaaaacuauaa

SEQ ID NO: 2096665 - RNA, 15 nt, Staphylococcus aureus subsp. aureus MW2
caauuaaagugaaua

SEQ ID NO: 2096666 - RNA, 19 nt, Staphylococcus aureus subsp. aureus MW2
caauuaaaacuauaauaaa

SEQ ID NO: 2096667 - RNA, 19 nt, Staphylococcus aureus subsp. aureus MW2
caauuaaguacuucaaagc

SEQ ID NO: 2096668 - RNA, 20 nt, Staphylococcus aureus subsp. aureus MW2
caauuaaguacuucaaagca

SEQ ID NO: 2096669 - RNA, 17 nt, Staphylococcus aureus subsp. aureus MW2
caauuuuaaaucuuuua

SEQ ID NO: 2096670 - RNA, 12 nt, Staphylococcus aureus subsp. aureus MW2
caauuuuaccag

SEQ ID NO: 2096671 - RNA, 21 nt, Staphylococcus aureus subsp. aureus MW2
caauuuuaauuuuucauuaau

SEQ ID NO: 2096672 - RNA, 12 nt, Staphylococcus aureus subsp. aureus MW2
caauuuucucau

SEQ ID NO: 2096673 - RNA, 19 nt, Staphylococcus aureus subsp. aureus MW2
caauuuucucauuaaccuu

SEQ ID NO: 2096674 - RNA, 23 nt, Staphylococcus aureus subsp. aureus MW2
caauuuuugaaagugauaaaucu

SEQ ID NO: 2096675 - RNA, 16 nt, Staphylococcus aureus subsp. aureus MW2
caauuuuuaacaaaau

SEQ ID NO: 2096676 - RNA, 16 nt, Staphylococcus aureus subsp. aureus MW2
caauuuuuaaaaaccu

SEQ ID NO: 2096677 - RNA, 14 nt, Staphylococcus aureus subsp. aureus MW2
caauuuuuaacaaa

SEQ ID NO: 2096678 - RNA, 19 nt, Staphylococcus aureus subsp. aureus MW2
caauuuuucacuuauaaca

SEQ ID NO: 2096679 - RNA, 17 nt, Staphylococcus aureus subsp. aureus MW2
caauuuauuauuaacug

SEQ ID NO: 2096680 - RNA, 22 nt, Staphylococcus aureus subsp. aureus MW2
caauuuauuauuaacuguaccu

SEQ ID NO: 2096681 - RNA, 19 nt, Staphylococcus aureus subsp. aureus MW2
caauuuaguauaaauaaaa

SEQ ID NO: 2096682 - RNA, 16 nt, Staphylococcus aureus subsp. aureus MW2
caauuuaguucacaau

SEQ ID NO: 2096683 - RNA, 18 nt, Staphylococcus aureus subsp. aureus MW2
caauuuaucgagaacauc

SEQ ID NO: 2096684 - RNA, 13 nt, Staphylococcus aureus subsp. aureus MW2
caauuucuguaau

SEQ ID NO: 2096685 - RNA, 13 nt, Staphylococcus aureus subsp. aureus MW2
caauuucuacaga

SEQ ID NO: 2096686 - RNA, 16 nt, Staphylococcus aureus subsp. aureus MW2
caauuucuacagacaa

SEQ ID NO: 2096687 - RNA, 22 nt, Staphylococcus aureus subsp. aureus MW2
caauuucuaggccacuaagacc

SEQ ID NO: 2096688 - RNA, 17 nt, Staphylococcus aureus subsp. aureus MW2
caauuucgauucgugau

SEQ ID NO: 2096689 - RNA, 15 nt, Staphylococcus aureus subsp. aureus MW2
caauuuggaaauauc

SEQ ID NO: 2096690 - RNA, 23 nt, Staphylococcus aureus subsp. aureus MW2
caauuugcuguccacuauauccu

SEQ ID NO: 2096691 - RNA, 18 nt, Staphylococcus aureus subsp. aureus MW2
caauuucuucauuuucau

SEQ ID NO: 2096692 - RNA, 15 nt, Staphylococcus aureus subsp. aureus MW2
caauuucuucauuuu

SEQ ID NO: 2096693 - RNA, 23 nt, Staphylococcus aureus subsp. aureus MW2
cacaaaguauuugaaguauuuuc

SEQ ID NO: 2096694 - RNA, 23 nt, Staphylococcus aureus subsp. aureus MW2
cacaaacaagaauaaaucccaua

SEQ ID NO: 2096695 - RNA, 12 nt, Staphylococcus aureus subsp. aureus MW2
cacaacaaucac

SEQ ID NO: 2096696 - RNA, 19 nt, Staphylococcus aureus subsp. aureus MW2
cacaacaaugaauccaaau

SEQ ID NO: 2096697 - RNA, 23 nt, Staphylococcus aureus subsp. aureus MW2
cacaacaaugaauccaaauauua

SEQ ID NO: 2096698 - RNA, 16 nt, Staphylococcus aureus subsp. aureus MW2
cacaaccagucagaaa

SEQ ID NO: 2096699 - RNA, 23 nt, Staphylococcus aureus subsp. aureus MW2
cacaacauguuuggaugaacaaa

SEQ ID NO: 2096700 - RNA, 21 nt, Staphylococcus aureus subsp. aureus MW2
cacaacgauagauaucauuuu

SEQ ID NO: 2096701 - RNA, 21 nt, Staphylococcus aureus subsp. aureus MW2
cacaacggcauaauacacauu

SEQ ID NO: 2096702 - RNA, 17 nt, Staphylococcus aureus subsp. aureus MW2
cacaauaauccaagaua

SEQ ID NO: 2096703 - RNA, 18 nt, Staphylococcus aureus subsp. aureus MW2
cacacacaguuuauaaua

SEQ ID NO: 2096704 - RNA, 15 nt, Staphylococcus aureus subsp. aureus MW2
cacacaguuuauaau

SEQ ID NO: 2096705 - RNA, 13 nt, Staphylococcus aureus subsp. aureus MW2
cacacauaaaugu

SEQ ID NO: 2096706 - RNA, 16 nt, Staphylococcus aureus subsp. aureus MW2
cacauacauaucuuuu

SEQ ID NO: 2096707 - RNA, 23 nt, Staphylococcus aureus subsp. aureus MW2
cacaguguugaauuuaaaaauag

SEQ ID NO: 2096708 - RNA, 18 nt, Staphylococcus aureus subsp. aureus MW2
cacaguuauauauuacuu

SEQ ID NO: 2096709 - RNA, 17 nt, Staphylococcus aureus subsp. aureus MW2
cacaguuucaucuucaa

SEQ ID NO: 2096710 - RNA, 18 nt, Staphylococcus aureus subsp. aureus MW2
cacagcgauuaaaugaug

SEQ ID NO: 2096711 - RNA, 22 nt, Staphylococcus aureus subsp. aureus MW2
cacagaagcuggcggaaaguca

SEQ ID NO: 2096712 - RNA, 21 nt, Staphylococcus aureus subsp. aureus MW2
cacagcaauucacuuauacau

SEQ ID NO: 2096713 - RNA, 22 nt, Staphylococcus aureus subsp. aureus MW2
cacagcaauucacuuauacaug

SEQ ID NO: 2096714 - RNA, 18 nt, Staphylococcus aureus subsp. aureus MW2
cacauguaccacauuuuc

SEQ ID NO: 2096715 - RNA, 21 nt, Staphylococcus aureus subsp. aureus MW2
cacauguacguuuuuuuaaau

SEQ ID NO: 2096716 - RNA, 14 nt, Staphylococcus aureus subsp. aureus MW2
cacauuaacaaggc

SEQ ID NO: 2096717 - RNA, 13 nt, Staphylococcus aureus subsp. aureus MW2
cacaucuaugugg

SEQ ID NO: 2096718 - RNA, 22 nt, Staphylococcus aureus subsp. aureus MW2
cacaucuuuagcuauuuaaaau

SEQ ID NO: 2096719 - RNA, 14 nt, Staphylococcus aureus subsp. aureus MW2
cacaucuuuuuaaa

SEQ ID NO: 2096720 - RNA, 15 nt, Staphylococcus aureus subsp. aureus MW2
cacaucauagcacua

SEQ ID NO: 2096721 - RNA, 20 nt, Staphylococcus aureus subsp. aureus MW2
cacaucaugacauuaaucau

SEQ ID NO: 2096722 - RNA, 23 nt, Staphylococcus aureus subsp. aureus MW2
cacauuauuuaaacgguaacaaa

SEQ ID NO: 2096723 - RNA, 15 nt, Staphylococcus aureus subsp. aureus MW2
cacauugucuacaaa

SEQ ID NO: 2096724 - RNA, 18 nt, Staphylococcus aureus subsp. aureus MW2
cacauugucuacaaaguu

SEQ ID NO: 2096725 - RNA, 14 nt, Staphylococcus aureus subsp. aureus MW2
cacauuuucaaauu

SEQ ID NO: 2096726 - RNA, 22 nt, Staphylococcus aureus subsp. aureus MW2
caccaacaauagguacaacuaa

SEQ ID NO: 2096727 - RNA, 22 nt, Staphylococcus aureus subsp. aureus MW2
caccaaauccaucuaauucaau

SEQ ID NO: 2096728 - RNA, 11 nt, Staphylococcus aureus subsp. aureus MW2
caccaauauuu

SEQ ID NO: 2096729 - RNA, 19 nt, Staphylococcus aureus subsp. aureus MW2
caccaaguucacuaaauuc

SEQ ID NO: 2096730 - RNA, 21 nt, Staphylococcus aureus subsp. aureus MW2
caccaaugauagugaauaaug

SEQ ID NO: 2096731 - RNA, 22 nt, Staphylococcus aureus subsp. aureus MW2
caccaucugcaacuaauaugau

SEQ ID NO: 2096732 - RNA, 21 nt, Staphylococcus aureus subsp. aureus MW2
caccauguacauugguuuuua

SEQ ID NO: 2096733 - RNA, 15 nt, Staphylococcus aureus subsp. aureus MW2
caccaucccauuaaa

SEQ ID NO: 2096734 - RNA, 15 nt, Staphylococcus aureus subsp. aureus MW2
caccauugcacaguu

SEQ ID NO: 2096735 - RNA, 17 nt, Staphylococcus aureus subsp. aureus MW2
caccagccccaauuagc

SEQ ID NO: 2096736 - RNA, 12 nt, Staphylococcus aureus subsp. aureus MW2
caccauaugugg

SEQ ID NO: 2096737 - RNA, 13 nt, Staphylococcus aureus subsp. aureus MW2
caccauaaaaaua

SEQ ID NO: 2096738 - RNA, 18 nt, Staphylococcus aureus subsp. aureus MW2
caccguaaucuuuuaacu

SEQ ID NO: 2096739 - RNA, 20 nt, Staphylococcus aureus subsp. aureus MW2
caccuauuuuuugagcacuu

SEQ ID NO: 2096740 - RNA, 14 nt, Staphylococcus aureus subsp. aureus MW2
caccuaaaauagaa

SEQ ID NO: 2096741 - RNA, 13 nt, Staphylococcus aureus subsp. aureus MW2
caccuaaaugauu

SEQ ID NO: 2096742 - RNA, 14 nt, Staphylococcus aureus subsp. aureus MW2
caccugcaacacua

SEQ ID NO: 2096743 - RNA, 19 nt, Staphylococcus aureus subsp. aureus MW2
caccucuaaguucaccuaa

SEQ ID NO: 2096744 - RNA, 15 nt, Staphylococcus aureus subsp. aureus MW2
caccuccaaccgcuu

SEQ ID NO: 2096745 - RNA, 12 nt, Staphylococcus aureus subsp. aureus MW2
cacgacuuucua

SEQ ID NO: 2096746 - RNA, 15 nt, Staphylococcus aureus subsp. aureus MW2
cacgacguucuucaa

SEQ ID NO: 2096747 - RNA, 17 nt, Staphylococcus aureus subsp. aureus MW2
cacgagcugcuucaacu

SEQ ID NO: 2096748 - RNA, 22 nt, Staphylococcus aureus subsp. aureus MW2
caccuuuuuuaacuuuaacauc

SEQ ID NO: 2096749 - RNA, 17 nt, Staphylococcus aureus subsp. aureus MW2
cacgaacaagucuugca

SEQ ID NO: 2096750 - RNA, 15 nt, Staphylococcus aureus subsp. aureus MW2
cacgaacaacauuag

SEQ ID NO: 2096751 - RNA, 13 nt, Staphylococcus aureus subsp. aureus MW2
caccuuuaucugu

SEQ ID NO: 2096752 - RNA, 16 nt, Staphylococcus aureus subsp. aureus MW2
caccuuuacaacauac

SEQ ID NO: 2096753 - RNA, 16 nt, Staphylococcus aureus subsp. aureus MW2
caccuucaauaucugu

SEQ ID NO: 2096754 - RNA, 17 nt, Staphylococcus aureus subsp. aureus MW2
caccuucaauaucugua

SEQ ID NO: 2096755 - RNA, 19 nt, Staphylococcus aureus subsp. aureus MW2
caccuucguuuaaauucau

SEQ ID NO: 2096756 - RNA, 20 nt, Staphylococcus aureus subsp. aureus MW2
caccugcuaguucagcuucu

SEQ ID NO: 2096757 - RNA, 23 nt, Staphylococcus aureus subsp. aureus MW2
caccuggucguacuuucaaauaa

SEQ ID NO: 2096758 - RNA, 19 nt, Staphylococcus aureus subsp. aureus MW2
caccgcaaugccacaucau

SEQ ID NO: 2096759 - RNA, 21 nt, Staphylococcus aureus subsp. aureus MW2
cacgcucauuuucuguugcag

SEQ ID NO: 2096760 - RNA, 14 nt, Staphylococcus aureus subsp. aureus MW2
cacgauuuuuaaaa

SEQ ID NO: 2096761 - RNA, 19 nt, Staphylococcus aureus subsp. aureus MW2
cacguucuugguauuuuuu

SEQ ID NO: 2096762 - RNA, 23 nt, Staphylococcus aureus subsp. aureus MW2
cacguugugcaauaccuguucca

SEQ ID NO: 2096763 - RNA, 17 nt, Staphylococcus aureus subsp. aureus MW2
cacgugguuucuuuaau

SEQ ID NO: 2096764 - RNA, 14 nt, Staphylococcus aureus subsp. aureus MW2
cacuaaauucaaua

SEQ ID NO: 2096765 - RNA, 11 nt, Staphylococcus aureus subsp. aureus MW2
cacuaaaaauc

SEQ ID NO: 2096766 - RNA, 16 nt, Staphylococcus aureus subsp. aureus MW2
cacuaaaaauauauuu

SEQ ID NO: 2096767 - RNA, 14 nt, Staphylococcus aureus subsp. aureus MW2
cacuaauauuuaaa

SEQ ID NO: 2096768 - RNA, 19 nt, Staphylococcus aureus subsp. aureus MW2
cacuaauauuuaaaaaaca

SEQ ID NO: 2096769 - RNA, 20 nt, Staphylococcus aureus subsp. aureus MW2
cacuaauauuuaaaaaacaa

SEQ ID NO: 2096770 - RNA, 16 nt, Staphylococcus aureus subsp. aureus MW2
cacuaaugcauaauua

SEQ ID NO: 2096771 - RNA, 11 nt, Staphylococcus aureus subsp. aureus MW2
cacuauaaaag

SEQ ID NO: 2096772 - RNA, 19 nt, Staphylococcus aureus subsp. aureus MW2
cacuaucauuaucaaauaa

SEQ ID NO: 2096773 - RNA, 11 nt, Staphylococcus aureus subsp. aureus MW2
cacuaucuuuu

SEQ ID NO: 2096774 - RNA, 18 nt, Staphylococcus aureus subsp. aureus MW2
cacuaggauguucaucaa

SEQ ID NO: 2096775 - RNA, 23 nt, Staphylococcus aureus subsp. aureus MW2
cacuacugucucaucuucuaaau

SEQ ID NO: 2096776 - RNA, 24 nt, Staphylococcus aureus subsp. aureus MW2
cacuacgcugaugaaugauugcau

SEQ ID NO: 2096777 - RNA, 15 nt, Staphylococcus aureus subsp. aureus MW2
cacucacuucaacgu

SEQ ID NO: 2096778 - RNA, 12 nt, Staphylococcus aureus subsp. aureus MW2
cacuauuuuuau

SEQ ID NO: 2096779 - RNA, 15 nt, Staphylococcus aureus subsp. aureus MW2
cacucauucaauuua

SEQ ID NO: 2096780 - RNA, 13 nt, Staphylococcus aureus subsp. aureus MW2
cacucauuuuuug

SEQ ID NO: 2096781 - RNA, 20 nt, Staphylococcus aureus subsp. aureus MW2
cacucauaaucaagucugca

SEQ ID NO: 2096782 - RNA, 20 nt, Staphylococcus aureus subsp. aureus MW2
cacucauaaccgcuucuuuu

SEQ ID NO: 2096783 - RNA, 19 nt, Staphylococcus aureus subsp. aureus MW2
cacucauaaccgcuucuuu

SEQ ID NO: 2096784 - RNA, 15 nt, Staphylococcus aureus subsp. aureus MW2
cacuccuuaaacaaa

SEQ ID NO: 2096785 - RNA, 22 nt, Staphylococcus aureus subsp. aureus MW2
cacuccucuauuuuaugauuug

SEQ ID NO: 2096786 - RNA, 17 nt, Staphylococcus aureus subsp. aureus MW2
cacugagcaacaaaaga

SEQ ID NO: 2096787 - RNA, 17 nt, Staphylococcus aureus subsp. aureus MW2
cacugacaugauaaauu

SEQ ID NO: 2096788 - RNA, 14 nt, Staphylococcus aureus subsp. aureus MW2
cacugaaaucuaga

SEQ ID NO: 2096789 - RNA, 22 nt, Staphylococcus aureus subsp. aureus MW2
auucuucaucaauaacuauaau

SEQ ID NO: 2096790 - RNA, 20 nt, Staphylococcus aureus subsp. aureus MW2
auucuucaucaugacuauuu

SEQ ID NO: 2096791 - RNA, 12 nt, Staphylococcus aureus subsp. aureus MW2
auucuucauuua

SEQ ID NO: 2096792 - RNA, 15 nt, Staphylococcus aureus subsp. aureus MW2
auucuugaaaaguuu

SEQ ID NO: 2096793 - RNA, 19 nt, Staphylococcus aureus subsp. aureus MW2
auucuugaauaaauuuuau

SEQ ID NO: 2096794 - RNA, 18 nt, Staphylococcus aureus subsp. aureus MW2
auucuugaauaaauuuua

SEQ ID NO: 2096795 - RNA, 14 nt, Staphylococcus aureus subsp. aureus MW2
auucugauacagaa

SEQ ID NO: 2096796 - RNA, 18 nt, Staphylococcus aureus subsp. aureus MW2
auucugcaccuguuuuaa

SEQ ID NO: 2096797 - RNA, 23 nt, Staphylococcus aureus subsp. aureus MW2
auucuuuaccuuuaccaguauca

SEQ ID NO: 2096798 - RNA, 15 nt, Staphylococcus aureus subsp. aureus MW2
auucuuuaauauaaa

SEQ ID NO: 2096799 - RNA, 18 nt, Staphylococcus aureus subsp. aureus MW2
auucuugguuuuuuagau

SEQ ID NO: 2096800 - RNA, 16 nt, Staphylococcus aureus subsp. aureus MW2
auucuuggcguauuuu

SEQ ID NO: 2096801 - RNA, 23 nt, Staphylococcus aureus subsp. aureus MW2
auucuuuauagaaaccaaaaaau

SEQ ID NO: 2096802 - RNA, 22 nt, Staphylococcus aureus subsp. aureus MW2
auucuuuauguuggggccucgc

SEQ ID NO: 2096803 - RNA, 20 nt, Staphylococcus aureus subsp. aureus MW2
auugaacaaaaaagugguuu

SEQ ID NO: 2096804 - RNA, 23 nt, Staphylococcus aureus subsp. aureus MW2
auugaacaaaaaagugguuuaau

SEQ ID NO: 2096805 - RNA, 15 nt, Staphylococcus aureus subsp. aureus MW2
auugaagaauauaaa

SEQ ID NO: 2096806 - RNA, 16 nt, Staphylococcus aureus subsp. aureus MW2
auugaagaauauaaac

SEQ ID NO: 2096807 - RNA, 22 nt, Staphylococcus aureus subsp. aureus MW2
auugaagaauauaaacuauuaa

SEQ ID NO: 2096808 - RNA, 15 nt, Staphylococcus aureus subsp. aureus MW2
auugaaaugauaaaa

SEQ ID NO: 2096809 - RNA, 16 nt, Staphylococcus aureus subsp. aureus MW2
auugaaaugauaaaaa

SEQ ID NO: 2096810 - RNA, 21 nt, Staphylococcus aureus subsp. aureus MW2
auucuuuuaauagaucuuugu

SEQ ID NO: 2096811 - RNA, 19 nt, Staphylococcus aureus subsp. aureus MW2
auucuuuguauuuauacua

SEQ ID NO: 2096812 - RNA, 14 nt, Staphylococcus aureus subsp. aureus MW2
auucuuuucaagaa

SEQ ID NO: 2096813 - RNA, 13 nt, Staphylococcus aureus subsp. aureus MW2
auucguuaacaau

SEQ ID NO: 2096814 - RNA, 16 nt, Staphylococcus aureus subsp. aureus MW2
auucuaagucuuuuga

SEQ ID NO: 2096815 - RNA, 14 nt, Staphylococcus aureus subsp. aureus MW2
auucuaacuuugua

SEQ ID NO: 2096816 - RNA, 14 nt, Staphylococcus aureus subsp. aureus MW2
auucuaacugcaaa

SEQ ID NO: 2096817 - RNA, 15 nt, Staphylococcus aureus subsp. aureus MW2
auucuaaaagaauua

SEQ ID NO: 2096818 - RNA, 20 nt, Staphylococcus aureus subsp. aureus MW2
auucguuugaauuauuuaau

SEQ ID NO: 2096819 - RNA, 17 nt, Staphylococcus aureus subsp. aureus MW2
auucguuugaauuauuu

SEQ ID NO: 2096820 - RNA, 14 nt, Staphylococcus aureus subsp. aureus MW2
auucugaaaucagu

SEQ ID NO: 2096821 - RNA, 13 nt, Staphylococcus aureus subsp. aureus MW2
auucucuuuacca

SEQ ID NO: 2096822 - RNA, 22 nt, Staphylococcus aureus subsp. aureus MW2
auucucuuuauugggagcaauc

SEQ ID NO: 2096823 - RNA, 20 nt, Staphylococcus aureus subsp. aureus MW2
auucucagucucuuugaagg

SEQ ID NO: 2096824 - RNA, 15 nt, Staphylococcus aureus subsp. aureus MW2
auucucagucucuuu

SEQ ID NO: 2096825 - RNA, 19 nt, Staphylococcus aureus subsp. aureus MW2
auucuaccaguugauuuaa

SEQ ID NO: 2096826 - RNA, 16 nt, Staphylococcus aureus subsp. aureus MW2
auugcucuuuaacaau

SEQ ID NO: 2096827 - RNA, 19 nt, Staphylococcus aureus subsp. aureus MW2
auugcgguaauugaaucgu

SEQ ID NO: 2096828 - RNA, 21 nt, Staphylococcus aureus subsp. aureus MW2
auugcguaacaucacagaaaa

SEQ ID NO: 2096829 - RNA, 18 nt, Staphylococcus aureus subsp. aureus MW2
auuggaaucccaaugcuu

SEQ ID NO: 2096830 - RNA, 20 nt, Staphylococcus aureus subsp. aureus MW2
auuggcaguucugaaacauu

SEQ ID NO: 2096831 - RNA, 20 nt, Staphylococcus aureus subsp. aureus MW2
auugcugggcuaccgauugu

SEQ ID NO: 2096832 - RNA, 21 nt, Staphylococcus aureus subsp. aureus MW2
auugcuuuuucuuaauuauuu

SEQ ID NO: 2096833 - RNA, 15 nt, Staphylococcus aureus subsp. aureus MW2
auuggaaaaauaaau

SEQ ID NO: 2096834 - RNA, 23 nt, Staphylococcus aureus subsp. aureus MW2
auugcugccacuguagaaacaca

SEQ ID NO: 2096835 - RNA, 17 nt, Staphylococcus aureus subsp. aureus MW2
auugauagauagaaauu

SEQ ID NO: 2096836 - RNA, 13 nt, Staphylococcus aureus subsp. aureus MW2
auugauaugguua

SEQ ID NO: 2096837 - RNA, 20 nt, Staphylococcus aureus subsp. aureus MW2
auugauaucccuaacauggg

SEQ ID NO: 2096838 - RNA, 21 nt, Staphylococcus aureus subsp. aureus MW2
auugaccaacguucgauaacg

SEQ ID NO: 2096839 - RNA, 23 nt, Staphylococcus aureus subsp. aureus MW2
auugacauuaaugauagcaauga

SEQ ID NO: 2096840 - RNA, 15 nt, Staphylococcus aureus subsp. aureus MW2
auugaccgacaaagc

SEQ ID NO: 2096841 - RNA, 15 nt, Staphylococcus aureus subsp. aureus MW2
auugaguuuuuuaaa

SEQ ID NO: 2096842 - RNA, 14 nt, Staphylococcus aureus subsp. aureus MW2
auugaauugaaaaa

SEQ ID NO: 2096843 - RNA, 15 nt, Staphylococcus aureus subsp. aureus MW2
auugaugaauaaaua

SEQ ID NO: 2096844 - RNA, 21 nt, Staphylococcus aureus subsp. aureus MW2
auugaugaauaaauagauaau

SEQ ID NO: 2096845 - RNA, 20 nt, Staphylococcus aureus subsp. aureus MW2
auugaugaucaauuaacacu

SEQ ID NO: 2096846 - RNA, 15 nt, Staphylococcus aureus subsp. aureus MW2
auugauucuacagcg

SEQ ID NO: 2096847 - RNA, 23 nt, Staphylococcus aureus subsp. aureus MW2
auugcagguaaacggaauaacuu

SEQ ID NO: 2096848 - RNA, 19 nt, Staphylococcus aureus subsp. aureus MW2
auugauugcucuaagcauu

SEQ ID NO: 2096849 - RNA, 12 nt, Staphylococcus aureus subsp. aureus MW2
auugauuguuaa

SEQ ID NO: 2096850 - RNA, 17 nt, Staphylococcus aureus subsp. aureus MW2
auugauuauucuuuaau

SEQ ID NO: 2096851 - RNA, 15 nt, Staphylococcus aureus subsp. aureus MW2
auuccaaaaauugua

SEQ ID NO: 2096852 - RNA, 18 nt, Staphylococcus aureus subsp. aureus MW2
auuccaaacacacuguug

SEQ ID NO: 2096853 - RNA, 20 nt, Staphylococcus aureus subsp. aureus MW2
auucauuucgauuaauuuaa

SEQ ID NO: 2096854 - RNA, 21 nt, Staphylococcus aureus subsp. aureus MW2
auucauuauagucuuaaacau

SEQ ID NO: 2096855 - RNA, 21 nt, Staphylococcus aureus subsp. aureus MW2
auucauuccuaagaauguaau

SEQ ID NO: 2096856 - RNA, 17 nt, Staphylococcus aureus subsp. aureus MW2
auuccaugucaauuuuu

SEQ ID NO: 2096857 - RNA, 15 nt, Staphylococcus aureus subsp. aureus MW2
auuccaucucauacu

SEQ ID NO: 2096858 - RNA, 20 nt, Staphylococcus aureus subsp. aureus MW2
auuccauacgaucuuuuuca

SEQ ID NO: 2096859 - RNA, 16 nt, Staphylococcus aureus subsp. aureus MW2
auuccacuacaaucau

SEQ ID NO: 2096860 - RNA, 14 nt, Staphylococcus aureus subsp. aureus MW2
auguugcaaaauua

SEQ ID NO: 2096861 - RNA, 15 nt, Staphylococcus aureus subsp. aureus MW2
auucaguauauguau

SEQ ID NO: 2096862 - RNA, 21 nt, Staphylococcus aureus subsp. aureus MW2
auucagucaguaaaaauacau

SEQ ID NO: 2096863 - RNA, 19 nt, Staphylococcus aureus subsp. aureus MW2
auucagucaguaaaaauac

SEQ ID NO: 2096864 - RNA, 20 nt, Staphylococcus aureus subsp. aureus MW2
auguugaaaaguauaugaau

SEQ ID NO: 2096865 - RNA, 19 nt, Staphylococcus aureus subsp. aureus MW2
auguugacucguuauucaa

SEQ ID NO: 2096866 - RNA, 12 nt, Staphylococcus aureus subsp. aureus MW2
auguucuuauaa

SEQ ID NO: 2096867 - RNA, 23 nt, Staphylococcus aureus subsp. aureus MW2
auguucuuaacaauaucaucuaa

SEQ ID NO: 2096868 - RNA, 17 nt, Staphylococcus aureus subsp. aureus MW2
auucauaagaaaaaugu

SEQ ID NO: 2096869 - RNA, 12 nt, Staphylococcus aureus subsp. aureus MW2
auucauauuaac

SEQ ID NO: 2096870 - RNA, 16 nt, Staphylococcus aureus subsp. aureus MW2
auucauauucaaauuu

SEQ ID NO: 2096871 - RNA, 14 nt, Staphylococcus aureus subsp. aureus MW2
auucaucuuaucaa

SEQ ID NO: 2096872 - RNA, 21 nt, Staphylococcus aureus subsp. aureus MW2
auucaugaaucgaacuaguac

SEQ ID NO: 2096873 - RNA, 22 nt, Staphylococcus aureus subsp. aureus MW2
auucaucguuuacuacaucaua

SEQ ID NO: 2096874 - RNA, 17 nt, Staphylococcus aureus subsp. aureus MW2
auucaucuuaucaagaa

SEQ ID NO: 2096875 - RNA, 14 nt, Staphylococcus aureus subsp. aureus MW2
auucaucuucaaac

SEQ ID NO: 2096876 - RNA, 20 nt, Staphylococcus aureus subsp. aureus MW2
auucgaaaaagguauucaaa

SEQ ID NO: 2096877 - RNA, 15 nt, Staphylococcus aureus subsp. aureus MW2
auucgaaagccaauu

SEQ ID NO: 2096878 - RNA, 20 nt, Staphylococcus aureus subsp. aureus MW2
auucgaacuaucaauauaau

SEQ ID NO: 2096879 - RNA, 16 nt, Staphylococcus aureus subsp. aureus MW2
auucgauuauuuagau

SEQ ID NO: 2096880 - RNA, 20 nt, Staphylococcus aureus subsp. aureus MW2
auucgauuauuuagauaaaa

SEQ ID NO: 2096881 - RNA, 23 nt, Staphylococcus aureus subsp. aureus MW2
auuccucuggaacuuuaauacca

SEQ ID NO: 2096882 - RNA, 14 nt, Staphylococcus aureus subsp. aureus MW2
auuccugaaacaau

SEQ ID NO: 2096883 - RNA, 15 nt, Staphylococcus aureus subsp. aureus MW2
auuccuagcuuuuau

SEQ ID NO: 2096884 - RNA, 16 nt, Staphylococcus aureus subsp. aureus MW2
auucccuuuucaucaa

SEQ ID NO: 2096885 - RNA, 17 nt, Staphylococcus aureus subsp. aureus MW2
auucccuuuucaucaaa

SEQ ID NO: 2096886 - RNA, 17 nt, Staphylococcus aureus subsp. aureus MW2
auuccccauuuaucuaa

SEQ ID NO: 2096887 - RNA, 23 nt, Staphylococcus aureus subsp. aureus MW2
auuucaauuuggaaauaucuuac

SEQ ID NO: 2096888 - RNA, 18 nt, Staphylococcus aureus subsp. aureus MW2
auuucaauuuggaaauau

SEQ ID NO: 2096889 - RNA, 13 nt, Staphylococcus aureus subsp. aureus MW2
auuucaauuugga

SEQ ID NO: 2096890 - RNA, 22 nt, Staphylococcus aureus subsp. aureus MW2
auuuauguucgauuauucuuaa

SEQ ID NO: 2096891 - RNA, 21 nt, Staphylococcus aureus subsp. aureus MW2
auuuauguguugugauauaua

SEQ ID NO: 2096892 - RNA, 16 nt, Staphylococcus aureus subsp. aureus MW2
auuucacucuacaauc

SEQ ID NO: 2096893 - RNA, 11 nt, Staphylococcus aureus subsp. aureus MW2
auuucacuuua

SEQ ID NO: 2096894 - RNA, 13 nt, Staphylococcus aureus subsp. aureus MW2
auuucacuuuaac

SEQ ID NO: 2096895 - RNA, 14 nt, Staphylococcus aureus subsp. aureus MW2
auuucacuuuaacu

SEQ ID NO: 2096896 - RNA, 15 nt, Staphylococcus aureus subsp. aureus MW2
auuucacuuuaacuu

SEQ ID NO: 2096897 - RNA, 15 nt, Staphylococcus aureus subsp. aureus MW2
auuucauaauguuaa

SEQ ID NO: 2096898 - RNA, 19 nt, Staphylococcus aureus subsp. aureus MW2
auuucaguauauuuuaaca

SEQ ID NO: 2096899 - RNA, 19 nt, Staphylococcus aureus subsp. aureus MW2
auuucaguaccauguuuuu

SEQ ID NO: 2096900 - RNA, 13 nt, Staphylococcus aureus subsp. aureus MW2
auuucauuuaugc

SEQ ID NO: 2096901 - RNA, 21 nt, Staphylococcus aureus subsp. aureus MW2
auuucauuugaaauaguuaaa

SEQ ID NO: 2096902 - RNA, 11 nt, Staphylococcus aureus subsp. aureus MW2
auuucaucaaa

SEQ ID NO: 2096903 - RNA, 18 nt, Staphylococcus aureus subsp. aureus MW2
auuucccacgugccucau

SEQ ID NO: 2096904 - RNA, 14 nt, Staphylococcus aureus subsp. aureus MW2
auuucccuggaaaa

SEQ ID NO: 2096905 - RNA, 20 nt, Staphylococcus aureus subsp. aureus MW2
auuucgacaucuagaugaaa

SEQ ID NO: 2096906 - RNA, 14 nt, Staphylococcus aureus subsp. aureus MW2
auuucgaaaagaaa

SEQ ID NO: 2096907 - RNA, 17 nt, Staphylococcus aureus subsp. aureus MW2
auuucgaaaagaaauuc

SEQ ID NO: 2096908 - RNA, 18 nt, Staphylococcus aureus subsp. aureus MW2
auuucgccucaucuaauu

SEQ ID NO: 2096909 - RNA, 15 nt, Staphylococcus aureus subsp. aureus MW2
auuucgccucaucua

SEQ ID NO: 2096910 - RNA, 22 nt, Staphylococcus aureus subsp. aureus MW2
auuucgccuuuuuuauuuuucu

SEQ ID NO: 2096911 - RNA, 16 nt, Staphylococcus aureus subsp. aureus MW2
auuuccguuuuagaau

SEQ ID NO: 2096912 - RNA, 15 nt, Staphylococcus aureus subsp. aureus MW2
auuuccuauuaggau

SEQ ID NO: 2096913 - RNA, 17 nt, Staphylococcus aureus subsp. aureus MW2
auuuccuauuaggaucc

SEQ ID NO: 2096914 - RNA, 21 nt, Staphylococcus aureus subsp. aureus MW2
auuuccucaccuucauuuuca

SEQ ID NO: 2096915 - RNA, 23 nt, Staphylococcus aureus subsp. aureus MW2
auuuccugaugaggcuaauuuuu

SEQ ID NO: 2096916 - RNA, 13 nt, Staphylococcus aureus subsp. aureus MW2
auuuacacagaau

SEQ ID NO: 2096917 - RNA, 18 nt, Staphylococcus aureus subsp. aureus MW2
auuuacagcgauuguuaa

SEQ ID NO: 2096918 - RNA, 22 nt, Staphylococcus aureus subsp. aureus MW2
auuuaccucuugauaaaauaaa

SEQ ID NO: 2096919 - RNA, 20 nt, Staphylococcus aureus subsp. aureus MW2
auuuaccucuugauaaaaua

SEQ ID NO: 2096920 - RNA, 15 nt, Staphylococcus aureus subsp. aureus MW2
auuuaccuucuucua

SEQ ID NO: 2096921 - RNA, 17 nt, Staphylococcus aureus subsp. aureus MW2
auuuaccuucaucuuuu

SEQ ID NO: 2096922 - RNA, 21 nt, Staphylococcus aureus subsp. aureus MW2
auuuaccuucaucuuuuuuau

SEQ ID NO: 2096923 - RNA, 23 nt, Staphylococcus aureus subsp. aureus MW2
auuuacgaaguuuaaaugugcaa

SEQ ID NO: 2096924 - RNA, 20 nt, Staphylococcus aureus subsp. aureus MW2
auuuacggcauaauuuuuua

SEQ ID NO: 2096925 - RNA, 15 nt, Staphylococcus aureus subsp. aureus MW2
auuuagcaucaaaaa

SEQ ID NO: 2096926 - RNA, 21 nt, Staphylococcus aureus subsp. aureus MW2
auuuaggaguauccugauuua

SEQ ID NO: 2096927 - RNA, 18 nt, Staphylococcus aureus subsp. aureus MW2
auuuaggcaugucaaauc

SEQ ID NO: 2096928 - RNA, 18 nt, Staphylococcus aureus subsp. aureus MW2
auuuagauuggucaaacu

SEQ ID NO: 2096929 - RNA, 16 nt, Staphylococcus aureus subsp. aureus MW2
auuuagauuuauaacg

SEQ ID NO: 2096930 - RNA, 22 nt, Staphylococcus aureus subsp. aureus MW2
auuuacuugauuagauuugugu

SEQ ID NO: 2096931 - RNA, 15 nt, Staphylococcus aureus subsp. aureus MW2
auuuaucauuauuua

SEQ ID NO: 2096932 - RNA, 18 nt, Staphylococcus aureus subsp. aureus MW2
auuuaucaauuucuauuu

SEQ ID NO: 2096933 - RNA, 17 nt, Staphylococcus aureus subsp. aureus MW2
auuuauauuuuuuguac

SEQ ID NO: 2096934 - RNA, 15 nt, Staphylococcus aureus subsp. aureus MW2
auuuauauuuagaau

SEQ ID NO: 2096935 - RNA, 19 nt, Staphylococcus aureus subsp. aureus MW2
auuuagguaauacaucauc

SEQ ID NO: 2096936 - RNA, 17 nt, Staphylococcus aureus subsp. aureus MW2
auuuauauuaaauacua

SEQ ID NO: 2096937 - RNA, 21 nt, Staphylococcus aureus subsp. aureus MW2
auuuauaugauguucaauauu

SEQ ID NO: 2096938 - RNA, 21 nt, Staphylococcus aureus subsp. aureus MW2
auuuauauagucuaugaauaa

SEQ ID NO: 2096939 - RNA, 16 nt, Staphylococcus aureus subsp. aureus MW2
auuguuuuuaaaaucu

SEQ ID NO: 2096940 - RNA, 22 nt, Staphylococcus aureus subsp. aureus MW2
auuuaaaaaacaaauguuuuaa

SEQ ID NO: 2096941 - RNA, 19 nt, Staphylococcus aureus subsp. aureus MW2
auuuaaaauaauagauaau

SEQ ID NO: 2096942 - RNA, 23 nt, Staphylococcus aureus subsp. aureus MW2
auuuaaaaaucuacauaugaaaa

SEQ ID NO: 2096943 - RNA, 18 nt, Staphylococcus aureus subsp. aureus MW2
auuuaaaaauugaaggaa

SEQ ID NO: 2096944 - RNA, 22 nt, Staphylococcus aureus subsp. aureus MW2
auuuaaaaauaguucuuuaaau

SEQ ID NO: 2096945 - RNA, 16 nt, Staphylococcus aureus subsp. aureus MW2
auuuaaaaauagccuu

SEQ ID NO: 2096946 - RNA, 15 nt, Staphylococcus aureus subsp. aureus MW2
auuuaaaaauaguaa

SEQ ID NO: 2096947 - RNA, 14 nt, Staphylococcus aureus subsp. aureus MW2
auugguauaacaau

SEQ ID NO: 2096948 - RNA, 16 nt, Staphylococcus aureus subsp. aureus MW2
auuggcgggccccaac

SEQ ID NO: 2096949 - RNA, 19 nt, Staphylococcus aureus subsp. aureus MW2
auuuaacugggcaacuuuu

SEQ ID NO: 2096950 - RNA, 21 nt, Staphylococcus aureus subsp. aureus MW2
auuuaacuuucccuacugcuu

SEQ ID NO: 2096951 - RNA, 21 nt, Staphylococcus aureus subsp. aureus MW2
auuuaacuuuuugugauuauu

SEQ ID NO: 2096952 - RNA, 19 nt, Staphylococcus aureus subsp. aureus MW2
auuuaaaauauuauuuuua

SEQ ID NO: 2096953 - RNA, 14 nt, Staphylococcus aureus subsp. aureus MW2
auuuaaaauauuaa

SEQ ID NO: 2096954 - RNA, 15 nt, Staphylococcus aureus subsp. aureus MW2
auuuaaaauauuaau

SEQ ID NO: 2096955 - RNA, 12 nt, Staphylococcus aureus subsp. aureus MW2
auuuaaaauaua

SEQ ID NO: 2096956 - RNA, 16 nt, Staphylococcus aureus subsp. aureus MW2
auuuaaaauauaaauu

SEQ ID NO: 2096957 - RNA, 19 nt, Staphylococcus aureus subsp. aureus MW2
auuuaaaauuauugacauu

SEQ ID NO: 2096958 - RNA, 20 nt, Staphylococcus aureus subsp. aureus MW2
auuuaaacauccaauuaugu

SEQ ID NO: 2096959 - RNA, 19 nt, Staphylococcus aureus subsp. aureus MW2
auuuaaacaagaaaacuaa

SEQ ID NO: 2096960 - RNA, 18 nt, Staphylococcus aureus subsp. aureus MW2
auuuacaaaaacuauuuu

SEQ ID NO: 2096961 - RNA, 21 nt, Staphylococcus aureus subsp. aureus MW2
auuuacaaaaacuauuuuuua

SEQ ID NO: 2096962 - RNA, 16 nt, Staphylococcus aureus subsp. aureus MW2
auuuaauguuaaacaa

SEQ ID NO: 2096963 - RNA, 21 nt, Staphylococcus aureus subsp. aureus MW2
auuuaauguuuuagugacaaa

SEQ ID NO: 2096964 - RNA, 14 nt, Staphylococcus aureus subsp. aureus MW2
auuuaauaaaccag

SEQ ID NO: 2096965 - RNA, 20 nt, Staphylococcus aureus subsp. aureus MW2
auuucuaucaaauaaugaau

SEQ ID NO: 2096966 - RNA, 16 nt, Staphylococcus aureus subsp. aureus MW2
auuucuaucaaauaau

SEQ ID NO: 2096967 - RNA, 23 nt, Staphylococcus aureus subsp. aureus MW2
auuucuauaucuauuuaucauac

SEQ ID NO: 2096968 - RNA, 21 nt, Staphylococcus aureus subsp. aureus MW2
auuucugaaaugauacauuau

SEQ ID NO: 2096969 - RNA, 14 nt, Staphylococcus aureus subsp. aureus MW2
auuucugaaaacuu

SEQ ID NO: 2096970 - RNA, 22 nt, Staphylococcus aureus subsp. aureus MW2
auuucugaaaugauacauuauu

SEQ ID NO: 2096971 - RNA, 14 nt, Staphylococcus aureus subsp. aureus MW2
auuucuacucgaaa

SEQ ID NO: 2096972 - RNA, 13 nt, Staphylococcus aureus subsp. aureus MW2
auuucuaauuuag

SEQ ID NO: 2096973 - RNA, 19 nt, Staphylococcus aureus subsp. aureus MW2
auuucuacagacaaugcaa

SEQ ID NO: 2096974 - RNA, 20 nt, Staphylococcus aureus subsp. aureus MW2
auuucuacagacaaugcaag

SEQ ID NO: 2096975 - RNA, 22 nt, Staphylococcus aureus subsp. aureus MW2
auuucuacagacaaugcaaguu

SEQ ID NO: 2096976 - RNA, 19 nt, Staphylococcus aureus subsp. aureus MW2
auuucgucgucccacccca

SEQ ID NO: 2096977 - RNA, 14 nt, Staphylococcus aureus subsp. aureus MW2
auuucuuaccauuu

SEQ ID NO: 2096978 - RNA, 14 nt, Staphylococcus aureus subsp. aureus MW2
auuucuguaccaaa

SEQ ID NO: 2096979 - RNA, 22 nt, Staphylococcus aureus subsp. aureus MW2
auuucuguaccaaauuugugau

SEQ ID NO: 2096980 - RNA, 18 nt, Staphylococcus aureus subsp. aureus MW2
auuucuguaccaaauuug

SEQ ID NO: 2096981 - RNA, 19 nt, Staphylococcus aureus subsp. aureus MW2
auuucuuuuuaaaaucguu

SEQ ID NO: 2096982 - RNA, 15 nt, Staphylococcus aureus subsp. aureus MW2
auuucuuuugaaucu

SEQ ID NO: 2096983 - RNA, 21 nt, Staphylococcus aureus subsp. aureus MW2
auuucuuuucauuaucauuaa

SEQ ID NO: 2096984 - RNA, 21 nt, Staphylococcus aureus subsp. aureus MW2
auuuuaaugaccuaacuguuu

SEQ ID NO: 2096985 - RNA, 19 nt, Staphylococcus aureus subsp. aureus MW2
auuuuaaaaauucauaauc

SEQ ID NO: 2096986 - RNA, 16 nt, Staphylococcus aureus subsp. aureus MW2
auuuuaaaagauaaau

SEQ ID NO: 2096987 - RNA, 16 nt, Staphylococcus aureus subsp. aureus MW2
auuuguuuuaaauacu

SEQ ID NO: 2096988 - RNA, 15 nt, Staphylococcus aureus subsp. aureus MW2
auuuguuguuauaua

SEQ ID NO: 2096989 - RNA, 15 nt, Staphylococcus aureus subsp. aureus MW2
auuuguaguaaguag

SEQ ID NO: 2096990 - RNA, 18 nt, Staphylococcus aureus subsp. aureus MW2
auuuguaaauauuuuuua

SEQ ID NO: 2096991 - RNA, 23 nt, Staphylococcus aureus subsp. aureus MW2
auuuguaaauauuuuuuaaaaug

SEQ ID NO: 2096992 - RNA, 19 nt, Staphylococcus aureus subsp. aureus MW2
auuuguaaagacaccauca

SEQ ID NO: 2096993 - RNA, 16 nt, Staphylococcus aureus subsp. aureus MW2
auuugguuaauacguu

SEQ ID NO: 2096994 - RNA, 13 nt, Staphylococcus aureus subsp. aureus MW2
auuuggaauacuu

SEQ ID NO: 2096995 - RNA, 18 nt, Staphylococcus aureus subsp. aureus MW2
auuuggaauacuuuucuu

SEQ ID NO: 2096996 - RNA, 21 nt, Staphylococcus aureus subsp. aureus MW2
auuuggauaauuuuuaacagc

SEQ ID NO: 2096997 - RNA, 14 nt, Staphylococcus aureus subsp. aureus MW2
auuuguaauuuaaa

SEQ ID NO: 2096998 - RNA, 19 nt, Staphylococcus aureus subsp. aureus MW2
auuuguagcuugaauaaua

SEQ ID NO: 2096999 - RNA, 16 nt, Staphylococcus aureus subsp. aureus MW2
auuugcaugaaaauua

SEQ ID NO: 2097000 - RNA, 16 nt, Staphylococcus aureus subsp. aureus MW2
auuugcugaaugaagc

SEQ ID NO: 2097001 - RNA, 23 nt, Staphylococcus aureus subsp. aureus MW2
auuugcugaaugaagcauuuuau

SEQ ID NO: 2097002 - RNA, 20 nt, Staphylococcus aureus subsp. aureus MW2
auuugaaugcaaaucaaaua

SEQ ID NO: 2097003 - RNA, 14 nt, Staphylococcus aureus subsp. aureus MW2
auuugaauuuaauu

SEQ ID NO: 2097004 - RNA, 19 nt, Staphylococcus aureus subsp. aureus MW2
auuugaauugacuuacauu

SEQ ID NO: 2097005 - RNA, 19 nt, Staphylococcus aureus subsp. aureus MW2
auuugcacaaagauauguu

SEQ ID NO: 2097006 - RNA, 17 nt, Staphylococcus aureus subsp. aureus MW2
auuugauuuucaauuuc

SEQ ID NO: 2097007 - RNA, 15 nt, Staphylococcus aureus subsp. aureus MW2
auuugcaaaaucaac

SEQ ID NO: 2097008 - RNA, 17 nt, Staphylococcus aureus subsp. aureus MW2
auuuuuaauuucuggua

SEQ ID NO: 2097009 - RNA, 21 nt, Staphylococcus aureus subsp. aureus MW2
auuuuuacaaagugauuuaaa

SEQ ID NO: 2097010 - RNA, 22 nt, Staphylococcus aureus subsp. aureus MW2
auuuuuacaaagugauuuaaaa

SEQ ID NO: 2097011 - RNA, 15 nt, Staphylococcus aureus subsp. aureus MW2
auuuuuaauguuaca

SEQ ID NO: 2097012 - RNA, 17 nt, Staphylococcus aureus subsp. aureus MW2
auuuuuagacauuaaaa

SEQ ID NO: 2097013 - RNA, 18 nt, Staphylococcus aureus subsp. aureus MW2
auuuuuaguuagaaagua

SEQ ID NO: 2097014 - RNA, 23 nt, Staphylococcus aureus subsp. aureus MW2
auuuuuaacagcgugaauauaag

SEQ ID NO: 2097015 - RNA, 14 nt, Staphylococcus aureus subsp. aureus MW2
auuuuuaacaucau

SEQ ID NO: 2097016 - RNA, 15 nt, Staphylococcus aureus subsp. aureus MW2
auuuuuaacaucauu

SEQ ID NO: 2097017 - RNA, 20 nt, Staphylococcus aureus subsp. aureus MW2
auuuuguaagcucaugaauc

SEQ ID NO: 2097018 - RNA, 13 nt, Staphylococcus aureus subsp. aureus MW2
auuuuggauuuuu

SEQ ID NO: 2097019 - RNA, 16 nt, Staphylococcus aureus subsp. aureus MW2
auuuuggcaaaagcuu

SEQ ID NO: 2097020 - RNA, 19 nt, Staphylococcus aureus subsp. aureus MW2
auuuugcuugcuuacaaua

SEQ ID NO: 2097021 - RNA, 17 nt, Staphylococcus aureus subsp. aureus MW2
auuuugcuuuaaacauu

SEQ ID NO: 2097022 - RNA, 17 nt, Staphylococcus aureus subsp. aureus MW2
auuuucuugccaucaau

SEQ ID NO: 2097023 - RNA, 21 nt, Staphylococcus aureus subsp. aureus MW2
auuuucuuuuucuaaauaaac

SEQ ID NO: 2097024 - RNA, 20 nt, Staphylococcus aureus subsp. aureus MW2
auuuugaauaugauauuaag

SEQ ID NO: 2097025 - RNA, 20 nt, Staphylococcus aureus subsp. aureus MW2
auuuugaaucacauuaacaa

SEQ ID NO: 2097026 - RNA, 20 nt, Staphylococcus aureus subsp. aureus MW2
auuuucucaaacuaucuuau

SEQ ID NO: 2097027 - RNA, 21 nt, Staphylococcus aureus subsp. aureus MW2
auuuucuacgaauacuaaaau

SEQ ID NO: 2097028 - RNA, 20 nt, Staphylococcus aureus subsp. aureus MW2
auuuugacguuuuagacaua

SEQ ID NO: 2097029 - RNA, 15 nt, Staphylococcus aureus subsp. aureus MW2
auuuugacuauucuc

SEQ ID NO: 2097030 - RNA, 23 nt, Staphylococcus aureus subsp. aureus MW2
auuuugacuauucucagucucuu

SEQ ID NO: 2097031 - RNA, 22 nt, Staphylococcus aureus subsp. aureus MW2
auuuugcgaaaauaucauuucu

SEQ ID NO: 2097032 - RNA, 19 nt, Staphylococcus aureus subsp. aureus MW2
auuuugcccaugucaugaa

SEQ ID NO: 2097033 - RNA, 15 nt, Staphylococcus aureus subsp. aureus MW2
auuuuaucugaaaau

SEQ ID NO: 2097034 - RNA, 20 nt, Staphylococcus aureus subsp. aureus MW2
auuuuauuuugugcuuuuuu

SEQ ID NO: 2097035 - RNA, 16 nt, Staphylococcus aureus subsp. aureus MW2
auuuuauuuuuaaaua

SEQ ID NO: 2097036 - RNA, 19 nt, Staphylococcus aureus subsp. aureus MW2
auuuucaaagcugccaaaa

SEQ ID NO: 2097037 - RNA, 23 nt, Staphylococcus aureus subsp. aureus MW2
auuuucaagaccaaauauuuuau

SEQ ID NO: 2097038 - RNA, 18 nt, Staphylococcus aureus subsp. aureus MW2
auuuucaaguuuaaaaua

SEQ ID NO: 2097039 - RNA, 20 nt, Staphylococcus aureus subsp. aureus MW2
auuuucaaguaaugauauua

SEQ ID NO: 2097040 - RNA, 19 nt, Staphylococcus aureus subsp. aureus MW2
auuuucauuguauguugaa

SEQ ID NO: 2097041 - RNA, 11 nt, Staphylococcus aureus subsp. aureus MW2
auuuucauuuu

SEQ ID NO: 2097042 - RNA, 20 nt, Staphylococcus aureus subsp. aureus MW2
auuuucgggaauuuuacguu

SEQ ID NO: 2097043 - RNA, 18 nt, Staphylococcus aureus subsp. aureus MW2
auuuucuaaagauauaag

SEQ ID NO: 2097044 - RNA, 23 nt, Staphylococcus aureus subsp. aureus MW2
auuuuauccaaaccaauuuuaac

SEQ ID NO: 2097045 - RNA, 12 nt, Staphylococcus aureus subsp. aureus MW2
auuuuauauuuu

SEQ ID NO: 2097046 - RNA, 12 nt, Staphylococcus aureus subsp. aureus MW2
auuuuauauauc

SEQ ID NO: 2097047 - RNA, 23 nt, Staphylococcus aureus subsp. aureus MW2
auuuuaucuaaagcuauaaaaaa

SEQ ID NO: 2097048 - RNA, 16 nt, Staphylococcus aureus subsp. aureus MW2
auuuuaucuaaacauu

SEQ ID NO: 2097049 - RNA, 12 nt, Staphylococcus aureus subsp. aureus MW2
auuuuauaaaaa

SEQ ID NO: 2097050 - RNA, 16 nt, Staphylococcus aureus subsp. aureus MW2
auuuuauaaaaaguua

SEQ ID NO: 2097051 - RNA, 18 nt, Staphylococcus aureus subsp. aureus MW2
auuuuauacauaaauauu

SEQ ID NO: 2097052 - RNA, 21 nt, Staphylococcus aureus subsp. aureus MW2
auuuuauaauaaccuacauua

SEQ ID NO: 2097053 - RNA, 22 nt, Staphylococcus aureus subsp. aureus MW2
auuuuaguucacaugaauuuua

SEQ ID NO: 2097054 - RNA, 15 nt, Staphylococcus aureus subsp. aureus MW2
auuuuaguacuuaau

SEQ ID NO: 2097055 - RNA, 18 nt, Staphylococcus aureus subsp. aureus MW2
auuuuaguacuuaauacu

SEQ ID NO: 2097056 - RNA, 21 nt, Staphylococcus aureus subsp. aureus MW2
auuuuagucgucgaaaugccu

SEQ ID NO: 2097057 - RNA, 18 nt, Staphylococcus aureus subsp. aureus MW2
auuuuaggccacacauca

SEQ ID NO: 2097058 - RNA, 20 nt, Staphylococcus aureus subsp. aureus MW2
auuuuagcucuuguucaagu

SEQ ID NO: 2097059 - RNA, 14 nt, Staphylococcus aureus subsp. aureus MW2
auuuuaccaucaau

SEQ ID NO: 2097060 - RNA, 19 nt, Staphylococcus aureus subsp. aureus MW2
auuuuaccaucaaugagca

SEQ ID NO: 2097061 - RNA, 17 nt, Staphylococcus aureus subsp. aureus MW2
auuuuaccauguuuuac

SEQ ID NO: 2097062 - RNA, 17 nt, Staphylococcus aureus subsp. aureus MW2
auuuuacaaucaacuua

SEQ ID NO: 2097063 - RNA, 18 nt, Staphylococcus aureus subsp. aureus MW2
auuuuacaaaauauggaa

SEQ ID NO: 2097064 - RNA, 21 nt, Staphylococcus aureus subsp. aureus MW2
auuuuaccuucgcauacuuuu

SEQ ID NO: 2097065 - RNA, 21 nt, Staphylococcus aureus subsp. aureus MW2
auuuuaccuguuucuauauua

SEQ ID NO: 2097066 - RNA, 20 nt, Staphylococcus aureus subsp. aureus MW2
caacguuauucguuaacaau

SEQ ID NO: 2097067 - RNA, 20 nt, Staphylococcus aureus subsp. aureus MW2
caaccuuaauaggauaugcu

SEQ ID NO: 2097068 - RNA, 17 nt, Staphylococcus aureus subsp. aureus MW2
caacauauuauauauau

SEQ ID NO: 2097069 - RNA, 14 nt, Staphylococcus aureus subsp. aureus MW2
caacauauuauaua

SEQ ID NO: 2097070 - RNA, 15 nt, Staphylococcus aureus subsp. aureus MW2
caacauauuuucaca

SEQ ID NO: 2097071 - RNA, 22 nt, Staphylococcus aureus subsp. aureus MW2
caacaucgauuuaucauuauuu

SEQ ID NO: 2097072 - RNA, 17 nt, Staphylococcus aureus subsp. aureus MW2
caacgagucauaaauau

SEQ ID NO: 2097073 - RNA, 14 nt, Staphylococcus aureus subsp. aureus MW2
caacgauaccaaau

SEQ ID NO: 2097074 - RNA, 23 nt, Staphylococcus aureus subsp. aureus MW2
caagagauaagaaaauaccuaau

SEQ ID NO: 2097075 - RNA, 23 nt, Staphylococcus aureus subsp. aureus MW2
caagaauuauggcagauccauaa

SEQ ID NO: 2097076 - RNA, 14 nt, Staphylococcus aureus subsp. aureus MW2
caagauaaaucauc

SEQ ID NO: 2097077 - RNA, 16 nt, Staphylococcus aureus subsp. aureus MW2
caagagguaaaucugu

SEQ ID NO: 2097078 - RNA, 20 nt, Staphylococcus aureus subsp. aureus MW2
caagaugcucaaugcauuuc

SEQ ID NO: 2097079 - RNA, 23 nt, Staphylococcus aureus subsp. aureus MW2
caacuugugguuggaagucugcu

SEQ ID NO: 2097080 - RNA, 22 nt, Staphylococcus aureus subsp. aureus MW2
caacuugugguuggaagucugc

SEQ ID NO: 2097081 - RNA, 15 nt, Staphylococcus aureus subsp. aureus MW2
caacuuuaaauguuu

SEQ ID NO: 2097082 - RNA, 14 nt, Staphylococcus aureus subsp. aureus MW2
caacuuuaguuguu

SEQ ID NO: 2097083 - RNA, 23 nt, Staphylococcus aureus subsp. aureus MW2
caacuuuuuuaacagcugcaguc

SEQ ID NO: 2097084 - RNA, 16 nt, Staphylococcus aureus subsp. aureus MW2
caacuuuuuuaacagc

SEQ ID NO: 2097085 - RNA, 21 nt, Staphylococcus aureus subsp. aureus MW2
caacuuuuuuagguguaaaau

SEQ ID NO: 2097086 - RNA, 16 nt, Staphylococcus aureus subsp. aureus MW2
caacuuuuuaauaaua

SEQ ID NO: 2097087 - RNA, 19 nt, Staphylococcus aureus subsp. aureus MW2
caacuugaucauuauaaaa

SEQ ID NO: 2097088 - RNA, 14 nt, Staphylococcus aureus subsp. aureus MW2
caacuugcacauua

SEQ ID NO: 2097089 - RNA, 17 nt, Staphylococcus aureus subsp. aureus MW2
caacuugugguuggaag

SEQ ID NO: 2097090 - RNA, 23 nt, Staphylococcus aureus subsp. aureus MW2
caacuugucuaccgaaugaguuu

SEQ ID NO: 2097091 - RNA, 14 nt, Staphylococcus aureus subsp. aureus MW2
caacucuaacagcu

SEQ ID NO: 2097092 - RNA, 17 nt, Staphylococcus aureus subsp. aureus MW2
caagaaauguuaaauua

SEQ ID NO: 2097093 - RNA, 17 nt, Staphylococcus aureus subsp. aureus MW2
caagaaguaauguuaaa

SEQ ID NO: 2097094 - RNA, 21 nt, Staphylococcus aureus subsp. aureus MW2
caagaauauaacguucgccaa

SEQ ID NO: 2097095 - RNA, 16 nt, Staphylococcus aureus subsp. aureus MW2
caaucacuauauuuca

SEQ ID NO: 2097096 - RNA, 17 nt, Staphylococcus aureus subsp. aureus MW2
caaucacagcaauaaua

SEQ ID NO: 2097097 - RNA, 14 nt, Staphylococcus aureus subsp. aureus MW2
caaucacagcaaua

SEQ ID NO: 2097098 - RNA, 13 nt, Staphylococcus aureus subsp. aureus MW2
caauauuaaaauc

SEQ ID NO: 2097099 - RNA, 19 nt, Staphylococcus aureus subsp. aureus MW2
caaucaacuuagaauuuac

SEQ ID NO: 2097100 - RNA, 16 nt, Staphylococcus aureus subsp. aureus MW2
caauagaaauaacgau

SEQ ID NO: 2097101 - RNA, 14 nt, Staphylococcus aureus subsp. aureus MW2
caauagaugaaaau

SEQ ID NO: 2097102 - RNA, 12 nt, Staphylococcus aureus subsp. aureus MW2
caauauacuuuu

SEQ ID NO: 2097103 - RNA, 20 nt, Staphylococcus aureus subsp. aureus MW2
caauaccgaauaauuuugau

SEQ ID NO: 2097104 - RNA, 17 nt, Staphylococcus aureus subsp. aureus MW2
caauacauuaauauaaa

SEQ ID NO: 2097105 - RNA, 18 nt, Staphylococcus aureus subsp. aureus MW2
caauacauuaauauaaau

SEQ ID NO: 2097106 - RNA, 23 nt, Staphylococcus aureus subsp. aureus MW2
caauaccagugggcuccaaacau

SEQ ID NO: 2097107 - RNA, 17 nt, Staphylococcus aureus subsp. aureus MW2
caauacauaaugguuca

SEQ ID NO: 2097108 - RNA, 11 nt, Staphylococcus aureus subsp. aureus MW2
caauaauguua

SEQ ID NO: 2097109 - RNA, 19 nt, Staphylococcus aureus subsp. aureus MW2
caauaaugugcaaguuggg

SEQ ID NO: 2097110 - RNA, 19 nt, Staphylococcus aureus subsp. aureus MW2
caauaauccgagucauacu

SEQ ID NO: 2097111 - RNA, 13 nt, Staphylococcus aureus subsp. aureus MW2
caauaaugugcaa

SEQ ID NO: 2097112 - RNA, 15 nt, Staphylococcus aureus subsp. aureus MW2
caauaaugugcaagu

SEQ ID NO: 2097113 - RNA, 20 nt, Staphylococcus aureus subsp. aureus MW2
caauaaugugcaaguuggcg

SEQ ID NO: 2097114 - RNA, 16 nt, Staphylococcus aureus subsp. aureus MW2
caaguuggcggggccc

SEQ ID NO: 2097115 - RNA, 23 nt, Staphylococcus aureus subsp. aureus MW2
caaguuggcggggccccaacaca

SEQ ID NO: 2097116 - RNA, 23 nt, Staphylococcus aureus subsp. aureus MW2
caaguuggggugugggccccaac

SEQ ID NO: 2097117 - RNA, 20 nt, Staphylococcus aureus subsp. aureus MW2
caaguucaccguaaucuuuu

SEQ ID NO: 2097118 - RNA, 14 nt, Staphylococcus aureus subsp. aureus MW2
caagugaugaaaaa

SEQ ID NO: 2097119 - RNA, 23 nt, Staphylococcus aureus subsp. aureus MW2
caagucuaguucgaacacacacu

SEQ ID NO: 2097120 - RNA, 22 nt, Staphylococcus aureus subsp. aureus MW2
caagucguucucuuaaauauga

SEQ ID NO: 2097121 - RNA, 15 nt, Staphylococcus aureus subsp. aureus MW2
caagucuaacaguua

SEQ ID NO: 2097122 - RNA, 18 nt, Staphylococcus aureus subsp. aureus MW2
caaguguaucgcccauac

SEQ ID NO: 2097123 - RNA, 17 nt, Staphylococcus aureus subsp. aureus MW2
caagugguaaaaaugaa

SEQ ID NO: 2097124 - RNA, 15 nt, Staphylococcus aureus subsp. aureus MW2
caagugguaaaaaug

SEQ ID NO: 2097125 - RNA, 15 nt, Staphylococcus aureus subsp. aureus MW2
caagguuuucgccaa

SEQ ID NO: 2097126 - RNA, 18 nt, Staphylococcus aureus subsp. aureus MW2
caagaugguauugcuuua

SEQ ID NO: 2097127 - RNA, 16 nt, Staphylococcus aureus subsp. aureus MW2
caagcuagaaacacau

SEQ ID NO: 2097128 - RNA, 22 nt, Staphylococcus aureus subsp. aureus MW2
caagcuuaauaagcugaaauaa

SEQ ID NO: 2097129 - RNA, 19 nt, Staphylococcus aureus subsp. aureus MW2
caagcucuuuuuuguuaua

SEQ ID NO: 2097130 - RNA, 16 nt, Staphylococcus aureus subsp. aureus MW2
caagcuuuuuaggaau

SEQ ID NO: 2097131 - RNA, 17 nt, Staphylococcus aureus subsp. aureus MW2
caagcuuuuuaggaaug

SEQ ID NO: 2097132 - RNA, 16 nt, Staphylococcus aureus subsp. aureus MW2
caaggauguuauaaaa

SEQ ID NO: 2097133 - RNA, 18 nt, Staphylococcus aureus subsp. aureus MW2
caagcuuuucauuuuuau

SEQ ID NO: 2097134 - RNA, 22 nt, Staphylococcus aureus subsp. aureus MW2
caaggauguuauaaaaugaaua

SEQ ID NO: 2097135 - RNA, 22 nt, Staphylococcus aureus subsp. aureus MW2
caaggcauauccgaaaauugcu

SEQ ID NO: 2097136 - RNA, 14 nt, Staphylococcus aureus subsp. aureus MW2
caacaguuuuaaag

SEQ ID NO: 2097137 - RNA, 15 nt, Staphylococcus aureus subsp. aureus MW2
caacaguauuaauua

SEQ ID NO: 2097138 - RNA, 21 nt, Staphylococcus aureus subsp. aureus MW2
caacaguuuuauuaucuuugu

SEQ ID NO: 2097139 - RNA, 13 nt, Staphylococcus aureus subsp. aureus MW2
caacauacaugcc

SEQ ID NO: 2097140 - RNA, 11 nt, Staphylococcus aureus subsp. aureus MW2
caacauagaag

SEQ ID NO: 2097141 - RNA, 15 nt, Staphylococcus aureus subsp. aureus MW2
caacauagaagcugg

SEQ ID NO: 2097142 - RNA, 12 nt, Staphylococcus aureus subsp. aureus MW2
caacaaauuuaa

SEQ ID NO: 2097143 - RNA, 14 nt, Staphylococcus aureus subsp. aureus MW2
caacaacauaucau

SEQ ID NO: 2097144 - RNA, 15 nt, Staphylococcus aureus subsp. aureus MW2
caacaccuaauauuu

SEQ ID NO: 2097145 - RNA, 16 nt, Staphylococcus aureus subsp. aureus MW2
caacacccauauaauu

SEQ ID NO: 2097146 - RNA, 15 nt, Staphylococcus aureus subsp. aureus MW2
caacacccauauaau

SEQ ID NO: 2097147 - RNA, 18 nt, Staphylococcus aureus subsp. aureus MW2
caaaugguacaguuaauu

SEQ ID NO: 2097148 - RNA, 16 nt, Staphylococcus aureus subsp. aureus MW2
caaauggagcaacgau

SEQ ID NO: 2097149 - RNA, 13 nt, Staphylococcus aureus subsp. aureus MW2
caaauuaaaaaac

SEQ ID NO: 2097150 - RNA, 14 nt, Staphylococcus aureus subsp. aureus MW2
caaauguuuacugu

SEQ ID NO: 2097151 - RNA, 17 nt, Staphylococcus aureus subsp. aureus MW2
caaaugugcgaccuuuc

SEQ ID NO: 2097152 - RNA, 20 nt, Staphylococcus aureus subsp. aureus MW2
caaauguugaauguggaaca

SEQ ID NO: 2097153 - RNA, 22 nt, Staphylococcus aureus subsp. aureus MW2
caaaugaaaaaguaaaaucuuu

SEQ ID NO: 2097154 - RNA, 15 nt, Staphylococcus aureus subsp. aureus MW2
caaaugaaauucuuu

SEQ ID NO: 2097155 - RNA, 20 nt, Staphylococcus aureus subsp. aureus MW2
caaauuugugauuaugcaua

SEQ ID NO: 2097156 - RNA, 14 nt, Staphylococcus aureus subsp. aureus MW2
caaauuuugaguau

SEQ ID NO: 2097157 - RNA, 16 nt, Staphylococcus aureus subsp. aureus MW2
caaauuuuaaaauaaa

SEQ ID NO: 2097158 - RNA, 14 nt, Staphylococcus aureus subsp. aureus MW2
caaauucauuugua

SEQ ID NO: 2097159 - RNA, 17 nt, Staphylococcus aureus subsp. aureus MW2
caaauucauauuaacug

SEQ ID NO: 2097160 - RNA, 13 nt, Staphylococcus aureus subsp. aureus MW2
caacaaauauaau

SEQ ID NO: 2097161 - RNA, 14 nt, Staphylococcus aureus subsp. aureus MW2
caacaaagaagcug

SEQ ID NO: 2097162 - RNA, 13 nt, Staphylococcus aureus subsp. aureus MW2
caacaaaagaugu

SEQ ID NO: 2097163 - RNA, 17 nt, Staphylococcus aureus subsp. aureus MW2
caaagggcgaaauggau

SEQ ID NO: 2097164 - RNA, 16 nt, Staphylococcus aureus subsp. aureus MW2
caaaggauauugaaaa

SEQ ID NO: 2097165 - RNA, 12 nt, Staphylococcus aureus subsp. aureus MW2
caaauaaauguc

SEQ ID NO: 2097166 - RNA, 15 nt, Staphylococcus aureus subsp. aureus MW2
caaauaacguuaaua

SEQ ID NO: 2097167 - RNA, 23 nt, Staphylococcus aureus subsp. aureus MW2
caaauaaggaauguauuuuucau

SEQ ID NO: 2097168 - RNA, 14 nt, Staphylococcus aureus subsp. aureus MW2
caaauaaaucaaac

SEQ ID NO: 2097169 - RNA, 19 nt, Staphylococcus aureus subsp. aureus MW2
caaauaaauaagugauaaa

SEQ ID NO: 2097170 - RNA, 14 nt, Staphylococcus aureus subsp. aureus MW2
caaauaaauauaaa

SEQ ID NO: 2097171 - RNA, 18 nt, Staphylococcus aureus subsp. aureus MW2
caaauaucauuuguacaa

SEQ ID NO: 2097172 - RNA, 15 nt, Staphylococcus aureus subsp. aureus MW2
caaauagacaccaaa

SEQ ID NO: 2097173 - RNA, 19 nt, Staphylococcus aureus subsp. aureus MW2
caaauacgaguguuuuaau

SEQ ID NO: 2097174 - RNA, 15 nt, Staphylococcus aureus subsp. aureus MW2
caaauacuaguaaua

SEQ ID NO: 2097175 - RNA, 14 nt, Staphylococcus aureus subsp. aureus MW2
caaauauuucuaaa

SEQ ID NO: 2097176 - RNA, 15 nt, Staphylococcus aureus subsp. aureus MW2
caaauauuaauuuau

SEQ ID NO: 2097177 - RNA, 18 nt, Staphylococcus aureus subsp. aureus MW2
caaauauuauuaaaucaa

SEQ ID NO: 2097178 - RNA, 14 nt, Staphylococcus aureus subsp. aureus MW2
caaaucaaauacau

SEQ ID NO: 2097179 - RNA, 17 nt, Staphylococcus aureus subsp. aureus MW2
caaagacuaaaaagaag

SEQ ID NO: 2097180 - RNA, 21 nt, Staphylococcus aureus subsp. aureus MW2
caaagacucaauuucauuuga

SEQ ID NO: 2097181 - RNA, 16 nt, Staphylococcus aureus subsp. aureus MW2
caaagacucaauuuca

SEQ ID NO: 2097182 - RNA, 17 nt, Staphylococcus aureus subsp. aureus MW2
caaagaggaacagugga

SEQ ID NO: 2097183 - RNA, 19 nt, Staphylococcus aureus subsp. aureus MW2
caaagauuccuguaacaag

SEQ ID NO: 2097184 - RNA, 18 nt, Staphylococcus aureus subsp. aureus MW2
caaagaggcuuuaaaauu

SEQ ID NO: 2097185 - RNA, 19 nt, Staphylococcus aureus subsp. aureus MW2
caaagcuaaguuugaagga

SEQ ID NO: 2097186 - RNA, 18 nt, Staphylococcus aureus subsp. aureus MW2
caaagcuugauuuaacaa

SEQ ID NO: 2097187 - RNA, 14 nt, Staphylococcus aureus subsp. aureus MW2
caaacauagagaaa

SEQ ID NO: 2097188 - RNA, 18 nt, Staphylococcus aureus subsp. aureus MW2
caaacacaguacaaauaa

SEQ ID NO: 2097189 - RNA, 15 nt, Staphylococcus aureus subsp. aureus MW2
caaacaauacauaau

SEQ ID NO: 2097190 - RNA, 11 nt, Staphylococcus aureus subsp. aureus MW2
caaacacacug

SEQ ID NO: 2097191 - RNA, 16 nt, Staphylococcus aureus subsp. aureus MW2
caaaccauuaauaaaa

SEQ ID NO: 2097192 - RNA, 21 nt, Staphylococcus aureus subsp. aureus MW2
caaacauuaaucuauauaaaa

SEQ ID NO: 2097193 - RNA, 12 nt, Staphylococcus aureus subsp. aureus MW2
caaacauuuguu

SEQ ID NO: 2097194 - RNA, 15 nt, Staphylococcus aureus subsp. aureus MW2
caaacguuauguaca

SEQ ID NO: 2097195 - RNA, 13 nt, Staphylococcus aureus subsp. aureus MW2
caaacguuguuca

SEQ ID NO: 2097196 - RNA, 18 nt, Staphylococcus aureus subsp. aureus MW2
caaacugccuaauacacu

SEQ ID NO: 2097197 - RNA, 16 nt, Staphylococcus aureus subsp. aureus MW2
caaacugauuuuuuau

SEQ ID NO: 2097198 - RNA, 22 nt, Staphylococcus aureus subsp. aureus MW2
caaacggcacuaauauuuaaaa

SEQ ID NO: 2097199 - RNA, 17 nt, Staphylococcus aureus subsp. aureus MW2
caaaccggucuauaaca

SEQ ID NO: 2097200 - RNA, 21 nt, Staphylococcus aureus subsp. aureus MW2
caaaccggucuauaacaccau

SEQ ID NO: 2097201 - RNA, 20 nt, Staphylococcus aureus subsp. aureus MW2
auuuuuaucccacuccuuau

SEQ ID NO: 2097202 - RNA, 13 nt, Staphylococcus aureus subsp. aureus MW2
auuuuuauagaua

SEQ ID NO: 2097203 - RNA, 13 nt, Staphylococcus aureus subsp. aureus MW2
auuuuuauuuaua

SEQ ID NO: 2097204 - RNA, 16 nt, Staphylococcus aureus subsp. aureus MW2
auuuuucaauuaaaug

SEQ ID NO: 2097205 - RNA, 17 nt, Staphylococcus aureus subsp. aureus MW2
auuuuucaaauaaagau

SEQ ID NO: 2097206 - RNA, 20 nt, Staphylococcus aureus subsp. aureus MW2
auuuuucaaaaagucucauu

SEQ ID NO: 2097207 - RNA, 21 nt, Staphylococcus aureus subsp. aureus MW2
caaaaguaugauuuguuugau

SEQ ID NO: 2097208 - RNA, 18 nt, Staphylococcus aureus subsp. aureus MW2
caaaagugguuguuccca

SEQ ID NO: 2097209 - RNA, 20 nt, Staphylococcus aureus subsp. aureus MW2
caaaagugguuguucccauu

SEQ ID NO: 2097210 - RNA, 13 nt, Staphylococcus aureus subsp. aureus MW2
caaaagugaaugu

SEQ ID NO: 2097211 - RNA, 20 nt, Staphylococcus aureus subsp. aureus MW2
caaaauauacuaaauuugaa

SEQ ID NO: 2097212 - RNA, 15 nt, Staphylococcus aureus subsp. aureus MW2
caaaauauacuaaau

SEQ ID NO: 2097213 - RNA, 14 nt, Staphylococcus aureus subsp. aureus MW2
caaaauauaaaauc

SEQ ID NO: 2097214 - RNA, 21 nt, Staphylococcus aureus subsp. aureus MW2
caaaauaguuguuuauuauag

SEQ ID NO: 2097215 - RNA, 15 nt, Staphylococcus aureus subsp. aureus MW2
caaaauaacauguuu

SEQ ID NO: 2097216 - RNA, 20 nt, Staphylococcus aureus subsp. aureus MW2
caaaauaacauguuuguggc

SEQ ID NO: 2097217 - RNA, 21 nt, Staphylococcus aureus subsp. aureus MW2
caaaauaacauguuuguggca

SEQ ID NO: 2097218 - RNA, 17 nt, Staphylococcus aureus subsp. aureus MW2
caaaauuuccacuuuga

SEQ ID NO: 2097219 - RNA, 20 nt, Staphylococcus aureus subsp. aureus MW2
caaaauuuugacuauucuca

SEQ ID NO: 2097220 - RNA, 21 nt, Staphylococcus aureus subsp. aureus MW2
caaaauuuugacuauucucag

SEQ ID NO: 2097221 - RNA, 18 nt, Staphylococcus aureus subsp. aureus MW2
caaaauuuugcaaaaaaa

SEQ ID NO: 2097222 - RNA, 19 nt, Staphylococcus aureus subsp. aureus MW2
caaaauuuugcaaaaaaau

SEQ ID NO: 2097223 - RNA, 18 nt, Staphylococcus aureus subsp. aureus MW2
caaacaaagcucaauaaa

SEQ ID NO: 2097224 - RNA, 19 nt, Staphylococcus aureus subsp. aureus MW2
caaacaagcuagaaacaca

SEQ ID NO: 2097225 - RNA, 18 nt, Staphylococcus aureus subsp. aureus MW2
caaaauguuuaacaauaa

SEQ ID NO: 2097226 - RNA, 22 nt, Staphylococcus aureus subsp. aureus MW2
caaaaugguuaaaaucgcagca

SEQ ID NO: 2097227 - RNA, 23 nt, Staphylococcus aureus subsp. aureus MW2
caaaaugccaagaagacauugga

SEQ ID NO: 2097228 - RNA, 15 nt, Staphylococcus aureus subsp. aureus MW2
caaaaucuuuacuug

SEQ ID NO: 2097229 - RNA, 21 nt, Staphylococcus aureus subsp. aureus MW2
cauccaauuauguuuaucuac

SEQ ID NO: 2097230 - RNA, 14 nt, Staphylococcus aureus subsp. aureus MW2
cauccaauuauguu

SEQ ID NO: 2097231 - RNA, 19 nt, Staphylococcus aureus subsp. aureus MW2
caucauuaguuuuuaaaau

SEQ ID NO: 2097232 - RNA, 15 nt, Staphylococcus aureus subsp. aureus MW2
caucauuaaauauuu

SEQ ID NO: 2097233 - RNA, 16 nt, Staphylococcus aureus subsp. aureus MW2
caucauucaaacuccu

SEQ ID NO: 2097234 - RNA, 23 nt, Staphylococcus aureus subsp. aureus MW2
caucauuaguuuuuaaaauuauc

SEQ ID NO: 2097235 - RNA, 14 nt, Staphylococcus aureus subsp. aureus MW2
caucauguuuaucu

SEQ ID NO: 2097236 - RNA, 18 nt, Staphylococcus aureus subsp. aureus MW2
cauccccagccauuuguu

SEQ ID NO: 2097237 - RNA, 16 nt, Staphylococcus aureus subsp. aureus MW2
cauccccaacuugcau

SEQ ID NO: 2097238 - RNA, 16 nt, Staphylococcus aureus subsp. aureus MW2
caucccauuaaaccac

SEQ ID NO: 2097239 - RNA, 20 nt, Staphylococcus aureus subsp. aureus MW2
caucgauuuaucauuauuug

SEQ ID NO: 2097240 - RNA, 19 nt, Staphylococcus aureus subsp. aureus MW2
caucgcaaaaacauaauca

SEQ ID NO: 2097241 - RNA, 16 nt, Staphylococcus aureus subsp. aureus MW2
caucguagcaccagca

SEQ ID NO: 2097242 - RNA, 14 nt, Staphylococcus aureus subsp. aureus MW2
caucguauagaugu

SEQ ID NO: 2097243 - RNA, 22 nt, Staphylococcus aureus subsp. aureus MW2
caucguaaaaaacaaaaaaccg

SEQ ID NO: 2097244 - RNA, 14 nt, Staphylococcus aureus subsp. aureus MW2
caucguauucuuuu

SEQ ID NO: 2097245 - RNA, 21 nt, Staphylococcus aureus subsp. aureus MW2
caucgucgcuaaagaccuuuc

SEQ ID NO: 2097246 - RNA, 22 nt, Staphylococcus aureus subsp. aureus MW2
caucuacaacgccaauagguuc

SEQ ID NO: 2097247 - RNA, 14 nt, Staphylococcus aureus subsp. aureus MW2
caucuaauccccaa

SEQ ID NO: 2097248 - RNA, 18 nt, Staphylococcus aureus subsp. aureus MW2
caucuauuuaauaaugua

SEQ ID NO: 2097249 - RNA, 14 nt, Staphylococcus aureus subsp. aureus MW2
caucuauuucuugu

SEQ ID NO: 2097250 - RNA, 13 nt, Staphylococcus aureus subsp. aureus MW2
caucuaaaaugag

SEQ ID NO: 2097251 - RNA, 18 nt, Staphylococcus aureus subsp. aureus MW2
caucuaaaugcacuagca

SEQ ID NO: 2097252 - RNA, 17 nt, Staphylococcus aureus subsp. aureus MW2
caucuaaaugguuaucu

SEQ ID NO: 2097253 - RNA, 23 nt, Staphylococcus aureus subsp. aureus MW2
caucuaaaugguuaucuaaaauu

SEQ ID NO: 2097254 - RNA, 17 nt, Staphylococcus aureus subsp. aureus MW2
caucuaaauuugccaug

SEQ ID NO: 2097255 - RNA, 18 nt, Staphylococcus aureus subsp. aureus MW2
caucacucgcaaucgaga

SEQ ID NO: 2097256 - RNA, 13 nt, Staphylococcus aureus subsp. aureus MW2
caucacuuuuuaa

SEQ ID NO: 2097257 - RNA, 13 nt, Staphylococcus aureus subsp. aureus MW2
caucacuugcugu

SEQ ID NO: 2097258 - RNA, 12 nt, Staphylococcus aureus subsp. aureus MW2
caucaauuucua

SEQ ID NO: 2097259 - RNA, 15 nt, Staphylococcus aureus subsp. aureus MW2
caucacagaaaauac

SEQ ID NO: 2097260 - RNA, 21 nt, Staphylococcus aureus subsp. aureus MW2
caucaaucgcuuuagcaauug

SEQ ID NO: 2097261 - RNA, 13 nt, Staphylococcus aureus subsp. aureus MW2
cauauuucuaaau

SEQ ID NO: 2097262 - RNA, 16 nt, Staphylococcus aureus subsp. aureus MW2
cauauuucuaaauuau

SEQ ID NO: 2097263 - RNA, 19 nt, Staphylococcus aureus subsp. aureus MW2
cauauuucuaaauuauuua

SEQ ID NO: 2097264 - RNA, 23 nt, Staphylococcus aureus subsp. aureus MW2
cauauugugccgcuucuacaacu

SEQ ID NO: 2097265 - RNA, 23 nt, Staphylococcus aureus subsp. aureus MW2
cauauuuauauuuuguaugaaug

SEQ ID NO: 2097266 - RNA, 23 nt, Staphylococcus aureus subsp. aureus MW2
cauauuuaucgcgauuauuacca

SEQ ID NO: 2097267 - RNA, 13 nt, Staphylococcus aureus subsp. aureus MW2
cauauuuauauuu

SEQ ID NO: 2097268 - RNA, 13 nt, Staphylococcus aureus subsp. aureus MW2
cauauuuaauguu

SEQ ID NO: 2097269 - RNA, 22 nt, Staphylococcus aureus subsp. aureus MW2
cauauuuacacagaaugauaua

SEQ ID NO: 2097270 - RNA, 15 nt, Staphylococcus aureus subsp. aureus MW2
cauauugcacauaaa

SEQ ID NO: 2097271 - RNA, 16 nt, Staphylococcus aureus subsp. aureus MW2
cauaguuauuaaaucu

SEQ ID NO: 2097272 - RNA, 18 nt, Staphylococcus aureus subsp. aureus MW2
cauagucugcuauuuuuu

SEQ ID NO: 2097273 - RNA, 21 nt, Staphylococcus aureus subsp. aureus MW2
cauagucgguuauuacaaaau

SEQ ID NO: 2097274 - RNA, 15 nt, Staphylococcus aureus subsp. aureus MW2
cauauacgacauuuu

SEQ ID NO: 2097275 - RNA, 16 nt, Staphylococcus aureus subsp. aureus MW2
cauauacgacauuuuu

SEQ ID NO: 2097276 - RNA, 16 nt, Staphylococcus aureus subsp. aureus MW2
cauauacucuaaaaaa

SEQ ID NO: 2097277 - RNA, 19 nt, Staphylococcus aureus subsp. aureus MW2
cauauacgacauuuuuaga

SEQ ID NO: 2097278 - RNA, 17 nt, Staphylococcus aureus subsp. aureus MW2
cauauacgacauuuuua

SEQ ID NO: 2097279 - RNA, 18 nt, Staphylococcus aureus subsp. aureus MW2
cauauacgacauuuuuag

SEQ ID NO: 2097280 - RNA, 18 nt, Staphylococcus aureus subsp. aureus MW2
cauagcucuucuuuuucu

SEQ ID NO: 2097281 - RNA, 16 nt, Staphylococcus aureus subsp. aureus MW2
cauagcucuucuuuuu

SEQ ID NO: 2097282 - RNA, 23 nt, Staphylococcus aureus subsp. aureus MW2
cauaggcuuacggggcuuuuugu

SEQ ID NO: 2097283 - RNA, 21 nt, Staphylococcus aureus subsp. aureus MW2
cauaggcgcuuuuuuuuauaa

SEQ ID NO: 2097284 - RNA, 15 nt, Staphylococcus aureus subsp. aureus MW2
cauacacaaugauua

SEQ ID NO: 2097285 - RNA, 13 nt, Staphylococcus aureus subsp. aureus MW2
cauacaauaaugu

SEQ ID NO: 2097286 - RNA, 11 nt, Staphylococcus aureus subsp. aureus MW2
cauaauuuaaa

SEQ ID NO: 2097287 - RNA, 22 nt, Staphylococcus aureus subsp. aureus MW2
cauaauuugauguucuugaaaa

SEQ ID NO: 2097288 - RNA, 15 nt, Staphylococcus aureus subsp. aureus MW2
cauaauuuguugaua

SEQ ID NO: 2097289 - RNA, 13 nt, Staphylococcus aureus subsp. aureus MW2
cauacaaauuuuu

SEQ ID NO: 2097290 - RNA, 15 nt, Staphylococcus aureus subsp. aureus MW2
cauaauuuucuauua

SEQ ID NO: 2097291 - RNA, 18 nt, Staphylococcus aureus subsp. aureus MW2
cauaauuuucuauuauuu

SEQ ID NO: 2097292 - RNA, 11 nt, Staphylococcus aureus subsp. aureus MW2
cauaaugguuc

SEQ ID NO: 2097293 - RNA, 19 nt, Staphylococcus aureus subsp. aureus MW2
cauaauuaccuuuccauuc

SEQ ID NO: 2097294 - RNA, 15 nt, Staphylococcus aureus subsp. aureus MW2
cauaauuaaauaacu

SEQ ID NO: 2097295 - RNA, 14 nt, Staphylococcus aureus subsp. aureus MW2
cauagagaaauuug

SEQ ID NO: 2097296 - RNA, 15 nt, Staphylococcus aureus subsp. aureus MW2
cauagagaauuucaa

SEQ ID NO: 2097297 - RNA, 16 nt, Staphylococcus aureus subsp. aureus MW2
cauagagaauuucaaa

SEQ ID NO: 2097298 - RNA, 22 nt, Staphylococcus aureus subsp. aureus MW2
cauagcauuaagaugauugucu

SEQ ID NO: 2097299 - RNA, 16 nt, Staphylococcus aureus subsp. aureus MW2
cauagcauuaagauga

SEQ ID NO: 2097300 - RNA, 18 nt, Staphylococcus aureus subsp. aureus MW2
cauagccucuuaaaauac

SEQ ID NO: 2097301 - RNA, 15 nt, Staphylococcus aureus subsp. aureus MW2
cauucagucaaacac

SEQ ID NO: 2097302 - RNA, 14 nt, Staphylococcus aureus subsp. aureus MW2
cauucaucgucuca

SEQ ID NO: 2097303 - RNA, 22 nt, Staphylococcus aureus subsp. aureus MW2
cauucaucguuuacuacaucau

SEQ ID NO: 2097304 - RNA, 15 nt, Staphylococcus aureus subsp. aureus MW2
cauucaguuuuguau

SEQ ID NO: 2097305 - RNA, 18 nt, Staphylococcus aureus subsp. aureus MW2
cauucaguuuuguauuca

SEQ ID NO: 2097306 - RNA, 12 nt, Staphylococcus aureus subsp. aureus MW2
cauuccaaaaau

SEQ ID NO: 2097307 - RNA, 13 nt, Staphylococcus aureus subsp. aureus MW2
cauuccaaaaauu

SEQ ID NO: 2097308 - RNA, 13 nt, Staphylococcus aureus subsp. aureus MW2
cauuccaaaaccg

SEQ ID NO: 2097309 - RNA, 13 nt, Staphylococcus aureus subsp. aureus MW2
cauucauuaacag

SEQ ID NO: 2097310 - RNA, 18 nt, Staphylococcus aureus subsp. aureus MW2
cauuauuugauaaauaaa

SEQ ID NO: 2097311 - RNA, 15 nt, Staphylococcus aureus subsp. aureus MW2
cauucaauguuuaau

SEQ ID NO: 2097312 - RNA, 21 nt, Staphylococcus aureus subsp. aureus MW2
cauuauuguuguaucaucaua

SEQ ID NO: 2097313 - RNA, 14 nt, Staphylococcus aureus subsp. aureus MW2
cauuauuguaaccu

SEQ ID NO: 2097314 - RNA, 15 nt, Staphylococcus aureus subsp. aureus MW2
cauuauuguaaccug

SEQ ID NO: 2097315 - RNA, 17 nt, Staphylococcus aureus subsp. aureus MW2
cauuauuguaaccugac

SEQ ID NO: 2097316 - RNA, 13 nt, Staphylococcus aureus subsp. aureus MW2
cauuauuaaauag

SEQ ID NO: 2097317 - RNA, 16 nt, Staphylococcus aureus subsp. aureus MW2
cauuaucaacuuuaua

SEQ ID NO: 2097318 - RNA, 15 nt, Staphylococcus aureus subsp. aureus MW2
cauuaucaagaacuu

SEQ ID NO: 2097319 - RNA, 17 nt, Staphylococcus aureus subsp. aureus MW2
cauuauagucuuaaaca

SEQ ID NO: 2097320 - RNA, 12 nt, Staphylococcus aureus subsp. aureus MW2
cauuauuaagug

SEQ ID NO: 2097321 - RNA, 17 nt, Staphylococcus aureus subsp. aureus MW2
cauuauuaagugaguuu

SEQ ID NO: 2097322 - RNA, 19 nt, Staphylococcus aureus subsp. aureus MW2
cauuaugugucuuccaauc

SEQ ID NO: 2097323 - RNA, 15 nt, Staphylococcus aureus subsp. aureus MW2
cauguuauauuauga

SEQ ID NO: 2097324 - RNA, 15 nt, Staphylococcus aureus subsp. aureus MW2
cauguuauguuuaag

SEQ ID NO: 2097325 - RNA, 15 nt, Staphylococcus aureus subsp. aureus MW2
cauguguugcaauug

SEQ ID NO: 2097326 - RNA, 22 nt, Staphylococcus aureus subsp. aureus MW2
cauuaguugcauaaucaauuuc

SEQ ID NO: 2097327 - RNA, 20 nt, Staphylococcus aureus subsp. aureus MW2
cauuaguuugaucauuuacu

SEQ ID NO: 2097328 - RNA, 19 nt, Staphylococcus aureus subsp. aureus MW2
cauuacuaucuucaucaua

SEQ ID NO: 2097329 - RNA, 20 nt, Staphylococcus aureus subsp. aureus MW2
cauuacuacuuuauaaauau

SEQ ID NO: 2097330 - RNA, 14 nt, Staphylococcus aureus subsp. aureus MW2
cauuacuacuuuau

SEQ ID NO: 2097331 - RNA, 14 nt, Staphylococcus aureus subsp. aureus MW2
cauuaguacuaaac

SEQ ID NO: 2097332 - RNA, 15 nt, Staphylococcus aureus subsp. aureus MW2
cauucuuuauagaaa

SEQ ID NO: 2097333 - RNA, 17 nt, Staphylococcus aureus subsp. aureus MW2
cauucuucaaaaaauaa

SEQ ID NO: 2097334 - RNA, 15 nt, Staphylococcus aureus subsp. aureus MW2
cauucuucauuacag

SEQ ID NO: 2097335 - RNA, 19 nt, Staphylococcus aureus subsp. aureus MW2
cauucuucauuacaguauu

SEQ ID NO: 2097336 - RNA, 22 nt, Staphylococcus aureus subsp. aureus MW2
cauucuuccaacacccauauaa

SEQ ID NO: 2097337 - RNA, 15 nt, Staphylococcus aureus subsp. aureus MW2
cauucuuuuucaaaa

SEQ ID NO: 2097338 - RNA, 17 nt, Staphylococcus aureus subsp. aureus MW2
cauugaaaauauuuuau

SEQ ID NO: 2097339 - RNA, 19 nt, Staphylococcus aureus subsp. aureus MW2
cauugaaaggaacauuuca

SEQ ID NO: 2097340 - RNA, 18 nt, Staphylococcus aureus subsp. aureus MW2
cauugaaaucgucuuacu

SEQ ID NO: 2097341 - RNA, 21 nt, Staphylococcus aureus subsp. aureus MW2
cauugaaaucgucuuacugcu

SEQ ID NO: 2097342 - RNA, 16 nt, Staphylococcus aureus subsp. aureus MW2
cauuguaaaacaaauu

SEQ ID NO: 2097343 - RNA, 13 nt, Staphylococcus aureus subsp. aureus MW2
cauuguaaaaugu

SEQ ID NO: 2097344 - RNA, 17 nt, Staphylococcus aureus subsp. aureus MW2
cauugguaccuuuuuau

SEQ ID NO: 2097345 - RNA, 22 nt, Staphylococcus aureus subsp. aureus MW2
cauugcguaacaucacagaaaa

SEQ ID NO: 2097346 - RNA, 21 nt, Staphylococcus aureus subsp. aureus MW2
cauugcgugcuucacuaaaaa

SEQ ID NO: 2097347 - RNA, 22 nt, Staphylococcus aureus subsp. aureus MW2
cauuguaaauauaguaauaaaa

SEQ ID NO: 2097348 - RNA, 14 nt, Staphylococcus aureus subsp. aureus MW2
cauuguaauaccaa

SEQ ID NO: 2097349 - RNA, 23 nt, Staphylococcus aureus subsp. aureus MW2
cauugguaccuuuuuauuaucuu

SEQ ID NO: 2097350 - RNA, 23 nt, Staphylococcus aureus subsp. aureus MW2
cauuguagcgccuaagacauaaa

SEQ ID NO: 2097351 - RNA, 17 nt, Staphylococcus aureus subsp. aureus MW2
cauugucaugccuucau

SEQ ID NO: 2097352 - RNA, 15 nt, Staphylococcus aureus subsp. aureus MW2
cauuuagauuucaua

SEQ ID NO: 2097353 - RNA, 21 nt, Staphylococcus aureus subsp. aureus MW2
cauuuagauuucauaauguua

SEQ ID NO: 2097354 - RNA, 22 nt, Staphylococcus aureus subsp. aureus MW2
cauuuauuuucaauaaauaaac

SEQ ID NO: 2097355 - RNA, 12 nt, Staphylococcus aureus subsp. aureus MW2
cauuuauuuuca

SEQ ID NO: 2097356 - RNA, 12 nt, Staphylococcus aureus subsp. aureus MW2
cauuuauuuaau

SEQ ID NO: 2097357 - RNA, 18 nt, Staphylococcus aureus subsp. aureus MW2
cauuuauauggaauacua

SEQ ID NO: 2097358 - RNA, 16 nt, Staphylococcus aureus subsp. aureus MW2
cauuucaauauuaaaa

SEQ ID NO: 2097359 - RNA, 15 nt, Staphylococcus aureus subsp. aureus MW2
cauuuauuuuuucuc

SEQ ID NO: 2097360 - RNA, 17 nt, Staphylococcus aureus subsp. aureus MW2
cauuuauuuuuucucua

SEQ ID NO: 2097361 - RNA, 20 nt, Staphylococcus aureus subsp. aureus MW2
cauuucaguauauuuuaaca

SEQ ID NO: 2097362 - RNA, 17 nt, Staphylococcus aureus subsp. aureus MW2
cauuucaugugucacaa

SEQ ID NO: 2097363 - RNA, 21 nt, Staphylococcus aureus subsp. aureus MW2
cauuucaucaauaauuucuug

SEQ ID NO: 2097364 - RNA, 14 nt, Staphylococcus aureus subsp. aureus MW2
caucucuaugucuc

SEQ ID NO: 2097365 - RNA, 13 nt, Staphylococcus aureus subsp. aureus MW2
caucucuauuuuu

SEQ ID NO: 2097366 - RNA, 21 nt, Staphylococcus aureus subsp. aureus MW2
caucucugcuuuaauauaauu

SEQ ID NO: 2097367 - RNA, 18 nt, Staphylococcus aureus subsp. aureus MW2
caugaaucgcauuuaaau

SEQ ID NO: 2097368 - RNA, 15 nt, Staphylococcus aureus subsp. aureus MW2
caugaauaaauacaa

SEQ ID NO: 2097369 - RNA, 23 nt, Staphylococcus aureus subsp. aureus MW2
caugacgaacgauagauucugau

SEQ ID NO: 2097370 - RNA, 18 nt, Staphylococcus aureus subsp. aureus MW2
caugacacucauucaauu

SEQ ID NO: 2097371 - RNA, 16 nt, Staphylococcus aureus subsp. aureus MW2
caugaauuuucaucau

SEQ ID NO: 2097372 - RNA, 18 nt, Staphylococcus aureus subsp. aureus MW2
caugaauuuuaauauauu

SEQ ID NO: 2097373 - RNA, 15 nt, Staphylococcus aureus subsp. aureus MW2
caugacauucauuua

SEQ ID NO: 2097374 - RNA, 12 nt, Staphylococcus aureus subsp. aureus MW2
caugaccaacag

SEQ ID NO: 2097375 - RNA, 16 nt, Staphylococcus aureus subsp. aureus MW2
caugauugaaauccuu

SEQ ID NO: 2097376 - RNA, 14 nt, Staphylococcus aureus subsp. aureus MW2
caugauucaugaua

SEQ ID NO: 2097377 - RNA, 12 nt, Staphylococcus aureus subsp. aureus MW2
caugaugauaaa

SEQ ID NO: 2097378 - RNA, 20 nt, Staphylococcus aureus subsp. aureus MW2
caugaugauaaauugaguuu

SEQ ID NO: 2097379 - RNA, 21 nt, Staphylococcus aureus subsp. aureus MW2
caugagauuauuuuuuuaaau

SEQ ID NO: 2097380 - RNA, 18 nt, Staphylococcus aureus subsp. aureus MW2
caugagccuucuaucuuu

SEQ ID NO: 2097381 - RNA, 16 nt, Staphylococcus aureus subsp. aureus MW2
caugauauaaauaggu

SEQ ID NO: 2097382 - RNA, 17 nt, Staphylococcus aureus subsp. aureus MW2
caugauaaaaauaaaaa

SEQ ID NO: 2097383 - RNA, 20 nt, Staphylococcus aureus subsp. aureus MW2
caugauaaaaauaaaaaacg

SEQ ID NO: 2097384 - RNA, 17 nt, Staphylococcus aureus subsp. aureus MW2
caugcuuaauuuaugug

SEQ ID NO: 2097385 - RNA, 22 nt, Staphylococcus aureus subsp. aureus MW2
caugccaauuaauucuuugaaa

SEQ ID NO: 2097386 - RNA, 21 nt, Staphylococcus aureus subsp. aureus MW2
caugucaauuuuuucaugauu

SEQ ID NO: 2097387 - RNA, 19 nt, Staphylococcus aureus subsp. aureus MW2
caugucacuggguguuuuu

SEQ ID NO: 2097388 - RNA, 19 nt, Staphylococcus aureus subsp. aureus MW2
cauguauauggcaucauca

SEQ ID NO: 2097389 - RNA, 19 nt, Staphylococcus aureus subsp. aureus MW2
cauguauaaaagauauaaa

SEQ ID NO: 2097390 - RNA, 22 nt, Staphylococcus aureus subsp. aureus MW2
cauguauuuaguaucauaauag

SEQ ID NO: 2097391 - RNA, 12 nt, Staphylococcus aureus subsp. aureus MW2
cauguauaaaag

SEQ ID NO: 2097392 - RNA, 21 nt, Staphylococcus aureus subsp. aureus MW2
cauguacguuuuuuuaaauac

SEQ ID NO: 2097393 - RNA, 19 nt, Staphylococcus aureus subsp. aureus MW2
cauguacauugguuuuuac

SEQ ID NO: 2097394 - RNA, 15 nt, Staphylococcus aureus subsp. aureus MW2
cauguacaguuacuu

SEQ ID NO: 2097395 - RNA, 16 nt, Staphylococcus aureus subsp. aureus MW2
cauguaaugcuuaaaa

SEQ ID NO: 2097396 - RNA, 21 nt, Staphylococcus aureus subsp. aureus MW2
cauguaaugcuuaaaaacaau

SEQ ID NO: 2097397 - RNA, 19 nt, Staphylococcus aureus subsp. aureus MW2
cauguaaugcuuaaaaaca

SEQ ID NO: 2097398 - RNA, 13 nt, Staphylococcus aureus subsp. aureus MW2
cauguaacagugu

SEQ ID NO: 2097399 - RNA, 12 nt, Staphylococcus aureus subsp. aureus MW2
cagcuaacaaaa

SEQ ID NO: 2097400 - RNA, 21 nt, Staphylococcus aureus subsp. aureus MW2
cagcuaaaaaguauacuaaac

SEQ ID NO: 2097401 - RNA, 15 nt, Staphylococcus aureus subsp. aureus MW2
cagcuaaaaaguaua

SEQ ID NO: 2097402 - RNA, 13 nt, Staphylococcus aureus subsp. aureus MW2
cagcuaaauauuu

SEQ ID NO: 2097403 - RNA, 17 nt, Staphylococcus aureus subsp. aureus MW2
cagcuacaaauaaugag

SEQ ID NO: 2097404 - RNA, 19 nt, Staphylococcus aureus subsp. aureus MW2
cagcuucuaaguaauauaa

SEQ ID NO: 2097405 - RNA, 17 nt, Staphylococcus aureus subsp. aureus MW2
cagcuuguucaauacuu

SEQ ID NO: 2097406 - RNA, 14 nt, Staphylococcus aureus subsp. aureus MW2
cagcuuuucuucaa

SEQ ID NO: 2097407 - RNA, 15 nt, Staphylococcus aureus subsp. aureus MW2
cagcuuuauaaugug

SEQ ID NO: 2097408 - RNA, 15 nt, Staphylococcus aureus subsp. aureus MW2
caguuacuucaguuu

SEQ ID NO: 2097409 - RNA, 20 nt, Staphylococcus aureus subsp. aureus MW2
caguuacucuauagucaucu

SEQ ID NO: 2097410 - RNA, 23 nt, Staphylococcus aureus subsp. aureus MW2
caguuaauuauuuagauucuuuu

SEQ ID NO: 2097411 - RNA, 17 nt, Staphylococcus aureus subsp. aureus MW2
caguuaugccugaagcg

SEQ ID NO: 2097412 - RNA, 21 nt, Staphylococcus aureus subsp. aureus MW2
caguuacuuucgcuugcaaag

SEQ ID NO: 2097413 - RNA, 17 nt, Staphylococcus aureus subsp. aureus MW2
caguuagaaacagaauu

SEQ ID NO: 2097414 - RNA, 21 nt, Staphylococcus aureus subsp. aureus MW2
caguuagaaacagaauuauuu

SEQ ID NO: 2097415 - RNA, 20 nt, Staphylococcus aureus subsp. aureus MW2
cagugcuaauuuugagacaa

SEQ ID NO: 2097416 - RNA, 18 nt, Staphylococcus aureus subsp. aureus MW2
cauaaggacucuguuuaa

SEQ ID NO: 2097417 - RNA, 17 nt, Staphylococcus aureus subsp. aureus MW2
cauaaggucuuggacua

SEQ ID NO: 2097418 - RNA, 22 nt, Staphylococcus aureus subsp. aureus MW2
cauaagguacauaaauagugaa

SEQ ID NO: 2097419 - RNA, 16 nt, Staphylococcus aureus subsp. aureus MW2
cauaagccauaugcuu

SEQ ID NO: 2097420 - RNA, 13 nt, Staphylococcus aureus subsp. aureus MW2
cauaagcaaagau

SEQ ID NO: 2097421 - RNA, 16 nt, Staphylococcus aureus subsp. aureus MW2
cauaaaguuuauuuau

SEQ ID NO: 2097422 - RNA, 15 nt, Staphylococcus aureus subsp. aureus MW2
cauaaauacaaaaau

SEQ ID NO: 2097423 - RNA, 16 nt, Staphylococcus aureus subsp. aureus MW2
cauaaagcuguuuauu

SEQ ID NO: 2097424 - RNA, 17 nt, Staphylococcus aureus subsp. aureus MW2
cauaaagcuuugacaua

SEQ ID NO: 2097425 - RNA, 15 nt, Staphylococcus aureus subsp. aureus MW2
cauaagaaaaagcag

SEQ ID NO: 2097426 - RNA, 14 nt, Staphylococcus aureus subsp. aureus MW2
cauaagaaaauacu

SEQ ID NO: 2097427 - RNA, 15 nt, Staphylococcus aureus subsp. aureus MW2
cauaaucaagucugc

SEQ ID NO: 2097428 - RNA, 17 nt, Staphylococcus aureus subsp. aureus MW2
cauaaucaacauguguc

SEQ ID NO: 2097429 - RNA, 21 nt, Staphylococcus aureus subsp. aureus MW2
cauaauaucuuacuacuuaau

SEQ ID NO: 2097430 - RNA, 14 nt, Staphylococcus aureus subsp. aureus MW2
cauaauauauuaaa

SEQ ID NO: 2097431 - RNA, 22 nt, Staphylococcus aureus subsp. aureus MW2
cauaaucauuaguuaugugcua

SEQ ID NO: 2097432 - RNA, 19 nt, Staphylococcus aureus subsp. aureus MW2
cauaauccauucuucuugu

SEQ ID NO: 2097433 - RNA, 19 nt, Staphylococcus aureus subsp. aureus MW2
caguuuuugguagcauuuu

SEQ ID NO: 2097434 - RNA, 12 nt, Staphylococcus aureus subsp. aureus MW2
caguuuuuauau

SEQ ID NO: 2097435 - RNA, 19 nt, Staphylococcus aureus subsp. aureus MW2
caguuuugaagaauaaaaa

SEQ ID NO: 2097436 - RNA, 16 nt, Staphylococcus aureus subsp. aureus MW2
cauaaaagacagaaau

SEQ ID NO: 2097437 - RNA, 18 nt, Staphylococcus aureus subsp. aureus MW2
cauaaaacuuacauuaca

SEQ ID NO: 2097438 - RNA, 14 nt, Staphylococcus aureus subsp. aureus MW2
cauaaaauuucugc

SEQ ID NO: 2097439 - RNA, 14 nt, Staphylococcus aureus subsp. aureus MW2
caguuuuaugaaua

SEQ ID NO: 2097440 - RNA, 18 nt, Staphylococcus aureus subsp. aureus MW2
caguuuuauuaucuuugu

SEQ ID NO: 2097441 - RNA, 23 nt, Staphylococcus aureus subsp. aureus MW2
caguuuuaauuaaacuguaaaca

SEQ ID NO: 2097442 - RNA, 14 nt, Staphylococcus aureus subsp. aureus MW2
caguuuuaaagacu

SEQ ID NO: 2097443 - RNA, 22 nt, Staphylococcus aureus subsp. aureus MW2
caguuucuaauaaugcauguga

SEQ ID NO: 2097444 - RNA, 15 nt, Staphylococcus aureus subsp. aureus MW2
caguuucuauauuuu

SEQ ID NO: 2097445 - RNA, 17 nt, Staphylococcus aureus subsp. aureus MW2
caguuugaauugacuga

SEQ ID NO: 2097446 - RNA, 14 nt, Staphylococcus aureus subsp. aureus MW2
caguuugauuaaaa

SEQ ID NO: 2097447 - RNA, 15 nt, Staphylococcus aureus subsp. aureus MW2
caguauguaaaaagu

SEQ ID NO: 2097448 - RNA, 17 nt, Staphylococcus aureus subsp. aureus MW2
caguaucucuuuucuau

SEQ ID NO: 2097449 - RNA, 18 nt, Staphylococcus aureus subsp. aureus MW2
cagucauuugauuuaaaa

SEQ ID NO: 2097450 - RNA, 17 nt, Staphylococcus aureus subsp. aureus MW2
caguccauuuuuuauag

SEQ ID NO: 2097451 - RNA, 22 nt, Staphylococcus aureus subsp. aureus MW2
caguacgguuauuuaauaaugc

SEQ ID NO: 2097452 - RNA, 16 nt, Staphylococcus aureus subsp. aureus MW2
caguaggacacauaaa

SEQ ID NO: 2097453 - RNA, 16 nt, Staphylococcus aureus subsp. aureus MW2
caguaauuuuuaaaca

SEQ ID NO: 2097454 - RNA, 13 nt, Staphylococcus aureus subsp. aureus MW2
caguacaaauaac

SEQ ID NO: 2097455 - RNA, 14 nt, Staphylococcus aureus subsp. aureus MW2
caguacgaacaacu

SEQ ID NO: 2097456 - RNA, 13 nt, Staphylococcus aureus subsp. aureus MW2
caggugcaucuuu

SEQ ID NO: 2097457 - RNA, 13 nt, Staphylococcus aureus subsp. aureus MW2
cagguucaauagu

SEQ ID NO: 2097458 - RNA, 22 nt, Staphylococcus aureus subsp. aureus MW2
cagguuacaauaaugugcaagu

SEQ ID NO: 2097459 - RNA, 14 nt, Staphylococcus aureus subsp. aureus MW2
cagguuauagaaua

SEQ ID NO: 2097460 - RNA, 16 nt, Staphylococcus aureus subsp. aureus MW2
cagguuauagaauacc

SEQ ID NO: 2097461 - RNA, 15 nt, Staphylococcus aureus subsp. aureus MW2
cagguuaucacaaca

SEQ ID NO: 2097462 - RNA, 16 nt, Staphylococcus aureus subsp. aureus MW2
cagguuaucacaacag

SEQ ID NO: 2097463 - RNA, 15 nt, Staphylococcus aureus subsp. aureus MW2
caguaaauuuauuau

SEQ ID NO: 2097464 - RNA, 16 nt, Staphylococcus aureus subsp. aureus MW2
cagguuuaauaaauuu

SEQ ID NO: 2097465 - RNA, 15 nt, Staphylococcus aureus subsp. aureus MW2
cagguaauguuugaa

SEQ ID NO: 2097466 - RNA, 16 nt, Staphylococcus aureus subsp. aureus MW2
cagguacuucgguacu

SEQ ID NO: 2097467 - RNA, 21 nt, Staphylococcus aureus subsp. aureus MW2
caggucgcccuugccugugcu

SEQ ID NO: 2097468 - RNA, 13 nt, Staphylococcus aureus subsp. aureus MW2
caggugauugacg

SEQ ID NO: 2097469 - RNA, 22 nt, Staphylococcus aureus subsp. aureus MW2
ccaaacaaccugugauaaaaau

SEQ ID NO: 2097470 - RNA, 13 nt, Staphylococcus aureus subsp. aureus MW2
ccaaacauagaga

SEQ ID NO: 2097471 - RNA, 14 nt, Staphylococcus aureus subsp. aureus MW2
ccaaaaccaaauga

SEQ ID NO: 2097472 - RNA, 18 nt, Staphylococcus aureus subsp. aureus MW2
ccaaaaauaauuaugaaa

SEQ ID NO: 2097473 - RNA, 22 nt, Staphylococcus aureus subsp. aureus MW2
ccaaaaauagauugaaaaaaua

SEQ ID NO: 2097474 - RNA, 12 nt, Staphylococcus aureus subsp. aureus MW2
ccaaaaaguauu

SEQ ID NO: 2097475 - RNA, 16 nt, Staphylococcus aureus subsp. aureus MW2
ccaaagcugaauuuua

SEQ ID NO: 2097476 - RNA, 19 nt, Staphylococcus aureus subsp. aureus MW2
ccaaaucggaauaaaauaa

SEQ ID NO: 2097477 - RNA, 17 nt, Staphylococcus aureus subsp. aureus MW2
ccaaaucggaauaaaau

SEQ ID NO: 2097478 - RNA, 16 nt, Staphylococcus aureus subsp. aureus MW2
ccaaauauuaaaaaca

SEQ ID NO: 2097479 - RNA, 22 nt, Staphylococcus aureus subsp. aureus MW2
ccaaauacuaguaauaauaggc

SEQ ID NO: 2097480 - RNA, 17 nt, Staphylococcus aureus subsp. aureus MW2
ccaaauauuuuaucugu

SEQ ID NO: 2097481 - RNA, 18 nt, Staphylococcus aureus subsp. aureus MW2
ccaaauacaguuguacca

SEQ ID NO: 2097482 - RNA, 15 nt, Staphylococcus aureus subsp. aureus MW2
ccaaauaaauuuuga

SEQ ID NO: 2097483 - RNA, 20 nt, Staphylococcus aureus subsp. aureus MW2
ccaacugucgguucaucuaa

SEQ ID NO: 2097484 - RNA, 14 nt, Staphylococcus aureus subsp. aureus MW2
ccaacuugcacauu

SEQ ID NO: 2097485 - RNA, 16 nt, Staphylococcus aureus subsp. aureus MW2
ccaacuugcacauuau

SEQ ID NO: 2097486 - RNA, 18 nt, Staphylococcus aureus subsp. aureus MW2
ccaacaaagaagcuggcg

SEQ ID NO: 2097487 - RNA, 21 nt, Staphylococcus aureus subsp. aureus MW2
ccaacaauagguacaacuaaa

SEQ ID NO: 2097488 - RNA, 16 nt, Staphylococcus aureus subsp. aureus MW2
ccaacaccuaauauuu

SEQ ID NO: 2097489 - RNA, 18 nt, Staphylococcus aureus subsp. aureus MW2
ccaacacccauauaauuu

SEQ ID NO: 2097490 - RNA, 14 nt, Staphylococcus aureus subsp. aureus MW2
ccaacagcuucaac

SEQ ID NO: 2097491 - RNA, 15 nt, Staphylococcus aureus subsp. aureus MW2
ccaacagcuucaaca

SEQ ID NO: 2097492 - RNA, 14 nt, Staphylococcus aureus subsp. aureus MW2
ccaaccaugcuuuu

SEQ ID NO: 2097493 - RNA, 19 nt, Staphylococcus aureus subsp. aureus MW2
ccaaccccuuuauuuugau

SEQ ID NO: 2097494 - RNA, 13 nt, Staphylococcus aureus subsp. aureus MW2
ccaaguauuuucu

SEQ ID NO: 2097495 - RNA, 19 nt, Staphylococcus aureus subsp. aureus MW2
ccaaguacgcaauuuaaua

SEQ ID NO: 2097496 - RNA, 21 nt, Staphylococcus aureus subsp. aureus MW2
ccaagaagacauuggauuacu

SEQ ID NO: 2097497 - RNA, 17 nt, Staphylococcus aureus subsp. aureus MW2
ccaagaacguguuugaa

SEQ ID NO: 2097498 - RNA, 21 nt, Staphylococcus aureus subsp. aureus MW2
ccaagacgaacaucaucuaug

SEQ ID NO: 2097499 - RNA, 20 nt, Staphylococcus aureus subsp. aureus MW2
ccaagauaaaucaucauucu

SEQ ID NO: 2097500 - RNA, 16 nt, Staphylococcus aureus subsp. aureus MW2
ccaagauuaugacaac

SEQ ID NO: 2097501 - RNA, 15 nt, Staphylococcus aureus subsp. aureus MW2
ccaagauauauaacu

SEQ ID NO: 2097502 - RNA, 20 nt, Staphylococcus aureus subsp. aureus MW2
ccaagcucuuuuuuguuaua

SEQ ID NO: 2097503 - RNA, 22 nt, Staphylococcus aureus subsp. aureus MW2
ccaaucgguacgaagugcaaca

SEQ ID NO: 2097504 - RNA, 22 nt, Staphylococcus aureus subsp. aureus MW2
ccaaucuaaaaauccauucauc

SEQ ID NO: 2097505 - RNA, 18 nt, Staphylococcus aureus subsp. aureus MW2
ccaaucaucauuaaaucu

SEQ ID NO: 2097506 - RNA, 11 nt, Staphylococcus aureus subsp. aureus MW2
ccaaucaacuu

SEQ ID NO: 2097507 - RNA, 14 nt, Staphylococcus aureus subsp. aureus MW2
ccaauauuuuucga

SEQ ID NO: 2097508 - RNA, 13 nt, Staphylococcus aureus subsp. aureus MW2
ccaaucacaauau

SEQ ID NO: 2097509 - RNA, 19 nt, Staphylococcus aureus subsp. aureus MW2
ccaauaaaaugcaauuuuu

SEQ ID NO: 2097510 - RNA, 23 nt, Staphylococcus aureus subsp. aureus MW2
ccaauaaaaugucagcaacuucu

SEQ ID NO: 2097511 - RNA, 19 nt, Staphylococcus aureus subsp. aureus MW2
ccaauacaauuuagguuaa

SEQ ID NO: 2097512 - RNA, 14 nt, Staphylococcus aureus subsp. aureus MW2
ccaauaauugcugu

SEQ ID NO: 2097513 - RNA, 21 nt, Staphylococcus aureus subsp. aureus MW2
ccaauauauucaccuacaaca

SEQ ID NO: 2097514 - RNA, 14 nt, Staphylococcus aureus subsp. aureus MW2
ccaauauaacaagc

SEQ ID NO: 2097515 - RNA, 18 nt, Staphylococcus aureus subsp. aureus MW2
ccaauagguucauuauuu

SEQ ID NO: 2097516 - RNA, 17 nt, Staphylococcus aureus subsp. aureus MW2
ccaauaucauauuugaa

SEQ ID NO: 2097517 - RNA, 16 nt, Staphylococcus aureus subsp. aureus MW2
ccaauaucauauuuga

SEQ ID NO: 2097518 - RNA, 21 nt, Staphylococcus aureus subsp. aureus MW2
ccaauaccgaauaauuuugau

SEQ ID NO: 2097519 - RNA, 15 nt, Staphylococcus aureus subsp. aureus MW2
ccaauacuuuuuaua

SEQ ID NO: 2097520 - RNA, 20 nt, Staphylococcus aureus subsp. aureus MW2
ccaauacuuuuuauauaauu

SEQ ID NO: 2097521 - RNA, 14 nt, Staphylococcus aureus subsp. aureus MW2
ccaauguguuuaac

SEQ ID NO: 2097522 - RNA, 19 nt, Staphylococcus aureus subsp. aureus MW2
ccaauggaaguuuuuuagu

SEQ ID NO: 2097523 - RNA, 18 nt, Staphylococcus aureus subsp. aureus MW2
ccaaugcugaauaaauaa

SEQ ID NO: 2097524 - RNA, 16 nt, Staphylococcus aureus subsp. aureus MW2
ccaaugcauaaaaccu

SEQ ID NO: 2097525 - RNA, 22 nt, Staphylococcus aureus subsp. aureus MW2
ccaauuaaaucgauuaagaaug

SEQ ID NO: 2097526 - RNA, 15 nt, Staphylococcus aureus subsp. aureus MW2
ccaauuaauucuuug

SEQ ID NO: 2097527 - RNA, 16 nt, Staphylococcus aureus subsp. aureus MW2
ccaauuaauucuuuga

SEQ ID NO: 2097528 - RNA, 12 nt, Staphylococcus aureus subsp. aureus MW2
ccaauuaggauu

SEQ ID NO: 2097529 - RNA, 16 nt, Staphylococcus aureus subsp. aureus MW2
ccaauugauuuugcug

SEQ ID NO: 2097530 - RNA, 19 nt, Staphylococcus aureus subsp. aureus MW2
ccacaacaaucacgauuaa

SEQ ID NO: 2097531 - RNA, 17 nt, Staphylococcus aureus subsp. aureus MW2
ccaauuugauuaguaau

SEQ ID NO: 2097532 - RNA, 17 nt, Staphylococcus aureus subsp. aureus MW2
ccaauuucucuguguug

SEQ ID NO: 2097533 - RNA, 12 nt, Staphylococcus aureus subsp. aureus MW2
ccacauuuuccu

SEQ ID NO: 2097534 - RNA, 21 nt, Staphylococcus aureus subsp. aureus MW2
ccacauuuuccuuguuucgaa

SEQ ID NO: 2097535 - RNA, 21 nt, Staphylococcus aureus subsp. aureus MW2
ccaccguuaaaauauaugaau

SEQ ID NO: 2097536 - RNA, 18 nt, Staphylococcus aureus subsp. aureus MW2
ccacggcauuuaagccug

SEQ ID NO: 2097537 - RNA, 23 nt, Staphylococcus aureus subsp. aureus MW2
ccagcaugaagugggauaugaau

SEQ ID NO: 2097538 - RNA, 15 nt, Staphylococcus aureus subsp. aureus MW2
ccacuuugaucuuua

SEQ ID NO: 2097539 - RNA, 12 nt, Staphylococcus aureus subsp. aureus MW2
ccagacuccuaa

SEQ ID NO: 2097540 - RNA, 23 nt, Staphylococcus aureus subsp. aureus MW2
ccagcuucuauguuggggccccg

SEQ ID NO: 2097541 - RNA, 20 nt, Staphylococcus aureus subsp. aureus MW2
ccagcuugaccgccuaugau

SEQ ID NO: 2097542 - RNA, 20 nt, Staphylococcus aureus subsp. aureus MW2
ccagcuuucguaccugcucu

SEQ ID NO: 2097543 - RNA, 15 nt, Staphylococcus aureus subsp. aureus MW2
ccaggugcaucuuuu

SEQ ID NO: 2097544 - RNA, 23 nt, Staphylococcus aureus subsp. aureus MW2
ccagguucaauaguaccaugcuc

SEQ ID NO: 2097545 - RNA, 17 nt, Staphylococcus aureus subsp. aureus MW2
ccauaagguacauaaau

SEQ ID NO: 2097546 - RNA, 23 nt, Staphylococcus aureus subsp. aureus MW2
ccaguuuuugguagcauuuuaga

SEQ ID NO: 2097547 - RNA, 15 nt, Staphylococcus aureus subsp. aureus MW2
ccaguuuucaauuua

SEQ ID NO: 2097548 - RNA, 17 nt, Staphylococcus aureus subsp. aureus MW2
ccauauagauauuagcu

SEQ ID NO: 2097549 - RNA, 18 nt, Staphylococcus aureus subsp. aureus MW2
ccauaguauguaucuuuc

SEQ ID NO: 2097550 - RNA, 17 nt, Staphylococcus aureus subsp. aureus MW2
ccauaguaacaaaauga

SEQ ID NO: 2097551 - RNA, 22 nt, Staphylococcus aureus subsp. aureus MW2
ccauauuuuuuaguaauaacau

SEQ ID NO: 2097552 - RNA, 15 nt, Staphylococcus aureus subsp. aureus MW2
ccauacuaaauaagu

SEQ ID NO: 2097553 - RNA, 20 nt, Staphylococcus aureus subsp. aureus MW2
ccauacuaaucguuccaaca

SEQ ID NO: 2097554 - RNA, 18 nt, Staphylococcus aureus subsp. aureus MW2
ccauacgaucuuuuucaa

SEQ ID NO: 2097555 - RNA, 24 nt, Staphylococcus aureus subsp. aureus MW2
ccauacuucuauuuuauaauaaau

SEQ ID NO: 2097556 - RNA, 20 nt, Staphylococcus aureus subsp. aureus MW2
ccauacuucuauuuuauaau

SEQ ID NO: 2097557 - RNA, 22 nt, Staphylococcus aureus subsp. aureus MW2
ccauacuucuauuuuauaauaa

SEQ ID NO: 2097558 - RNA, 21 nt, Staphylococcus aureus subsp. aureus MW2
ccaucccaacuuaauaaccau

SEQ ID NO: 2097559 - RNA, 15 nt, Staphylococcus aureus subsp. aureus MW2
ccaucauuuguguuu

SEQ ID NO: 2097560 - RNA, 16 nt, Staphylococcus aureus subsp. aureus MW2
ccaucugugucagcau

SEQ ID NO: 2097561 - RNA, 16 nt, Staphylococcus aureus subsp. aureus MW2
ccaugagaaaccgcuu

SEQ ID NO: 2097562 - RNA, 19 nt, Staphylococcus aureus subsp. aureus MW2
ccaugcccgauaaaaccac

SEQ ID NO: 2097563 - RNA, 17 nt, Staphylococcus aureus subsp. aureus MW2
ccaugauuagcgcacca

SEQ ID NO: 2097564 - RNA, 19 nt, Staphylococcus aureus subsp. aureus MW2
ccaugauuagcgcaccaau

SEQ ID NO: 2097565 - RNA, 21 nt, Staphylococcus aureus subsp. aureus MW2
ccccuagcaaaaauacuuuuu

SEQ ID NO: 2097566 - RNA, 14 nt, Staphylococcus aureus subsp. aureus MW2
ccccuagcaaaaau

SEQ ID NO: 2097567 - RNA, 16 nt, Staphylococcus aureus subsp. aureus MW2
ccccaggccagucaau

SEQ ID NO: 2097568 - RNA, 19 nt, Staphylococcus aureus subsp. aureus MW2
cccauugcuuguccucuaa

SEQ ID NO: 2097569 - RNA, 14 nt, Staphylococcus aureus subsp. aureus MW2
cccauccccaacuu

SEQ ID NO: 2097570 - RNA, 16 nt, Staphylococcus aureus subsp. aureus MW2
cccaggugcaucuuuu

SEQ ID NO: 2097571 - RNA, 16 nt, Staphylococcus aureus subsp. aureus MW2
ccauucaauguuuaau

SEQ ID NO: 2097572 - RNA, 18 nt, Staphylococcus aureus subsp. aureus MW2
ccauuaaaccuaaucugc

SEQ ID NO: 2097573 - RNA, 19 nt, Staphylococcus aureus subsp. aureus MW2
ccauuaaugcucuauauau

SEQ ID NO: 2097574 - RNA, 13 nt, Staphylococcus aureus subsp. aureus MW2
ccauuaauaaaac

SEQ ID NO: 2097575 - RNA, 19 nt, Staphylococcus aureus subsp. aureus MW2
ccauuaauaaaacugcaau

SEQ ID NO: 2097576 - RNA, 12 nt, Staphylococcus aureus subsp. aureus MW2
ccauucauuaag

SEQ ID NO: 2097577 - RNA, 23 nt, Staphylococcus aureus subsp. aureus MW2
ccauguauucuuagauauuauug

SEQ ID NO: 2097578 - RNA, 16 nt, Staphylococcus aureus subsp. aureus MW2
ccaugcucuuuuuccc

SEQ ID NO: 2097579 - RNA, 15 nt, Staphylococcus aureus subsp. aureus MW2
cccaauuucucugug

SEQ ID NO: 2097580 - RNA, 20 nt, Staphylococcus aureus subsp. aureus MW2
cccaauucggauuauauuua

SEQ ID NO: 2097581 - RNA, 18 nt, Staphylococcus aureus subsp. aureus MW2
cccaagaugguauugcuu

SEQ ID NO: 2097582 - RNA, 13 nt, Staphylococcus aureus subsp. aureus MW2
cccaacuugcauu

SEQ ID NO: 2097583 - RNA, 22 nt, Staphylococcus aureus subsp. aureus MW2
ccauuguccaacugcuuuuuau

SEQ ID NO: 2097584 - RNA, 14 nt, Staphylococcus aureus subsp. aureus MW2
cccaagcucuuuuu

SEQ ID NO: 2097585 - RNA, 20 nt, Staphylococcus aureus subsp. aureus MW2
cgacauguccauaauauccu

SEQ ID NO: 2097586 - RNA, 10 nt, Staphylococcus aureus subsp. aureus MW2
cgacaucuag

SEQ ID NO: 2097587 - RNA, 20 nt, Staphylococcus aureus subsp. aureus MW2
cgacaucuagaugaaauugu

SEQ ID NO: 2097588 - RNA, 15 nt, Staphylococcus aureus subsp. aureus MW2
cgacaugaaaguugu

SEQ ID NO: 2097589 - RNA, 18 nt, Staphylococcus aureus subsp. aureus MW2
cgacauuuguaaauauuu

SEQ ID NO: 2097590 - RNA, 22 nt, Staphylococcus aureus subsp. aureus MW2
cgaauguuccuuguuuuaaacu

SEQ ID NO: 2097591 - RNA, 15 nt, Staphylococcus aureus subsp. aureus MW2
cgaauuaaaauaacu

SEQ ID NO: 2097592 - RNA, 17 nt, Staphylococcus aureus subsp. aureus MW2
cgaauugguaaaaaucu

SEQ ID NO: 2097593 - RNA, 20 nt, Staphylococcus aureus subsp. aureus MW2
cgaauucaccuucccaguca

SEQ ID NO: 2097594 - RNA, 14 nt, Staphylococcus aureus subsp. aureus MW2
cgaauucauuaacg

SEQ ID NO: 2097595 - RNA, 16 nt, Staphylococcus aureus subsp. aureus MW2
cgaauaacuguuuauc

SEQ ID NO: 2097596 - RNA, 15 nt, Staphylococcus aureus subsp. aureus MW2
cgaauagaaaauaau

SEQ ID NO: 2097597 - RNA, 17 nt, Staphylococcus aureus subsp. aureus MW2
cgacacgaacaacauua

SEQ ID NO: 2097598 - RNA, 19 nt, Staphylococcus aureus subsp. aureus MW2
cgacacguguaaaaaugau

SEQ ID NO: 2097599 - RNA, 16 nt, Staphylococcus aureus subsp. aureus MW2
cgacaccaacauauuu

SEQ ID NO: 2097600 - RNA, 14 nt, Staphylococcus aureus subsp. aureus MW2
cgacacauauaguu

SEQ ID NO: 2097601 - RNA, 19 nt, Staphylococcus aureus subsp. aureus MW2
cgacaaauuaaaaaacaau

SEQ ID NO: 2097602 - RNA, 15 nt, Staphylococcus aureus subsp. aureus MW2
cgaauuucauaguua

SEQ ID NO: 2097603 - RNA, 22 nt, Staphylococcus aureus subsp. aureus MW2
cgaauuuuuuuguacuuuucuu

SEQ ID NO: 2097604 - RNA, 19 nt, Staphylococcus aureus subsp. aureus MW2
cgaacuugcuuuguucuuc

SEQ ID NO: 2097605 - RNA, 22 nt, Staphylococcus aureus subsp. aureus MW2
cgaagugcaacaaaagugccag

SEQ ID NO: 2097606 - RNA, 23 nt, Staphylococcus aureus subsp. aureus MW2
cgaagggcggucaauuuuaccau

SEQ ID NO: 2097607 - RNA, 17 nt, Staphylococcus aureus subsp. aureus MW2
ccuucuugagcaucacu

SEQ ID NO: 2097608 - RNA, 17 nt, Staphylococcus aureus subsp. aureus MW2
ccuucgcauacuuuuuc

SEQ ID NO: 2097609 - RNA, 19 nt, Staphylococcus aureus subsp. aureus MW2
ccuucgcauacuuuuucag

SEQ ID NO: 2097610 - RNA, 19 nt, Staphylococcus aureus subsp. aureus MW2
ccuucgaagucauaugcau

SEQ ID NO: 2097611 - RNA, 23 nt, Staphylococcus aureus subsp. aureus MW2
ccuuguucacccaagcaugucac

SEQ ID NO: 2097612 - RNA, 18 nt, Staphylococcus aureus subsp. aureus MW2
ccuuguuggcuuuuuuaa

SEQ ID NO: 2097613 - RNA, 13 nt, Staphylococcus aureus subsp. aureus MW2
ccuuuaaaucauu

SEQ ID NO: 2097614 - RNA, 18 nt, Staphylococcus aureus subsp. aureus MW2
ccuuuaauuacacuacgc

SEQ ID NO: 2097615 - RNA, 13 nt, Staphylococcus aureus subsp. aureus MW2
ccuuuaauaauau

SEQ ID NO: 2097616 - RNA, 19 nt, Staphylococcus aureus subsp. aureus MW2
ccuuuacaacauacaugcc

SEQ ID NO: 2097617 - RNA, 17 nt, Staphylococcus aureus subsp. aureus MW2
ccuuuaauaauauugaa

SEQ ID NO: 2097618 - RNA, 21 nt, Staphylococcus aureus subsp. aureus MW2
ccuuggccuacuuuuucaaua

SEQ ID NO: 2097619 - RNA, 20 nt, Staphylococcus aureus subsp. aureus MW2
ccuuucauuuuggcaaaagc

SEQ ID NO: 2097620 - RNA, 20 nt, Staphylococcus aureus subsp. aureus MW2
ccuuucauaggucugcuucc

SEQ ID NO: 2097621 - RNA, 17 nt, Staphylococcus aureus subsp. aureus MW2
ccuuucaauaauaaauc

SEQ ID NO: 2097622 - RNA, 17 nt, Staphylococcus aureus subsp. aureus MW2
ccuuuagccaaugcuuc

SEQ ID NO: 2097623 - RNA, 16 nt, Staphylococcus aureus subsp. aureus MW2
ccuuuagccaaugcuu

SEQ ID NO: 2097624 - RNA, 18 nt, Staphylococcus aureus subsp. aureus MW2
ccuuuauauuuaguuagc

SEQ ID NO: 2097625 - RNA, 19 nt, Staphylococcus aureus subsp. aureus MW2
ccuuuaugugcaucauuua

SEQ ID NO: 2097626 - RNA, 16 nt, Staphylococcus aureus subsp. aureus MW2
ccuuuauuaccagcuu

SEQ ID NO: 2097627 - RNA, 16 nt, Staphylococcus aureus subsp. aureus MW2
ccuuucuaauauuuug

SEQ ID NO: 2097628 - RNA, 20 nt, Staphylococcus aureus subsp. aureus MW2
ccuuugauuuaauaauauuu

SEQ ID NO: 2097629 - RNA, 23 nt, Staphylococcus aureus subsp. aureus MW2
ccuuuguuugaagugaaaaauuu

SEQ ID NO: 2097630 - RNA, 17 nt, Staphylococcus aureus subsp. aureus MW2
ccuuugcuuaaaccuua

SEQ ID NO: 2097631 - RNA, 10 nt, Staphylococcus aureus subsp. aureus MW2
cgaaaagaaa

SEQ ID NO: 2097632 - RNA, 23 nt, Staphylococcus aureus subsp. aureus MW2
cgaaaaccucuguuuuguuggug

SEQ ID NO: 2097633 - RNA, 22 nt, Staphylococcus aureus subsp. aureus MW2
cgaaaaaaucggacagcugaaa

SEQ ID NO: 2097634 - RNA, 22 nt, Staphylococcus aureus subsp. aureus MW2
cgaaaauagcuauuaaaauaga

SEQ ID NO: 2097635 - RNA, 19 nt, Staphylococcus aureus subsp. aureus MW2
cgaaaagucagcuuacaau

SEQ ID NO: 2097636 - RNA, 21 nt, Staphylococcus aureus subsp. aureus MW2
cgaaaagucagcuuacaauaa

SEQ ID NO: 2097637 - RNA, 18 nt, Staphylococcus aureus subsp. aureus MW2
ccuuuuuuaacuuuaaca

SEQ ID NO: 2097638 - RNA, 18 nt, Staphylococcus aureus subsp. aureus MW2
ccuuuuuuaggcagguac

SEQ ID NO: 2097639 - RNA, 13 nt, Staphylococcus aureus subsp. aureus MW2
ccuuuuuguaauu

SEQ ID NO: 2097640 - RNA, 15 nt, Staphylococcus aureus subsp. aureus MW2
ccuuuuguuucaaau

SEQ ID NO: 2097641 - RNA, 20 nt, Staphylococcus aureus subsp. aureus MW2
ccuuuuguuucaaauuuugu

SEQ ID NO: 2097642 - RNA, 22 nt, Staphylococcus aureus subsp. aureus MW2
ccuuuugauguuuaugacaaag

SEQ ID NO: 2097643 - RNA, 13 nt, Staphylococcus aureus subsp. aureus MW2
cgaacaaaugaaa

SEQ ID NO: 2097644 - RNA, 21 nt, Staphylococcus aureus subsp. aureus MW2
cgaaaugcauugagcaucuug

SEQ ID NO: 2097645 - RNA, 19 nt, Staphylococcus aureus subsp. aureus MW2
cgaaauaguucaaaauacu

SEQ ID NO: 2097646 - RNA, 13 nt, Staphylococcus aureus subsp. aureus MW2
cgaaauaaauuuu

SEQ ID NO: 2097647 - RNA, 15 nt, Staphylococcus aureus subsp. aureus MW2
cgauuguuucaccag

SEQ ID NO: 2097648 - RNA, 19 nt, Staphylococcus aureus subsp. aureus MW2
cgauucgugauuuggaaua

SEQ ID NO: 2097649 - RNA, 15 nt, Staphylococcus aureus subsp. aureus MW2
cgauuuuaaagaaaa

SEQ ID NO: 2097650 - RNA, 15 nt, Staphylococcus aureus subsp. aureus MW2
cgauuuguucaauga

SEQ ID NO: 2097651 - RNA, 12 nt, Staphylococcus aureus subsp. aureus MW2
cgauuuuaaaga

SEQ ID NO: 2097652 - RNA, 13 nt, Staphylococcus aureus subsp. aureus MW2
cgauuuucaagua

SEQ ID NO: 2097653 - RNA, 18 nt, Staphylococcus aureus subsp. aureus MW2
cgauuuuauuaugacaag

SEQ ID NO: 2097654 - RNA, 21 nt, Staphylococcus aureus subsp. aureus MW2
cgauuuauuuauaaaauaaaa

SEQ ID NO: 2097655 - RNA, 22 nt, Staphylococcus aureus subsp. aureus MW2
cgauuucuuuaugauaauaaga

SEQ ID NO: 2097656 - RNA, 21 nt, Staphylococcus aureus subsp. aureus MW2
cgauuugauuuauauuuuuug

SEQ ID NO: 2097657 - RNA, 14 nt, Staphylococcus aureus subsp. aureus MW2
cgcaaugucuugug

SEQ ID NO: 2097658 - RNA, 21 nt, Staphylococcus aureus subsp. aureus MW2
cgcacaacugcauauaaaguc

SEQ ID NO: 2097659 - RNA, 13 nt, Staphylococcus aureus subsp. aureus MW2
cgcacauuauuuu

SEQ ID NO: 2097660 - RNA, 13 nt, Staphylococcus aureus subsp. aureus MW2
cgcaagagauaag

SEQ ID NO: 2097661 - RNA, 22 nt, Staphylococcus aureus subsp. aureus MW2
cgccaauacagaacuuuaauaa

SEQ ID NO: 2097662 - RNA, 17 nt, Staphylococcus aureus subsp. aureus MW2
cgccaacuaaaucacca

SEQ ID NO: 2097663 - RNA, 16 nt, Staphylococcus aureus subsp. aureus MW2
cgccaacuaauguuaa

SEQ ID NO: 2097664 - RNA, 11 nt, Staphylococcus aureus subsp. aureus MW2
cgcauacuuuu

SEQ ID NO: 2097665 - RNA, 15 nt, Staphylococcus aureus subsp. aureus MW2
cgcaucaaaaaugag

SEQ ID NO: 2097666 - RNA, 17 nt, Staphylococcus aureus subsp. aureus MW2
cgagccauuauuauuuu

SEQ ID NO: 2097667 - RNA, 18 nt, Staphylococcus aureus subsp. aureus MW2
cgagcaguauauaucaaa

SEQ ID NO: 2097668 - RNA, 13 nt, Staphylococcus aureus subsp. aureus MW2
cgagcaauucuuc

SEQ ID NO: 2097669 - RNA, 16 nt, Staphylococcus aureus subsp. aureus MW2
cgagagagaaaagcua

SEQ ID NO: 2097670 - RNA, 11 nt, Staphylococcus aureus subsp. aureus MW2
cgagaaucucc

SEQ ID NO: 2097671 - RNA, 16 nt, Staphylococcus aureus subsp. aureus MW2
cgagaauucaauuucu

SEQ ID NO: 2097672 - RNA, 17 nt, Staphylococcus aureus subsp. aureus MW2
cgagacauuucuucaau

SEQ ID NO: 2097673 - RNA, 19 nt, Staphylococcus aureus subsp. aureus MW2
cgagacauuucuucaauuu

SEQ ID NO: 2097674 - RNA, 16 nt, Staphylococcus aureus subsp. aureus MW2
cgacuuucacuacauu

SEQ ID NO: 2097675 - RNA, 14 nt, Staphylococcus aureus subsp. aureus MW2
cgacuuaacuuaag

SEQ ID NO: 2097676 - RNA, 15 nt, Staphylococcus aureus subsp. aureus MW2
cgacuucauuacaaa

SEQ ID NO: 2097677 - RNA, 16 nt, Staphylococcus aureus subsp. aureus MW2
cgacguuuaaaugccc

SEQ ID NO: 2097678 - RNA, 21 nt, Staphylococcus aureus subsp. aureus MW2
cgauauguuuggauaucuuug

SEQ ID NO: 2097679 - RNA, 24 nt, Staphylococcus aureus subsp. aureus MW2
cgauauucuccaacucuaacagcu

SEQ ID NO: 2097680 - RNA, 20 nt, Staphylococcus aureus subsp. aureus MW2
cgauauggucuuuuaauauu

SEQ ID NO: 2097681 - RNA, 13 nt, Staphylococcus aureus subsp. aureus MW2
cgauagauaucau

SEQ ID NO: 2097682 - RNA, 21 nt, Staphylococcus aureus subsp. aureus MW2
cgauaauuguugcauuacuuu

SEQ ID NO: 2097683 - RNA, 13 nt, Staphylococcus aureus subsp. aureus MW2
cgauaauaacuag

SEQ ID NO: 2097684 - RNA, 17 nt, Staphylococcus aureus subsp. aureus MW2
cgauaagcaaaaauucu

SEQ ID NO: 2097685 - RNA, 20 nt, Staphylococcus aureus subsp. aureus MW2
cgaguguuuuaaucuuauuc

SEQ ID NO: 2097686 - RNA, 16 nt, Staphylococcus aureus subsp. aureus MW2
cgaguuauaucuucuu

SEQ ID NO: 2097687 - RNA, 15 nt, Staphylococcus aureus subsp. aureus MW2
cgaggucuuuaauuu

SEQ ID NO: 2097688 - RNA, 17 nt, Staphylococcus aureus subsp. aureus MW2
cgaggucuuuaauuuau

SEQ ID NO: 2097689 - RNA, 19 nt, Staphylococcus aureus subsp. aureus MW2
cgaggaaauccuuaaaugg

SEQ ID NO: 2097690 - RNA, 20 nt, Staphylococcus aureus subsp. aureus MW2
cgagcuuugcucauagauga

SEQ ID NO: 2097691 - RNA, 14 nt, Staphylococcus aureus subsp. aureus MW2
ccggcuuuuucuuu

SEQ ID NO: 2097692 - RNA, 15 nt, Staphylococcus aureus subsp. aureus MW2
ccggcuuuuucuuuu

SEQ ID NO: 2097693 - RNA, 23 nt, Staphylococcus aureus subsp. aureus MW2
ccuaauucgccaucuuuuuuagc

SEQ ID NO: 2097694 - RNA, 17 nt, Staphylococcus aureus subsp. aureus MW2
ccuaauucgccaucuuu

SEQ ID NO: 2097695 - RNA, 22 nt, Staphylococcus aureus subsp. aureus MW2
ccuacagauuuuaaaaauucau

SEQ ID NO: 2097696 - RNA, 12 nt, Staphylococcus aureus subsp. aureus MW2
ccuaaugauaau

SEQ ID NO: 2097697 - RNA, 20 nt, Staphylococcus aureus subsp. aureus MW2
ccuaauggucgugcuugcgg

SEQ ID NO: 2097698 - RNA, 21 nt, Staphylococcus aureus subsp. aureus MW2
ccuaauacacuugcuaaaacu

SEQ ID NO: 2097699 - RNA, 22 nt, Staphylococcus aureus subsp. aureus MW2
ccuaaucugcaacgauuuuaaa

SEQ ID NO: 2097700 - RNA, 13 nt, Staphylococcus aureus subsp. aureus MW2
ccuaacuuuuauu

SEQ ID NO: 2097701 - RNA, 19 nt, Staphylococcus aureus subsp. aureus MW2
ccuaacguguuugagauau

SEQ ID NO: 2097702 - RNA, 21 nt, Staphylococcus aureus subsp. aureus MW2
ccguuugaagucuguuuagaa

SEQ ID NO: 2097703 - RNA, 13 nt, Staphylococcus aureus subsp. aureus MW2
ccguuauuuuuuu

SEQ ID NO: 2097704 - RNA, 16 nt, Staphylococcus aureus subsp. aureus MW2
ccucgguauucaauuc

SEQ ID NO: 2097705 - RNA, 12 nt, Staphylococcus aureus subsp. aureus MW2
ccucuugccuug

SEQ ID NO: 2097706 - RNA, 22 nt, Staphylococcus aureus subsp. aureus MW2
ccucugauacuucaccaucuuu

SEQ ID NO: 2097707 - RNA, 22 nt, Staphylococcus aureus subsp. aureus MW2
ccucuuguucuccgaucaugcc

SEQ ID NO: 2097708 - RNA, 21 nt, Staphylococcus aureus subsp. aureus MW2
ccugcaacuuuugguaauuua

SEQ ID NO: 2097709 - RNA, 18 nt, Staphylococcus aureus subsp. aureus MW2
ccugcauauucacgauau

SEQ ID NO: 2097710 - RNA, 20 nt, Staphylococcus aureus subsp. aureus MW2
ccgauuuauuuauaaaauaa

SEQ ID NO: 2097711 - RNA, 17 nt, Staphylococcus aureus subsp. aureus MW2
ccgauuuugauauaaaa

SEQ ID NO: 2097712 - RNA, 18 nt, Staphylococcus aureus subsp. aureus MW2
ccgauuuugauauaaaaa

SEQ ID NO: 2097713 - RNA, 15 nt, Staphylococcus aureus subsp. aureus MW2
ccgcacuucuauauu

SEQ ID NO: 2097714 - RNA, 18 nt, Staphylococcus aureus subsp. aureus MW2
ccgcacuucuauauuaau

SEQ ID NO: 2097715 - RNA, 19 nt, Staphylococcus aureus subsp. aureus MW2
ccgaacaucugaaaaaauu

SEQ ID NO: 2097716 - RNA, 18 nt, Staphylococcus aureus subsp. aureus MW2
ccgaaaauugcuaaaaaa

SEQ ID NO: 2097717 - RNA, 21 nt, Staphylococcus aureus subsp. aureus MW2
ccgaaaauugcuaaaaaaauu

SEQ ID NO: 2097718 - RNA, 20 nt, Staphylococcus aureus subsp. aureus MW2
cccuucccuaucauacauau

SEQ ID NO: 2097719 - RNA, 13 nt, Staphylococcus aureus subsp. aureus MW2
cccuuagucaugu

SEQ ID NO: 2097720 - RNA, 13 nt, Staphylococcus aureus subsp. aureus MW2
cccuguaaaacca

SEQ ID NO: 2097721 - RNA, 14 nt, Staphylococcus aureus subsp. aureus MW2
cccuggaaaaugau

SEQ ID NO: 2097722 - RNA, 15 nt, Staphylococcus aureus subsp. aureus MW2
cccugcuguuuuauu

SEQ ID NO: 2097723 - RNA, 13 nt, Staphylococcus aureus subsp. aureus MW2
ccggaaauuaaau

SEQ ID NO: 2097724 - RNA, 16 nt, Staphylococcus aureus subsp. aureus MW2
ccggaacauuaaaagg

SEQ ID NO: 2097725 - RNA, 15 nt, Staphylococcus aureus subsp. aureus MW2
cgggaacaucauaau

SEQ ID NO: 2097726 - RNA, 14 nt, Staphylococcus aureus subsp. aureus MW2
cgguauuuucaaag

SEQ ID NO: 2097727 - RNA, 21 nt, Staphylococcus aureus subsp. aureus MW2
cggucaaagcgaauagaaggu

SEQ ID NO: 2097728 - RNA, 22 nt, Staphylococcus aureus subsp. aureus MW2
cgguacgaagugcaacaaaagu

SEQ ID NO: 2097729 - RNA, 23 nt, Staphylococcus aureus subsp. aureus MW2
cgguacgaagugcaacaaaagug

SEQ ID NO: 2097730 - RNA, 21 nt, Staphylococcus aureus subsp. aureus MW2
cgguacuucgcccuuccauuc

SEQ ID NO: 2097731 - RNA, 18 nt, Staphylococcus aureus subsp. aureus MW2
cgguaggaccucuuauuu

SEQ ID NO: 2097732 - RNA, 18 nt, Staphylococcus aureus subsp. aureus MW2
cggggccccaacacagag

SEQ ID NO: 2097733 - RNA, 19 nt, Staphylococcus aureus subsp. aureus MW2
cggggccccaacaaagaag

SEQ ID NO: 2097734 - RNA, 21 nt, Staphylococcus aureus subsp. aureus MW2
cggggccccaacauagaagcu

SEQ ID NO: 2097735 - RNA, 20 nt, Staphylococcus aureus subsp. aureus MW2
cguaagcaguuaauaagaaa

SEQ ID NO: 2097736 - RNA, 22 nt, Staphylococcus aureus subsp. aureus MW2
cguaacuguuuuaaauuaacuu

SEQ ID NO: 2097737 - RNA, 19 nt, Staphylococcus aureus subsp. aureus MW2
cguaacucuuuaauuuuac

SEQ ID NO: 2097738 - RNA, 18 nt, Staphylococcus aureus subsp. aureus MW2
cguaacauuuaaaaaaug

SEQ ID NO: 2097739 - RNA, 14 nt, Staphylococcus aureus subsp. aureus MW2
cgguucauaaugau

SEQ ID NO: 2097740 - RNA, 22 nt, Staphylococcus aureus subsp. aureus MW2
cguaauuuaccuauuugcugaa

SEQ ID NO: 2097741 - RNA, 21 nt, Staphylococcus aureus subsp. aureus MW2
cguaauuuaugauuguuuauu

SEQ ID NO: 2097742 - RNA, 20 nt, Staphylococcus aureus subsp. aureus MW2
cguacguugauguguugcau

SEQ ID NO: 2097743 - RNA, 14 nt, Staphylococcus aureus subsp. aureus MW2
cgguucaucuaaaa

SEQ ID NO: 2097744 - RNA, 23 nt, Staphylococcus aureus subsp. aureus MW2
cggacaauaacagcuacaaauaa

SEQ ID NO: 2097745 - RNA, 13 nt, Staphylococcus aureus subsp. aureus MW2
cggacugaaagaa

SEQ ID NO: 2097746 - RNA, 10 nt, Staphylococcus aureus subsp. aureus MW2
cggacugaug

SEQ ID NO: 2097747 - RNA, 15 nt, Staphylococcus aureus subsp. aureus MW2
cggaauaacuuuuua

SEQ ID NO: 2097748 - RNA, 12 nt, Staphylococcus aureus subsp. aureus MW2
cggaauaaaaua

SEQ ID NO: 2097749 - RNA, 17 nt, Staphylococcus aureus subsp. aureus MW2
cggaauauuaacaccag

SEQ ID NO: 2097750 - RNA, 16 nt, Staphylococcus aureus subsp. aureus MW2
cgcuuucuauuuauug

SEQ ID NO: 2097751 - RNA, 14 nt, Staphylococcus aureus subsp. aureus MW2
cgcuuauuuuacua

SEQ ID NO: 2097752 - RNA, 20 nt, Staphylococcus aureus subsp. aureus MW2
cgcuucauagucacuuuuaa

SEQ ID NO: 2097753 - RNA, 16 nt, Staphylococcus aureus subsp. aureus MW2
cgcuuguaacaagcuu

SEQ ID NO: 2097754 - RNA, 14 nt, Staphylococcus aureus subsp. aureus MW2
cgcuacaaaacaua

SEQ ID NO: 2097755 - RNA, 22 nt, Staphylococcus aureus subsp. aureus MW2
cgcuauauguaaagcuaauuuu

SEQ ID NO: 2097756 - RNA, 16 nt, Staphylococcus aureus subsp. aureus MW2
cgcuccaagauuauga

SEQ ID NO: 2097757 - RNA, 17 nt, Staphylococcus aureus subsp. aureus MW2
cgugccuuaacuucaua

SEQ ID NO: 2097758 - RNA, 18 nt, Staphylococcus aureus subsp. aureus MW2
cgugauggcuacuuuuuc

SEQ ID NO: 2097759 - RNA, 22 nt, Staphylococcus aureus subsp. aureus MW2
cgugauuacauucuauacuuuu

SEQ ID NO: 2097760 - RNA, 20 nt, Staphylococcus aureus subsp. aureus MW2
cgugauuuggaauacuuuuc

SEQ ID NO: 2097761 - RNA, 22 nt, Staphylococcus aureus subsp. aureus MW2
cgugauuuggaauacuuuucuu

SEQ ID NO: 2097762 - RNA, 13 nt, Staphylococcus aureus subsp. aureus MW2
cgucgugauggcu

SEQ ID NO: 2097763 - RNA, 18 nt, Staphylococcus aureus subsp. aureus MW2
cgucuaauuuuaaucauu

SEQ ID NO: 2097764 - RNA, 16 nt, Staphylococcus aureus subsp. aureus MW2
cgucuuguaaacuucu

SEQ ID NO: 2097765 - RNA, 17 nt, Staphylococcus aureus subsp. aureus MW2
cgucuuguaaacuucuu

SEQ ID NO: 2097766 - RNA, 12 nt, Staphylococcus aureus subsp. aureus MW2
cgucuuguaaac

SEQ ID NO: 2097767 - RNA, 14 nt, Staphylococcus aureus subsp. aureus MW2
cgucuuuuuauacu

SEQ ID NO: 2097768 - RNA, 15 nt, Staphylococcus aureus subsp. aureus MW2
cgugaaagaaaaaac

SEQ ID NO: 2097769 - RNA, 16 nt, Staphylococcus aureus subsp. aureus MW2
cgugaaagaaaaaacu

SEQ ID NO: 2097770 - RNA, 17 nt, Staphylococcus aureus subsp. aureus MW2
cgugaaagaaaaaacuu

SEQ ID NO: 2097771 - RNA, 18 nt, Staphylococcus aureus subsp. aureus MW2
cgucuucaauuaaugauu

SEQ ID NO: 2097772 - RNA, 22 nt, Staphylococcus aureus subsp. aureus MW2
cgucuucaauuaaugauucacc

SEQ ID NO: 2097773 - RNA, 16 nt, Staphylococcus aureus subsp. aureus MW2
cguccgaagucaccuu

SEQ ID NO: 2097774 - RNA, 20 nt, Staphylococcus aureus subsp. aureus MW2
cgucccaccccaacuugcau

SEQ ID NO: 2097775 - RNA, 15 nt, Staphylococcus aureus subsp. aureus MW2
cuaaccacuucuuca

SEQ ID NO: 2097776 - RNA, 16 nt, Staphylococcus aureus subsp. aureus MW2
cuaaccacuucuucac

SEQ ID NO: 2097777 - RNA, 14 nt, Staphylococcus aureus subsp. aureus MW2
cuaaccaaauaauu

SEQ ID NO: 2097778 - RNA, 18 nt, Staphylococcus aureus subsp. aureus MW2
cuaaccaucauaaauguu

SEQ ID NO: 2097779 - RNA, 16 nt, Staphylococcus aureus subsp. aureus MW2
cuaaccuauuaaaaua

SEQ ID NO: 2097780 - RNA, 16 nt, Staphylococcus aureus subsp. aureus MW2
cuaacuuguuuauuca

SEQ ID NO: 2097781 - RNA, 13 nt, Staphylococcus aureus subsp. aureus MW2
cuaagucuuuuga

SEQ ID NO: 2097782 - RNA, 16 nt, Staphylococcus aureus subsp. aureus MW2
cuaagucuuuugaagu

SEQ ID NO: 2097783 - RNA, 16 nt, Staphylococcus aureus subsp. aureus MW2
cuaagugaauuaucua

SEQ ID NO: 2097784 - RNA, 13 nt, Staphylococcus aureus subsp. aureus MW2
cuaaguuugaauc

SEQ ID NO: 2097785 - RNA, 12 nt, Staphylococcus aureus subsp. aureus MW2
cuaagcagucug

SEQ ID NO: 2097786 - RNA, 14 nt, Staphylococcus aureus subsp. aureus MW2
cuaaagauaauauu

SEQ ID NO: 2097787 - RNA, 23 nt, Staphylococcus aureus subsp. aureus MW2
cuaaaugcacuagcaacaucuuu

SEQ ID NO: 2097788 - RNA, 18 nt, Staphylococcus aureus subsp. aureus MW2
cuaaauggugucgauacu

SEQ ID NO: 2097789 - RNA, 16 nt, Staphylococcus aureus subsp. aureus MW2
cuaaaugguuaucuaa

SEQ ID NO: 2097790 - RNA, 12 nt, Staphylococcus aureus subsp. aureus MW2
cuaaauguaaaa

SEQ ID NO: 2097791 - RNA, 17 nt, Staphylococcus aureus subsp. aureus MW2
cuaaauguaaaaucauu

SEQ ID NO: 2097792 - RNA, 19 nt, Staphylococcus aureus subsp. aureus MW2
cuaaauguaaaaucauuaa

SEQ ID NO: 2097793 - RNA, 19 nt, Staphylococcus aureus subsp. aureus MW2
cuaaauucaauaaucuuag

SEQ ID NO: 2097794 - RNA, 16 nt, Staphylococcus aureus subsp. aureus MW2
cuaaauuauuguuuau

SEQ ID NO: 2097795 - RNA, 14 nt, Staphylococcus aureus subsp. aureus MW2
cuaaauucuuuuug

SEQ ID NO: 2097796 - RNA, 11 nt, Staphylococcus aureus subsp. aureus MW2
cuaaauugucg

SEQ ID NO: 2097797 - RNA, 13 nt, Staphylococcus aureus subsp. aureus MW2
cuaaauuuauaua

SEQ ID NO: 2097798 - RNA, 18 nt, Staphylococcus aureus subsp. aureus MW2
cuaaauuuucuaaaugug

SEQ ID NO: 2097799 - RNA, 13 nt, Staphylococcus aureus subsp. aureus MW2
cuaacauugguac

SEQ ID NO: 2097800 - RNA, 15 nt, Staphylococcus aureus subsp. aureus MW2
cuaacaguuaauaug

SEQ ID NO: 2097801 - RNA, 14 nt, Staphylococcus aureus subsp. aureus MW2
cuaacauaacugua

SEQ ID NO: 2097802 - RNA, 12 nt, Staphylococcus aureus subsp. aureus MW2
cuaaaaaauuug

SEQ ID NO: 2097803 - RNA, 18 nt, Staphylococcus aureus subsp. aureus MW2
cuaaaaaauuugcaugaa

SEQ ID NO: 2097804 - RNA, 22 nt, Staphylococcus aureus subsp. aureus MW2
cuaaaaaucuauauaacgcuuu

SEQ ID NO: 2097805 - RNA, 13 nt, Staphylococcus aureus subsp. aureus MW2
cuaaaaagucuuu

SEQ ID NO: 2097806 - RNA, 20 nt, Staphylococcus aureus subsp. aureus MW2
cuaaaaccuauuccuaauaa

SEQ ID NO: 2097807 - RNA, 19 nt, Staphylococcus aureus subsp. aureus MW2
cuaaaacauguugauaaaa

SEQ ID NO: 2097808 - RNA, 14 nt, Staphylococcus aureus subsp. aureus MW2
cuaaaaauaaaauc

SEQ ID NO: 2097809 - RNA, 19 nt, Staphylococcus aureus subsp. aureus MW2
cuaaacauuuuauacucug

SEQ ID NO: 2097810 - RNA, 16 nt, Staphylococcus aureus subsp. aureus MW2
cuaaaacuaucugauu

SEQ ID NO: 2097811 - RNA, 15 nt, Staphylococcus aureus subsp. aureus MW2
cuaaaacuuuuucaa

SEQ ID NO: 2097812 - RNA, 15 nt, Staphylococcus aureus subsp. aureus MW2
cuaaaccucaacauu

SEQ ID NO: 2097813 - RNA, 15 nt, Staphylococcus aureus subsp. aureus MW2
cuaaaccucuaaaua

SEQ ID NO: 2097814 - RNA, 16 nt, Staphylococcus aureus subsp. aureus MW2
cuaaaccucuaaauaa

SEQ ID NO: 2097815 - RNA, 19 nt, Staphylococcus aureus subsp. aureus MW2
cuaaaccgauuaauauaau

SEQ ID NO: 2097816 - RNA, 18 nt, Staphylococcus aureus subsp. aureus MW2
cuaaaccgauuaauauaa

SEQ ID NO: 2097817 - RNA, 20 nt, Staphylococcus aureus subsp. aureus MW2
cuaaacauuuuugugcaaaa

SEQ ID NO: 2097818 - RNA, 23 nt, Staphylococcus aureus subsp. aureus MW2
cuaaaccaaugauuguuaauaca

SEQ ID NO: 2097819 - RNA, 15 nt, Staphylococcus aureus subsp. aureus MW2
cuaaaccauugaaug

SEQ ID NO: 2097820 - RNA, 14 nt, Staphylococcus aureus subsp. aureus MW2
cuaaaaaaauguug

SEQ ID NO: 2097821 - RNA, 12 nt, Staphylococcus aureus subsp. aureus MW2
cuaaaaaacuaa

SEQ ID NO: 2097822 - RNA, 13 nt, Staphylococcus aureus subsp. aureus MW2
cguuuuuuuaaau

SEQ ID NO: 2097823 - RNA, 14 nt, Staphylococcus aureus subsp. aureus MW2
cguucuguuuugcg

SEQ ID NO: 2097824 - RNA, 10 nt, Staphylococcus aureus subsp. aureus MW2
cguucugcua

SEQ ID NO: 2097825 - RNA, 11 nt, Staphylococcus aureus subsp. aureus MW2
cguucugcuaa

SEQ ID NO: 2097826 - RNA, 12 nt, Staphylococcus aureus subsp. aureus MW2
cguucugcuaau

SEQ ID NO: 2097827 - RNA, 21 nt, Staphylococcus aureus subsp. aureus MW2
cguucuugguauuuuuuaaau

SEQ ID NO: 2097828 - RNA, 17 nt, Staphylococcus aureus subsp. aureus MW2
cguugguauucaucuuc

SEQ ID NO: 2097829 - RNA, 18 nt, Staphylococcus aureus subsp. aureus MW2
cguugguugugauuuguu

SEQ ID NO: 2097830 - RNA, 18 nt, Staphylococcus aureus subsp. aureus MW2
cguuuaccgucuuuugca

SEQ ID NO: 2097831 - RNA, 14 nt, Staphylococcus aureus subsp. aureus MW2
cguuuaaauucauu

SEQ ID NO: 2097832 - RNA, 21 nt, Staphylococcus aureus subsp. aureus MW2
cguuuaacaaacguuguucaa

SEQ ID NO: 2097833 - RNA, 20 nt, Staphylococcus aureus subsp. aureus MW2
cguucaauacaaacacccac

SEQ ID NO: 2097834 - RNA, 16 nt, Staphylococcus aureus subsp. aureus MW2
cguuauuuucaauaaa

SEQ ID NO: 2097835 - RNA, 22 nt, Staphylococcus aureus subsp. aureus MW2
cguuacuuuggucaacuuuuuc

SEQ ID NO: 2097836 - RNA, 15 nt, Staphylococcus aureus subsp. aureus MW2
cguucccauucuuug

SEQ ID NO: 2097837 - RNA, 17 nt, Staphylococcus aureus subsp. aureus MW2
cguucaauguuauuaaa

SEQ ID NO: 2097838 - RNA, 10 nt, Staphylococcus aureus subsp. aureus MW2
cguucaauuu

SEQ ID NO: 2097839 - RNA, 16 nt, Staphylococcus aureus subsp. aureus MW2
cguguuuaauauuguu

SEQ ID NO: 2097840 - RNA, 11 nt, Staphylococcus aureus subsp. aureus MW2
cguuaaaaaga

SEQ ID NO: 2097841 - RNA, 20 nt, Staphylococcus aureus subsp. aureus MW2
cguuaauaaaccuacaauau

SEQ ID NO: 2097842 - RNA, 15 nt, Staphylococcus aureus subsp. aureus MW2
cguuaaauauauauu

SEQ ID NO: 2097843 - RNA, 20 nt, Staphylococcus aureus subsp. aureus MW2
cguguauacaacauguguau

SEQ ID NO: 2097844 - RNA, 14 nt, Staphylococcus aureus subsp. aureus MW2
cguguaaaaaugau

SEQ ID NO: 2097845 - RNA, 21 nt, Staphylococcus aureus subsp. aureus MW2
cgugguucaaaaaucauacca

SEQ ID NO: 2097846 - RNA, 14 nt, Staphylococcus aureus subsp. aureus MW2
cgugguaugauuuu

SEQ ID NO: 2097847 - RNA, 17 nt, Staphylococcus aureus subsp. aureus MW2
cuccaaaaauaauuaaa

SEQ ID NO: 2097848 - RNA, 21 nt, Staphylococcus aureus subsp. aureus MW2
cucauuuucuacgaauacuaa

SEQ ID NO: 2097849 - RNA, 21 nt, Staphylococcus aureus subsp. aureus MW2
cucauuuguauagauuguauu

SEQ ID NO: 2097850 - RNA, 22 nt, Staphylococcus aureus subsp. aureus MW2
cuccuaaagguaacuuuuuaac

SEQ ID NO: 2097851 - RNA, 18 nt, Staphylococcus aureus subsp. aureus MW2
cuccuauuaauauauaua

SEQ ID NO: 2097852 - RNA, 14 nt, Staphylococcus aureus subsp. aureus MW2
cuccuacuccauag

SEQ ID NO: 2097853 - RNA, 20 nt, Staphylococcus aureus subsp. aureus MW2
cuccuaccgcuaaaauucuu

SEQ ID NO: 2097854 - RNA, 16 nt, Staphylococcus aureus subsp. aureus MW2
cuccuaaauuauuguu

SEQ ID NO: 2097855 - RNA, 18 nt, Staphylococcus aureus subsp. aureus MW2
cuccauggcuuaaaucaa

SEQ ID NO: 2097856 - RNA, 13 nt, Staphylococcus aureus subsp. aureus MW2
cuccauuauaaag

SEQ ID NO: 2097857 - RNA, 20 nt, Staphylococcus aureus subsp. aureus MW2
cuccauuauaaagccugcaa

SEQ ID NO: 2097858 - RNA, 22 nt, Staphylococcus aureus subsp. aureus MW2
cucccuuaaauacaauuucuuc

SEQ ID NO: 2097859 - RNA, 18 nt, Staphylococcus aureus subsp. aureus MW2
cucccuuaaauacaauuu

SEQ ID NO: 2097860 - RNA, 23 nt, Staphylococcus aureus subsp. aureus MW2
cucgguuuuuucgguuuauuuaa

SEQ ID NO: 2097861 - RNA, 12 nt, Staphylococcus aureus subsp. aureus MW2
cucgguuuuuuc

SEQ ID NO: 2097862 - RNA, 12 nt, Staphylococcus aureus subsp. aureus MW2
cucuaaauaaaa

SEQ ID NO: 2097863 - RNA, 22 nt, Staphylococcus aureus subsp. aureus MW2
cucuaaacuucuauuaauaauu

SEQ ID NO: 2097864 - RNA, 15 nt, Staphylococcus aureus subsp. aureus MW2
cucuaaaauguucug

SEQ ID NO: 2097865 - RNA, 16 nt, Staphylococcus aureus subsp. aureus MW2
cucuaaauauaauaga

SEQ ID NO: 2097866 - RNA, 17 nt, Staphylococcus aureus subsp. aureus MW2
cucuaaaagccaucuua

SEQ ID NO: 2097867 - RNA, 17 nt, Staphylococcus aureus subsp. aureus MW2
cucgaugcuaauauuua

SEQ ID NO: 2097868 - RNA, 18 nt, Staphylococcus aureus subsp. aureus MW2
cucgauuuuuuuauauuu

SEQ ID NO: 2097869 - RNA, 19 nt, Staphylococcus aureus subsp. aureus MW2
cucgauuuuuuuauauuuu

SEQ ID NO: 2097870 - RNA, 20 nt, Staphylococcus aureus subsp. aureus MW2
cucgacuugguauuuauccu

SEQ ID NO: 2097871 - RNA, 11 nt, Staphylococcus aureus subsp. aureus MW2
cuauuuuuaau

SEQ ID NO: 2097872 - RNA, 12 nt, Staphylococcus aureus subsp. aureus MW2
cuauuuuuuaga

SEQ ID NO: 2097873 - RNA, 16 nt, Staphylococcus aureus subsp. aureus MW2
cuauuuuauacauaaa

SEQ ID NO: 2097874 - RNA, 18 nt, Staphylococcus aureus subsp. aureus MW2
cucaaagguuuacuauua

SEQ ID NO: 2097875 - RNA, 20 nt, Staphylococcus aureus subsp. aureus MW2
cucaaagguuuacuauuaaa

SEQ ID NO: 2097876 - RNA, 13 nt, Staphylococcus aureus subsp. aureus MW2
cuauuuuuuuaug

SEQ ID NO: 2097877 - RNA, 19 nt, Staphylococcus aureus subsp. aureus MW2
cuauuaauuacgucauaaa

SEQ ID NO: 2097878 - RNA, 23 nt, Staphylococcus aureus subsp. aureus MW2
cuauuaauugaaaugauaaaaau

SEQ ID NO: 2097879 - RNA, 20 nt, Staphylococcus aureus subsp. aureus MW2
cuauuaacugaccuaacaau

SEQ ID NO: 2097880 - RNA, 12 nt, Staphylococcus aureus subsp. aureus MW2
cuauuaaauaau

SEQ ID NO: 2097881 - RNA, 16 nt, Staphylococcus aureus subsp. aureus MW2
cuauuaauagcaccau

SEQ ID NO: 2097882 - RNA, 13 nt, Staphylococcus aureus subsp. aureus MW2
cuauuaauauaua

SEQ ID NO: 2097883 - RNA, 22 nt, Staphylococcus aureus subsp. aureus MW2
cuauuacuacauaauuuaucaa

SEQ ID NO: 2097884 - RNA, 15 nt, Staphylococcus aureus subsp. aureus MW2
cuauuacuauaaaaa

SEQ ID NO: 2097885 - RNA, 16 nt, Staphylococcus aureus subsp. aureus MW2
cuauuuaaaagacaau

SEQ ID NO: 2097886 - RNA, 12 nt, Staphylococcus aureus subsp. aureus MW2
cucaacauuuug

SEQ ID NO: 2097887 - RNA, 16 nt, Staphylococcus aureus subsp. aureus MW2
cucaagugauuuccca

SEQ ID NO: 2097888 - RNA, 23 nt, Staphylococcus aureus subsp. aureus MW2
cucaagugauuucccacgugccu

SEQ ID NO: 2097889 - RNA, 21 nt, Staphylococcus aureus subsp. aureus MW2
cucaauuuaguauaaauaaaa

SEQ ID NO: 2097890 - RNA, 23 nt, Staphylococcus aureus subsp. aureus MW2
cucaauuuaguauaaauaaaaau

SEQ ID NO: 2097891 - RNA, 18 nt, Staphylococcus aureus subsp. aureus MW2
cucaauucucuaacuuua

SEQ ID NO: 2097892 - RNA, 24 nt, Staphylococcus aureus subsp. aureus MW2
cucaauuucauuugaaauaguuaa

SEQ ID NO: 2097893 - RNA, 22 nt, Staphylococcus aureus subsp. aureus MW2
cucaaugauuguaauaucuaaa

SEQ ID NO: 2097894 - RNA, 13 nt, Staphylococcus aureus subsp. aureus MW2
cucaccaaguuca

SEQ ID NO: 2097895 - RNA, 15 nt, Staphylococcus aureus subsp. aureus MW2
cucaccuuuaucauu

SEQ ID NO: 2097896 - RNA, 16 nt, Staphylococcus aureus subsp. aureus MW2
cucaccuuuaucauua

SEQ ID NO: 2097897 - RNA, 14 nt, Staphylococcus aureus subsp. aureus MW2
cucagauucauauc

SEQ ID NO: 2097898 - RNA, 19 nt, Staphylococcus aureus subsp. aureus MW2
cucagauucauaucuuuca

SEQ ID NO: 2097899 - RNA, 20 nt, Staphylococcus aureus subsp. aureus MW2
cucauuagcgaaaacuaaag

SEQ ID NO: 2097900 - RNA, 14 nt, Staphylococcus aureus subsp. aureus MW2
cucauuagcgcaag

SEQ ID NO: 2097901 - RNA, 18 nt, Staphylococcus aureus subsp. aureus MW2
cucauuagcgaaaacuaa

SEQ ID NO: 2097902 - RNA, 17 nt, Staphylococcus aureus subsp. aureus MW2
cucaucuacuauuuaau

SEQ ID NO: 2097903 - RNA, 17 nt, Staphylococcus aureus subsp. aureus MW2
cucaucgaauucauuug

SEQ ID NO: 2097904 - RNA, 20 nt, Staphylococcus aureus subsp. aureus MW2
cucauccgccaauuaaaauu

SEQ ID NO: 2097905 - RNA, 20 nt, Staphylococcus aureus subsp. aureus MW2
cucagguauaggugcaguua

SEQ ID NO: 2097906 - RNA, 23 nt, Staphylococcus aureus subsp. aureus MW2
cuacgauuuucaagaccaaauau

SEQ ID NO: 2097907 - RNA, 15 nt, Staphylococcus aureus subsp. aureus MW2
cuacgcccaucauca

SEQ ID NO: 2097908 - RNA, 15 nt, Staphylococcus aureus subsp. aureus MW2
cuaccuguuggcuuu

SEQ ID NO: 2097909 - RNA, 16 nt, Staphylococcus aureus subsp. aureus MW2
cuacgaaguuauauug

SEQ ID NO: 2097910 - RNA, 15 nt, Staphylococcus aureus subsp. aureus MW2
cuaauacuuuaacug

SEQ ID NO: 2097911 - RNA, 20 nt, Staphylococcus aureus subsp. aureus MW2
cuaauagcauuuguaaacag

SEQ ID NO: 2097912 - RNA, 14 nt, Staphylococcus aureus subsp. aureus MW2
cuaauagcauuugu

SEQ ID NO: 2097913 - RNA, 18 nt, Staphylococcus aureus subsp. aureus MW2
cuacuacaaauuuuaaaa

SEQ ID NO: 2097914 - RNA, 15 nt, Staphylococcus aureus subsp. aureus MW2
cuacuauuaaauaau

SEQ ID NO: 2097915 - RNA, 23 nt, Staphylococcus aureus subsp. aureus MW2
cuacguguguaguagcaccgauu

SEQ ID NO: 2097916 - RNA, 15 nt, Staphylococcus aureus subsp. aureus MW2
cuacuaaauaacuau

SEQ ID NO: 2097917 - RNA, 19 nt, Staphylococcus aureus subsp. aureus MW2
cuagagcguuuugcuuuag

SEQ ID NO: 2097918 - RNA, 14 nt, Staphylococcus aureus subsp. aureus MW2
cuagaaaguaaugc

SEQ ID NO: 2097919 - RNA, 16 nt, Staphylococcus aureus subsp. aureus MW2
cuagaacauugauuau

SEQ ID NO: 2097920 - RNA, 13 nt, Staphylococcus aureus subsp. aureus MW2
cuauaugaaaaga

SEQ ID NO: 2097921 - RNA, 23 nt, Staphylococcus aureus subsp. aureus MW2
cuauaugaaauguucccuucaaa

SEQ ID NO: 2097922 - RNA, 20 nt, Staphylococcus aureus subsp. aureus MW2
cuauauccaguuaauuauuu

SEQ ID NO: 2097923 - RNA, 11 nt, Staphylococcus aureus subsp. aureus MW2
cuauaugcaua

SEQ ID NO: 2097924 - RNA, 19 nt, Staphylococcus aureus subsp. aureus MW2
cuauauauauuuaaaucaa

SEQ ID NO: 2097925 - RNA, 14 nt, Staphylococcus aureus subsp. aureus MW2
cuauauaguaaaau

SEQ ID NO: 2097926 - RNA, 20 nt, Staphylococcus aureus subsp. aureus MW2
cuauaucgucgauuucauua

SEQ ID NO: 2097927 - RNA, 21 nt, Staphylococcus aureus subsp. aureus MW2
cuauaucgucgauuucauuaa

SEQ ID NO: 2097928 - RNA, 14 nt, Staphylococcus aureus subsp. aureus MW2
cuauauaaaguuga

SEQ ID NO: 2097929 - RNA, 14 nt, Staphylococcus aureus subsp. aureus MW2
cuauauaauaauua

SEQ ID NO: 2097930 - RNA, 23 nt, Staphylococcus aureus subsp. aureus MW2
cuauauaaauguuuauaucuuuu

SEQ ID NO: 2097931 - RNA, 21 nt, Staphylococcus aureus subsp. aureus MW2
cuauauaacgcuuuaaaucau

SEQ ID NO: 2097932 - RNA, 24 nt, Staphylococcus aureus subsp. aureus MW2
cuaucuccgcuacaauuauaugua

SEQ ID NO: 2097933 - RNA, 21 nt, Staphylococcus aureus subsp. aureus MW2
cuaucuguaccguauuuuaau

SEQ ID NO: 2097934 - RNA, 20 nt, Staphylococcus aureus subsp. aureus MW2
cuaucucuuuaguuaaaagu

SEQ ID NO: 2097935 - RNA, 16 nt, Staphylococcus aureus subsp. aureus MW2
cuaucgccuaaaaaua

SEQ ID NO: 2097936 - RNA, 23 nt, Staphylococcus aureus subsp. aureus MW2
cuauggcgcaauuuuuaacaaaa

SEQ ID NO: 2097937 - RNA, 20 nt, Staphylococcus aureus subsp. aureus MW2
cuaugaaacuggauaaauaa

SEQ ID NO: 2097938 - RNA, 21 nt, Staphylococcus aureus subsp. aureus MW2
cuaugaaacuggauaaauaaa

SEQ ID NO: 2097939 - RNA, 21 nt, Staphylococcus aureus subsp. aureus MW2
cuaugauauauguaacauaaa

SEQ ID NO: 2097940 - RNA, 16 nt, Staphylococcus aureus subsp. aureus MW2
cuaucuuguucuucuu

SEQ ID NO: 2097941 - RNA, 14 nt, Staphylococcus aureus subsp. aureus MW2
cuaucuucagauuc

SEQ ID NO: 2097942 - RNA, 14 nt, Staphylococcus aureus subsp. aureus MW2
cuaucuuauauuua

SEQ ID NO: 2097943 - RNA, 20 nt, Staphylococcus aureus subsp. aureus MW2
cuauaauuggcagauagaau

SEQ ID NO: 2097944 - RNA, 13 nt, Staphylococcus aureus subsp. aureus MW2
cuauaauaauuaa

SEQ ID NO: 2097945 - RNA, 14 nt, Staphylococcus aureus subsp. aureus MW2
cuauaauaaagauu

SEQ ID NO: 2097946 - RNA, 16 nt, Staphylococcus aureus subsp. aureus MW2
cuauaaguauuuugaa

SEQ ID NO: 2097947 - RNA, 17 nt, Staphylococcus aureus subsp. aureus MW2
cuauaaucauuaaguaa

SEQ ID NO: 2097948 - RNA, 19 nt, Staphylococcus aureus subsp. aureus MW2
cuauaacucuaaauauaau

SEQ ID NO: 2097949 - RNA, 18 nt, Staphylococcus aureus subsp. aureus MW2
cuauaacucuaaauauaa

SEQ ID NO: 2097950 - RNA, 17 nt, Staphylococcus aureus subsp. aureus MW2
cuauaccauuccaaaaa

SEQ ID NO: 2097951 - RNA, 22 nt, Staphylococcus aureus subsp. aureus MW2
cuauacaauuauggauaaaauu

SEQ ID NO: 2097952 - RNA, 17 nt, Staphylococcus aureus subsp. aureus MW2
cuauaauuucuuaauua

SEQ ID NO: 2097953 - RNA, 21 nt, Staphylococcus aureus subsp. aureus MW2
cuauacaauuauggauaaaau

SEQ ID NO: 2097954 - RNA, 18 nt, Staphylococcus aureus subsp. aureus MW2
cuauacuccaguuuauaa

SEQ ID NO: 2097955 - RNA, 18 nt, Staphylococcus aureus subsp. aureus MW2
cuauacuuuaucuauuuc

SEQ ID NO: 2097956 - RNA, 15 nt, Staphylococcus aureus subsp. aureus MW2
cuauaaauaaaaaua

SEQ ID NO: 2097957 - RNA, 16 nt, Staphylococcus aureus subsp. aureus MW2
cuauaaauaaaaauau

SEQ ID NO: 2097958 - RNA, 23 nt, Staphylococcus aureus subsp. aureus MW2
cuauaaaaguacuuuaaaauugu

SEQ ID NO: 2097959 - RNA, 19 nt, Staphylococcus aureus subsp. aureus MW2
cuauaaaaguacuuuaaaa

SEQ ID NO: 2097960 - RNA, 16 nt, Staphylococcus aureus subsp. aureus MW2
cuauaacaccaauuaa

SEQ ID NO: 2097961 - RNA, 16 nt, Staphylococcus aureus subsp. aureus MW2
cuauaaccuauuaaau

SEQ ID NO: 2097962 - RNA, 15 nt, Staphylococcus aureus subsp. aureus MW2
cuauaacgauagauu

SEQ ID NO: 2097963 - RNA, 16 nt, Staphylococcus aureus subsp. aureus MW2
cuauaacgauagauuu

SEQ ID NO: 2097964 - RNA, 20 nt, Staphylococcus aureus subsp. aureus MW2
cuauaacgauagauuuuuuc

SEQ ID NO: 2097965 - RNA, 19 nt, Staphylococcus aureus subsp. aureus MW2
cuauaaccgcuacaauuau

SEQ ID NO: 2097966 - RNA, 23 nt, Staphylococcus aureus subsp. aureus MW2
cuauaaagaaugauuuauaaaaa

SEQ ID NO: 2097967 - RNA, 14 nt, Staphylococcus aureus subsp. aureus MW2
cuauaaauuauuuu

SEQ ID NO: 2097968 - RNA, 23 nt, Staphylococcus aureus subsp. aureus MW2
cuauaaauacgucaucuuuauuu

SEQ ID NO: 2097969 - RNA, 14 nt, Staphylococcus aureus subsp. aureus MW2
cuauaaauaucaau

SEQ ID NO: 2097970 - RNA, 17 nt, Staphylococcus aureus subsp. aureus MW2
cuaggauuaaaagcauc

SEQ ID NO: 2097971 - RNA, 22 nt, Staphylococcus aureus subsp. aureus MW2
cugauacagaaccaacaauaaa

SEQ ID NO: 2097972 - RNA, 17 nt, Staphylococcus aureus subsp. aureus MW2
cugauacagaaccaaca

SEQ ID NO: 2097973 - RNA, 19 nt, Staphylococcus aureus subsp. aureus MW2
cucuauuuacggcauaauu

SEQ ID NO: 2097974 - RNA, 17 nt, Staphylococcus aureus subsp. aureus MW2
cucuaucaguccgcuuu

SEQ ID NO: 2097975 - RNA, 13 nt, Staphylococcus aureus subsp. aureus MW2
cugaguucaauua

SEQ ID NO: 2097976 - RNA, 21 nt, Staphylococcus aureus subsp. aureus MW2
cugaguauuguuauugaugau

SEQ ID NO: 2097977 - RNA, 16 nt, Staphylococcus aureus subsp. aureus MW2
cugcaaucguugaaaa

SEQ ID NO: 2097978 - RNA, 15 nt, Staphylococcus aureus subsp. aureus MW2
cugcaguugauugca

SEQ ID NO: 2097979 - RNA, 19 nt, Staphylococcus aureus subsp. aureus MW2
cugcaaaauguuacacaaa

SEQ ID NO: 2097980 - RNA, 17 nt, Staphylococcus aureus subsp. aureus MW2
cugauuucuauuaauua

SEQ ID NO: 2097981 - RNA, 21 nt, Staphylococcus aureus subsp. aureus MW2
cugauuucuauuaauuauuug

SEQ ID NO: 2097982 - RNA, 22 nt, Staphylococcus aureus subsp. aureus MW2
cugcaaaauguuacacaaauua

SEQ ID NO: 2097983 - RNA, 16 nt, Staphylococcus aureus subsp. aureus MW2
cugcaaacacaguaca

SEQ ID NO: 2097984 - RNA, 21 nt, Staphylococcus aureus subsp. aureus MW2
cugcaaacacaguacaaauaa

SEQ ID NO: 2097985 - RNA, 20 nt, Staphylococcus aureus subsp. aureus MW2
cugcaagugccguccauuuc

SEQ ID NO: 2097986 - RNA, 16 nt, Staphylococcus aureus subsp. aureus MW2
cugcaacuaauaugau

SEQ ID NO: 2097987 - RNA, 23 nt, Staphylococcus aureus subsp. aureus MW2
cugauugcugcuguacaauuucg

SEQ ID NO: 2097988 - RNA, 15 nt, Staphylococcus aureus subsp. aureus MW2
cugaucguaacauua

SEQ ID NO: 2097989 - RNA, 15 nt, Staphylococcus aureus subsp. aureus MW2
cugaucuaaaaccau

SEQ ID NO: 2097990 - RNA, 14 nt, Staphylococcus aureus subsp. aureus MW2
cugaucguaacauu

SEQ ID NO: 2097991 - RNA, 15 nt, Staphylococcus aureus subsp. aureus MW2
cugccauauagauau

SEQ ID NO: 2097992 - RNA, 21 nt, Staphylococcus aureus subsp. aureus MW2
cugccaucaggcuuuauuguu

SEQ ID NO: 2097993 - RNA, 21 nt, Staphylococcus aureus subsp. aureus MW2
cugccuaaucgcacucugcau

SEQ ID NO: 2097994 - RNA, 13 nt, Staphylococcus aureus subsp. aureus MW2
cugcuaaaauugu

SEQ ID NO: 2097995 - RNA, 14 nt, Staphylococcus aureus subsp. aureus MW2
cugcuaauuuauaa

SEQ ID NO: 2097996 - RNA, 15 nt, Staphylococcus aureus subsp. aureus MW2
cugcuaauuuuuuca

SEQ ID NO: 2097997 - RNA, 22 nt, Staphylococcus aureus subsp. aureus MW2
cuggugcaggcaucauaucaua

SEQ ID NO: 2097998 - RNA, 16 nt, Staphylococcus aureus subsp. aureus MW2
cuguaccaucacuaaa

SEQ ID NO: 2097999 - RNA, 16 nt, Staphylococcus aureus subsp. aureus MW2
cuguaccaaauuugug

SEQ ID NO: 2098000 - RNA, 18 nt, Staphylococcus aureus subsp. aureus MW2
cuguacgauucaauuuaa

SEQ ID NO: 2098001 - RNA, 22 nt, Staphylococcus aureus subsp. aureus MW2
cuguagguuuaauguuuaauaa

SEQ ID NO: 2098002 - RNA, 19 nt, Staphylococcus aureus subsp. aureus MW2
cuguaguuucaacuuuuga

SEQ ID NO: 2098003 - RNA, 15 nt, Staphylococcus aureus subsp. aureus MW2
cuguaaaugaaaugg

SEQ ID NO: 2098004 - RNA, 16 nt, Staphylococcus aureus subsp. aureus MW2
cuguaaauaugaacuu

SEQ ID NO: 2098005 - RNA, 13 nt, Staphylococcus aureus subsp. aureus MW2
cuguaaaacauuc

SEQ ID NO: 2098006 - RNA, 20 nt, Staphylococcus aureus subsp. aureus MW2
cuguaaaaccauagauaauu

SEQ ID NO: 2098007 - RNA, 14 nt, Staphylococcus aureus subsp. aureus MW2
cuguauuuaauaaa

SEQ ID NO: 2098008 - RNA, 18 nt, Staphylococcus aureus subsp. aureus MW2
cuguauaaccauaaugaa

SEQ ID NO: 2098009 - RNA, 14 nt, Staphylococcus aureus subsp. aureus MW2
cuguccgauuuuua

SEQ ID NO: 2098010 - RNA, 14 nt, Staphylococcus aureus subsp. aureus MW2
cugcuuuaacugua

SEQ ID NO: 2098011 - RNA, 16 nt, Staphylococcus aureus subsp. aureus MW2
cugcuugugugaaauu

SEQ ID NO: 2098012 - RNA, 20 nt, Staphylococcus aureus subsp. aureus MW2
cugcuuuuuauuauuaugug

SEQ ID NO: 2098013 - RNA, 18 nt, Staphylococcus aureus subsp. aureus MW2
cugcuuuuuuuauaagua

SEQ ID NO: 2098014 - RNA, 21 nt, Staphylococcus aureus subsp. aureus MW2
cugcuaauuuuuucaucauuc

SEQ ID NO: 2098015 - RNA, 15 nt, Staphylococcus aureus subsp. aureus MW2
cugcuauuuuuuuaa

SEQ ID NO: 2098016 - RNA, 18 nt, Staphylococcus aureus subsp. aureus MW2
cuggaacuuuaauaccag

SEQ ID NO: 2098017 - RNA, 16 nt, Staphylococcus aureus subsp. aureus MW2
cuggcggaaagucagc

SEQ ID NO: 2098018 - RNA, 18 nt, Staphylococcus aureus subsp. aureus MW2
cuggcggaaagucagguu

SEQ ID NO: 2098019 - RNA, 23 nt, Staphylococcus aureus subsp. aureus MW2
cuggauaaauaaagauucaauua

SEQ ID NO: 2098020 - RNA, 22 nt, Staphylococcus aureus subsp. aureus MW2
cuucuucaggaauaucuuucaa

SEQ ID NO: 2098021 - RNA, 12 nt, Staphylococcus aureus subsp. aureus MW2
cuucuucaguaa

SEQ ID NO: 2098022 - RNA, 21 nt, Staphylococcus aureus subsp. aureus MW2
cuucuucaggaauaucuuuca

SEQ ID NO: 2098023 - RNA, 21 nt, Staphylococcus aureus subsp. aureus MW2
cuucuuaaaauaugauuuaaa

SEQ ID NO: 2098024 - RNA, 24 nt, Staphylococcus aureus subsp. aureus MW2
cuucuuaaaucaacaucaucuuua

SEQ ID NO: 2098025 - RNA, 14 nt, Staphylococcus aureus subsp. aureus MW2
cuucuguuuauaua

SEQ ID NO: 2098026 - RNA, 15 nt, Staphylococcus aureus subsp. aureus MW2
cuucuuguuucaaac

SEQ ID NO: 2098027 - RNA, 20 nt, Staphylococcus aureus subsp. aureus MW2
cuucuggagccucuuguucu

SEQ ID NO: 2098028 - RNA, 23 nt, Staphylococcus aureus subsp. aureus MW2
cuucuggauagguaucacuagga

SEQ ID NO: 2098029 - RNA, 11 nt, Staphylococcus aureus subsp. aureus MW2
cuucugcuaac

SEQ ID NO: 2098030 - RNA, 23 nt, Staphylococcus aureus subsp. aureus MW2
cuucuccguauuuaccuucuucu

SEQ ID NO: 2098031 - RNA, 12 nt, Staphylococcus aureus subsp. aureus MW2
cuucucuaucag

SEQ ID NO: 2098032 - RNA, 20 nt, Staphylococcus aureus subsp. aureus MW2
cuucucuauacccuuuauua

SEQ ID NO: 2098033 - RNA, 20 nt, Staphylococcus aureus subsp. aureus MW2
cuugauggcaacuaaaauuu

SEQ ID NO: 2098034 - RNA, 16 nt, Staphylococcus aureus subsp. aureus MW2
cuugaaacacaaaaag

SEQ ID NO: 2098035 - RNA, 22 nt, Staphylococcus aureus subsp. aureus MW2
cuugaaauaaacauaucaucau

SEQ ID NO: 2098036 - RNA, 17 nt, Staphylococcus aureus subsp. aureus MW2
cuucuuuuuuguaucuc

SEQ ID NO: 2098037 - RNA, 15 nt, Staphylococcus aureus subsp. aureus MW2
cuugagcuauucaua

SEQ ID NO: 2098038 - RNA, 14 nt, Staphylococcus aureus subsp. aureus MW2
cuugagcaucacuc

SEQ ID NO: 2098039 - RNA, 17 nt, Staphylococcus aureus subsp. aureus MW2
cuugaaauuauuauuua

SEQ ID NO: 2098040 - RNA, 14 nt, Staphylococcus aureus subsp. aureus MW2
cuugccuucaaauu

SEQ ID NO: 2098041 - RNA, 15 nt, Staphylococcus aureus subsp. aureus MW2
cuugccuauuuuuuu

SEQ ID NO: 2098042 - RNA, 16 nt, Staphylococcus aureus subsp. aureus MW2
cuugcggucucaacuu

SEQ ID NO: 2098043 - RNA, 20 nt, Staphylococcus aureus subsp. aureus MW2
cuugcggucucaacuugccu

SEQ ID NO: 2098044 - RNA, 18 nt, Staphylococcus aureus subsp. aureus MW2
cuugcuuuguucuucguc

SEQ ID NO: 2098045 - RNA, 15 nt, Staphylococcus aureus subsp. aureus MW2
cuuuaauaaccuuua

SEQ ID NO: 2098046 - RNA, 12 nt, Staphylococcus aureus subsp. aureus MW2
cuuuaauacuac

SEQ ID NO: 2098047 - RNA, 21 nt, Staphylococcus aureus subsp. aureus MW2
cuuuaacaauuuuaucugaau

SEQ ID NO: 2098048 - RNA, 22 nt, Staphylococcus aureus subsp. aureus MW2
cuuuaaauuauauacucaccac

SEQ ID NO: 2098049 - RNA, 22 nt, Staphylococcus aureus subsp. aureus MW2
cuuuaaauauacuucuauuaaa

SEQ ID NO: 2098050 - RNA, 13 nt, Staphylococcus aureus subsp. aureus MW2
cuuuaaauauugu

SEQ ID NO: 2098051 - RNA, 13 nt, Staphylococcus aureus subsp. aureus MW2
cuuuaaauguuuu

SEQ ID NO: 2098052 - RNA, 17 nt, Staphylococcus aureus subsp. aureus MW2
cuuuaaaaauuaaguaa

SEQ ID NO: 2098053 - RNA, 19 nt, Staphylococcus aureus subsp. aureus MW2
cuuuaaaacaucauucaca

SEQ ID NO: 2098054 - RNA, 14 nt, Staphylococcus aureus subsp. aureus MW2
cuuuaaaauucucu

SEQ ID NO: 2098055 - RNA, 20 nt, Staphylococcus aureus subsp. aureus MW2
cuuuaaacucguaaauuuua

SEQ ID NO: 2098056 - RNA, 14 nt, Staphylococcus aureus subsp. aureus MW2
cuuuaaacaagcau

SEQ ID NO: 2098057 - RNA, 13 nt, Staphylococcus aureus subsp. aureus MW2
cuuguuuuaaacu

SEQ ID NO: 2098058 - RNA, 18 nt, Staphylococcus aureus subsp. aureus MW2
cuuguuuagggaauccca

SEQ ID NO: 2098059 - RNA, 13 nt, Staphylococcus aureus subsp. aureus MW2
cuuguuucagacu

SEQ ID NO: 2098060 - RNA, 16 nt, Staphylococcus aureus subsp. aureus MW2
cuuguuuauuuuuaau

SEQ ID NO: 2098061 - RNA, 14 nt, Staphylococcus aureus subsp. aureus MW2
cuuguucuaaaaaa

SEQ ID NO: 2098062 - RNA, 22 nt, Staphylococcus aureus subsp. aureus MW2
cuuguucgauaaucguuaaaac

SEQ ID NO: 2098063 - RNA, 16 nt, Staphylococcus aureus subsp. aureus MW2
cuuguucuucuuuacg

SEQ ID NO: 2098064 - RNA, 13 nt, Staphylococcus aureus subsp. aureus MW2
cuuguucuuuacu

SEQ ID NO: 2098065 - RNA, 19 nt, Staphylococcus aureus subsp. aureus MW2
cuuguuggaaagcuuuaac

SEQ ID NO: 2098066 - RNA, 16 nt, Staphylococcus aureus subsp. aureus MW2
cuuguuggauuuuaac

SEQ ID NO: 2098067 - RNA, 14 nt, Staphylococcus aureus subsp. aureus MW2
cuugugugaaauua

SEQ ID NO: 2098068 - RNA, 19 nt, Staphylococcus aureus subsp. aureus MW2
cuugugguuggaagucugc

SEQ ID NO: 2098069 - RNA, 17 nt, Staphylococcus aureus subsp. aureus MW2
cuuguccucuaaaacau

SEQ ID NO: 2098070 - RNA, 20 nt, Staphylococcus aureus subsp. aureus MW2
cuugucuuuuuuaaagaggc

SEQ ID NO: 2098071 - RNA, 22 nt, Staphylococcus aureus subsp. aureus MW2
cuuguaacaagcuuuucauuuu

SEQ ID NO: 2098072 - RNA, 16 nt, Staphylococcus aureus subsp. aureus MW2
cuuguaaacuucuuuu

SEQ ID NO: 2098073 - RNA, 15 nt, Staphylococcus aureus subsp. aureus MW2
cuugucaguuuuuuu

SEQ ID NO: 2098074 - RNA, 21 nt, Staphylococcus aureus subsp. aureus MW2
cuugucaguuuuuuuauaagc

SEQ ID NO: 2098075 - RNA, 18 nt, Staphylococcus aureus subsp. aureus MW2
cuuguaauauaacaagua

SEQ ID NO: 2098076 - RNA, 16 nt, Staphylococcus aureus subsp. aureus MW2
cuuucaccauuuacuu

SEQ ID NO: 2098077 - RNA, 20 nt, Staphylococcus aureus subsp. aureus MW2
cuuucaccauuuacuucaua

SEQ ID NO: 2098078 - RNA, 21 nt, Staphylococcus aureus subsp. aureus MW2
cuuuaugugcaucauuuauau

SEQ ID NO: 2098079 - RNA, 14 nt, Staphylococcus aureus subsp. aureus MW2
cuuuauuaaaaauc

SEQ ID NO: 2098080 - RNA, 20 nt, Staphylococcus aureus subsp. aureus MW2
cuuuauggguauccuucuca

SEQ ID NO: 2098081 - RNA, 16 nt, Staphylococcus aureus subsp. aureus MW2
cuuuauguuggggccu

SEQ ID NO: 2098082 - RNA, 14 nt, Staphylococcus aureus subsp. aureus MW2
cuuuauuaaauaac

SEQ ID NO: 2098083 - RNA, 13 nt, Staphylococcus aureus subsp. aureus MW2
cuuuauuaaauuc

SEQ ID NO: 2098084 - RNA, 14 nt, Staphylococcus aureus subsp. aureus MW2
cuuuauuaccagcu

SEQ ID NO: 2098085 - RNA, 19 nt, Staphylococcus aureus subsp. aureus MW2
cuuuaauagcgucaaguuu

SEQ ID NO: 2098086 - RNA, 19 nt, Staphylococcus aureus subsp. aureus MW2
cuuuaauauaauuauuaaa

SEQ ID NO: 2098087 - RNA, 15 nt, Staphylococcus aureus subsp. aureus MW2
cuuuaccaauaucau

SEQ ID NO: 2098088 - RNA, 12 nt, Staphylococcus aureus subsp. aureus MW2
cuuuaccaucuu

SEQ ID NO: 2098089 - RNA, 14 nt, Staphylococcus aureus subsp. aureus MW2
cuuuauaugagaaa

SEQ ID NO: 2098090 - RNA, 14 nt, Staphylococcus aureus subsp. aureus MW2
cuuuauauuuauca

SEQ ID NO: 2098091 - RNA, 16 nt, Staphylococcus aureus subsp. aureus MW2
cuuucucaucuauuua

SEQ ID NO: 2098092 - RNA, 12 nt, Staphylococcus aureus subsp. aureus MW2
cuuucuauuaau

SEQ ID NO: 2098093 - RNA, 16 nt, Staphylococcus aureus subsp. aureus MW2
cuuucuaucuuguucu

SEQ ID NO: 2098094 - RNA, 22 nt, Staphylococcus aureus subsp. aureus MW2
cuuucuaucuuguucuucuuua

SEQ ID NO: 2098095 - RNA, 16 nt, Staphylococcus aureus subsp. aureus MW2
cuuuccauuguugaua

SEQ ID NO: 2098096 - RNA, 23 nt, Staphylococcus aureus subsp. aureus MW2
cuuucaucuuuuucacuaaucau

SEQ ID NO: 2098097 - RNA, 21 nt, Staphylococcus aureus subsp. aureus MW2
cuuucaucaaauucucauuca

SEQ ID NO: 2098098 - RNA, 20 nt, Staphylococcus aureus subsp. aureus MW2
cuuucauaguuauuaaaucu

SEQ ID NO: 2098099 - RNA, 17 nt, Staphylococcus aureus subsp. aureus MW2
cuuucauacauaacaca

SEQ ID NO: 2098100 - RNA, 15 nt, Staphylococcus aureus subsp. aureus MW2
cuuucauaaauuguu

SEQ ID NO: 2098101 - RNA, 21 nt, Staphylococcus aureus subsp. aureus MW2
cuuuccucacuagauaguuua

SEQ ID NO: 2098102 - RNA, 13 nt, Staphylococcus aureus subsp. aureus MW2
cuuuccgccagcu

SEQ ID NO: 2098103 - RNA, 20 nt, Staphylococcus aureus subsp. aureus MW2
cuucauuaucaauagaugaa

SEQ ID NO: 2098104 - RNA, 23 nt, Staphylococcus aureus subsp. aureus MW2
cuucauuauauaauucuucaaau

SEQ ID NO: 2098105 - RNA, 21 nt, Staphylococcus aureus subsp. aureus MW2
cuucauuaguugcauaaucaa

SEQ ID NO: 2098106 - RNA, 14 nt, Staphylococcus aureus subsp. aureus MW2
cuucaugucguuuu

SEQ ID NO: 2098107 - RNA, 15 nt, Staphylococcus aureus subsp. aureus MW2
cuucauuugcgauuu

SEQ ID NO: 2098108 - RNA, 22 nt, Staphylococcus aureus subsp. aureus MW2
cuucauuugcgauuucuucugc

SEQ ID NO: 2098109 - RNA, 13 nt, Staphylococcus aureus subsp. aureus MW2
cuucgccaagcca

SEQ ID NO: 2098110 - RNA, 21 nt, Staphylococcus aureus subsp. aureus MW2
cuucgccaagccaucuuucuu

SEQ ID NO: 2098111 - RNA, 21 nt, Staphylococcus aureus subsp. aureus MW2
cuucgccaagccauuuuucuu

SEQ ID NO: 2098112 - RNA, 21 nt, Staphylococcus aureus subsp. aureus MW2
cuuccuccgccaucaauauuu

SEQ ID NO: 2098113 - RNA, 20 nt, Staphylococcus aureus subsp. aureus MW2
cuucgauucuccuuuuguuu

SEQ ID NO: 2098114 - RNA, 18 nt, Staphylococcus aureus subsp. aureus MW2
cuucgcacaacugcauau

SEQ ID NO: 2098115 - RNA, 22 nt, Staphylococcus aureus subsp. aureus MW2
cuucaguacaauccugaagaga

SEQ ID NO: 2098116 - RNA, 15 nt, Staphylococcus aureus subsp. aureus MW2
cuucagguguaguag

SEQ ID NO: 2098117 - RNA, 17 nt, Staphylococcus aureus subsp. aureus MW2
cuucauauccuucauua

SEQ ID NO: 2098118 - RNA, 22 nt, Staphylococcus aureus subsp. aureus MW2
cuucauaguucaaauugaacuu

SEQ ID NO: 2098119 - RNA, 20 nt, Staphylococcus aureus subsp. aureus MW2
cuucauaaucguauucauau

SEQ ID NO: 2098120 - RNA, 15 nt, Staphylococcus aureus subsp. aureus MW2
cuucauaguucaaau

SEQ ID NO: 2098121 - RNA, 21 nt, Staphylococcus aureus subsp. aureus MW2
cuucauagucacuuuuaacga

SEQ ID NO: 2098122 - RNA, 18 nt, Staphylococcus aureus subsp. aureus MW2
cuucaucaguuguguaau

SEQ ID NO: 2098123 - RNA, 20 nt, Staphylococcus aureus subsp. aureus MW2
cuucaucauuguaaaacaaa

SEQ ID NO: 2098124 - RNA, 17 nt, Staphylococcus aureus subsp. aureus MW2
cuucacuaaaaauauau

SEQ ID NO: 2098125 - RNA, 15 nt, Staphylococcus aureus subsp. aureus MW2
cuucacuaaaaauau

SEQ ID NO: 2098126 - RNA, 14 nt, Staphylococcus aureus subsp. aureus MW2
cuucacuaaaaauc

SEQ ID NO: 2098127 - RNA, 19 nt, Staphylococcus aureus subsp. aureus MW2
cuuaugucauauacuauau

SEQ ID NO: 2098128 - RNA, 20 nt, Staphylococcus aureus subsp. aureus MW2
cuuauguggaggacacauuu

SEQ ID NO: 2098129 - RNA, 15 nt, Staphylococcus aureus subsp. aureus MW2
cuuauucaaauguuu

SEQ ID NO: 2098130 - RNA, 17 nt, Staphylococcus aureus subsp. aureus MW2
cuucaauuuauuuuuau

SEQ ID NO: 2098131 - RNA, 21 nt, Staphylococcus aureus subsp. aureus MW2
cuucaauuuauuuuuauauga

SEQ ID NO: 2098132 - RNA, 12 nt, Staphylococcus aureus subsp. aureus MW2
cuuauuauuuau

SEQ ID NO: 2098133 - RNA, 22 nt, Staphylococcus aureus subsp. aureus MW2
cuuauuauuuuguauuuuucaa

SEQ ID NO: 2098134 - RNA, 16 nt, Staphylococcus aureus subsp. aureus MW2
cuuagauucuauuagg

SEQ ID NO: 2098135 - RNA, 14 nt, Staphylococcus aureus subsp. aureus MW2
cuuagauaaauuaa

SEQ ID NO: 2098136 - RNA, 19 nt, Staphylococcus aureus subsp. aureus MW2
cuuagauaaauuaauauga

SEQ ID NO: 2098137 - RNA, 14 nt, Staphylococcus aureus subsp. aureus MW2
cuuacugcugcuuc

SEQ ID NO: 2098138 - RNA, 20 nt, Staphylococcus aureus subsp. aureus MW2
cuuacuaaguaaccaagucu

SEQ ID NO: 2098139 - RNA, 16 nt, Staphylococcus aureus subsp. aureus MW2
cuuagcaaucucuuua

SEQ ID NO: 2098140 - RNA, 21 nt, Staphylococcus aureus subsp. aureus MW2
cuuauaaguucaaccauauga

SEQ ID NO: 2098141 - RNA, 14 nt, Staphylococcus aureus subsp. aureus MW2
cuuauaauauuaaa

SEQ ID NO: 2098142 - RNA, 22 nt, Staphylococcus aureus subsp. aureus MW2
cuuauagaaugauuaaaauuaa

SEQ ID NO: 2098143 - RNA, 13 nt, Staphylococcus aureus subsp. aureus MW2
cuuauacuauaua

SEQ ID NO: 2098144 - RNA, 17 nt, Staphylococcus aureus subsp. aureus MW2
cuuauacuauauaauaa

SEQ ID NO: 2098145 - RNA, 14 nt, Staphylococcus aureus subsp. aureus MW2
cuuaucaacaacaa

SEQ ID NO: 2098146 - RNA, 18 nt, Staphylococcus aureus subsp. aureus MW2
cuuaucaacagcuucaaa

SEQ ID NO: 2098147 - RNA, 14 nt, Staphylococcus aureus subsp. aureus MW2
cuuaucauuacuug

SEQ ID NO: 2098148 - RNA, 20 nt, Staphylococcus aureus subsp. aureus MW2
cuuaucaguuugcacuucaa

SEQ ID NO: 2098149 - RNA, 15 nt, Staphylococcus aureus subsp. aureus MW2
cuuaucauuucaaau

SEQ ID NO: 2098150 - RNA, 12 nt, Staphylococcus aureus subsp. aureus MW2
cuuaucagugua

SEQ ID NO: 2098151 - RNA, 14 nt, Staphylococcus aureus subsp. aureus MW2
cuuaauuaauaauu

SEQ ID NO: 2098152 - RNA, 20 nt, Staphylococcus aureus subsp. aureus MW2
cuuaauuauuuauuguucuc

SEQ ID NO: 2098153 - RNA, 21 nt, Staphylococcus aureus subsp. aureus MW2
cuuaauucuucaucaauaacu

SEQ ID NO: 2098154 - RNA, 19 nt, Staphylococcus aureus subsp. aureus MW2
cuuaauuaauaauuuaacu

SEQ ID NO: 2098155 - RNA, 18 nt, Staphylococcus aureus subsp. aureus MW2
cuuaauuuaaaaauaguu

SEQ ID NO: 2098156 - RNA, 21 nt, Staphylococcus aureus subsp. aureus MW2
cuuaauuuaaaaauaguucuu

SEQ ID NO: 2098157 - RNA, 22 nt, Staphylococcus aureus subsp. aureus MW2
cuuaaucauugcuccccucuuu

SEQ ID NO: 2098158 - RNA, 22 nt, Staphylococcus aureus subsp. aureus MW2
cuuaaucagcuauaaaaguacu

SEQ ID NO: 2098159 - RNA, 18 nt, Staphylococcus aureus subsp. aureus MW2
cuuaauaucauauucaaa

SEQ ID NO: 2098160 - RNA, 23 nt, Staphylococcus aureus subsp. aureus MW2
cuuaaauacaauuucuucauuuu

SEQ ID NO: 2098161 - RNA, 21 nt, Staphylococcus aureus subsp. aureus MW2
cuuaauaggauaugcuaaaca

SEQ ID NO: 2098162 - RNA, 22 nt, Staphylococcus aureus subsp. aureus MW2
cuuaauaucaguagcauauuga

SEQ ID NO: 2098163 - RNA, 21 nt, Staphylococcus aureus subsp. aureus MW2
cuuaaauaucgacaaauuaaa

SEQ ID NO: 2098164 - RNA, 22 nt, Staphylococcus aureus subsp. aureus MW2
cuuaaauacaauuucuucauuu

SEQ ID NO: 2098165 - RNA, 21 nt, Staphylococcus aureus subsp. aureus MW2
cuuaaauacaauuucuucauu

SEQ ID NO: 2098166 - RNA, 18 nt, Staphylococcus aureus subsp. aureus MW2
cuuaaauagugcuuuuuc

SEQ ID NO: 2098167 - RNA, 19 nt, Staphylococcus aureus subsp. aureus MW2
cuuaaauagugcuuuuuca

SEQ ID NO: 2098168 - RNA, 21 nt, Staphylococcus aureus subsp. aureus MW2
cuuaaagauuuacccauuaca

SEQ ID NO: 2098169 - RNA, 16 nt, Staphylococcus aureus subsp. aureus MW2
cuuaaagcuaauaaug

SEQ ID NO: 2098170 - RNA, 18 nt, Staphylococcus aureus subsp. aureus MW2
cuuaccuuucaaauauau

SEQ ID NO: 2098171 - RNA, 19 nt, Staphylococcus aureus subsp. aureus MW2
cuuaccuuuauguucaaau

SEQ ID NO: 2098172 - RNA, 21 nt, Staphylococcus aureus subsp. aureus MW2
cuuaccuuuauguucaaaugu

SEQ ID NO: 2098173 - RNA, 14 nt, Staphylococcus aureus subsp. aureus MW2
cuuacaaauauacu

SEQ ID NO: 2098174 - RNA, 14 nt, Staphylococcus aureus subsp. aureus MW2
cuuaauuuaaaucu

SEQ ID NO: 2098175 - RNA, 15 nt, Staphylococcus aureus subsp. aureus MW2
cuuaauuuguuuuaa

SEQ ID NO: 2098176 - RNA, 14 nt, Staphylococcus aureus subsp. aureus MW2
cuuacaauaaucac

SEQ ID NO: 2098177 - RNA, 16 nt, Staphylococcus aureus subsp. aureus MW2
cuuacagacaaacauu

SEQ ID NO: 2098178 - RNA, 20 nt, Staphylococcus aureus subsp. aureus MW2
cuguuuaaauuuaaaagaaa

SEQ ID NO: 2098179 - RNA, 20 nt, Staphylococcus aureus subsp. aureus MW2
cuguuggaauaccuuuuucu

SEQ ID NO: 2098180 - RNA, 19 nt, Staphylococcus aureus subsp. aureus MW2
cugucucaucuucuaaauc

SEQ ID NO: 2098181 - RNA, 12 nt, Staphylococcus aureus subsp. aureus MW2
cuguucuaaaau

SEQ ID NO: 2098182 - RNA, 19 nt, Staphylococcus aureus subsp. aureus MW2
cuguuuugcgguuuuuuug

SEQ ID NO: 2098183 - RNA, 18 nt, Staphylococcus aureus subsp. aureus MW2
cuguuuuaucuacaguuu

SEQ ID NO: 2098184 - RNA, 22 nt, Staphylococcus aureus subsp. aureus MW2
cuguuuuaauugggucuuuauc

SEQ ID NO: 2098185 - RNA, 19 nt, Staphylococcus aureus subsp. aureus MW2
cuguuucaaagcugucaac

SEQ ID NO: 2098186 - RNA, 11 nt, Staphylococcus aureus subsp. aureus MW2
cuuaaaaacaa

SEQ ID NO: 2098187 - RNA, 12 nt, Staphylococcus aureus subsp. aureus MW2
cuuaaaaacaau

SEQ ID NO: 2098188 - RNA, 20 nt, Staphylococcus aureus subsp. aureus MW2
cuuaaaagacauccacagaa

SEQ ID NO: 2098189 - RNA, 19 nt, Staphylococcus aureus subsp. aureus MW2
cuuaaaaacgcuuuuaaac

SEQ ID NO: 2098190 - RNA, 15 nt, Staphylococcus aureus subsp. aureus MW2
cuuaaaauuuaaaua

SEQ ID NO: 2098191 - RNA, 17 nt, Staphylococcus aureus subsp. aureus MW2
cuuaaacgcucuucuuc

SEQ ID NO: 2098192 - RNA, 19 nt, Staphylococcus aureus subsp. aureus MW2
cuuaaacgcucuucuucuu

SEQ ID NO: 2098193 - RNA, 21 nt, Staphylococcus aureus subsp. aureus MW2
cuuaaacgcucuucuucuuca

SEQ ID NO: 2098194 - RNA, 18 nt, Staphylococcus aureus subsp. aureus MW2
cuuaaaccuaacauaacu

SEQ ID NO: 2098195 - RNA, 21 nt, Staphylococcus aureus subsp. aureus MW2
cuuaaaauaugauuuaaaaua

SEQ ID NO: 2098196 - RNA, 20 nt, Staphylococcus aureus subsp. aureus MW2
cuuaaaagagaauauaaaau

SEQ ID NO: 2098197 - RNA, 21 nt, Staphylococcus aureus subsp. aureus MW2
cuuaaaauaccugcaacuuuu

SEQ ID NO: 2098198 - RNA, 18 nt, Staphylococcus aureus subsp. aureus MW2
cuuaaaauaugauuuaaa

SEQ ID NO: 2098199 - RNA, 13 nt, Staphylococcus aureus subsp. aureus MW2
cuuaaaauauuua

SEQ ID NO: 2098200 - RNA, 15 nt, Staphylococcus aureus subsp. aureus MW2
cuuaaaauauuuaac

SEQ ID NO: 2098201 - RNA, 16 nt, Staphylococcus aureus subsp. aureus MW2
cuuaaaauauuuaacu

SEQ ID NO: 2098202 - RNA, 20 nt, Staphylococcus aureus subsp. aureus MW2
cuuaaaaucagucauucaca

SEQ ID NO: 2098203 - RNA, 13 nt, Staphylococcus aureus subsp. aureus MW2
gaauauaacgaau

SEQ ID NO: 2098204 - RNA, 12 nt, Staphylococcus aureus subsp. aureus MW2
gaauauaaauga

SEQ ID NO: 2098205 - RNA, 16 nt, Staphylococcus aureus subsp. aureus MW2
gaauauaaaauaaugc

SEQ ID NO: 2098206 - RNA, 14 nt, Staphylococcus aureus subsp. aureus MW2
gaauauaaugacca

SEQ ID NO: 2098207 - RNA, 22 nt, Staphylococcus aureus subsp. aureus MW2
gaauauacaauaguauaaauau

SEQ ID NO: 2098208 - RNA, 19 nt, Staphylococcus aureus subsp. aureus MW2
gaauauacuuaauuuaaau

SEQ ID NO: 2098209 - RNA, 17 nt, Staphylococcus aureus subsp. aureus MW2
gaauacuuuauuugaua

SEQ ID NO: 2098210 - RNA, 22 nt, Staphylococcus aureus subsp. aureus MW2
gaauauuaacaccagauaucau

SEQ ID NO: 2098211 - RNA, 23 nt, Staphylococcus aureus subsp. aureus MW2
gaauauuaacguuaguauaaacg

SEQ ID NO: 2098212 - RNA, 19 nt, Staphylococcus aureus subsp. aureus MW2
gaauauuaagauguauaug

SEQ ID NO: 2098213 - RNA, 17 nt, Staphylococcus aureus subsp. aureus MW2
gaauauagcugugauuu

SEQ ID NO: 2098214 - RNA, 23 nt, Staphylococcus aureus subsp. aureus MW2
gaauauagauuuuguauuagcau

SEQ ID NO: 2098215 - RNA, 18 nt, Staphylococcus aureus subsp. aureus MW2
gaauaauuuuaaaaauaa

SEQ ID NO: 2098216 - RNA, 18 nt, Staphylococcus aureus subsp. aureus MW2
gaauaauuacuaaaauau

SEQ ID NO: 2098217 - RNA, 20 nt, Staphylococcus aureus subsp. aureus MW2
gaauaauucuuuuagaauuc

SEQ ID NO: 2098218 - RNA, 16 nt, Staphylococcus aureus subsp. aureus MW2
gaauaauugagaaaaa

SEQ ID NO: 2098219 - RNA, 20 nt, Staphylococcus aureus subsp. aureus MW2
gaauaauugagaaaaagguu

SEQ ID NO: 2098220 - RNA, 21 nt, Staphylococcus aureus subsp. aureus MW2
gaauaauugagaaaaagguua

SEQ ID NO: 2098221 - RNA, 20 nt, Staphylococcus aureus subsp. aureus MW2
gaauacucuuuaaucuacca

SEQ ID NO: 2098222 - RNA, 15 nt, Staphylococcus aureus subsp. aureus MW2
gaauaaauagauaau

SEQ ID NO: 2098223 - RNA, 18 nt, Staphylococcus aureus subsp. aureus MW2
gaauaaauaauuuagaaa

SEQ ID NO: 2098224 - RNA, 20 nt, Staphylococcus aureus subsp. aureus MW2
gaauaaauaauuuagaaaua

SEQ ID NO: 2098225 - RNA, 12 nt, Staphylococcus aureus subsp. aureus MW2
gaauaauauauu

SEQ ID NO: 2098226 - RNA, 17 nt, Staphylococcus aureus subsp. aureus MW2
gaauaauaaacuuaaaa

SEQ ID NO: 2098227 - RNA, 19 nt, Staphylococcus aureus subsp. aureus MW2
gaauaauaaacuuaaaaga

SEQ ID NO: 2098228 - RNA, 20 nt, Staphylococcus aureus subsp. aureus MW2
gaauaauaaacuuaaaagag

SEQ ID NO: 2098229 - RNA, 16 nt, Staphylococcus aureus subsp. aureus MW2
gaagggaguauuuuuu

SEQ ID NO: 2098230 - RNA, 21 nt, Staphylococcus aureus subsp. aureus MW2
gaaguaggcugaaguugaagc

SEQ ID NO: 2098231 - RNA, 19 nt, Staphylococcus aureus subsp. aureus MW2
gaaguaaugugcauugcuu

SEQ ID NO: 2098232 - RNA, 15 nt, Staphylococcus aureus subsp. aureus MW2
gaaguuguuucucca

SEQ ID NO: 2098233 - RNA, 13 nt, Staphylococcus aureus subsp. aureus MW2
gaauaaaauauau

SEQ ID NO: 2098234 - RNA, 12 nt, Staphylococcus aureus subsp. aureus MW2
gaaguuguuucu

SEQ ID NO: 2098235 - RNA, 15 nt, Staphylococcus aureus subsp. aureus MW2
gaaguuacguucuaa

SEQ ID NO: 2098236 - RNA, 20 nt, Staphylococcus aureus subsp. aureus MW2
gaagugacaucguugcuuuu

SEQ ID NO: 2098237 - RNA, 17 nt, Staphylococcus aureus subsp. aureus MW2
gaagucuuucaacaaaa

SEQ ID NO: 2098238 - RNA, 13 nt, Staphylococcus aureus subsp. aureus MW2
gaauccuucauca

SEQ ID NO: 2098239 - RNA, 15 nt, Staphylococcus aureus subsp. aureus MW2
gaaucgauauaauga

SEQ ID NO: 2098240 - RNA, 19 nt, Staphylococcus aureus subsp. aureus MW2
gaauccuaugccaaauaac

SEQ ID NO: 2098241 - RNA, 19 nt, Staphylococcus aureus subsp. aureus MW2
gaaucacauuaacaaggcc

SEQ ID NO: 2098242 - RNA, 19 nt, Staphylococcus aureus subsp. aureus MW2
gaaucacaguuauauauua

SEQ ID NO: 2098243 - RNA, 19 nt, Staphylococcus aureus subsp. aureus MW2
gaaucaacaauauaaaagc

SEQ ID NO: 2098244 - RNA, 20 nt, Staphylococcus aureus subsp. aureus MW2
gaaucauuuucuugauuuua

SEQ ID NO: 2098245 - RNA, 16 nt, Staphylococcus aureus subsp. aureus MW2
gaaucaggaauguuug

SEQ ID NO: 2098246 - RNA, 15 nt, Staphylococcus aureus subsp. aureus MW2
gaaucuaaacuauaa

SEQ ID NO: 2098247 - RNA, 22 nt, Staphylococcus aureus subsp. aureus MW2
gaaucuuauuuuguuuuaaaaa

SEQ ID NO: 2098248 - RNA, 17 nt, Staphylococcus aureus subsp. aureus MW2
gaaucuuauuuuguuuu

SEQ ID NO: 2098249 - RNA, 14 nt, Staphylococcus aureus subsp. aureus MW2
gaaugaaguaauau

SEQ ID NO: 2098250 - RNA, 15 nt, Staphylococcus aureus subsp. aureus MW2
gaaugaagcauuuua

SEQ ID NO: 2098251 - RNA, 13 nt, Staphylococcus aureus subsp. aureus MW2
gaaugaaccuuua

SEQ ID NO: 2098252 - RNA, 14 nt, Staphylococcus aureus subsp. aureus MW2
gaaugaauaauucc

SEQ ID NO: 2098253 - RNA, 14 nt, Staphylococcus aureus subsp. aureus MW2
gaaugauuaaaauu

SEQ ID NO: 2098254 - RNA, 23 nt, Staphylococcus aureus subsp. aureus MW2
gaauguauuuuucauauugcuac

SEQ ID NO: 2098255 - RNA, 13 nt, Staphylococcus aureus subsp. aureus MW2
gaauguuccuugu

SEQ ID NO: 2098256 - RNA, 15 nt, Staphylococcus aureus subsp. aureus MW2
gaaugugaugauuaa

SEQ ID NO: 2098257 - RNA, 21 nt, Staphylococcus aureus subsp. aureus MW2
gaaugugcgaacuugcuuugu

SEQ ID NO: 2098258 - RNA, 19 nt, Staphylococcus aureus subsp. aureus MW2
gaauuaacaacaaauauaa

SEQ ID NO: 2098259 - RNA, 22 nt, Staphylococcus aureus subsp. aureus MW2
gaauuaacuagugccucuuuua

SEQ ID NO: 2098260 - RNA, 13 nt, Staphylococcus aureus subsp. aureus MW2
gaaugccuaauuu

SEQ ID NO: 2098261 - RNA, 21 nt, Staphylococcus aureus subsp. aureus MW2
gaaugcgauuuccuuuagcaa

SEQ ID NO: 2098262 - RNA, 14 nt, Staphylococcus aureus subsp. aureus MW2
gaauggcaaauaug

SEQ ID NO: 2098263 - RNA, 20 nt, Staphylococcus aureus subsp. aureus MW2
gaauugagcaacucaggaau

SEQ ID NO: 2098264 - RNA, 15 nt, Staphylococcus aureus subsp. aureus MW2
gaauugacugacuuc

SEQ ID NO: 2098265 - RNA, 20 nt, Staphylococcus aureus subsp. aureus MW2
gaauuuaguuuucguaguaa

SEQ ID NO: 2098266 - RNA, 21 nt, Staphylococcus aureus subsp. aureus MW2
gaauuuaggaaugaauaaagc

SEQ ID NO: 2098267 - RNA, 14 nt, Staphylococcus aureus subsp. aureus MW2
gaauuuaaaaauag

SEQ ID NO: 2098268 - RNA, 19 nt, Staphylococcus aureus subsp. aureus MW2
gaauuuacuccuuacaaua

SEQ ID NO: 2098269 - RNA, 15 nt, Staphylococcus aureus subsp. aureus MW2
gaauuucaaaaagga

SEQ ID NO: 2098270 - RNA, 17 nt, Staphylococcus aureus subsp. aureus MW2
gaauuucaaaaaggaau

SEQ ID NO: 2098271 - RNA, 16 nt, Staphylococcus aureus subsp. aureus MW2
gaauuguauuagcaau

SEQ ID NO: 2098272 - RNA, 22 nt, Staphylococcus aureus subsp. aureus MW2
gaauucaaccaauuauuaaagc

SEQ ID NO: 2098273 - RNA, 20 nt, Staphylococcus aureus subsp. aureus MW2
gaauuagcuaagccuguuug

SEQ ID NO: 2098274 - RNA, 17 nt, Staphylococcus aureus subsp. aureus MW2
gaauuacacuuuaaaua

SEQ ID NO: 2098275 - RNA, 20 nt, Staphylococcus aureus subsp. aureus MW2
gaauuaucuauauaugaaga

SEQ ID NO: 2098276 - RNA, 18 nt, Staphylococcus aureus subsp. aureus MW2
gaauuaucuauauaugaa

SEQ ID NO: 2098277 - RNA, 17 nt, Staphylococcus aureus subsp. aureus MW2
gaacccaggugcaucuu

SEQ ID NO: 2098278 - RNA, 18 nt, Staphylococcus aureus subsp. aureus MW2
gaaccauuuccgaauaaa

SEQ ID NO: 2098279 - RNA, 12 nt, Staphylococcus aureus subsp. aureus MW2
gaaccauauuua

SEQ ID NO: 2098280 - RNA, 15 nt, Staphylococcus aureus subsp. aureus MW2
gaaccacgcaucaug

SEQ ID NO: 2098281 - RNA, 15 nt, Staphylococcus aureus subsp. aureus MW2
gaacccuguuaagcu

SEQ ID NO: 2098282 - RNA, 20 nt, Staphylococcus aureus subsp. aureus MW2
gaacgauauuuuaaaaagua

SEQ ID NO: 2098283 - RNA, 16 nt, Staphylococcus aureus subsp. aureus MW2
gaacgagagagaaaag

SEQ ID NO: 2098284 - RNA, 21 nt, Staphylococcus aureus subsp. aureus MW2
gaacgagagagaaaagcuaga

SEQ ID NO: 2098285 - RNA, 19 nt, Staphylococcus aureus subsp. aureus MW2
gaacgcaagcauaucuuua

SEQ ID NO: 2098286 - RNA, 14 nt, Staphylococcus aureus subsp. aureus MW2
gaacgccgaauaau

SEQ ID NO: 2098287 - RNA, 21 nt, Staphylococcus aureus subsp. aureus MW2
gaaccuauuuuuuauaugaug

SEQ ID NO: 2098288 - RNA, 13 nt, Staphylococcus aureus subsp. aureus MW2
gaaccuauuuuuu

SEQ ID NO: 2098289 - RNA, 18 nt, Staphylococcus aureus subsp. aureus MW2
gaaccguaacuauaugaa

SEQ ID NO: 2098290 - RNA, 21 nt, Staphylococcus aureus subsp. aureus MW2
gaacgaaagagaaaagcuaga

SEQ ID NO: 2098291 - RNA, 13 nt, Staphylococcus aureus subsp. aureus MW2
gaacgaaaaugcg

SEQ ID NO: 2098292 - RNA, 16 nt, Staphylococcus aureus subsp. aureus MW2
gaaccugcugaaguuu

SEQ ID NO: 2098293 - RNA, 18 nt, Staphylococcus aureus subsp. aureus MW2
gaacguguuugaauggca

SEQ ID NO: 2098294 - RNA, 15 nt, Staphylococcus aureus subsp. aureus MW2
gaacguuauuuucaa

SEQ ID NO: 2098295 - RNA, 12 nt, Staphylococcus aureus subsp. aureus MW2
gaacuaaaacaa

SEQ ID NO: 2098296 - RNA, 19 nt, Staphylococcus aureus subsp. aureus MW2
gaacuacgcauuuuaaaua

SEQ ID NO: 2098297 - RNA, 19 nt, Staphylococcus aureus subsp. aureus MW2
gaacuacaauucauaagaa

SEQ ID NO: 2098298 - RNA, 21 nt, Staphylococcus aureus subsp. aureus MW2
gaacuuacaagucuaguucga

SEQ ID NO: 2098299 - RNA, 19 nt, Staphylococcus aureus subsp. aureus MW2
gaacuuauaagucugauuu

SEQ ID NO: 2098300 - RNA, 16 nt, Staphylococcus aureus subsp. aureus MW2
gaacuuaaugcuucaa

SEQ ID NO: 2098301 - RNA, 16 nt, Staphylococcus aureus subsp. aureus MW2
gaacucugagcacuua

SEQ ID NO: 2098302 - RNA, 18 nt, Staphylococcus aureus subsp. aureus MW2
gaaggaaaauaaaaacca

SEQ ID NO: 2098303 - RNA, 21 nt, Staphylococcus aureus subsp. aureus MW2
gaaggaauaauuuuaaaaaua

SEQ ID NO: 2098304 - RNA, 21 nt, Staphylococcus aureus subsp. aureus MW2
gaagcugacgaaaagucagcu

SEQ ID NO: 2098305 - RNA, 22 nt, Staphylococcus aureus subsp. aureus MW2
gaagcugacgaaaagucagcuu

SEQ ID NO: 2098306 - RNA, 21 nt, Staphylococcus aureus subsp. aureus MW2
gaagcuggcggaaagucagcu

SEQ ID NO: 2098307 - RNA, 22 nt, Staphylococcus aureus subsp. aureus MW2
gaagcuggcggaaagucagcuu

SEQ ID NO: 2098308 - RNA, 20 nt, Staphylococcus aureus subsp. aureus MW2
gaagcuggcggaaagucagg

SEQ ID NO: 2098309 - RNA, 18 nt, Staphylococcus aureus subsp. aureus MW2
gaagcugucuuacugcug

SEQ ID NO: 2098310 - RNA, 21 nt, Staphylococcus aureus subsp. aureus MW2
gaagcuaaguauauaagcaaa

SEQ ID NO: 2098311 - RNA, 16 nt, Staphylococcus aureus subsp. aureus MW2
gaagcggguugaagca

SEQ ID NO: 2098312 - RNA, 19 nt, Staphylococcus aureus subsp. aureus MW2
gaagccccuggugauucac

SEQ ID NO: 2098313 - RNA, 22 nt, Staphylococcus aureus subsp. aureus MW2
gaagcgcuuggauuuuuugguu

SEQ ID NO: 2098314 - RNA, 15 nt, Staphylococcus aureus subsp. aureus MW2
gaagcacagaaaauu

SEQ ID NO: 2098315 - RNA, 20 nt, Staphylococcus aureus subsp. aureus MW2
gaagcaguuguugguuuugc

SEQ ID NO: 2098316 - RNA, 17 nt, Staphylococcus aureus subsp. aureus MW2
gaagcaaaagaugaaaa

SEQ ID NO: 2098317 - RNA, 18 nt, Staphylococcus aureus subsp. aureus MW2
gaagcaaaagaugaaaau

SEQ ID NO: 2098318 - RNA, 12 nt, Staphylococcus aureus subsp. aureus MW2
gaagagaaaauu

SEQ ID NO: 2098319 - RNA, 15 nt, Staphylococcus aureus subsp. aureus MW2
gaagaauacaaauau

SEQ ID NO: 2098320 - RNA, 22 nt, Staphylococcus aureus subsp. aureus MW2
gaagaauccuaugccaaauaac

SEQ ID NO: 2098321 - RNA, 14 nt, Staphylococcus aureus subsp. aureus MW2
gaagaccuucuaaa

SEQ ID NO: 2098322 - RNA, 16 nt, Staphylococcus aureus subsp. aureus MW2
gaagaaacuuaaucaa

SEQ ID NO: 2098323 - RNA, 19 nt, Staphylococcus aureus subsp. aureus MW2
gaagaaacuuaaucaagcu

SEQ ID NO: 2098324 - RNA, 22 nt, Staphylococcus aureus subsp. aureus MW2
gaagaaacuaaauacgaguguu

SEQ ID NO: 2098325 - RNA, 14 nt, Staphylococcus aureus subsp. aureus MW2
gaacuucucuuuga

SEQ ID NO: 2098326 - RNA, 19 nt, Staphylococcus aureus subsp. aureus MW2
gaacuucuuuuuuguaucu

SEQ ID NO: 2098327 - RNA, 18 nt, Staphylococcus aureus subsp. aureus MW2
gaaaucucggcauuuuua

SEQ ID NO: 2098328 - RNA, 20 nt, Staphylococcus aureus subsp. aureus MW2
gaaauccgcauaaauuagau

SEQ ID NO: 2098329 - RNA, 19 nt, Staphylococcus aureus subsp. aureus MW2
gaaauccgcauaaauuaga

SEQ ID NO: 2098330 - RNA, 19 nt, Staphylococcus aureus subsp. aureus MW2
gaaaucaguuugaauugac

SEQ ID NO: 2098331 - RNA, 16 nt, Staphylococcus aureus subsp. aureus MW2
gaaaucaguaauauca

SEQ ID NO: 2098332 - RNA, 16 nt, Staphylococcus aureus subsp. aureus MW2
gaaaugguaucuaaau

SEQ ID NO: 2098333 - RNA, 19 nt, Staphylococcus aureus subsp. aureus MW2
gaaaugguaucuaaaugug

SEQ ID NO: 2098334 - RNA, 21 nt, Staphylococcus aureus subsp. aureus MW2
gaaaugguaucuaaaugugaa

SEQ ID NO: 2098335 - RNA, 13 nt, Staphylococcus aureus subsp. aureus MW2
gaaauggaaagua

SEQ ID NO: 2098336 - RNA, 15 nt, Staphylococcus aureus subsp. aureus MW2
gaaaugauaauuuaa

SEQ ID NO: 2098337 - RNA, 13 nt, Staphylococcus aureus subsp. aureus MW2
gaaaugauaauuu

SEQ ID NO: 2098338 - RNA, 19 nt, Staphylococcus aureus subsp. aureus MW2
gaaaugauauuuucgcaaa

SEQ ID NO: 2098339 - RNA, 13 nt, Staphylococcus aureus subsp. aureus MW2
gaaaugcauugag

SEQ ID NO: 2098340 - RNA, 11 nt, Staphylococcus aureus subsp. aureus MW2
gaaauuagaaa

SEQ ID NO: 2098341 - RNA, 18 nt, Staphylococcus aureus subsp. aureus MW2
gaaauguuuuggaaaaau

SEQ ID NO: 2098342 - RNA, 18 nt, Staphylococcus aureus subsp. aureus MW2
gaaauguuuauaauaaua

SEQ ID NO: 2098343 - RNA, 19 nt, Staphylococcus aureus subsp. aureus MW2
gaaauguuuauaauaauau

SEQ ID NO: 2098344 - RNA, 16 nt, Staphylococcus aureus subsp. aureus MW2
gaaauguuuuggaaaa

SEQ ID NO: 2098345 - RNA, 13 nt, Staphylococcus aureus subsp. aureus MW2
gaaauuaaaucua

SEQ ID NO: 2098346 - RNA, 14 nt, Staphylococcus aureus subsp. aureus MW2
gaaauuaaaucuac

SEQ ID NO: 2098347 - RNA, 16 nt, Staphylococcus aureus subsp. aureus MW2
gaaauuaaaucuacaa

SEQ ID NO: 2098348 - RNA, 20 nt, Staphylococcus aureus subsp. aureus MW2
gaaauucuuuauguuggggc

SEQ ID NO: 2098349 - RNA, 21 nt, Staphylococcus aureus subsp. aureus MW2
gaaauucuuuauguuggggcc

SEQ ID NO: 2098350 - RNA, 20 nt, Staphylococcus aureus subsp. aureus MW2
gaacaacauugagauuaucu

SEQ ID NO: 2098351 - RNA, 16 nt, Staphylococcus aureus subsp. aureus MW2
gaacaacauuaggaug

SEQ ID NO: 2098352 - RNA, 14 nt, Staphylococcus aureus subsp. aureus MW2
gaacaaaauguagg

SEQ ID NO: 2098353 - RNA, 16 nt, Staphylococcus aureus subsp. aureus MW2
gaaauuugauuuucaa

SEQ ID NO: 2098354 - RNA, 18 nt, Staphylococcus aureus subsp. aureus MW2
gaaauuguguuucuuuua

SEQ ID NO: 2098355 - RNA, 17 nt, Staphylococcus aureus subsp. aureus MW2
gaaauugugaacuaaau

SEQ ID NO: 2098356 - RNA, 17 nt, Staphylococcus aureus subsp. aureus MW2
gaaauuguaguauuuuu

SEQ ID NO: 2098357 - RNA, 19 nt, Staphylococcus aureus subsp. aureus MW2
gaaauuguguuucuuuuau

SEQ ID NO: 2098358 - RNA, 15 nt, Staphylococcus aureus subsp. aureus MW2
gaaauuguucuaaua

SEQ ID NO: 2098359 - RNA, 21 nt, Staphylococcus aureus subsp. aureus MW2
gaaauuuauuauaaaauagaa

SEQ ID NO: 2098360 - RNA, 16 nt, Staphylococcus aureus subsp. aureus MW2
gaaauuuauuauaauu

SEQ ID NO: 2098361 - RNA, 21 nt, Staphylococcus aureus subsp. aureus MW2
gaacagauauacuacuuguuu

SEQ ID NO: 2098362 - RNA, 16 nt, Staphylococcus aureus subsp. aureus MW2
gaacagcacauuuuua

SEQ ID NO: 2098363 - RNA, 19 nt, Staphylococcus aureus subsp. aureus MW2
gaacagcaucuuguucuuc

SEQ ID NO: 2098364 - RNA, 21 nt, Staphylococcus aureus subsp. aureus MW2
gaacaauaauaugccaaagua

SEQ ID NO: 2098365 - RNA, 23 nt, Staphylococcus aureus subsp. aureus MW2
gaacaaucggaagcauauuucua

SEQ ID NO: 2098366 - RNA, 12 nt, Staphylococcus aureus subsp. aureus MW2
gaacaaugguua

SEQ ID NO: 2098367 - RNA, 18 nt, Staphylococcus aureus subsp. aureus MW2
gaacaccaauauaaacau

SEQ ID NO: 2098368 - RNA, 14 nt, Staphylococcus aureus subsp. aureus MW2
gaaccaacaauaaa

SEQ ID NO: 2098369 - RNA, 14 nt, Staphylococcus aureus subsp. aureus MW2
gaacaucuaguuau

SEQ ID NO: 2098370 - RNA, 19 nt, Staphylococcus aureus subsp. aureus MW2
gaacaucuaguuauuucau

SEQ ID NO: 2098371 - RNA, 22 nt, Staphylococcus aureus subsp. aureus MW2
gaacauaccugcauauguguuu

SEQ ID NO: 2098372 - RNA, 15 nt, Staphylococcus aureus subsp. aureus MW2
gaacauauuauaaaa

SEQ ID NO: 2098373 - RNA, 18 nt, Staphylococcus aureus subsp. aureus MW2
gaacauauucauaauauc

SEQ ID NO: 2098374 - RNA, 21 nt, Staphylococcus aureus subsp. aureus MW2
gaacauagucugcuauuuuuu

SEQ ID NO: 2098375 - RNA, 16 nt, Staphylococcus aureus subsp. aureus MW2
gaaagugauucccaaa

SEQ ID NO: 2098376 - RNA, 12 nt, Staphylococcus aureus subsp. aureus MW2
gaaagugauuua

SEQ ID NO: 2098377 - RNA, 23 nt, Staphylococcus aureus subsp. aureus MW2
gaaagucuuuaaccaaaauugau

SEQ ID NO: 2098378 - RNA, 19 nt, Staphylococcus aureus subsp. aureus MW2
gaaaguuucgacguaccaa

SEQ ID NO: 2098379 - RNA, 19 nt, Staphylococcus aureus subsp. aureus MW2
gaaaguugcuuagcuucuc

SEQ ID NO: 2098380 - RNA, 21 nt, Staphylococcus aureus subsp. aureus MW2
gaaauaaucuaguaucuauca

SEQ ID NO: 2098381 - RNA, 15 nt, Staphylococcus aureus subsp. aureus MW2
gaaauaauauuaacg

SEQ ID NO: 2098382 - RNA, 9 nt, Staphylococcus aureus subsp. aureus MW2
gaaauaaua

SEQ ID NO: 2098383 - RNA, 12 nt, Staphylococcus aureus subsp. aureus MW2
gaaauaauaacg

SEQ ID NO: 2098384 - RNA, 14 nt, Staphylococcus aureus subsp. aureus MW2
gaaauaaaaaauaa

SEQ ID NO: 2098385 - RNA, 18 nt, Staphylococcus aureus subsp. aureus MW2
gaaauaaauuuugagaaa

SEQ ID NO: 2098386 - RNA, 20 nt, Staphylococcus aureus subsp. aureus MW2
gaaauaaauuuugagaaaau

SEQ ID NO: 2098387 - RNA, 21 nt, Staphylococcus aureus subsp. aureus MW2
gaaauaaauuuugagaaaaua

SEQ ID NO: 2098388 - RNA, 17 nt, Staphylococcus aureus subsp. aureus MW2
gaaauauuguaaucacu

SEQ ID NO: 2098389 - RNA, 14 nt, Staphylococcus aureus subsp. aureus MW2
gaaauaugauugaa

SEQ ID NO: 2098390 - RNA, 13 nt, Staphylococcus aureus subsp. aureus MW2
gaaauaugaaaag

SEQ ID NO: 2098391 - RNA, 15 nt, Staphylococcus aureus subsp. aureus MW2
gaaauaucaagaugu

SEQ ID NO: 2098392 - RNA, 15 nt, Staphylococcus aureus subsp. aureus MW2
gaaauauaguaacag

SEQ ID NO: 2098393 - RNA, 23 nt, Staphylococcus aureus subsp. aureus MW2
gaaauauaccaaccaaaaccaaa

SEQ ID NO: 2098394 - RNA, 21 nt, Staphylococcus aureus subsp. aureus MW2
gaaauagguaucuuaaagcau

SEQ ID NO: 2098395 - RNA, 18 nt, Staphylococcus aureus subsp. aureus MW2
gaaauaggugcuuguaaa

SEQ ID NO: 2098396 - RNA, 21 nt, Staphylococcus aureus subsp. aureus MW2
gaaauaggugcuuguaaaauu

SEQ ID NO: 2098397 - RNA, 19 nt, Staphylococcus aureus subsp. aureus MW2
gaaaguaccgguuuuucau

SEQ ID NO: 2098398 - RNA, 16 nt, Staphylococcus aureus subsp. aureus MW2
gaaagucagcuuacaa

SEQ ID NO: 2098399 - RNA, 20 nt, Staphylococcus aureus subsp. aureus MW2
gaaagucagcuuacaauaau

SEQ ID NO: 2098400 - RNA, 22 nt, Staphylococcus aureus subsp. aureus MW2
gaaagucagcuuacaauaaugu

SEQ ID NO: 2098401 - RNA, 16 nt, Staphylococcus aureus subsp. aureus MW2
gaaagcuuuaacuuga

SEQ ID NO: 2098402 - RNA, 14 nt, Staphylococcus aureus subsp. aureus MW2
gaaagauauuucug

SEQ ID NO: 2098403 - RNA, 18 nt, Staphylococcus aureus subsp. aureus MW2
gaaagcauagcuguaugg

SEQ ID NO: 2098404 - RNA, 21 nt, Staphylococcus aureus subsp. aureus MW2
gaaagcuaauaucaauaaugc

SEQ ID NO: 2098405 - RNA, 20 nt, Staphylococcus aureus subsp. aureus MW2
gaaagcgucuuuuuauacuu

SEQ ID NO: 2098406 - RNA, 14 nt, Staphylococcus aureus subsp. aureus MW2
gaaacuaauaauuu

SEQ ID NO: 2098407 - RNA, 15 nt, Staphylococcus aureus subsp. aureus MW2
gaaacugaaguugaa

SEQ ID NO: 2098408 - RNA, 14 nt, Staphylococcus aureus subsp. aureus MW2
gaaacuuuaauacu

SEQ ID NO: 2098409 - RNA, 15 nt, Staphylococcus aureus subsp. aureus MW2
gaaacuuuaauacua

SEQ ID NO: 2098410 - RNA, 19 nt, Staphylococcus aureus subsp. aureus MW2
gaaacuggauaaauaaaga

SEQ ID NO: 2098411 - RNA, 14 nt, Staphylococcus aureus subsp. aureus MW2
gaaagaagucugca

SEQ ID NO: 2098412 - RNA, 21 nt, Staphylococcus aureus subsp. aureus MW2
gaaagacguuuuuuuauaaau

SEQ ID NO: 2098413 - RNA, 17 nt, Staphylococcus aureus subsp. aureus MW2
gaaagaccguauuuuuu

SEQ ID NO: 2098414 - RNA, 21 nt, Staphylococcus aureus subsp. aureus MW2
gaaaccuuucgauaaacuaca

SEQ ID NO: 2098415 - RNA, 14 nt, Staphylococcus aureus subsp. aureus MW2
gaaaccuuaaaauc

SEQ ID NO: 2098416 - RNA, 14 nt, Staphylococcus aureus subsp. aureus MW2
gaaacauuaaaaua

SEQ ID NO: 2098417 - RNA, 16 nt, Staphylococcus aureus subsp. aureus MW2
gaaacaucuugauauu

SEQ ID NO: 2098418 - RNA, 14 nt, Staphylococcus aureus subsp. aureus MW2
gaaaccaaaaauaa

SEQ ID NO: 2098419 - RNA, 12 nt, Staphylococcus aureus subsp. aureus MW2
cuuuuuuaaguu

SEQ ID NO: 2098420 - RNA, 20 nt, Staphylococcus aureus subsp. aureus MW2
cuuuuuuacauuuaacauuu

SEQ ID NO: 2098421 - RNA, 19 nt, Staphylococcus aureus subsp. aureus MW2
cuuuuuuaccagcaugaau

SEQ ID NO: 2098422 - RNA, 16 nt, Staphylococcus aureus subsp. aureus MW2
cuuuuuuaagaucaau

SEQ ID NO: 2098423 - RNA, 18 nt, Staphylococcus aureus subsp. aureus MW2
cuuuuuguuaauuuuuua

SEQ ID NO: 2098424 - RNA, 21 nt, Staphylococcus aureus subsp. aureus MW2
cuuuuugcguuuuuaaauaau

SEQ ID NO: 2098425 - RNA, 17 nt, Staphylococcus aureus subsp. aureus MW2
cuuuuugcguuuuuaaa

SEQ ID NO: 2098426 - RNA, 20 nt, Staphylococcus aureus subsp. aureus MW2
cuuuuugucucucaacauuu

SEQ ID NO: 2098427 - RNA, 15 nt, Staphylococcus aureus subsp. aureus MW2
cuuuuugcuuaguac

SEQ ID NO: 2098428 - RNA, 19 nt, Staphylococcus aureus subsp. aureus MW2
cuuuuuugaaaugguaucu

SEQ ID NO: 2098429 - RNA, 17 nt, Staphylococcus aureus subsp. aureus MW2
cuuuuuuuaugaaaaga

SEQ ID NO: 2098430 - RNA, 13 nt, Staphylococcus aureus subsp. aureus MW2
cuuuuuugugauu

SEQ ID NO: 2098431 - RNA, 13 nt, Staphylococcus aureus subsp. aureus MW2
cuuuuuuuuauaa

SEQ ID NO: 2098432 - RNA, 22 nt, Staphylococcus aureus subsp. aureus MW2
gaaaaaauuaauaauuuuccau

SEQ ID NO: 2098433 - RNA, 12 nt, Staphylococcus aureus subsp. aureus MW2
gaaaaaccaagu

SEQ ID NO: 2098434 - RNA, 20 nt, Staphylococcus aureus subsp. aureus MW2
gaaaaauuucaaaaauagcg

SEQ ID NO: 2098435 - RNA, 19 nt, Staphylococcus aureus subsp. aureus MW2
gaaaaauguguuaaaauau

SEQ ID NO: 2098436 - RNA, 16 nt, Staphylococcus aureus subsp. aureus MW2
gaaaaauuucaaaaau

SEQ ID NO: 2098437 - RNA, 18 nt, Staphylococcus aureus subsp. aureus MW2
gaaaaauugcucauugug

SEQ ID NO: 2098438 - RNA, 22 nt, Staphylococcus aureus subsp. aureus MW2
gaaaacauaaauacaaaaauau

SEQ ID NO: 2098439 - RNA, 14 nt, Staphylococcus aureus subsp. aureus MW2
gaaaacgaacaagg

SEQ ID NO: 2098440 - RNA, 20 nt, Staphylococcus aureus subsp. aureus MW2
gaaaaagauucggaaaauau

SEQ ID NO: 2098441 - RNA, 17 nt, Staphylococcus aureus subsp. aureus MW2
gaaaaagcaggcaagcu

SEQ ID NO: 2098442 - RNA, 20 nt, Staphylococcus aureus subsp. aureus MW2
gaaaaagugauaauuaaaau

SEQ ID NO: 2098443 - RNA, 21 nt, Staphylococcus aureus subsp. aureus MW2
gaaacaagaaguuuccaacgu

SEQ ID NO: 2098444 - RNA, 15 nt, Staphylococcus aureus subsp. aureus MW2
gaaacacacuaaaag

SEQ ID NO: 2098445 - RNA, 13 nt, Staphylococcus aureus subsp. aureus MW2
gaaaauuuuauca

SEQ ID NO: 2098446 - RNA, 16 nt, Staphylococcus aureus subsp. aureus MW2
gaaaauuaucuuucau

SEQ ID NO: 2098447 - RNA, 14 nt, Staphylococcus aureus subsp. aureus MW2
gaaaauuaaaaaau

SEQ ID NO: 2098448 - RNA, 14 nt, Staphylococcus aureus subsp. aureus MW2
gaaaauugcuaaaa

SEQ ID NO: 2098449 - RNA, 18 nt, Staphylococcus aureus subsp. aureus MW2
gaaaauugcuaaaaaaau

SEQ ID NO: 2098450 - RNA, 23 nt, Staphylococcus aureus subsp. aureus MW2
gaaaaucuuuaacucuugaaaca

SEQ ID NO: 2098451 - RNA, 18 nt, Staphylococcus aureus subsp. aureus MW2
gaaaaugcgcuuguaaca

SEQ ID NO: 2098452 - RNA, 22 nt, Staphylococcus aureus subsp. aureus MW2
gaaaaugcgcuuguaacaagcu

SEQ ID NO: 2098453 - RNA, 15 nt, Staphylococcus aureus subsp. aureus MW2
gaaaauaucauuucu

SEQ ID NO: 2098454 - RNA, 17 nt, Staphylococcus aureus subsp. aureus MW2
gaaaauagccauaucau

SEQ ID NO: 2098455 - RNA, 21 nt, Staphylococcus aureus subsp. aureus MW2
gaaaauaucacuaauauauuu

SEQ ID NO: 2098456 - RNA, 17 nt, Staphylococcus aureus subsp. aureus MW2
gaaaauauauuauaaaa

SEQ ID NO: 2098457 - RNA, 14 nt, Staphylococcus aureus subsp. aureus MW2
gaaaauaaaaacca

SEQ ID NO: 2098458 - RNA, 20 nt, Staphylococcus aureus subsp. aureus MW2
gaaaagggaauggauuacag

SEQ ID NO: 2098459 - RNA, 14 nt, Staphylococcus aureus subsp. aureus MW2
gaaaaguauaugaa

SEQ ID NO: 2098460 - RNA, 16 nt, Staphylococcus aureus subsp. aureus MW2
gaaaagucacagugua

SEQ ID NO: 2098461 - RNA, 13 nt, Staphylococcus aureus subsp. aureus MW2
gaaaagucagcuu

SEQ ID NO: 2098462 - RNA, 17 nt, Staphylococcus aureus subsp. aureus MW2
gaaaagucagcuuacaa

SEQ ID NO: 2098463 - RNA, 20 nt, Staphylococcus aureus subsp. aureus MW2
gaaaauagcuguuugauauu

SEQ ID NO: 2098464 - RNA, 22 nt, Staphylococcus aureus subsp. aureus MW2
gaaaauagcuauuaaaauagag

SEQ ID NO: 2098465 - RNA, 18 nt, Staphylococcus aureus subsp. aureus MW2
gaaaauaccaacugcaaa

SEQ ID NO: 2098466 - RNA, 17 nt, Staphylococcus aureus subsp. aureus MW2
gaaaauaaaacaaauua

SEQ ID NO: 2098467 - RNA, 16 nt, Staphylococcus aureus subsp. aureus MW2
gaaaagaaauucuaca

SEQ ID NO: 2098468 - RNA, 15 nt, Staphylococcus aureus subsp. aureus MW2
gaaaagagaaacaaa

SEQ ID NO: 2098469 - RNA, 17 nt, Staphylococcus aureus subsp. aureus MW2
gaaaagagauuuuuuug

SEQ ID NO: 2098470 - RNA, 21 nt, Staphylococcus aureus subsp. aureus MW2
gaaaagagauuuuuuugaaaa

SEQ ID NO: 2098471 - RNA, 18 nt, Staphylococcus aureus subsp. aureus MW2
gaaaagcuagaaguucuu

SEQ ID NO: 2098472 - RNA, 16 nt, Staphylococcus aureus subsp. aureus MW2
cuuuuucuaaauaaac

SEQ ID NO: 2098473 - RNA, 21 nt, Staphylococcus aureus subsp. aureus MW2
cuuuuucgauuaauucuucuu

SEQ ID NO: 2098474 - RNA, 23 nt, Staphylococcus aureus subsp. aureus MW2
cuuuuucgauuaauucuucuuca

SEQ ID NO: 2098475 - RNA, 19 nt, Staphylococcus aureus subsp. aureus MW2
cuuuuucacgauuuuuaaa

SEQ ID NO: 2098476 - RNA, 22 nt, Staphylococcus aureus subsp. aureus MW2
cuuuuucacgauuuuuaaaaug

SEQ ID NO: 2098477 - RNA, 18 nt, Staphylococcus aureus subsp. aureus MW2
cuuuuucacuaaucauuu

SEQ ID NO: 2098478 - RNA, 22 nt, Staphylococcus aureus subsp. aureus MW2
cuuuuucacuaaucauuuuuuc

SEQ ID NO: 2098479 - RNA, 21 nt, Staphylococcus aureus subsp. aureus MW2
cuuuuucauaaauauuuaaaa

SEQ ID NO: 2098480 - RNA, 15 nt, Staphylococcus aureus subsp. aureus MW2
cuuuuucauagaaca

SEQ ID NO: 2098481 - RNA, 19 nt, Staphylococcus aureus subsp. aureus MW2
cuuuuugacauauuuuuua

SEQ ID NO: 2098482 - RNA, 17 nt, Staphylococcus aureus subsp. aureus MW2
cuuuuucuauacaauga

SEQ ID NO: 2098483 - RNA, 17 nt, Staphylococcus aureus subsp. aureus MW2
cuuuuuagccccagcaa

SEQ ID NO: 2098484 - RNA, 16 nt, Staphylococcus aureus subsp. aureus MW2
cuuuuuagcauauucu

SEQ ID NO: 2098485 - RNA, 21 nt, Staphylococcus aureus subsp. aureus MW2
cuuuuuacuaggaauauaaaa

SEQ ID NO: 2098486 - RNA, 15 nt, Staphylococcus aureus subsp. aureus MW2
cuuuuuaauauuuuu

SEQ ID NO: 2098487 - RNA, 12 nt, Staphylococcus aureus subsp. aureus MW2
cuuuuuaaaaaa

SEQ ID NO: 2098488 - RNA, 15 nt, Staphylococcus aureus subsp. aureus MW2
cuuuuuaaaaaauuu

SEQ ID NO: 2098489 - RNA, 15 nt, Staphylococcus aureus subsp. aureus MW2
cuuuuuaaaaucguu

SEQ ID NO: 2098490 - RNA, 12 nt, Staphylococcus aureus subsp. aureus MW2
cuuuuuaaagua

SEQ ID NO: 2098491 - RNA, 12 nt, Staphylococcus aureus subsp. aureus MW2
cuuuuuaaagga

SEQ ID NO: 2098492 - RNA, 17 nt, Staphylococcus aureus subsp. aureus MW2
cuuuuuauuuuaauauu

SEQ ID NO: 2098493 - RNA, 13 nt, Staphylococcus aureus subsp. aureus MW2
cuuuuucaaaaau

SEQ ID NO: 2098494 - RNA, 23 nt, Staphylococcus aureus subsp. aureus MW2
cuuuuucaaaaauuguuaauccc

SEQ ID NO: 2098495 - RNA, 23 nt, Staphylococcus aureus subsp. aureus MW2
cuuuuuauuuauaacuuuaaaaa

SEQ ID NO: 2098496 - RNA, 18 nt, Staphylococcus aureus subsp. aureus MW2
cuuuuuauugauauuaau

SEQ ID NO: 2098497 - RNA, 23 nt, Staphylococcus aureus subsp. aureus MW2
cuuuuuauuguaauaaagaaggg

SEQ ID NO: 2098498 - RNA, 21 nt, Staphylococcus aureus subsp. aureus MW2
cuuuuucaaauaauauaaaac

SEQ ID NO: 2098499 - RNA, 21 nt, Staphylococcus aureus subsp. aureus MW2
cuuuuuaggaaugauagauuu

SEQ ID NO: 2098500 - RNA, 16 nt, Staphylococcus aureus subsp. aureus MW2
cuuuugcuguaucuuc

SEQ ID NO: 2098501 - RNA, 19 nt, Staphylococcus aureus subsp. aureus MW2
cuuuuguuuaguauggaau

SEQ ID NO: 2098502 - RNA, 20 nt, Staphylococcus aureus subsp. aureus MW2
cuuuuguguuugcccugcug

SEQ ID NO: 2098503 - RNA, 16 nt, Staphylococcus aureus subsp. aureus MW2
cuuuuguaccaucaau

SEQ ID NO: 2098504 - RNA, 19 nt, Staphylococcus aureus subsp. aureus MW2
cuuuuguaccaucaauaaa

SEQ ID NO: 2098505 - RNA, 16 nt, Staphylococcus aureus subsp. aureus MW2
cuuuuguccaacaugu

SEQ ID NO: 2098506 - RNA, 19 nt, Staphylococcus aureus subsp. aureus MW2
cuuuugaauaauaaacuua

SEQ ID NO: 2098507 - RNA, 13 nt, Staphylococcus aureus subsp. aureus MW2
cuuuugauagcua

SEQ ID NO: 2098508 - RNA, 15 nt, Staphylococcus aureus subsp. aureus MW2
cuuuugauagcuaau

SEQ ID NO: 2098509 - RNA, 14 nt, Staphylococcus aureus subsp. aureus MW2
cuuuugauuuugaa

SEQ ID NO: 2098510 - RNA, 16 nt, Staphylococcus aureus subsp. aureus MW2
cuuuucuaauuuuucu

SEQ ID NO: 2098511 - RNA, 20 nt, Staphylococcus aureus subsp. aureus MW2
cuuuucgaaauucucugugu

SEQ ID NO: 2098512 - RNA, 14 nt, Staphylococcus aureus subsp. aureus MW2
cuuuucuaucaaaa

SEQ ID NO: 2098513 - RNA, 16 nt, Staphylococcus aureus subsp. aureus MW2
cuuuucuaucaaaaaa

SEQ ID NO: 2098514 - RNA, 18 nt, Staphylococcus aureus subsp. aureus MW2
cuuuucugucuguaaauu

SEQ ID NO: 2098515 - RNA, 21 nt, Staphylococcus aureus subsp. aureus MW2
cuuuucuugaaauaaacauau

SEQ ID NO: 2098516 - RNA, 12 nt, Staphylococcus aureus subsp. aureus MW2
cuuuguaauucu

SEQ ID NO: 2098517 - RNA, 13 nt, Staphylococcus aureus subsp. aureus MW2
cuuucuuuuucau

SEQ ID NO: 2098518 - RNA, 16 nt, Staphylococcus aureus subsp. aureus MW2
cuuucuuuuucaucuu

SEQ ID NO: 2098519 - RNA, 11 nt, Staphylococcus aureus subsp. aureus MW2
cuuucuuuucu

SEQ ID NO: 2098520 - RNA, 12 nt, Staphylococcus aureus subsp. aureus MW2
cuuucuuuucug

SEQ ID NO: 2098521 - RNA, 17 nt, Staphylococcus aureus subsp. aureus MW2
cuuucuuuaucauaucu

SEQ ID NO: 2098522 - RNA, 16 nt, Staphylococcus aureus subsp. aureus MW2
cuuuguguuugcuuuu

SEQ ID NO: 2098523 - RNA, 14 nt, Staphylococcus aureus subsp. aureus MW2
cuuuguguuugcuu

SEQ ID NO: 2098524 - RNA, 22 nt, Staphylococcus aureus subsp. aureus MW2
cuuuuaaaccguguucuuuaau

SEQ ID NO: 2098525 - RNA, 17 nt, Staphylococcus aureus subsp. aureus MW2
cuuuuacaaacuucaca

SEQ ID NO: 2098526 - RNA, 18 nt, Staphylococcus aureus subsp. aureus MW2
cuuuuaauuguauuuucu

SEQ ID NO: 2098527 - RNA, 21 nt, Staphylococcus aureus subsp. aureus MW2
cuuuuaauauuugauaacaaa

SEQ ID NO: 2098528 - RNA, 23 nt, Staphylococcus aureus subsp. aureus MW2
cuuuuaauauuuucauuuuucuu

SEQ ID NO: 2098529 - RNA, 16 nt, Staphylococcus aureus subsp. aureus MW2
cuuuuaauucuuaauc

SEQ ID NO: 2098530 - RNA, 18 nt, Staphylococcus aureus subsp. aureus MW2
cuuuuaaaccguguucuu

SEQ ID NO: 2098531 - RNA, 19 nt, Staphylococcus aureus subsp. aureus MW2
cuuuguuguaagguggacu

SEQ ID NO: 2098532 - RNA, 15 nt, Staphylococcus aureus subsp. aureus MW2
cuuuguuuucaaacu

SEQ ID NO: 2098533 - RNA, 23 nt, Staphylococcus aureus subsp. aureus MW2
cuuuguucugcuuuuucuuuauc

SEQ ID NO: 2098534 - RNA, 14 nt, Staphylococcus aureus subsp. aureus MW2
cuuuguuaaaaaau

SEQ ID NO: 2098535 - RNA, 13 nt, Staphylococcus aureus subsp. aureus MW2
cuuuguucugcuu

SEQ ID NO: 2098536 - RNA, 18 nt, Staphylococcus aureus subsp. aureus MW2
cuuuguucugcuuuuucu

SEQ ID NO: 2098537 - RNA, 14 nt, Staphylococcus aureus subsp. aureus MW2
cuuuucauuuaaug

SEQ ID NO: 2098538 - RNA, 16 nt, Staphylococcus aureus subsp. aureus MW2
cuuuucauuuuuuaga

SEQ ID NO: 2098539 - RNA, 17 nt, Staphylococcus aureus subsp. aureus MW2
cuuuuauuuaucuuuua

SEQ ID NO: 2098540 - RNA, 12 nt, Staphylococcus aureus subsp. aureus MW2
cuuuuauuuuca

SEQ ID NO: 2098541 - RNA, 18 nt, Staphylococcus aureus subsp. aureus MW2
cuuuucaucguucauaua

SEQ ID NO: 2098542 - RNA, 23 nt, Staphylococcus aureus subsp. aureus MW2
cuuuucaucuguccgauuuuuug

SEQ ID NO: 2098543 - RNA, 21 nt, Staphylococcus aureus subsp. aureus MW2
cuuuuacuuucucaucuauuu

SEQ ID NO: 2098544 - RNA, 18 nt, Staphylococcus aureus subsp. aureus MW2
cuuuuagaauucuaaaua

SEQ ID NO: 2098545 - RNA, 17 nt, Staphylococcus aureus subsp. aureus MW2
cuuuuacgccuucuuua

SEQ ID NO: 2098546 - RNA, 21 nt, Staphylococcus aureus subsp. aureus MW2
cuuuuacagaacguucauaua

SEQ ID NO: 2098547 - RNA, 18 nt, Staphylococcus aureus subsp. aureus MW2
cuuuuaugucuaguucuu

SEQ ID NO: 2098548 - RNA, 19 nt, Staphylococcus aureus subsp. aureus MW2
cuuuuauuacuuauuucuu

SEQ ID NO: 2098549 - RNA, 14 nt, Staphylococcus aureus subsp. aureus MW2
cuuuuauuacuuau

SEQ ID NO: 2098550 - RNA, 13 nt, Staphylococcus aureus subsp. aureus MW2
cuuuuauuauuuu

SEQ ID NO: 2098551 - RNA, 13 nt, Staphylococcus aureus subsp. aureus MW2
cuuuuauauuuuu

SEQ ID NO: 2098552 - RNA, 16 nt, Staphylococcus aureus subsp. aureus MW2
aaaaaauuaaaauguu

SEQ ID NO: 2098553 - RNA, 13 nt, Staphylococcus aureus subsp. aureus MW2
aaaaaauuaaaau

SEQ ID NO: 2098554 - RNA, 12 nt, Staphylococcus aureus subsp. aureus MW2
aaaaacaaaaaa

SEQ ID NO: 2098555 - RNA, 15 nt, Staphylococcus aureus subsp. aureus MW2
aaaaaauuuucauuu

SEQ ID NO: 2098556 - RNA, 21 nt, Staphylococcus aureus subsp. aureus MW2
aaaaacaaaacgcaauaacac

SEQ ID NO: 2098557 - RNA, 13 nt, Staphylococcus aureus subsp. aureus MW2
aaaaacaaaaaau

SEQ ID NO: 2098558 - RNA, 14 nt, Staphylococcus aureus subsp. aureus MW2
aaaaacaaaaaaua

SEQ ID NO: 2098559 - RNA, 12 nt, Staphylococcus aureus subsp. aureus MW2
aaaaaauuaaua

SEQ ID NO: 2098560 - RNA, 14 nt, Staphylococcus aureus subsp. aureus MW2
aaaaaacaguguag

SEQ ID NO: 2098561 - RNA, 15 nt, Staphylococcus aureus subsp. aureus MW2
aaaaaaccaauaauc

SEQ ID NO: 2098562 - RNA, 21 nt, Staphylococcus aureus subsp. aureus MW2
aaaaauugauaguagcuuaau

SEQ ID NO: 2098563 - RNA, 18 nt, Staphylococcus aureus subsp. aureus MW2
aaaaauguaaauaaaaau

SEQ ID NO: 2098564 - RNA, 16 nt, Staphylococcus aureus subsp. aureus MW2
aaaaaugugaccuuau

SEQ ID NO: 2098565 - RNA, 21 nt, Staphylococcus aureus subsp. aureus MW2
aaaaaugucuaaaaaaauguu

SEQ ID NO: 2098566 - RNA, 10 nt, Staphylococcus aureus subsp. aureus MW2
aaaaaugaaa

SEQ ID NO: 2098567 - RNA, 19 nt, Staphylococcus aureus subsp. aureus MW2
aaaaaugaagaauacaaau

SEQ ID NO: 2098568 - RNA, 22 nt, Staphylococcus aureus subsp. aureus MW2
aaaaaugaagucuuucaacaaa

SEQ ID NO: 2098569 - RNA, 17 nt, Staphylococcus aureus subsp. aureus MW2
aaaaaucacgcuaacau

SEQ ID NO: 2098570 - RNA, 21 nt, Staphylococcus aureus subsp. aureus MW2
aaaaaucuacauaugaaaaau

SEQ ID NO: 2098571 - RNA, 23 nt, Staphylococcus aureus subsp. aureus MW2
aaaaaucuacauaugaaaaaugu

SEQ ID NO: 2098572 - RNA, 18 nt, Staphylococcus aureus subsp. aureus MW2
aaaaaucuucuccaauca

SEQ ID NO: 2098573 - RNA, 12 nt, Staphylococcus aureus subsp. aureus MW2
aaaaauauguau

SEQ ID NO: 2098574 - RNA, 17 nt, Staphylococcus aureus subsp. aureus MW2
aaaaauauucaaacgaa

SEQ ID NO: 2098575 - RNA, 14 nt, Staphylococcus aureus subsp. aureus MW2
aaaaauauuuaaac

SEQ ID NO: 2098576 - RNA, 13 nt, Staphylococcus aureus subsp. aureus MW2
aaaaauauuuaaa

SEQ ID NO: 2098577 - RNA, 21 nt, Staphylococcus aureus subsp. aureus MW2
aaaaauauguuuaauguauaa

SEQ ID NO: 2098578 - RNA, 19 nt, Staphylococcus aureus subsp. aureus MW2
aaaaagugauaauuaaaau

SEQ ID NO: 2098579 - RNA, 23 nt, Staphylococcus aureus subsp. aureus MW2
aaaaagucccgcuuaaaaugauu

SEQ ID NO: 2098580 - RNA, 15 nt, Staphylococcus aureus subsp. aureus MW2
aaaaagucaaagagg

SEQ ID NO: 2098581 - RNA, 18 nt, Staphylococcus aureus subsp. aureus MW2
aaaaagucuuuaauagcu

SEQ ID NO: 2098582 - RNA, 19 nt, Staphylococcus aureus subsp. aureus MW2
aaaacaguguagcacaaga

SEQ ID NO: 2098583 - RNA, 17 nt, Staphylococcus aureus subsp. aureus MW2
aaaacauaaauacaaaa

SEQ ID NO: 2098584 - RNA, 18 nt, Staphylococcus aureus subsp. aureus MW2
aaaacagguggaaguguu

SEQ ID NO: 2098585 - RNA, 16 nt, Staphylococcus aureus subsp. aureus MW2
aaaacaaaaaauaucu

SEQ ID NO: 2098586 - RNA, 15 nt, Staphylococcus aureus subsp. aureus MW2
aaaacaaaaaauauc

SEQ ID NO: 2098587 - RNA, 15 nt, Staphylococcus aureus subsp. aureus MW2
aaaacaaaaaaccga

SEQ ID NO: 2098588 - RNA, 13 nt, Staphylococcus aureus subsp. aureus MW2
aaaacaaaaccaa

SEQ ID NO: 2098589 - RNA, 13 nt, Staphylococcus aureus subsp. aureus MW2
aaaacaaauuaca

SEQ ID NO: 2098590 - RNA, 21 nt, Staphylococcus aureus subsp. aureus MW2
aaaaccgcuauaaaauuuuga

SEQ ID NO: 2098591 - RNA, 22 nt, Staphylococcus aureus subsp. aureus MW2
aaaaccgcuauaaaauuuugaa

SEQ ID NO: 2098592 - RNA, 20 nt, Staphylococcus aureus subsp. aureus MW2
aaaaccuauuccuaauaaau

SEQ ID NO: 2098593 - RNA, 21 nt, Staphylococcus aureus subsp. aureus MW2
aaaaccuauuccuaauaaaua

SEQ ID NO: 2098594 - RNA, 21 nt, Staphylococcus aureus subsp. aureus MW2
aaaaccgaacaucugaaaaaa

SEQ ID NO: 2098595 - RNA, 17 nt, Staphylococcus aureus subsp. aureus MW2
aaaaccgaacaucugaa

SEQ ID NO: 2098596 - RNA, 21 nt, Staphylococcus aureus subsp. aureus MW2
aaaaccccuguugaacuuuag

SEQ ID NO: 2098597 - RNA, 15 nt, Staphylococcus aureus subsp. aureus MW2
aaaaccgagaaucuc

SEQ ID NO: 2098598 - RNA, 20 nt, Staphylococcus aureus subsp. aureus MW2
aaaaccgaggaaauccuuaa

SEQ ID NO: 2098599 - RNA, 16 nt, Staphylococcus aureus subsp. aureus MW2
aaaaccaguuugauua

SEQ ID NO: 2098600 - RNA, 23 nt, Staphylococcus aureus subsp. aureus MW2
aaaaacgguacagauaagaauau

SEQ ID NO: 2098601 - RNA, 19 nt, Staphylococcus aureus subsp. aureus MW2
aaaaacuguaaaucaucau

SEQ ID NO: 2098602 - RNA, 18 nt, Staphylococcus aureus subsp. aureus MW2
aaaaaccgaacaucugaa

SEQ ID NO: 2098603 - RNA, 15 nt, Staphylococcus aureus subsp. aureus MW2
aaaaacgcuuuuaaa

SEQ ID NO: 2098604 - RNA, 20 nt, Staphylococcus aureus subsp. aureus MW2
aaaaacgcuuuuaaaccgug

SEQ ID NO: 2098605 - RNA, 18 nt, Staphylococcus aureus subsp. aureus MW2
aaaaaccguaauuuuaau

SEQ ID NO: 2098606 - RNA, 15 nt, Staphylococcus aureus subsp. aureus MW2
aaaaacaaauguuuu

SEQ ID NO: 2098607 - RNA, 18 nt, Staphylococcus aureus subsp. aureus MW2
aaaaacaauaaaauuacu

SEQ ID NO: 2098608 - RNA, 22 nt, Staphylococcus aureus subsp. aureus MW2
aaaaagcugauuucuauuaauu

SEQ ID NO: 2098609 - RNA, 18 nt, Staphylococcus aureus subsp. aureus MW2
aaaaagucccgcuuaaaa

SEQ ID NO: 2098610 - RNA, 21 nt, Staphylococcus aureus subsp. aureus MW2
aaaaagguuguuuuucaucau

SEQ ID NO: 2098611 - RNA, 22 nt, Staphylococcus aureus subsp. aureus MW2
aaaaaggaugaugugaauguuu

SEQ ID NO: 2098612 - RNA, 19 nt, Staphylococcus aureus subsp. aureus MW2
aaaaagggcaaaaaaggau

SEQ ID NO: 2098613 - RNA, 16 nt, Staphylococcus aureus subsp. aureus MW2
aaaaacuugugaauuu

SEQ ID NO: 2098614 - RNA, 17 nt, Staphylococcus aureus subsp. aureus MW2
aaaaacuucuuaacuug

SEQ ID NO: 2098615 - RNA, 19 nt, Staphylococcus aureus subsp. aureus MW2
aaaaagcaguaagagauuu

SEQ ID NO: 2098616 - RNA, 21 nt, Staphylococcus aureus subsp. aureus MW2
aaaaagacggugaccuuauau

SEQ ID NO: 2098617 - RNA, 20 nt, Staphylococcus aureus subsp. aureus MW2
aaaaagacaauuucuauuua

SEQ ID NO: 2098618 - RNA, 22 nt, Staphylococcus aureus subsp. aureus MW2
aaaaagacaauuucuauuuaaa

SEQ ID NO: 2098619 - RNA, 17 nt, Staphylococcus aureus subsp. aureus MW2
aaaaagaguuaauaaaa

SEQ ID NO: 2098620 - RNA, 13 nt, Staphylococcus aureus subsp. aureus MW2
aaaaucaaagagg

SEQ ID NO: 2098621 - RNA, 14 nt, Staphylococcus aureus subsp. aureus MW2
aaaaucauaaauaa

SEQ ID NO: 2098622 - RNA, 17 nt, Staphylococcus aureus subsp. aureus MW2
aaaaucuuuaacauuug

SEQ ID NO: 2098623 - RNA, 15 nt, Staphylococcus aureus subsp. aureus MW2
aaaaucuuuaacucu

SEQ ID NO: 2098624 - RNA, 10 nt, Staphylococcus aureus subsp. aureus MW2
aaaauaccaa

SEQ ID NO: 2098625 - RNA, 13 nt, Staphylococcus aureus subsp. aureus MW2
aaaauacauaaua

SEQ ID NO: 2098626 - RNA, 14 nt, Staphylococcus aureus subsp. aureus MW2
aaaauacauaauua

SEQ ID NO: 2098627 - RNA, 19 nt, Staphylococcus aureus subsp. aureus MW2
aaaauacauaauuaacuuu

SEQ ID NO: 2098628 - RNA, 17 nt, Staphylococcus aureus subsp. aureus MW2
aaaauacauaauuaacu

SEQ ID NO: 2098629 - RNA, 21 nt, Staphylococcus aureus subsp. aureus MW2
aaaauaacuaagugaauuauc

SEQ ID NO: 2098630 - RNA, 18 nt, Staphylococcus aureus subsp. aureus MW2
aaaauauuuaaacuagua

SEQ ID NO: 2098631 - RNA, 14 nt, Staphylococcus aureus subsp. aureus MW2
aaaauauuuacauu

SEQ ID NO: 2098632 - RNA, 15 nt, Staphylococcus aureus subsp. aureus MW2
aaaauaugauuuaaa

SEQ ID NO: 2098633 - RNA, 22 nt, Staphylococcus aureus subsp. aureus MW2
aaaauaugauugcaaauuauca

SEQ ID NO: 2098634 - RNA, 17 nt, Staphylococcus aureus subsp. aureus MW2
aaaauaugacacauaca

SEQ ID NO: 2098635 - RNA, 17 nt, Staphylococcus aureus subsp. aureus MW2
aaaauaucuuuuuguuu

SEQ ID NO: 2098636 - RNA, 19 nt, Staphylococcus aureus subsp. aureus MW2
aaaauaucugaaaaaccaa

SEQ ID NO: 2098637 - RNA, 18 nt, Staphylococcus aureus subsp. aureus MW2
aaaauuacgcaaagaaaa

SEQ ID NO: 2098638 - RNA, 22 nt, Staphylococcus aureus subsp. aureus MW2
aaaauuacgcaaagaaaaacau

SEQ ID NO: 2098639 - RNA, 17 nt, Staphylococcus aureus subsp. aureus MW2
aaaauguuacacaaauu

SEQ ID NO: 2098640 - RNA, 16 nt, Staphylococcus aureus subsp. aureus MW2
aaaauguuaauaauga

SEQ ID NO: 2098641 - RNA, 15 nt, Staphylococcus aureus subsp. aureus MW2
aaaauguguuaaaau

SEQ ID NO: 2098642 - RNA, 21 nt, Staphylococcus aureus subsp. aureus MW2
aaaauguguuaaaauauauuu

SEQ ID NO: 2098643 - RNA, 14 nt, Staphylococcus aureus subsp. aureus MW2
aaaaugucuaaaaa

SEQ ID NO: 2098644 - RNA, 15 nt, Staphylococcus aureus subsp. aureus MW2
aaaaugucuaaaaaa

SEQ ID NO: 2098645 - RNA, 16 nt, Staphylococcus aureus subsp. aureus MW2
aaaauguuuaacaaua

SEQ ID NO: 2098646 - RNA, 13 nt, Staphylococcus aureus subsp. aureus MW2
aaaauuaaaaaac

SEQ ID NO: 2098647 - RNA, 20 nt, Staphylococcus aureus subsp. aureus MW2
aaaauguauuaaauaugcac

SEQ ID NO: 2098648 - RNA, 15 nt, Staphylococcus aureus subsp. aureus MW2
aaaauuaaauaauga

SEQ ID NO: 2098649 - RNA, 22 nt, Staphylococcus aureus subsp. aureus MW2
aaaauuaaauaaugauaaauua

SEQ ID NO: 2098650 - RNA, 15 nt, Staphylococcus aureus subsp. aureus MW2
aaaaugguuaaaauc

SEQ ID NO: 2098651 - RNA, 17 nt, Staphylococcus aureus subsp. aureus MW2
aaaaugaguacaacaua

SEQ ID NO: 2098652 - RNA, 23 nt, Staphylococcus aureus subsp. aureus MW2
aaaaugagcugaacuuucuuuau

SEQ ID NO: 2098653 - RNA, 21 nt, Staphylococcus aureus subsp. aureus MW2
aaaaugauagauucaaaauua

SEQ ID NO: 2098654 - RNA, 21 nt, Staphylococcus aureus subsp. aureus MW2
aaaaugauagcuaaacauuuu

SEQ ID NO: 2098655 - RNA, 21 nt, Staphylococcus aureus subsp. aureus MW2
aaaauggauuuuauuuucaaa

SEQ ID NO: 2098656 - RNA, 17 nt, Staphylococcus aureus subsp. aureus MW2
aaaaugaagaauacaaa

SEQ ID NO: 2098657 - RNA, 23 nt, Staphylococcus aureus subsp. aureus MW2
aaaaugaagucuuucaacaaaau

SEQ ID NO: 2098658 - RNA, 18 nt, Staphylococcus aureus subsp. aureus MW2
aaaaugaauaauuacuaa

SEQ ID NO: 2098659 - RNA, 24 nt, Staphylococcus aureus subsp. aureus MW2
aaaaugaauaauuacuaaaauauc

SEQ ID NO: 2098660 - RNA, 19 nt, Staphylococcus aureus subsp. aureus MW2
aaaaugaauguuaagacau

SEQ ID NO: 2098661 - RNA, 22 nt, Staphylococcus aureus subsp. aureus MW2
aaaaugacuaccuguuggcuuu

SEQ ID NO: 2098662 - RNA, 16 nt, Staphylococcus aureus subsp. aureus MW2
aaaaugacgauacgua

SEQ ID NO: 2098663 - RNA, 23 nt, Staphylococcus aureus subsp. aureus MW2
aaaaggugugggcuuuauuauca

SEQ ID NO: 2098664 - RNA, 16 nt, Staphylococcus aureus subsp. aureus MW2
aaaagucgauaaauau

SEQ ID NO: 2098665 - RNA, 14 nt, Staphylococcus aureus subsp. aureus MW2
aaaagucgucaaaa

SEQ ID NO: 2098666 - RNA, 16 nt, Staphylococcus aureus subsp. aureus MW2
aaaagguuaauauuaa

SEQ ID NO: 2098667 - RNA, 13 nt, Staphylococcus aureus subsp. aureus MW2
aaaagggcaaaaa

SEQ ID NO: 2098668 - RNA, 19 nt, Staphylococcus aureus subsp. aureus MW2
aaaaggcgaaacauuaaaa

SEQ ID NO: 2098669 - RNA, 16 nt, Staphylococcus aureus subsp. aureus MW2
aaaaggcucauuuguu

SEQ ID NO: 2098670 - RNA, 19 nt, Staphylococcus aureus subsp. aureus MW2
aaaauaaccgcuuaauucu

SEQ ID NO: 2098671 - RNA, 23 nt, Staphylococcus aureus subsp. aureus MW2
aaaauaaaucauacgagaaauua

SEQ ID NO: 2098672 - RNA, 14 nt, Staphylococcus aureus subsp. aureus MW2
aaaauaaauacaau

SEQ ID NO: 2098673 - RNA, 13 nt, Staphylococcus aureus subsp. aureus MW2
aaaauaaagaaaa

SEQ ID NO: 2098674 - RNA, 17 nt, Staphylococcus aureus subsp. aureus MW2
aaaaguugauuaaaagu

SEQ ID NO: 2098675 - RNA, 23 nt, Staphylococcus aureus subsp. aureus MW2
aaaagugaaaguauuagauauau

SEQ ID NO: 2098676 - RNA, 20 nt, Staphylococcus aureus subsp. aureus MW2
aaaaguuuaggucaguccau

SEQ ID NO: 2098677 - RNA, 21 nt, Staphylococcus aureus subsp. aureus MW2
aaaaguugauuaaaaguguug

SEQ ID NO: 2098678 - RNA, 14 nt, Staphylococcus aureus subsp. aureus MW2
aaaagcuaaagagu

SEQ ID NO: 2098679 - RNA, 14 nt, Staphylococcus aureus subsp. aureus MW2
aaaacgagauuaca

SEQ ID NO: 2098680 - RNA, 20 nt, Staphylococcus aureus subsp. aureus MW2
aaaacgagcuggugagaaau

SEQ ID NO: 2098681 - RNA, 16 nt, Staphylococcus aureus subsp. aureus MW2
aaaacgauaagaauua

SEQ ID NO: 2098682 - RNA, 17 nt, Staphylococcus aureus subsp. aureus MW2
aaaacgauaguguacac

SEQ ID NO: 2098683 - RNA, 14 nt, Staphylococcus aureus subsp. aureus MW2
aaaacgaagucagu

SEQ ID NO: 2098684 - RNA, 19 nt, Staphylococcus aureus subsp. aureus MW2
aaaacgcaauaacacauca

SEQ ID NO: 2098685 - RNA, 20 nt, Staphylococcus aureus subsp. aureus MW2
aaaaacuucuuaacuugaaa

SEQ ID NO: 2098686 - RNA, 15 nt, Staphylococcus aureus subsp. aureus MW2
aaaagcuagaaguuc

SEQ ID NO: 2098687 - RNA, 21 nt, Staphylococcus aureus subsp. aureus MW2
aaaagcuagaaguucuuaugc

SEQ ID NO: 2098688 - RNA, 18 nt, Staphylococcus aureus subsp. aureus MW2
aaaagcugauuucuauca

SEQ ID NO: 2098689 - RNA, 21 nt, Staphylococcus aureus subsp. aureus MW2
aaaaagacgcuuucuauuuau

SEQ ID NO: 2098690 - RNA, 22 nt, Staphylococcus aureus subsp. aureus MW2
aaacagaaauugcgaauuguua

SEQ ID NO: 2098691 - RNA, 13 nt, Staphylococcus aureus subsp. aureus MW2
aaacagaauuauu

SEQ ID NO: 2098692 - RNA, 17 nt, Staphylococcus aureus subsp. aureus MW2
aaacagcaguaagauau

SEQ ID NO: 2098693 - RNA, 16 nt, Staphylococcus aureus subsp. aureus MW2
aaacagcaguaagaua

SEQ ID NO: 2098694 - RNA, 21 nt, Staphylococcus aureus subsp. aureus MW2
aaacauaauuaccuuuccauu

SEQ ID NO: 2098695 - RNA, 14 nt, Staphylococcus aureus subsp. aureus MW2
aaacauaaaaauau

SEQ ID NO: 2098696 - RNA, 20 nt, Staphylococcus aureus subsp. aureus MW2
aaacauaaauacaaaaauau

SEQ ID NO: 2098697 - RNA, 15 nt, Staphylococcus aureus subsp. aureus MW2
aaacauaaucauaau

SEQ ID NO: 2098698 - RNA, 14 nt, Staphylococcus aureus subsp. aureus MW2
aaacauaucaucau

SEQ ID NO: 2098699 - RNA, 18 nt, Staphylococcus aureus subsp. aureus MW2
aaacauagagaaauuuga

SEQ ID NO: 2098700 - RNA, 17 nt, Staphylococcus aureus subsp. aureus MW2
aaacauagagaauuuca

SEQ ID NO: 2098701 - RNA, 19 nt, Staphylococcus aureus subsp. aureus MW2
aaacauagagaauuucaaa

SEQ ID NO: 2098702 - RNA, 15 nt, Staphylococcus aureus subsp. aureus MW2
aaacauauucauucu

SEQ ID NO: 2098703 - RNA, 18 nt, Staphylococcus aureus subsp. aureus MW2
aaacacccugcuuaucau

SEQ ID NO: 2098704 - RNA, 21 nt, Staphylococcus aureus subsp. aureus MW2
aaacaccuuucgcgacuucau

SEQ ID NO: 2098705 - RNA, 18 nt, Staphylococcus aureus subsp. aureus MW2
aaacacaguacaaauaac

SEQ ID NO: 2098706 - RNA, 22 nt, Staphylococcus aureus subsp. aureus MW2
aaacacaguacaaauaacaaac

SEQ ID NO: 2098707 - RNA, 19 nt, Staphylococcus aureus subsp. aureus MW2
aaacacagacguuuuugaa

SEQ ID NO: 2098708 - RNA, 13 nt, Staphylococcus aureus subsp. aureus MW2
aaacacaaaaagg

SEQ ID NO: 2098709 - RNA, 13 nt, Staphylococcus aureus subsp. aureus MW2
aaaauugaacuuu

SEQ ID NO: 2098710 - RNA, 23 nt, Staphylococcus aureus subsp. aureus MW2
aaaauucuuucuuuuuuacauuu

SEQ ID NO: 2098711 - RNA, 21 nt, Staphylococcus aureus subsp. aureus MW2
aaaauugauauugcaaaacuu

SEQ ID NO: 2098712 - RNA, 21 nt, Staphylococcus aureus subsp. aureus MW2
aaaauugguuuggauaaaaug

SEQ ID NO: 2098713 - RNA, 22 nt, Staphylococcus aureus subsp. aureus MW2
aaaauugguuuggauaaaauga

SEQ ID NO: 2098714 - RNA, 20 nt, Staphylococcus aureus subsp. aureus MW2
aaaauugguuuggauaaaau

SEQ ID NO: 2098715 - RNA, 16 nt, Staphylococcus aureus subsp. aureus MW2
aaaauuguauagaaug

SEQ ID NO: 2098716 - RNA, 13 nt, Staphylococcus aureus subsp. aureus MW2
aaaauuguaauac

SEQ ID NO: 2098717 - RNA, 18 nt, Staphylococcus aureus subsp. aureus MW2
aaaauugcuauauuagua

SEQ ID NO: 2098718 - RNA, 19 nt, Staphylococcus aureus subsp. aureus MW2
aaaauugcuaaaaaaauua

SEQ ID NO: 2098719 - RNA, 16 nt, Staphylococcus aureus subsp. aureus MW2
aaaauugcuaaaaaaa

SEQ ID NO: 2098720 - RNA, 17 nt, Staphylococcus aureus subsp. aureus MW2
aaacaaugauuaaaauu

SEQ ID NO: 2098721 - RNA, 17 nt, Staphylococcus aureus subsp. aureus MW2
aaacaauuuaaaaagca

SEQ ID NO: 2098722 - RNA, 12 nt, Staphylococcus aureus subsp. aureus MW2
aaacaauaauaa

SEQ ID NO: 2098723 - RNA, 14 nt, Staphylococcus aureus subsp. aureus MW2
aaaauuguuaauac

SEQ ID NO: 2098724 - RNA, 16 nt, Staphylococcus aureus subsp. aureus MW2
aaacauuuauauagau

SEQ ID NO: 2098725 - RNA, 16 nt, Staphylococcus aureus subsp. aureus MW2
aaacauuuauaaaucu

SEQ ID NO: 2098726 - RNA, 22 nt, Staphylococcus aureus subsp. aureus MW2
aaacauuucgguaugauauuuc

SEQ ID NO: 2098727 - RNA, 23 nt, Staphylococcus aureus subsp. aureus MW2
aaacauuaaucuauauaaaaacu

SEQ ID NO: 2098728 - RNA, 14 nt, Staphylococcus aureus subsp. aureus MW2
aaacauuaaaauaa

SEQ ID NO: 2098729 - RNA, 21 nt, Staphylococcus aureus subsp. aureus MW2
aaacauucccuuaauaauaag

SEQ ID NO: 2098730 - RNA, 16 nt, Staphylococcus aureus subsp. aureus MW2
aaacaugaacaaucag

SEQ ID NO: 2098731 - RNA, 21 nt, Staphylococcus aureus subsp. aureus MW2
aaacaugcuuggacauauacu

SEQ ID NO: 2098732 - RNA, 20 nt, Staphylococcus aureus subsp. aureus MW2
aaacaugggcaaucacuccu

SEQ ID NO: 2098733 - RNA, 22 nt, Staphylococcus aureus subsp. aureus MW2
aaacaucgauugauaauguaaa

SEQ ID NO: 2098734 - RNA, 13 nt, Staphylococcus aureus subsp. aureus MW2
aaacauuuuauac

SEQ ID NO: 2098735 - RNA, 23 nt, Staphylococcus aureus subsp. aureus MW2
aaacauuuugugacuuuguucau

SEQ ID NO: 2098736 - RNA, 18 nt, Staphylococcus aureus subsp. aureus MW2
aaacauuuuuagaaucaa

SEQ ID NO: 2098737 - RNA, 14 nt, Staphylococcus aureus subsp. aureus MW2
aaaccaaaaauaau

SEQ ID NO: 2098738 - RNA, 20 nt, Staphylococcus aureus subsp. aureus MW2
aaaccaaaauacugagucau

SEQ ID NO: 2098739 - RNA, 20 nt, Staphylococcus aureus subsp. aureus MW2
aaaccaauaauccgagucau

SEQ ID NO: 2098740 - RNA, 13 nt, Staphylococcus aureus subsp. aureus MW2
aaaccaauacgaa

SEQ ID NO: 2098741 - RNA, 16 nt, Staphylococcus aureus subsp. aureus MW2
aaaccguaauuuuaau

SEQ ID NO: 2098742 - RNA, 22 nt, Staphylococcus aureus subsp. aureus MW2
aaaccgccaacuaauguuaaaa

SEQ ID NO: 2098743 - RNA, 17 nt, Staphylococcus aureus subsp. aureus MW2
aaaccgaggaaauccuu

SEQ ID NO: 2098744 - RNA, 18 nt, Staphylococcus aureus subsp. aureus MW2
aaaccgagaaucuccauu

SEQ ID NO: 2098745 - RNA, 23 nt, Staphylococcus aureus subsp. aureus MW2
aaaccgcacuucuauauuaauag

SEQ ID NO: 2098746 - RNA, 21 nt, Staphylococcus aureus subsp. aureus MW2
aaaccgaacaucugaaaaaau

SEQ ID NO: 2098747 - RNA, 17 nt, Staphylococcus aureus subsp. aureus MW2
aaaccauugaaugaauc

SEQ ID NO: 2098748 - RNA, 19 nt, Staphylococcus aureus subsp. aureus MW2
aaaccauuaauaaaacugc

SEQ ID NO: 2098749 - RNA, 15 nt, Staphylococcus aureus subsp. aureus MW2
aacaacaucacuuua

SEQ ID NO: 2098750 - RNA, 22 nt, Staphylococcus aureus subsp. aureus MW2
aacaacaaauauaauguauaaa

SEQ ID NO: 2098751 - RNA, 16 nt, Staphylococcus aureus subsp. aureus MW2
aacaaaucgauuaauu

SEQ ID NO: 2098752 - RNA, 15 nt, Staphylococcus aureus subsp. aureus MW2
aacaaaucuuuuaaa

SEQ ID NO: 2098753 - RNA, 18 nt, Staphylococcus aureus subsp. aureus MW2
aacaaaucuauaaauauc

SEQ ID NO: 2098754 - RNA, 18 nt, Staphylococcus aureus subsp. aureus MW2
aacaaccugugauaaaaa

SEQ ID NO: 2098755 - RNA, 23 nt, Staphylococcus aureus subsp. aureus MW2
aacaaccucugauacuucaccau

SEQ ID NO: 2098756 - RNA, 14 nt, Staphylococcus aureus subsp. aureus MW2
aacaagaaaacuaa

SEQ ID NO: 2098757 - RNA, 20 nt, Staphylococcus aureus subsp. aureus MW2
aacaagauuccuaaagaaua

SEQ ID NO: 2098758 - RNA, 15 nt, Staphylococcus aureus subsp. aureus MW2
aacaagcaucaugaa

SEQ ID NO: 2098759 - RNA, 14 nt, Staphylococcus aureus subsp. aureus MW2
aacaagcaucauga

SEQ ID NO: 2098760 - RNA, 16 nt, Staphylococcus aureus subsp. aureus MW2
aacaagccuuaaaaua

SEQ ID NO: 2098761 - RNA, 18 nt, Staphylococcus aureus subsp. aureus MW2
aacaagcuuuuuucaauu

SEQ ID NO: 2098762 - RNA, 18 nt, Staphylococcus aureus subsp. aureus MW2
aacaaaacuuaaaauauu

SEQ ID NO: 2098763 - RNA, 22 nt, Staphylococcus aureus subsp. aureus MW2
aacaaaacuuaaaauauuuaac

SEQ ID NO: 2098764 - RNA, 17 nt, Staphylococcus aureus subsp. aureus MW2
aacaaaaccaaaauacu

SEQ ID NO: 2098765 - RNA, 12 nt, Staphylococcus aureus subsp. aureus MW2
aacaaaagaaag

SEQ ID NO: 2098766 - RNA, 18 nt, Staphylococcus aureus subsp. aureus MW2
aacaaaagugaauguuuu

SEQ ID NO: 2098767 - RNA, 18 nt, Staphylococcus aureus subsp. aureus MW2
aacaaaaugcguaucaau

SEQ ID NO: 2098768 - RNA, 16 nt, Staphylococcus aureus subsp. aureus MW2
aacaaacauaccccuu

SEQ ID NO: 2098769 - RNA, 22 nt, Staphylococcus aureus subsp. aureus MW2
aacaaacauuaaucuauauaaa

SEQ ID NO: 2098770 - RNA, 11 nt, Staphylococcus aureus subsp. aureus MW2
aacaaagaagc

SEQ ID NO: 2098771 - RNA, 22 nt, Staphylococcus aureus subsp. aureus MW2
aacaaagauuauugaaauuugg

SEQ ID NO: 2098772 - RNA, 16 nt, Staphylococcus aureus subsp. aureus MW2
aacaaaaaagagcuca

SEQ ID NO: 2098773 - RNA, 12 nt, Staphylococcus aureus subsp. aureus MW2
aacaaaaaauaa

SEQ ID NO: 2098774 - RNA, 20 nt, Staphylococcus aureus subsp. aureus MW2
aaauuuuggaccucuugaaa

SEQ ID NO: 2098775 - RNA, 18 nt, Staphylococcus aureus subsp. aureus MW2
aaauuuugcgaaaauauc

SEQ ID NO: 2098776 - RNA, 15 nt, Staphylococcus aureus subsp. aureus MW2
aaauuuugaagaagu

SEQ ID NO: 2098777 - RNA, 17 nt, Staphylococcus aureus subsp. aureus MW2
aaauugauauugcaaaa

SEQ ID NO: 2098778 - RNA, 21 nt, Staphylococcus aureus subsp. aureus MW2
aaauugauauugcaaaacuug

SEQ ID NO: 2098779 - RNA, 14 nt, Staphylococcus aureus subsp. aureus MW2
aaauugauuaaaua

SEQ ID NO: 2098780 - RNA, 12 nt, Staphylococcus aureus subsp. aureus MW2
aaauugauuaaa

SEQ ID NO: 2098781 - RNA, 19 nt, Staphylococcus aureus subsp. aureus MW2
aaauugauaguagcuuaau

SEQ ID NO: 2098782 - RNA, 22 nt, Staphylococcus aureus subsp. aureus MW2
aaauugaaauguuuaucaauuc

SEQ ID NO: 2098783 - RNA, 13 nt, Staphylococcus aureus subsp. aureus MW2
aaauugaacuuug

SEQ ID NO: 2098784 - RNA, 11 nt, Staphylococcus aureus subsp. aureus MW2
aaauucuuuuu

SEQ ID NO: 2098785 - RNA, 15 nt, Staphylococcus aureus subsp. aureus MW2
aaauugaauuaugau

SEQ ID NO: 2098786 - RNA, 12 nt, Staphylococcus aureus subsp. aureus MW2
aaauucaucuug

SEQ ID NO: 2098787 - RNA, 15 nt, Staphylococcus aureus subsp. aureus MW2
aaauucaaauuauaa

SEQ ID NO: 2098788 - RNA, 13 nt, Staphylococcus aureus subsp. aureus MW2
aaauucuuuugua

SEQ ID NO: 2098789 - RNA, 14 nt, Staphylococcus aureus subsp. aureus MW2
aaauucuuuuguaa

SEQ ID NO: 2098790 - RNA, 13 nt, Staphylococcus aureus subsp. aureus MW2
aaauucauuugua

SEQ ID NO: 2098791 - RNA, 17 nt, Staphylococcus aureus subsp. aureus MW2
aaauugauuaaauaaau

SEQ ID NO: 2098792 - RNA, 17 nt, Staphylococcus aureus subsp. aureus MW2
aaauugcuauauuagua

SEQ ID NO: 2098793 - RNA, 21 nt, Staphylococcus aureus subsp. aureus MW2
aaauugcuaaaaaaauuaaaa

SEQ ID NO: 2098794 - RNA, 19 nt, Staphylococcus aureus subsp. aureus MW2
aaauugcuauauuaguaua

SEQ ID NO: 2098795 - RNA, 18 nt, Staphylococcus aureus subsp. aureus MW2
aaauugucuuuucauuuu

SEQ ID NO: 2098796 - RNA, 21 nt, Staphylococcus aureus subsp. aureus MW2
aaauugucuuuucauuuuuua

SEQ ID NO: 2098797 - RNA, 12 nt, Staphylococcus aureus subsp. aureus MW2
aaauuguaaaac

SEQ ID NO: 2098798 - RNA, 14 nt, Staphylococcus aureus subsp. aureus MW2
aaauuguauagaau

SEQ ID NO: 2098799 - RNA, 18 nt, Staphylococcus aureus subsp. aureus MW2
aaauuguacugauauaua

SEQ ID NO: 2098800 - RNA, 20 nt, Staphylococcus aureus subsp. aureus MW2
aaauuggacuuauggguuca

SEQ ID NO: 2098801 - RNA, 19 nt, Staphylococcus aureus subsp. aureus MW2
aaauuggauaauuucuucu

SEQ ID NO: 2098802 - RNA, 16 nt, Staphylococcus aureus subsp. aureus MW2
aaauuggaaucccaau

SEQ ID NO: 2098803 - RNA, 17 nt, Staphylococcus aureus subsp. aureus MW2
aaauugcuugaaauuau

SEQ ID NO: 2098804 - RNA, 19 nt, Staphylococcus aureus subsp. aureus MW2
aaauuuuaucuaaacauuu

SEQ ID NO: 2098805 - RNA, 18 nt, Staphylococcus aureus subsp. aureus MW2
aaauuugcaugaaaauua

SEQ ID NO: 2098806 - RNA, 19 nt, Staphylococcus aureus subsp. aureus MW2
aaauuucgccucaucuaau

SEQ ID NO: 2098807 - RNA, 15 nt, Staphylococcus aureus subsp. aureus MW2
aaauuucgacaucua

SEQ ID NO: 2098808 - RNA, 16 nt, Staphylococcus aureus subsp. aureus MW2
aaauuucgacaucuag

SEQ ID NO: 2098809 - RNA, 20 nt, Staphylococcus aureus subsp. aureus MW2
aaauuucucccauccccuuu

SEQ ID NO: 2098810 - RNA, 12 nt, Staphylococcus aureus subsp. aureus MW2
aaauuucaaaaa

SEQ ID NO: 2098811 - RNA, 15 nt, Staphylococcus aureus subsp. aureus MW2
aaauuucaaaaauag

SEQ ID NO: 2098812 - RNA, 21 nt, Staphylococcus aureus subsp. aureus MW2
aaauuuagguggagauuuaac

SEQ ID NO: 2098813 - RNA, 16 nt, Staphylococcus aureus subsp. aureus MW2
aaauuuaguaucucau

SEQ ID NO: 2098814 - RNA, 17 nt, Staphylococcus aureus subsp. aureus MW2
aaauuuauuauaaaaua

SEQ ID NO: 2098815 - RNA, 21 nt, Staphylococcus aureus subsp. aureus MW2
aaauuuauuauucguuucuuu

SEQ ID NO: 2098816 - RNA, 13 nt, Staphylococcus aureus subsp. aureus MW2
aaauuuauuuuua

SEQ ID NO: 2098817 - RNA, 16 nt, Staphylococcus aureus subsp. aureus MW2
aaauuuauauuaaaua

SEQ ID NO: 2098818 - RNA, 12 nt, Staphylococcus aureus subsp. aureus MW2
aaauuuauuaua

SEQ ID NO: 2098819 - RNA, 16 nt, Staphylococcus aureus subsp. aureus MW2
aaauuuauaauuugua

SEQ ID NO: 2098820 - RNA, 11 nt, Staphylococcus aureus subsp. aureus MW2
aaauuuaaaua

SEQ ID NO: 2098821 - RNA, 17 nt, Staphylococcus aureus subsp. aureus MW2
aaauuuaagaaugcgaa

SEQ ID NO: 2098822 - RNA, 14 nt, Staphylococcus aureus subsp. aureus MW2
aaauuuaacuauga

SEQ ID NO: 2098823 - RNA, 15 nt, Staphylococcus aureus subsp. aureus MW2
aaauuuaaaagaaaa

SEQ ID NO: 2098824 - RNA, 12 nt, Staphylococcus aureus subsp. aureus MW2
aaauuuaaaaua

SEQ ID NO: 2098825 - RNA, 16 nt, Staphylococcus aureus subsp. aureus MW2
aaauuuaaaacaauga

SEQ ID NO: 2098826 - RNA, 17 nt, Staphylococcus aureus subsp. aureus MW2
aaauuuaaaacaaugau

SEQ ID NO: 2098827 - RNA, 22 nt, Staphylococcus aureus subsp. aureus MW2
aaauuguguuucuuuuauuuuc

SEQ ID NO: 2098828 - RNA, 15 nt, Staphylococcus aureus subsp. aureus MW2
aaauuguguuucuuu

SEQ ID NO: 2098829 - RNA, 19 nt, Staphylococcus aureus subsp. aureus MW2
aaauuguguuucuuuuauu

SEQ ID NO: 2098830 - RNA, 14 nt, Staphylococcus aureus subsp. aureus MW2
aaauuguguuucuu

SEQ ID NO: 2098831 - RNA, 15 nt, Staphylococcus aureus subsp. aureus MW2
aaauuguuaauacau

SEQ ID NO: 2098832 - RNA, 17 nt, Staphylococcus aureus subsp. aureus MW2
aaauuguucuaauacac

SEQ ID NO: 2098833 - RNA, 17 nt, Staphylococcus aureus subsp. aureus MW2
aaauugugcuuuuucau

SEQ ID NO: 2098834 - RNA, 14 nt, Staphylococcus aureus subsp. aureus MW2
aaauugugaacuaa

SEQ ID NO: 2098835 - RNA, 20 nt, Staphylococcus aureus subsp. aureus MW2
aaauugugaacuaaauugaa

SEQ ID NO: 2098836 - RNA, 21 nt, Staphylococcus aureus subsp. aureus MW2
aaauccgcuuuauuuuaucau

SEQ ID NO: 2098837 - RNA, 22 nt, Staphylococcus aureus subsp. aureus MW2
aaauccuaagcaucguaaaaaa

SEQ ID NO: 2098838 - RNA, 24 nt, Staphylococcus aureus subsp. aureus MW2
aaauccuuaaauggagauucucgg

SEQ ID NO: 2098839 - RNA, 15 nt, Staphylococcus aureus subsp. aureus MW2
aaauccaaugaugaa

SEQ ID NO: 2098840 - RNA, 13 nt, Staphylococcus aureus subsp. aureus MW2
aaauauguuuaau

SEQ ID NO: 2098841 - RNA, 14 nt, Staphylococcus aureus subsp. aureus MW2
aaauauuauaaaaa

SEQ ID NO: 2098842 - RNA, 15 nt, Staphylococcus aureus subsp. aureus MW2
aaauauuaauuuaua

SEQ ID NO: 2098843 - RNA, 16 nt, Staphylococcus aureus subsp. aureus MW2
aaauauuacuaacaac

SEQ ID NO: 2098844 - RNA, 18 nt, Staphylococcus aureus subsp. aureus MW2
aaauauuaauauaaaaua

SEQ ID NO: 2098845 - RNA, 22 nt, Staphylococcus aureus subsp. aureus MW2
aaauauuaauauaaaauaaagu

SEQ ID NO: 2098846 - RNA, 13 nt, Staphylococcus aureus subsp. aureus MW2
aaauauuaaucaa

SEQ ID NO: 2098847 - RNA, 17 nt, Staphylococcus aureus subsp. aureus MW2
aaauauguaaucagguu

SEQ ID NO: 2098848 - RNA, 21 nt, Staphylococcus aureus subsp. aureus MW2
aaauauguauguuuuaucaau

SEQ ID NO: 2098849 - RNA, 14 nt, Staphylococcus aureus subsp. aureus MW2
aaaugacugaauua

SEQ ID NO: 2098850 - RNA, 18 nt, Staphylococcus aureus subsp. aureus MW2
aaaugacgcucgagcucu

SEQ ID NO: 2098851 - RNA, 16 nt, Staphylococcus aureus subsp. aureus MW2
aaaugagcguuccauu

SEQ ID NO: 2098852 - RNA, 21 nt, Staphylococcus aureus subsp. aureus MW2
aaaugacugaauuaauaucca

SEQ ID NO: 2098853 - RNA, 23 nt, Staphylococcus aureus subsp. aureus MW2
aaaugacugaauuaauauccaaa

SEQ ID NO: 2098854 - RNA, 15 nt, Staphylococcus aureus subsp. aureus MW2
aaaugacauuuuaaa

SEQ ID NO: 2098855 - RNA, 15 nt, Staphylococcus aureus subsp. aureus MW2
aaaugaauugcuugu

SEQ ID NO: 2098856 - RNA, 19 nt, Staphylococcus aureus subsp. aureus MW2
aaaugaaugaagacgaaua

SEQ ID NO: 2098857 - RNA, 20 nt, Staphylococcus aureus subsp. aureus MW2
aaaugaauguuaagacauau

SEQ ID NO: 2098858 - RNA, 14 nt, Staphylococcus aureus subsp. aureus MW2
aaaugaauuauuua

SEQ ID NO: 2098859 - RNA, 19 nt, Staphylococcus aureus subsp. aureus MW2
aaaucuuugauuaugaacu

SEQ ID NO: 2098860 - RNA, 21 nt, Staphylococcus aureus subsp. aureus MW2
aaaugaagucuuucaacaaaa

SEQ ID NO: 2098861 - RNA, 23 nt, Staphylococcus aureus subsp. aureus MW2
aaaugaagucuuucaacaaaaug

SEQ ID NO: 2098862 - RNA, 23 nt, Staphylococcus aureus subsp. aureus MW2
aaaucuggcacuuaagcuuuaau

SEQ ID NO: 2098863 - RNA, 20 nt, Staphylococcus aureus subsp. aureus MW2
aaaucugcuugugugucauu

SEQ ID NO: 2098864 - RNA, 21 nt, Staphylococcus aureus subsp. aureus MW2
aaaucuuguuggauuuuaaca

SEQ ID NO: 2098865 - RNA, 23 nt, Staphylococcus aureus subsp. aureus MW2
aaaucuuguuggauuuuaacaag

SEQ ID NO: 2098866 - RNA, 12 nt, Staphylococcus aureus subsp. aureus MW2
aaaucuuguucu

SEQ ID NO: 2098867 - RNA, 21 nt, Staphylococcus aureus subsp. aureus MW2
aaaucuuuaaauguaucacuu

SEQ ID NO: 2098868 - RNA, 23 nt, Staphylococcus aureus subsp. aureus MW2
aaaucuuuacuuguaauuaauac

SEQ ID NO: 2098869 - RNA, 16 nt, Staphylococcus aureus subsp. aureus MW2
aaaucuuuacuuguaa

SEQ ID NO: 2098870 - RNA, 15 nt, Staphylococcus aureus subsp. aureus MW2
aaaucguuaaggaaa

SEQ ID NO: 2098871 - RNA, 18 nt, Staphylococcus aureus subsp. aureus MW2
aaaucgugcuguuaucau

SEQ ID NO: 2098872 - RNA, 16 nt, Staphylococcus aureus subsp. aureus MW2
aaaugaucaucguaua

SEQ ID NO: 2098873 - RNA, 13 nt, Staphylococcus aureus subsp. aureus MW2
aaaugcaauacau

SEQ ID NO: 2098874 - RNA, 19 nt, Staphylococcus aureus subsp. aureus MW2
aaaugcacuagcaacaucu

SEQ ID NO: 2098875 - RNA, 21 nt, Staphylococcus aureus subsp. aureus MW2
aaaugcacuagcaacaucuuu

SEQ ID NO: 2098876 - RNA, 20 nt, Staphylococcus aureus subsp. aureus MW2
aaaugauacauuauuaaaua

SEQ ID NO: 2098877 - RNA, 15 nt, Staphylococcus aureus subsp. aureus MW2
aaaugauacauuauu

SEQ ID NO: 2098878 - RNA, 12 nt, Staphylococcus aureus subsp. aureus MW2
aaaugauaagaa

SEQ ID NO: 2098879 - RNA, 23 nt, Staphylococcus aureus subsp. aureus MW2
aaaugauagcuaaacauuuuaua

SEQ ID NO: 2098880 - RNA, 20 nt, Staphylococcus aureus subsp. aureus MW2
aaaugauagggcauugagau

SEQ ID NO: 2098881 - RNA, 13 nt, Staphylococcus aureus subsp. aureus MW2
aaaugauaucuau

SEQ ID NO: 2098882 - RNA, 23 nt, Staphylococcus aureus subsp. aureus MW2
aaauggcaucuggcaaauugccu

SEQ ID NO: 2098883 - RNA, 15 nt, Staphylococcus aureus subsp. aureus MW2
aaaugcauuacuacu

SEQ ID NO: 2098884 - RNA, 15 nt, Staphylococcus aureus subsp. aureus MW2
aaaugcauaauauau

SEQ ID NO: 2098885 - RNA, 21 nt, Staphylococcus aureus subsp. aureus MW2
aaaugcauaauauauuaaaaa

SEQ ID NO: 2098886 - RNA, 13 nt, Staphylococcus aureus subsp. aureus MW2
aaaugugaaagac

SEQ ID NO: 2098887 - RNA, 20 nt, Staphylococcus aureus subsp. aureus MW2
aaaugugaaagucauccuac

SEQ ID NO: 2098888 - RNA, 14 nt, Staphylococcus aureus subsp. aureus MW2
aaaugucauuugaa

SEQ ID NO: 2098889 - RNA, 21 nt, Staphylococcus aureus subsp. aureus MW2
aaauguccgauuugauaaaaa

SEQ ID NO: 2098890 - RNA, 16 nt, Staphylococcus aureus subsp. aureus MW2
aaauguauuaaacauu

SEQ ID NO: 2098891 - RNA, 22 nt, Staphylococcus aureus subsp. aureus MW2
aaauguauuauucucucauuug

SEQ ID NO: 2098892 - RNA, 19 nt, Staphylococcus aureus subsp. aureus MW2
aaauguuuuguguauuuau

SEQ ID NO: 2098893 - RNA, 18 nt, Staphylococcus aureus subsp. aureus MW2
aaaugucuuugaaaaauu

SEQ ID NO: 2098894 - RNA, 22 nt, Staphylococcus aureus subsp. aureus MW2
aaauguuuacugucaucuuuau

SEQ ID NO: 2098895 - RNA, 22 nt, Staphylococcus aureus subsp. aureus MW2
aaauguuuauaauaauauugaa

SEQ ID NO: 2098896 - RNA, 15 nt, Staphylococcus aureus subsp. aureus MW2
aaauguacauuguaa

SEQ ID NO: 2098897 - RNA, 23 nt, Staphylococcus aureus subsp. aureus MW2
aaauguaaaaucauuaauaauua

SEQ ID NO: 2098898 - RNA, 19 nt, Staphylococcus aureus subsp. aureus MW2
aaauguaaauaaaaauuau

SEQ ID NO: 2098899 - RNA, 15 nt, Staphylococcus aureus subsp. aureus MW2
aaauguaacauuaaa

SEQ ID NO: 2098900 - RNA, 19 nt, Staphylococcus aureus subsp. aureus MW2
aaauggugcgaauaauaau

SEQ ID NO: 2098901 - RNA, 23 nt, Staphylococcus aureus subsp. aureus MW2
aaaugguuuucuuuuucuauaca

SEQ ID NO: 2098902 - RNA, 12 nt, Staphylococcus aureus subsp. aureus MW2
aaauuaauaauu

SEQ ID NO: 2098903 - RNA, 18 nt, Staphylococcus aureus subsp. aureus MW2
aaauuaaguacuauuaaa

SEQ ID NO: 2098904 - RNA, 12 nt, Staphylococcus aureus subsp. aureus MW2
aaauuaaugaac

SEQ ID NO: 2098905 - RNA, 18 nt, Staphylococcus aureus subsp. aureus MW2
aaauuaagagucaguaaa

SEQ ID NO: 2098906 - RNA, 16 nt, Staphylococcus aureus subsp. aureus MW2
aaauuaagaugaaaua

SEQ ID NO: 2098907 - RNA, 18 nt, Staphylococcus aureus subsp. aureus MW2
aaauuaagaugaaauacu

SEQ ID NO: 2098908 - RNA, 15 nt, Staphylococcus aureus subsp. aureus MW2
aaauuaaaacuuuca

SEQ ID NO: 2098909 - RNA, 13 nt, Staphylococcus aureus subsp. aureus MW2
aaauuaaaauaau

SEQ ID NO: 2098910 - RNA, 14 nt, Staphylococcus aureus subsp. aureus MW2
aaauuaaaauaauu

SEQ ID NO: 2098911 - RNA, 17 nt, Staphylococcus aureus subsp. aureus MW2
aaauuaaaauaauuaaa

SEQ ID NO: 2098912 - RNA, 17 nt, Staphylococcus aureus subsp. aureus MW2
aaauuaaaaaacaauaa

SEQ ID NO: 2098913 - RNA, 16 nt, Staphylococcus aureus subsp. aureus MW2
aaauuaaaaaacaaaa

SEQ ID NO: 2098914 - RNA, 19 nt, Staphylococcus aureus subsp. aureus MW2
aaaaagaguuaauaaaauu

SEQ ID NO: 2098915 - RNA, 21 nt, Staphylococcus aureus subsp. aureus MW2
aaauuauacgagaauaugauc

SEQ ID NO: 2098916 - RNA, 14 nt, Staphylococcus aureus subsp. aureus MW2
aaauuaguuauacu

SEQ ID NO: 2098917 - RNA, 23 nt, Staphylococcus aureus subsp. aureus MW2
aaauuagugguuagcuauauuuu

SEQ ID NO: 2098918 - RNA, 13 nt, Staphylococcus aureus subsp. aureus MW2
aaauuauauaaau

SEQ ID NO: 2098919 - RNA, 20 nt, Staphylococcus aureus subsp. aureus MW2
aaauuauagccuucauuugc

SEQ ID NO: 2098920 - RNA, 21 nt, Staphylococcus aureus subsp. aureus MW2
aaauuauuugauauuucauuu

SEQ ID NO: 2098921 - RNA, 23 nt, Staphylococcus aureus subsp. aureus MW2
aaauuauuuauucauuauagucu

SEQ ID NO: 2098922 - RNA, 13 nt, Staphylococcus aureus subsp. aureus MW2
aaauuauuuuuga

SEQ ID NO: 2098923 - RNA, 23 nt, Staphylococcus aureus subsp. aureus MW2
aaauuagcaagugaguaacauuu

SEQ ID NO: 2098924 - RNA, 17 nt, Staphylococcus aureus subsp. aureus MW2
aaauuaauaugaacaaa

SEQ ID NO: 2098925 - RNA, 18 nt, Staphylococcus aureus subsp. aureus MW2
aaauuagucauccaaaga

SEQ ID NO: 2098926 - RNA, 15 nt, Staphylococcus aureus subsp. aureus MW2
aaauuagucauccaa

SEQ ID NO: 2098927 - RNA, 16 nt, Staphylococcus aureus subsp. aureus MW2
aaauuagccauuucaa

SEQ ID NO: 2098928 - RNA, 22 nt, Staphylococcus aureus subsp. aureus MW2
aaauuagggguggaaauaugaa

SEQ ID NO: 2098929 - RNA, 14 nt, Staphylococcus aureus subsp. aureus MW2
aaauuagauaaaac

SEQ ID NO: 2098930 - RNA, 16 nt, Staphylococcus aureus subsp. aureus MW2
aaauuagauaaaacaa

SEQ ID NO: 2098931 - RNA, 18 nt, Staphylococcus aureus subsp. aureus MW2
aaauuagauaaaacaaaa

SEQ ID NO: 2098932 - RNA, 22 nt, Staphylococcus aureus subsp. aureus MW2
aaauuagauaaaacaaaaccaa

SEQ ID NO: 2098933 - RNA, 16 nt, Staphylococcus aureus subsp. aureus MW2
aaauuacuugaauauu

SEQ ID NO: 2098934 - RNA, 22 nt, Staphylococcus aureus subsp. aureus MW2
aaauuacuugaauauuauucau

SEQ ID NO: 2098935 - RNA, 15 nt, Staphylococcus aureus subsp. aureus MW2
aaaguaaguaaaaua

SEQ ID NO: 2098936 - RNA, 13 nt, Staphylococcus aureus subsp. aureus MW2
aaaguaauaugag

SEQ ID NO: 2098937 - RNA, 14 nt, Staphylococcus aureus subsp. aureus MW2
aaaguaaguaaaau

SEQ ID NO: 2098938 - RNA, 16 nt, Staphylococcus aureus subsp. aureus MW2
aaaguagacauugaaa

SEQ ID NO: 2098939 - RNA, 24 nt, Staphylococcus aureus subsp. aureus MW2
aaaguaguugaaauguuuauaaua

SEQ ID NO: 2098940 - RNA, 12 nt, Staphylococcus aureus subsp. aureus MW2
aaaguauaaggu

SEQ ID NO: 2098941 - RNA, 16 nt, Staphylococcus aureus subsp. aureus MW2
aaaguauaaaccaaau

SEQ ID NO: 2098942 - RNA, 17 nt, Staphylococcus aureus subsp. aureus MW2
aaagucguuguugaaau

SEQ ID NO: 2098943 - RNA, 20 nt, Staphylococcus aureus subsp. aureus MW2
aaagucguuguugaaauuaa

SEQ ID NO: 2098944 - RNA, 21 nt, Staphylococcus aureus subsp. aureus MW2
aaagucguuguugaaauuaaa

SEQ ID NO: 2098945 - RNA, 22 nt, Staphylococcus aureus subsp. aureus MW2
aaagucguuguugaaauuaaau

SEQ ID NO: 2098946 - RNA, 13 nt, Staphylococcus aureus subsp. aureus MW2
aaagucuuuaaua

SEQ ID NO: 2098947 - RNA, 16 nt, Staphylococcus aureus subsp. aureus MW2
aaagucuucaucuuua

SEQ ID NO: 2098948 - RNA, 19 nt, Staphylococcus aureus subsp. aureus MW2
aaagucuucuucaacaauu

SEQ ID NO: 2098949 - RNA, 13 nt, Staphylococcus aureus subsp. aureus MW2
aaagugaauauua

SEQ ID NO: 2098950 - RNA, 19 nt, Staphylococcus aureus subsp. aureus MW2
aaagugaaaacuucucuau

SEQ ID NO: 2098951 - RNA, 15 nt, Staphylococcus aureus subsp. aureus MW2
aaagugaaaguauua

SEQ ID NO: 2098952 - RNA, 22 nt, Staphylococcus aureus subsp. aureus MW2
aaagugauaauuaaaauaagau

SEQ ID NO: 2098953 - RNA, 16 nt, Staphylococcus aureus subsp. aureus MW2
aaagugauaauuaaaa

SEQ ID NO: 2098954 - RNA, 14 nt, Staphylococcus aureus subsp. aureus MW2
aaagugauucccaa

SEQ ID NO: 2098955 - RNA, 14 nt, Staphylococcus aureus subsp. aureus MW2
aaagugaauguuuu

SEQ ID NO: 2098956 - RNA, 13 nt, Staphylococcus aureus subsp. aureus MW2
aaagugaauugua

SEQ ID NO: 2098957 - RNA, 18 nt, Staphylococcus aureus subsp. aureus MW2
aaagugauuuaaaaaaau

SEQ ID NO: 2098958 - RNA, 21 nt, Staphylococcus aureus subsp. aureus MW2
aaaguguaauguuccccugaa

SEQ ID NO: 2098959 - RNA, 18 nt, Staphylococcus aureus subsp. aureus MW2
aaaguguagccaaauaaa

SEQ ID NO: 2098960 - RNA, 16 nt, Staphylococcus aureus subsp. aureus MW2
aaaguguuaugaauua

SEQ ID NO: 2098961 - RNA, 16 nt, Staphylococcus aureus subsp. aureus MW2
aaagugguuguuccca

SEQ ID NO: 2098962 - RNA, 18 nt, Staphylococcus aureus subsp. aureus MW2
aaagugguuguucccauu

SEQ ID NO: 2098963 - RNA, 14 nt, Staphylococcus aureus subsp. aureus MW2
aaagugguuuuacu

SEQ ID NO: 2098964 - RNA, 19 nt, Staphylococcus aureus subsp. aureus MW2
aaagugcgguuauuuauac

SEQ ID NO: 2098965 - RNA, 15 nt, Staphylococcus aureus subsp. aureus MW2
aaaguggccuuuuaa

SEQ ID NO: 2098966 - RNA, 21 nt, Staphylococcus aureus subsp. aureus MW2
aaaguggucguuuauuuuaaa

SEQ ID NO: 2098967 - RNA, 11 nt, Staphylococcus aureus subsp. aureus MW2
aaaguuuucau

SEQ ID NO: 2098968 - RNA, 18 nt, Staphylococcus aureus subsp. aureus MW2
aaaguuuucauuuaacau

SEQ ID NO: 2098969 - RNA, 20 nt, Staphylococcus aureus subsp. aureus MW2
aaaguuuucauuuaacaugu

SEQ ID NO: 2098970 - RNA, 15 nt, Staphylococcus aureus subsp. aureus MW2
aaaguuucuccaccu

SEQ ID NO: 2098971 - RNA, 13 nt, Staphylococcus aureus subsp. aureus MW2
aaaguuucuccac

SEQ ID NO: 2098972 - RNA, 14 nt, Staphylococcus aureus subsp. aureus MW2
aaauaaauaagcaa

SEQ ID NO: 2098973 - RNA, 16 nt, Staphylococcus aureus subsp. aureus MW2
aaauaaauacaauaga

SEQ ID NO: 2098974 - RNA, 11 nt, Staphylococcus aureus subsp. aureus MW2
aaauaaauaag

SEQ ID NO: 2098975 - RNA, 14 nt, Staphylococcus aureus subsp. aureus MW2
aaauaaaaaagcca

SEQ ID NO: 2098976 - RNA, 19 nt, Staphylococcus aureus subsp. aureus MW2
aaauaaacucaccaaguuc

SEQ ID NO: 2098977 - RNA, 14 nt, Staphylococcus aureus subsp. aureus MW2
aaauaaaaauauau

SEQ ID NO: 2098978 - RNA, 16 nt, Staphylococcus aureus subsp. aureus MW2
aaaguuagcaaauggu

SEQ ID NO: 2098979 - RNA, 20 nt, Staphylococcus aureus subsp. aureus MW2
aaaguuguauucugaaacuu

SEQ ID NO: 2098980 - RNA, 16 nt, Staphylococcus aureus subsp. aureus MW2
aaaguuguauucugaa

SEQ ID NO: 2098981 - RNA, 20 nt, Staphylococcus aureus subsp. aureus MW2
aaaguugguuuuauuaauuc

SEQ ID NO: 2098982 - RNA, 15 nt, Staphylococcus aureus subsp. aureus MW2
aaaguugacaauaca

SEQ ID NO: 2098983 - RNA, 16 nt, Staphylococcus aureus subsp. aureus MW2
aaaguugauaauguaa

SEQ ID NO: 2098984 - RNA, 21 nt, Staphylococcus aureus subsp. aureus MW2
aaaguugcacucgguucauaa

SEQ ID NO: 2098985 - RNA, 21 nt, Staphylococcus aureus subsp. aureus MW2
aaauaauuuaaauuaaaauaa

SEQ ID NO: 2098986 - RNA, 14 nt, Staphylococcus aureus subsp. aureus MW2
aaauaauuuaauuu

SEQ ID NO: 2098987 - RNA, 12 nt, Staphylococcus aureus subsp. aureus MW2
aaauaauuuaaa

SEQ ID NO: 2098988 - RNA, 13 nt, Staphylococcus aureus subsp. aureus MW2
aaauaauuuaaag

SEQ ID NO: 2098989 - RNA, 15 nt, Staphylococcus aureus subsp. aureus MW2
aaauaauuaugaaaa

SEQ ID NO: 2098990 - RNA, 15 nt, Staphylococcus aureus subsp. aureus MW2
aaauaauuaaacuuu

SEQ ID NO: 2098991 - RNA, 16 nt, Staphylococcus aureus subsp. aureus MW2
aaauaauuaaacuuua

SEQ ID NO: 2098992 - RNA, 22 nt, Staphylococcus aureus subsp. aureus MW2
aaauaauuaaacuuuaugaaaa

SEQ ID NO: 2098993 - RNA, 14 nt, Staphylococcus aureus subsp. aureus MW2
aaauaaauauaaaa

SEQ ID NO: 2098994 - RNA, 19 nt, Staphylococcus aureus subsp. aureus MW2
aaauaaugcuuauuaaaau

SEQ ID NO: 2098995 - RNA, 20 nt, Staphylococcus aureus subsp. aureus MW2
aaauaaugcuuauuaaaauu

SEQ ID NO: 2098996 - RNA, 20 nt, Staphylococcus aureus subsp. aureus MW2
aaauacaauuucuucauuuu

SEQ ID NO: 2098997 - RNA, 17 nt, Staphylococcus aureus subsp. aureus MW2
aaauacaauuucuucau

SEQ ID NO: 2098998 - RNA, 16 nt, Staphylococcus aureus subsp. aureus MW2
aaauacaucaauuucu

SEQ ID NO: 2098999 - RNA, 20 nt, Staphylococcus aureus subsp. aureus MW2
aaauacaucaacaucgaauu

SEQ ID NO: 2099000 - RNA, 16 nt, Staphylococcus aureus subsp. aureus MW2
aaauacauaauaaaaa

SEQ ID NO: 2099001 - RNA, 23 nt, Staphylococcus aureus subsp. aureus MW2
aaauaccagaugaaccaaaaaac

SEQ ID NO: 2099002 - RNA, 17 nt, Staphylococcus aureus subsp. aureus MW2
aaauacaucaauuucua

SEQ ID NO: 2099003 - RNA, 19 nt, Staphylococcus aureus subsp. aureus MW2
aaauacauccauacuucua

SEQ ID NO: 2099004 - RNA, 15 nt, Staphylococcus aureus subsp. aureus MW2
aaauacaucggaauu

SEQ ID NO: 2099005 - RNA, 22 nt, Staphylococcus aureus subsp. aureus MW2
aaauacaugugggauaucuucu

SEQ ID NO: 2099006 - RNA, 18 nt, Staphylococcus aureus subsp. aureus MW2
aaauaccuaccacaauaa

SEQ ID NO: 2099007 - RNA, 19 nt, Staphylococcus aureus subsp. aureus MW2
aaauagaaaaauuucaaaa

SEQ ID NO: 2099008 - RNA, 20 nt, Staphylococcus aureus subsp. aureus MW2
aaauaucgagaggguacacu

SEQ ID NO: 2099009 - RNA, 20 nt, Staphylococcus aureus subsp. aureus MW2
aaauaucgacaaauuaaaaa

SEQ ID NO: 2099010 - RNA, 20 nt, Staphylococcus aureus subsp. aureus MW2
aaauaucccggaauauuaac

SEQ ID NO: 2099011 - RNA, 17 nt, Staphylococcus aureus subsp. aureus MW2
aaauaucuaaacaauuc

SEQ ID NO: 2099012 - RNA, 19 nt, Staphylococcus aureus subsp. aureus MW2
aaauaucaugcaaaacuaa

SEQ ID NO: 2099013 - RNA, 12 nt, Staphylococcus aureus subsp. aureus MW2
aaauaucacuaa

SEQ ID NO: 2099014 - RNA, 20 nt, Staphylococcus aureus subsp. aureus MW2
aaauaucacuaauauauuua

SEQ ID NO: 2099015 - RNA, 17 nt, Staphylococcus aureus subsp. aureus MW2
aaauauauuuguaguaa

SEQ ID NO: 2099016 - RNA, 14 nt, Staphylococcus aureus subsp. aureus MW2
aaauauauauuacc

SEQ ID NO: 2099017 - RNA, 23 nt, Staphylococcus aureus subsp. aureus MW2
aaauauaucuaauacuuucacuu

SEQ ID NO: 2099018 - RNA, 18 nt, Staphylococcus aureus subsp. aureus MW2
aaauauaucuagccugaa

SEQ ID NO: 2099019 - RNA, 19 nt, Staphylococcus aureus subsp. aureus MW2
aaauauaucuagccugaaa

SEQ ID NO: 2099020 - RNA, 14 nt, Staphylococcus aureus subsp. aureus MW2
aaauauauuauaaa

SEQ ID NO: 2099021 - RNA, 18 nt, Staphylococcus aureus subsp. aureus MW2
aaauauauuauaaaaaua

SEQ ID NO: 2099022 - RNA, 18 nt, Staphylococcus aureus subsp. aureus MW2
aaauauaauguauaaaac

SEQ ID NO: 2099023 - RNA, 20 nt, Staphylococcus aureus subsp. aureus MW2
aaauauaauagaaauaauca

SEQ ID NO: 2099024 - RNA, 19 nt, Staphylococcus aureus subsp. aureus MW2
aaauauaauguauaaaaca

SEQ ID NO: 2099025 - RNA, 17 nt, Staphylococcus aureus subsp. aureus MW2
aaauauaccaaccaaaa

SEQ ID NO: 2099026 - RNA, 15 nt, Staphylococcus aureus subsp. aureus MW2
aaauauaccaaccaa

SEQ ID NO: 2099027 - RNA, 18 nt, Staphylococcus aureus subsp. aureus MW2
aaauauacuaaauuugaa

SEQ ID NO: 2099028 - RNA, 21 nt, Staphylococcus aureus subsp. aureus MW2
aaauauacuugccuucaaauu

SEQ ID NO: 2099029 - RNA, 20 nt, Staphylococcus aureus subsp. aureus MW2
aaauauagcuauuagaauuu

SEQ ID NO: 2099030 - RNA, 20 nt, Staphylococcus aureus subsp. aureus MW2
aaauaguucuuuaaauuaua

SEQ ID NO: 2099031 - RNA, 23 nt, Staphylococcus aureus subsp. aureus MW2
aaauaguuuuucauauucacauc

SEQ ID NO: 2099032 - RNA, 14 nt, Staphylococcus aureus subsp. aureus MW2
aaauaguucuuuaa

SEQ ID NO: 2099033 - RNA, 14 nt, Staphylococcus aureus subsp. aureus MW2
aaauagauugaaaa

SEQ ID NO: 2099034 - RNA, 13 nt, Staphylococcus aureus subsp. aureus MW2
aaauagaucgaac

SEQ ID NO: 2099035 - RNA, 23 nt, Staphylococcus aureus subsp. aureus MW2
aaauagaucgaacugauggaaaa

SEQ ID NO: 2099036 - RNA, 17 nt, Staphylococcus aureus subsp. aureus MW2
aaauaguucaaaauacu

SEQ ID NO: 2099037 - RNA, 12 nt, Staphylococcus aureus subsp. aureus MW2
aaagacagaaau

SEQ ID NO: 2099038 - RNA, 13 nt, Staphylococcus aureus subsp. aureus MW2
aaagacaaaagca

SEQ ID NO: 2099039 - RNA, 19 nt, Staphylococcus aureus subsp. aureus MW2
aaagacauccacagaauua

SEQ ID NO: 2099040 - RNA, 16 nt, Staphylococcus aureus subsp. aureus MW2
aaagacaugagauuau

SEQ ID NO: 2099041 - RNA, 20 nt, Staphylococcus aureus subsp. aureus MW2
aaagaucguuuucaacauaa

SEQ ID NO: 2099042 - RNA, 14 nt, Staphylococcus aureus subsp. aureus MW2
aaagaguaaaguua

SEQ ID NO: 2099043 - RNA, 21 nt, Staphylococcus aureus subsp. aureus MW2
aaagaggcuuuaaaauuuuuu

SEQ ID NO: 2099044 - RNA, 15 nt, Staphylococcus aureus subsp. aureus MW2
aaagaggcuuuaaaa

SEQ ID NO: 2099045 - RNA, 23 nt, Staphylococcus aureus subsp. aureus MW2
aaagaugguuuuguuuugcucuu

SEQ ID NO: 2099046 - RNA, 13 nt, Staphylococcus aureus subsp. aureus MW2
aaagauguugaaa

SEQ ID NO: 2099047 - RNA, 16 nt, Staphylococcus aureus subsp. aureus MW2
aaagauguugaaaagu

SEQ ID NO: 2099048 - RNA, 18 nt, Staphylococcus aureus subsp. aureus MW2
aaagauguugaaaaguau

SEQ ID NO: 2099049 - RNA, 17 nt, Staphylococcus aureus subsp. aureus MW2
aaagaugaaaaucuuua

SEQ ID NO: 2099050 - RNA, 21 nt, Staphylococcus aureus subsp. aureus MW2
aaagaugaaaaucuuuaacuc

SEQ ID NO: 2099051 - RNA, 18 nt, Staphylococcus aureus subsp. aureus MW2
aaagauuauugaaauuug

SEQ ID NO: 2099052 - RNA, 12 nt, Staphylococcus aureus subsp. aureus MW2
aaagauuaaaau

SEQ ID NO: 2099053 - RNA, 21 nt, Staphylococcus aureus subsp. aureus MW2
aaagcaaugucuugauugaau

SEQ ID NO: 2099054 - RNA, 12 nt, Staphylococcus aureus subsp. aureus MW2
aaaccucuaaau

SEQ ID NO: 2099055 - RNA, 17 nt, Staphylococcus aureus subsp. aureus MW2
aaaccucuaaauaaaau

SEQ ID NO: 2099056 - RNA, 20 nt, Staphylococcus aureus subsp. aureus MW2
aaaccucuaaauaaaauuaa

SEQ ID NO: 2099057 - RNA, 12 nt, Staphylococcus aureus subsp. aureus MW2
aaaccuaaugau

SEQ ID NO: 2099058 - RNA, 15 nt, Staphylococcus aureus subsp. aureus MW2
aaaccuaaugauaau

SEQ ID NO: 2099059 - RNA, 23 nt, Staphylococcus aureus subsp. aureus MW2
aaagaacuauguucaauuuaugu

SEQ ID NO: 2099060 - RNA, 22 nt, Staphylococcus aureus subsp. aureus MW2
aaagaacgucgcgaaaacguug

SEQ ID NO: 2099061 - RNA, 21 nt, Staphylococcus aureus subsp. aureus MW2
aaagaaccacgcaucauguau

SEQ ID NO: 2099062 - RNA, 18 nt, Staphylococcus aureus subsp. aureus MW2
aaagguauucuauuuuuc

SEQ ID NO: 2099063 - RNA, 12 nt, Staphylococcus aureus subsp. aureus MW2
aaaggucaucug

SEQ ID NO: 2099064 - RNA, 18 nt, Staphylococcus aureus subsp. aureus MW2
aaagguaccacuguauuu

SEQ ID NO: 2099065 - RNA, 23 nt, Staphylococcus aureus subsp. aureus MW2
aaaggugugggcuuuauuaucau

SEQ ID NO: 2099066 - RNA, 16 nt, Staphylococcus aureus subsp. aureus MW2
aaagguaacuuuuuaa

SEQ ID NO: 2099067 - RNA, 14 nt, Staphylococcus aureus subsp. aureus MW2
aaaggguuauuaac

SEQ ID NO: 2099068 - RNA, 17 nt, Staphylococcus aureus subsp. aureus MW2
aaaggcuagcuaaaauu

SEQ ID NO: 2099069 - RNA, 11 nt, Staphylococcus aureus subsp. aureus MW2
aaagcuuuaac

SEQ ID NO: 2099070 - RNA, 16 nt, Staphylococcus aureus subsp. aureus MW2
aaagcuuuuuugcuuu

SEQ ID NO: 2099071 - RNA, 21 nt, Staphylococcus aureus subsp. aureus MW2
aaagcuuuuuugcuuuuauaa

SEQ ID NO: 2099072 - RNA, 16 nt, Staphylococcus aureus subsp. aureus MW2
aaagcuuuaugugguu

SEQ ID NO: 2099073 - RNA, 14 nt, Staphylococcus aureus subsp. aureus MW2
aaagcuugauuuaa

SEQ ID NO: 2099074 - RNA, 21 nt, Staphylococcus aureus subsp. aureus MW2
aaagcuugauuuaacaaccuc

SEQ ID NO: 2099075 - RNA, 23 nt, Staphylococcus aureus subsp. aureus MW2
aaaggaugaugugaauguuuugu

SEQ ID NO: 2099076 - RNA, 17 nt, Staphylococcus aureus subsp. aureus MW2
aaaggcgaaacauuaaa

SEQ ID NO: 2099077 - RNA, 16 nt, Staphylococcus aureus subsp. aureus MW2
aaagccuucuaucucu

SEQ ID NO: 2099078 - RNA, 19 nt, Staphylococcus aureus subsp. aureus MW2
aaagcaucuucaauauuua

SEQ ID NO: 2099079 - RNA, 22 nt, Staphylococcus aureus subsp. aureus MW2
aaagcaucuucaauauuuaaau

SEQ ID NO: 2099080 - RNA, 23 nt, Staphylococcus aureus subsp. aureus MW2
aaagcaucuucaauauuuaaauu

SEQ ID NO: 2099081 - RNA, 17 nt, Staphylococcus aureus subsp. aureus MW2
aaagcagucgaacaaug

SEQ ID NO: 2099082 - RNA, 23 nt, Staphylococcus aureus subsp. aureus MW2
aaagcguaaggaauuacacuuua

SEQ ID NO: 2099083 - RNA, 15 nt, Staphylococcus aureus subsp. aureus MW2
aacagcuucaaaauc

SEQ ID NO: 2099084 - RNA, 13 nt, Staphylococcus aureus subsp. aureus MW2
aacagcuacaaau

SEQ ID NO: 2099085 - RNA, 23 nt, Staphylococcus aureus subsp. aureus MW2
aacaagguguucgggaauuuuuu

SEQ ID NO: 2099086 - RNA, 15 nt, Staphylococcus aureus subsp. aureus MW2
aacagguuaucacaa

SEQ ID NO: 2099087 - RNA, 13 nt, Staphylococcus aureus subsp. aureus MW2
aacaguaauuuuu

SEQ ID NO: 2099088 - RNA, 16 nt, Staphylococcus aureus subsp. aureus MW2
aacaguaauuuuuaaa

SEQ ID NO: 2099089 - RNA, 20 nt, Staphylococcus aureus subsp. aureus MW2
aacaggcuuagcuaauucau

SEQ ID NO: 2099090 - RNA, 14 nt, Staphylococcus aureus subsp. aureus MW2
aacaucacuugcug

SEQ ID NO: 2099091 - RNA, 18 nt, Staphylococcus aureus subsp. aureus MW2
aacaucacagaaaauaca

SEQ ID NO: 2099092 - RNA, 18 nt, Staphylococcus aureus subsp. aureus MW2
aacauagacacuuaacuu

SEQ ID NO: 2099093 - RNA, 13 nt, Staphylococcus aureus subsp. aureus MW2
aacauaauauuuc

SEQ ID NO: 2099094 - RNA, 15 nt, Staphylococcus aureus subsp. aureus MW2
aacauagagaauuuc

SEQ ID NO: 2099095 - RNA, 23 nt, Staphylococcus aureus subsp. aureus MW2
aacauaauaauaauacaauuuua

SEQ ID NO: 2099096 - RNA, 17 nt, Staphylococcus aureus subsp. aureus MW2
aacauagcuuaauaauu

SEQ ID NO: 2099097 - RNA, 21 nt, Staphylococcus aureus subsp. aureus MW2
aacauagcuuaauaauuaaua

SEQ ID NO: 2099098 - RNA, 15 nt, Staphylococcus aureus subsp. aureus MW2
aacauauaaaucauu

SEQ ID NO: 2099099 - RNA, 12 nt, Staphylococcus aureus subsp. aureus MW2
aacaguuuuaaa

SEQ ID NO: 2099100 - RNA, 13 nt, Staphylococcus aureus subsp. aureus MW2
aacaguuuuaaag

SEQ ID NO: 2099101 - RNA, 19 nt, Staphylococcus aureus subsp. aureus MW2
aacaguuuuauuaucuuug

SEQ ID NO: 2099102 - RNA, 12 nt, Staphylococcus aureus subsp. aureus MW2
aacauaaaaaua

SEQ ID NO: 2099103 - RNA, 17 nt, Staphylococcus aureus subsp. aureus MW2
aacauaaaaauauucaa

SEQ ID NO: 2099104 - RNA, 15 nt, Staphylococcus aureus subsp. aureus MW2
aacauaacucaaaua

SEQ ID NO: 2099105 - RNA, 14 nt, Staphylococcus aureus subsp. aureus MW2
aacauaaagaauuu

SEQ ID NO: 2099106 - RNA, 18 nt, Staphylococcus aureus subsp. aureus MW2
aacagucccaaccccuuu

SEQ ID NO: 2099107 - RNA, 20 nt, Staphylococcus aureus subsp. aureus MW2
aacaguggaauacagaugau

SEQ ID NO: 2099108 - RNA, 20 nt, Staphylococcus aureus subsp. aureus MW2
aacaguuagaaacagaauua

SEQ ID NO: 2099109 - RNA, 21 nt, Staphylococcus aureus subsp. aureus MW2
aacaguuagaaacagaauuau

SEQ ID NO: 2099110 - RNA, 20 nt, Staphylococcus aureus subsp. aureus MW2
aacauuuuugugcaaaaguu

SEQ ID NO: 2099111 - RNA, 20 nt, Staphylococcus aureus subsp. aureus MW2
aacauuuuuuauagcaaauu

SEQ ID NO: 2099112 - RNA, 15 nt, Staphylococcus aureus subsp. aureus MW2
aaccaaaaccaaaug

SEQ ID NO: 2099113 - RNA, 18 nt, Staphylococcus aureus subsp. aureus MW2
aaccaaaaccaaaugaac

SEQ ID NO: 2099114 - RNA, 22 nt, Staphylococcus aureus subsp. aureus MW2
aaccaccaucccauuaaaccac

SEQ ID NO: 2099115 - RNA, 16 nt, Staphylococcus aureus subsp. aureus MW2
aacauuuuuagaauca

SEQ ID NO: 2099116 - RNA, 18 nt, Staphylococcus aureus subsp. aureus MW2
aacauuuuugauuuuaau

SEQ ID NO: 2099117 - RNA, 13 nt, Staphylococcus aureus subsp. aureus MW2
aacauuugucaua

SEQ ID NO: 2099118 - RNA, 13 nt, Staphylococcus aureus subsp. aureus MW2
aacauuuugaguc

SEQ ID NO: 2099119 - RNA, 11 nt, Staphylococcus aureus subsp. aureus MW2
aacauuuuuag

SEQ ID NO: 2099120 - RNA, 16 nt, Staphylococcus aureus subsp. aureus MW2
aacauuuguccgauuu

SEQ ID NO: 2099121 - RNA, 21 nt, Staphylococcus aureus subsp. aureus MW2
aacaugggguuuuauuuuugg

SEQ ID NO: 2099122 - RNA, 16 nt, Staphylococcus aureus subsp. aureus MW2
aacauuuaagaaacgu

SEQ ID NO: 2099123 - RNA, 19 nt, Staphylococcus aureus subsp. aureus MW2
aacauuuauuuuuucucua

SEQ ID NO: 2099124 - RNA, 20 nt, Staphylococcus aureus subsp. aureus MW2
aacaugauucaugauauguu

SEQ ID NO: 2099125 - RNA, 20 nt, Staphylococcus aureus subsp. aureus MW2
aacaugcuuggacauauacu

SEQ ID NO: 2099126 - RNA, 21 nt, Staphylococcus aureus subsp. aureus MW2
aacaugauucaugauauguuc

SEQ ID NO: 2099127 - RNA, 18 nt, Staphylococcus aureus subsp. aureus MW2
aacccauuuucaaaacua

SEQ ID NO: 2099128 - RNA, 14 nt, Staphylococcus aureus subsp. aureus MW2
aaccaguuuaguau

SEQ ID NO: 2099129 - RNA, 14 nt, Staphylococcus aureus subsp. aureus MW2
aaccccauguauaa

SEQ ID NO: 2099130 - RNA, 18 nt, Staphylococcus aureus subsp. aureus MW2
aaccagcuaaccaaauaa

SEQ ID NO: 2099131 - RNA, 20 nt, Staphylococcus aureus subsp. aureus MW2
aaccagcuaaccaaauaauu

SEQ ID NO: 2099132 - RNA, 22 nt, Staphylococcus aureus subsp. aureus MW2
aaccagcuuacugcuuuuuuau

SEQ ID NO: 2099133 - RNA, 23 nt, Staphylococcus aureus subsp. aureus MW2
aacgaaaauuaagaugaaauacu

SEQ ID NO: 2099134 - RNA, 15 nt, Staphylococcus aureus subsp. aureus MW2
aaccuuuucaaacua

SEQ ID NO: 2099135 - RNA, 13 nt, Staphylococcus aureus subsp. aureus MW2
aaccuugauuuaa

SEQ ID NO: 2099136 - RNA, 11 nt, Staphylococcus aureus subsp. aureus MW2
aaccuuuaaaa

SEQ ID NO: 2099137 - RNA, 20 nt, Staphylococcus aureus subsp. aureus MW2
aaccuguucuuuauuuaaag

SEQ ID NO: 2099138 - RNA, 22 nt, Staphylococcus aureus subsp. aureus MW2
aaccugucuuaauucauuccaa

SEQ ID NO: 2099139 - RNA, 18 nt, Staphylococcus aureus subsp. aureus MW2
aaccucuaaauaaaauua

SEQ ID NO: 2099140 - RNA, 23 nt, Staphylococcus aureus subsp. aureus MW2
aaccuaaucugccguguuuugua

SEQ ID NO: 2099141 - RNA, 19 nt, Staphylococcus aureus subsp. aureus MW2
aaccuaccuauuugauuaa

SEQ ID NO: 2099142 - RNA, 20 nt, Staphylococcus aureus subsp. aureus MW2
aaccuauuaaaauaaaccac

SEQ ID NO: 2099143 - RNA, 13 nt, Staphylococcus aureus subsp. aureus MW2
aaccuaaaaacaa

SEQ ID NO: 2099144 - RNA, 18 nt, Staphylococcus aureus subsp. aureus MW2
aaccuaaaaacagcagua

SEQ ID NO: 2099145 - RNA, 22 nt, Staphylococcus aureus subsp. aureus MW2
aaccgugagggacgucaucaug

SEQ ID NO: 2099146 - RNA, 14 nt, Staphylococcus aureus subsp. aureus MW2
aaccguauuauuag

SEQ ID NO: 2099147 - RNA, 15 nt, Staphylococcus aureus subsp. aureus MW2
aaccguuauauauua

SEQ ID NO: 2099148 - RNA, 19 nt, Staphylococcus aureus subsp. aureus MW2
aaccggucuauaacaccau

SEQ ID NO: 2099149 - RNA, 13 nt, Staphylococcus aureus subsp. aureus MW2
aacgcauuucaug

SEQ ID NO: 2099150 - RNA, 20 nt, Staphylococcus aureus subsp. aureus MW2
aacgcaucacggccuucuuu

SEQ ID NO: 2099151 - RNA, 18 nt, Staphylococcus aureus subsp. aureus MW2
aacgauagacauugagau

SEQ ID NO: 2099152 - RNA, 13 nt, Staphylococcus aureus subsp. aureus MW2
aacgaguuuucag

SEQ ID NO: 2099153 - RNA, 18 nt, Staphylococcus aureus subsp. aureus MW2
aacgauaccaaauauauu

SEQ ID NO: 2099154 - RNA, 15 nt, Staphylococcus aureus subsp. aureus MW2
aacgauaccaaauau

SEQ ID NO: 2099155 - RNA, 18 nt, Staphylococcus aureus subsp. aureus MW2
aacgagucauaaauauaa

SEQ ID NO: 2099156 - RNA, 17 nt, Staphylococcus aureus subsp. aureus MW2
aacgagcuggugagaaa

SEQ ID NO: 2099157 - RNA, 18 nt, Staphylococcus aureus subsp. aureus MW2
aacgacaugaaaguuguu

SEQ ID NO: 2099158 - RNA, 17 nt, Staphylococcus aureus subsp. aureus MW2
aacgagagagaaaagcu

SEQ ID NO: 2099159 - RNA, 23 nt, Staphylococcus aureus subsp. aureus MW2
aacgaaggucuacuaaauaacua

SEQ ID NO: 2099160 - RNA, 15 nt, Staphylococcus aureus subsp. aureus MW2
aacgaagccuaauuu

SEQ ID NO: 2099161 - RNA, 16 nt, Staphylococcus aureus subsp. aureus MW2
aacgcuaauuuuacuc

SEQ ID NO: 2099162 - RNA, 14 nt, Staphylococcus aureus subsp. aureus MW2
aacuguucuaaaau

SEQ ID NO: 2099163 - RNA, 22 nt, Staphylococcus aureus subsp. aureus MW2
aacuguucuuucgucuuguaaa

SEQ ID NO: 2099164 - RNA, 14 nt, Staphylococcus aureus subsp. aureus MW2
aacuucauaauaua

SEQ ID NO: 2099165 - RNA, 17 nt, Staphylococcus aureus subsp. aureus MW2
aacuguuaaacucauac

SEQ ID NO: 2099166 - RNA, 15 nt, Staphylococcus aureus subsp. aureus MW2
aacuguuuauccaua

SEQ ID NO: 2099167 - RNA, 23 nt, Staphylococcus aureus subsp. aureus MW2
aacugauaauacuguuuaaauaa

SEQ ID NO: 2099168 - RNA, 20 nt, Staphylococcus aureus subsp. aureus MW2
aacugcgccaguuucuaaua

SEQ ID NO: 2099169 - RNA, 16 nt, Staphylococcus aureus subsp. aureus MW2
aacugguugauaaaua

SEQ ID NO: 2099170 - RNA, 23 nt, Staphylococcus aureus subsp. aureus MW2
aacugugauauuaauugaaaaac

SEQ ID NO: 2099171 - RNA, 16 nt, Staphylococcus aureus subsp. aureus MW2
aacuuuacgauaaaua

SEQ ID NO: 2099172 - RNA, 15 nt, Staphylococcus aureus subsp. aureus MW2
aacuuuaauauaagu

SEQ ID NO: 2099173 - RNA, 14 nt, Staphylococcus aureus subsp. aureus MW2
aacuuuaauaccag

SEQ ID NO: 2099174 - RNA, 17 nt, Staphylococcus aureus subsp. aureus MW2
aacuuuaagcugucaua

SEQ ID NO: 2099175 - RNA, 16 nt, Staphylococcus aureus subsp. aureus MW2
aacuuuaacaucugaa

SEQ ID NO: 2099176 - RNA, 20 nt, Staphylococcus aureus subsp. aureus MW2
aacuuuaacaucugaaucug

SEQ ID NO: 2099177 - RNA, 16 nt, Staphylococcus aureus subsp. aureus MW2
aacuucugaaacgccu

SEQ ID NO: 2099178 - RNA, 15 nt, Staphylococcus aureus subsp. aureus MW2
aacuuuaaauguuuu

SEQ ID NO: 2099179 - RNA, 22 nt, Staphylococcus aureus subsp. aureus MW2
aacuugucuaccgaaugaguuu

SEQ ID NO: 2099180 - RNA, 23 nt, Staphylococcus aureus subsp. aureus MW2
aacuuucagcaccagaacaauuc

SEQ ID NO: 2099181 - RNA, 20 nt, Staphylococcus aureus subsp. aureus MW2
aacuuucacucauauuacuu

SEQ ID NO: 2099182 - RNA, 15 nt, Staphylococcus aureus subsp. aureus MW2
aacuuuaguuguuag

SEQ ID NO: 2099183 - RNA, 17 nt, Staphylococcus aureus subsp. aureus MW2
aacuuuaguauauucaa

SEQ ID NO: 2099184 - RNA, 22 nt, Staphylococcus aureus subsp. aureus MW2
aacuuuauagggcgcacauuau

SEQ ID NO: 2099185 - RNA, 12 nt, Staphylococcus aureus subsp. aureus MW2
aacuuuauauug

SEQ ID NO: 2099186 - RNA, 17 nt, Staphylococcus aureus subsp. aureus MW2
aacuuucucaaauuaga

SEQ ID NO: 2099187 - RNA, 11 nt, Staphylococcus aureus subsp. aureus MW2
aacuuucucua

SEQ ID NO: 2099188 - RNA, 14 nt, Staphylococcus aureus subsp. aureus MW2
aagaaaauuucagu

SEQ ID NO: 2099189 - RNA, 19 nt, Staphylococcus aureus subsp. aureus MW2
aacuuuuggucaaguuuug

SEQ ID NO: 2099190 - RNA, 22 nt, Staphylococcus aureus subsp. aureus MW2
aacuuuuucgauuaauucuucu

SEQ ID NO: 2099191 - RNA, 13 nt, Staphylococcus aureus subsp. aureus MW2
aacuuuuacuuuc

SEQ ID NO: 2099192 - RNA, 23 nt, Staphylococcus aureus subsp. aureus MW2
aacuuugucuguauuauuauaau

SEQ ID NO: 2099193 - RNA, 19 nt, Staphylococcus aureus subsp. aureus MW2
aacuuuguaugaagauuua

SEQ ID NO: 2099194 - RNA, 22 nt, Staphylococcus aureus subsp. aureus MW2
aacuuuguaugaagauuuaagg

SEQ ID NO: 2099195 - RNA, 20 nt, Staphylococcus aureus subsp. aureus MW2
aacuuugguaguaugacaaa

SEQ ID NO: 2099196 - RNA, 16 nt, Staphylococcus aureus subsp. aureus MW2
aacuuuuccuuguugg

SEQ ID NO: 2099197 - RNA, 22 nt, Staphylococcus aureus subsp. aureus MW2
aacuuuucagcaguugcacaaa

SEQ ID NO: 2099198 - RNA, 18 nt, Staphylococcus aureus subsp. aureus MW2
aacuuuuauuaucagucc

SEQ ID NO: 2099199 - RNA, 19 nt, Staphylococcus aureus subsp. aureus MW2
aacucacaacagugcucua

SEQ ID NO: 2099200 - RNA, 17 nt, Staphylococcus aureus subsp. aureus MW2
aacuauaugaaauguuc

SEQ ID NO: 2099201 - RNA, 15 nt, Staphylococcus aureus subsp. aureus MW2
aacuaucgauacuaa

SEQ ID NO: 2099202 - RNA, 15 nt, Staphylococcus aureus subsp. aureus MW2
aacuauccauaaagu

SEQ ID NO: 2099203 - RNA, 22 nt, Staphylococcus aureus subsp. aureus MW2
aacuauuaaaucauuauuuuac

SEQ ID NO: 2099204 - RNA, 19 nt, Staphylococcus aureus subsp. aureus MW2
aacugacccuugucaguuu

SEQ ID NO: 2099205 - RNA, 13 nt, Staphylococcus aureus subsp. aureus MW2
aacugaauuucgu

SEQ ID NO: 2099206 - RNA, 12 nt, Staphylococcus aureus subsp. aureus MW2
aacucuaucuau

SEQ ID NO: 2099207 - RNA, 14 nt, Staphylococcus aureus subsp. aureus MW2
aacucuaucuauuu

SEQ ID NO: 2099208 - RNA, 15 nt, Staphylococcus aureus subsp. aureus MW2
aacucuaacagcuua

SEQ ID NO: 2099209 - RNA, 17 nt, Staphylococcus aureus subsp. aureus MW2
aacucuaacagcuuaau

SEQ ID NO: 2099210 - RNA, 14 nt, Staphylococcus aureus subsp. aureus MW2
aacucugagcacuu

SEQ ID NO: 2099211 - RNA, 22 nt, Staphylococcus aureus subsp. aureus MW2
aacucuaaaagccaucuuaccu

SEQ ID NO: 2099212 - RNA, 21 nt, Staphylococcus aureus subsp. aureus MW2
aagacuuggugcccaaguuuc

SEQ ID NO: 2099213 - RNA, 15 nt, Staphylococcus aureus subsp. aureus MW2
aagagaaaauuugua

SEQ ID NO: 2099214 - RNA, 21 nt, Staphylococcus aureus subsp. aureus MW2
aagacuucccuauauguaggg

SEQ ID NO: 2099215 - RNA, 16 nt, Staphylococcus aureus subsp. aureus MW2
aagagaaaagcuagaa

SEQ ID NO: 2099216 - RNA, 17 nt, Staphylococcus aureus subsp. aureus MW2
aagagaaaagcuagaag

SEQ ID NO: 2099217 - RNA, 17 nt, Staphylococcus aureus subsp. aureus MW2
aagacuauaaugaauaa

SEQ ID NO: 2099218 - RNA, 15 nt, Staphylococcus aureus subsp. aureus MW2
aagaccuucuaaaau

SEQ ID NO: 2099219 - RNA, 21 nt, Staphylococcus aureus subsp. aureus MW2
aagacggugaccuuauauuuu

SEQ ID NO: 2099220 - RNA, 16 nt, Staphylococcus aureus subsp. aureus MW2
aagacgccgaaaagag

SEQ ID NO: 2099221 - RNA, 17 nt, Staphylococcus aureus subsp. aureus MW2
aagacgccgaaaagagg

SEQ ID NO: 2099222 - RNA, 20 nt, Staphylococcus aureus subsp. aureus MW2
aagaccauuuuauauuuuag

SEQ ID NO: 2099223 - RNA, 22 nt, Staphylococcus aureus subsp. aureus MW2
aagaccaaauauuuuaucugua

SEQ ID NO: 2099224 - RNA, 19 nt, Staphylococcus aureus subsp. aureus MW2
aagaccguauuuuuuuaua

SEQ ID NO: 2099225 - RNA, 21 nt, Staphylococcus aureus subsp. aureus MW2
aagaccguauccuguguaaaa

SEQ ID NO: 2099226 - RNA, 17 nt, Staphylococcus aureus subsp. aureus MW2
aagaauuguugaucaug

SEQ ID NO: 2099227 - RNA, 17 nt, Staphylococcus aureus subsp. aureus MW2
aagaaugcgaagauuuu

SEQ ID NO: 2099228 - RNA, 17 nt, Staphylococcus aureus subsp. aureus MW2
aagaaugauuuauaaaa

SEQ ID NO: 2099229 - RNA, 13 nt, Staphylococcus aureus subsp. aureus MW2
aagacaccuucaa

SEQ ID NO: 2099230 - RNA, 19 nt, Staphylococcus aureus subsp. aureus MW2
aagaauuucgaaaagaaau

SEQ ID NO: 2099231 - RNA, 22 nt, Staphylococcus aureus subsp. aureus MW2
aagacagcuucucauugaaauc

SEQ ID NO: 2099232 - RNA, 19 nt, Staphylococcus aureus subsp. aureus MW2
aagacauaaacaauaauuu

SEQ ID NO: 2099233 - RNA, 20 nt, Staphylococcus aureus subsp. aureus MW2
aagacauacagucaauacaa

SEQ ID NO: 2099234 - RNA, 15 nt, Staphylococcus aureus subsp. aureus MW2
aagauaucuggauua

SEQ ID NO: 2099235 - RNA, 13 nt, Staphylococcus aureus subsp. aureus MW2
aagauauccauua

SEQ ID NO: 2099236 - RNA, 17 nt, Staphylococcus aureus subsp. aureus MW2
aagauaguuugagaaaa

SEQ ID NO: 2099237 - RNA, 15 nt, Staphylococcus aureus subsp. aureus MW2
aagauauauuguaag

SEQ ID NO: 2099238 - RNA, 18 nt, Staphylococcus aureus subsp. aureus MW2
aagauauuuccaaauuga

SEQ ID NO: 2099239 - RNA, 21 nt, Staphylococcus aureus subsp. aureus MW2
aagaucacacgacauguaggu

SEQ ID NO: 2099240 - RNA, 22 nt, Staphylococcus aureus subsp. aureus MW2
aagauagagcccuuagcaauau

SEQ ID NO: 2099241 - RNA, 15 nt, Staphylococcus aureus subsp. aureus MW2
aagauaccuuuuucu

SEQ ID NO: 2099242 - RNA, 19 nt, Staphylococcus aureus subsp. aureus MW2
aagauagaaugaauaauuc

SEQ ID NO: 2099243 - RNA, 21 nt, Staphylococcus aureus subsp. aureus MW2
aagauacguugauguaauucu

SEQ ID NO: 2099244 - RNA, 20 nt, Staphylococcus aureus subsp. aureus MW2
aagauaaacaagccaagaua

SEQ ID NO: 2099245 - RNA, 17 nt, Staphylococcus aureus subsp. aureus MW2
aagaguuaauccucauu

SEQ ID NO: 2099246 - RNA, 23 nt, Staphylococcus aureus subsp. aureus MW2
aagauaaauaaaaggcauucuuc

SEQ ID NO: 2099247 - RNA, 13 nt, Staphylococcus aureus subsp. aureus MW2
aagauaaauaaaa

SEQ ID NO: 2099248 - RNA, 18 nt, Staphylococcus aureus subsp. aureus MW2
aagagauuuuuuugaaaa

SEQ ID NO: 2099249 - RNA, 14 nt, Staphylococcus aureus subsp. aureus MW2
aagagcaauuaaag

SEQ ID NO: 2099250 - RNA, 17 nt, Staphylococcus aureus subsp. aureus MW2
aagagaauauaaaauaa

SEQ ID NO: 2099251 - RNA, 13 nt, Staphylococcus aureus subsp. aureus MW2
aagaggucuccaa

SEQ ID NO: 2099252 - RNA, 20 nt, Staphylococcus aureus subsp. aureus MW2
aagaguaaaguuaaaagcuu

SEQ ID NO: 2099253 - RNA, 15 nt, Staphylococcus aureus subsp. aureus MW2
aagaggcaggaauga

SEQ ID NO: 2099254 - RNA, 18 nt, Staphylococcus aureus subsp. aureus MW2
aagaggcuuuaaaauuuu

SEQ ID NO: 2099255 - RNA, 22 nt, Staphylococcus aureus subsp. aureus MW2
aagaggacaacuaauaacaaau

SEQ ID NO: 2099256 - RNA, 22 nt, Staphylococcus aureus subsp. aureus MW2
aagagcuuuuaguaaauaauuu

SEQ ID NO: 2099257 - RNA, 16 nt, Staphylococcus aureus subsp. aureus MW2
aauaaaucuaucuauu

SEQ ID NO: 2099258 - RNA, 15 nt, Staphylococcus aureus subsp. aureus MW2
aauaacaucuaaauu

SEQ ID NO: 2099259 - RNA, 13 nt, Staphylococcus aureus subsp. aureus MW2
aauaaauguuaaa

SEQ ID NO: 2099260 - RNA, 20 nt, Staphylococcus aureus subsp. aureus MW2
aauaaaucauacgagaaauu

SEQ ID NO: 2099261 - RNA, 19 nt, Staphylococcus aureus subsp. aureus MW2
aauaaaucggacugauaga

SEQ ID NO: 2099262 - RNA, 20 nt, Staphylococcus aureus subsp. aureus MW2
aaguugauaacuauuuaauu

SEQ ID NO: 2099263 - RNA, 21 nt, Staphylococcus aureus subsp. aureus MW2
aaguuggggugugggccccaa

SEQ ID NO: 2099264 - RNA, 22 nt, Staphylococcus aureus subsp. aureus MW2
aaguuggggugugggccccaac

SEQ ID NO: 2099265 - RNA, 16 nt, Staphylococcus aureus subsp. aureus MW2
aaguuguauaaaaaug

SEQ ID NO: 2099266 - RNA, 17 nt, Staphylococcus aureus subsp. aureus MW2
aaguuguugauuuaaaa

SEQ ID NO: 2099267 - RNA, 18 nt, Staphylococcus aureus subsp. aureus MW2
aaguugguccaaaucgug

SEQ ID NO: 2099268 - RNA, 19 nt, Staphylococcus aureus subsp. aureus MW2
aaguuguggucuaaccauc

SEQ ID NO: 2099269 - RNA, 16 nt, Staphylococcus aureus subsp. aureus MW2
aaguuguuucuccagu

SEQ ID NO: 2099270 - RNA, 18 nt, Staphylococcus aureus subsp. aureus MW2
aaguuuaaucguauuagc

SEQ ID NO: 2099271 - RNA, 15 nt, Staphylococcus aureus subsp. aureus MW2
aauaacuguuuauca

SEQ ID NO: 2099272 - RNA, 17 nt, Staphylococcus aureus subsp. aureus MW2
aauaacuugauauuaua

SEQ ID NO: 2099273 - RNA, 23 nt, Staphylococcus aureus subsp. aureus MW2
aauaagaacuugcuuuucauuua

SEQ ID NO: 2099274 - RNA, 12 nt, Staphylococcus aureus subsp. aureus MW2
aauaagauuauu

SEQ ID NO: 2099275 - RNA, 16 nt, Staphylococcus aureus subsp. aureus MW2
aauaacccauuuucaa

SEQ ID NO: 2099276 - RNA, 17 nt, Staphylococcus aureus subsp. aureus MW2
aauaacauguuuguggc

SEQ ID NO: 2099277 - RNA, 18 nt, Staphylococcus aureus subsp. aureus MW2
aauaaccgcacuuucuau

SEQ ID NO: 2099278 - RNA, 17 nt, Staphylococcus aureus subsp. aureus MW2
aauaacucuuaggguuu

SEQ ID NO: 2099279 - RNA, 14 nt, Staphylococcus aureus subsp. aureus MW2
aauaaguugucauc

SEQ ID NO: 2099280 - RNA, 19 nt, Staphylococcus aureus subsp. aureus MW2
aauaaguugucaucuaauu

SEQ ID NO: 2099281 - RNA, 13 nt, Staphylococcus aureus subsp. aureus MW2
aauaaguuaccuu

SEQ ID NO: 2099282 - RNA, 13 nt, Staphylococcus aureus subsp. aureus MW2
aauaauaaaauag

SEQ ID NO: 2099283 - RNA, 13 nt, Staphylococcus aureus subsp. aureus MW2
aauaagugauaaa

SEQ ID NO: 2099284 - RNA, 23 nt, Staphylococcus aureus subsp. aureus MW2
aauaagucucuuuacggauugcu

SEQ ID NO: 2099285 - RNA, 15 nt, Staphylococcus aureus subsp. aureus MW2
aauaaguaauaauuu

SEQ ID NO: 2099286 - RNA, 15 nt, Staphylococcus aureus subsp. aureus MW2
aauaagauuuugcuu

SEQ ID NO: 2099287 - RNA, 22 nt, Staphylococcus aureus subsp. aureus MW2
aauaagauuuugcuuuaaacau

SEQ ID NO: 2099288 - RNA, 14 nt, Staphylococcus aureus subsp. aureus MW2
aaaaauaaaccaug

SEQ ID NO: 2099289 - RNA, 20 nt, Staphylococcus aureus subsp. aureus MW2
aaaaauaaagucauaugguu

SEQ ID NO: 2099290 - RNA, 16 nt, Staphylococcus aureus subsp. aureus MW2
aaaaauaaauguuaaa

SEQ ID NO: 2099291 - RNA, 20 nt, Staphylococcus aureus subsp. aureus MW2
aaaaauaacuguaaaacauu

SEQ ID NO: 2099292 - RNA, 11 nt, Staphylococcus aureus subsp. aureus MW2
aaaaauaaaaa

SEQ ID NO: 2099293 - RNA, 13 nt, Staphylococcus aureus subsp. aureus MW2
aaaaaguuuaaag

SEQ ID NO: 2099294 - RNA, 20 nt, Staphylococcus aureus subsp. aureus MW2
aaaaauccggaacauuaaaa

SEQ ID NO: 2099295 - RNA, 20 nt, Staphylococcus aureus subsp. aureus MW2
aaaaauccucacaaauuuga

SEQ ID NO: 2099296 - RNA, 14 nt, Staphylococcus aureus subsp. aureus MW2
aaaaauccuaugaa

SEQ ID NO: 2099297 - RNA, 19 nt, Staphylococcus aureus subsp. aureus MW2
aaaaauccuaugaauaaau

SEQ ID NO: 2099298 - RNA, 21 nt, Staphylococcus aureus subsp. aureus MW2
aaaaaucgaacuagacaagau

SEQ ID NO: 2099299 - RNA, 17 nt, Staphylococcus aureus subsp. aureus MW2
aaaaaucggcuuucuaa

SEQ ID NO: 2099300 - RNA, 17 nt, Staphylococcus aureus subsp. aureus MW2
aaaaaucuacauaugaa

SEQ ID NO: 2099301 - RNA, 20 nt, Staphylococcus aureus subsp. aureus MW2
aaaaaucuacauaugaaaaa

SEQ ID NO: 2099302 - RNA, 16 nt, Staphylococcus aureus subsp. aureus MW2
aaaaaucuuuugauag

SEQ ID NO: 2099303 - RNA, 22 nt, Staphylococcus aureus subsp. aureus MW2
aaaaaucuucuccaaucaucau

SEQ ID NO: 2099304 - RNA, 16 nt, Staphylococcus aureus subsp. aureus MW2
aauaauuuuaaaaaua

SEQ ID NO: 2099305 - RNA, 15 nt, Staphylococcus aureus subsp. aureus MW2
aauaaugugaaaaau

SEQ ID NO: 2099306 - RNA, 14 nt, Staphylococcus aureus subsp. aureus MW2
aauacaaaaauaua

SEQ ID NO: 2099307 - RNA, 14 nt, Staphylococcus aureus subsp. aureus MW2
aauaauuuugauau

SEQ ID NO: 2099308 - RNA, 17 nt, Staphylococcus aureus subsp. aureus MW2
aauaaugcuuauuaaaa

SEQ ID NO: 2099309 - RNA, 19 nt, Staphylococcus aureus subsp. aureus MW2
aauaaugcuuauuaaaauu

SEQ ID NO: 2099310 - RNA, 20 nt, Staphylococcus aureus subsp. aureus MW2
aauaaugacgagaauuaaag

SEQ ID NO: 2099311 - RNA, 18 nt, Staphylococcus aureus subsp. aureus MW2
aauaaugacugacacuuu

SEQ ID NO: 2099312 - RNA, 14 nt, Staphylococcus aureus subsp. aureus MW2
aauaaugacaaauu

SEQ ID NO: 2099313 - RNA, 20 nt, Staphylococcus aureus subsp. aureus MW2
aauaaugacaaauuaucacu

SEQ ID NO: 2099314 - RNA, 18 nt, Staphylococcus aureus subsp. aureus MW2
aauaaugaugauacugau

SEQ ID NO: 2099315 - RNA, 14 nt, Staphylococcus aureus subsp. aureus MW2
aaaaauagaaaaaa

SEQ ID NO: 2099316 - RNA, 16 nt, Staphylococcus aureus subsp. aureus MW2
aauaauacauucauua

SEQ ID NO: 2099317 - RNA, 22 nt, Staphylococcus aureus subsp. aureus MW2
aauaauaggauaccacaucgca

SEQ ID NO: 2099318 - RNA, 22 nt, Staphylococcus aureus subsp. aureus MW2
aauaauaggcuagauaauaauc

SEQ ID NO: 2099319 - RNA, 16 nt, Staphylococcus aureus subsp. aureus MW2
aauaauagcaaaauua

SEQ ID NO: 2099320 - RNA, 17 nt, Staphylococcus aureus subsp. aureus MW2
aaaaauaguucuuuaaa

SEQ ID NO: 2099321 - RNA, 19 nt, Staphylococcus aureus subsp. aureus MW2
aaaaauaguucuuuaaauu

SEQ ID NO: 2099322 - RNA, 15 nt, Staphylococcus aureus subsp. aureus MW2
aauacauuuugcucu

SEQ ID NO: 2099323 - RNA, 13 nt, Staphylococcus aureus subsp. aureus MW2
aauaccaauugcu

SEQ ID NO: 2099324 - RNA, 23 nt, Staphylococcus aureus subsp. aureus MW2
aauaccaacugcaaauacaccag

SEQ ID NO: 2099325 - RNA, 14 nt, Staphylococcus aureus subsp. aureus MW2
aauaccaauugcuu

SEQ ID NO: 2099326 - RNA, 20 nt, Staphylococcus aureus subsp. aureus MW2
aauacaugugggauaucuuc

SEQ ID NO: 2099327 - RNA, 16 nt, Staphylococcus aureus subsp. aureus MW2
aauacaugauauaaau

SEQ ID NO: 2099328 - RNA, 17 nt, Staphylococcus aureus subsp. aureus MW2
aauacaugauauaaaua

SEQ ID NO: 2099329 - RNA, 18 nt, Staphylococcus aureus subsp. aureus MW2
aauacacuugcuaaaacu

SEQ ID NO: 2099330 - RNA, 23 nt, Staphylococcus aureus subsp. aureus MW2
aauacacuugcuaaaacuaauga

SEQ ID NO: 2099331 - RNA, 21 nt, Staphylococcus aureus subsp. aureus MW2
aauacaauuucuucauuuuca

SEQ ID NO: 2099332 - RNA, 12 nt, Staphylococcus aureus subsp. aureus MW2
aauacaauuuua

SEQ ID NO: 2099333 - RNA, 16 nt, Staphylococcus aureus subsp. aureus MW2
aaaaauggcgaaaaag

SEQ ID NO: 2099334 - RNA, 18 nt, Staphylococcus aureus subsp. aureus MW2
aaaaauggcgaaaaagcu

SEQ ID NO: 2099335 - RNA, 18 nt, Staphylococcus aureus subsp. aureus MW2
aaaaaugcgcuuccaauu

SEQ ID NO: 2099336 - RNA, 21 nt, Staphylococcus aureus subsp. aureus MW2
aaaaaugccgagauuauuaug

SEQ ID NO: 2099337 - RNA, 13 nt, Staphylococcus aureus subsp. aureus MW2
aauaccaucaucg

SEQ ID NO: 2099338 - RNA, 17 nt, Staphylococcus aureus subsp. aureus MW2
aauaccauaauuaaaua

SEQ ID NO: 2099339 - RNA, 19 nt, Staphylococcus aureus subsp. aureus MW2
aauaccagugggcuccaaa

SEQ ID NO: 2099340 - RNA, 12 nt, Staphylococcus aureus subsp. aureus MW2
aaaaaugaugua

SEQ ID NO: 2099341 - RNA, 23 nt, Staphylococcus aureus subsp. aureus MW2
aaaaauggggacauguucacuua

SEQ ID NO: 2099342 - RNA, 17 nt, Staphylococcus aureus subsp. aureus MW2
aaaaauguaaauaaaaa

SEQ ID NO: 2099343 - RNA, 21 nt, Staphylococcus aureus subsp. aureus MW2
aaaaauggugauccgccuuga

SEQ ID NO: 2099344 - RNA, 16 nt, Staphylococcus aureus subsp. aureus MW2
aauaccccaaauagug

SEQ ID NO: 2099345 - RNA, 20 nt, Staphylococcus aureus subsp. aureus MW2
aauagcgauuuuaaagaaaa

SEQ ID NO: 2099346 - RNA, 17 nt, Staphylococcus aureus subsp. aureus MW2
aauagcuauuaaaauag

SEQ ID NO: 2099347 - RNA, 21 nt, Staphylococcus aureus subsp. aureus MW2
aauagcuacaauuaaagugaa

SEQ ID NO: 2099348 - RNA, 23 nt, Staphylococcus aureus subsp. aureus MW2
aauagcuauauuuuuguauuuau

SEQ ID NO: 2099349 - RNA, 18 nt, Staphylococcus aureus subsp. aureus MW2
aauagcuauaacucuaaa

SEQ ID NO: 2099350 - RNA, 21 nt, Staphylococcus aureus subsp. aureus MW2
aauagcuauaacucuaaauau

SEQ ID NO: 2099351 - RNA, 14 nt, Staphylococcus aureus subsp. aureus MW2
aauagcuauauuuu

SEQ ID NO: 2099352 - RNA, 21 nt, Staphylococcus aureus subsp. aureus MW2
aauagaugucacuguuaaaga

SEQ ID NO: 2099353 - RNA, 19 nt, Staphylococcus aureus subsp. aureus MW2
aauagaugagaaaguaaaa

SEQ ID NO: 2099354 - RNA, 16 nt, Staphylococcus aureus subsp. aureus MW2
aauagagaaaaaauaa

SEQ ID NO: 2099355 - RNA, 23 nt, Staphylococcus aureus subsp. aureus MW2
aauagacauuguuaaacuaagag

SEQ ID NO: 2099356 - RNA, 16 nt, Staphylococcus aureus subsp. aureus MW2
aauaccugcaacuuuu

SEQ ID NO: 2099357 - RNA, 20 nt, Staphylococcus aureus subsp. aureus MW2
aauagaagguuauuuuuuau

SEQ ID NO: 2099358 - RNA, 22 nt, Staphylococcus aureus subsp. aureus MW2
aauagaagguuauuuuuuaugg

SEQ ID NO: 2099359 - RNA, 16 nt, Staphylococcus aureus subsp. aureus MW2
aauagguuauuugaua

SEQ ID NO: 2099360 - RNA, 21 nt, Staphylococcus aureus subsp. aureus MW2
aauaggugcuuguaaaauuuu

SEQ ID NO: 2099361 - RNA, 20 nt, Staphylococcus aureus subsp. aureus MW2
aauagguucauuauuuaaau

SEQ ID NO: 2099362 - RNA, 16 nt, Staphylococcus aureus subsp. aureus MW2
aauagguuaguaauau

SEQ ID NO: 2099363 - RNA, 19 nt, Staphylococcus aureus subsp. aureus MW2
aauagguuaguaauauauu

SEQ ID NO: 2099364 - RNA, 19 nt, Staphylococcus aureus subsp. aureus MW2
aauaguaccaugcucuuuu

SEQ ID NO: 2099365 - RNA, 21 nt, Staphylococcus aureus subsp. aureus MW2
aauagcuuucguuucuuuuau

SEQ ID NO: 2099366 - RNA, 20 nt, Staphylococcus aureus subsp. aureus MW2
aauagcuuucguuucuuuua

SEQ ID NO: 2099367 - RNA, 14 nt, Staphylococcus aureus subsp. aureus MW2
aauagcuuguuuau

SEQ ID NO: 2099368 - RNA, 18 nt, Staphylococcus aureus subsp. aureus MW2
aauauaacaaguauaaau

SEQ ID NO: 2099369 - RNA, 14 nt, Staphylococcus aureus subsp. aureus MW2
aauauaacaucaaa

SEQ ID NO: 2099370 - RNA, 14 nt, Staphylococcus aureus subsp. aureus MW2
aauauaaauuuuga

SEQ ID NO: 2099371 - RNA, 14 nt, Staphylococcus aureus subsp. aureus MW2
aauauaaaagcacu

SEQ ID NO: 2099372 - RNA, 15 nt, Staphylococcus aureus subsp. aureus MW2
aauauaaaagcacua

SEQ ID NO: 2099373 - RNA, 15 nt, Staphylococcus aureus subsp. aureus MW2
aauauaaaauaaagu

SEQ ID NO: 2099374 - RNA, 13 nt, Staphylococcus aureus subsp. aureus MW2
aauauaaauaaaa

SEQ ID NO: 2099375 - RNA, 14 nt, Staphylococcus aureus subsp. aureus MW2
aauaguuuuucaua

SEQ ID NO: 2099376 - RNA, 12 nt, Staphylococcus aureus subsp. aureus MW2
aauauaaaaaag

SEQ ID NO: 2099377 - RNA, 14 nt, Staphylococcus aureus subsp. aureus MW2
aauauaaaacgaua

SEQ ID NO: 2099378 - RNA, 19 nt, Staphylococcus aureus subsp. aureus MW2
aauaguuuucuucacugcu

SEQ ID NO: 2099379 - RNA, 18 nt, Staphylococcus aureus subsp. aureus MW2
aauaguucuuuaaauuau

SEQ ID NO: 2099380 - RNA, 19 nt, Staphylococcus aureus subsp. aureus MW2
aauaguuguuuauuauaga

SEQ ID NO: 2099381 - RNA, 17 nt, Staphylococcus aureus subsp. aureus MW2
aauaguuaccaaaauuu

SEQ ID NO: 2099382 - RNA, 13 nt, Staphylococcus aureus subsp. aureus MW2
aauauauuaacaa

SEQ ID NO: 2099383 - RNA, 15 nt, Staphylococcus aureus subsp. aureus MW2
aauauauuauaaaaa

SEQ ID NO: 2099384 - RNA, 17 nt, Staphylococcus aureus subsp. aureus MW2
aauauauuauaaaaaua

SEQ ID NO: 2099385 - RNA, 20 nt, Staphylococcus aureus subsp. aureus MW2
aauauaugaauaagucuaau

SEQ ID NO: 2099386 - RNA, 16 nt, Staphylococcus aureus subsp. aureus MW2
aauauauuuaaacuca

SEQ ID NO: 2099387 - RNA, 19 nt, Staphylococcus aureus subsp. aureus MW2
aauauauuuaaacucauaa

SEQ ID NO: 2099388 - RNA, 13 nt, Staphylococcus aureus subsp. aureus MW2
aauauauuuauuu

SEQ ID NO: 2099389 - RNA, 14 nt, Staphylococcus aureus subsp. aureus MW2
aauaucaaaauaua

SEQ ID NO: 2099390 - RNA, 16 nt, Staphylococcus aureus subsp. aureus MW2
aauauauuuauuuuug

SEQ ID NO: 2099391 - RNA, 19 nt, Staphylococcus aureus subsp. aureus MW2
aauaucaauaauucguuga

SEQ ID NO: 2099392 - RNA, 14 nt, Staphylococcus aureus subsp. aureus MW2
aauaucaagauguu

SEQ ID NO: 2099393 - RNA, 15 nt, Staphylococcus aureus subsp. aureus MW2
aauauaguaauaaaa

SEQ ID NO: 2099394 - RNA, 15 nt, Staphylococcus aureus subsp. aureus MW2
aauauaguuaaaguu

SEQ ID NO: 2099395 - RNA, 16 nt, Staphylococcus aureus subsp. aureus MW2
aauauaguuaaaguua

SEQ ID NO: 2099396 - RNA, 15 nt, Staphylococcus aureus subsp. aureus MW2
aauauauacaaauaa

SEQ ID NO: 2099397 - RNA, 16 nt, Staphylococcus aureus subsp. aureus MW2
aauauauacaaauaaa

SEQ ID NO: 2099398 - RNA, 16 nt, Staphylococcus aureus subsp. aureus MW2
aauauauccugccaau

SEQ ID NO: 2099399 - RNA, 18 nt, Staphylococcus aureus subsp. aureus MW2
aauauaucuaauacuuuc

SEQ ID NO: 2099400 - RNA, 14 nt, Staphylococcus aureus subsp. aureus MW2
aauauaauguauaa

SEQ ID NO: 2099401 - RNA, 13 nt, Staphylococcus aureus subsp. aureus MW2
aauauaauuauua

SEQ ID NO: 2099402 - RNA, 23 nt, Staphylococcus aureus subsp. aureus MW2
aauauaauuaaacauuuagauuu

SEQ ID NO: 2099403 - RNA, 18 nt, Staphylococcus aureus subsp. aureus MW2
aauauaauuaauuuugua

SEQ ID NO: 2099404 - RNA, 18 nt, Staphylococcus aureus subsp. aureus MW2
aauauaauagaaauaauc

SEQ ID NO: 2099405 - RNA, 15 nt, Staphylococcus aureus subsp. aureus MW2
aauauaauauauaca

SEQ ID NO: 2099406 - RNA, 17 nt, Staphylococcus aureus subsp. aureus MW2
aauauaauauauacaaa

SEQ ID NO: 2099407 - RNA, 15 nt, Staphylococcus aureus subsp. aureus MW2
aauauaauagaaaua

SEQ ID NO: 2099408 - RNA, 14 nt, Staphylococcus aureus subsp. aureus MW2
aauauaaguauaau

SEQ ID NO: 2099409 - RNA, 16 nt, Staphylococcus aureus subsp. aureus MW2
aauauaacaucaaaua

SEQ ID NO: 2099410 - RNA, 16 nt, Staphylococcus aureus subsp. aureus MW2
aauauaaguaaucaua

SEQ ID NO: 2099411 - RNA, 17 nt, Staphylococcus aureus subsp. aureus MW2
aauauagaaaaugagua

SEQ ID NO: 2099412 - RNA, 22 nt, Staphylococcus aureus subsp. aureus MW2
aauauacuuuuauagaaaauua

SEQ ID NO: 2099413 - RNA, 18 nt, Staphylococcus aureus subsp. aureus MW2
aauauacuaaauuugaaa

SEQ ID NO: 2099414 - RNA, 15 nt, Staphylococcus aureus subsp. aureus MW2
aauauacuaaaguuc

SEQ ID NO: 2099415 - RNA, 15 nt, Staphylococcus aureus subsp. aureus MW2
aauauacuucuauua

SEQ ID NO: 2099416 - RNA, 22 nt, Staphylococcus aureus subsp. aureus MW2
aauauacuucuauuaaaugaca

SEQ ID NO: 2099417 - RNA, 15 nt, Staphylococcus aureus subsp. aureus MW2
aauauaccaaccaaa

SEQ ID NO: 2099418 - RNA, 20 nt, Staphylococcus aureus subsp. aureus MW2
aauauaccaaccaaaaccaa

SEQ ID NO: 2099419 - RNA, 13 nt, Staphylococcus aureus subsp. aureus MW2
aauaucuucuuua

SEQ ID NO: 2099420 - RNA, 22 nt, Staphylococcus aureus subsp. aureus MW2
aauaucuucuucuaaccacuuc

SEQ ID NO: 2099421 - RNA, 12 nt, Staphylococcus aureus subsp. aureus MW2
aauaugaaaaga

SEQ ID NO: 2099422 - RNA, 13 nt, Staphylococcus aureus subsp. aureus MW2
aauaucuucagcu

SEQ ID NO: 2099423 - RNA, 20 nt, Staphylococcus aureus subsp. aureus MW2
aauaucuaaagauuucaguu

SEQ ID NO: 2099424 - RNA, 13 nt, Staphylococcus aureus subsp. aureus MW2
aauaucuaauucu

SEQ ID NO: 2099425 - RNA, 20 nt, Staphylococcus aureus subsp. aureus MW2
aauaucgauuuuggcacaua

SEQ ID NO: 2099426 - RNA, 17 nt, Staphylococcus aureus subsp. aureus MW2
aauaucgacuuuucuau

SEQ ID NO: 2099427 - RNA, 23 nt, Staphylococcus aureus subsp. aureus MW2
aauaucgacuuuucuaucaaaaa

SEQ ID NO: 2099428 - RNA, 15 nt, Staphylococcus aureus subsp. aureus MW2
aauaucauauuugaa

SEQ ID NO: 2099429 - RNA, 23 nt, Staphylococcus aureus subsp. aureus MW2
aauaucauauucaaaauaacuua

SEQ ID NO: 2099430 - RNA, 13 nt, Staphylococcus aureus subsp. aureus MW2
aauaucauauuug

SEQ ID NO: 2099431 - RNA, 17 nt, Staphylococcus aureus subsp. aureus MW2
aauaucauaaaugcaua

SEQ ID NO: 2099432 - RNA, 22 nt, Staphylococcus aureus subsp. aureus MW2
aauaucaucauuuaaauauuuc

SEQ ID NO: 2099433 - RNA, 17 nt, Staphylococcus aureus subsp. aureus MW2
aauaucacuaauauauu

SEQ ID NO: 2099434 - RNA, 18 nt, Staphylococcus aureus subsp. aureus MW2
aauaucacuaauauauuu

SEQ ID NO: 2099435 - RNA, 18 nt, Staphylococcus aureus subsp. aureus MW2
aauauccugcaguugauu

SEQ ID NO: 2099436 - RNA, 14 nt, Staphylococcus aureus subsp. aureus MW2
aaguacauaaaugc

SEQ ID NO: 2099437 - RNA, 24 nt, Staphylococcus aureus subsp. aureus MW2
aaguaaugcuuuacuauauucaau

SEQ ID NO: 2099438 - RNA, 15 nt, Staphylococcus aureus subsp. aureus MW2
aaguaauuaaauacu

SEQ ID NO: 2099439 - RNA, 15 nt, Staphylococcus aureus subsp. aureus MW2
aaguaaugugcauug

SEQ ID NO: 2099440 - RNA, 14 nt, Staphylococcus aureus subsp. aureus MW2
aaguacaaauaaua

SEQ ID NO: 2099441 - RNA, 13 nt, Staphylococcus aureus subsp. aureus MW2
aaguacaaauaau

SEQ ID NO: 2099442 - RNA, 13 nt, Staphylococcus aureus subsp. aureus MW2
aaguaauuucucu

SEQ ID NO: 2099443 - RNA, 16 nt, Staphylococcus aureus subsp. aureus MW2
aaguagacauugaaag

SEQ ID NO: 2099444 - RNA, 14 nt, Staphylococcus aureus subsp. aureus MW2
aaguacuuuaccac

SEQ ID NO: 2099445 - RNA, 14 nt, Staphylococcus aureus subsp. aureus MW2
aaguacuuuuacaa

SEQ ID NO: 2099446 - RNA, 17 nt, Staphylococcus aureus subsp. aureus MW2
aaguacuucggugcuug

SEQ ID NO: 2099447 - RNA, 22 nt, Staphylococcus aureus subsp. aureus MW2
aaguacuuaccuuucaaauaua

SEQ ID NO: 2099448 - RNA, 14 nt, Staphylococcus aureus subsp. aureus MW2
aaguacgcaauuua

SEQ ID NO: 2099449 - RNA, 20 nt, Staphylococcus aureus subsp. aureus MW2
aaguaaagggaggaauuaau

SEQ ID NO: 2099450 - RNA, 21 nt, Staphylococcus aureus subsp. aureus MW2
aaguaaagggaggaauuaaua

SEQ ID NO: 2099451 - RNA, 23 nt, Staphylococcus aureus subsp. aureus MW2
aaguauuaugauugcuuauuuau

SEQ ID NO: 2099452 - RNA, 16 nt, Staphylococcus aureus subsp. aureus MW2
aaguauuaugauugcu

SEQ ID NO: 2099453 - RNA, 14 nt, Staphylococcus aureus subsp. aureus MW2
aaguauuaugauug

SEQ ID NO: 2099454 - RNA, 18 nt, Staphylococcus aureus subsp. aureus MW2
aaguauuaucuaauucuu

SEQ ID NO: 2099455 - RNA, 17 nt, Staphylococcus aureus subsp. aureus MW2
aaguauuagauauauuu

SEQ ID NO: 2099456 - RNA, 15 nt, Staphylococcus aureus subsp. aureus MW2
aaguauguugucaua

SEQ ID NO: 2099457 - RNA, 21 nt, Staphylococcus aureus subsp. aureus MW2
aaguaucuuuugcaccuucaa

SEQ ID NO: 2099458 - RNA, 11 nt, Staphylococcus aureus subsp. aureus MW2
aaguauuuaaa

SEQ ID NO: 2099459 - RNA, 21 nt, Staphylococcus aureus subsp. aureus MW2
aaguauuuaaaccuaaugaua

SEQ ID NO: 2099460 - RNA, 16 nt, Staphylococcus aureus subsp. aureus MW2
aagucagcuuacaaua

SEQ ID NO: 2099461 - RNA, 16 nt, Staphylococcus aureus subsp. aureus MW2
aagucagcauacaaua

SEQ ID NO: 2099462 - RNA, 17 nt, Staphylococcus aureus subsp. aureus MW2
aagucagcauacaauaa

SEQ ID NO: 2099463 - RNA, 18 nt, Staphylococcus aureus subsp. aureus MW2
aagucagcgauaauuguu

SEQ ID NO: 2099464 - RNA, 13 nt, Staphylococcus aureus subsp. aureus MW2
aagucaauuuaaa

SEQ ID NO: 2099465 - RNA, 15 nt, Staphylococcus aureus subsp. aureus MW2
aagucacaguguaau

SEQ ID NO: 2099466 - RNA, 23 nt, Staphylococcus aureus subsp. aureus MW2
aaguagcucaaaacaauuuaaaa

SEQ ID NO: 2099467 - RNA, 17 nt, Staphylococcus aureus subsp. aureus MW2
aaguagcucaaaacaau

SEQ ID NO: 2099468 - RNA, 20 nt, Staphylococcus aureus subsp. aureus MW2
aaguaggcugaaguugaagc

SEQ ID NO: 2099469 - RNA, 21 nt, Staphylococcus aureus subsp. aureus MW2
aaguagucgaagaagauuaug

SEQ ID NO: 2099470 - RNA, 20 nt, Staphylococcus aureus subsp. aureus MW2
aaguaucugugaauaugcuu

SEQ ID NO: 2099471 - RNA, 19 nt, Staphylococcus aureus subsp. aureus MW2
aaguaucugugaauaugcu

SEQ ID NO: 2099472 - RNA, 12 nt, Staphylococcus aureus subsp. aureus MW2
aaguaucuguga

SEQ ID NO: 2099473 - RNA, 18 nt, Staphylococcus aureus subsp. aureus MW2
aaguaucuaugaaauuuu

SEQ ID NO: 2099474 - RNA, 23 nt, Staphylococcus aureus subsp. aureus MW2
aaguaucgccaaucuauugcaau

SEQ ID NO: 2099475 - RNA, 19 nt, Staphylococcus aureus subsp. aureus MW2
aaguauggcgaaauguuuu

SEQ ID NO: 2099476 - RNA, 22 nt, Staphylococcus aureus subsp. aureus MW2
aaguauggcgaaauguuuugga

SEQ ID NO: 2099477 - RNA, 13 nt, Staphylococcus aureus subsp. aureus MW2
aaguaguuucauu

SEQ ID NO: 2099478 - RNA, 19 nt, Staphylococcus aureus subsp. aureus MW2
aaguauaaguagcucaaaa

SEQ ID NO: 2099479 - RNA, 15 nt, Staphylococcus aureus subsp. aureus MW2
aaguauaauuaaacu

SEQ ID NO: 2099480 - RNA, 18 nt, Staphylococcus aureus subsp. aureus MW2
aaguauaagguugaagaa

SEQ ID NO: 2099481 - RNA, 14 nt, Staphylococcus aureus subsp. aureus MW2
aaguauagaccauc

SEQ ID NO: 2099482 - RNA, 18 nt, Staphylococcus aureus subsp. aureus MW2
aaguauauaagcaaagac

SEQ ID NO: 2099483 - RNA, 13 nt, Staphylococcus aureus subsp. aureus MW2
aaguauaugaauc

SEQ ID NO: 2099484 - RNA, 17 nt, Staphylococcus aureus subsp. aureus MW2
aaguccggcugaaggga

SEQ ID NO: 2099485 - RNA, 12 nt, Staphylococcus aureus subsp. aureus MW2
aagucgaaagua

SEQ ID NO: 2099486 - RNA, 22 nt, Staphylococcus aureus subsp. aureus MW2
aagucauuaaauguacauugua

SEQ ID NO: 2099487 - RNA, 15 nt, Staphylococcus aureus subsp. aureus MW2
aagucauuaaaugua

SEQ ID NO: 2099488 - RNA, 13 nt, Staphylococcus aureus subsp. aureus MW2
aagucauuaaaug

SEQ ID NO: 2099489 - RNA, 16 nt, Staphylococcus aureus subsp. aureus MW2
aagucauuuucauuca

SEQ ID NO: 2099490 - RNA, 19 nt, Staphylococcus aureus subsp. aureus MW2
aagucuaguucgaacacac

SEQ ID NO: 2099491 - RNA, 15 nt, Staphylococcus aureus subsp. aureus MW2
aagucgcucuagaca

SEQ ID NO: 2099492 - RNA, 20 nt, Staphylococcus aureus subsp. aureus MW2
aagucgcucuagacauuaca

SEQ ID NO: 2099493 - RNA, 17 nt, Staphylococcus aureus subsp. aureus MW2
aagugaaaucauuuaaa

SEQ ID NO: 2099494 - RNA, 20 nt, Staphylococcus aureus subsp. aureus MW2
aagugaaaguauuagauaua

SEQ ID NO: 2099495 - RNA, 12 nt, Staphylococcus aureus subsp. aureus MW2
aagugaaaaauu

SEQ ID NO: 2099496 - RNA, 18 nt, Staphylococcus aureus subsp. aureus MW2
aagugacaucguugcuuu

SEQ ID NO: 2099497 - RNA, 15 nt, Staphylococcus aureus subsp. aureus MW2
aagucucuuuccuca

SEQ ID NO: 2099498 - RNA, 16 nt, Staphylococcus aureus subsp. aureus MW2
aagucucuugucauuu

SEQ ID NO: 2099499 - RNA, 15 nt, Staphylococcus aureus subsp. aureus MW2
aagucucuugucauu

SEQ ID NO: 2099500 - RNA, 16 nt, Staphylococcus aureus subsp. aureus MW2
aagugcgguuuaaucu

SEQ ID NO: 2099501 - RNA, 14 nt, Staphylococcus aureus subsp. aureus MW2
aagugacuuaauau

SEQ ID NO: 2099502 - RNA, 18 nt, Staphylococcus aureus subsp. aureus MW2
aaguuaaacgacaugaaa

SEQ ID NO: 2099503 - RNA, 19 nt, Staphylococcus aureus subsp. aureus MW2
aaguuaaaauugguuugga

SEQ ID NO: 2099504 - RNA, 20 nt, Staphylococcus aureus subsp. aureus MW2
aaguguuauaaauagagaac

SEQ ID NO: 2099505 - RNA, 15 nt, Staphylococcus aureus subsp. aureus MW2
aaguguuaaugucuu

SEQ ID NO: 2099506 - RNA, 14 nt, Staphylococcus aureus subsp. aureus MW2
aaguguuauaaaua

SEQ ID NO: 2099507 - RNA, 14 nt, Staphylococcus aureus subsp. aureus MW2
aaguuauuuaaguu

SEQ ID NO: 2099508 - RNA, 17 nt, Staphylococcus aureus subsp. aureus MW2
aaguuaauuauguauuu

SEQ ID NO: 2099509 - RNA, 20 nt, Staphylococcus aureus subsp. aureus MW2
aaguuaugaagggaaaaaau

SEQ ID NO: 2099510 - RNA, 23 nt, Staphylococcus aureus subsp. aureus MW2
aaguucaaccauaugacuuuuua

SEQ ID NO: 2099511 - RNA, 18 nt, Staphylococcus aureus subsp. aureus MW2
aaguuaagucgccuaacu

SEQ ID NO: 2099512 - RNA, 15 nt, Staphylococcus aureus subsp. aureus MW2
aaguuaaucagaaaa

SEQ ID NO: 2099513 - RNA, 20 nt, Staphylococcus aureus subsp. aureus MW2
aaguuaaucagaaaagcagu

SEQ ID NO: 2099514 - RNA, 15 nt, Staphylococcus aureus subsp. aureus MW2
aaguuacgauaucau

SEQ ID NO: 2099515 - RNA, 22 nt, Staphylococcus aureus subsp. aureus MW2
aaguuacgauaucauacgcaac

SEQ ID NO: 2099516 - RNA, 22 nt, Staphylococcus aureus subsp. aureus MW2
aaguugaagccaguugaaguug

SEQ ID NO: 2099517 - RNA, 20 nt, Staphylococcus aureus subsp. aureus MW2
aaguugaagcggguugaagc

SEQ ID NO: 2099518 - RNA, 15 nt, Staphylococcus aureus subsp. aureus MW2
aaguugacaauacaa

SEQ ID NO: 2099519 - RNA, 18 nt, Staphylococcus aureus subsp. aureus MW2
aaguucaucaugcacugu

SEQ ID NO: 2099520 - RNA, 14 nt, Staphylococcus aureus subsp. aureus MW2
aaguugaaaaccuc

SEQ ID NO: 2099521 - RNA, 14 nt, Staphylococcus aureus subsp. aureus MW2
aaggccauuuuuau

SEQ ID NO: 2099522 - RNA, 22 nt, Staphylococcus aureus subsp. aureus MW2
aaggaaucguaacgcuguuggu

SEQ ID NO: 2099523 - RNA, 23 nt, Staphylococcus aureus subsp. aureus MW2
aaggaauauacaauaguauaaau

SEQ ID NO: 2099524 - RNA, 22 nt, Staphylococcus aureus subsp. aureus MW2
aaggaauuacacuuuaaauaca

SEQ ID NO: 2099525 - RNA, 13 nt, Staphylococcus aureus subsp. aureus MW2
aaggaauuucaaa

SEQ ID NO: 2099526 - RNA, 23 nt, Staphylococcus aureus subsp. aureus MW2
aaggaauaauuuuaaaaauaaaa

SEQ ID NO: 2099527 - RNA, 16 nt, Staphylococcus aureus subsp. aureus MW2
aaggaugaguuuaaaa

SEQ ID NO: 2099528 - RNA, 12 nt, Staphylococcus aureus subsp. aureus MW2
aaggaucauguu

SEQ ID NO: 2099529 - RNA, 22 nt, Staphylococcus aureus subsp. aureus MW2
aaggauccaggcauuaggaaaa

SEQ ID NO: 2099530 - RNA, 17 nt, Staphylococcus aureus subsp. aureus MW2
aaggacgucuuuuuaga

SEQ ID NO: 2099531 - RNA, 14 nt, Staphylococcus aureus subsp. aureus MW2
aagcucaugaauca

SEQ ID NO: 2099532 - RNA, 23 nt, Staphylococcus aureus subsp. aureus MW2
aaggaacauuucaauccuuuguu

SEQ ID NO: 2099533 - RNA, 16 nt, Staphylococcus aureus subsp. aureus MW2
aagcuugcgauaaguu

SEQ ID NO: 2099534 - RNA, 14 nt, Staphylococcus aureus subsp. aureus MW2
aagcuugaucaaau

SEQ ID NO: 2099535 - RNA, 14 nt, Staphylococcus aureus subsp. aureus MW2
aagcuauaaaaaau

SEQ ID NO: 2099536 - RNA, 17 nt, Staphylococcus aureus subsp. aureus MW2
aagcuaucguaaacaac

SEQ ID NO: 2099537 - RNA, 21 nt, Staphylococcus aureus subsp. aureus MW2
aagcuauaaaaaaucuuuuga

SEQ ID NO: 2099538 - RNA, 12 nt, Staphylococcus aureus subsp. aureus MW2
aagcuaugcuuu

SEQ ID NO: 2099539 - RNA, 18 nt, Staphylococcus aureus subsp. aureus MW2
aagcucaauaaauuauga

SEQ ID NO: 2099540 - RNA, 13 nt, Staphylococcus aureus subsp. aureus MW2
aagcuacccguuu

SEQ ID NO: 2099541 - RNA, 23 nt, Staphylococcus aureus subsp. aureus MW2
aagcuaauucauauucaaauuua

SEQ ID NO: 2099542 - RNA, 19 nt, Staphylococcus aureus subsp. aureus MW2
aagcgccugucucauuagc

SEQ ID NO: 2099543 - RNA, 23 nt, Staphylococcus aureus subsp. aureus MW2
aagcgcaugcuugaacuuuuauu

SEQ ID NO: 2099544 - RNA, 13 nt, Staphylococcus aureus subsp. aureus MW2
aagcgauuuccau

SEQ ID NO: 2099545 - RNA, 14 nt, Staphylococcus aureus subsp. aureus MW2
aagccuucuauaua

SEQ ID NO: 2099546 - RNA, 21 nt, Staphylococcus aureus subsp. aureus MW2
aagccuucuauauaguaaaau

SEQ ID NO: 2099547 - RNA, 16 nt, Staphylococcus aureus subsp. aureus MW2
aagccuucaauaguuu

SEQ ID NO: 2099548 - RNA, 17 nt, Staphylococcus aureus subsp. aureus MW2
aagccuucaauaguuuc

SEQ ID NO: 2099549 - RNA, 21 nt, Staphylococcus aureus subsp. aureus MW2
aagccuuaaaauauuuaacuu

SEQ ID NO: 2099550 - RNA, 14 nt, Staphylococcus aureus subsp. aureus MW2
aagccuacuuuguc

SEQ ID NO: 2099551 - RNA, 13 nt, Staphylococcus aureus subsp. aureus MW2
aauuuuuucguua

SEQ ID NO: 2099552 - RNA, 15 nt, Staphylococcus aureus subsp. aureus MW2
aauuuuuuauuaaga

SEQ ID NO: 2099553 - RNA, 12 nt, Staphylococcus aureus subsp. aureus MW2
aauuuuuuaugu

SEQ ID NO: 2099554 - RNA, 16 nt, Staphylococcus aureus subsp. aureus MW2
aauuuuuuauuaagac

SEQ ID NO: 2099555 - RNA, 21 nt, Staphylococcus aureus subsp. aureus MW2
aauuuuucuucuuuuuuaucu

SEQ ID NO: 2099556 - RNA, 12 nt, Staphylococcus aureus subsp. aureus MW2
aauuuuucuuua

SEQ ID NO: 2099557 - RNA, 15 nt, Staphylococcus aureus subsp. aureus MW2
aauuuuucuucuuuu

SEQ ID NO: 2099558 - RNA, 23 nt, Staphylococcus aureus subsp. aureus MW2
aauuuuuggaaugguauagauuu

SEQ ID NO: 2099559 - RNA, 19 nt, Staphylococcus aureus subsp. aureus MW2
aauuuuuguaauacaucua

SEQ ID NO: 2099560 - RNA, 15 nt, Staphylococcus aureus subsp. aureus MW2
aauuuuuuucauaau

SEQ ID NO: 2099561 - RNA, 12 nt, Staphylococcus aureus subsp. aureus MW2
aauuuuuuuaau

SEQ ID NO: 2099562 - RNA, 18 nt, Staphylococcus aureus subsp. aureus MW2
acaacggcauaauacaca

SEQ ID NO: 2099563 - RNA, 19 nt, Staphylococcus aureus subsp. aureus MW2
acaacggcauaauacacau

SEQ ID NO: 2099564 - RNA, 20 nt, Staphylococcus aureus subsp. aureus MW2
acaacggcauaauacacauu

SEQ ID NO: 2099565 - RNA, 19 nt, Staphylococcus aureus subsp. aureus MW2
acaacguccacagaugcau

SEQ ID NO: 2099566 - RNA, 13 nt, Staphylococcus aureus subsp. aureus MW2
acaacuucuucuc

SEQ ID NO: 2099567 - RNA, 19 nt, Staphylococcus aureus subsp. aureus MW2
acaacuugaacuaaaacaa

SEQ ID NO: 2099568 - RNA, 22 nt, Staphylococcus aureus subsp. aureus MW2
acaacuugaacuaaaacaauaa

SEQ ID NO: 2099569 - RNA, 22 nt, Staphylococcus aureus subsp. aureus MW2
acaacuuuaguuguuaggggcu

SEQ ID NO: 2099570 - RNA, 22 nt, Staphylococcus aureus subsp. aureus MW2
acaauaagaacuugcuuuucau

SEQ ID NO: 2099571 - RNA, 16 nt, Staphylococcus aureus subsp. aureus MW2
acaauaauaugccaaa

SEQ ID NO: 2099572 - RNA, 22 nt, Staphylococcus aureus subsp. aureus MW2
acaauaauaugccaaaguaaua

SEQ ID NO: 2099573 - RNA, 14 nt, Staphylococcus aureus subsp. aureus MW2
acaauauaauauau

SEQ ID NO: 2099574 - RNA, 23 nt, Staphylococcus aureus subsp. aureus MW2
acaauauaauauauacaaauaaa

SEQ ID NO: 2099575 - RNA, 16 nt, Staphylococcus aureus subsp. aureus MW2
acaauagguacaacua

SEQ ID NO: 2099576 - RNA, 13 nt, Staphylococcus aureus subsp. aureus MW2
acaauauaaaagc

SEQ ID NO: 2099577 - RNA, 14 nt, Staphylococcus aureus subsp. aureus MW2
acaauauaaaagca

SEQ ID NO: 2099578 - RNA, 16 nt, Staphylococcus aureus subsp. aureus MW2
acaagugaugaaaaag

SEQ ID NO: 2099579 - RNA, 17 nt, Staphylococcus aureus subsp. aureus MW2
acaagugaugaaaaaga

SEQ ID NO: 2099580 - RNA, 13 nt, Staphylococcus aureus subsp. aureus MW2
acaagagacugaa

SEQ ID NO: 2099581 - RNA, 16 nt, Staphylococcus aureus subsp. aureus MW2
acaagagacugaagag

SEQ ID NO: 2099582 - RNA, 18 nt, Staphylococcus aureus subsp. aureus MW2
acaagaacaugauacuga

SEQ ID NO: 2099583 - RNA, 21 nt, Staphylococcus aureus subsp. aureus MW2
acaagccaagauaaaucauca

SEQ ID NO: 2099584 - RNA, 19 nt, Staphylococcus aureus subsp. aureus MW2
acaagauucauacacugca

SEQ ID NO: 2099585 - RNA, 16 nt, Staphylococcus aureus subsp. aureus MW2
acaagauuccuaaaga

SEQ ID NO: 2099586 - RNA, 20 nt, Staphylococcus aureus subsp. aureus MW2
acaagcaucaugaaauuaga

SEQ ID NO: 2099587 - RNA, 20 nt, Staphylococcus aureus subsp. aureus MW2
acaaugaauccaaauauuaa

SEQ ID NO: 2099588 - RNA, 15 nt, Staphylococcus aureus subsp. aureus MW2
acaauauuaaaauua

SEQ ID NO: 2099589 - RNA, 18 nt, Staphylococcus aureus subsp. aureus MW2
acaauauuaaaauuaaaa

SEQ ID NO: 2099590 - RNA, 19 nt, Staphylococcus aureus subsp. aureus MW2
acaauauuaaaauuaaaac

SEQ ID NO: 2099591 - RNA, 14 nt, Staphylococcus aureus subsp. aureus MW2
acaauaucaucuaa

SEQ ID NO: 2099592 - RNA, 19 nt, Staphylococcus aureus subsp. aureus MW2
acaaucuccauuagaacua

SEQ ID NO: 2099593 - RNA, 20 nt, Staphylococcus aureus subsp. aureus MW2
acaaucuuaucguaaucuuc

SEQ ID NO: 2099594 - RNA, 16 nt, Staphylococcus aureus subsp. aureus MW2
acaauuaaagugaaua

SEQ ID NO: 2099595 - RNA, 13 nt, Staphylococcus aureus subsp. aureus MW2
acaauuaauuacu

SEQ ID NO: 2099596 - RNA, 14 nt, Staphylococcus aureus subsp. aureus MW2
acaauuguaguaau

SEQ ID NO: 2099597 - RNA, 22 nt, Staphylococcus aureus subsp. aureus MW2
acaauuguauaaugugcgucac

SEQ ID NO: 2099598 - RNA, 21 nt, Staphylococcus aureus subsp. aureus MW2
acaauugguuguuucaauuca

SEQ ID NO: 2099599 - RNA, 14 nt, Staphylococcus aureus subsp. aureus MW2
acaauuuaaaaagc

SEQ ID NO: 2099600 - RNA, 16 nt, Staphylococcus aureus subsp. aureus MW2
acaauuuaaaaagcag

SEQ ID NO: 2099601 - RNA, 23 nt, Staphylococcus aureus subsp. aureus MW2
acaauuguggguguuuuuuuuau

SEQ ID NO: 2099602 - RNA, 22 nt, Staphylococcus aureus subsp. aureus MW2
acacaaugauucaucaguguag

SEQ ID NO: 2099603 - RNA, 23 nt, Staphylococcus aureus subsp. aureus MW2
acacaauaccuguccaaauaaau

SEQ ID NO: 2099604 - RNA, 17 nt, Staphylococcus aureus subsp. aureus MW2
acaauuuaaauuaagua

SEQ ID NO: 2099605 - RNA, 21 nt, Staphylococcus aureus subsp. aureus MW2
acacagaagcuggcggaaagu

SEQ ID NO: 2099606 - RNA, 23 nt, Staphylococcus aureus subsp. aureus MW2
acacagaagcuggcggaaaguca

SEQ ID NO: 2099607 - RNA, 13 nt, Staphylococcus aureus subsp. aureus MW2
acacagagaaauu

SEQ ID NO: 2099608 - RNA, 22 nt, Staphylococcus aureus subsp. aureus MW2
acacagagaauuucgaaaagaa

SEQ ID NO: 2099609 - RNA, 22 nt, Staphylococcus aureus subsp. aureus MW2
acacaguaauucuuaaaaagca

SEQ ID NO: 2099610 - RNA, 14 nt, Staphylococcus aureus subsp. aureus MW2
acacaguacaaaua

SEQ ID NO: 2099611 - RNA, 14 nt, Staphylococcus aureus subsp. aureus MW2
acacagguaaauuu

SEQ ID NO: 2099612 - RNA, 16 nt, Staphylococcus aureus subsp. aureus MW2
acacagguaaauuuaa

SEQ ID NO: 2099613 - RNA, 21 nt, Staphylococcus aureus subsp. aureus MW2
acacagcuaaacgcaauacga

SEQ ID NO: 2099614 - RNA, 13 nt, Staphylococcus aureus subsp. aureus MW2
acacaucacuaua

SEQ ID NO: 2099615 - RNA, 20 nt, Staphylococcus aureus subsp. aureus MW2
acagcauuuccuauaugcug

SEQ ID NO: 2099616 - RNA, 13 nt, Staphylococcus aureus subsp. aureus MW2
acagcuucauuaa

SEQ ID NO: 2099617 - RNA, 17 nt, Staphylococcus aureus subsp. aureus MW2
acagcugcuucucuuug

SEQ ID NO: 2099618 - RNA, 20 nt, Staphylococcus aureus subsp. aureus MW2
acagcugcuucucuuugaac

SEQ ID NO: 2099619 - RNA, 22 nt, Staphylococcus aureus subsp. aureus MW2
acagcguauuuuaaugauuuuu

SEQ ID NO: 2099620 - RNA, 17 nt, Staphylococcus aureus subsp. aureus MW2
acagauaaguaauaaua

SEQ ID NO: 2099621 - RNA, 22 nt, Staphylococcus aureus subsp. aureus MW2
acagauaagaauauuuaaguuu

SEQ ID NO: 2099622 - RNA, 15 nt, Staphylococcus aureus subsp. aureus MW2
acagauaaagcuucg

SEQ ID NO: 2099623 - RNA, 22 nt, Staphylococcus aureus subsp. aureus MW2
acagagaaucaauuauugaaaa

SEQ ID NO: 2099624 - RNA, 23 nt, Staphylococcus aureus subsp. aureus MW2
acagaucucaauccaauuaaaua

SEQ ID NO: 2099625 - RNA, 23 nt, Staphylococcus aureus subsp. aureus MW2
acagauuuaccucuugauaaaau

SEQ ID NO: 2099626 - RNA, 16 nt, Staphylococcus aureus subsp. aureus MW2
acagauuuuaaaaauu

SEQ ID NO: 2099627 - RNA, 17 nt, Staphylococcus aureus subsp. aureus MW2
acacugcacaucauaau

SEQ ID NO: 2099628 - RNA, 17 nt, Staphylococcus aureus subsp. aureus MW2
acacugccaauauaaca

SEQ ID NO: 2099629 - RNA, 16 nt, Staphylococcus aureus subsp. aureus MW2
acacugcuuuuaaauc

SEQ ID NO: 2099630 - RNA, 15 nt, Staphylococcus aureus subsp. aureus MW2
acacuuaauauauuc

SEQ ID NO: 2099631 - RNA, 22 nt, Staphylococcus aureus subsp. aureus MW2
acacuucaacauauaaaucauu

SEQ ID NO: 2099632 - RNA, 23 nt, Staphylococcus aureus subsp. aureus MW2
acaccauuauagacauaagcaaa

SEQ ID NO: 2099633 - RNA, 16 nt, Staphylococcus aureus subsp. aureus MW2
acacuaucguuuuuau

SEQ ID NO: 2099634 - RNA, 21 nt, Staphylococcus aureus subsp. aureus MW2
acacuagucuuuuuauuuuaa

SEQ ID NO: 2099635 - RNA, 21 nt, Staphylococcus aureus subsp. aureus MW2
acacuacgcugaugaaugauu

SEQ ID NO: 2099636 - RNA, 20 nt, Staphylococcus aureus subsp. aureus MW2
acacguucuugguauuuuuu

SEQ ID NO: 2099637 - RNA, 23 nt, Staphylococcus aureus subsp. aureus MW2
acacguucuugguauuuuuuaaa

SEQ ID NO: 2099638 - RNA, 19 nt, Staphylococcus aureus subsp. aureus MW2
acacuaaaaccuauuccua

SEQ ID NO: 2099639 - RNA, 15 nt, Staphylococcus aureus subsp. aureus MW2
acagacaaugcaagu

SEQ ID NO: 2099640 - RNA, 14 nt, Staphylococcus aureus subsp. aureus MW2
acagaauuucauca

SEQ ID NO: 2099641 - RNA, 18 nt, Staphylococcus aureus subsp. aureus MW2
acagaauuucaucaaauc

SEQ ID NO: 2099642 - RNA, 13 nt, Staphylococcus aureus subsp. aureus MW2
acagacaaacauu

SEQ ID NO: 2099643 - RNA, 19 nt, Staphylococcus aureus subsp. aureus MW2
acagaauuauuugauuaug

SEQ ID NO: 2099644 - RNA, 20 nt, Staphylococcus aureus subsp. aureus MW2
acacuucguauugaaugaau

SEQ ID NO: 2099645 - RNA, 16 nt, Staphylococcus aureus subsp. aureus MW2
acacuugcuaaaacua

SEQ ID NO: 2099646 - RNA, 21 nt, Staphylococcus aureus subsp. aureus MW2
acacuucguauugaaugaauu

SEQ ID NO: 2099647 - RNA, 22 nt, Staphylococcus aureus subsp. aureus MW2
acagaaaaucguuauaaguaca

SEQ ID NO: 2099648 - RNA, 12 nt, Staphylococcus aureus subsp. aureus MW2
acagaaaacaaa

SEQ ID NO: 2099649 - RNA, 17 nt, Staphylococcus aureus subsp. aureus MW2
acagaaccgaaaauaau

SEQ ID NO: 2099650 - RNA, 12 nt, Staphylococcus aureus subsp. aureus MW2
acagaaaugaua

SEQ ID NO: 2099651 - RNA, 13 nt, Staphylococcus aureus subsp. aureus MW2
acaucaucaaguu

SEQ ID NO: 2099652 - RNA, 22 nt, Staphylococcus aureus subsp. aureus MW2
acaucauagcacuacaucaagu

SEQ ID NO: 2099653 - RNA, 15 nt, Staphylococcus aureus subsp. aureus MW2
acauauuuuuuaaau

SEQ ID NO: 2099654 - RNA, 14 nt, Staphylococcus aureus subsp. aureus MW2
acauauuuuuugau

SEQ ID NO: 2099655 - RNA, 22 nt, Staphylococcus aureus subsp. aureus MW2
acaucaaauagacaccaaaaac

SEQ ID NO: 2099656 - RNA, 14 nt, Staphylococcus aureus subsp. aureus MW2
acaucaaauuuuuc

SEQ ID NO: 2099657 - RNA, 23 nt, Staphylococcus aureus subsp. aureus MW2
acauaugucuuucuaaguuugaa

SEQ ID NO: 2099658 - RNA, 19 nt, Staphylococcus aureus subsp. aureus MW2
acauauguacuauuaucua

SEQ ID NO: 2099659 - RNA, 20 nt, Staphylococcus aureus subsp. aureus MW2
acauaugcaaguauagacca

SEQ ID NO: 2099660 - RNA, 18 nt, Staphylococcus aureus subsp. aureus MW2
acauauuaugauacgcuu

SEQ ID NO: 2099661 - RNA, 14 nt, Staphylococcus aureus subsp. aureus MW2
acauauuauauaua

SEQ ID NO: 2099662 - RNA, 18 nt, Staphylococcus aureus subsp. aureus MW2
acauauuuauauuuugua

SEQ ID NO: 2099663 - RNA, 13 nt, Staphylococcus aureus subsp. aureus MW2
acauauuggcuug

SEQ ID NO: 2099664 - RNA, 16 nt, Staphylococcus aureus subsp. aureus MW2
acauauaaaucauuuc

SEQ ID NO: 2099665 - RNA, 16 nt, Staphylococcus aureus subsp. aureus MW2
acauauacaaauuuau

SEQ ID NO: 2099666 - RNA, 18 nt, Staphylococcus aureus subsp. aureus MW2
acauauacaaauuuauau

SEQ ID NO: 2099667 - RNA, 22 nt, Staphylococcus aureus subsp. aureus MW2
acauagguauaaucauuuaaac

SEQ ID NO: 2099668 - RNA, 19 nt, Staphylococcus aureus subsp. aureus MW2
acauagguauaaucauuua

SEQ ID NO: 2099669 - RNA, 16 nt, Staphylococcus aureus subsp. aureus MW2
acauaggauaucuacg

SEQ ID NO: 2099670 - RNA, 20 nt, Staphylococcus aureus subsp. aureus MW2
acauagcuuaauaauuaaua

SEQ ID NO: 2099671 - RNA, 20 nt, Staphylococcus aureus subsp. aureus MW2
acauagcguaauuuuaccug

SEQ ID NO: 2099672 - RNA, 18 nt, Staphylococcus aureus subsp. aureus MW2
acauagccucuuaaaaua

SEQ ID NO: 2099673 - RNA, 21 nt, Staphylococcus aureus subsp. aureus MW2
acauagaagcuggcggaaagu

SEQ ID NO: 2099674 - RNA, 14 nt, Staphylococcus aureus subsp. aureus MW2
acauacugauuaaa

SEQ ID NO: 2099675 - RNA, 13 nt, Staphylococcus aureus subsp. aureus MW2
acauaccuaauaa

SEQ ID NO: 2099676 - RNA, 16 nt, Staphylococcus aureus subsp. aureus MW2
acauagagaauuucaa

SEQ ID NO: 2099677 - RNA, 22 nt, Staphylococcus aureus subsp. aureus MW2
acauagaauaacgucauauguu

SEQ ID NO: 2099678 - RNA, 14 nt, Staphylococcus aureus subsp. aureus MW2
acauagaaagguga

SEQ ID NO: 2099679 - RNA, 15 nt, Staphylococcus aureus subsp. aureus MW2
acauacugauuaaac

SEQ ID NO: 2099680 - RNA, 20 nt, Staphylococcus aureus subsp. aureus MW2
acauaauuuaucaauuucua

SEQ ID NO: 2099681 - RNA, 22 nt, Staphylococcus aureus subsp. aureus MW2
acauaauuaacuuucuuuuguu

SEQ ID NO: 2099682 - RNA, 16 nt, Staphylococcus aureus subsp. aureus MW2
acauaauuuaucaauu

SEQ ID NO: 2099683 - RNA, 18 nt, Staphylococcus aureus subsp. aureus MW2
acauaauuuaucaauuuc

SEQ ID NO: 2099684 - RNA, 15 nt, Staphylococcus aureus subsp. aureus MW2
acauacauuuugaaa

SEQ ID NO: 2099685 - RNA, 21 nt, Staphylococcus aureus subsp. aureus MW2
acauuguaaauauaguaauaa

SEQ ID NO: 2099686 - RNA, 17 nt, Staphylococcus aureus subsp. aureus MW2
acauuucagcauuugcu

SEQ ID NO: 2099687 - RNA, 18 nt, Staphylococcus aureus subsp. aureus MW2
acauucuauacuuuuaau

SEQ ID NO: 2099688 - RNA, 19 nt, Staphylococcus aureus subsp. aureus MW2
acauucccuuaauaauaag

SEQ ID NO: 2099689 - RNA, 13 nt, Staphylococcus aureus subsp. aureus MW2
acauuccucuauu

SEQ ID NO: 2099690 - RNA, 16 nt, Staphylococcus aureus subsp. aureus MW2
acauuccucuauugua

SEQ ID NO: 2099691 - RNA, 22 nt, Staphylococcus aureus subsp. aureus MW2
acauucauaccgaagaaacuaa

SEQ ID NO: 2099692 - RNA, 17 nt, Staphylococcus aureus subsp. aureus MW2
acauucauuuaguuaaa

SEQ ID NO: 2099693 - RNA, 22 nt, Staphylococcus aureus subsp. aureus MW2
acauuccaaaaccgaaaauacc

SEQ ID NO: 2099694 - RNA, 22 nt, Staphylococcus aureus subsp. aureus MW2
acauuccaaaguaccaucucua

SEQ ID NO: 2099695 - RNA, 19 nt, Staphylococcus aureus subsp. aureus MW2
acauuauuuauauuuagaa

SEQ ID NO: 2099696 - RNA, 20 nt, Staphylococcus aureus subsp. aureus MW2
acauucauaccgaagaaacu

SEQ ID NO: 2099697 - RNA, 20 nt, Staphylococcus aureus subsp. aureus MW2
acauucagugcaaugauagc

SEQ ID NO: 2099698 - RNA, 16 nt, Staphylococcus aureus subsp. aureus MW2
acauucacauuauuua

SEQ ID NO: 2099699 - RNA, 21 nt, Staphylococcus aureus subsp. aureus MW2
acauuaaaauguguuuucaac

SEQ ID NO: 2099700 - RNA, 19 nt, Staphylococcus aureus subsp. aureus MW2
acauuaaaauaauuaaaua

SEQ ID NO: 2099701 - RNA, 16 nt, Staphylococcus aureus subsp. aureus MW2
acauuaagcuaugcuu

SEQ ID NO: 2099702 - RNA, 14 nt, Staphylococcus aureus subsp. aureus MW2
acauuaaguuaaac

SEQ ID NO: 2099703 - RNA, 16 nt, Staphylococcus aureus subsp. aureus MW2
acauuauuuauauuua

SEQ ID NO: 2099704 - RNA, 12 nt, Staphylococcus aureus subsp. aureus MW2
acauuauuuaua

SEQ ID NO: 2099705 - RNA, 13 nt, Staphylococcus aureus subsp. aureus MW2
acauuauuaaaua

SEQ ID NO: 2099706 - RNA, 19 nt, Staphylococcus aureus subsp. aureus MW2
acaugcaccuuuacaacau

SEQ ID NO: 2099707 - RNA, 17 nt, Staphylococcus aureus subsp. aureus MW2
acauguuuggaugaaca

SEQ ID NO: 2099708 - RNA, 23 nt, Staphylococcus aureus subsp. aureus MW2
acauggcuuagguuuaauuuuaa

SEQ ID NO: 2099709 - RNA, 18 nt, Staphylococcus aureus subsp. aureus MW2
acaugggcaaucacuccu

SEQ ID NO: 2099710 - RNA, 10 nt, Staphylococcus aureus subsp. aureus MW2
acauguucac

SEQ ID NO: 2099711 - RNA, 20 nt, Staphylococcus aureus subsp. aureus MW2
acaugaacaaucagauaagu

SEQ ID NO: 2099712 - RNA, 21 nt, Staphylococcus aureus subsp. aureus MW2
acaugaacaaucagauaaguu

SEQ ID NO: 2099713 - RNA, 15 nt, Staphylococcus aureus subsp. aureus MW2
acaucuuuuucaccu

SEQ ID NO: 2099714 - RNA, 14 nt, Staphylococcus aureus subsp. aureus MW2
acaugaaaguuguu

SEQ ID NO: 2099715 - RNA, 14 nt, Staphylococcus aureus subsp. aureus MW2
acaugaaauuaauc

SEQ ID NO: 2099716 - RNA, 13 nt, Staphylococcus aureus subsp. aureus MW2
acaucuuuuuaaa

SEQ ID NO: 2099717 - RNA, 20 nt, Staphylococcus aureus subsp. aureus MW2
acaucuuuaagcucuuaauc

SEQ ID NO: 2099718 - RNA, 14 nt, Staphylococcus aureus subsp. aureus MW2
acaucuucuucauc

SEQ ID NO: 2099719 - RNA, 20 nt, Staphylococcus aureus subsp. aureus MW2
acaucuucuucaucauauuc

SEQ ID NO: 2099720 - RNA, 15 nt, Staphylococcus aureus subsp. aureus MW2
acaucgccaauuuga

SEQ ID NO: 2099721 - RNA, 22 nt, Staphylococcus aureus subsp. aureus MW2
acauuucgguaugauauuucua

SEQ ID NO: 2099722 - RNA, 20 nt, Staphylococcus aureus subsp. aureus MW2
accaaugauagugaauaaug

SEQ ID NO: 2099723 - RNA, 14 nt, Staphylococcus aureus subsp. aureus MW2
accaauugaauauu

SEQ ID NO: 2099724 - RNA, 16 nt, Staphylococcus aureus subsp. aureus MW2
accaauugaaauuaac

SEQ ID NO: 2099725 - RNA, 13 nt, Staphylococcus aureus subsp. aureus MW2
accaauuagcaug

SEQ ID NO: 2099726 - RNA, 13 nt, Staphylococcus aureus subsp. aureus MW2
accacacagcauu

SEQ ID NO: 2099727 - RNA, 18 nt, Staphylococcus aureus subsp. aureus MW2
accaauuuuaacuuauau

SEQ ID NO: 2099728 - RNA, 15 nt, Staphylococcus aureus subsp. aureus MW2
accaauuuuaauagu

SEQ ID NO: 2099729 - RNA, 14 nt, Staphylococcus aureus subsp. aureus MW2
accacaaccaguca

SEQ ID NO: 2099730 - RNA, 14 nt, Staphylococcus aureus subsp. aureus MW2
accaccacuuucag

SEQ ID NO: 2099731 - RNA, 17 nt, Staphylococcus aureus subsp. aureus MW2
accacacuuuaaacaag

SEQ ID NO: 2099732 - RNA, 21 nt, Staphylococcus aureus subsp. aureus MW2
accacuugaauacuuuuuaac

SEQ ID NO: 2099733 - RNA, 16 nt, Staphylococcus aureus subsp. aureus MW2
accacuugaauacuuu

SEQ ID NO: 2099734 - RNA, 17 nt, Staphylococcus aureus subsp. aureus MW2
aauuucaccuuguaaau

SEQ ID NO: 2099735 - RNA, 23 nt, Staphylococcus aureus subsp. aureus MW2
aauuucaauuuggaaauaucuua

SEQ ID NO: 2099736 - RNA, 19 nt, Staphylococcus aureus subsp. aureus MW2
aauuucaguaccauguuuu

SEQ ID NO: 2099737 - RNA, 14 nt, Staphylococcus aureus subsp. aureus MW2
aauuucaugugcaa

SEQ ID NO: 2099738 - RNA, 19 nt, Staphylococcus aureus subsp. aureus MW2
aauuucauuugaaauaguu

SEQ ID NO: 2099739 - RNA, 18 nt, Staphylococcus aureus subsp. aureus MW2
aauuuccaauaucuucuu

SEQ ID NO: 2099740 - RNA, 19 nt, Staphylococcus aureus subsp. aureus MW2
aauuucugguaaaaaaaua

SEQ ID NO: 2099741 - RNA, 17 nt, Staphylococcus aureus subsp. aureus MW2
aauuucuaugaaaaaaa

SEQ ID NO: 2099742 - RNA, 13 nt, Staphylococcus aureus subsp. aureus MW2
aauuucucugugu

SEQ ID NO: 2099743 - RNA, 19 nt, Staphylococcus aureus subsp. aureus MW2
aauuucucccguuugauuu

SEQ ID NO: 2099744 - RNA, 14 nt, Staphylococcus aureus subsp. aureus MW2
aauuucgcaguagc

SEQ ID NO: 2099745 - RNA, 20 nt, Staphylococcus aureus subsp. aureus MW2
aauuucguuuuauuaaugaa

SEQ ID NO: 2099746 - RNA, 21 nt, Staphylococcus aureus subsp. aureus MW2
aauuucguuuuauuaaugaag

SEQ ID NO: 2099747 - RNA, 14 nt, Staphylococcus aureus subsp. aureus MW2
aauuucuacagaca

SEQ ID NO: 2099748 - RNA, 14 nt, Staphylococcus aureus subsp. aureus MW2
aauuucuacugaca

SEQ ID NO: 2099749 - RNA, 19 nt, Staphylococcus aureus subsp. aureus MW2
aauuucgacuccauuagcu

SEQ ID NO: 2099750 - RNA, 18 nt, Staphylococcus aureus subsp. aureus MW2
aauuucgauuuucaccaa

SEQ ID NO: 2099751 - RNA, 17 nt, Staphylococcus aureus subsp. aureus MW2
aauuuagauauaauaaa

SEQ ID NO: 2099752 - RNA, 10 nt, Staphylococcus aureus subsp. aureus MW2
aauuuaaaug

SEQ ID NO: 2099753 - RNA, 12 nt, Staphylococcus aureus subsp. aureus MW2
aauuuaaauauu

SEQ ID NO: 2099754 - RNA, 16 nt, Staphylococcus aureus subsp. aureus MW2
aauuuaaauuaaaaua

SEQ ID NO: 2099755 - RNA, 18 nt, Staphylococcus aureus subsp. aureus MW2
aauuuaaauuaaguacua

SEQ ID NO: 2099756 - RNA, 13 nt, Staphylococcus aureus subsp. aureus MW2
aauuuaaaugaua

SEQ ID NO: 2099757 - RNA, 12 nt, Staphylococcus aureus subsp. aureus MW2
aauuuaaaugcu

SEQ ID NO: 2099758 - RNA, 20 nt, Staphylococcus aureus subsp. aureus MW2
aauuuaacguuauucauuug

SEQ ID NO: 2099759 - RNA, 21 nt, Staphylococcus aureus subsp. aureus MW2
aauuuaacuuucccuacugcu

SEQ ID NO: 2099760 - RNA, 14 nt, Staphylococcus aureus subsp. aureus MW2
aauugcguuuaaua

SEQ ID NO: 2099761 - RNA, 18 nt, Staphylococcus aureus subsp. aureus MW2
aauuuaaagcaucauaua

SEQ ID NO: 2099762 - RNA, 16 nt, Staphylococcus aureus subsp. aureus MW2
aauuuaaaggcauaau

SEQ ID NO: 2099763 - RNA, 22 nt, Staphylococcus aureus subsp. aureus MW2
aauugcuauauuaguauaauuu

SEQ ID NO: 2099764 - RNA, 14 nt, Staphylococcus aureus subsp. aureus MW2
aauugcuaaaucau

SEQ ID NO: 2099765 - RNA, 20 nt, Staphylococcus aureus subsp. aureus MW2
aauugcuauauuaguauaau

SEQ ID NO: 2099766 - RNA, 15 nt, Staphylococcus aureus subsp. aureus MW2
aauuuaaagcaucau

SEQ ID NO: 2099767 - RNA, 13 nt, Staphylococcus aureus subsp. aureus MW2
aauuuauauuaaa

SEQ ID NO: 2099768 - RNA, 15 nt, Staphylococcus aureus subsp. aureus MW2
aauuuauauuaaaua

SEQ ID NO: 2099769 - RNA, 16 nt, Staphylococcus aureus subsp. aureus MW2
aauuuagaugcauaaa

SEQ ID NO: 2099770 - RNA, 14 nt, Staphylococcus aureus subsp. aureus MW2
aauuuaucuuaauc

SEQ ID NO: 2099771 - RNA, 15 nt, Staphylococcus aureus subsp. aureus MW2
aauuucaaaaaggaa

SEQ ID NO: 2099772 - RNA, 16 nt, Staphylococcus aureus subsp. aureus MW2
aauuuauuuauuuuga

SEQ ID NO: 2099773 - RNA, 22 nt, Staphylococcus aureus subsp. aureus MW2
aauuuauguguugugauauaua

SEQ ID NO: 2099774 - RNA, 22 nt, Staphylococcus aureus subsp. aureus MW2
aauuuaugauuguuuauucguu

SEQ ID NO: 2099775 - RNA, 13 nt, Staphylococcus aureus subsp. aureus MW2
aauuuauuauaaa

SEQ ID NO: 2099776 - RNA, 22 nt, Staphylococcus aureus subsp. aureus MW2
aauuuauuauaaaauagaagua

SEQ ID NO: 2099777 - RNA, 12 nt, Staphylococcus aureus subsp. aureus MW2
aauuuauuauua

SEQ ID NO: 2099778 - RNA, 22 nt, Staphylococcus aureus subsp. aureus MW2
aauuuuaucuaaagcuauaaaa

SEQ ID NO: 2099779 - RNA, 15 nt, Staphylococcus aureus subsp. aureus MW2
aauuuuaugaaucga

SEQ ID NO: 2099780 - RNA, 17 nt, Staphylococcus aureus subsp. aureus MW2
aauuuuaucugaaucug

SEQ ID NO: 2099781 - RNA, 22 nt, Staphylococcus aureus subsp. aureus MW2
aauuuuauuauuaaucguucca

SEQ ID NO: 2099782 - RNA, 21 nt, Staphylococcus aureus subsp. aureus MW2
aauuuuccuuucaauaauaaa

SEQ ID NO: 2099783 - RNA, 13 nt, Staphylococcus aureus subsp. aureus MW2
aauuuuucauuaa

SEQ ID NO: 2099784 - RNA, 17 nt, Staphylococcus aureus subsp. aureus MW2
aauuuuuaacaaaauau

SEQ ID NO: 2099785 - RNA, 21 nt, Staphylococcus aureus subsp. aureus MW2
aauuuuuaacaaaauauacua

SEQ ID NO: 2099786 - RNA, 13 nt, Staphylococcus aureus subsp. aureus MW2
aauuuuuaacaaa

SEQ ID NO: 2099787 - RNA, 14 nt, Staphylococcus aureus subsp. aureus MW2
aauuuuuaaacaaa

SEQ ID NO: 2099788 - RNA, 18 nt, Staphylococcus aureus subsp. aureus MW2
aauuuuuauccaagucua

SEQ ID NO: 2099789 - RNA, 16 nt, Staphylococcus aureus subsp. aureus MW2
aauuuucuguccaaaa

SEQ ID NO: 2099790 - RNA, 12 nt, Staphylococcus aureus subsp. aureus MW2
aauuuucuauua

SEQ ID NO: 2099791 - RNA, 15 nt, Staphylococcus aureus subsp. aureus MW2
aauuuucuugccauc

SEQ ID NO: 2099792 - RNA, 14 nt, Staphylococcus aureus subsp. aureus MW2
aauuuugagacaaa

SEQ ID NO: 2099793 - RNA, 16 nt, Staphylococcus aureus subsp. aureus MW2
aauuuugagacaaaaa

SEQ ID NO: 2099794 - RNA, 21 nt, Staphylococcus aureus subsp. aureus MW2
aauuuuguacauaaaaauaag

SEQ ID NO: 2099795 - RNA, 13 nt, Staphylococcus aureus subsp. aureus MW2
aauuuugauauag

SEQ ID NO: 2099796 - RNA, 16 nt, Staphylococcus aureus subsp. aureus MW2
aauuuuguaaccugau

SEQ ID NO: 2099797 - RNA, 12 nt, Staphylococcus aureus subsp. aureus MW2
aauuugauuaaa

SEQ ID NO: 2099798 - RNA, 16 nt, Staphylococcus aureus subsp. aureus MW2
aauuugcacaaagaua

SEQ ID NO: 2099799 - RNA, 16 nt, Staphylococcus aureus subsp. aureus MW2
aauuugcauaacauug

SEQ ID NO: 2099800 - RNA, 17 nt, Staphylococcus aureus subsp. aureus MW2
aauuugaaauauaccaa

SEQ ID NO: 2099801 - RNA, 12 nt, Staphylococcus aureus subsp. aureus MW2
aauuugaaauug

SEQ ID NO: 2099802 - RNA, 13 nt, Staphylococcus aureus subsp. aureus MW2
aauuugaaauaua

SEQ ID NO: 2099803 - RNA, 16 nt, Staphylococcus aureus subsp. aureus MW2
aauuugaaauauacca

SEQ ID NO: 2099804 - RNA, 14 nt, Staphylococcus aureus subsp. aureus MW2
aauuucuuuaaagu

SEQ ID NO: 2099805 - RNA, 11 nt, Staphylococcus aureus subsp. aureus MW2
aauuucuuuuc

SEQ ID NO: 2099806 - RNA, 21 nt, Staphylococcus aureus subsp. aureus MW2
aauuugagccauuguuauuau

SEQ ID NO: 2099807 - RNA, 17 nt, Staphylococcus aureus subsp. aureus MW2
aauuugaggauacauaa

SEQ ID NO: 2099808 - RNA, 22 nt, Staphylococcus aureus subsp. aureus MW2
aauuuuaccuucgcauacuuuu

SEQ ID NO: 2099809 - RNA, 16 nt, Staphylococcus aureus subsp. aureus MW2
aauuuuaccauguuuu

SEQ ID NO: 2099810 - RNA, 12 nt, Staphylococcus aureus subsp. aureus MW2
aauuuuaccaug

SEQ ID NO: 2099811 - RNA, 14 nt, Staphylococcus aureus subsp. aureus MW2
aauuuuaaguuaau

SEQ ID NO: 2099812 - RNA, 11 nt, Staphylococcus aureus subsp. aureus MW2
aauuuuaaauc

SEQ ID NO: 2099813 - RNA, 21 nt, Staphylococcus aureus subsp. aureus MW2
aauuuuaaauauugauauaaa

SEQ ID NO: 2099814 - RNA, 17 nt, Staphylococcus aureus subsp. aureus MW2
aauuugguuaacauccu

SEQ ID NO: 2099815 - RNA, 18 nt, Staphylococcus aureus subsp. aureus MW2
aauuugguaggcauuuua

SEQ ID NO: 2099816 - RNA, 14 nt, Staphylococcus aureus subsp. aureus MW2
aauuuguaauuccu

SEQ ID NO: 2099817 - RNA, 14 nt, Staphylococcus aureus subsp. aureus MW2
aauuuguaauacaa

SEQ ID NO: 2099818 - RNA, 18 nt, Staphylococcus aureus subsp. aureus MW2
aauuugugauuaugcaua

SEQ ID NO: 2099819 - RNA, 14 nt, Staphylococcus aureus subsp. aureus MW2
aauuuguauuuaaa

SEQ ID NO: 2099820 - RNA, 15 nt, Staphylococcus aureus subsp. aureus MW2
aauuuguauuuaaaa

SEQ ID NO: 2099821 - RNA, 17 nt, Staphylococcus aureus subsp. aureus MW2
aauuaggauuaacauaa

SEQ ID NO: 2099822 - RNA, 16 nt, Staphylococcus aureus subsp. aureus MW2
aauuaggauuaacaua

SEQ ID NO: 2099823 - RNA, 15 nt, Staphylococcus aureus subsp. aureus MW2
aauuaguacuugaaa

SEQ ID NO: 2099824 - RNA, 14 nt, Staphylococcus aureus subsp. aureus MW2
aauuagucccauua

SEQ ID NO: 2099825 - RNA, 18 nt, Staphylococcus aureus subsp. aureus MW2
aauuagucccauuaacac

SEQ ID NO: 2099826 - RNA, 14 nt, Staphylococcus aureus subsp. aureus MW2
aauuaucuucauca

SEQ ID NO: 2099827 - RNA, 22 nt, Staphylococcus aureus subsp. aureus MW2
aauuauuucccuggaaaaugau

SEQ ID NO: 2099828 - RNA, 11 nt, Staphylococcus aureus subsp. aureus MW2
aauuauuucau

SEQ ID NO: 2099829 - RNA, 22 nt, Staphylococcus aureus subsp. aureus MW2
aauuauuaaagcuaucuucaga

SEQ ID NO: 2099830 - RNA, 20 nt, Staphylococcus aureus subsp. aureus MW2
aauuauguauuuuuauuuau

SEQ ID NO: 2099831 - RNA, 15 nt, Staphylococcus aureus subsp. aureus MW2
aauuauguaaaaaau

SEQ ID NO: 2099832 - RNA, 22 nt, Staphylococcus aureus subsp. aureus MW2
aauuaugauuauuuuucucaua

SEQ ID NO: 2099833 - RNA, 19 nt, Staphylococcus aureus subsp. aureus MW2
aauuauggcagauccauaa

SEQ ID NO: 2099834 - RNA, 19 nt, Staphylococcus aureus subsp. aureus MW2
aauuacuuauucaaauguu

SEQ ID NO: 2099835 - RNA, 16 nt, Staphylococcus aureus subsp. aureus MW2
aauuagauaaaacaaa

SEQ ID NO: 2099836 - RNA, 16 nt, Staphylococcus aureus subsp. aureus MW2
aauuagaagcaauuaa

SEQ ID NO: 2099837 - RNA, 22 nt, Staphylococcus aureus subsp. aureus MW2
aauuagaagcaauuaaguauag

SEQ ID NO: 2099838 - RNA, 23 nt, Staphylococcus aureus subsp. aureus MW2
aauuagaauauauguauaacaau

SEQ ID NO: 2099839 - RNA, 13 nt, Staphylococcus aureus subsp. aureus MW2
aauuagaaccauc

SEQ ID NO: 2099840 - RNA, 19 nt, Staphylococcus aureus subsp. aureus MW2
aauuagaaaaauaugauug

SEQ ID NO: 2099841 - RNA, 14 nt, Staphylococcus aureus subsp. aureus MW2
aauuagauuuaaaa

SEQ ID NO: 2099842 - RNA, 21 nt, Staphylococcus aureus subsp. aureus MW2
aauuagauuuuaugcuuuacu

SEQ ID NO: 2099843 - RNA, 16 nt, Staphylococcus aureus subsp. aureus MW2
aauuagccauuucaau

SEQ ID NO: 2099844 - RNA, 15 nt, Staphylococcus aureus subsp. aureus MW2
aauuaaguguauaua

SEQ ID NO: 2099845 - RNA, 15 nt, Staphylococcus aureus subsp. aureus MW2
aauuaauacaucaau

SEQ ID NO: 2099846 - RNA, 22 nt, Staphylococcus aureus subsp. aureus MW2
aauuaauaacauccccaaaaau

SEQ ID NO: 2099847 - RNA, 16 nt, Staphylococcus aureus subsp. aureus MW2
aauuaauauccaaaau

SEQ ID NO: 2099848 - RNA, 11 nt, Staphylococcus aureus subsp. aureus MW2
aauuaauaauu

SEQ ID NO: 2099849 - RNA, 18 nt, Staphylococcus aureus subsp. aureus MW2
aauuaauagagaaaaaau

SEQ ID NO: 2099850 - RNA, 13 nt, Staphylococcus aureus subsp. aureus MW2
aauguaucaccua

SEQ ID NO: 2099851 - RNA, 21 nt, Staphylococcus aureus subsp. aureus MW2
aauguaggcgccauaaucauu

SEQ ID NO: 2099852 - RNA, 22 nt, Staphylococcus aureus subsp. aureus MW2
aauguacuuuucugucuguaaa

SEQ ID NO: 2099853 - RNA, 14 nt, Staphylococcus aureus subsp. aureus MW2
aaugguuaaagguc

SEQ ID NO: 2099854 - RNA, 22 nt, Staphylococcus aureus subsp. aureus MW2
aaugguaucuaaaugugaaaga

SEQ ID NO: 2099855 - RNA, 21 nt, Staphylococcus aureus subsp. aureus MW2
aaugguaguuagguaaaaauu

SEQ ID NO: 2099856 - RNA, 21 nt, Staphylococcus aureus subsp. aureus MW2
aauuacagcgugauucaucua

SEQ ID NO: 2099857 - RNA, 21 nt, Staphylococcus aureus subsp. aureus MW2
aauuacacccuuuaaauuuaa

SEQ ID NO: 2099858 - RNA, 16 nt, Staphylococcus aureus subsp. aureus MW2
aauuacacuuuaaaua

SEQ ID NO: 2099859 - RNA, 20 nt, Staphylococcus aureus subsp. aureus MW2
aauuacgcauccuaauguaa

SEQ ID NO: 2099860 - RNA, 17 nt, Staphylococcus aureus subsp. aureus MW2
aauuacgcaaagaaaaa

SEQ ID NO: 2099861 - RNA, 21 nt, Staphylococcus aureus subsp. aureus MW2
aauuaccuuuccauucguaua

SEQ ID NO: 2099862 - RNA, 20 nt, Staphylococcus aureus subsp. aureus MW2
aauuaauuacuuucauugua

SEQ ID NO: 2099863 - RNA, 22 nt, Staphylococcus aureus subsp. aureus MW2
aauuaauuacuuucauuguaaa

SEQ ID NO: 2099864 - RNA, 18 nt, Staphylococcus aureus subsp. aureus MW2
aauuaauuaucauaaaua

SEQ ID NO: 2099865 - RNA, 22 nt, Staphylococcus aureus subsp. aureus MW2
aauuaauucgccuaaaugguuu

SEQ ID NO: 2099866 - RNA, 13 nt, Staphylococcus aureus subsp. aureus MW2
aauuaauuaaaag

SEQ ID NO: 2099867 - RNA, 17 nt, Staphylococcus aureus subsp. aureus MW2
aauuaaugcaucaguau

SEQ ID NO: 2099868 - RNA, 21 nt, Staphylococcus aureus subsp. aureus MW2
aauuaauccaucuacacccau

SEQ ID NO: 2099869 - RNA, 22 nt, Staphylococcus aureus subsp. aureus MW2
aauugcacauuuaaacuucgua

SEQ ID NO: 2099870 - RNA, 21 nt, Staphylococcus aureus subsp. aureus MW2
aauugauugcucuaagcauuc

SEQ ID NO: 2099871 - RNA, 22 nt, Staphylococcus aureus subsp. aureus MW2
aauugauuacaccacuuaggau

SEQ ID NO: 2099872 - RNA, 17 nt, Staphylococcus aureus subsp. aureus MW2
aauugauguugaugcaa

SEQ ID NO: 2099873 - RNA, 13 nt, Staphylococcus aureus subsp. aureus MW2
aauugauugcucu

SEQ ID NO: 2099874 - RNA, 18 nt, Staphylococcus aureus subsp. aureus MW2
aauugauuuugaaucaca

SEQ ID NO: 2099875 - RNA, 16 nt, Staphylococcus aureus subsp. aureus MW2
aauugaguuguugcaa

SEQ ID NO: 2099876 - RNA, 21 nt, Staphylococcus aureus subsp. aureus MW2
aauugaucagcauuuaaguua

SEQ ID NO: 2099877 - RNA, 18 nt, Staphylococcus aureus subsp. aureus MW2
aauugauaguagcuuaau

SEQ ID NO: 2099878 - RNA, 22 nt, Staphylococcus aureus subsp. aureus MW2
aauugauaguagcuuaaugcau

SEQ ID NO: 2099879 - RNA, 14 nt, Staphylococcus aureus subsp. aureus MW2
aaaacaaaaaaccg

SEQ ID NO: 2099880 - RNA, 16 nt, Staphylococcus aureus subsp. aureus MW2
aaaacaaaaaagagcu

SEQ ID NO: 2099881 - RNA, 19 nt, Staphylococcus aureus subsp. aureus MW2
aauugaucgaagucaggau

SEQ ID NO: 2099882 - RNA, 14 nt, Staphylococcus aureus subsp. aureus MW2
aauugaugauuacu

SEQ ID NO: 2099883 - RNA, 19 nt, Staphylococcus aureus subsp. aureus MW2
aauugacuuacauuuuaau

SEQ ID NO: 2099884 - RNA, 22 nt, Staphylococcus aureus subsp. aureus MW2
aauugacucaaagauauacuua

SEQ ID NO: 2099885 - RNA, 17 nt, Staphylococcus aureus subsp. aureus MW2
aauugacucaaagauau

SEQ ID NO: 2099886 - RNA, 18 nt, Staphylococcus aureus subsp. aureus MW2
aauugacgcauuaaugau

SEQ ID NO: 2099887 - RNA, 14 nt, Staphylococcus aureus subsp. aureus MW2
aauugaauuaugau

SEQ ID NO: 2099888 - RNA, 21 nt, Staphylococcus aureus subsp. aureus MW2
aauugaauuucgcacaauguu

SEQ ID NO: 2099889 - RNA, 15 nt, Staphylococcus aureus subsp. aureus MW2
aauugaauuaaaucu

SEQ ID NO: 2099890 - RNA, 17 nt, Staphylococcus aureus subsp. aureus MW2
aauucuuguaaaucaua

SEQ ID NO: 2099891 - RNA, 21 nt, Staphylococcus aureus subsp. aureus MW2
aauucuucuuuagauugucca

SEQ ID NO: 2099892 - RNA, 21 nt, Staphylococcus aureus subsp. aureus MW2
aauucuucaucuucuucaaaa

SEQ ID NO: 2099893 - RNA, 12 nt, Staphylococcus aureus subsp. aureus MW2
aauucuucuuca

SEQ ID NO: 2099894 - RNA, 16 nt, Staphylococcus aureus subsp. aureus MW2
aauugaagugaaauug

SEQ ID NO: 2099895 - RNA, 15 nt, Staphylococcus aureus subsp. aureus MW2
aauucuuuaccauuc

SEQ ID NO: 2099896 - RNA, 20 nt, Staphylococcus aureus subsp. aureus MW2
aauucuuuaccauucaaccu

SEQ ID NO: 2099897 - RNA, 16 nt, Staphylococcus aureus subsp. aureus MW2
aauucuucaaauuuaa

SEQ ID NO: 2099898 - RNA, 19 nt, Staphylococcus aureus subsp. aureus MW2
aauucuucaucaugacuau

SEQ ID NO: 2099899 - RNA, 22 nt, Staphylococcus aureus subsp. aureus MW2
aauucuucaucaauaacuauaa

SEQ ID NO: 2099900 - RNA, 23 nt, Staphylococcus aureus subsp. aureus MW2
aauucuucaaauuuaacguguaa

SEQ ID NO: 2099901 - RNA, 16 nt, Staphylococcus aureus subsp. aureus MW2
aauucuucaaccauuu

SEQ ID NO: 2099902 - RNA, 21 nt, Staphylococcus aureus subsp. aureus MW2
aauucuucaaccauuuguucu

SEQ ID NO: 2099903 - RNA, 21 nt, Staphylococcus aureus subsp. aureus MW2
aauucuucaauuucauuuuug

SEQ ID NO: 2099904 - RNA, 12 nt, Staphylococcus aureus subsp. aureus MW2
aauucuacagaa

SEQ ID NO: 2099905 - RNA, 14 nt, Staphylococcus aureus subsp. aureus MW2
aauucuaacugcaa

SEQ ID NO: 2099906 - RNA, 19 nt, Staphylococcus aureus subsp. aureus MW2
aauucgucuguuucauaua

SEQ ID NO: 2099907 - RNA, 19 nt, Staphylococcus aureus subsp. aureus MW2
aauucguuuugcuaaccau

SEQ ID NO: 2099908 - RNA, 14 nt, Staphylococcus aureus subsp. aureus MW2
aauucuaaaagaau

SEQ ID NO: 2099909 - RNA, 22 nt, Staphylococcus aureus subsp. aureus MW2
aauucguuuugcuaaccaucau

SEQ ID NO: 2099910 - RNA, 16 nt, Staphylococcus aureus subsp. aureus MW2
aauucuaaaagaauua

SEQ ID NO: 2099911 - RNA, 15 nt, Staphylococcus aureus subsp. aureus MW2
aauucaaugauuuuu

SEQ ID NO: 2099912 - RNA, 20 nt, Staphylococcus aureus subsp. aureus MW2
aauucaaugauuuuuaaaaa

SEQ ID NO: 2099913 - RNA, 13 nt, Staphylococcus aureus subsp. aureus MW2
aauucaaauuaua

SEQ ID NO: 2099914 - RNA, 15 nt, Staphylococcus aureus subsp. aureus MW2
aauucaaauuauaau

SEQ ID NO: 2099915 - RNA, 21 nt, Staphylococcus aureus subsp. aureus MW2
aauuauuuuucucaacaguuu

SEQ ID NO: 2099916 - RNA, 21 nt, Staphylococcus aureus subsp. aureus MW2
aauucgcaagccuucuauaua

SEQ ID NO: 2099917 - RNA, 14 nt, Staphylococcus aureus subsp. aureus MW2
aaugaagaauacaa

SEQ ID NO: 2099918 - RNA, 18 nt, Staphylococcus aureus subsp. aureus MW2
aaugaacuucucuuaguu

SEQ ID NO: 2099919 - RNA, 23 nt, Staphylococcus aureus subsp. aureus MW2
aaugaaccuuuacucauauugaa

SEQ ID NO: 2099920 - RNA, 14 nt, Staphylococcus aureus subsp. aureus MW2
aaugaauaauucca

SEQ ID NO: 2099921 - RNA, 16 nt, Staphylococcus aureus subsp. aureus MW2
aaugaauaaugacaaa

SEQ ID NO: 2099922 - RNA, 21 nt, Staphylococcus aureus subsp. aureus MW2
aaugaauaaugacaaauuauc

SEQ ID NO: 2099923 - RNA, 14 nt, Staphylococcus aureus subsp. aureus MW2
aaugaauaaagcua

SEQ ID NO: 2099924 - RNA, 17 nt, Staphylococcus aureus subsp. aureus MW2
aaugaagcuaaguauau

SEQ ID NO: 2099925 - RNA, 16 nt, Staphylococcus aureus subsp. aureus MW2
aaugaagcugugugaa

SEQ ID NO: 2099926 - RNA, 13 nt, Staphylococcus aureus subsp. aureus MW2
aaugaauguuaag

SEQ ID NO: 2099927 - RNA, 18 nt, Staphylococcus aureus subsp. aureus MW2
aaugaaucaaaucaauau

SEQ ID NO: 2099928 - RNA, 16 nt, Staphylococcus aureus subsp. aureus MW2
aaugaaucaauugcau

SEQ ID NO: 2099929 - RNA, 19 nt, Staphylococcus aureus subsp. aureus MW2
aaugaauuauuuaaaaugc

SEQ ID NO: 2099930 - RNA, 21 nt, Staphylococcus aureus subsp. aureus MW2
aaugaauuagcuaagccuguu

SEQ ID NO: 2099931 - RNA, 19 nt, Staphylococcus aureus subsp. aureus MW2
aaucuuuacuuguaauuaa

SEQ ID NO: 2099932 - RNA, 19 nt, Staphylococcus aureus subsp. aureus MW2
aaucuuguuuucauuuaaa

SEQ ID NO: 2099933 - RNA, 14 nt, Staphylococcus aureus subsp. aureus MW2
aaucuuuaucaguu

SEQ ID NO: 2099934 - RNA, 17 nt, Staphylococcus aureus subsp. aureus MW2
aaucuuguucuaauugu

SEQ ID NO: 2099935 - RNA, 18 nt, Staphylococcus aureus subsp. aureus MW2
aaucuuguuggauuuuaa

SEQ ID NO: 2099936 - RNA, 19 nt, Staphylococcus aureus subsp. aureus MW2
aaucuuuuagcuuuuguaa

SEQ ID NO: 2099937 - RNA, 12 nt, Staphylococcus aureus subsp. aureus MW2
aaucuuuuaacu

SEQ ID NO: 2099938 - RNA, 21 nt, Staphylococcus aureus subsp. aureus MW2
aaugacugaauuaauauccaa

SEQ ID NO: 2099939 - RNA, 17 nt, Staphylococcus aureus subsp. aureus MW2
aaugacuucacauuuau

SEQ ID NO: 2099940 - RNA, 14 nt, Staphylococcus aureus subsp. aureus MW2
aaugaguacaacau

SEQ ID NO: 2099941 - RNA, 18 nt, Staphylococcus aureus subsp. aureus MW2
aaugagcuuuucuaaugc

SEQ ID NO: 2099942 - RNA, 24 nt, Staphylococcus aureus subsp. aureus MW2
aaugagcugaacuuucuuuauuau

SEQ ID NO: 2099943 - RNA, 17 nt, Staphylococcus aureus subsp. aureus MW2
aaugauaccuuuaaauc

SEQ ID NO: 2099944 - RNA, 18 nt, Staphylococcus aureus subsp. aureus MW2
aaugauacgccuaaauau

SEQ ID NO: 2099945 - RNA, 14 nt, Staphylococcus aureus subsp. aureus MW2
aaugauaauuuaau

SEQ ID NO: 2099946 - RNA, 19 nt, Staphylococcus aureus subsp. aureus MW2
aaugauagaugcuggcuua

SEQ ID NO: 2099947 - RNA, 15 nt, Staphylococcus aureus subsp. aureus MW2
aaugacuaacuuucu

SEQ ID NO: 2099948 - RNA, 23 nt, Staphylococcus aureus subsp. aureus MW2
aaugacuaccuguuggcuuuaaa

SEQ ID NO: 2099949 - RNA, 14 nt, Staphylococcus aureus subsp. aureus MW2
aaugacgagaauua

SEQ ID NO: 2099950 - RNA, 18 nt, Staphylococcus aureus subsp. aureus MW2
aaugacauggaaaauaua

SEQ ID NO: 2099951 - RNA, 23 nt, Staphylococcus aureus subsp. aureus MW2
aaugaccaucuggcguuaaccau

SEQ ID NO: 2099952 - RNA, 14 nt, Staphylococcus aureus subsp. aureus MW2
aaugaugacaucaa

SEQ ID NO: 2099953 - RNA, 23 nt, Staphylococcus aureus subsp. aureus MW2
aaugaugaaaaucaguugcuuca

SEQ ID NO: 2099954 - RNA, 18 nt, Staphylococcus aureus subsp. aureus MW2
aaugaucaucuauauuua

SEQ ID NO: 2099955 - RNA, 16 nt, Staphylococcus aureus subsp. aureus MW2
aaugaucagugaagcu

SEQ ID NO: 2099956 - RNA, 15 nt, Staphylococcus aureus subsp. aureus MW2
aaugauagugaauaa

SEQ ID NO: 2099957 - RNA, 18 nt, Staphylococcus aureus subsp. aureus MW2
aaugauauauuacaucau

SEQ ID NO: 2099958 - RNA, 17 nt, Staphylococcus aureus subsp. aureus MW2
aaugauagugaauaaug

SEQ ID NO: 2099959 - RNA, 14 nt, Staphylococcus aureus subsp. aureus MW2
aaugaugauuuaaa

SEQ ID NO: 2099960 - RNA, 17 nt, Staphylococcus aureus subsp. aureus MW2
aaugaugauuuaaagca

SEQ ID NO: 2099961 - RNA, 12 nt, Staphylococcus aureus subsp. aureus MW2
aaugauuauaaa

SEQ ID NO: 2099962 - RNA, 14 nt, Staphylococcus aureus subsp. aureus MW2
aaugauuauaaaua

SEQ ID NO: 2099963 - RNA, 20 nt, Staphylococcus aureus subsp. aureus MW2
aaugauuaaaaaucaaagag

SEQ ID NO: 2099964 - RNA, 17 nt, Staphylococcus aureus subsp. aureus MW2
aaugauuauaaauacau

SEQ ID NO: 2099965 - RNA, 21 nt, Staphylococcus aureus subsp. aureus MW2
aaugcauguggacguugaucu

SEQ ID NO: 2099966 - RNA, 16 nt, Staphylococcus aureus subsp. aureus MW2
aauggcaaucuauaua

SEQ ID NO: 2099967 - RNA, 16 nt, Staphylococcus aureus subsp. aureus MW2
aauggcacuuaauaua

SEQ ID NO: 2099968 - RNA, 22 nt, Staphylococcus aureus subsp. aureus MW2
aauggcacuuaauauaaggaag

SEQ ID NO: 2099969 - RNA, 15 nt, Staphylococcus aureus subsp. aureus MW2
aaugggcgugccauu

SEQ ID NO: 2099970 - RNA, 18 nt, Staphylococcus aureus subsp. aureus MW2
aaugggcgauaaaaguug

SEQ ID NO: 2099971 - RNA, 22 nt, Staphylococcus aureus subsp. aureus MW2
aaugggaauuguauuagcaauu

SEQ ID NO: 2099972 - RNA, 19 nt, Staphylococcus aureus subsp. aureus MW2
aauggcgugcuuuucaaac

SEQ ID NO: 2099973 - RNA, 19 nt, Staphylococcus aureus subsp. aureus MW2
aaugcuacaucaauauugu

SEQ ID NO: 2099974 - RNA, 19 nt, Staphylococcus aureus subsp. aureus MW2
aaugcuaauacuaaucaaa

SEQ ID NO: 2099975 - RNA, 15 nt, Staphylococcus aureus subsp. aureus MW2
aaugcuacuauuaaa

SEQ ID NO: 2099976 - RNA, 13 nt, Staphylococcus aureus subsp. aureus MW2
aaugcuaucaugc

SEQ ID NO: 2099977 - RNA, 15 nt, Staphylococcus aureus subsp. aureus MW2
aaugcuaugauuaaa

SEQ ID NO: 2099978 - RNA, 15 nt, Staphylococcus aureus subsp. aureus MW2
aaugcucaucuucua

SEQ ID NO: 2099979 - RNA, 20 nt, Staphylococcus aureus subsp. aureus MW2
aaugcucuauauauccauuc

SEQ ID NO: 2099980 - RNA, 20 nt, Staphylococcus aureus subsp. aureus MW2
aaugccugccccuuagucau

SEQ ID NO: 2099981 - RNA, 15 nt, Staphylococcus aureus subsp. aureus MW2
aaugccuaauuuugu

SEQ ID NO: 2099982 - RNA, 19 nt, Staphylococcus aureus subsp. aureus MW2
aaugccuaauuuguaaccc

SEQ ID NO: 2099983 - RNA, 14 nt, Staphylococcus aureus subsp. aureus MW2
aauccaauuaaaua

SEQ ID NO: 2099984 - RNA, 19 nt, Staphylococcus aureus subsp. aureus MW2
aauccaguaaucaaagauu

SEQ ID NO: 2099985 - RNA, 13 nt, Staphylococcus aureus subsp. aureus MW2
aauccaguaauca

SEQ ID NO: 2099986 - RNA, 19 nt, Staphylococcus aureus subsp. aureus MW2
aaucauucacuucaaguug

SEQ ID NO: 2099987 - RNA, 18 nt, Staphylococcus aureus subsp. aureus MW2
aaucauuaauaauuaaac

SEQ ID NO: 2099988 - RNA, 23 nt, Staphylococcus aureus subsp. aureus MW2
aaucauuaguuaugugcuaaucu

SEQ ID NO: 2099989 - RNA, 18 nt, Staphylococcus aureus subsp. aureus MW2
aauccaagauauauaacu

SEQ ID NO: 2099990 - RNA, 21 nt, Staphylococcus aureus subsp. aureus MW2
aaucaucgaacaugaaugaua

SEQ ID NO: 2099991 - RNA, 17 nt, Staphylococcus aureus subsp. aureus MW2
aaucaucgcaaaaacau

SEQ ID NO: 2099992 - RNA, 16 nt, Staphylococcus aureus subsp. aureus MW2
aaucaucgaacaugaa

SEQ ID NO: 2099993 - RNA, 18 nt, Staphylococcus aureus subsp. aureus MW2
aaucaucguauuucauau

SEQ ID NO: 2099994 - RNA, 17 nt, Staphylococcus aureus subsp. aureus MW2
aaucaucuaaaugcacu

SEQ ID NO: 2099995 - RNA, 17 nt, Staphylococcus aureus subsp. aureus MW2
aaucauuaauaauuaaa

SEQ ID NO: 2099996 - RNA, 20 nt, Staphylococcus aureus subsp. aureus MW2
aaaaauuccuagcuuuuaug

SEQ ID NO: 2099997 - RNA, 19 nt, Staphylococcus aureus subsp. aureus MW2
aaucaucaagacauuuuaa

SEQ ID NO: 2099998 - RNA, 17 nt, Staphylococcus aureus subsp. aureus MW2
aauaugaacaaaaauaa

SEQ ID NO: 2099999 - RNA, 14 nt, Staphylococcus aureus subsp. aureus MW2
aaucaguaauaaug

SEQ ID NO: 2100000 - RNA, 22 nt, Staphylococcus aureus subsp. aureus MW2
aaucagguuuaaacaguuuaau

SEQ ID NO: 2100001 - RNA, 21 nt, Staphylococcus aureus subsp. aureus MW2
aaucaguauaaucagcaaugu

SEQ ID NO: 2100002 - RNA, 16 nt, Staphylococcus aureus subsp. aureus MW2
aaucagugaaauauca

SEQ ID NO: 2100003 - RNA, 16 nt, Staphylococcus aureus subsp. aureus MW2
aaucaggaauguuugu

SEQ ID NO: 2100004 - RNA, 18 nt, Staphylococcus aureus subsp. aureus MW2
aaucaggaauguuuguau

SEQ ID NO: 2100005 - RNA, 17 nt, Staphylococcus aureus subsp. aureus MW2
aaucagggacaaaaauu

SEQ ID NO: 2100006 - RNA, 12 nt, Staphylococcus aureus subsp. aureus MW2
aaucauagauau

SEQ ID NO: 2100007 - RNA, 22 nt, Staphylococcus aureus subsp. aureus MW2
aaucauagauauaagaaaucca

SEQ ID NO: 2100008 - RNA, 20 nt, Staphylococcus aureus subsp. aureus MW2
aaucauacgagaaauuagaa

SEQ ID NO: 2100009 - RNA, 21 nt, Staphylococcus aureus subsp. aureus MW2
aaucaguuucaucaaguauaa

SEQ ID NO: 2100010 - RNA, 15 nt, Staphylococcus aureus subsp. aureus MW2
aaucaguuuuugaau

SEQ ID NO: 2100011 - RNA, 24 nt, Staphylococcus aureus subsp. aureus MW2
aaucaguuacucuauagucaucug

SEQ ID NO: 2100012 - RNA, 18 nt, Staphylococcus aureus subsp. aureus MW2
aaaaaugucuaaaaaaau

SEQ ID NO: 2100013 - RNA, 19 nt, Staphylococcus aureus subsp. aureus MW2
aaaaaugucuaaaaaaaug

SEQ ID NO: 2100014 - RNA, 18 nt, Staphylococcus aureus subsp. aureus MW2
aaaaauguguuaaaauau

SEQ ID NO: 2100015 - RNA, 21 nt, Staphylococcus aureus subsp. aureus MW2
aaaaauguguuaaaauauauu

SEQ ID NO: 2100016 - RNA, 12 nt, Staphylococcus aureus subsp. aureus MW2
aaaaauuaaaaa

SEQ ID NO: 2100017 - RNA, 15 nt, Staphylococcus aureus subsp. aureus MW2
aaaaauuaaaaaaca

SEQ ID NO: 2100018 - RNA, 14 nt, Staphylococcus aureus subsp. aureus MW2
aaaaauuaaaaauu

SEQ ID NO: 2100019 - RNA, 14 nt, Staphylococcus aureus subsp. aureus MW2
aaaaauuaaaaugu

SEQ ID NO: 2100020 - RNA, 13 nt, Staphylococcus aureus subsp. aureus MW2
aaucuaaauguaa

SEQ ID NO: 2100021 - RNA, 14 nt, Staphylococcus aureus subsp. aureus MW2
aaucuaaaaaucca

SEQ ID NO: 2100022 - RNA, 22 nt, Staphylococcus aureus subsp. aureus MW2
aaucuauaaauaucaauaauuc

SEQ ID NO: 2100023 - RNA, 14 nt, Staphylococcus aureus subsp. aureus MW2
aaucuauaaauuau

SEQ ID NO: 2100024 - RNA, 15 nt, Staphylococcus aureus subsp. aureus MW2
aaucuauaccauucc

SEQ ID NO: 2100025 - RNA, 16 nt, Staphylococcus aureus subsp. aureus MW2
aaucuaaacuauaaua

SEQ ID NO: 2100026 - RNA, 23 nt, Staphylococcus aureus subsp. aureus MW2
aaucuccuugcucaugagcacaa

SEQ ID NO: 2100027 - RNA, 22 nt, Staphylococcus aureus subsp. aureus MW2
aaucuccauuuaaggauuuccu

SEQ ID NO: 2100028 - RNA, 12 nt, Staphylococcus aureus subsp. aureus MW2
aaucuauauaua

SEQ ID NO: 2100029 - RNA, 21 nt, Staphylococcus aureus subsp. aureus MW2
aaucuauauaaaguugacaau

SEQ ID NO: 2100030 - RNA, 14 nt, Staphylococcus aureus subsp. aureus MW2
aaucuauugcaaua

SEQ ID NO: 2100031 - RNA, 13 nt, Staphylococcus aureus subsp. aureus MW2
aaucuaucuauuc

SEQ ID NO: 2100032 - RNA, 15 nt, Staphylococcus aureus subsp. aureus MW2
aaucguugaaaaaua

SEQ ID NO: 2100033 - RNA, 16 nt, Staphylococcus aureus subsp. aureus MW2
aaucggaauaaaauaa

SEQ ID NO: 2100034 - RNA, 23 nt, Staphylococcus aureus subsp. aureus MW2
aauccaucaauaccauaauuaaa

SEQ ID NO: 2100035 - RNA, 17 nt, Staphylococcus aureus subsp. aureus MW2
aauccuuuguuuguaag

SEQ ID NO: 2100036 - RNA, 16 nt, Staphylococcus aureus subsp. aureus MW2
aaucgaaaauaucaau

SEQ ID NO: 2100037 - RNA, 15 nt, Staphylococcus aureus subsp. aureus MW2
aaucgaacagaaaau

SEQ ID NO: 2100038 - RNA, 15 nt, Staphylococcus aureus subsp. aureus MW2
aaucgccuuguuuau

SEQ ID NO: 2100039 - RNA, 18 nt, Staphylococcus aureus subsp. aureus MW2
aaaaauuugcaugaaaau

SEQ ID NO: 2100040 - RNA, 23 nt, Staphylococcus aureus subsp. aureus MW2
aaaaauuugcaugaaaauuaaaa

SEQ ID NO: 2100041 - RNA, 17 nt, Staphylococcus aureus subsp. aureus MW2
acucuuuuuaauauuuu

SEQ ID NO: 2100042 - RNA, 18 nt, Staphylococcus aureus subsp. aureus MW2
acucuuuaaaucaaagag

SEQ ID NO: 2100043 - RNA, 12 nt, Staphylococcus aureus subsp. aureus MW2
acucuuugcaau

SEQ ID NO: 2100044 - RNA, 21 nt, Staphylococcus aureus subsp. aureus MW2
acugcauagguaaccuuaaau

SEQ ID NO: 2100045 - RNA, 18 nt, Staphylococcus aureus subsp. aureus MW2
acugcaacaccacacagc

SEQ ID NO: 2100046 - RNA, 21 nt, Staphylococcus aureus subsp. aureus MW2
acugcaacaccacacagcauu

SEQ ID NO: 2100047 - RNA, 19 nt, Staphylococcus aureus subsp. aureus MW2
acugcaaacacaguacaaa

SEQ ID NO: 2100048 - RNA, 22 nt, Staphylococcus aureus subsp. aureus MW2
acugcaaauacgaguguuuuaa

SEQ ID NO: 2100049 - RNA, 13 nt, Staphylococcus aureus subsp. aureus MW2
acugauaauacug

SEQ ID NO: 2100050 - RNA, 22 nt, Staphylococcus aureus subsp. aureus MW2
acugauaaaaggggaaaucauu

SEQ ID NO: 2100051 - RNA, 16 nt, Staphylococcus aureus subsp. aureus MW2
acugccaauaaaaugc

SEQ ID NO: 2100052 - RNA, 22 nt, Staphylococcus aureus subsp. aureus MW2
acugccugacauucaucacaaa

SEQ ID NO: 2100053 - RNA, 17 nt, Staphylococcus aureus subsp. aureus MW2
acuggauaaauaaagau

SEQ ID NO: 2100054 - RNA, 19 nt, Staphylococcus aureus subsp. aureus MW2
acuggauaaauaaagauuc

SEQ ID NO: 2100055 - RNA, 18 nt, Staphylococcus aureus subsp. aureus MW2
acugcuggaacaccaaua

SEQ ID NO: 2100056 - RNA, 13 nt, Staphylococcus aureus subsp. aureus MW2
acuauuuguuguu

SEQ ID NO: 2100057 - RNA, 18 nt, Staphylococcus aureus subsp. aureus MW2
acuauuuguuguuauaua

SEQ ID NO: 2100058 - RNA, 19 nt, Staphylococcus aureus subsp. aureus MW2
acuauuuuugaaaagagcg

SEQ ID NO: 2100059 - RNA, 14 nt, Staphylococcus aureus subsp. aureus MW2
acuauuuuuuagac

SEQ ID NO: 2100060 - RNA, 20 nt, Staphylococcus aureus subsp. aureus MW2
acucaaaaagccaacacauu

SEQ ID NO: 2100061 - RNA, 20 nt, Staphylococcus aureus subsp. aureus MW2
acucguugcgcucuuuucuu

SEQ ID NO: 2100062 - RNA, 12 nt, Staphylococcus aureus subsp. aureus MW2
acucuaaaggaa

SEQ ID NO: 2100063 - RNA, 22 nt, Staphylococcus aureus subsp. aureus MW2
acucuaaaacgauuaauaguuu

SEQ ID NO: 2100064 - RNA, 19 nt, Staphylococcus aureus subsp. aureus MW2
acucugagcacuuagcaau

SEQ ID NO: 2100065 - RNA, 24 nt, Staphylococcus aureus subsp. aureus MW2
acucuucaguacgaacaacuaaca

SEQ ID NO: 2100066 - RNA, 16 nt, Staphylococcus aureus subsp. aureus MW2
acuucgccaagccauu

SEQ ID NO: 2100067 - RNA, 21 nt, Staphylococcus aureus subsp. aureus MW2
acuucgccaagccauuuuucu

SEQ ID NO: 2100068 - RNA, 21 nt, Staphylococcus aureus subsp. aureus MW2
acuucgcccuuccauucaucu

SEQ ID NO: 2100069 - RNA, 18 nt, Staphylococcus aureus subsp. aureus MW2
acuuccugcuuuuuuuau

SEQ ID NO: 2100070 - RNA, 13 nt, Staphylococcus aureus subsp. aureus MW2
acuucaucuaaau

SEQ ID NO: 2100071 - RNA, 16 nt, Staphylococcus aureus subsp. aureus MW2
acuucaucacucgcaa

SEQ ID NO: 2100072 - RNA, 18 nt, Staphylococcus aureus subsp. aureus MW2
acuucuuaacuugaaaug

SEQ ID NO: 2100073 - RNA, 22 nt, Staphylococcus aureus subsp. aureus MW2
acuucuuaaaauaugauuuaaa

SEQ ID NO: 2100074 - RNA, 13 nt, Staphylococcus aureus subsp. aureus MW2
acuucuuaaaaua

SEQ ID NO: 2100075 - RNA, 16 nt, Staphylococcus aureus subsp. aureus MW2
acuucugguucuucac

SEQ ID NO: 2100076 - RNA, 14 nt, Staphylococcus aureus subsp. aureus MW2
acuucucuuugaac

SEQ ID NO: 2100077 - RNA, 15 nt, Staphylococcus aureus subsp. aureus MW2
acuucucuuugaacg

SEQ ID NO: 2100078 - RNA, 20 nt, Staphylococcus aureus subsp. aureus MW2
acuucucuuugaacgaaaga

SEQ ID NO: 2100079 - RNA, 21 nt, Staphylococcus aureus subsp. aureus MW2
acuucucuuugaacgaaagag

SEQ ID NO: 2100080 - RNA, 13 nt, Staphylococcus aureus subsp. aureus MW2
acuucugaaaaua

SEQ ID NO: 2100081 - RNA, 16 nt, Staphylococcus aureus subsp. aureus MW2
acuucucaauuuagua

SEQ ID NO: 2100082 - RNA, 17 nt, Staphylococcus aureus subsp. aureus MW2
acuucucaauuuaguau

SEQ ID NO: 2100083 - RNA, 16 nt, Staphylococcus aureus subsp. aureus MW2
acuucuauuaauaauu

SEQ ID NO: 2100084 - RNA, 17 nt, Staphylococcus aureus subsp. aureus MW2
acuucuaauuugcaaaa

SEQ ID NO: 2100085 - RNA, 16 nt, Staphylococcus aureus subsp. aureus MW2
acuucuaauuugcaaa

SEQ ID NO: 2100086 - RNA, 18 nt, Staphylococcus aureus subsp. aureus MW2
acuucuaacgcaacugaa

SEQ ID NO: 2100087 - RNA, 15 nt, Staphylococcus aureus subsp. aureus MW2
acuucuuuuuuguau

SEQ ID NO: 2100088 - RNA, 13 nt, Staphylococcus aureus subsp. aureus MW2
acuugaauauuau

SEQ ID NO: 2100089 - RNA, 18 nt, Staphylococcus aureus subsp. aureus MW2
acuugaauaccuuuuauu

SEQ ID NO: 2100090 - RNA, 16 nt, Staphylococcus aureus subsp. aureus MW2
acuucuuuauauuuau

SEQ ID NO: 2100091 - RNA, 17 nt, Staphylococcus aureus subsp. aureus MW2
acuucuuguucgauaau

SEQ ID NO: 2100092 - RNA, 19 nt, Staphylococcus aureus subsp. aureus MW2
acuucaacgucaucugcuu

SEQ ID NO: 2100093 - RNA, 17 nt, Staphylococcus aureus subsp. aureus MW2
acuucaaagcaucuaau

SEQ ID NO: 2100094 - RNA, 23 nt, Staphylococcus aureus subsp. aureus MW2
acuucaauugucguuuaauaaua

SEQ ID NO: 2100095 - RNA, 14 nt, Staphylococcus aureus subsp. aureus MW2
acuuauuucuuuuc

SEQ ID NO: 2100096 - RNA, 17 nt, Staphylococcus aureus subsp. aureus MW2
acuucaaacguuaugua

SEQ ID NO: 2100097 - RNA, 18 nt, Staphylococcus aureus subsp. aureus MW2
acuucaaacguuauguac

SEQ ID NO: 2100098 - RNA, 19 nt, Staphylococcus aureus subsp. aureus MW2
acuuauugacgaguagauu

SEQ ID NO: 2100099 - RNA, 18 nt, Staphylococcus aureus subsp. aureus MW2
acuuauuaauuaauagag

SEQ ID NO: 2100100 - RNA, 21 nt, Staphylococcus aureus subsp. aureus MW2
acuuauuaauuaauagagaca

SEQ ID NO: 2100101 - RNA, 14 nt, Staphylococcus aureus subsp. aureus MW2
acuuacuuuucuaa

SEQ ID NO: 2100102 - RNA, 22 nt, Staphylococcus aureus subsp. aureus MW2
acuuacuuuucuaaacaacuuc

SEQ ID NO: 2100103 - RNA, 18 nt, Staphylococcus aureus subsp. aureus MW2
acuuacugugaaaauacc

SEQ ID NO: 2100104 - RNA, 18 nt, Staphylococcus aureus subsp. aureus MW2
acuuagaccccuaauuaa

SEQ ID NO: 2100105 - RNA, 15 nt, Staphylococcus aureus subsp. aureus MW2
acuuagaugugcgug

SEQ ID NO: 2100106 - RNA, 15 nt, Staphylococcus aureus subsp. aureus MW2
acuuaugagcaaagc

SEQ ID NO: 2100107 - RNA, 22 nt, Staphylococcus aureus subsp. aureus MW2
acugugauauuaauugaaaaac

SEQ ID NO: 2100108 - RNA, 21 nt, Staphylococcus aureus subsp. aureus MW2
acuguucuuucgucuuguaaa

SEQ ID NO: 2100109 - RNA, 22 nt, Staphylococcus aureus subsp. aureus MW2
acuguucuuucgucuuguaaac

SEQ ID NO: 2100110 - RNA, 16 nt, Staphylococcus aureus subsp. aureus MW2
acuguuggaauaccuu

SEQ ID NO: 2100111 - RNA, 16 nt, Staphylococcus aureus subsp. aureus MW2
acuguugacauuugac

SEQ ID NO: 2100112 - RNA, 12 nt, Staphylococcus aureus subsp. aureus MW2
acuuaaaauuua

SEQ ID NO: 2100113 - RNA, 20 nt, Staphylococcus aureus subsp. aureus MW2
acuuaaaauaaguauuuuuu

SEQ ID NO: 2100114 - RNA, 15 nt, Staphylococcus aureus subsp. aureus MW2
acuuaaagauuuacc

SEQ ID NO: 2100115 - RNA, 17 nt, Staphylococcus aureus subsp. aureus MW2
acuuaaaacuauaaccu

SEQ ID NO: 2100116 - RNA, 21 nt, Staphylococcus aureus subsp. aureus MW2
acuuaaaagagaauauaaaau

SEQ ID NO: 2100117 - RNA, 23 nt, Staphylococcus aureus subsp. aureus MW2
acuuaaauaucgacaaauuaaaa

SEQ ID NO: 2100118 - RNA, 21 nt, Staphylococcus aureus subsp. aureus MW2
acuuaaauaucgacaaauuaa

SEQ ID NO: 2100119 - RNA, 18 nt, Staphylococcus aureus subsp. aureus MW2
acuuaauuaauaauuuaa

SEQ ID NO: 2100120 - RNA, 15 nt, Staphylococcus aureus subsp. aureus MW2
acuuaaccauuuaaa

SEQ ID NO: 2100121 - RNA, 13 nt, Staphylococcus aureus subsp. aureus MW2
acuuaaccauuua

SEQ ID NO: 2100122 - RNA, 16 nt, Staphylococcus aureus subsp. aureus MW2
acuuaaccauuuaaaa

SEQ ID NO: 2100123 - RNA, 23 nt, Staphylococcus aureus subsp. aureus MW2
acuuacauuuuaauaaaaucauc

SEQ ID NO: 2100124 - RNA, 13 nt, Staphylococcus aureus subsp. aureus MW2
acuuacauuacau

SEQ ID NO: 2100125 - RNA, 13 nt, Staphylococcus aureus subsp. aureus MW2
acuuacaaauaua

SEQ ID NO: 2100126 - RNA, 13 nt, Staphylococcus aureus subsp. aureus MW2
acuuacaagucua

SEQ ID NO: 2100127 - RNA, 22 nt, Staphylococcus aureus subsp. aureus MW2
acuaacguaaaggcgauauuug

SEQ ID NO: 2100128 - RNA, 17 nt, Staphylococcus aureus subsp. aureus MW2
acuaaccuauuaaaaua

SEQ ID NO: 2100129 - RNA, 20 nt, Staphylococcus aureus subsp. aureus MW2
acuaacauguuauugcuuau

SEQ ID NO: 2100130 - RNA, 20 nt, Staphylococcus aureus subsp. aureus MW2
acuaagugaauuaucuauau

SEQ ID NO: 2100131 - RNA, 19 nt, Staphylococcus aureus subsp. aureus MW2
acuaaguaaccaagucuaa

SEQ ID NO: 2100132 - RNA, 17 nt, Staphylococcus aureus subsp. aureus MW2
acuaagaccaugagaaa

SEQ ID NO: 2100133 - RNA, 21 nt, Staphylococcus aureus subsp. aureus MW2
acuaagauaucuggauuaacu

SEQ ID NO: 2100134 - RNA, 19 nt, Staphylococcus aureus subsp. aureus MW2
acuaagauauuuaguacau

SEQ ID NO: 2100135 - RNA, 20 nt, Staphylococcus aureus subsp. aureus MW2
acuaagauauuuaguacaua

SEQ ID NO: 2100136 - RNA, 18 nt, Staphylococcus aureus subsp. aureus MW2
acuaauuuaaagcaucau

SEQ ID NO: 2100137 - RNA, 21 nt, Staphylococcus aureus subsp. aureus MW2
acuaauuuuguacauaaaaau

SEQ ID NO: 2100138 - RNA, 15 nt, Staphylococcus aureus subsp. aureus MW2
acuacaaauuuuaaa

SEQ ID NO: 2100139 - RNA, 22 nt, Staphylococcus aureus subsp. aureus MW2
acuacacuccccuuaucaaaac

SEQ ID NO: 2100140 - RNA, 21 nt, Staphylococcus aureus subsp. aureus MW2
acuacacacguagaaagaugu

SEQ ID NO: 2100141 - RNA, 13 nt, Staphylococcus aureus subsp. aureus MW2
acuaaucguguau

SEQ ID NO: 2100142 - RNA, 16 nt, Staphylococcus aureus subsp. aureus MW2
acuaaugauaguacau

SEQ ID NO: 2100143 - RNA, 14 nt, Staphylococcus aureus subsp. aureus MW2
acuaaucaauacua

SEQ ID NO: 2100144 - RNA, 11 nt, Staphylococcus aureus subsp. aureus MW2
acuaauuaaag

SEQ ID NO: 2100145 - RNA, 20 nt, Staphylococcus aureus subsp. aureus MW2
acuaauggcacuuaauauaa

SEQ ID NO: 2100146 - RNA, 16 nt, Staphylococcus aureus subsp. aureus MW2
acuaaucaaagaaaaa

SEQ ID NO: 2100147 - RNA, 13 nt, Staphylococcus aureus subsp. aureus MW2
acuaauauuuaaa

SEQ ID NO: 2100148 - RNA, 17 nt, Staphylococcus aureus subsp. aureus MW2
acuaauauuuaaaaaac

SEQ ID NO: 2100149 - RNA, 13 nt, Staphylococcus aureus subsp. aureus MW2
acuaaucauuuuu

SEQ ID NO: 2100150 - RNA, 18 nt, Staphylococcus aureus subsp. aureus MW2
acuaaucauuuuuucaau

SEQ ID NO: 2100151 - RNA, 13 nt, Staphylococcus aureus subsp. aureus MW2
acuaauauauuaa

SEQ ID NO: 2100152 - RNA, 17 nt, Staphylococcus aureus subsp. aureus MW2
acuaauaugauugguuu

SEQ ID NO: 2100153 - RNA, 11 nt, Staphylococcus aureus subsp. aureus MW2
acuaauaauug

SEQ ID NO: 2100154 - RNA, 17 nt, Staphylococcus aureus subsp. aureus MW2
acuaauaacucuucuaa

SEQ ID NO: 2100155 - RNA, 19 nt, Staphylococcus aureus subsp. aureus MW2
acuagaaaacauaaauaca

SEQ ID NO: 2100156 - RNA, 16 nt, Staphylococcus aureus subsp. aureus MW2
acuacauucuauguag

SEQ ID NO: 2100157 - RNA, 19 nt, Staphylococcus aureus subsp. aureus MW2
acuauaaccuauuaaaucu

SEQ ID NO: 2100158 - RNA, 14 nt, Staphylococcus aureus subsp. aureus MW2
acuauaauaauuaa

SEQ ID NO: 2100159 - RNA, 19 nt, Staphylococcus aureus subsp. aureus MW2
acuauaacaccaauuaaau

SEQ ID NO: 2100160 - RNA, 15 nt, Staphylococcus aureus subsp. aureus MW2
acuauaaauaaaaau

SEQ ID NO: 2100161 - RNA, 18 nt, Staphylococcus aureus subsp. aureus MW2
acuauaaauaaaaauaua

SEQ ID NO: 2100162 - RNA, 15 nt, Staphylococcus aureus subsp. aureus MW2
acuauaaaaaacagc

SEQ ID NO: 2100163 - RNA, 16 nt, Staphylococcus aureus subsp. aureus MW2
acuauaaaaaacagca

SEQ ID NO: 2100164 - RNA, 19 nt, Staphylococcus aureus subsp. aureus MW2
acuagauaguuuauacuuu

SEQ ID NO: 2100165 - RNA, 19 nt, Staphylococcus aureus subsp. aureus MW2
acuauauuucacacagcuu

SEQ ID NO: 2100166 - RNA, 16 nt, Staphylococcus aureus subsp. aureus MW2
acuauaauuucuuaau

SEQ ID NO: 2100167 - RNA, 20 nt, Staphylococcus aureus subsp. aureus MW2
acuauaauaauuaacugcgg

SEQ ID NO: 2100168 - RNA, 13 nt, Staphylococcus aureus subsp. aureus MW2
acuauacuuugag

SEQ ID NO: 2100169 - RNA, 14 nt, Staphylococcus aureus subsp. aureus MW2
acuauauuuauuag

SEQ ID NO: 2100170 - RNA, 21 nt, Staphylococcus aureus subsp. aureus MW2
acuauugauauucuaaaaaau

SEQ ID NO: 2100171 - RNA, 16 nt, Staphylococcus aureus subsp. aureus MW2
acgucuuguaucaaca

SEQ ID NO: 2100172 - RNA, 21 nt, Staphylococcus aureus subsp. aureus MW2
acgucuuuccauuuaucaaca

SEQ ID NO: 2100173 - RNA, 15 nt, Staphylococcus aureus subsp. aureus MW2
acgucuuuuuagauu

SEQ ID NO: 2100174 - RNA, 22 nt, Staphylococcus aureus subsp. aureus MW2
acgugacauuuucaaguuuaaa

SEQ ID NO: 2100175 - RNA, 17 nt, Staphylococcus aureus subsp. aureus MW2
acguucaaucguuucuu

SEQ ID NO: 2100176 - RNA, 22 nt, Staphylococcus aureus subsp. aureus MW2
acguucuugguauuuuuuaaau

SEQ ID NO: 2100177 - RNA, 23 nt, Staphylococcus aureus subsp. aureus MW2
acguucuugguauuuuuuaaaug

SEQ ID NO: 2100178 - RNA, 21 nt, Staphylococcus aureus subsp. aureus MW2
acguugaauguuccucuauau

SEQ ID NO: 2100179 - RNA, 19 nt, Staphylococcus aureus subsp. aureus MW2
acgugcugccuuuuugcuu

SEQ ID NO: 2100180 - RNA, 20 nt, Staphylococcus aureus subsp. aureus MW2
acguuuauccuuuaaaucau

SEQ ID NO: 2100181 - RNA, 17 nt, Staphylococcus aureus subsp. aureus MW2
acguuuagugaaaauac

SEQ ID NO: 2100182 - RNA, 17 nt, Staphylococcus aureus subsp. aureus MW2
acguuuuagacauaaaa

SEQ ID NO: 2100183 - RNA, 16 nt, Staphylococcus aureus subsp. aureus MW2
acguuugcauauccuu

SEQ ID NO: 2100184 - RNA, 20 nt, Staphylococcus aureus subsp. aureus MW2
acguuuuaaauaaaugacuu

SEQ ID NO: 2100185 - RNA, 19 nt, Staphylococcus aureus subsp. aureus MW2
acguuuuaaauaaaugacu

SEQ ID NO: 2100186 - RNA, 14 nt, Staphylococcus aureus subsp. aureus MW2
acguuugaaaaauu

SEQ ID NO: 2100187 - RNA, 15 nt, Staphylococcus aureus subsp. aureus MW2
acguugauguaauuc

SEQ ID NO: 2100188 - RNA, 21 nt, Staphylococcus aureus subsp. aureus MW2
acguuguaauaguaaguacga

SEQ ID NO: 2100189 - RNA, 16 nt, Staphylococcus aureus subsp. aureus MW2
acuaaaugaauugcuu

SEQ ID NO: 2100190 - RNA, 15 nt, Staphylococcus aureus subsp. aureus MW2
acuaaaguugcaaac

SEQ ID NO: 2100191 - RNA, 17 nt, Staphylococcus aureus subsp. aureus MW2
acuaaaucaccauuuuu

SEQ ID NO: 2100192 - RNA, 13 nt, Staphylococcus aureus subsp. aureus MW2
acuaaacgauaaa

SEQ ID NO: 2100193 - RNA, 15 nt, Staphylococcus aureus subsp. aureus MW2
acuaaaccaaugauu

SEQ ID NO: 2100194 - RNA, 16 nt, Staphylococcus aureus subsp. aureus MW2
acuaaaaauauauuuc

SEQ ID NO: 2100195 - RNA, 11 nt, Staphylococcus aureus subsp. aureus MW2
acuaaaaauau

SEQ ID NO: 2100196 - RNA, 21 nt, Staphylococcus aureus subsp. aureus MW2
acuaaaacaauaauaauaaga

SEQ ID NO: 2100197 - RNA, 21 nt, Staphylococcus aureus subsp. aureus MW2
acuaaaaguggccuuuuaaac

SEQ ID NO: 2100198 - RNA, 19 nt, Staphylococcus aureus subsp. aureus MW2
acuaaaauuuguaauuuaa

SEQ ID NO: 2100199 - RNA, 20 nt, Staphylococcus aureus subsp. aureus MW2
acguuuugguuguucuuuuu

SEQ ID NO: 2100200 - RNA, 15 nt, Staphylococcus aureus subsp. aureus MW2
acguuuuugaaucag

SEQ ID NO: 2100201 - RNA, 13 nt, Staphylococcus aureus subsp. aureus MW2
acgcucuucuucu

SEQ ID NO: 2100202 - RNA, 14 nt, Staphylococcus aureus subsp. aureus MW2
acgcuguuuuuaaa

SEQ ID NO: 2100203 - RNA, 16 nt, Staphylococcus aureus subsp. aureus MW2
acgcuuuguuuuuagu

SEQ ID NO: 2100204 - RNA, 14 nt, Staphylococcus aureus subsp. aureus MW2
acguaaaauaugau

SEQ ID NO: 2100205 - RNA, 16 nt, Staphylococcus aureus subsp. aureus MW2
acguaaugaaucaauu

SEQ ID NO: 2100206 - RNA, 19 nt, Staphylococcus aureus subsp. aureus MW2
acguaauccuuggaaacga

SEQ ID NO: 2100207 - RNA, 14 nt, Staphylococcus aureus subsp. aureus MW2
acguaaguuugcua

SEQ ID NO: 2100208 - RNA, 19 nt, Staphylococcus aureus subsp. aureus MW2
acguaaguguaaaugaaag

SEQ ID NO: 2100209 - RNA, 18 nt, Staphylococcus aureus subsp. aureus MW2
acguaacuguuuuaaauu

SEQ ID NO: 2100210 - RNA, 15 nt, Staphylococcus aureus subsp. aureus MW2
acguacguugaugug

SEQ ID NO: 2100211 - RNA, 16 nt, Staphylococcus aureus subsp. aureus MW2
acggcugcuuuaacug

SEQ ID NO: 2100212 - RNA, 20 nt, Staphylococcus aureus subsp. aureus MW2
accucggauaccaaaacuca

SEQ ID NO: 2100213 - RNA, 13 nt, Staphylococcus aureus subsp. aureus MW2
accugacuuuccg

SEQ ID NO: 2100214 - RNA, 16 nt, Staphylococcus aureus subsp. aureus MW2
accuauaagucucuuu

SEQ ID NO: 2100215 - RNA, 21 nt, Staphylococcus aureus subsp. aureus MW2
accuaucccuguaaaaccaua

SEQ ID NO: 2100216 - RNA, 14 nt, Staphylococcus aureus subsp. aureus MW2
acgaaauaguucaa

SEQ ID NO: 2100217 - RNA, 12 nt, Staphylococcus aureus subsp. aureus MW2
acgaaaagucag

SEQ ID NO: 2100218 - RNA, 21 nt, Staphylococcus aureus subsp. aureus MW2
accuuuuuuaguuaaagugau

SEQ ID NO: 2100219 - RNA, 20 nt, Staphylococcus aureus subsp. aureus MW2
acgaaaaagaugguuuuguu

SEQ ID NO: 2100220 - RNA, 12 nt, Staphylococcus aureus subsp. aureus MW2
accuuuuuuaac

SEQ ID NO: 2100221 - RNA, 15 nt, Staphylococcus aureus subsp. aureus MW2
accuuucauaggucu

SEQ ID NO: 2100222 - RNA, 17 nt, Staphylococcus aureus subsp. aureus MW2
accuuuuuauugauauu

SEQ ID NO: 2100223 - RNA, 20 nt, Staphylococcus aureus subsp. aureus MW2
accuuuuuauugauauuaau

SEQ ID NO: 2100224 - RNA, 23 nt, Staphylococcus aureus subsp. aureus MW2
accuuuagacaauauuuuuacau

SEQ ID NO: 2100225 - RNA, 20 nt, Staphylococcus aureus subsp. aureus MW2
acgaaauugugaacuaaauu

SEQ ID NO: 2100226 - RNA, 23 nt, Staphylococcus aureus subsp. aureus MW2
accuuuaugugcaucauuuauau

SEQ ID NO: 2100227 - RNA, 14 nt, Staphylococcus aureus subsp. aureus MW2
accuuuauuuuuau

SEQ ID NO: 2100228 - RNA, 12 nt, Staphylococcus aureus subsp. aureus MW2
accuuucaaaua

SEQ ID NO: 2100229 - RNA, 17 nt, Staphylococcus aureus subsp. aureus MW2
accuuuaucuguaucaa

SEQ ID NO: 2100230 - RNA, 17 nt, Staphylococcus aureus subsp. aureus MW2
accuuuagacaauauuu

SEQ ID NO: 2100231 - RNA, 16 nt, Staphylococcus aureus subsp. aureus MW2
accuuuaaaacaucau

SEQ ID NO: 2100232 - RNA, 19 nt, Staphylococcus aureus subsp. aureus MW2
accuuuaaaacaucauuca

SEQ ID NO: 2100233 - RNA, 14 nt, Staphylococcus aureus subsp. aureus MW2
accuuuaaaacauc

SEQ ID NO: 2100234 - RNA, 15 nt, Staphylococcus aureus subsp. aureus MW2
accuuuaaaacauca

SEQ ID NO: 2100235 - RNA, 20 nt, Staphylococcus aureus subsp. aureus MW2
accuugauuuaauuuuuaau

SEQ ID NO: 2100236 - RNA, 23 nt, Staphylococcus aureus subsp. aureus MW2
accuuauauuuuauuuaaaaaua

SEQ ID NO: 2100237 - RNA, 12 nt, Staphylococcus aureus subsp. aureus MW2
accuuauauuuu

SEQ ID NO: 2100238 - RNA, 13 nt, Staphylococcus aureus subsp. aureus MW2
accuuauauuuua

SEQ ID NO: 2100239 - RNA, 16 nt, Staphylococcus aureus subsp. aureus MW2
accuuaucaugacaca

SEQ ID NO: 2100240 - RNA, 20 nt, Staphylococcus aureus subsp. aureus MW2
accuuacccaaaaaauugua

SEQ ID NO: 2100241 - RNA, 17 nt, Staphylococcus aureus subsp. aureus MW2
accuuacuacucauuau

SEQ ID NO: 2100242 - RNA, 22 nt, Staphylococcus aureus subsp. aureus MW2
accuuaauaggauaugcuaaac

SEQ ID NO: 2100243 - RNA, 19 nt, Staphylococcus aureus subsp. aureus MW2
accuuaauaggauaugcua

SEQ ID NO: 2100244 - RNA, 14 nt, Staphylococcus aureus subsp. aureus MW2
accugauaauacaa

SEQ ID NO: 2100245 - RNA, 12 nt, Staphylococcus aureus subsp. aureus MW2
accuguuaaugu

SEQ ID NO: 2100246 - RNA, 18 nt, Staphylococcus aureus subsp. aureus MW2
accuggucguacuuucaa

SEQ ID NO: 2100247 - RNA, 18 nt, Staphylococcus aureus subsp. aureus MW2
accuguuuuuauuuguuu

SEQ ID NO: 2100248 - RNA, 23 nt, Staphylococcus aureus subsp. aureus MW2
accuguuuuaauugggucuuuau

SEQ ID NO: 2100249 - RNA, 15 nt, Staphylococcus aureus subsp. aureus MW2
acgauuuugucuuuu

SEQ ID NO: 2100250 - RNA, 16 nt, Staphylococcus aureus subsp. aureus MW2
acgauuuuuaaaaugc

SEQ ID NO: 2100251 - RNA, 17 nt, Staphylococcus aureus subsp. aureus MW2
acgauuuguucaaugau

SEQ ID NO: 2100252 - RNA, 16 nt, Staphylococcus aureus subsp. aureus MW2
acgauugaacaucucu

SEQ ID NO: 2100253 - RNA, 16 nt, Staphylococcus aureus subsp. aureus MW2
acgauugauuaucaua

SEQ ID NO: 2100254 - RNA, 18 nt, Staphylococcus aureus subsp. aureus MW2
acgauugaguugaaaaua

SEQ ID NO: 2100255 - RNA, 16 nt, Staphylococcus aureus subsp. aureus MW2
acgauugggcaacuuu

SEQ ID NO: 2100256 - RNA, 17 nt, Staphylococcus aureus subsp. aureus MW2
acgauugggcaacuuuu

SEQ ID NO: 2100257 - RNA, 15 nt, Staphylococcus aureus subsp. aureus MW2
acgauugaacaucuc

SEQ ID NO: 2100258 - RNA, 13 nt, Staphylococcus aureus subsp. aureus MW2
acgaugguugcuu

SEQ ID NO: 2100259 - RNA, 19 nt, Staphylococcus aureus subsp. aureus MW2
acgacuuucuaaagcaauu

SEQ ID NO: 2100260 - RNA, 19 nt, Staphylococcus aureus subsp. aureus MW2
acgaagugcaacaaaagug

SEQ ID NO: 2100261 - RNA, 19 nt, Staphylococcus aureus subsp. aureus MW2
acgaagcgggacucaucga

SEQ ID NO: 2100262 - RNA, 23 nt, Staphylococcus aureus subsp. aureus MW2
acgauaauaacuagaacaagaau

SEQ ID NO: 2100263 - RNA, 16 nt, Staphylococcus aureus subsp. aureus MW2
acgauaagaauuaaca

SEQ ID NO: 2100264 - RNA, 18 nt, Staphylococcus aureus subsp. aureus MW2
acgauaagaauuaacaac

SEQ ID NO: 2100265 - RNA, 14 nt, Staphylococcus aureus subsp. aureus MW2
acgauaagaauuaa

SEQ ID NO: 2100266 - RNA, 14 nt, Staphylococcus aureus subsp. aureus MW2
acgauagauuuauc

SEQ ID NO: 2100267 - RNA, 22 nt, Staphylococcus aureus subsp. aureus MW2
acgauagauuuuuucauagcuu

SEQ ID NO: 2100268 - RNA, 19 nt, Staphylococcus aureus subsp. aureus MW2
acgcacguauauacgauug

SEQ ID NO: 2100269 - RNA, 19 nt, Staphylococcus aureus subsp. aureus MW2
acgcaccuggcacaaaugc

SEQ ID NO: 2100270 - RNA, 20 nt, Staphylococcus aureus subsp. aureus MW2
acgcaaauuaaauauacuuu

SEQ ID NO: 2100271 - RNA, 15 nt, Staphylococcus aureus subsp. aureus MW2
acgcaguugaaaaag

SEQ ID NO: 2100272 - RNA, 14 nt, Staphylococcus aureus subsp. aureus MW2
acgcaguugaaaaa

SEQ ID NO: 2100273 - RNA, 21 nt, Staphylococcus aureus subsp. aureus MW2
acgccaaauacuaguaauaau

SEQ ID NO: 2100274 - RNA, 22 nt, Staphylococcus aureus subsp. aureus MW2
acgccaguggcauuuaaaaauc

SEQ ID NO: 2100275 - RNA, 19 nt, Staphylococcus aureus subsp. aureus MW2
accgccaacuaauguuaaa

SEQ ID NO: 2100276 - RNA, 19 nt, Staphylococcus aureus subsp. aureus MW2
accgcauaagauugcuuuu

SEQ ID NO: 2100277 - RNA, 21 nt, Staphylococcus aureus subsp. aureus MW2
acccguuuuaccgacaacacg

SEQ ID NO: 2100278 - RNA, 14 nt, Staphylococcus aureus subsp. aureus MW2
accauacucuaacu

SEQ ID NO: 2100279 - RNA, 20 nt, Staphylococcus aureus subsp. aureus MW2
accauacuaaaacaugauac

SEQ ID NO: 2100280 - RNA, 19 nt, Staphylococcus aureus subsp. aureus MW2
accaucaacgccauauuua

SEQ ID NO: 2100281 - RNA, 17 nt, Staphylococcus aureus subsp. aureus MW2
accaugagaaaccgcuu

SEQ ID NO: 2100282 - RNA, 14 nt, Staphylococcus aureus subsp. aureus MW2
accaucauaaaugu

SEQ ID NO: 2100283 - RNA, 16 nt, Staphylococcus aureus subsp. aureus MW2
accaucaguauuugua

SEQ ID NO: 2100284 - RNA, 21 nt, Staphylococcus aureus subsp. aureus MW2
accauugcacaguuucaucuu

SEQ ID NO: 2100285 - RNA, 19 nt, Staphylococcus aureus subsp. aureus MW2
accauugcacaguuucauc

SEQ ID NO: 2100286 - RNA, 20 nt, Staphylococcus aureus subsp. aureus MW2
accauucuaccaguugauuu

SEQ ID NO: 2100287 - RNA, 17 nt, Staphylococcus aureus subsp. aureus MW2
accauuuaacucaccuu

SEQ ID NO: 2100288 - RNA, 20 nt, Staphylococcus aureus subsp. aureus MW2
accauuaucaagaacuuuaa

SEQ ID NO: 2100289 - RNA, 14 nt, Staphylococcus aureus subsp. aureus MW2
accauuaugauuaa

SEQ ID NO: 2100290 - RNA, 20 nt, Staphylococcus aureus subsp. aureus MW2
accauuauaauuauuuuuau

SEQ ID NO: 2100291 - RNA, 13 nt, Staphylococcus aureus subsp. aureus MW2
acccaaaaaauug

SEQ ID NO: 2100292 - RNA, 16 nt, Staphylococcus aureus subsp. aureus MW2
accauuuuauauuuua

SEQ ID NO: 2100293 - RNA, 16 nt, Staphylococcus aureus subsp. aureus MW2
accauuucuuuuuuca

SEQ ID NO: 2100294 - RNA, 20 nt, Staphylococcus aureus subsp. aureus MW2
acccaaguccggcugaaggg

SEQ ID NO: 2100295 - RNA, 14 nt, Staphylococcus aureus subsp. aureus MW2
accccauuuuaaag

SEQ ID NO: 2100296 - RNA, 15 nt, Staphylococcus aureus subsp. aureus MW2
accccauuuuaaagu

SEQ ID NO: 2100297 - RNA, 18 nt, Staphylococcus aureus subsp. aureus MW2
acccacaucuuuuuaaaa

SEQ ID NO: 2100298 - RNA, 13 nt, Staphylococcus aureus subsp. aureus MW2
accccuucucuaa

SEQ ID NO: 2100299 - RNA, 14 nt, Staphylococcus aureus subsp. aureus MW2
accccuucaaaauu

SEQ ID NO: 2100300 - RNA, 14 nt, Staphylococcus aureus subsp. aureus MW2
agaaaguaaaaguu

SEQ ID NO: 2100301 - RNA, 22 nt, Staphylococcus aureus subsp. aureus MW2
agaaaggcuagcuaaaauuugc
